United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 4

SEQ ID NO: 117964 - DNA, 16 bp, Homo sapiens
cagcagcacccaccca

SEQ ID NO: 117965 - DNA, 18 bp, Homo sapiens
cagcagcacccacccatg

SEQ ID NO: 117966 - DNA, 15 bp, Homo sapiens
cagcagcgcagccga

SEQ ID NO: 117967 - DNA, 19 bp, Homo sapiens
cagcagcgcagccgagccc

SEQ ID NO: 117968 - DNA, 22 bp, Homo sapiens
cagcagcgggggcggcccagcc

SEQ ID NO: 117969 - DNA, 16 bp, Homo sapiens
cagcagctcagcctcc

SEQ ID NO: 117970 - DNA, 20 bp, Homo sapiens
cagccatcatgtgcctggaa

SEQ ID NO: 117971 - DNA, 20 bp, Homo sapiens
cagcccctggcactgcaggt

SEQ ID NO: 117972 - DNA, 13 bp, Homo sapiens
cagccctcgggcc

SEQ ID NO: 117973 - DNA, 16 bp, Homo sapiens
cagccgagccccagga

SEQ ID NO: 117974 - DNA, 17 bp, Homo sapiens
cagccgagccccaggag

SEQ ID NO: 117975 - DNA, 22 bp, Homo sapiens
cagccgggtacctcagtttctc

SEQ ID NO: 117976 - DNA, 14 bp, Homo sapiens
cagcctacactgcc

SEQ ID NO: 117977 - DNA, 17 bp, Homo sapiens
cagcctacactgccagc

SEQ ID NO: 117978 - DNA, 12 bp, Homo sapiens
cagcctcccccc

SEQ ID NO: 117979 - DNA, 20 bp, Homo sapiens
cagcctccccccgctgggga

SEQ ID NO: 117980 - DNA, 14 bp, Homo sapiens
cagcctctgagtcc

SEQ ID NO: 117981 - DNA, 16 bp, Homo sapiens
cagcgcagccgagccc

SEQ ID NO: 117982 - DNA, 21 bp, Homo sapiens
cagcgcagccgagccccagga

SEQ ID NO: 117983 - DNA, 21 bp, Homo sapiens
cagcgggggcggcccagcctc

SEQ ID NO: 117984 - DNA, 15 bp, Homo sapiens
cagctcactccctgg

SEQ ID NO: 117985 - DNA, 16 bp, Homo sapiens
cagctcagcctccccc

SEQ ID NO: 117986 - DNA, 19 bp, Homo sapiens
cagctggtggtatctgagt

SEQ ID NO: 117987 - DNA, 17 bp, Homo sapiens
caggccacagcccctgg

SEQ ID NO: 117988 - DNA, 21 bp, Homo sapiens
caggccacagcccctggcact

SEQ ID NO: 117989 - DNA, 14 bp, Homo sapiens
cagtccccccagta

SEQ ID NO: 117990 - DNA, 11 bp, Homo sapiens
cagtcctggaa

SEQ ID NO: 117991 - DNA, 19 bp, Homo sapiens
cagtctctcaaagacccca

SEQ ID NO: 117992 - DNA, 16 bp, Homo sapiens
cagtgactgggccctg

SEQ ID NO: 117993 - DNA, 21 bp, Homo sapiens
cagtgactgggccctgtccag

SEQ ID NO: 117994 - DNA, 13 bp, Homo sapiens
cagtgctcggcag

SEQ ID NO: 117995 - DNA, 16 bp, Homo sapiens
cagtgctcggcagtca

SEQ ID NO: 117996 - DNA, 19 bp, Homo sapiens
cagtgctggccacacagca

SEQ ID NO: 117997 - DNA, 16 bp, Homo sapiens
cagtggtaccagctca

SEQ ID NO: 117998 - DNA, 23 bp, Homo sapiens
cagtggtaccagctcactccctg

SEQ ID NO: 117999 - DNA, 20 bp, Homo sapiens
cagtttctcctttattgctc

SEQ ID NO: 118000 - DNA, 14 bp, Homo sapiens
catctctctttaat

SEQ ID NO: 118001 - DNA, 15 bp, Homo sapiens
catctgctcctccca

SEQ ID NO: 118002 - DNA, 22 bp, Homo sapiens
catgaaaatgcaacaacatgta

SEQ ID NO: 118003 - DNA, 20 bp, Homo sapiens
catgaaggagacagcagcac

SEQ ID NO: 118004 - DNA, 12 bp, Homo sapiens
catgcctggccc

SEQ ID NO: 118005 - DNA, 13 bp, Homo sapiens
catgttcccagct

SEQ ID NO: 118006 - DNA, 15 bp, Homo sapiens
catgttcccagctca

SEQ ID NO: 118007 - DNA, 23 bp, Homo sapiens
cattatgatgtgggtcaaggaat

SEQ ID NO: 118008 - DNA, 20 bp, Homo sapiens
catttgctaactagcttgga

SEQ ID NO: 118009 - DNA, 13 bp, Homo sapiens
ccaaacccagccc

SEQ ID NO: 118010 - DNA, 17 bp, Homo sapiens
ccaaagatcccacggga

SEQ ID NO: 118011 - DNA, 22 bp, Homo sapiens
ccaagagctgaggcaattctaa

SEQ ID NO: 118012 - DNA, 21 bp, Homo sapiens
ccaagctcggatcacatgaag

SEQ ID NO: 118013 - DNA, 20 bp, Homo sapiens
ccaataaatcaactccagct

SEQ ID NO: 118014 - DNA, 21 bp, Homo sapiens
ccacagtgactgggccctgtc

SEQ ID NO: 118015 - DNA, 12 bp, Homo sapiens
ccacccccagtc

SEQ ID NO: 118016 - DNA, 13 bp, Homo sapiens
ccacccccagtcc

SEQ ID NO: 118017 - DNA, 16 bp, Homo sapiens
ccaccggggcacacgg

SEQ ID NO: 118018 - DNA, 17 bp, Homo sapiens
ccaccgtgtgcctttcc

SEQ ID NO: 118019 - DNA, 17 bp, Homo sapiens
ccagcctacactgccag

SEQ ID NO: 118020 - DNA, 19 bp, Homo sapiens
ccagcctctgagtcccgtg

SEQ ID NO: 118021 - DNA, 24 bp, Homo sapiens
ccaggagcccgtcaggccacagcc

SEQ ID NO: 118022 - DNA, 14 bp, Homo sapiens
ccaggtagaacaca

SEQ ID NO: 118023 - DNA, 14 bp, Homo sapiens
ccagtgctggccac

SEQ ID NO: 118024 - DNA, 15 bp, Homo sapiens
ccagtggtaccagct

SEQ ID NO: 118025 - DNA, 20 bp, Homo sapiens
ccataaaagccgcccagtgg

SEQ ID NO: 118026 - DNA, 17 bp, Homo sapiens
ccatcatgtgcctggaa

SEQ ID NO: 118027 - DNA, 19 bp, Homo sapiens
ccatcatgtgcctggaaat

SEQ ID NO: 118028 - DNA, 20 bp, Homo sapiens
ccatcatgtgcctggaaatt

SEQ ID NO: 118029 - DNA, 23 bp, Homo sapiens
ccatgcacgcaccccgcccctgc

SEQ ID NO: 118030 - DNA, 19 bp, Homo sapiens
ccatggtccatcccctgag

SEQ ID NO: 118031 - DNA, 17 bp, Homo sapiens
ccatgttcccagctcag

SEQ ID NO: 118032 - DNA, 17 bp, Homo sapiens
cccacagtcacacagag

SEQ ID NO: 118033 - DNA, 15 bp, Homo sapiens
cccaccggtgccaaa

SEQ ID NO: 118034 - DNA, 22 bp, Homo sapiens
cccaccggtgccaaacccagcc

SEQ ID NO: 118035 - DNA, 20 bp, Homo sapiens
cccacttctctactctggaa

SEQ ID NO: 118036 - DNA, 15 bp, Homo sapiens
cccagcccctgcggc

SEQ ID NO: 118037 - DNA, 20 bp, Homo sapiens
cccaggagcccgtcaggcca

SEQ ID NO: 118038 - DNA, 21 bp, Homo sapiens
cccaggagcccgtcaggccac

SEQ ID NO: 118039 - DNA, 14 bp, Homo sapiens
cccagtgctggcca

SEQ ID NO: 118040 - DNA, 16 bp, Homo sapiens
cccatgattccctcct

SEQ ID NO: 118041 - DNA, 14 bp, Homo sapiens
cccatggtccatcc

SEQ ID NO: 118042 - DNA, 23 bp, Homo sapiens
ccccacttctctactctggaagt

SEQ ID NO: 118043 - DNA, 14 bp, Homo sapiens
ccccatgattccct

SEQ ID NO: 118044 - DNA, 14 bp, Homo sapiens
cccccacaagagcc

SEQ ID NO: 118045 - DNA, 24 bp, Homo sapiens
ccccgccagcctacactgccagcc

SEQ ID NO: 118046 - DNA, 17 bp, Homo sapiens
ccccgcccctgcatgcc

SEQ ID NO: 118047 - DNA, 18 bp, Homo sapiens
ccccggcccctgccccgc

SEQ ID NO: 118048 - DNA, 15 bp, Homo sapiens
cccctcaccacctct

SEQ ID NO: 118049 - DNA, 11 bp, Homo sapiens
cccctcagtgc

SEQ ID NO: 118050 - DNA, 12 bp, Homo sapiens
cccctcagtgct

SEQ ID NO: 118051 - DNA, 15 bp, Homo sapiens
cccctcccccctgta

SEQ ID NO: 118052 - DNA, 16 bp, Homo sapiens
cccctgcatgcctggc

SEQ ID NO: 118053 - DNA, 22 bp, Homo sapiens
cccctgcatgcctggcccctcc

SEQ ID NO: 118054 - DNA, 22 bp, Homo sapiens
cccctgcggccgtcaccccgcc

SEQ ID NO: 118055 - DNA, 14 bp, Homo sapiens
cccctggcactgca

SEQ ID NO: 118056 - DNA, 13 bp, Homo sapiens
cccgcccccaagc

SEQ ID NO: 118057 - DNA, 20 bp, Homo sapiens
cccgccccctcggcccctca

SEQ ID NO: 118058 - DNA, 18 bp, Homo sapiens
cccgcccctgcatgcctg

SEQ ID NO: 118059 - DNA, 23 bp, Homo sapiens
cccgcccctgcatgcctggcccc

SEQ ID NO: 118060 - DNA, 13 bp, Homo sapiens
cccggctcccacc

SEQ ID NO: 118061 - DNA, 11 bp, Homo sapiens
cccgggccctc

SEQ ID NO: 118062 - DNA, 18 bp, Homo sapiens
cccgtcaggccacagccc

SEQ ID NO: 118063 - DNA, 23 bp, Homo sapiens
cccgtggggccccggctcccacc

SEQ ID NO: 118064 - DNA, 22 bp, Homo sapiens
cccgttccgtgggatgccataa

SEQ ID NO: 118065 - DNA, 18 bp, Homo sapiens
ccctcccactccctgggg

SEQ ID NO: 118066 - DNA, 14 bp, Homo sapiens
ccctcccctccccc

SEQ ID NO: 118067 - DNA, 12 bp, Homo sapiens
ccctcgccctgt

SEQ ID NO: 118068 - DNA, 17 bp, Homo sapiens
ccctcggcccctcacca

SEQ ID NO: 118069 - DNA, 21 bp, Homo sapiens
ccctgagggtggtcagccaag

SEQ ID NO: 118070 - DNA, 12 bp, Homo sapiens
ccctgcatgcct

SEQ ID NO: 118071 - DNA, 22 bp, Homo sapiens
ccctgcatgcctggcccctcct

SEQ ID NO: 118072 - DNA, 20 bp, Homo sapiens
ccctgcgtaaccctcgccct

SEQ ID NO: 118073 - DNA, 22 bp, Homo sapiens
ccctgcgtaaccctcgccctgt

SEQ ID NO: 118074 - DNA, 13 bp, Homo sapiens
ccctggcactgca

SEQ ID NO: 118075 - DNA, 13 bp, Homo sapiens
ccctgggaaaggg

SEQ ID NO: 118076 - DNA, 20 bp, Homo sapiens
ccctgtccctcccactccct

SEQ ID NO: 118077 - DNA, 20 bp, Homo sapiens
cccttccagtggtaccagct

SEQ ID NO: 118078 - DNA, 18 bp, Homo sapiens
cccttcccgccctcggga

SEQ ID NO: 118079 - DNA, 17 bp, Homo sapiens
cccttcctgaccctccg

SEQ ID NO: 118080 - DNA, 13 bp, Homo sapiens
ccctttccagcca

SEQ ID NO: 118081 - DNA, 16 bp, Homo sapiens
ccgagccccaggagcc

SEQ ID NO: 118082 - DNA, 20 bp, Homo sapiens
ccgagccccaggagcccgtc

SEQ ID NO: 118083 - DNA, 12 bp, Homo sapiens
ccgatgccagcc

SEQ ID NO: 118084 - DNA, 21 bp, Homo sapiens
ccgccagcctacactgccagc

SEQ ID NO: 118085 - DNA, 15 bp, Homo sapiens
ccgcccccaagctcg

SEQ ID NO: 118086 - DNA, 21 bp, Homo sapiens
ccggctcccaccggtgccaaa

SEQ ID NO: 118087 - DNA, 14 bp, Homo sapiens
ccgggcaccacccc

SEQ ID NO: 118088 - DNA, 22 bp, Homo sapiens
ccggggcacacgggcctctgct

SEQ ID NO: 118089 - DNA, 19 bp, Homo sapiens
ccggtgccaaacccagccc

SEQ ID NO: 118090 - DNA, 14 bp, Homo sapiens
ccgtcaccccgcca

SEQ ID NO: 118091 - DNA, 18 bp, Homo sapiens
ccgtcaccccgccagcct

SEQ ID NO: 118092 - DNA, 16 bp, Homo sapiens
ccgtcaggccacagcc

SEQ ID NO: 118093 - DNA, 21 bp, Homo sapiens
ccgtcaggccacagcccctgg

SEQ ID NO: 118094 - DNA, 14 bp, Homo sapiens
ccgtgaagggcacc

SEQ ID NO: 118095 - DNA, 12 bp, Homo sapiens
ccgtgccagcag

SEQ ID NO: 118096 - DNA, 22 bp, Homo sapiens
ccgtggggccccggctcccacc

SEQ ID NO: 118097 - DNA, 19 bp, Homo sapiens
cctaatttattggattccc

SEQ ID NO: 118098 - DNA, 16 bp, Homo sapiens
cctagaaaacccttcc

SEQ ID NO: 118099 - DNA, 23 bp, Homo sapiens
cctcaccacctctttctacagcc

SEQ ID NO: 118100 - DNA, 16 bp, Homo sapiens
cctcagtgctcggcag

SEQ ID NO: 118101 - DNA, 22 bp, Homo sapiens
cctcagtgctcggcagtcatac

SEQ ID NO: 118102 - DNA, 13 bp, Homo sapiens
cctcccactccct

SEQ ID NO: 118103 - DNA, 21 bp, Homo sapiens
cctcctagaaaacccttcccg

SEQ ID NO: 118104 - DNA, 18 bp, Homo sapiens
cctcgccctgtccctccc

SEQ ID NO: 118105 - DNA, 23 bp, Homo sapiens
cctcgccctgtccctcccactcc

SEQ ID NO: 118106 - DNA, 15 bp, Homo sapiens
cctcggcccctcacc

SEQ ID NO: 118107 - DNA, 20 bp, Homo sapiens
cctcggcccctcaccacctc

SEQ ID NO: 118108 - DNA, 23 bp, Homo sapiens
cctcgggccgggcaccaccccca

SEQ ID NO: 118109 - DNA, 16 bp, Homo sapiens
cctctgcttgccagcc

SEQ ID NO: 118110 - DNA, 16 bp, Homo sapiens
cctgagggtggtcagc

SEQ ID NO: 118111 - DNA, 15 bp, Homo sapiens
cctgcatcctctccc

SEQ ID NO: 118112 - DNA, 13 bp, Homo sapiens
cctgcatgcctgg

SEQ ID NO: 118113 - DNA, 21 bp, Homo sapiens
cctgcatgcctggcccctcct

SEQ ID NO: 118114 - DNA, 13 bp, Homo sapiens
cctgccccgcccc

SEQ ID NO: 118115 - DNA, 20 bp, Homo sapiens
cctgcggccgtcaccccgcc

SEQ ID NO: 118116 - DNA, 23 bp, Homo sapiens
cctgcgtaaccctcgccctgtcc

SEQ ID NO: 118117 - DNA, 14 bp, Homo sapiens
cctggcccctcctc

SEQ ID NO: 118118 - DNA, 19 bp, Homo sapiens
cctgggaaaggggttgtca

SEQ ID NO: 118119 - DNA, 15 bp, Homo sapiens
cctgtaatcccagct

SEQ ID NO: 118120 - DNA, 20 bp, Homo sapiens
cctgtacgaacccctcccct

SEQ ID NO: 118121 - DNA, 22 bp, Homo sapiens
cctgtccctcccactccctggg

SEQ ID NO: 118122 - DNA, 21 bp, Homo sapiens
ccttccagtggtaccagctca

SEQ ID NO: 118123 - DNA, 13 bp, Homo sapiens
ccttcccgccctc

SEQ ID NO: 118124 - DNA, 18 bp, Homo sapiens
ccttcctcagtcctggaa

SEQ ID NO: 118125 - DNA, 17 bp, Homo sapiens
cctttattgctcctgta

SEQ ID NO: 118126 - DNA, 16 bp, Homo sapiens
cctttcccgggccctc

SEQ ID NO: 118127 - DNA, 20 bp, Homo sapiens
cgaacccctcccctcccccc

SEQ ID NO: 118128 - DNA, 13 bp, Homo sapiens
cgacccctcagtg

SEQ ID NO: 118129 - DNA, 19 bp, Homo sapiens
cgagagagaccccaccgcc

SEQ ID NO: 118130 - DNA, 17 bp, Homo sapiens
cgagatcgctggcagag

SEQ ID NO: 118131 - DNA, 19 bp, Homo sapiens
cgagatcgctggcagagaa

SEQ ID NO: 118132 - DNA, 13 bp, Homo sapiens
cgagccccaggag

SEQ ID NO: 118133 - DNA, 9 bp, Homo sapiens
cgcacagca

SEQ ID NO: 118134 - DNA, 17 bp, Homo sapiens
cgcaccccgcccctgca

SEQ ID NO: 118135 - DNA, 19 bp, Homo sapiens
cgcaccccgcccctgcatg

SEQ ID NO: 118136 - DNA, 16 bp, Homo sapiens
cgcagccgagccccag

SEQ ID NO: 118137 - DNA, 19 bp, Homo sapiens
cgccaccgtgtgcctttcc

SEQ ID NO: 118138 - DNA, 21 bp, Homo sapiens
cgcccctgcatgcctggcccc

SEQ ID NO: 118139 - DNA, 19 bp, Homo sapiens
cggatgtcccatctgctcc

SEQ ID NO: 118140 - DNA, 13 bp, Homo sapiens
cggcccagcctct

SEQ ID NO: 118141 - DNA, 15 bp, Homo sapiens
cggcccagcctctga

SEQ ID NO: 118142 - DNA, 18 bp, Homo sapiens
cggccgtcaccccgccag

SEQ ID NO: 118143 - DNA, 11 bp, Homo sapiens
cggctcccacc

SEQ ID NO: 118144 - DNA, 15 bp, Homo sapiens
cgggagcctctcctt

SEQ ID NO: 118145 - DNA, 24 bp, Homo sapiens
cgggagcctctccttgcctggtga

SEQ ID NO: 118146 - DNA, 19 bp, Homo sapiens
cgggcaccacccccagtcc

SEQ ID NO: 118147 - DNA, 18 bp, Homo sapiens
cgggcctctgcttgccag

SEQ ID NO: 118148 - DNA, 20 bp, Homo sapiens
cgggcctctgcttgccagcc

SEQ ID NO: 118149 - DNA, 21 bp, Homo sapiens
cgggcctctgcttgccagcca

SEQ ID NO: 118150 - DNA, 21 bp, Homo sapiens
cggggcgacccctcagtgctc

SEQ ID NO: 118151 - DNA, 13 bp, Homo sapiens
cgggggcggccca

SEQ ID NO: 118152 - DNA, 18 bp, Homo sapiens
cgggtacctcagtttctc

SEQ ID NO: 118153 - DNA, 19 bp, Homo sapiens
cgtaaccctcgccctgtcc

SEQ ID NO: 118154 - DNA, 14 bp, Homo sapiens
cgtcaccccgccag

SEQ ID NO: 118155 - DNA, 15 bp, Homo sapiens
cgtcaccccgccagc

SEQ ID NO: 118156 - DNA, 18 bp, Homo sapiens
cgtcaccccgccagccta

SEQ ID NO: 118157 - DNA, 23 bp, Homo sapiens
cgtcaggccacagcccctggcac

SEQ ID NO: 118158 - DNA, 22 bp, Homo sapiens
cgtcagtctctcaaagacccca

SEQ ID NO: 118159 - DNA, 16 bp, Homo sapiens
cgtccccggcccctgc

SEQ ID NO: 118160 - DNA, 21 bp, Homo sapiens
cgtccccggcccctgccccgc

SEQ ID NO: 118161 - DNA, 15 bp, Homo sapiens
cgtgaagggcaccga

SEQ ID NO: 118162 - DNA, 21 bp, Homo sapiens
cgtggggccccggctcccacc

SEQ ID NO: 118163 - DNA, 14 bp, Homo sapiens
ctacactgccagcc

SEQ ID NO: 118164 - DNA, 23 bp, Homo sapiens
ctactctggaagtccccgggagc

SEQ ID NO: 118165 - DNA, 17 bp, Homo sapiens
ctactttgctccgtgga

SEQ ID NO: 118166 - DNA, 13 bp, Homo sapiens
ctatattgtacac

SEQ ID NO: 118167 - DNA, 14 bp, Homo sapiens
ctatattgtacaca

SEQ ID NO: 118168 - DNA, 16 bp, Homo sapiens
ctcaaagaccccatgg

SEQ ID NO: 118169 - DNA, 17 bp, Homo sapiens
ctcaaccaacctccccg

SEQ ID NO: 118170 - DNA, 13 bp, Homo sapiens
ctcaatattttcc

SEQ ID NO: 118171 - DNA, 19 bp, Homo sapiens
ctcaatattttccatgaaa

SEQ ID NO: 118172 - DNA, 23 bp, Homo sapiens
ctcaccacctctttctacagcct

SEQ ID NO: 118173 - DNA, 13 bp, Homo sapiens
ctcagcctccccc

SEQ ID NO: 118174 - DNA, 15 bp, Homo sapiens
ctcagcctccccccg

SEQ ID NO: 118175 - DNA, 18 bp, Homo sapiens
ctcagcttcatttccgtg

SEQ ID NO: 118176 - DNA, 14 bp, Homo sapiens
ctcagtgctcggca

SEQ ID NO: 118177 - DNA, 16 bp, Homo sapiens
ctcagtgctcggcagt

SEQ ID NO: 118178 - DNA, 20 bp, Homo sapiens
ctcagtgctcggcagtcata

SEQ ID NO: 118179 - DNA, 20 bp, Homo sapiens
ctcccccacaagagccccaa

SEQ ID NO: 118180 - DNA, 19 bp, Homo sapiens
ctcccctcccccctgtaaa

SEQ ID NO: 118181 - DNA, 19 bp, Homo sapiens
ctcctagaaaacccttccc

SEQ ID NO: 118182 - DNA, 20 bp, Homo sapiens
ctcctagaaaacccttcccg

SEQ ID NO: 118183 - DNA, 17 bp, Homo sapiens
ctcgaagcccttccagt

SEQ ID NO: 118184 - DNA, 13 bp, Homo sapiens
ctcgccctgtccc

SEQ ID NO: 118185 - DNA, 14 bp, Homo sapiens
ctcgccctgtccct

SEQ ID NO: 118186 - DNA, 17 bp, Homo sapiens
ctcgccctgtccctccc

SEQ ID NO: 118187 - DNA, 18 bp, Homo sapiens
ctcgccctgtccctccca

SEQ ID NO: 118188 - DNA, 19 bp, Homo sapiens
ctcgccctgtccctcccac

SEQ ID NO: 118189 - DNA, 20 bp, Homo sapiens
ctcggctgtaaacagctctg

SEQ ID NO: 118190 - DNA, 20 bp, Homo sapiens
ctcggggcgacccctcagtg

SEQ ID NO: 118191 - DNA, 13 bp, Homo sapiens
ctctactctggaa

SEQ ID NO: 118192 - DNA, 18 bp, Homo sapiens
ctctcaaagaccccatgg

SEQ ID NO: 118193 - DNA, 20 bp, Homo sapiens
ctctcggggcgacccctcag

SEQ ID NO: 118194 - DNA, 17 bp, Homo sapiens
ctctgcttgccagccag

SEQ ID NO: 118195 - DNA, 18 bp, Homo sapiens
ctctgcttgccagccagg

SEQ ID NO: 118196 - DNA, 15 bp, Homo sapiens
ctctttctacagcct

SEQ ID NO: 118197 - DNA, 16 bp, Homo sapiens
ctgaaaattaacactg

SEQ ID NO: 118198 - DNA, 17 bp, Homo sapiens
ctgaccctccgctgcag

SEQ ID NO: 118199 - DNA, 20 bp, Homo sapiens
ctgagtcccgtggggccccg

SEQ ID NO: 118200 - DNA, 21 bp, Homo sapiens
ctgagttggtgttgacatgtg

SEQ ID NO: 118201 - DNA, 17 bp, Homo sapiens
ctgcaggtggcctccct

SEQ ID NO: 118202 - DNA, 15 bp, Homo sapiens
ctgcatgcctggccc

SEQ ID NO: 118203 - DNA, 16 bp, Homo sapiens
ctgcatgcctggcccc

SEQ ID NO: 118204 - DNA, 19 bp, Homo sapiens
ctgcatgcctggcccctcc

SEQ ID NO: 118205 - DNA, 22 bp, Homo sapiens
ctgcatgcctggcccctcctcc

SEQ ID NO: 118206 - DNA, 11 bp, Homo sapiens
ctgccccgccc

SEQ ID NO: 118207 - DNA, 15 bp, Homo sapiens
ctgccccgcccccaa

SEQ ID NO: 118208 - DNA, 11 bp, Homo sapiens
ctgcctgccaa

SEQ ID NO: 118209 - DNA, 12 bp, Homo sapiens
ctgcctgccaag

SEQ ID NO: 118210 - DNA, 15 bp, Homo sapiens
ctgcggagccagcgc

SEQ ID NO: 118211 - DNA, 22 bp, Homo sapiens
ctgcggccgtcaccccgccagc

SEQ ID NO: 118212 - DNA, 13 bp, Homo sapiens
ctgctcctcccat

SEQ ID NO: 118213 - DNA, 12 bp, Homo sapiens
ctgcttgccagc

SEQ ID NO: 118214 - DNA, 16 bp, Homo sapiens
ctgcttgccagccagg

SEQ ID NO: 118215 - DNA, 21 bp, Homo sapiens
ctggaagccggccggctggga

SEQ ID NO: 118216 - DNA, 17 bp, Homo sapiens
ctggccacacagcagcg

SEQ ID NO: 118217 - DNA, 14 bp, Homo sapiens
ctgggccctgtcca

SEQ ID NO: 118218 - DNA, 20 bp, Homo sapiens
ctgtacgaacccctcccctc

SEQ ID NO: 118219 - DNA, 11 bp, Homo sapiens
ctgtccctccc

SEQ ID NO: 118220 - DNA, 13 bp, Homo sapiens
ctgtccctcccac

SEQ ID NO: 118221 - DNA, 16 bp, Homo sapiens
ctgtccctcccactcc

SEQ ID NO: 118222 - DNA, 18 bp, Homo sapiens
ctgtctgcggagccagcg

SEQ ID NO: 118223 - DNA, 15 bp, Homo sapiens
cttaattctgagctg

SEQ ID NO: 118224 - DNA, 20 bp, Homo sapiens
cttcatttccgtgaagggca

SEQ ID NO: 118225 - DNA, 16 bp, Homo sapiens
cttccagtggtaccag

SEQ ID NO: 118226 - DNA, 21 bp, Homo sapiens
cttccagtggtaccagctcac

SEQ ID NO: 118227 - DNA, 23 bp, Homo sapiens
cttccagtggtaccagctcactc

SEQ ID NO: 118228 - DNA, 13 bp, Homo sapiens
cttctaggaagct

SEQ ID NO: 118229 - DNA, 21 bp, Homo sapiens
cttggaaactggatgaggtca

SEQ ID NO: 118230 - DNA, 16 bp, Homo sapiens
cttggtctcagcttca

SEQ ID NO: 118231 - DNA, 17 bp, Homo sapiens
cttggtctcagcttcat

SEQ ID NO: 118232 - DNA, 21 bp, Homo sapiens
ctttcaatggtttgcaaggaa

SEQ ID NO: 118233 - DNA, 14 bp, Homo sapiens
ctttcccgggccct

SEQ ID NO: 118234 - DNA, 19 bp, Homo sapiens
ctttcccgggccctcagcc

SEQ ID NO: 118235 - DNA, 22 bp, Homo sapiens
ctttcccgggccctcagccctc

SEQ ID NO: 118236 - DNA, 20 bp, Homo sapiens
gaaaatgcaacaacatgtat

SEQ ID NO: 118237 - DNA, 15 bp, Homo sapiens
gaaaattaacactgc

SEQ ID NO: 118238 - DNA, 11 bp, Homo sapiens
gaaagtttctt

SEQ ID NO: 118239 - DNA, 23 bp, Homo sapiens
gaaagtttcttggtctcagcttc

SEQ ID NO: 118240 - DNA, 16 bp, Homo sapiens
gaactcgaagcccttc

SEQ ID NO: 118241 - DNA, 15 bp, Homo sapiens
gaagcccttccagtg

SEQ ID NO: 118242 - DNA, 18 bp, Homo sapiens
gaaggaaaaggcagggag

SEQ ID NO: 118243 - DNA, 14 bp, Homo sapiens
gaaggagacagcag

SEQ ID NO: 118244 - DNA, 17 bp, Homo sapiens
gaaggcagcaggtggca

SEQ ID NO: 118245 - DNA, 15 bp, Homo sapiens
gaagggcaccgagaa

SEQ ID NO: 118246 - DNA, 14 bp, Homo sapiens
gacagaacactgtc

SEQ ID NO: 118247 - DNA, 14 bp, Homo sapiens
gacagcgccacctc

SEQ ID NO: 118248 - DNA, 12 bp, Homo sapiens
gacccctcagtg

SEQ ID NO: 118249 - DNA, 16 bp, Homo sapiens
gaccctggctcttctc

SEQ ID NO: 118250 - DNA, 11 bp, Homo sapiens
gacgcacagca

SEQ ID NO: 118251 - DNA, 17 bp, Homo sapiens
gagaactcgaagccctt

SEQ ID NO: 118252 - DNA, 18 bp, Homo sapiens
gagaactcgaagcccttc

SEQ ID NO: 118253 - DNA, 16 bp, Homo sapiens
gagagaggtgggcagc

SEQ ID NO: 118254 - DNA, 12 bp, Homo sapiens
gagccccaggag

SEQ ID NO: 118255 - DNA, 16 bp, Homo sapiens
gagcctgaggcatgag

SEQ ID NO: 118256 - DNA, 15 bp, Homo sapiens
gagcgaaagtttctt

SEQ ID NO: 118257 - DNA, 14 bp, Homo sapiens
gagctcaggacact

SEQ ID NO: 118258 - DNA, 15 bp, Homo sapiens
gaggtagctcccagc

SEQ ID NO: 118259 - DNA, 14 bp, Homo sapiens
gaggtgggcagcag

SEQ ID NO: 118260 - DNA, 21 bp, Homo sapiens
gagtccccatgattccctcct

SEQ ID NO: 118261 - DNA, 16 bp, Homo sapiens
gatcgctggcagagaa

SEQ ID NO: 118262 - DNA, 16 bp, Homo sapiens
gatcttttcaagttaa

SEQ ID NO: 118263 - DNA, 17 bp, Homo sapiens
gatgagagagtgctgag

SEQ ID NO: 118264 - DNA, 22 bp, Homo sapiens
gatgtcccatctgctcctccca

SEQ ID NO: 118265 - DNA, 22 bp, Homo sapiens
gattgcgtggaattgtgctgag

SEQ ID NO: 118266 - DNA, 20 bp, Homo sapiens
gcacacgggcctctgcttgc

SEQ ID NO: 118267 - DNA, 22 bp, Homo sapiens
gcacacgggcctctgcttgcca

SEQ ID NO: 118268 - DNA, 17 bp, Homo sapiens
gcacagcactgcctgcc

SEQ ID NO: 118269 - DNA, 19 bp, Homo sapiens
gcacagcactgcctgccaa

SEQ ID NO: 118270 - DNA, 21 bp, Homo sapiens
gcacagcactgcctgccaagc

SEQ ID NO: 118271 - DNA, 20 bp, Homo sapiens
gcaccacccccagtcccccc

SEQ ID NO: 118272 - DNA, 14 bp, Homo sapiens
gcaccccgcccctg

SEQ ID NO: 118273 - DNA, 21 bp, Homo sapiens
gcaccccgcccctgcatgcct

SEQ ID NO: 118274 - DNA, 22 bp, Homo sapiens
gcacgcaccccgcccctgcatg

SEQ ID NO: 118275 - DNA, 23 bp, Homo sapiens
gcactgcaggtggcctccctcca

SEQ ID NO: 118276 - DNA, 13 bp, Homo sapiens
gcactgcctgcca

SEQ ID NO: 118277 - DNA, 12 bp, Homo sapiens
gcagagaaggct

SEQ ID NO: 118278 - DNA, 18 bp, Homo sapiens
gcagaggattgaggctta

SEQ ID NO: 118279 - DNA, 14 bp, Homo sapiens
gcagcacccaccca

SEQ ID NO: 118280 - DNA, 19 bp, Homo sapiens
gcagcacccacccatgcac

SEQ ID NO: 118281 - DNA, 16 bp, Homo sapiens
gcagccgagccccagg

SEQ ID NO: 118282 - DNA, 16 bp, Homo sapiens
gcagcgcagccgagcc

SEQ ID NO: 118283 - DNA, 17 bp, Homo sapiens
gcaggaccgatgccagc

SEQ ID NO: 118284 - DNA, 17 bp, Homo sapiens
gcaggccccgccccctc

SEQ ID NO: 118285 - DNA, 16 bp, Homo sapiens
gcaggtggcctccctc

SEQ ID NO: 118286 - DNA, 12 bp, Homo sapiens
gcatcctctccc

SEQ ID NO: 118287 - DNA, 14 bp, Homo sapiens
gcatgcctggcccc

SEQ ID NO: 118288 - DNA, 14 bp, Homo sapiens
gccacacagcagcg

SEQ ID NO: 118289 - DNA, 14 bp, Homo sapiens
gccagccaggagtg

SEQ ID NO: 118290 - DNA, 18 bp, Homo sapiens
gccatcatgtgcctggaa

SEQ ID NO: 118291 - DNA, 20 bp, Homo sapiens
gccatcatgtgcctggaaat

SEQ ID NO: 118292 - DNA, 18 bp, Homo sapiens
gcccagtgggacccacag

SEQ ID NO: 118293 - DNA, 19 bp, Homo sapiens
gcccagtgggacccacagt

SEQ ID NO: 118294 - DNA, 19 bp, Homo sapiens
gccccctcggcccctcacc

SEQ ID NO: 118295 - DNA, 16 bp, Homo sapiens
gccccggctcccaccg

SEQ ID NO: 118296 - DNA, 12 bp, Homo sapiens
gcccctgcatgc

SEQ ID NO: 118297 - DNA, 16 bp, Homo sapiens
gcccctgcatgcctgg

SEQ ID NO: 118298 - DNA, 19 bp, Homo sapiens
gcccctgcatgcctggccc

SEQ ID NO: 118299 - DNA, 11 bp, Homo sapiens
gcccctgcccc

SEQ ID NO: 118300 - DNA, 16 bp, Homo sapiens
gcccctgccccgcccc

SEQ ID NO: 118301 - DNA, 11 bp, Homo sapiens
gccctcagccc

SEQ ID NO: 118302 - DNA, 16 bp, Homo sapiens
gccctgtccagggcag

SEQ ID NO: 118303 - DNA, 14 bp, Homo sapiens
gccctgtccctccc

SEQ ID NO: 118304 - DNA, 17 bp, Homo sapiens
gccctgtccctcccact

SEQ ID NO: 118305 - DNA, 18 bp, Homo sapiens
gccggatgtcccatctgc

SEQ ID NO: 118306 - DNA, 17 bp, Homo sapiens
gccgtcaccccgccagc

SEQ ID NO: 118307 - DNA, 21 bp, Homo sapiens
gccgtcaccccgccagcctac

SEQ ID NO: 118308 - DNA, 13 bp, Homo sapiens
gcctacactgcca

SEQ ID NO: 118309 - DNA, 15 bp, Homo sapiens
gcctacactgccagc

SEQ ID NO: 118310 - DNA, 14 bp, Homo sapiens
gcctcacctgcatc

SEQ ID NO: 118311 - DNA, 15 bp, Homo sapiens
gcctcacctgcatcc

SEQ ID NO: 118312 - DNA, 19 bp, Homo sapiens
gcctcacctgcatcctctc

SEQ ID NO: 118313 - DNA, 13 bp, Homo sapiens
gcctccccccgct

SEQ ID NO: 118314 - DNA, 21 bp, Homo sapiens
gcctctgcttgccagccagga

SEQ ID NO: 118315 - DNA, 16 bp, Homo sapiens
gcctttcccgggccct

SEQ ID NO: 118316 - DNA, 16 bp, Homo sapiens
gccttttatttcttaa

SEQ ID NO: 118317 - DNA, 11 bp, Homo sapiens
gcgacccctca

SEQ ID NO: 118318 - DNA, 21 bp, Homo sapiens
gcgccctgcgtaaccctcgcc

SEQ ID NO: 118319 - DNA, 14 bp, Homo sapiens
gcgcctcacctgca

SEQ ID NO: 118320 - DNA, 15 bp, Homo sapiens
gcgctgttccacagt

SEQ ID NO: 118321 - DNA, 20 bp, Homo sapiens
gcggacaccatgttcccagc

SEQ ID NO: 118322 - DNA, 20 bp, Homo sapiens
gcggcccagcctctgagtcc

SEQ ID NO: 118323 - DNA, 20 bp, Homo sapiens
gcgtaaccctcgccctgtcc

SEQ ID NO: 118324 - DNA, 15 bp, Homo sapiens
gctcagcctcccccc

SEQ ID NO: 118325 - DNA, 15 bp, Homo sapiens
gctcctcccattccc

SEQ ID NO: 118326 - DNA, 21 bp, Homo sapiens
gctgcgagatcgctggcagag

SEQ ID NO: 118327 - DNA, 18 bp, Homo sapiens
gctggcagagaaggcttc

SEQ ID NO: 118328 - DNA, 18 bp, Homo sapiens
gctggccacacagcagcg

SEQ ID NO: 118329 - DNA, 23 bp, Homo sapiens
gcttaattctgagctggcccttt

SEQ ID NO: 118330 - DNA, 15 bp, Homo sapiens
gcttgccagccagga

SEQ ID NO: 118331 - DNA, 18 bp, Homo sapiens
gcttggaaactggatgag

SEQ ID NO: 118332 - DNA, 17 bp, Homo sapiens
ggaaactggatgaggtc

SEQ ID NO: 118333 - DNA, 20 bp, Homo sapiens
ggaaattaaaccctgcccca

SEQ ID NO: 118334 - DNA, 19 bp, Homo sapiens
ggacaccatgttcccagct

SEQ ID NO: 118335 - DNA, 14 bp, Homo sapiens
ggagacagcagcac

SEQ ID NO: 118336 - DNA, 19 bp, Homo sapiens
ggagacagcagcacccacc

SEQ ID NO: 118337 - DNA, 15 bp, Homo sapiens
ggagccagcgcctgc

SEQ ID NO: 118338 - DNA, 17 bp, Homo sapiens
ggagccagcgcctgccc

SEQ ID NO: 118339 - DNA, 15 bp, Homo sapiens
ggagcgaaagtttct

SEQ ID NO: 118340 - DNA, 17 bp, Homo sapiens
ggaggtagctcccagca

SEQ ID NO: 118341 - DNA, 21 bp, Homo sapiens
ggaggttgcagtgagctgaga

SEQ ID NO: 118342 - DNA, 23 bp, Homo sapiens
ggatgtcccatctgctcctccca

SEQ ID NO: 118343 - DNA, 23 bp, Homo sapiens
ggatgtttctgtcacatcagctc

SEQ ID NO: 118344 - DNA, 13 bp, Homo sapiens
ggattgaggctta

SEQ ID NO: 118345 - DNA, 18 bp, Homo sapiens
ggcaagagtgagactccg

SEQ ID NO: 118346 - DNA, 18 bp, Homo sapiens
ggcagagaaggcttcctc

SEQ ID NO: 118347 - DNA, 22 bp, Homo sapiens
ggcagagaaggcttcctccagc

SEQ ID NO: 118348 - DNA, 16 bp, Homo sapiens
ggcagcagctcagcct

SEQ ID NO: 118349 - DNA, 22 bp, Homo sapiens
ggcagcagctcagcctcccccc

SEQ ID NO: 118350 - DNA, 17 bp, Homo sapiens
ggcagtcatactggggt

SEQ ID NO: 118351 - DNA, 22 bp, Homo sapiens
ggccaatgtgactaccgtgcca

SEQ ID NO: 118352 - DNA, 18 bp, Homo sapiens
ggccacacagcagcgcag

SEQ ID NO: 118353 - DNA, 22 bp, Homo sapiens
ggccacagcccctggcactgca

SEQ ID NO: 118354 - DNA, 20 bp, Homo sapiens
ggcccagcctctgagtcccg

SEQ ID NO: 118355 - DNA, 13 bp, Homo sapiens
ggccccggctccc

SEQ ID NO: 118356 - DNA, 11 bp, Homo sapiens
ggcccctcctc

SEQ ID NO: 118357 - DNA, 16 bp, Homo sapiens
ggccgtcaccccgcca

SEQ ID NO: 118358 - DNA, 16 bp, Homo sapiens
ggcctctgcttgccag

SEQ ID NO: 118359 - DNA, 19 bp, Homo sapiens
ggcctctgcttgccagcca

SEQ ID NO: 118360 - DNA, 11 bp, Homo sapiens
ggcgccctgcg

SEQ ID NO: 118361 - DNA, 18 bp, Homo sapiens
ggctgtaaacagctctgt

SEQ ID NO: 118362 - DNA, 19 bp, Homo sapiens
ggctgtaaacagctctgtg

SEQ ID NO: 118363 - DNA, 22 bp, Homo sapiens
gggaatggcacagcccaaagaa

SEQ ID NO: 118364 - DNA, 18 bp, Homo sapiens
gggagagggacgcacagc

SEQ ID NO: 118365 - DNA, 19 bp, Homo sapiens
gggcaccacccccagtccc

SEQ ID NO: 118366 - DNA, 21 bp, Homo sapiens
gggccgggcaccacccccagt

SEQ ID NO: 118367 - DNA, 21 bp, Homo sapiens
gggcctctgcttgccagccag

SEQ ID NO: 118368 - DNA, 19 bp, Homo sapiens
ggggagagggacgcacagc

SEQ ID NO: 118369 - DNA, 13 bp, Homo sapiens
gggtacctcagtt

SEQ ID NO: 118370 - DNA, 14 bp, Homo sapiens
gggtgcgagagagg

SEQ ID NO: 118371 - DNA, 19 bp, Homo sapiens
ggtacaaggggcccagtgc

SEQ ID NO: 118372 - DNA, 13 bp, Homo sapiens
ggtaccagctcac

SEQ ID NO: 118373 - DNA, 14 bp, Homo sapiens
ggtacctcagtttc

SEQ ID NO: 118374 - DNA, 11 bp, Homo sapiens
ggtagaacaca

SEQ ID NO: 118375 - DNA, 21 bp, Homo sapiens
ggtatgaccttctaggaagct

SEQ ID NO: 118376 - DNA, 16 bp, Homo sapiens
ggtcatagcagtgctt

SEQ ID NO: 118377 - DNA, 14 bp, Homo sapiens
ggtctcagcttcat

SEQ ID NO: 118378 - DNA, 17 bp, Homo sapiens
ggtctcagcttcatttc

SEQ ID NO: 118379 - DNA, 21 bp, Homo sapiens
ggtgccaaacccagcccctgc

SEQ ID NO: 118380 - DNA, 21 bp, Homo sapiens
ggtgcgagagaggtgggcagc

SEQ ID NO: 118381 - DNA, 17 bp, Homo sapiens
ggtgttgacatgtgctt

SEQ ID NO: 118382 - DNA, 15 bp, Homo sapiens
ggtttgaatataaac

SEQ ID NO: 118383 - DNA, 18 bp, Homo sapiens
ggtttgaatataaacact

SEQ ID NO: 118384 - DNA, 19 bp, Homo sapiens
gtaaccctcgccctgtccc

SEQ ID NO: 118385 - DNA, 15 bp, Homo sapiens
gtacaaggggcccag

SEQ ID NO: 118386 - DNA, 23 bp, Homo sapiens
gtacgaacccctcccctcccccc

SEQ ID NO: 118387 - DNA, 12 bp, Homo sapiens
gtactacaattt

SEQ ID NO: 118388 - DNA, 21 bp, Homo sapiens
gtagaaagacagagctgggat

SEQ ID NO: 118389 - DNA, 22 bp, Homo sapiens
gtagaacacaaggtcatttgct

SEQ ID NO: 118390 - DNA, 13 bp, Homo sapiens
gtagctcccagca

SEQ ID NO: 118391 - DNA, 19 bp, Homo sapiens
gtatgtttttgtgtatttg

SEQ ID NO: 118392 - DNA, 13 bp, Homo sapiens
gtcacacagagcg

SEQ ID NO: 118393 - DNA, 18 bp, Homo sapiens
gtcaggccacagcccctg

SEQ ID NO: 118394 - DNA, 18 bp, Homo sapiens
gtccccggcccctgcccc

SEQ ID NO: 118395 - DNA, 12 bp, Homo sapiens
gtccctcccact

SEQ ID NO: 118396 - DNA, 20 bp, Homo sapiens
gtctcagcttcatttccgtg

SEQ ID NO: 118397 - DNA, 23 bp, Homo sapiens
gtctcagcttcatttccgtgaag

SEQ ID NO: 118398 - DNA, 19 bp, Homo sapiens
gtgaaggaccctggctctt

SEQ ID NO: 118399 - DNA, 15 bp, Homo sapiens
gtgccaaacccagcc

SEQ ID NO: 118400 - DNA, 18 bp, Homo sapiens
gtgcctttcccgggccct

SEQ ID NO: 118401 - DNA, 21 bp, Homo sapiens
gtgcctttcccgggccctcag

SEQ ID NO: 118402 - DNA, 21 bp, Homo sapiens
gtgcgagagaggtgggcagca

SEQ ID NO: 118403 - DNA, 12 bp, Homo sapiens
gtgctcggcagt

SEQ ID NO: 118404 - DNA, 20 bp, Homo sapiens
gtggaggagctcaggacact

SEQ ID NO: 118405 - DNA, 18 bp, Homo sapiens
gtggagggtggcgccctg

SEQ ID NO: 118406 - DNA, 20 bp, Homo sapiens
gtggagggtggcgccctgcg

SEQ ID NO: 118407 - DNA, 22 bp, Homo sapiens
gtggagggtggcgccctgcgta

SEQ ID NO: 118408 - DNA, 13 bp, Homo sapiens
gtgggacccacag

SEQ ID NO: 118409 - DNA, 14 bp, Homo sapiens
gtggtaccagctca

SEQ ID NO: 118410 - DNA, 20 bp, Homo sapiens
gtggtgaaggaccctggctc

SEQ ID NO: 118411 - DNA, 23 bp, Homo sapiens
gtggttaatgccatggacagaag

SEQ ID NO: 118412 - DNA, 16 bp, Homo sapiens
gttcccagctcagtgc

SEQ ID NO: 118413 - DNA, 17 bp, Homo sapiens
gttcccagctcagtgcc

SEQ ID NO: 118414 - DNA, 19 bp, Homo sapiens
gttgacttgacagaacact

SEQ ID NO: 118415 - DNA, 17 bp, Homo sapiens
gtttcttggtctcagct

SEQ ID NO: 118416 - DNA, 15 bp, Homo sapiens
gtttttaactcaata

SEQ ID NO: 118417 - DNA, 12 bp, Homo sapiens
taaacaaatgta

SEQ ID NO: 118418 - DNA, 16 bp, Homo sapiens
taaatcaactccagct

SEQ ID NO: 118419 - DNA, 15 bp, Homo sapiens
taaccctcgccctgt

SEQ ID NO: 118420 - DNA, 16 bp, Homo sapiens
taatatggggatgcag

SEQ ID NO: 118421 - DNA, 15 bp, Homo sapiens
taatatttttaatta

SEQ ID NO: 118422 - DNA, 15 bp, Homo sapiens
taatggtttgaatat

SEQ ID NO: 118423 - DNA, 18 bp, Homo sapiens
tacacaccttatatttac

SEQ ID NO: 118424 - DNA, 10 bp, Homo sapiens
tacagcctaa

SEQ ID NO: 118425 - DNA, 19 bp, Homo sapiens
taccagctcactccctggg

SEQ ID NO: 118426 - DNA, 14 bp, Homo sapiens
tacctcagtttctc

SEQ ID NO: 118427 - DNA, 22 bp, Homo sapiens
tacgaacccctcccctcccccc

SEQ ID NO: 118428 - DNA, 13 bp, Homo sapiens
tacgtatgagacg

SEQ ID NO: 118429 - DNA, 15 bp, Homo sapiens
tagcttggaaactgg

SEQ ID NO: 118430 - DNA, 20 bp, Homo sapiens
tagcttggaaactggatgag

SEQ ID NO: 118431 - DNA, 14 bp, Homo sapiens
tataaacactatat

SEQ ID NO: 118432 - DNA, 14 bp, Homo sapiens
tatatattttaatt

SEQ ID NO: 118433 - DNA, 14 bp, Homo sapiens
tatattttaatttg

SEQ ID NO: 118434 - DNA, 15 bp, Homo sapiens
tatgaagaagagagt

SEQ ID NO: 118435 - DNA, 18 bp, Homo sapiens
tatgaccttctaggaagc

SEQ ID NO: 118436 - DNA, 16 bp, Homo sapiens
tatggcagtgtctttc

SEQ ID NO: 118437 - DNA, 18 bp, Homo sapiens
tatgtttttgtgtatttg

SEQ ID NO: 118438 - DNA, 17 bp, Homo sapiens
tattcgtagccatctcc

SEQ ID NO: 118439 - DNA, 16 bp, Homo sapiens
tattttccatgaaaat

SEQ ID NO: 118440 - DNA, 20 bp, Homo sapiens
tattttccatgaaaatgcaa

SEQ ID NO: 118441 - DNA, 19 bp, Homo sapiens
tcaaccaacctccccgcag

SEQ ID NO: 118442 - DNA, 14 bp, Homo sapiens
tcaccccgccagcc

SEQ ID NO: 118443 - DNA, 12 bp, Homo sapiens
tcagcctccccc

SEQ ID NO: 118444 - DNA, 12 bp, Homo sapiens
tcaggacactaa

SEQ ID NO: 118445 - DNA, 13 bp, Homo sapiens
tcaggacactaat

SEQ ID NO: 118446 - DNA, 20 bp, Homo sapiens
tcagtctctcaaagacccca

SEQ ID NO: 118447 - DNA, 22 bp, Homo sapiens
tcagtctctcaaagaccccatg

SEQ ID NO: 118448 - DNA, 12 bp, Homo sapiens
tcagtgccaaag

SEQ ID NO: 118449 - DNA, 10 bp, Homo sapiens
tcagtttctc

SEQ ID NO: 118450 - DNA, 16 bp, Homo sapiens
tcatctctctttaata

SEQ ID NO: 118451 - DNA, 15 bp, Homo sapiens
agcacccacccatgc

SEQ ID NO: 118452 - DNA, 23 bp, Homo sapiens
agcactcaaccaacctccccgca

SEQ ID NO: 118453 - DNA, 15 bp, Homo sapiens
agcactgcctgccaa

SEQ ID NO: 118454 - DNA, 15 bp, Homo sapiens
agcagctcagcctcc

SEQ ID NO: 118455 - DNA, 19 bp, Homo sapiens
agcagctcagcctcccccc

SEQ ID NO: 118456 - DNA, 17 bp, Homo sapiens
agcatcacttgggatta

SEQ ID NO: 118457 - DNA, 19 bp, Homo sapiens
agcattatgatgtgggtca

SEQ ID NO: 118458 - DNA, 13 bp, Homo sapiens
agccacagctggt

SEQ ID NO: 118459 - DNA, 13 bp, Homo sapiens
agcccaaagaagg

SEQ ID NO: 118460 - DNA, 16 bp, Homo sapiens
agcccctggcactgca

SEQ ID NO: 118461 - DNA, 14 bp, Homo sapiens
agcccgtcaggcca

SEQ ID NO: 118462 - DNA, 13 bp, Homo sapiens
agccgagccccag

SEQ ID NO: 118463 - DNA, 15 bp, Homo sapiens
agccgagccccagga

SEQ ID NO: 118464 - DNA, 14 bp, Homo sapiens
agcctacactgcca

SEQ ID NO: 118465 - DNA, 18 bp, Homo sapiens
agcctacactgccagccg

SEQ ID NO: 118466 - DNA, 13 bp, Homo sapiens
aaacacagtgctg

SEQ ID NO: 118467 - DNA, 20 bp, Homo sapiens
aaaccattatgaagaagaga

SEQ ID NO: 118468 - DNA, 16 bp, Homo sapiens
aaagcatcacttggga

SEQ ID NO: 118469 - DNA, 18 bp, Homo sapiens
aaagtttcttggtctcag

SEQ ID NO: 118470 - DNA, 12 bp, Homo sapiens
aacacagtgctg

SEQ ID NO: 118471 - DNA, 20 bp, Homo sapiens
aaccctcgccctgtccctcc

SEQ ID NO: 118472 - DNA, 19 bp, Homo sapiens
aacctccccgcagagctcc

SEQ ID NO: 118473 - DNA, 18 bp, Homo sapiens
aactagcttggaaactgg

SEQ ID NO: 118474 - DNA, 12 bp, Homo sapiens
aactcaatattt

SEQ ID NO: 118475 - DNA, 19 bp, Homo sapiens
aactcgaagcccttccagt

SEQ ID NO: 118476 - DNA, 23 bp, Homo sapiens
aactcgaagcccttccagtggta

SEQ ID NO: 118477 - DNA, 16 bp, Homo sapiens
aagacagagctgggat

SEQ ID NO: 118478 - DNA, 11 bp, Homo sapiens
aagagctgagg

SEQ ID NO: 118479 - DNA, 18 bp, Homo sapiens
aagagctgaggcaattct

SEQ ID NO: 118480 - DNA, 13 bp, Homo sapiens
aagaggggtcacc

SEQ ID NO: 118481 - DNA, 23 bp, Homo sapiens
aagccgcccagtgggacccacag

SEQ ID NO: 118482 - DNA, 14 bp, Homo sapiens
aatataaacactat

SEQ ID NO: 118483 - DNA, 17 bp, Homo sapiens
aatggcacagcccaaag

SEQ ID NO: 118484 - DNA, 14 bp, Homo sapiens
aatggtttgaatat

SEQ ID NO: 118485 - DNA, 17 bp, Homo sapiens
aatggtttgcaaggaag

SEQ ID NO: 118486 - DNA, 18 bp, Homo sapiens
aatggtttgcaaggaagc

SEQ ID NO: 118487 - DNA, 13 bp, Homo sapiens
acaaatgtatgat

SEQ ID NO: 118488 - DNA, 14 bp, Homo sapiens
acaacatgtataat

SEQ ID NO: 118489 - DNA, 23 bp, Homo sapiens
acaaccgtccccggcccctgccc

SEQ ID NO: 118490 - DNA, 20 bp, Homo sapiens
acacagagcgcctcacctgc

SEQ ID NO: 118491 - DNA, 23 bp, Homo sapiens
acacagagcgcctcacctgcatc

SEQ ID NO: 118492 - DNA, 22 bp, Homo sapiens
acacagcagcgcagccgagccc

SEQ ID NO: 118493 - DNA, 23 bp, Homo sapiens
acaccagccatcatgtgcctgga

SEQ ID NO: 118494 - DNA, 19 bp, Homo sapiens
acaccatgttcccagctca

SEQ ID NO: 118495 - DNA, 15 bp, Homo sapiens
acaccttatatttac

SEQ ID NO: 118496 - DNA, 19 bp, Homo sapiens
acactgcttgtgtttttaa

SEQ ID NO: 118497 - DNA, 14 bp, Homo sapiens
acagaacactgtct

SEQ ID NO: 118498 - DNA, 16 bp, Homo sapiens
acagaagaaggcagca

SEQ ID NO: 118499 - DNA, 21 bp, Homo sapiens
acagagcgcctcacctgcatc

SEQ ID NO: 118500 - DNA, 22 bp, Homo sapiens
acagagcgcctcacctgcatcc

SEQ ID NO: 118501 - DNA, 10 bp, Homo sapiens
acagagctgg

SEQ ID NO: 118502 - DNA, 12 bp, Homo sapiens
acagcactgcct

SEQ ID NO: 118503 - DNA, 23 bp, Homo sapiens
acagcagcgcagccgagccccag

SEQ ID NO: 118504 - DNA, 16 bp, Homo sapiens
acagcccaaagaagga

SEQ ID NO: 118505 - DNA, 17 bp, Homo sapiens
acagcccaaagaaggaa

SEQ ID NO: 118506 - DNA, 19 bp, Homo sapiens
acagcccaaagaaggaaaa

SEQ ID NO: 118507 - DNA, 16 bp, Homo sapiens
acagcccctggcactg

SEQ ID NO: 118508 - DNA, 14 bp, Homo sapiens
acagtgctgcgaga

SEQ ID NO: 118509 - DNA, 19 bp, Homo sapiens
acatgtataatatttttaa

SEQ ID NO: 118510 - DNA, 14 bp, Homo sapiens
accaacctccccgc

SEQ ID NO: 118511 - DNA, 22 bp, Homo sapiens
accacctctttctacagcctaa

SEQ ID NO: 118512 - DNA, 15 bp, Homo sapiens
accatgttcccagct

SEQ ID NO: 118513 - DNA, 18 bp, Homo sapiens
accccgccagcctacact

SEQ ID NO: 118514 - DNA, 20 bp, Homo sapiens
acccctcagtgctcggcagt

SEQ ID NO: 118515 - DNA, 13 bp, Homo sapiens
accctggctcttc

SEQ ID NO: 118516 - DNA, 13 bp, Homo sapiens
acccttcccgccc

SEQ ID NO: 118517 - DNA, 12 bp, Homo sapiens
accggtgccaaa

SEQ ID NO: 118518 - DNA, 19 bp, Homo sapiens
accggtgccaaacccagcc

SEQ ID NO: 118519 - DNA, 20 bp, Homo sapiens
accggtgccaaacccagccc

SEQ ID NO: 118520 - DNA, 20 bp, Homo sapiens
accgtccccggcccctgccc

SEQ ID NO: 118521 - DNA, 21 bp, Homo sapiens
acctccttcctcagtcctgga

SEQ ID NO: 118522 - DNA, 22 bp, Homo sapiens
acctccttcctcagtcctggaa

SEQ ID NO: 118523 - DNA, 15 bp, Homo sapiens
acctgcatcctctcc

SEQ ID NO: 118524 - DNA, 19 bp, Homo sapiens
acctgcatcctctccccca

SEQ ID NO: 118525 - DNA, 21 bp, Homo sapiens
acgaacccctcccctcccccc

SEQ ID NO: 118526 - DNA, 13 bp, Homo sapiens
acgcacagcactg

SEQ ID NO: 118527 - DNA, 18 bp, Homo sapiens
acgcacagcactgcctgc

SEQ ID NO: 118528 - DNA, 21 bp, Homo sapiens
acgcacagcactgcctgccaa

SEQ ID NO: 118529 - DNA, 19 bp, Homo sapiens
acgggcctctgcttgccag

SEQ ID NO: 118530 - DNA, 20 bp, Homo sapiens
acgggcctctgcttgccagc

SEQ ID NO: 118531 - DNA, 21 bp, Homo sapiens
acgggcctctgcttgccagcc

SEQ ID NO: 118532 - DNA, 15 bp, Homo sapiens
actaccgtgccagca

SEQ ID NO: 118533 - DNA, 18 bp, Homo sapiens
actcaaccaacctccccg

SEQ ID NO: 118534 - DNA, 11 bp, Homo sapiens
actccagctcc

SEQ ID NO: 118535 - DNA, 12 bp, Homo sapiens
actccagctccc

SEQ ID NO: 118536 - DNA, 15 bp, Homo sapiens
actccctgggaaagg

SEQ ID NO: 118537 - DNA, 20 bp, Homo sapiens
actcgaagcccttccagtgg

SEQ ID NO: 118538 - DNA, 13 bp, Homo sapiens
actgcactccagt

SEQ ID NO: 118539 - DNA, 15 bp, Homo sapiens
actgccagccgccac

SEQ ID NO: 118540 - DNA, 13 bp, Homo sapiens
actgcctgccaag

SEQ ID NO: 118541 - DNA, 17 bp, Homo sapiens
actgggccctgtccagg

SEQ ID NO: 118542 - DNA, 20 bp, Homo sapiens
acttgacagaacactgtctt

SEQ ID NO: 118543 - DNA, 14 bp, Homo sapiens
agaaaacccttccc

SEQ ID NO: 118544 - DNA, 20 bp, Homo sapiens
agaaaacccttcccgccctc

SEQ ID NO: 118545 - DNA, 18 bp, Homo sapiens
agaaagacagagctggga

SEQ ID NO: 118546 - DNA, 22 bp, Homo sapiens
agaactcgaagcccttccagtg

SEQ ID NO: 118547 - DNA, 20 bp, Homo sapiens
agaaggacacctccttcctc

SEQ ID NO: 118548 - DNA, 17 bp, Homo sapiens
agaatgcaggccccgcc

SEQ ID NO: 118549 - DNA, 22 bp, Homo sapiens
agaatgcaggccccgccccctc

SEQ ID NO: 118550 - DNA, 18 bp, Homo sapiens
agactcgagtccccatga

SEQ ID NO: 118551 - DNA, 15 bp, Homo sapiens
agagaggtgggcagc

SEQ ID NO: 118552 - DNA, 23 bp, Homo sapiens
agagagtgctgagaaggacacct

SEQ ID NO: 118553 - DNA, 21 bp, Homo sapiens
agagggacgcacagcactgcc

SEQ ID NO: 118554 - DNA, 13 bp, Homo sapiens
agaggtgggcagc

SEQ ID NO: 118555 - DNA, 16 bp, Homo sapiens
agaggtgggcagcagc

SEQ ID NO: 118556 - DNA, 19 bp, Homo sapiens
agaggtgggcagcagctca

SEQ ID NO: 118557 - DNA, 20 bp, Homo sapiens
agaggtgggcagcagctcag

SEQ ID NO: 118558 - DNA, 20 bp, Homo sapiens
agagtgctgagaaggacacc

SEQ ID NO: 118559 - DNA, 21 bp, Homo sapiens
agatggccgggacatgcagct

SEQ ID NO: 118560 - DNA, 23 bp, Homo sapiens
agcaaaggagtagaaagacagag

SEQ ID NO: 118561 - DNA, 16 bp, Homo sapiens
agcacccacccatgca

SEQ ID NO: 118562 - DNA, 14 bp, Homo sapiens
agcactgcctgcca

SEQ ID NO: 118563 - DNA, 15 bp, Homo sapiens
agcagcgcagccgag

SEQ ID NO: 118564 - DNA, 18 bp, Homo sapiens
agcagcgggggcggccca

SEQ ID NO: 118565 - DNA, 13 bp, Homo sapiens
agccaaggctccc

SEQ ID NO: 118566 - DNA, 19 bp, Homo sapiens
agccatcatgtgcctggaa

SEQ ID NO: 118567 - DNA, 14 bp, Homo sapiens
agcccaaagaagga

SEQ ID NO: 118568 - DNA, 14 bp, Homo sapiens
ttattgctcctgta

SEQ ID NO: 118569 - DNA, 15 bp, Homo sapiens
ttattggattcccta

SEQ ID NO: 118570 - DNA, 20 bp, Homo sapiens
ttcaatggtttgcaaggaag

SEQ ID NO: 118571 - DNA, 23 bp, Homo sapiens
ttcaatggtttgcaaggaagcca

SEQ ID NO: 118572 - DNA, 12 bp, Homo sapiens
ttccaagagctg

SEQ ID NO: 118573 - DNA, 13 bp, Homo sapiens
ttccaagagctga

SEQ ID NO: 118574 - DNA, 23 bp, Homo sapiens
ttccacagtgactgggccctgtc

SEQ ID NO: 118575 - DNA, 19 bp, Homo sapiens
ttccagtggtaccagctca

SEQ ID NO: 118576 - DNA, 24 bp, Homo sapiens
ttccatgaaaatgcaacaacatgt

SEQ ID NO: 118577 - DNA, 15 bp, Homo sapiens
ttcccgggccctcag

SEQ ID NO: 118578 - DNA, 19 bp, Homo sapiens
ttcccgggccctcagccct

SEQ ID NO: 118579 - DNA, 17 bp, Homo sapiens
ttccgtgaagggcaccg

SEQ ID NO: 118580 - DNA, 15 bp, Homo sapiens
ttcctcagtcctgga

SEQ ID NO: 118581 - DNA, 21 bp, Homo sapiens
ttcgatgggcccaattcttac

SEQ ID NO: 118582 - DNA, 16 bp, Homo sapiens
ttctcctttattgctc

SEQ ID NO: 118583 - DNA, 15 bp, Homo sapiens
ttcttacaaacatgt

SEQ ID NO: 118584 - DNA, 16 bp, Homo sapiens
ttcttggtctcagctt

SEQ ID NO: 118585 - DNA, 15 bp, Homo sapiens
ttgacagaacactgt

SEQ ID NO: 118586 - DNA, 17 bp, Homo sapiens
ttgacagaacactgtct

SEQ ID NO: 118587 - DNA, 21 bp, Homo sapiens
ttgcgtggaattgtgctgagt

SEQ ID NO: 118588 - DNA, 14 bp, Homo sapiens
ttggtctcagcttc

SEQ ID NO: 118589 - DNA, 21 bp, Homo sapiens
agcctacactgccagccgcca

SEQ ID NO: 118590 - DNA, 19 bp, Homo sapiens
agcctctccttgcctggtg

SEQ ID NO: 118591 - DNA, 14 bp, Homo sapiens
agcgaaagtttctt

SEQ ID NO: 118592 - DNA, 17 bp, Homo sapiens
agcgcagccgagcccca

SEQ ID NO: 118593 - DNA, 16 bp, Homo sapiens
agcgcctcacctgcat

SEQ ID NO: 118594 - DNA, 20 bp, Homo sapiens
agcggctgggtggtgaagga

SEQ ID NO: 118595 - DNA, 14 bp, Homo sapiens
agctcagcctcccc

SEQ ID NO: 118596 - DNA, 16 bp, Homo sapiens
agctcagcctcccccc

SEQ ID NO: 118597 - DNA, 15 bp, Homo sapiens
agctctgatgagaga

SEQ ID NO: 118598 - DNA, 17 bp, Homo sapiens
agctgaggcaattctaa

SEQ ID NO: 118599 - DNA, 21 bp, Homo sapiens
agctggtggtatctgagttga

SEQ ID NO: 118600 - DNA, 23 bp, Homo sapiens
agcttggaaactggatgaggtca

SEQ ID NO: 118601 - DNA, 18 bp, Homo sapiens
aggaagccacagctggtg

SEQ ID NO: 118602 - DNA, 23 bp, Homo sapiens
aggaattaagttagggaatggca

SEQ ID NO: 118603 - DNA, 16 bp, Homo sapiens
aggaccctggctcttc

SEQ ID NO: 118604 - DNA, 14 bp, Homo sapiens
aggagacccacagg

SEQ ID NO: 118605 - DNA, 21 bp, Homo sapiens
aggaggtagctcccagcactc

SEQ ID NO: 118606 - DNA, 15 bp, Homo sapiens
aggccacagcccctg

SEQ ID NO: 118607 - DNA, 17 bp, Homo sapiens
aggccacagcccctggc

SEQ ID NO: 118608 - DNA, 19 bp, Homo sapiens
agggacgcacagcactgcc

SEQ ID NO: 118609 - DNA, 21 bp, Homo sapiens
agggagaagactatattgtac

SEQ ID NO: 118610 - DNA, 16 bp, Homo sapiens
aggggacagcgccacc

SEQ ID NO: 118611 - DNA, 14 bp, Homo sapiens
aggtagctcccagc

SEQ ID NO: 118612 - DNA, 18 bp, Homo sapiens
aggtagctcccagcactc

SEQ ID NO: 118613 - DNA, 12 bp, Homo sapiens
aggtgggcagca

SEQ ID NO: 118614 - DNA, 17 bp, Homo sapiens
aggtgggcagcagctca

SEQ ID NO: 118615 - DNA, 19 bp, Homo sapiens
aggttgcagtgagctgaga

SEQ ID NO: 118616 - DNA, 23 bp, Homo sapiens
aggtttctgaaaattaacactgc

SEQ ID NO: 118617 - DNA, 23 bp, Homo sapiens
agtccatatttcaatttccaaga

SEQ ID NO: 118618 - DNA, 12 bp, Homo sapiens
agtcctggaagc

SEQ ID NO: 118619 - DNA, 14 bp, Homo sapiens
agtgaaagcatcac

SEQ ID NO: 118620 - DNA, 15 bp, Homo sapiens
agtgactgggccctg

SEQ ID NO: 118621 - DNA, 15 bp, Homo sapiens
agtgctcggcagtca

SEQ ID NO: 118622 - DNA, 16 bp, Homo sapiens
agtgctggccacacag

SEQ ID NO: 118623 - DNA, 14 bp, Homo sapiens
agtgggacccacag

SEQ ID NO: 118624 - DNA, 21 bp, Homo sapiens
agttcgatgggcccaattctt

SEQ ID NO: 118625 - DNA, 16 bp, Homo sapiens
agtttcttggtctcag

SEQ ID NO: 118626 - DNA, 19 bp, Homo sapiens
agtttcttggtctcagctt

SEQ ID NO: 118627 - DNA, 20 bp, Homo sapiens
ataatatttttaattaaata

SEQ ID NO: 118628 - DNA, 13 bp, Homo sapiens
atatatattttaa

SEQ ID NO: 118629 - DNA, 15 bp, Homo sapiens
atcaactccagctcc

SEQ ID NO: 118630 - DNA, 23 bp, Homo sapiens
atcacatgaaggagacagcagca

SEQ ID NO: 118631 - DNA, 17 bp, Homo sapiens
atcatgtgcctggaaat

SEQ ID NO: 118632 - DNA, 22 bp, Homo sapiens
atcccctgagggtggtcagcca

SEQ ID NO: 118633 - DNA, 15 bp, Homo sapiens
atcctctcccccaca

SEQ ID NO: 118634 - DNA, 15 bp, Homo sapiens
atctgctcctcccat

SEQ ID NO: 118635 - DNA, 17 bp, Homo sapiens
atgaaggtttctgaaaa

SEQ ID NO: 118636 - DNA, 19 bp, Homo sapiens
atgatgtgggtcaaggaat

SEQ ID NO: 118637 - DNA, 11 bp, Homo sapiens
atgattccctc

SEQ ID NO: 118638 - DNA, 15 bp, Homo sapiens
atgattccctcctcg

SEQ ID NO: 118639 - DNA, 17 bp, Homo sapiens
atgccatggacagaaga

SEQ ID NO: 118640 - DNA, 13 bp, Homo sapiens
atgcctggcccct

SEQ ID NO: 118641 - DNA, 18 bp, Homo sapiens
atgcctggcccctcctcc

SEQ ID NO: 118642 - DNA, 22 bp, Homo sapiens
atgcctggcccctcctcctaga

SEQ ID NO: 118643 - DNA, 23 bp, Homo sapiens
atgctaaaggttgtattgcatat

SEQ ID NO: 118644 - DNA, 20 bp, Homo sapiens
atggacagaagaaggcagca

SEQ ID NO: 118645 - DNA, 23 bp, Homo sapiens
atggcacagcccaaagaaggaaa

SEQ ID NO: 118646 - DNA, 15 bp, Homo sapiens
atgggagcctgaggc

SEQ ID NO: 118647 - DNA, 18 bp, Homo sapiens
atggtttgcaaggaagcc

SEQ ID NO: 118648 - DNA, 16 bp, Homo sapiens
atgtcccatctgctcc

SEQ ID NO: 118649 - DNA, 17 bp, Homo sapiens
atgtgactaccgtgcca

SEQ ID NO: 118650 - DNA, 22 bp, Homo sapiens
atgtggagggtggcgccctgcg

SEQ ID NO: 118651 - DNA, 16 bp, Homo sapiens
atgtgggtcaaggaat

SEQ ID NO: 118652 - DNA, 14 bp, Homo sapiens
atgttcccagctca

SEQ ID NO: 118653 - DNA, 22 bp, Homo sapiens
attcatctctctttaatataaa

SEQ ID NO: 118654 - DNA, 21 bp, Homo sapiens
attccctcctcgtcagtctct

SEQ ID NO: 118655 - DNA, 15 bp, Homo sapiens
attcgtagccatctc

SEQ ID NO: 118656 - DNA, 16 bp, Homo sapiens
attcttacaaacatgt

SEQ ID NO: 118657 - DNA, 21 bp, Homo sapiens
atttcttaaacaaatgtatga

SEQ ID NO: 118658 - DNA, 20 bp, Homo sapiens
atttgatagtattgtgcata

SEQ ID NO: 118659 - DNA, 20 bp, Homo sapiens
attttatgccttttatttct

SEQ ID NO: 118660 - DNA, 21 bp, Homo sapiens
attttatgccttttatttctt

SEQ ID NO: 118661 - DNA, 17 bp, Homo sapiens
caaacccagcccctgcg

SEQ ID NO: 118662 - DNA, 22 bp, Homo sapiens
caaagaccccatggtccatccc

SEQ ID NO: 118663 - DNA, 22 bp, Homo sapiens
caacaacatgtataatattttt

SEQ ID NO: 118664 - DNA, 23 bp, Homo sapiens
caacatgtataatatttttaatt

SEQ ID NO: 118665 - DNA, 24 bp, Homo sapiens
caaccaacctccccgcagagctcc

SEQ ID NO: 118666 - DNA, 23 bp, Homo sapiens
caacctccccgcagagctccctt

SEQ ID NO: 118667 - DNA, 19 bp, Homo sapiens
caatattttccatgaaaat

SEQ ID NO: 118668 - DNA, 13 bp, Homo sapiens
caatggtttgcaa

SEQ ID NO: 118669 - DNA, 20 bp, Homo sapiens
caatggtttgcaaggaagcc

SEQ ID NO: 118670 - DNA, 17 bp, Homo sapiens
caattcttacaaacatg

SEQ ID NO: 118671 - DNA, 15 bp, Homo sapiens
cacaagagccccaaa

SEQ ID NO: 118672 - DNA, 20 bp, Homo sapiens
cacacagagcgcctcacctg

SEQ ID NO: 118673 - DNA, 23 bp, Homo sapiens
cacagagcgcctcacctgcatcc

SEQ ID NO: 118674 - DNA, 17 bp, Homo sapiens
cacagcactgcctgcca

SEQ ID NO: 118675 - DNA, 18 bp, Homo sapiens
cacagcactgcctgccaa

SEQ ID NO: 118676 - DNA, 21 bp, Homo sapiens
cacagcagcgcagccgagccc

SEQ ID NO: 118677 - DNA, 19 bp, Homo sapiens
cacagcccctggcactgca

SEQ ID NO: 118678 - DNA, 22 bp, Homo sapiens
cacagcccctggcactgcaggt

SEQ ID NO: 118679 - DNA, 21 bp, Homo sapiens
cacagtgactgggccctgtcc

SEQ ID NO: 118680 - DNA, 13 bp, Homo sapiens
caccacccccagt

SEQ ID NO: 118681 - DNA, 16 bp, Homo sapiens
caccatgttcccagct

SEQ ID NO: 118682 - DNA, 17 bp, Homo sapiens
caccatgttcccagctc

SEQ ID NO: 118683 - DNA, 13 bp, Homo sapiens
cgcctcacctgca

SEQ ID NO: 118684 - DNA, 15 bp, Homo sapiens
cgcctcacctgcatc

SEQ ID NO: 118685 - DNA, 16 bp, Homo sapiens
cgctgttccacagtga

SEQ ID NO: 118686 - DNA, 21 bp, Homo sapiens
cggacaccatgttcccagctc

SEQ ID NO: 118687 - DNA, 22 bp, Homo sapiens
cggatgtcccatctgctcctcc

SEQ ID NO: 118688 - DNA, 12 bp, Homo sapiens
cggcccagcctc

SEQ ID NO: 118689 - DNA, 18 bp, Homo sapiens
cggcccctcaccacctct

SEQ ID NO: 118690 - DNA, 11 bp, Homo sapiens
cggcccctgcc

SEQ ID NO: 118691 - DNA, 12 bp, Homo sapiens
cggctcccaccg

SEQ ID NO: 118692 - DNA, 23 bp, Homo sapiens
cgggcctctgcttgccagccagg

SEQ ID NO: 118693 - DNA, 18 bp, Homo sapiens
cggggcacacgggcctct

SEQ ID NO: 118694 - DNA, 22 bp, Homo sapiens
cggtgccaaacccagcccctgc

SEQ ID NO: 118695 - DNA, 13 bp, Homo sapiens
cgtaaccctcgcc

SEQ ID NO: 118696 - DNA, 21 bp, Homo sapiens
cgtaaccctcgccctgtccct

SEQ ID NO: 118697 - DNA, 18 bp, Homo sapiens
cgtgaagggcaccgagaa

SEQ ID NO: 118698 - DNA, 12 bp, Homo sapiens
cgtgccagcagc

SEQ ID NO: 118699 - DNA, 13 bp, Homo sapiens
cgtgccagcagcg

SEQ ID NO: 118700 - DNA, 16 bp, Homo sapiens
ctacaatttaaagcaa

SEQ ID NO: 118701 - DNA, 14 bp, Homo sapiens
ctaccgtgccagca

SEQ ID NO: 118702 - DNA, 15 bp, Homo sapiens
ctaccgtgccagcag

SEQ ID NO: 118703 - DNA, 16 bp, Homo sapiens
ctaccgtgccagcagc

SEQ ID NO: 118704 - DNA, 17 bp, Homo sapiens
ctaccgtgccagcagcg

SEQ ID NO: 118705 - DNA, 16 bp, Homo sapiens
ctactttgctccgtgg

SEQ ID NO: 118706 - DNA, 17 bp, Homo sapiens
ctagaaaacccttcccg

SEQ ID NO: 118707 - DNA, 22 bp, Homo sapiens
ctcaatattttccatgaaaatg

SEQ ID NO: 118708 - DNA, 22 bp, Homo sapiens
ctcaccacctctttctacagcc

SEQ ID NO: 118709 - DNA, 12 bp, Homo sapiens
ctcacctgcatc

SEQ ID NO: 118710 - DNA, 16 bp, Homo sapiens
ctcacctgcatcctct

SEQ ID NO: 118711 - DNA, 15 bp, Homo sapiens
ctcactccctgggaa

SEQ ID NO: 118712 - DNA, 12 bp, Homo sapiens
ctcagccctcgg

SEQ ID NO: 118713 - DNA, 14 bp, Homo sapiens
ctcagcttcatttc

SEQ ID NO: 118714 - DNA, 15 bp, Homo sapiens
ctcagcttcatttcc

SEQ ID NO: 118715 - DNA, 19 bp, Homo sapiens
ctcagcttcatttccgtga

SEQ ID NO: 118716 - DNA, 12 bp, Homo sapiens
ctcagtcctgga

SEQ ID NO: 118717 - DNA, 13 bp, Homo sapiens
ctcagtcctggaa

SEQ ID NO: 118718 - DNA, 14 bp, Homo sapiens
ctcagtgccaaaga

SEQ ID NO: 118719 - DNA, 18 bp, Homo sapiens
ctcagtgctcggcagtca

SEQ ID NO: 118720 - DNA, 17 bp, Homo sapiens
ctccagcggctgggtgg

SEQ ID NO: 118721 - DNA, 11 bp, Homo sapiens
ctccagctccc

SEQ ID NO: 118722 - DNA, 15 bp, Homo sapiens
ctcccaccggtgcca

SEQ ID NO: 118723 - DNA, 18 bp, Homo sapiens
ctcccaccggtgccaaac

SEQ ID NO: 118724 - DNA, 19 bp, Homo sapiens
gcctctgcttgccagccag

SEQ ID NO: 118725 - DNA, 16 bp, Homo sapiens
gcctggcccctcctcc

SEQ ID NO: 118726 - DNA, 17 bp, Homo sapiens
gcgagaatgcaggcccc

SEQ ID NO: 118727 - DNA, 20 bp, Homo sapiens
gcgagagaggtgggcagcag

SEQ ID NO: 118728 - DNA, 17 bp, Homo sapiens
gcgagatcgctggcaga

SEQ ID NO: 118729 - DNA, 18 bp, Homo sapiens
gcgagatcgctggcagag

SEQ ID NO: 118730 - DNA, 21 bp, Homo sapiens
gcgagatcgctggcagagaag

SEQ ID NO: 118731 - DNA, 12 bp, Homo sapiens
gcgcctcacctg

SEQ ID NO: 118732 - DNA, 23 bp, Homo sapiens
gcgcctgcccgagagagacccca

SEQ ID NO: 118733 - DNA, 16 bp, Homo sapiens
gcgctgttccacagtg

SEQ ID NO: 118734 - DNA, 22 bp, Homo sapiens
gctatttttatttgtttgtgca

SEQ ID NO: 118735 - DNA, 13 bp, Homo sapiens
gctcagcctcccc

SEQ ID NO: 118736 - DNA, 20 bp, Homo sapiens
gctcccaccggtgccaaacc

SEQ ID NO: 118737 - DNA, 13 bp, Homo sapiens
gctcccttcctga

SEQ ID NO: 118738 - DNA, 12 bp, Homo sapiens
gctcctcccatt

SEQ ID NO: 118739 - DNA, 16 bp, Homo sapiens
gctgagaaggacacct

SEQ ID NO: 118740 - DNA, 15 bp, Homo sapiens
gctgaggcaattcta

SEQ ID NO: 118741 - DNA, 14 bp, Homo sapiens
gctggccacacagc

SEQ ID NO: 118742 - DNA, 24 bp, Homo sapiens
gctgttccacagtgactgggccct

SEQ ID NO: 118743 - DNA, 11 bp, Homo sapiens
gcttgccagcc

SEQ ID NO: 118744 - DNA, 13 bp, Homo sapiens
gcttgccagccag

SEQ ID NO: 118745 - DNA, 20 bp, Homo sapiens
ggaaaaggcagggagcgagg

SEQ ID NO: 118746 - DNA, 22 bp, Homo sapiens
ggacaccatgttcccagctcag

SEQ ID NO: 118747 - DNA, 21 bp, Homo sapiens
ggagagggacgcacagcactg

SEQ ID NO: 118748 - DNA, 20 bp, Homo sapiens
ggagctgtctgcggagccag

SEQ ID NO: 118749 - DNA, 16 bp, Homo sapiens
ggaggtagctcccagc

SEQ ID NO: 118750 - DNA, 23 bp, Homo sapiens
ggatcaagaaggggacagcgcca

SEQ ID NO: 118751 - DNA, 13 bp, Homo sapiens
ggatgcagcatta

SEQ ID NO: 118752 - DNA, 21 bp, Homo sapiens
ggatgccataaaagccgccca

SEQ ID NO: 118753 - DNA, 20 bp, Homo sapiens
ggatgtcccatctgctcctc

SEQ ID NO: 118754 - DNA, 18 bp, Homo sapiens
ggcactgcaggtggcctc

SEQ ID NO: 118755 - DNA, 22 bp, Homo sapiens
ggcactgcaggtggcctccctc

SEQ ID NO: 118756 - DNA, 17 bp, Homo sapiens
ggcagagaaggcttcct

SEQ ID NO: 118757 - DNA, 23 bp, Homo sapiens
ggcccagcctctgagtcccgtgg

SEQ ID NO: 118758 - DNA, 12 bp, Homo sapiens
ggcccctgcccc

SEQ ID NO: 118759 - DNA, 16 bp, Homo sapiens
ggcccctgccccgccc

SEQ ID NO: 118760 - DNA, 12 bp, Homo sapiens
ggcctccctcca

SEQ ID NO: 118761 - DNA, 13 bp, Homo sapiens
ggcgacccctcag

SEQ ID NO: 118762 - DNA, 17 bp, Homo sapiens
ggctgtaaacagctctg

SEQ ID NO: 118763 - DNA, 17 bp, Homo sapiens
gggcaccacccccagtc

SEQ ID NO: 118764 - DNA, 18 bp, Homo sapiens
gggcaccacccccagtcc

SEQ ID NO: 118765 - DNA, 23 bp, Homo sapiens
gggcaccacccccagtcccccca

SEQ ID NO: 118766 - DNA, 21 bp, Homo sapiens
gggcaccgagaactcgaagcc

SEQ ID NO: 118767 - DNA, 13 bp, Homo sapiens
gggccctcagccc

SEQ ID NO: 118768 - DNA, 14 bp, Homo sapiens
gggccctcagccct

SEQ ID NO: 118769 - DNA, 12 bp, Homo sapiens
gggccctgtcca

SEQ ID NO: 118770 - DNA, 17 bp, Homo sapiens
gggcgacccctcagtgc

SEQ ID NO: 118771 - DNA, 12 bp, Homo sapiens
gggtcaaggaat

SEQ ID NO: 118772 - DNA, 22 bp, Homo sapiens
ggtctcagcttcatttccgtga

SEQ ID NO: 118773 - DNA, 13 bp, Homo sapiens
ggtggcctccctc

SEQ ID NO: 118774 - DNA, 17 bp, Homo sapiens
ggtggcctccctccaga

SEQ ID NO: 118775 - DNA, 16 bp, Homo sapiens
ggtgggcagcagctca

SEQ ID NO: 118776 - DNA, 13 bp, Homo sapiens
ggtttctgaaaat

SEQ ID NO: 118777 - DNA, 14 bp, Homo sapiens
ggtttgcaaggaag

SEQ ID NO: 118778 - DNA, 18 bp, Homo sapiens
gtaaccctcgccctgtcc

SEQ ID NO: 118779 - DNA, 12 bp, Homo sapiens
gtaccagctcac

SEQ ID NO: 118780 - DNA, 18 bp, Homo sapiens
gtaccagctcactccctg

SEQ ID NO: 118781 - DNA, 11 bp, Homo sapiens
gtacctcagtt

SEQ ID NO: 118782 - DNA, 14 bp, Homo sapiens
gtacgaacccctcc

SEQ ID NO: 118783 - DNA, 19 bp, Homo sapiens
gtacgaacccctcccctcc

SEQ ID NO: 118784 - DNA, 15 bp, Homo sapiens
gtactacaatttaaa

SEQ ID NO: 118785 - DNA, 18 bp, Homo sapiens
gtagaaagacagagctgg

SEQ ID NO: 118786 - DNA, 15 bp, Homo sapiens
gtataatatttttaa

SEQ ID NO: 118787 - DNA, 16 bp, Homo sapiens
gtcacacagagcgcct

SEQ ID NO: 118788 - DNA, 23 bp, Homo sapiens
gtcacacagagcgcctcacctgc

SEQ ID NO: 118789 - DNA, 17 bp, Homo sapiens
gtcaccagggggagctg

SEQ ID NO: 118790 - DNA, 13 bp, Homo sapiens
gtcaccccgccag

SEQ ID NO: 118791 - DNA, 18 bp, Homo sapiens
gtcaccccgccagcctac

SEQ ID NO: 118792 - DNA, 16 bp, Homo sapiens
gtcccatctgctcctc

SEQ ID NO: 118793 - DNA, 20 bp, Homo sapiens
gtcccatctgctcctcccat

SEQ ID NO: 118794 - DNA, 17 bp, Homo sapiens
gtccctcccactccctg

SEQ ID NO: 118795 - DNA, 18 bp, Homo sapiens
gtctgcggagccagcgcc

SEQ ID NO: 118796 - DNA, 17 bp, Homo sapiens
gtgaaggaccctggctc

SEQ ID NO: 118797 - DNA, 17 bp, Homo sapiens
gtgactgggccctgtcc

SEQ ID NO: 118798 - DNA, 22 bp, Homo sapiens
gtgatgctaaaggttgtattgc

SEQ ID NO: 118799 - DNA, 18 bp, Homo sapiens
gtgccaaacccagcccct

SEQ ID NO: 118800 - DNA, 16 bp, Homo sapiens
gtgcctttcccgggcc

SEQ ID NO: 118801 - DNA, 16 bp, Homo sapiens
tcaatattttccatga

SEQ ID NO: 118802 - DNA, 17 bp, Homo sapiens
tcaatattttccatgaa

SEQ ID NO: 118803 - DNA, 18 bp, Homo sapiens
tcaatattttccatgaaa

SEQ ID NO: 118804 - DNA, 18 bp, Homo sapiens
tcaatttccaagagctga

SEQ ID NO: 118805 - DNA, 20 bp, Homo sapiens
tcacatgaaggagacagcag

SEQ ID NO: 118806 - DNA, 16 bp, Homo sapiens
tcaccccgccagccta

SEQ ID NO: 118807 - DNA, 17 bp, Homo sapiens
tcaccccgccagcctac

SEQ ID NO: 118808 - DNA, 18 bp, Homo sapiens
tcacctgcatcctctccc

SEQ ID NO: 118809 - DNA, 16 bp, Homo sapiens
tcacttgaactcggga

SEQ ID NO: 118810 - DNA, 16 bp, Homo sapiens
tcagccaaggctcccg

SEQ ID NO: 118811 - DNA, 13 bp, Homo sapiens
tcagcctcccccc

SEQ ID NO: 118812 - DNA, 13 bp, Homo sapiens
tcatgtgcctgga

SEQ ID NO: 118813 - DNA, 22 bp, Homo sapiens
tccacagtgactgggccctgtc

SEQ ID NO: 118814 - DNA, 24 bp, Homo sapiens
tccacagtgactgggccctgtcca

SEQ ID NO: 118815 - DNA, 18 bp, Homo sapiens
tccagagactcgagtccc

SEQ ID NO: 118816 - DNA, 15 bp, Homo sapiens
tccagtggtaccagc

SEQ ID NO: 118817 - DNA, 18 bp, Homo sapiens
tccagtggtaccagctca

SEQ ID NO: 118818 - DNA, 19 bp, Homo sapiens
tccagtggtaccagctcac

SEQ ID NO: 118819 - DNA, 12 bp, Homo sapiens
tccatgaaaatg

SEQ ID NO: 118820 - DNA, 15 bp, Homo sapiens
tccatgaaaatgcaa

SEQ ID NO: 118821 - DNA, 15 bp, Homo sapiens
tcccagctcagtgcc

SEQ ID NO: 118822 - DNA, 18 bp, Homo sapiens
tcccagctcagtgccaaa

SEQ ID NO: 118823 - DNA, 18 bp, Homo sapiens
tccccatgattccctcct

SEQ ID NO: 118824 - DNA, 20 bp, Homo sapiens
tccccatgattccctcctcg

SEQ ID NO: 118825 - DNA, 22 bp, Homo sapiens
tcccccacaagagccccaaaga

SEQ ID NO: 118826 - DNA, 13 bp, Homo sapiens
tccccggcccctg

SEQ ID NO: 118827 - DNA, 14 bp, Homo sapiens
tccccggcccctgc

SEQ ID NO: 118828 - DNA, 15 bp, Homo sapiens
tcccgttccgtggga

SEQ ID NO: 118829 - DNA, 14 bp, Homo sapiens
tccctcccactccc

SEQ ID NO: 118830 - DNA, 16 bp, Homo sapiens
tccctgggggcgctgt

SEQ ID NO: 118831 - DNA, 23 bp, Homo sapiens
tccgtgaagggcaccgagaactc

SEQ ID NO: 118832 - DNA, 16 bp, Homo sapiens
tcctagaaaacccttc

SEQ ID NO: 118833 - DNA, 14 bp, Homo sapiens
tcctcagtcctgga

SEQ ID NO: 118834 - DNA, 16 bp, Homo sapiens
tcctcagtcctggaag

SEQ ID NO: 118835 - DNA, 18 bp, Homo sapiens
tcctgaccctccgctgca

SEQ ID NO: 118836 - DNA, 17 bp, Homo sapiens
tcgccctgtccctccca

SEQ ID NO: 118837 - DNA, 20 bp, Homo sapiens
tcgctggcagagaaggcttc

SEQ ID NO: 118838 - DNA, 14 bp, Homo sapiens
tcggcccctcacca

SEQ ID NO: 118839 - DNA, 18 bp, Homo sapiens
tcggcccctcaccacctc

SEQ ID NO: 118840 - DNA, 19 bp, Homo sapiens
tcggctgtaaacagctctg

SEQ ID NO: 118841 - DNA, 13 bp, Homo sapiens
tcgtagccatctc

SEQ ID NO: 118842 - DNA, 20 bp, Homo sapiens
tctcagcttcatttccgtga

SEQ ID NO: 118843 - DNA, 22 bp, Homo sapiens
tctcccccacaagagccccaaa

SEQ ID NO: 118844 - DNA, 17 bp, Homo sapiens
tctcggggcgacccctc

SEQ ID NO: 118845 - DNA, 18 bp, Homo sapiens
tctctcggggcgacccct

SEQ ID NO: 118846 - DNA, 22 bp, Homo sapiens
tctctcggggcgacccctcagt

SEQ ID NO: 118847 - DNA, 17 bp, Homo sapiens
tctgaaaattaacactg

SEQ ID NO: 118848 - DNA, 14 bp, Homo sapiens
tctgctcctcccat

SEQ ID NO: 118849 - DNA, 20 bp, Homo sapiens
tctgctcctcccattcccct

SEQ ID NO: 118850 - DNA, 19 bp, Homo sapiens
tctggaagtccccgggagc

SEQ ID NO: 118851 - DNA, 13 bp, Homo sapiens
tgaaggtttctga

SEQ ID NO: 118852 - DNA, 16 bp, Homo sapiens
tgaaggtttctgaaaa

SEQ ID NO: 118853 - DNA, 18 bp, Homo sapiens
tgaaggtttctgaaaatt

SEQ ID NO: 118854 - DNA, 16 bp, Homo sapiens
tgacagaacactgtct

SEQ ID NO: 118855 - DNA, 17 bp, Homo sapiens
tgacagaacactgtctt

SEQ ID NO: 118856 - DNA, 17 bp, Homo sapiens
tgactaccgtgccagca

SEQ ID NO: 118857 - DNA, 14 bp, Homo sapiens
tgactgggccctgt

SEQ ID NO: 118858 - DNA, 15 bp, Homo sapiens
tgactgggccctgtc

SEQ ID NO: 118859 - DNA, 23 bp, Homo sapiens
tgagttgacttgacagaacactg

SEQ ID NO: 118860 - DNA, 15 bp, Homo sapiens
tgcaacaacatgtat

SEQ ID NO: 118861 - DNA, 19 bp, Homo sapiens
tgcaaggaagccacagctg

SEQ ID NO: 118862 - DNA, 22 bp, Homo sapiens
tgcacgcaccccgcccctgcat

SEQ ID NO: 118863 - DNA, 21 bp, Homo sapiens
tgcaggtggcctccctccaga

SEQ ID NO: 118864 - DNA, 18 bp, Homo sapiens
tgcatgaaggtttctgaa

SEQ ID NO: 118865 - DNA, 17 bp, Homo sapiens
tgcatgcctggcccctc

SEQ ID NO: 118866 - DNA, 15 bp, Homo sapiens
tgccaaacccagccc

SEQ ID NO: 118867 - DNA, 17 bp, Homo sapiens
tgccaaacccagcccct

SEQ ID NO: 118868 - DNA, 13 bp, Homo sapiens
tgccagccaggag

SEQ ID NO: 118869 - DNA, 22 bp, Homo sapiens
tgccataaaagccgcccagtgg

SEQ ID NO: 118870 - DNA, 21 bp, Homo sapiens
tgcctttcccgggccctcagc

SEQ ID NO: 118871 - DNA, 24 bp, Homo sapiens
tgcgagagaggtgggcagcagctc

SEQ ID NO: 118872 - DNA, 22 bp, Homo sapiens
tgcgagatcgctggcagagaag

SEQ ID NO: 118873 - DNA, 23 bp, Homo sapiens
tgcggacaccatgttcccagctc

SEQ ID NO: 118874 - DNA, 21 bp, Homo sapiens
tgcggagccagcgcctgcccg

SEQ ID NO: 118875 - DNA, 16 bp, Homo sapiens
gcaggccccgccccct

SEQ ID NO: 118876 - DNA, 16 bp, Homo sapiens
gcatcctctcccccac

SEQ ID NO: 118877 - DNA, 19 bp, Homo sapiens
gcatgcctggcccctcctc

SEQ ID NO: 118878 - DNA, 13 bp, Homo sapiens
gccaaacccagcc

SEQ ID NO: 118879 - DNA, 15 bp, Homo sapiens
gccaaacccagcccc

SEQ ID NO: 118880 - DNA, 22 bp, Homo sapiens
gccaagcgagaatgcaggcccc

SEQ ID NO: 118881 - DNA, 23 bp, Homo sapiens
gccaataaatcaactccagctcc

SEQ ID NO: 118882 - DNA, 13 bp, Homo sapiens
gccacacagcagc

SEQ ID NO: 118883 - DNA, 12 bp, Homo sapiens
gccacagcccct

SEQ ID NO: 118884 - DNA, 16 bp, Homo sapiens
gccacagcccctggca

SEQ ID NO: 118885 - DNA, 21 bp, Homo sapiens
gccacagcccctggcactgca

SEQ ID NO: 118886 - DNA, 19 bp, Homo sapiens
gccactgcactccagtctg

SEQ ID NO: 118887 - DNA, 20 bp, Homo sapiens
gccagccgggtacctcagtt

SEQ ID NO: 118888 - DNA, 16 bp, Homo sapiens
gccagcctacactgcc

SEQ ID NO: 118889 - DNA, 13 bp, Homo sapiens
gccagcgcctgcc

SEQ ID NO: 118890 - DNA, 15 bp, Homo sapiens
gccagcgcctgcccg

SEQ ID NO: 118891 - DNA, 17 bp, Homo sapiens
gcccagcctctgagtcc

SEQ ID NO: 118892 - DNA, 18 bp, Homo sapiens
gcccagtgctggccacac

SEQ ID NO: 118893 - DNA, 20 bp, Homo sapiens
gcccagtgggacccacagtc

SEQ ID NO: 118894 - DNA, 17 bp, Homo sapiens
gccccctcggcccctca

SEQ ID NO: 118895 - DNA, 22 bp, Homo sapiens
gccccgccccctcggcccctca

SEQ ID NO: 118896 - DNA, 17 bp, Homo sapiens
gccctcgggccgggcac

SEQ ID NO: 118897 - DNA, 23 bp, Homo sapiens
gccctcgggccgggcaccacccc

SEQ ID NO: 118898 - DNA, 14 bp, Homo sapiens
gccctgtccagggc

SEQ ID NO: 118899 - DNA, 15 bp, Homo sapiens
gccctgtccagggca

SEQ ID NO: 118900 - DNA, 16 bp, Homo sapiens
gccctgtccctcccac

SEQ ID NO: 118901 - DNA, 21 bp, Homo sapiens
gccctgtccctcccactccct

SEQ ID NO: 118902 - DNA, 12 bp, Homo sapiens
gcccttccagtg

SEQ ID NO: 118903 - DNA, 16 bp, Homo sapiens
gccgagccccaggagc

SEQ ID NO: 118904 - DNA, 19 bp, Homo sapiens
gccgggacatgcagctctg

SEQ ID NO: 118905 - DNA, 16 bp, Homo sapiens
gcctacactgccagcc

SEQ ID NO: 118906 - DNA, 13 bp, Homo sapiens
gcctcacctgcat

SEQ ID NO: 118907 - DNA, 21 bp, Homo sapiens
gcctcacctgcatcctctccc

SEQ ID NO: 118908 - DNA, 12 bp, Homo sapiens
gcctccctccag

SEQ ID NO: 118909 - DNA, 16 bp, Homo sapiens
gcctctgcttgccagc

SEQ ID NO: 118910 - DNA, 20 bp, Homo sapiens
gcctctgcttgccagccagg

SEQ ID NO: 118911 - DNA, 13 bp, Homo sapiens
gcgaaagtttctt

SEQ ID NO: 118912 - DNA, 14 bp, Homo sapiens
gcgacccctcagtg

SEQ ID NO: 118913 - DNA, 22 bp, Homo sapiens
gcgagaatgcaggccccgcccc

SEQ ID NO: 118914 - DNA, 19 bp, Homo sapiens
gcgagagaggtgggcagca

SEQ ID NO: 118915 - DNA, 13 bp, Homo sapiens
gcggacaccatgt

SEQ ID NO: 118916 - DNA, 23 bp, Homo sapiens
gcggacaccatgttcccagctca

SEQ ID NO: 118917 - DNA, 16 bp, Homo sapiens
gcggagccagcgcctg

SEQ ID NO: 118918 - DNA, 17 bp, Homo sapiens
gcggagccagcgcctgc

SEQ ID NO: 118919 - DNA, 19 bp, Homo sapiens
gctatccagctatttttat

SEQ ID NO: 118920 - DNA, 14 bp, Homo sapiens
gctcagtgccaaag

SEQ ID NO: 118921 - DNA, 13 bp, Homo sapiens
gctgagttggtgt

SEQ ID NO: 118922 - DNA, 13 bp, Homo sapiens
gctggggagcgaa

SEQ ID NO: 118923 - DNA, 16 bp, Homo sapiens
gctgtaaacagctctg

SEQ ID NO: 118924 - DNA, 14 bp, Homo sapiens
gcttgccagccagg

SEQ ID NO: 118925 - DNA, 21 bp, Homo sapiens
ggaagttttgtggaggagctc

SEQ ID NO: 118926 - DNA, 15 bp, Homo sapiens
ggacatgcagctctg

SEQ ID NO: 118927 - DNA, 23 bp, Homo sapiens
ggacgcacagcactgcctgccaa

SEQ ID NO: 118928 - DNA, 19 bp, Homo sapiens
ggagagggacgcacagcac

SEQ ID NO: 118929 - DNA, 18 bp, Homo sapiens
ggagccagcgcctgcccg

SEQ ID NO: 118930 - DNA, 16 bp, Homo sapiens
ggagggtggcgccctg

SEQ ID NO: 118931 - DNA, 19 bp, Homo sapiens
ggaggtggaggttgcagtg

SEQ ID NO: 118932 - DNA, 20 bp, Homo sapiens
ggaggtggaggttgcagtga

SEQ ID NO: 118933 - DNA, 14 bp, Homo sapiens
ggcaagagtgagac

SEQ ID NO: 118934 - DNA, 16 bp, Homo sapiens
ggcaccacccccagtc

SEQ ID NO: 118935 - DNA, 22 bp, Homo sapiens
ggcaccacccccagtcccccca

SEQ ID NO: 118936 - DNA, 23 bp, Homo sapiens
ggccaatgtgactaccgtgccag

SEQ ID NO: 118937 - DNA, 13 bp, Homo sapiens
ggcccagcctctg

SEQ ID NO: 118938 - DNA, 16 bp, Homo sapiens
ggcccagtgctggcca

SEQ ID NO: 118939 - DNA, 22 bp, Homo sapiens
ggccccgccccctcggcccctc

SEQ ID NO: 118940 - DNA, 16 bp, Homo sapiens
ggccccggctcccacc

SEQ ID NO: 118941 - DNA, 18 bp, Homo sapiens
ggccgggcaccaccccca

SEQ ID NO: 118942 - DNA, 22 bp, Homo sapiens
ggccgtcaccccgccagcctac

SEQ ID NO: 118943 - DNA, 17 bp, Homo sapiens
ggcctctgcttgccagc

SEQ ID NO: 118944 - DNA, 18 bp, Homo sapiens
ggcctctgcttgccagcc

SEQ ID NO: 118945 - DNA, 21 bp, Homo sapiens
ggcctctgcttgccagccagg

SEQ ID NO: 118946 - DNA, 15 bp, Homo sapiens
ggcgacccctcagtg

SEQ ID NO: 118947 - DNA, 18 bp, Homo sapiens
ggcgacccctcagtgctc

SEQ ID NO: 118948 - DNA, 15 bp, Homo sapiens
ggcggcccagcctct

SEQ ID NO: 118949 - DNA, 20 bp, Homo sapiens
ggctcccaccggtgccaaac

SEQ ID NO: 118950 - DNA, 12 bp, Homo sapiens
gggacccacagt

SEQ ID NO: 118951 - DNA, 22 bp, Homo sapiens
gggacgcacagcactgcctgcc

SEQ ID NO: 118952 - DNA, 14 bp, Homo sapiens
gggccctgtccagg

SEQ ID NO: 118953 - DNA, 17 bp, Homo sapiens
gggccgggcaccacccc

SEQ ID NO: 118954 - DNA, 22 bp, Homo sapiens
gggcggcccagcctctgagtcc

SEQ ID NO: 118955 - DNA, 18 bp, Homo sapiens
ggggccccggctcccacc

SEQ ID NO: 118956 - DNA, 20 bp, Homo sapiens
ggggcgacccctcagtgctc

SEQ ID NO: 118957 - DNA, 22 bp, Homo sapiens
ggggtgcgagagaggtgggcag

SEQ ID NO: 118958 - DNA, 23 bp, Homo sapiens
gggtgcgagagaggtgggcagca

SEQ ID NO: 118959 - DNA, 21 bp, Homo sapiens
gggttgtcaagagagagtcaa

SEQ ID NO: 118960 - DNA, 14 bp, Homo sapiens
ggtaccagctcact

SEQ ID NO: 118961 - DNA, 16 bp, Homo sapiens
ggtacctcagtttctc

SEQ ID NO: 118962 - DNA, 20 bp, Homo sapiens
ggtacctcagtttctccttt

SEQ ID NO: 118963 - DNA, 19 bp, Homo sapiens
ggtcagccaaggctcccgt

SEQ ID NO: 118964 - DNA, 11 bp, Homo sapiens
ggtctcagctt

SEQ ID NO: 118965 - DNA, 15 bp, Homo sapiens
ggtctcagcttcatt

SEQ ID NO: 118966 - DNA, 10 bp, Homo sapiens
ggtgccaaac

SEQ ID NO: 118967 - DNA, 16 bp, Homo sapiens
ggtggcctccctccag

SEQ ID NO: 118968 - DNA, 14 bp, Homo sapiens
ggtggcgccctgcg

SEQ ID NO: 118969 - DNA, 14 bp, Homo sapiens
ggtgggcagcagct

SEQ ID NO: 118970 - DNA, 19 bp, Homo sapiens
ggtgggcagcagctcagcc

SEQ ID NO: 118971 - DNA, 23 bp, Homo sapiens
gtaaccctcgccctgtccctccc

SEQ ID NO: 118972 - DNA, 12 bp, Homo sapiens
gtacctcagttt

SEQ ID NO: 118973 - DNA, 17 bp, Homo sapiens
gtacctcagtttctcct

SEQ ID NO: 118974 - DNA, 12 bp, Homo sapiens
gtagccatctcc

SEQ ID NO: 118975 - DNA, 12 bp, Homo sapiens
gtataatatttt

SEQ ID NO: 118976 - DNA, 14 bp, Homo sapiens
gtcaccccgccagc

SEQ ID NO: 118977 - DNA, 16 bp, Homo sapiens
gtcaccccgccagcct

SEQ ID NO: 118978 - DNA, 21 bp, Homo sapiens
gtcaggccacagcccctggca

SEQ ID NO: 118979 - DNA, 22 bp, Homo sapiens
gtcaggccacagcccctggcac

SEQ ID NO: 118980 - DNA, 13 bp, Homo sapiens
gtccatcccctga

SEQ ID NO: 118981 - DNA, 19 bp, Homo sapiens
gtccccatgattccctcct

SEQ ID NO: 118982 - DNA, 13 bp, Homo sapiens
gtccctcccactc

SEQ ID NO: 118983 - DNA, 18 bp, Homo sapiens
gtccctcccactccctgg

SEQ ID NO: 118984 - DNA, 12 bp, Homo sapiens
gtctcagcttca

SEQ ID NO: 118985 - DNA, 13 bp, Homo sapiens
gtgaagggcaccg

SEQ ID NO: 118986 - DNA, 14 bp, Homo sapiens
gtgaagggcaccga

SEQ ID NO: 118987 - DNA, 17 bp, Homo sapiens
gtgactaccgtgccagc

SEQ ID NO: 118988 - DNA, 21 bp, Homo sapiens
gtgactaccgtgccagcagcg

SEQ ID NO: 118989 - DNA, 22 bp, Homo sapiens
gtgcatgaaggtttctgaaaat

SEQ ID NO: 118990 - DNA, 23 bp, Homo sapiens
gtgccaaacccagcccctgcggc

SEQ ID NO: 118991 - DNA, 22 bp, Homo sapiens
gtgcctttcccgggccctcagc

SEQ ID NO: 118992 - DNA, 23 bp, Homo sapiens
gtgctgagttggtgttgacatgt

SEQ ID NO: 118993 - DNA, 17 bp, Homo sapiens
gtggaggttgcagtgag

SEQ ID NO: 118994 - DNA, 15 bp, Homo sapiens
gtggcctccctccag

SEQ ID NO: 118995 - DNA, 14 bp, Homo sapiens
gtggggccccggct

SEQ ID NO: 118996 - DNA, 21 bp, Homo sapiens
gtggggccccggctcccaccg

SEQ ID NO: 118997 - DNA, 13 bp, Homo sapiens
gtggtaccagctc

SEQ ID NO: 118998 - DNA, 22 bp, Homo sapiens
gtggtaccagctcactccctgg

SEQ ID NO: 118999 - DNA, 13 bp, Homo sapiens
gttagggaatggc

SEQ ID NO: 119000 - DNA, 20 bp, Homo sapiens
gttcccagctcagtgccaaa

SEQ ID NO: 119001 - DNA, 16 bp, Homo sapiens
gttgcagtgagctgag

SEQ ID NO: 119002 - DNA, 16 bp, Homo sapiens
gttgtcaagagagagt

SEQ ID NO: 119003 - DNA, 21 bp, Homo sapiens
gtttctgaaaattaacactgc

SEQ ID NO: 119004 - DNA, 17 bp, Homo sapiens
gtttgaatataaacact

SEQ ID NO: 119005 - DNA, 13 bp, Homo sapiens
gtttgcaaggaag

SEQ ID NO: 119006 - DNA, 14 bp, Homo sapiens
gtttgcaaggaagc

SEQ ID NO: 119007 - DNA, 17 bp, Homo sapiens
gtttgcaaggaagccac

SEQ ID NO: 119008 - DNA, 22 bp, Homo sapiens
gtttgcaaggaagccacagctg

SEQ ID NO: 119009 - DNA, 19 bp, Homo sapiens
gttttgtggaggagctcag

SEQ ID NO: 119010 - DNA, 19 bp, Homo sapiens
gtttttaactcaatatttt

SEQ ID NO: 119011 - DNA, 20 bp, Homo sapiens
taaaccctgccccacttctc

SEQ ID NO: 119012 - DNA, 20 bp, Homo sapiens
tcatttgctaactagcttgg

SEQ ID NO: 119013 - DNA, 23 bp, Homo sapiens
tccacagtgactgggccctgtcc

SEQ ID NO: 119014 - DNA, 18 bp, Homo sapiens
tccactttcagtgaaagc

SEQ ID NO: 119015 - DNA, 16 bp, Homo sapiens
tccagtggtaccagct

SEQ ID NO: 119016 - DNA, 23 bp, Homo sapiens
tccagtggtaccagctcactccc

SEQ ID NO: 119017 - DNA, 15 bp, Homo sapiens
tcccactccctgggg

SEQ ID NO: 119018 - DNA, 13 bp, Homo sapiens
tcccatctgctcc

SEQ ID NO: 119019 - DNA, 20 bp, Homo sapiens
tcccatctgctcctcccatt

SEQ ID NO: 119020 - DNA, 15 bp, Homo sapiens
tcccattccccttaa

SEQ ID NO: 119021 - DNA, 15 bp, Homo sapiens
tccccgcagagctcc

SEQ ID NO: 119022 - DNA, 23 bp, Homo sapiens
tccccgcagagctcccttcctga

SEQ ID NO: 119023 - DNA, 16 bp, Homo sapiens
tccccggcccctgccc

SEQ ID NO: 119024 - DNA, 18 bp, Homo sapiens
aaaatgcaacaacatgta

SEQ ID NO: 119025 - DNA, 11 bp, Homo sapiens
aaacccagccc

SEQ ID NO: 119026 - DNA, 14 bp, Homo sapiens
aaagacagagctgg

SEQ ID NO: 119027 - DNA, 21 bp, Homo sapiens
aaagccgcccagtgggaccca

SEQ ID NO: 119028 - DNA, 10 bp, Homo sapiens
aaagtttctt

SEQ ID NO: 119029 - DNA, 16 bp, Homo sapiens
aaatgcaacaacatgt

SEQ ID NO: 119030 - DNA, 18 bp, Homo sapiens
aaatgtatgattacatca

SEQ ID NO: 119031 - DNA, 12 bp, Homo sapiens
aaattaacactg

SEQ ID NO: 119032 - DNA, 13 bp, Homo sapiens
aaattaacactgc

SEQ ID NO: 119033 - DNA, 21 bp, Homo sapiens
aaattaacactgcttgtgttt

SEQ ID NO: 119034 - DNA, 14 bp, Homo sapiens
aacactatatggca

SEQ ID NO: 119035 - DNA, 18 bp, Homo sapiens
aacactatatggcagtgt

SEQ ID NO: 119036 - DNA, 20 bp, Homo sapiens
aacactatatggcagtgtct

SEQ ID NO: 119037 - DNA, 21 bp, Homo sapiens
aacactatatggcagtgtctt

SEQ ID NO: 119038 - DNA, 17 bp, Homo sapiens
aacatgtataatatttt

SEQ ID NO: 119039 - DNA, 14 bp, Homo sapiens
aaccaacctccccg

SEQ ID NO: 119040 - DNA, 15 bp, Homo sapiens
aaccctcgccctgtc

SEQ ID NO: 119041 - DNA, 21 bp, Homo sapiens
aaccgtccccggcccctgccc

SEQ ID NO: 119042 - DNA, 22 bp, Homo sapiens
aaccgtccccggcccctgcccc

SEQ ID NO: 119043 - DNA, 21 bp, Homo sapiens
aactcaatattttccatgaaa

SEQ ID NO: 119044 - DNA, 23 bp, Homo sapiens
aagacaatggcttactccaggag

SEQ ID NO: 119045 - DNA, 15 bp, Homo sapiens
aagacagagctggga

SEQ ID NO: 119046 - DNA, 23 bp, Homo sapiens
aagaccccatggtccatcccctg

SEQ ID NO: 119047 - DNA, 22 bp, Homo sapiens
aaggaagccacagctggtggta

SEQ ID NO: 119048 - DNA, 16 bp, Homo sapiens
aaggtttctgaaaatt

SEQ ID NO: 119049 - DNA, 13 bp, Homo sapiens
aatataaacacta

SEQ ID NO: 119050 - DNA, 21 bp, Homo sapiens
aatattttccatgaaaatgca

SEQ ID NO: 119051 - DNA, 17 bp, Homo sapiens
aatgatcttttcaagtt

SEQ ID NO: 119052 - DNA, 18 bp, Homo sapiens
aatgcaacaacatgtata

SEQ ID NO: 119053 - DNA, 20 bp, Homo sapiens
aatgcaggccccgccccctc

SEQ ID NO: 119054 - DNA, 18 bp, Homo sapiens
aatgtgactaccgtgcca

SEQ ID NO: 119055 - DNA, 21 bp, Homo sapiens
aatgtgactaccgtgccagca

SEQ ID NO: 119056 - DNA, 23 bp, Homo sapiens
aattaaaccctgccccacttctc

SEQ ID NO: 119057 - DNA, 22 bp, Homo sapiens
aattaagttagggaatggcaca

SEQ ID NO: 119058 - DNA, 14 bp, Homo sapiens
aattctaacttttt

SEQ ID NO: 119059 - DNA, 21 bp, Homo sapiens
aatttgatagtattgtgcata

SEQ ID NO: 119060 - DNA, 19 bp, Homo sapiens
acaaacatgtggttaatgc

SEQ ID NO: 119061 - DNA, 22 bp, Homo sapiens
acaacatgtataatatttttaa

SEQ ID NO: 119062 - DNA, 13 bp, Homo sapiens
acaatttaaagca

SEQ ID NO: 119063 - DNA, 18 bp, Homo sapiens
acaccatgttcccagctc

SEQ ID NO: 119064 - DNA, 23 bp, Homo sapiens
acacctccttcctcagtcctgga

SEQ ID NO: 119065 - DNA, 23 bp, Homo sapiens
acacgggcctctgcttgccagcc

SEQ ID NO: 119066 - DNA, 18 bp, Homo sapiens
acagcccaaagaaggaaa

SEQ ID NO: 119067 - DNA, 12 bp, Homo sapiens
acagcccctggc

SEQ ID NO: 119068 - DNA, 13 bp, Homo sapiens
acagcccctggca

SEQ ID NO: 119069 - DNA, 13 bp, Homo sapiens
acagtcacacaga

SEQ ID NO: 119070 - DNA, 15 bp, Homo sapiens
acagtgactgggccc

SEQ ID NO: 119071 - DNA, 19 bp, Homo sapiens
acatgaaggagacagcagc

SEQ ID NO: 119072 - DNA, 16 bp, Homo sapiens
acatgcagctctgatg

SEQ ID NO: 119073 - DNA, 20 bp, Homo sapiens
acatgtataatatttttaat

SEQ ID NO: 119074 - DNA, 15 bp, Homo sapiens
accaacctccccgca

SEQ ID NO: 119075 - DNA, 14 bp, Homo sapiens
accacccccagtcc

SEQ ID NO: 119076 - DNA, 14 bp, Homo sapiens
accagctcactccc

SEQ ID NO: 119077 - DNA, 23 bp, Homo sapiens
accatgttcccagctcagtgcca

SEQ ID NO: 119078 - DNA, 18 bp, Homo sapiens
accattatgaagaagaga

SEQ ID NO: 119079 - DNA, 13 bp, Homo sapiens
acccagcccctgc

SEQ ID NO: 119080 - DNA, 18 bp, Homo sapiens
acccatgcacgcaccccg

SEQ ID NO: 119081 - DNA, 14 bp, Homo sapiens
accccaccgccacc

SEQ ID NO: 119082 - DNA, 17 bp, Homo sapiens
accccatggtccatccc

SEQ ID NO: 119083 - DNA, 13 bp, Homo sapiens
acccccagtcccc

SEQ ID NO: 119084 - DNA, 15 bp, Homo sapiens
accccgccagcctac

SEQ ID NO: 119085 - DNA, 15 bp, Homo sapiens
accccgcccctgcat

SEQ ID NO: 119086 - DNA, 19 bp, Homo sapiens
accccgcccctgcatgcct

SEQ ID NO: 119087 - DNA, 14 bp, Homo sapiens
acccctcagtgctc

SEQ ID NO: 119088 - DNA, 15 bp, Homo sapiens
acccctcagtgctcg

SEQ ID NO: 119089 - DNA, 15 bp, Homo sapiens
acccctcccctcccc

SEQ ID NO: 119090 - DNA, 17 bp, Homo sapiens
acccctcccctcccccc

SEQ ID NO: 119091 - DNA, 18 bp, Homo sapiens
accctcgccctgtccctc

SEQ ID NO: 119092 - DNA, 21 bp, Homo sapiens
accctcgccctgtccctccca

SEQ ID NO: 119093 - DNA, 19 bp, Homo sapiens
acccttcccgccctcggga

SEQ ID NO: 119094 - DNA, 18 bp, Homo sapiens
accgtccccggcccctgc

SEQ ID NO: 119095 - DNA, 19 bp, Homo sapiens
accgtccccggcccctgcc

SEQ ID NO: 119096 - DNA, 12 bp, Homo sapiens
accgtgccagca

SEQ ID NO: 119097 - DNA, 13 bp, Homo sapiens
accgtgccagcag

SEQ ID NO: 119098 - DNA, 16 bp, Homo sapiens
accgtgtgcctttccc

SEQ ID NO: 119099 - DNA, 23 bp, Homo sapiens
acctccttcctcagtcctggaag

SEQ ID NO: 119100 - DNA, 11 bp, Homo sapiens
acgcacagcac

SEQ ID NO: 119101 - DNA, 20 bp, Homo sapiens
acgcaccccgcccctgcatg

SEQ ID NO: 119102 - DNA, 22 bp, Homo sapiens
acgggcctctgcttgccagcca

SEQ ID NO: 119103 - DNA, 17 bp, Homo sapiens
actacaatttaaagcaa

SEQ ID NO: 119104 - DNA, 18 bp, Homo sapiens
actcaatattttccatga

SEQ ID NO: 119105 - DNA, 16 bp, Homo sapiens
actcacatggctatgt

SEQ ID NO: 119106 - DNA, 19 bp, Homo sapiens
actcacatggctatgtttt

SEQ ID NO: 119107 - DNA, 20 bp, Homo sapiens
actcacatggctatgtttta

SEQ ID NO: 119108 - DNA, 17 bp, Homo sapiens
actcgaagcccttccag

SEQ ID NO: 119109 - DNA, 18 bp, Homo sapiens
actcgaagcccttccagt

SEQ ID NO: 119110 - DNA, 11 bp, Homo sapiens
actctggaagt

SEQ ID NO: 119111 - DNA, 20 bp, Homo sapiens
actgcaggtggcctccctcc

SEQ ID NO: 119112 - DNA, 16 bp, Homo sapiens
actgcttgtgttttta

SEQ ID NO: 119113 - DNA, 14 bp, Homo sapiens
actgggccctgtcc

SEQ ID NO: 119114 - DNA, 15 bp, Homo sapiens
actgggccctgtcca

SEQ ID NO: 119115 - DNA, 17 bp, Homo sapiens
acttgacagaacactgt

SEQ ID NO: 119116 - DNA, 16 bp, Homo sapiens
actttgctccgtggag

SEQ ID NO: 119117 - DNA, 18 bp, Homo sapiens
agaactcgaagcccttcc

SEQ ID NO: 119118 - DNA, 23 bp, Homo sapiens
agaactcgaagcccttccagtgg

SEQ ID NO: 119119 - DNA, 21 bp, Homo sapiens
agaagaaggcagcaggtggca

SEQ ID NO: 119120 - DNA, 22 bp, Homo sapiens
agaagagagtccatatttcaat

SEQ ID NO: 119121 - DNA, 21 bp, Homo sapiens
agaaggcttcctccagcggct

SEQ ID NO: 119122 - DNA, 14 bp, Homo sapiens
agaccccaccgcca

SEQ ID NO: 119123 - DNA, 20 bp, Homo sapiens
agaccccatggtccatcccc

SEQ ID NO: 119124 - DNA, 17 bp, Homo sapiens
agactcgagtccccatg

SEQ ID NO: 119125 - DNA, 16 bp, Homo sapiens
agagactcgagtcccc

SEQ ID NO: 119126 - DNA, 12 bp, Homo sapiens
agagagacccca

SEQ ID NO: 119127 - DNA, 18 bp, Homo sapiens
agaggtgggcagcagctc

SEQ ID NO: 119128 - DNA, 17 bp, Homo sapiens
agcccctggcactgcag

SEQ ID NO: 119129 - DNA, 19 bp, Homo sapiens
agcccgtcaggccacagcc

SEQ ID NO: 119130 - DNA, 14 bp, Homo sapiens
agcccttccagtgg

SEQ ID NO: 119131 - DNA, 12 bp, Homo sapiens
agccgagcccca

SEQ ID NO: 119132 - DNA, 14 bp, Homo sapiens
agccgagccccagg

SEQ ID NO: 119133 - DNA, 22 bp, Homo sapiens
agcctaatttattggattccct

SEQ ID NO: 119134 - DNA, 15 bp, Homo sapiens
agcctacactgccag

SEQ ID NO: 119135 - DNA, 16 bp, Homo sapiens
agcctacactgccagc

SEQ ID NO: 119136 - DNA, 17 bp, Homo sapiens
agcctacactgccagcc

SEQ ID NO: 119137 - DNA, 18 bp, Homo sapiens
agcctctccttgcctggt

SEQ ID NO: 119138 - DNA, 22 bp, Homo sapiens
agcgcagccgagccccaggagc

SEQ ID NO: 119139 - DNA, 19 bp, Homo sapiens
agcgcctcacctgcatcct

SEQ ID NO: 119140 - DNA, 12 bp, Homo sapiens
agcgcctgcccg

SEQ ID NO: 119141 - DNA, 19 bp, Homo sapiens
agcgggggcggcccagcct

SEQ ID NO: 119142 - DNA, 14 bp, Homo sapiens
agctcactccctgg

SEQ ID NO: 119143 - DNA, 12 bp, Homo sapiens
agctcagtgcca

SEQ ID NO: 119144 - DNA, 17 bp, Homo sapiens
agctcccagcactcaac

SEQ ID NO: 119145 - DNA, 16 bp, Homo sapiens
agctcggatcacatga

SEQ ID NO: 119146 - DNA, 20 bp, Homo sapiens
agctgtctgcggagccagcg

SEQ ID NO: 119147 - DNA, 20 bp, Homo sapiens
agcttcatttccgtgaaggg

SEQ ID NO: 119148 - DNA, 14 bp, Homo sapiens
aggaggtagctccc

SEQ ID NO: 119149 - DNA, 19 bp, Homo sapiens
aggctcccgttccgtggga

SEQ ID NO: 119150 - DNA, 23 bp, Homo sapiens
aggcttaattctgagctggccct

SEQ ID NO: 119151 - DNA, 15 bp, Homo sapiens
agggaatggcacagc

SEQ ID NO: 119152 - DNA, 17 bp, Homo sapiens
agggacgcacagcactg

SEQ ID NO: 119153 - DNA, 22 bp, Homo sapiens
agggacgcacagcactgcctgc

SEQ ID NO: 119154 - DNA, 16 bp, Homo sapiens
aggggagagggacgca

SEQ ID NO: 119155 - DNA, 16 bp, Homo sapiens
agggtggcgccctgcg

SEQ ID NO: 119156 - DNA, 20 bp, Homo sapiens
aggtatgaccttctaggaag

SEQ ID NO: 119157 - DNA, 22 bp, Homo sapiens
aggtatgaccttctaggaagct

SEQ ID NO: 119158 - DNA, 23 bp, Homo sapiens
aggtatgaccttctaggaagctc

SEQ ID NO: 119159 - DNA, 16 bp, Homo sapiens
aggtggcctccctcca

SEQ ID NO: 119160 - DNA, 22 bp, Homo sapiens
agtcccgtggggccccggctcc

SEQ ID NO: 119161 - DNA, 23 bp, Homo sapiens
agtcctctactttgctccgtgga

SEQ ID NO: 119162 - DNA, 16 bp, Homo sapiens
agtgactgggccctgt

SEQ ID NO: 119163 - DNA, 17 bp, Homo sapiens
agtgactgggccctgtc

SEQ ID NO: 119164 - DNA, 14 bp, Homo sapiens
agtggtaccagctc

SEQ ID NO: 119165 - DNA, 15 bp, Homo sapiens
agtggtaccagctca

SEQ ID NO: 119166 - DNA, 18 bp, Homo sapiens
agtggtaccagctcactc

SEQ ID NO: 119167 - DNA, 22 bp, Homo sapiens
agttgacttgacagaacactgt

SEQ ID NO: 119168 - DNA, 14 bp, Homo sapiens
ataaaagccgccca

SEQ ID NO: 119169 - DNA, 14 bp, Homo sapiens
ataatatttttaat

SEQ ID NO: 119170 - DNA, 15 bp, Homo sapiens
atataaacactatat

SEQ ID NO: 119171 - DNA, 14 bp, Homo sapiens
atatttacgtatga

SEQ ID NO: 119172 - DNA, 16 bp, Homo sapiens
atattttccatgaaaa

SEQ ID NO: 119173 - DNA, 16 bp, Homo sapiens
atcaactccagctccc

SEQ ID NO: 119174 - DNA, 22 bp, Homo sapiens
atcacatgaaggagacagcagc

SEQ ID NO: 119175 - DNA, 16 bp, Homo sapiens
atcatgtgcctggaaa

SEQ ID NO: 119176 - DNA, 20 bp, Homo sapiens
atgaaaatgcaacaacatgt

SEQ ID NO: 119177 - DNA, 14 bp, Homo sapiens
atgattccctcctc

SEQ ID NO: 119178 - DNA, 21 bp, Homo sapiens
atgcaacaacatgtataatat

SEQ ID NO: 119179 - DNA, 14 bp, Homo sapiens
atgcacgcaccccg

SEQ ID NO: 119180 - DNA, 22 bp, Homo sapiens
atgcacgcaccccgcccctgca

SEQ ID NO: 119181 - DNA, 18 bp, Homo sapiens
atgccatggacagaagaa

SEQ ID NO: 119182 - DNA, 12 bp, Homo sapiens
atgcctggcccc

SEQ ID NO: 119183 - DNA, 15 bp, Homo sapiens
atgcctggcccctcc

SEQ ID NO: 119184 - DNA, 18 bp, Homo sapiens
atggtccatcccctgagg

SEQ ID NO: 119185 - DNA, 16 bp, Homo sapiens
atggtttgcaaggaag

SEQ ID NO: 119186 - DNA, 17 bp, Homo sapiens
atgtcccatctgctcct

SEQ ID NO: 119187 - DNA, 20 bp, Homo sapiens
atgtgactaccgtgccagca

SEQ ID NO: 119188 - DNA, 21 bp, Homo sapiens
atgtgactaccgtgccagcag

SEQ ID NO: 119189 - DNA, 11 bp, Homo sapiens
atgtgcctgga

SEQ ID NO: 119190 - DNA, 13 bp, Homo sapiens
atgtgcctggaaa

SEQ ID NO: 119191 - DNA, 11 bp, Homo sapiens
attaacactgc

SEQ ID NO: 119192 - DNA, 20 bp, Homo sapiens
attaatatggggatgcagca

SEQ ID NO: 119193 - DNA, 23 bp, Homo sapiens
attccctattcgtagccatctcc

SEQ ID NO: 119194 - DNA, 19 bp, Homo sapiens
attctaacttttttgctat

SEQ ID NO: 119195 - DNA, 17 bp, Homo sapiens
attcttacaaacatgtg

SEQ ID NO: 119196 - DNA, 16 bp, Homo sapiens
attgcatatatacata

SEQ ID NO: 119197 - DNA, 23 bp, Homo sapiens
atttatcatctcgaccacttttc

SEQ ID NO: 119198 - DNA, 15 bp, Homo sapiens
atttccaagagctga

SEQ ID NO: 119199 - DNA, 13 bp, Homo sapiens
atttcttaaacaa

SEQ ID NO: 119200 - DNA, 15 bp, Homo sapiens
attttccatgaaaat

SEQ ID NO: 119201 - DNA, 18 bp, Homo sapiens
caaacatgtggttaatgc

SEQ ID NO: 119202 - DNA, 16 bp, Homo sapiens
caaaggagtagaaaga

SEQ ID NO: 119203 - DNA, 13 bp, Homo sapiens
caacatgtataat

SEQ ID NO: 119204 - DNA, 19 bp, Homo sapiens
caacatgtataatattttt

SEQ ID NO: 119205 - DNA, 20 bp, Homo sapiens
caaccgtccccggcccctgc

SEQ ID NO: 119206 - DNA, 21 bp, Homo sapiens
caaccgtccccggcccctgcc

SEQ ID NO: 119207 - DNA, 22 bp, Homo sapiens
caagagccccaaagatcccacg

SEQ ID NO: 119208 - DNA, 12 bp, Homo sapiens
caagagctgagg

SEQ ID NO: 119209 - DNA, 19 bp, Homo sapiens
caagcgagaatgcaggccc

SEQ ID NO: 119210 - DNA, 11 bp, Homo sapiens
caatattttcc

SEQ ID NO: 119211 - DNA, 16 bp, Homo sapiens
caatattttccatgaa

SEQ ID NO: 119212 - DNA, 20 bp, Homo sapiens
caatattttccatgaaaatg

SEQ ID NO: 119213 - DNA, 22 bp, Homo sapiens
caatattttccatgaaaatgca

SEQ ID NO: 119214 - DNA, 19 bp, Homo sapiens
caatgtgactaccgtgcca

SEQ ID NO: 119215 - DNA, 21 bp, Homo sapiens
caatgtgactaccgtgccagc

SEQ ID NO: 119216 - DNA, 22 bp, Homo sapiens
caatgtgactaccgtgccagca

SEQ ID NO: 119217 - DNA, 18 bp, Homo sapiens
caattcttacaaacatgt

SEQ ID NO: 119218 - DNA, 12 bp, Homo sapiens
caatttaaagca

SEQ ID NO: 119219 - DNA, 17 bp, Homo sapiens
caatttccaagagctga

SEQ ID NO: 119220 - DNA, 21 bp, Homo sapiens
cacaaccgtccccggcccctg

SEQ ID NO: 119221 - DNA, 12 bp, Homo sapiens
cacacagcagcg

SEQ ID NO: 119222 - DNA, 20 bp, Homo sapiens
cacacagcagcgcagccgag

SEQ ID NO: 119223 - DNA, 20 bp, Homo sapiens
cacacgggcctctgcttgcc

SEQ ID NO: 119224 - DNA, 14 bp, Homo sapiens
cacagcactgcctg

SEQ ID NO: 119225 - DNA, 15 bp, Homo sapiens
cacagcactgcctgc

SEQ ID NO: 119226 - DNA, 19 bp, Homo sapiens
cacagcactgcctgccaag

SEQ ID NO: 119227 - DNA, 18 bp, Homo sapiens
cacagcagcgcagccgag

SEQ ID NO: 119228 - DNA, 12 bp, Homo sapiens
cacagcccctgg

SEQ ID NO: 119229 - DNA, 14 bp, Homo sapiens
cacagcccctggca

SEQ ID NO: 119230 - DNA, 21 bp, Homo sapiens
cacagcccctggcactgcagg

SEQ ID NO: 119231 - DNA, 18 bp, Homo sapiens
cacagtgactgggccctg

SEQ ID NO: 119232 - DNA, 19 bp, Homo sapiens
cacagtgactgggccctgt

SEQ ID NO: 119233 - DNA, 22 bp, Homo sapiens
cacagtgactgggccctgtcca

SEQ ID NO: 119234 - DNA, 18 bp, Homo sapiens
cacatggctatgttttag

SEQ ID NO: 119235 - DNA, 20 bp, Homo sapiens
caccacctctttctacagcc

SEQ ID NO: 119236 - DNA, 18 bp, Homo sapiens
caccagttcctttcaatg

SEQ ID NO: 119237 - DNA, 13 bp, Homo sapiens
caccccgccagcc

SEQ ID NO: 119238 - DNA, 18 bp, Homo sapiens
caccccgcccctgcatgc

SEQ ID NO: 119239 - DNA, 20 bp, Homo sapiens
caccggtgccaaacccagcc

SEQ ID NO: 119240 - DNA, 21 bp, Homo sapiens
cacctccttcctcagtcctgg

SEQ ID NO: 119241 - DNA, 14 bp, Homo sapiens
cacctgcatcctct

SEQ ID NO: 119242 - DNA, 13 bp, Homo sapiens
cacgcaccccgcc

SEQ ID NO: 119243 - DNA, 14 bp, Homo sapiens
cacgggcctctgct

SEQ ID NO: 119244 - DNA, 12 bp, Homo sapiens
cactgccagccg

SEQ ID NO: 119245 - DNA, 14 bp, Homo sapiens
caccccgccagcct

SEQ ID NO: 119246 - DNA, 15 bp, Homo sapiens
caccccgccagccta

SEQ ID NO: 119247 - DNA, 17 bp, Homo sapiens
caccccgcccctgcatg

SEQ ID NO: 119248 - DNA, 16 bp, Homo sapiens
caccgtgtgcctttcc

SEQ ID NO: 119249 - DNA, 17 bp, Homo sapiens
cacctctttctacagcc

SEQ ID NO: 119250 - DNA, 17 bp, Homo sapiens
cacgcaccccgcccctg

SEQ ID NO: 119251 - DNA, 21 bp, Homo sapiens
cacgcaccccgcccctgcatg

SEQ ID NO: 119252 - DNA, 15 bp, Homo sapiens
cactaatacaccagg

SEQ ID NO: 119253 - DNA, 23 bp, Homo sapiens
cactccctgggggcgctgttcca

SEQ ID NO: 119254 - DNA, 12 bp, Homo sapiens
cactgcctgcca

SEQ ID NO: 119255 - DNA, 18 bp, Homo sapiens
cacttctctactctggaa

SEQ ID NO: 119256 - DNA, 19 bp, Homo sapiens
cactttcagtgaaagcatc

SEQ ID NO: 119257 - DNA, 15 bp, Homo sapiens
cagagcgcctcacct

SEQ ID NO: 119258 - DNA, 20 bp, Homo sapiens
cagagcgcctcacctgcatc

SEQ ID NO: 119259 - DNA, 21 bp, Homo sapiens
cagagcgcctcacctgcatcc

SEQ ID NO: 119260 - DNA, 23 bp, Homo sapiens
cagagcgcctcacctgcatcctc

SEQ ID NO: 119261 - DNA, 17 bp, Homo sapiens
cagagctcccttcctga

SEQ ID NO: 119262 - DNA, 17 bp, Homo sapiens
cagcacccacccatgca

SEQ ID NO: 119263 - DNA, 14 bp, Homo sapiens
cagcactgcctgcc

SEQ ID NO: 119264 - DNA, 15 bp, Homo sapiens
cagcactgcctgcca

SEQ ID NO: 119265 - DNA, 17 bp, Homo sapiens
cagcactgcctgccaag

SEQ ID NO: 119266 - DNA, 18 bp, Homo sapiens
cagcactgcctgccaagc

SEQ ID NO: 119267 - DNA, 17 bp, Homo sapiens
cagcagcgcagccgagc

SEQ ID NO: 119268 - DNA, 18 bp, Homo sapiens
cagcctacactgccagcc

SEQ ID NO: 119269 - DNA, 18 bp, Homo sapiens
cagcctccccccgctggg

SEQ ID NO: 119270 - DNA, 23 bp, Homo sapiens
cagcctctgagtcccgtggggcc

SEQ ID NO: 119271 - DNA, 22 bp, Homo sapiens
cagcgggggcggcccagcctct

SEQ ID NO: 119272 - DNA, 13 bp, Homo sapiens
cagctatttttat

SEQ ID NO: 119273 - DNA, 16 bp, Homo sapiens
cagctcactccctggg

SEQ ID NO: 119274 - DNA, 17 bp, Homo sapiens
cagctcagcctcccccc

SEQ ID NO: 119275 - DNA, 13 bp, Homo sapiens
cagctcagtgcca

SEQ ID NO: 119276 - DNA, 21 bp, Homo sapiens
cagcttcatttccgtgaaggg

SEQ ID NO: 119277 - DNA, 21 bp, Homo sapiens
caggagcccgtcaggccacag

SEQ ID NO: 119278 - DNA, 20 bp, Homo sapiens
caggccacagcccctggcac

SEQ ID NO: 119279 - DNA, 23 bp, Homo sapiens
caggccccgccccctcggcccct

SEQ ID NO: 119280 - DNA, 19 bp, Homo sapiens
caggtagaacacaaggtca

SEQ ID NO: 119281 - DNA, 13 bp, Homo sapiens
cagtgaaagcatc

SEQ ID NO: 119282 - DNA, 14 bp, Homo sapiens
cagtgaaagcatca

SEQ ID NO: 119283 - DNA, 20 bp, Homo sapiens
cagtgactgggccctgtcca

SEQ ID NO: 119284 - DNA, 22 bp, Homo sapiens
cagtgactgggccctgtccagg

SEQ ID NO: 119285 - DNA, 22 bp, Homo sapiens
cagtgctgcgagatcgctggca

SEQ ID NO: 119286 - DNA, 20 bp, Homo sapiens
cagtgctggccacacagcag

SEQ ID NO: 119287 - DNA, 13 bp, Homo sapiens
catcctctccccc

SEQ ID NO: 119288 - DNA, 14 bp, Homo sapiens
catcctctccccca

SEQ ID NO: 119289 - DNA, 17 bp, Homo sapiens
catgaaggagacagcag

SEQ ID NO: 119290 - DNA, 19 bp, Homo sapiens
catgaaggagacagcagca

SEQ ID NO: 119291 - DNA, 23 bp, Homo sapiens
catgaaggagacagcagcaccca

SEQ ID NO: 119292 - DNA, 14 bp, Homo sapiens
catgattccctcct

SEQ ID NO: 119293 - DNA, 17 bp, Homo sapiens
catgcacgcaccccgcc

SEQ ID NO: 119294 - DNA, 15 bp, Homo sapiens
catgcctggcccctc

SEQ ID NO: 119295 - DNA, 16 bp, Homo sapiens
catgcctggcccctcc

SEQ ID NO: 119296 - DNA, 17 bp, Homo sapiens
catggtccatcccctga

SEQ ID NO: 119297 - DNA, 18 bp, Homo sapiens
catggtccatcccctgag

SEQ ID NO: 119298 - DNA, 18 bp, Homo sapiens
catgtataatatttttaa

SEQ ID NO: 119299 - DNA, 14 bp, Homo sapiens
catgtgcctggaaa

SEQ ID NO: 119300 - DNA, 17 bp, Homo sapiens
catgtggttaatgccat

SEQ ID NO: 119301 - DNA, 22 bp, Homo sapiens
catgtggttaatgccatggaca

SEQ ID NO: 119302 - DNA, 21 bp, Homo sapiens
cattatgatgtgggtcaagga

SEQ ID NO: 119303 - DNA, 19 bp, Homo sapiens
ccaaagaggggtcaccagg

SEQ ID NO: 119304 - DNA, 21 bp, Homo sapiens
ccaaagaggggtcaccagggg

SEQ ID NO: 119305 - DNA, 22 bp, Homo sapiens
ccaaggctcccgttccgtggga

SEQ ID NO: 119306 - DNA, 12 bp, Homo sapiens
ccacagcccctg

SEQ ID NO: 119307 - DNA, 17 bp, Homo sapiens
ccacagcccctggcact

SEQ ID NO: 119308 - DNA, 17 bp, Homo sapiens
ccacagtgactgggccc

SEQ ID NO: 119309 - DNA, 13 bp, Homo sapiens
ccacccatgcacg

SEQ ID NO: 119310 - DNA, 14 bp, Homo sapiens
ccacccccagtccc

SEQ ID NO: 119311 - DNA, 14 bp, Homo sapiens
ccaccggtgccaaa

SEQ ID NO: 119312 - DNA, 21 bp, Homo sapiens
ccaccggtgccaaacccagcc

SEQ ID NO: 119313 - DNA, 19 bp, Homo sapiens
ccacctctttctacagcct

SEQ ID NO: 119314 - DNA, 15 bp, Homo sapiens
ccactccctgggggc

SEQ ID NO: 119315 - DNA, 19 bp, Homo sapiens
ccacttctctactctggaa

SEQ ID NO: 119316 - DNA, 18 bp, Homo sapiens
ccagagactcgagtcccc

SEQ ID NO: 119317 - DNA, 23 bp, Homo sapiens
ccagcagcgggggcggcccagcc

SEQ ID NO: 119318 - DNA, 24 bp, Homo sapiens
ccagccaataaatcaactccagct

SEQ ID NO: 119319 - DNA, 15 bp, Homo sapiens
ccagcccctgcggcc

SEQ ID NO: 119320 - DNA, 19 bp, Homo sapiens
ccagccgggtacctcagtt

SEQ ID NO: 119321 - DNA, 15 bp, Homo sapiens
ccagcctacactgcc

SEQ ID NO: 119322 - DNA, 16 bp, Homo sapiens
ccagcctacactgcca

SEQ ID NO: 119323 - DNA, 14 bp, Homo sapiens
ccagcgcctgcccg

SEQ ID NO: 119324 - DNA, 14 bp, Homo sapiens
ccagctcagtgcca

SEQ ID NO: 119325 - DNA, 13 bp, Homo sapiens
ccagtgctggcca

SEQ ID NO: 119326 - DNA, 16 bp, Homo sapiens
ccagtgctggccacac

SEQ ID NO: 119327 - DNA, 16 bp, Homo sapiens
ccagtgggacccacag

SEQ ID NO: 119328 - DNA, 14 bp, Homo sapiens
ccatgattccctcc

SEQ ID NO: 119329 - DNA, 17 bp, Homo sapiens
ccatgattccctcctcg

SEQ ID NO: 119330 - DNA, 17 bp, Homo sapiens
ccattatgaagaagaga

SEQ ID NO: 119331 - DNA, 19 bp, Homo sapiens
cccaagctcggatcacatg

SEQ ID NO: 119332 - DNA, 12 bp, Homo sapiens
cccacccatgca

SEQ ID NO: 119333 - DNA, 13 bp, Homo sapiens
cccaccggtgcca

SEQ ID NO: 119334 - DNA, 13 bp, Homo sapiens
cccactccctggg

SEQ ID NO: 119335 - DNA, 16 bp, Homo sapiens
cccagcccctgcggcc

SEQ ID NO: 119336 - DNA, 9 bp, Homo sapiens
cccagcctc

SEQ ID NO: 119337 - DNA, 13 bp, Homo sapiens
cccagtgctggcc

SEQ ID NO: 119338 - DNA, 18 bp, Homo sapiens
cccagtgggacccacagt

SEQ ID NO: 119339 - DNA, 19 bp, Homo sapiens
cccagtgggacccacagtc

SEQ ID NO: 119340 - DNA, 12 bp, Homo sapiens
cccatctgctcc

SEQ ID NO: 119341 - DNA, 14 bp, Homo sapiens
cccatctgctcctc

SEQ ID NO: 119342 - DNA, 17 bp, Homo sapiens
cccatctgctcctccca

SEQ ID NO: 119343 - DNA, 18 bp, Homo sapiens
cccatctgctcctcccat

SEQ ID NO: 119344 - DNA, 23 bp, Homo sapiens
cccatctgctcctcccattcccc

SEQ ID NO: 119345 - DNA, 17 bp, Homo sapiens
cccatgattccctcctc

SEQ ID NO: 119346 - DNA, 18 bp, Homo sapiens
cccatggtccatcccctg

SEQ ID NO: 119347 - DNA, 18 bp, Homo sapiens
ccccacaagagccccaaa

SEQ ID NO: 119348 - DNA, 21 bp, Homo sapiens
ccccacttctctactctggaa

SEQ ID NO: 119349 - DNA, 15 bp, Homo sapiens
ccccgcagagctccc

SEQ ID NO: 119350 - DNA, 23 bp, Homo sapiens
ccccgccagcctacactgccagc

SEQ ID NO: 119351 - DNA, 16 bp, Homo sapiens
ccccgcccctgcatgc

SEQ ID NO: 119352 - DNA, 14 bp, Homo sapiens
ccccggctcccacc

SEQ ID NO: 119353 - DNA, 12 bp, Homo sapiens
cccctcccctcc

SEQ ID NO: 119354 - DNA, 18 bp, Homo sapiens
cccctcggcccctcacca

SEQ ID NO: 119355 - DNA, 15 bp, Homo sapiens
cccctgcatgcctgg

SEQ ID NO: 119356 - DNA, 17 bp, Homo sapiens
cccctgccccgccccca

SEQ ID NO: 119357 - DNA, 18 bp, Homo sapiens
cccctgcggccgtcaccc

SEQ ID NO: 119358 - DNA, 16 bp, Homo sapiens
cccctggcactgcagg

SEQ ID NO: 119359 - DNA, 20 bp, Homo sapiens
cccgagagagaccccaccgc

SEQ ID NO: 119360 - DNA, 15 bp, Homo sapiens
cccgcccctgcatgc

SEQ ID NO: 119361 - DNA, 16 bp, Homo sapiens
cccgcccctgcatgcc

SEQ ID NO: 119362 - DNA, 16 bp, Homo sapiens
agcccaaagaaggaaa

SEQ ID NO: 119363 - DNA, 11 bp, Homo sapiens
agccccaaaga

SEQ ID NO: 119364 - DNA, 18 bp, Homo sapiens
agccccaaagatcccacg

SEQ ID NO: 119365 - DNA, 17 bp, Homo sapiens
agcccgtcaggccacag

SEQ ID NO: 119366 - DNA, 18 bp, Homo sapiens
agcccgtcaggccacagc

SEQ ID NO: 119367 - DNA, 22 bp, Homo sapiens
agcccttccagtggtaccagct

SEQ ID NO: 119368 - DNA, 17 bp, Homo sapiens
agccgagccccaggagc

SEQ ID NO: 119369 - DNA, 23 bp, Homo sapiens
agccgcccagtgggacccacagt

SEQ ID NO: 119370 - DNA, 17 bp, Homo sapiens
agccgggtacctcagtt

SEQ ID NO: 119371 - DNA, 19 bp, Homo sapiens
agcgcagccgagccccagg

SEQ ID NO: 119372 - DNA, 22 bp, Homo sapiens
agctatttttatttgtttgtgc

SEQ ID NO: 119373 - DNA, 12 bp, Homo sapiens
agctcactccct

SEQ ID NO: 119374 - DNA, 14 bp, Homo sapiens
agctcagtgccaaa

SEQ ID NO: 119375 - DNA, 15 bp, Homo sapiens
agctcagtgccaaag

SEQ ID NO: 119376 - DNA, 13 bp, Homo sapiens
agctccagttcga

SEQ ID NO: 119377 - DNA, 17 bp, Homo sapiens
agctgggatgtttctgt

SEQ ID NO: 119378 - DNA, 16 bp, Homo sapiens
aaaatctgtggtggtc

SEQ ID NO: 119379 - DNA, 14 bp, Homo sapiens
aaaattaacactgc

SEQ ID NO: 119380 - DNA, 13 bp, Homo sapiens
aacaacatgtata

SEQ ID NO: 119381 - DNA, 14 bp, Homo sapiens
aacactgcttgtgt

SEQ ID NO: 119382 - DNA, 22 bp, Homo sapiens
aacccaaattacgtgtactaca

SEQ ID NO: 119383 - DNA, 13 bp, Homo sapiens
aacccagcccctg

SEQ ID NO: 119384 - DNA, 14 bp, Homo sapiens
aacccttcccgccc

SEQ ID NO: 119385 - DNA, 20 bp, Homo sapiens
aactcaatattttccatgaa

SEQ ID NO: 119386 - DNA, 17 bp, Homo sapiens
aactcgaagcccttcca

SEQ ID NO: 119387 - DNA, 17 bp, Homo sapiens
aagaaggaaaaggcagg

SEQ ID NO: 119388 - DNA, 16 bp, Homo sapiens
aagaggggtcaccagg

SEQ ID NO: 119389 - DNA, 15 bp, Homo sapiens
aaggaccctggctct

SEQ ID NO: 119390 - DNA, 15 bp, Homo sapiens
aaggggcccagtgct

SEQ ID NO: 119391 - DNA, 13 bp, Homo sapiens
aaggttgtattgc

SEQ ID NO: 119392 - DNA, 17 bp, Homo sapiens
aaggttgtattgcatat

SEQ ID NO: 119393 - DNA, 18 bp, Homo sapiens
aagtttcttggtctcagc

SEQ ID NO: 119394 - DNA, 21 bp, Homo sapiens
aatacaccaggtagaacacaa

SEQ ID NO: 119395 - DNA, 15 bp, Homo sapiens
aatgcaacaacatgt

SEQ ID NO: 119396 - DNA, 19 bp, Homo sapiens
aatggcacagcccaaagaa

SEQ ID NO: 119397 - DNA, 23 bp, Homo sapiens
aatggtttgaatataaacactat

SEQ ID NO: 119398 - DNA, 22 bp, Homo sapiens
aatgtgactaccgtgccagcag

SEQ ID NO: 119399 - DNA, 22 bp, Homo sapiens
acaaccgtccccggcccctgcc

SEQ ID NO: 119400 - DNA, 14 bp, Homo sapiens
acaaggggcccagt

SEQ ID NO: 119401 - DNA, 14 bp, Homo sapiens
acaatttaaagcaa

SEQ ID NO: 119402 - DNA, 23 bp, Homo sapiens
acactgcttgtgtttttaactca

SEQ ID NO: 119403 - DNA, 20 bp, Homo sapiens
acagaagaaggcagcaggtg

SEQ ID NO: 119404 - DNA, 19 bp, Homo sapiens
acagagcgcctcacctgca

SEQ ID NO: 119405 - DNA, 14 bp, Homo sapiens
acagagctgggatg

SEQ ID NO: 119406 - DNA, 16 bp, Homo sapiens
acagcactgcctgcca

SEQ ID NO: 119407 - DNA, 17 bp, Homo sapiens
acagcactgcctgccaa

SEQ ID NO: 119408 - DNA, 17 bp, Homo sapiens
acagcagcacccaccca

SEQ ID NO: 119409 - DNA, 14 bp, Homo sapiens
acagcagcgcagcc

SEQ ID NO: 119410 - DNA, 14 bp, Homo sapiens
acagcccctggcac

SEQ ID NO: 119411 - DNA, 20 bp, Homo sapiens
acagcccctggcactgcagg

SEQ ID NO: 119412 - DNA, 17 bp, Homo sapiens
acagtgactgggccctg

SEQ ID NO: 119413 - DNA, 20 bp, Homo sapiens
acagtgactgggccctgtcc

SEQ ID NO: 119414 - DNA, 14 bp, Homo sapiens
acatgtataatatt

SEQ ID NO: 119415 - DNA, 22 bp, Homo sapiens
accaacctccccgcagagctcc

SEQ ID NO: 119416 - DNA, 20 bp, Homo sapiens
accagccatcatgtgcctgg

SEQ ID NO: 119417 - DNA, 22 bp, Homo sapiens
accagccatcatgtgcctggaa

SEQ ID NO: 119418 - DNA, 15 bp, Homo sapiens
accagctcactccct

SEQ ID NO: 119419 - DNA, 14 bp, Homo sapiens
accatgttcccagc

SEQ ID NO: 119420 - DNA, 12 bp, Homo sapiens
acccagcccctg

SEQ ID NO: 119421 - DNA, 17 bp, Homo sapiens
acccagcccctgcggcc

SEQ ID NO: 119422 - DNA, 20 bp, Homo sapiens
acccatgcacgcaccccgcc

SEQ ID NO: 119423 - DNA, 18 bp, Homo sapiens
accccatggtccatcccc

SEQ ID NO: 119424 - DNA, 13 bp, Homo sapiens
accccgccagcct

SEQ ID NO: 119425 - DNA, 13 bp, Homo sapiens
accccgcccctgc

SEQ ID NO: 119426 - DNA, 14 bp, Homo sapiens
accccgcccctgca

SEQ ID NO: 119427 - DNA, 12 bp, Homo sapiens
acccctcagtgc

SEQ ID NO: 119428 - DNA, 22 bp, Homo sapiens
acccctcagtgctcggcagtca

SEQ ID NO: 119429 - DNA, 13 bp, Homo sapiens
acccctcccctcc

SEQ ID NO: 119430 - DNA, 16 bp, Homo sapiens
accctcgccctgtccc

SEQ ID NO: 119431 - DNA, 17 bp, Homo sapiens
accctcgccctgtccct

SEQ ID NO: 119432 - DNA, 20 bp, Homo sapiens
accctcgccctgtccctccc

SEQ ID NO: 119433 - DNA, 23 bp, Homo sapiens
accctcgccctgtccctcccact

SEQ ID NO: 119434 - DNA, 11 bp, Homo sapiens
accctggctct

SEQ ID NO: 119435 - DNA, 13 bp, Homo sapiens
accgatgccagcc

SEQ ID NO: 119436 - DNA, 23 bp, Homo sapiens
accggtgccaaacccagcccctg

SEQ ID NO: 119437 - DNA, 17 bp, Homo sapiens
accgtccccggcccctg

SEQ ID NO: 119438 - DNA, 21 bp, Homo sapiens
accgtccccggcccctgcccc

SEQ ID NO: 119439 - DNA, 16 bp, Homo sapiens
acctctttctacagcc

SEQ ID NO: 119440 - DNA, 17 bp, Homo sapiens
acctgcatcctctcccc

SEQ ID NO: 119441 - DNA, 23 bp, Homo sapiens
acctgcatcctctcccccacaag

SEQ ID NO: 119442 - DNA, 16 bp, Homo sapiens
acgaacccctcccctc

SEQ ID NO: 119443 - DNA, 17 bp, Homo sapiens
acgaacccctcccctcc

SEQ ID NO: 119444 - DNA, 20 bp, Homo sapiens
acgtatgtttttgtgtattt

SEQ ID NO: 119445 - DNA, 18 bp, Homo sapiens
acgtgtactacaatttaa

SEQ ID NO: 119446 - DNA, 16 bp, Homo sapiens
actaccgtgccagcag

SEQ ID NO: 119447 - DNA, 17 bp, Homo sapiens
actaccgtgccagcagc

SEQ ID NO: 119448 - DNA, 18 bp, Homo sapiens
actaccgtgccagcagcg

SEQ ID NO: 119449 - DNA, 15 bp, Homo sapiens
actcaatattttcca

SEQ ID NO: 119450 - DNA, 23 bp, Homo sapiens
actcaatattttccatgaaaatg

SEQ ID NO: 119451 - DNA, 23 bp, Homo sapiens
actccctgggaaaggggttgtca

SEQ ID NO: 119452 - DNA, 18 bp, Homo sapiens
actgcaggtggcctccct

SEQ ID NO: 119453 - DNA, 22 bp, Homo sapiens
actgcaggtggcctccctccag

SEQ ID NO: 119454 - DNA, 18 bp, Homo sapiens
actgcttgtgtttttaac

SEQ ID NO: 119455 - DNA, 14 bp, Homo sapiens
actggggtgcgaga

SEQ ID NO: 119456 - DNA, 17 bp, Homo sapiens
acttctctactctggaa

SEQ ID NO: 119457 - DNA, 18 bp, Homo sapiens
actttcagtgaaagcatc

SEQ ID NO: 119458 - DNA, 13 bp, Homo sapiens
agaagaaggcagc

SEQ ID NO: 119459 - DNA, 14 bp, Homo sapiens
agaagaaggcagca

SEQ ID NO: 119460 - DNA, 20 bp, Homo sapiens
agaaggggacagcgccacct

SEQ ID NO: 119461 - DNA, 12 bp, Homo sapiens
agacagagctgg

SEQ ID NO: 119462 - DNA, 17 bp, Homo sapiens
agactatattgtacaca

SEQ ID NO: 119463 - DNA, 15 bp, Homo sapiens
agagaaggcttcctc

SEQ ID NO: 119464 - DNA, 15 bp, Homo sapiens
agagaccccaccgcc

SEQ ID NO: 119465 - DNA, 16 bp, Homo sapiens
agagaccccaccgcca

SEQ ID NO: 119466 - DNA, 17 bp, Homo sapiens
agagactcgagtcccca

SEQ ID NO: 119467 - DNA, 17 bp, Homo sapiens
agagagaccccaccgcc

SEQ ID NO: 119468 - DNA, 11 bp, Homo sapiens
agagctgaggc

SEQ ID NO: 119469 - DNA, 14 bp, Homo sapiens
agatcgctggcaga

SEQ ID NO: 119470 - DNA, 14 bp, Homo sapiens
agcagcacccaccc

SEQ ID NO: 119471 - DNA, 20 bp, Homo sapiens
agcagcgcagccgagcccca

SEQ ID NO: 119472 - DNA, 20 bp, Homo sapiens
agcagcgggggcggcccagc

SEQ ID NO: 119473 - DNA, 21 bp, Homo sapiens
agcagcgggggcggcccagcc

SEQ ID NO: 119474 - DNA, 22 bp, Homo sapiens
agcagcgggggcggcccagcct

SEQ ID NO: 119475 - DNA, 16 bp, Homo sapiens
agccagcgcctgcccg

SEQ ID NO: 119476 - DNA, 17 bp, Homo sapiens
agccagcgcctgcccga

SEQ ID NO: 119477 - DNA, 19 bp, Homo sapiens
agccagcgcctgcccgaga

SEQ ID NO: 119478 - DNA, 18 bp, Homo sapiens
agccatcatgtgcctgga

SEQ ID NO: 119479 - DNA, 17 bp, Homo sapiens
cccggcccctgccccgc

SEQ ID NO: 119480 - DNA, 14 bp, Homo sapiens
cccgggccctcagc

SEQ ID NO: 119481 - DNA, 16 bp, Homo sapiens
cccgggccctcagccc

SEQ ID NO: 119482 - DNA, 21 bp, Homo sapiens
cccgtggggccccggctccca

SEQ ID NO: 119483 - DNA, 14 bp, Homo sapiens
ccctcaccacctct

SEQ ID NO: 119484 - DNA, 14 bp, Homo sapiens
ccctcccactccct

SEQ ID NO: 119485 - DNA, 22 bp, Homo sapiens
ccctcctcctagaaaacccttc

SEQ ID NO: 119486 - DNA, 17 bp, Homo sapiens
ccctcgccctgtccctc

SEQ ID NO: 119487 - DNA, 14 bp, Homo sapiens
ccctcggcccctca

SEQ ID NO: 119488 - DNA, 18 bp, Homo sapiens
ccctgcatgcctggcccc

SEQ ID NO: 119489 - DNA, 19 bp, Homo sapiens
ccctgcatgcctggcccct

SEQ ID NO: 119490 - DNA, 22 bp, Homo sapiens
ccctgcggccgtcaccccgcca

SEQ ID NO: 119491 - DNA, 20 bp, Homo sapiens
ccctgtaaacacagtgctgc

SEQ ID NO: 119492 - DNA, 11 bp, Homo sapiens
ccctgtccagg

SEQ ID NO: 119493 - DNA, 15 bp, Homo sapiens
ccctgtccagggcag

SEQ ID NO: 119494 - DNA, 19 bp, Homo sapiens
ccctgtccctcccactccc

SEQ ID NO: 119495 - DNA, 22 bp, Homo sapiens
cccttccagtggtaccagctca

SEQ ID NO: 119496 - DNA, 15 bp, Homo sapiens
ccgcagagctccctt

SEQ ID NO: 119497 - DNA, 20 bp, Homo sapiens
ccgccaccgtgtgcctttcc

SEQ ID NO: 119498 - DNA, 15 bp, Homo sapiens
ccgccagcctacact

SEQ ID NO: 119499 - DNA, 19 bp, Homo sapiens
ccgccagcctacactgcca

SEQ ID NO: 119500 - DNA, 22 bp, Homo sapiens
ccgccagcctacactgccagcc

SEQ ID NO: 119501 - DNA, 22 bp, Homo sapiens
ccgcccagtgggacccacagtc

SEQ ID NO: 119502 - DNA, 18 bp, Homo sapiens
ccgccccctcggcccctc

SEQ ID NO: 119503 - DNA, 13 bp, Homo sapiens
ccggctcccaccg

SEQ ID NO: 119504 - DNA, 13 bp, Homo sapiens
tttatttcttaaa

SEQ ID NO: 119505 - DNA, 20 bp, Homo sapiens
tttatttgtttgtgcatttg

SEQ ID NO: 119506 - DNA, 19 bp, Homo sapiens
tttcaatttccaagagctg

SEQ ID NO: 119507 - DNA, 14 bp, Homo sapiens
tttccaagagctga

SEQ ID NO: 119508 - DNA, 16 bp, Homo sapiens
tttccaagagctgagg

SEQ ID NO: 119509 - DNA, 19 bp, Homo sapiens
tttctgaaaattaacactg

SEQ ID NO: 119510 - DNA, 20 bp, Homo sapiens
tttctgaaaattaacactgc

SEQ ID NO: 119511 - DNA, 18 bp, Homo sapiens
tttgatagtattgtgcat

SEQ ID NO: 119512 - DNA, 21 bp, Homo sapiens
tttgcaaggaagccacagctg

SEQ ID NO: 119513 - DNA, 18 bp, Homo sapiens
ccggctcccaccggtgcc

SEQ ID NO: 119514 - DNA, 16 bp, Homo sapiens
ccgggcaccaccccca

SEQ ID NO: 119515 - DNA, 15 bp, Homo sapiens
ccgggccctcagccc

SEQ ID NO: 119516 - DNA, 16 bp, Homo sapiens
ccgggccctcagccct

SEQ ID NO: 119517 - DNA, 16 bp, Homo sapiens
ccgtcaccccgccagc

SEQ ID NO: 119518 - DNA, 20 bp, Homo sapiens
ccgtcaggccacagcccctg

SEQ ID NO: 119519 - DNA, 17 bp, Homo sapiens
ccgtccccggcccctgc

SEQ ID NO: 119520 - DNA, 20 bp, Homo sapiens
ccgtggggccccggctccca

SEQ ID NO: 119521 - DNA, 22 bp, Homo sapiens
ccgtgtgcctttcccgggccct

SEQ ID NO: 119522 - DNA, 13 bp, Homo sapiens
cctacactgccag

SEQ ID NO: 119523 - DNA, 14 bp, Homo sapiens
cctacactgccagc

SEQ ID NO: 119524 - DNA, 15 bp, Homo sapiens
cctacactgccagcc

SEQ ID NO: 119525 - DNA, 21 bp, Homo sapiens
cctagaaaacccttcccgccc

SEQ ID NO: 119526 - DNA, 18 bp, Homo sapiens
cctattcgtagccatctc

SEQ ID NO: 119527 - DNA, 12 bp, Homo sapiens
cctcaccacctc

SEQ ID NO: 119528 - DNA, 17 bp, Homo sapiens
cctcacctgcatcctct

SEQ ID NO: 119529 - DNA, 11 bp, Homo sapiens
cctcagtgctc

SEQ ID NO: 119530 - DNA, 14 bp, Homo sapiens
cctcccattcccct

SEQ ID NO: 119531 - DNA, 14 bp, Homo sapiens
cctcccctcccccc

SEQ ID NO: 119532 - DNA, 14 bp, Homo sapiens
cctccctccagaga

SEQ ID NO: 119533 - DNA, 20 bp, Homo sapiens
cctcctagaaaacccttccc

SEQ ID NO: 119534 - DNA, 13 bp, Homo sapiens
cctcctcgtcagt

SEQ ID NO: 119535 - DNA, 19 bp, Homo sapiens
cctccttcctcagtcctgg

SEQ ID NO: 119536 - DNA, 13 bp, Homo sapiens
cctcgccctgtcc

SEQ ID NO: 119537 - DNA, 14 bp, Homo sapiens
cctcgccctgtccc

SEQ ID NO: 119538 - DNA, 21 bp, Homo sapiens
cctcgccctgtccctcccact

SEQ ID NO: 119539 - DNA, 14 bp, Homo sapiens
cctcggcccctcac

SEQ ID NO: 119540 - DNA, 17 bp, Homo sapiens
cctcggcccctcaccac

SEQ ID NO: 119541 - DNA, 14 bp, Homo sapiens
cctcgtcagtctct

SEQ ID NO: 119542 - DNA, 12 bp, Homo sapiens
cctctgagtccc

SEQ ID NO: 119543 - DNA, 15 bp, Homo sapiens
cctctgcttgccagc

SEQ ID NO: 119544 - DNA, 18 bp, Homo sapiens
cctctgcttgccagccag

SEQ ID NO: 119545 - DNA, 19 bp, Homo sapiens
cctctgcttgccagccagg

SEQ ID NO: 119546 - DNA, 18 bp, Homo sapiens
cctctttctacagcctaa

SEQ ID NO: 119547 - DNA, 23 bp, Homo sapiens
cctgaggcatgagaatcacttga

SEQ ID NO: 119548 - DNA, 22 bp, Homo sapiens
cctgagggtggtcagccaaggc

SEQ ID NO: 119549 - DNA, 14 bp, Homo sapiens
cctgcatgcctggc

SEQ ID NO: 119550 - DNA, 17 bp, Homo sapiens
cctgcatgcctggcccc

SEQ ID NO: 119551 - DNA, 22 bp, Homo sapiens
cctgcccgagagagaccccacc

SEQ ID NO: 119552 - DNA, 14 bp, Homo sapiens
cctggcactgcagg

SEQ ID NO: 119553 - DNA, 18 bp, Homo sapiens
cctgtacgaacccctccc

SEQ ID NO: 119554 - DNA, 16 bp, Homo sapiens
cctgtccctcccactc

SEQ ID NO: 119555 - DNA, 14 bp, Homo sapiens
ccttctaggaagct

SEQ ID NO: 119556 - DNA, 18 bp, Homo sapiens
cgaagcccttccagtggt

SEQ ID NO: 119557 - DNA, 21 bp, Homo sapiens
cgagaactcgaagcccttcca

SEQ ID NO: 119558 - DNA, 19 bp, Homo sapiens
cgagagaggtgggcagcag

SEQ ID NO: 119559 - DNA, 14 bp, Homo sapiens
cgagtccccatgat

SEQ ID NO: 119560 - DNA, 21 bp, Homo sapiens
cgatgggcccaattcttacaa

SEQ ID NO: 119561 - DNA, 10 bp, Homo sapiens
cgcacagcac

SEQ ID NO: 119562 - DNA, 16 bp, Homo sapiens
cgcacagcactgcctg

SEQ ID NO: 119563 - DNA, 19 bp, Homo sapiens
cgcacagcactgcctgcca

SEQ ID NO: 119564 - DNA, 21 bp, Homo sapiens
cgcacagcactgcctgccaag

SEQ ID NO: 119565 - DNA, 18 bp, Homo sapiens
cgcaccccgcccctgcat

SEQ ID NO: 119566 - DNA, 21 bp, Homo sapiens
cgccactgcactccagtctgg

SEQ ID NO: 119567 - DNA, 20 bp, Homo sapiens
cgccagcctacactgccagc

SEQ ID NO: 119568 - DNA, 13 bp, Homo sapiens
cgcccctgcatgc

SEQ ID NO: 119569 - DNA, 23 bp, Homo sapiens
cgccctgcgtaaccctcgccctg

SEQ ID NO: 119570 - DNA, 15 bp, Homo sapiens
cgccctgtccctccc

SEQ ID NO: 119571 - DNA, 16 bp, Homo sapiens
cgccctgtccctccca

SEQ ID NO: 119572 - DNA, 21 bp, Homo sapiens
cgcctcacctgcatcctctcc

SEQ ID NO: 119573 - DNA, 13 bp, Homo sapiens
cgctggcagagaa

SEQ ID NO: 119574 - DNA, 22 bp, Homo sapiens
cgctggggagcgaaagtttctt

SEQ ID NO: 119575 - DNA, 18 bp, Homo sapiens
cggagccagcgcctgccc

SEQ ID NO: 119576 - DNA, 19 bp, Homo sapiens
cggagccagcgcctgcccg

SEQ ID NO: 119577 - DNA, 18 bp, Homo sapiens
cggcagtcatactggggt

SEQ ID NO: 119578 - DNA, 17 bp, Homo sapiens
cgggacatgcagctctg

SEQ ID NO: 119579 - DNA, 14 bp, Homo sapiens
cgggccctcagccc

SEQ ID NO: 119580 - DNA, 18 bp, Homo sapiens
cggggcgacccctcagtg

SEQ ID NO: 119581 - DNA, 18 bp, Homo sapiens
cggtgccaaacccagccc

SEQ ID NO: 119582 - DNA, 20 bp, Homo sapiens
cgtaaccctcgccctgtccc

SEQ ID NO: 119583 - DNA, 20 bp, Homo sapiens
cgtagccatctccgtggcca

SEQ ID NO: 119584 - DNA, 14 bp, Homo sapiens
cgtcaggccacagc

SEQ ID NO: 119585 - DNA, 15 bp, Homo sapiens
cgtcaggccacagcc

SEQ ID NO: 119586 - DNA, 22 bp, Homo sapiens
cgtcaggccacagcccctggca

SEQ ID NO: 119587 - DNA, 18 bp, Homo sapiens
cgtccccggcccctgccc

SEQ ID NO: 119588 - DNA, 17 bp, Homo sapiens
cgtgaagggcaccgaga

SEQ ID NO: 119589 - DNA, 13 bp, Homo sapiens
ctacactgccagc

SEQ ID NO: 119590 - DNA, 13 bp, Homo sapiens
ctaccgtgccagc

SEQ ID NO: 119591 - DNA, 16 bp, Homo sapiens
ctagaaaacccttccc

SEQ ID NO: 119592 - DNA, 15 bp, Homo sapiens
ctatattgtacacac

SEQ ID NO: 119593 - DNA, 11 bp, Homo sapiens
ctcaatatttt

SEQ ID NO: 119594 - DNA, 18 bp, Homo sapiens
ctcaatattttccatgaa

SEQ ID NO: 119595 - DNA, 13 bp, Homo sapiens
ctcacctgcatcc

SEQ ID NO: 119596 - DNA, 14 bp, Homo sapiens
ctcagcctcccccc

SEQ ID NO: 119597 - DNA, 14 bp, Homo sapiens
ctcagtcctggaag

SEQ ID NO: 119598 - DNA, 19 bp, Homo sapiens
ctcagtgctcggcagtcat

SEQ ID NO: 119599 - DNA, 11 bp, Homo sapiens
ctcagtttctc

SEQ ID NO: 119600 - DNA, 14 bp, Homo sapiens
ctcccccacaagag

SEQ ID NO: 119601 - DNA, 13 bp, Homo sapiens
ctcccctcccccc

SEQ ID NO: 119602 - DNA, 21 bp, Homo sapiens
cagcagctcagcctccccccg

SEQ ID NO: 119603 - DNA, 21 bp, Homo sapiens
cagccaataaatcaactccag

SEQ ID NO: 119604 - DNA, 18 bp, Homo sapiens
cagccatcatgtgcctgg

SEQ ID NO: 119605 - DNA, 13 bp, Homo sapiens
cagcccctgcggc

SEQ ID NO: 119606 - DNA, 13 bp, Homo sapiens
cagccgagcccca

SEQ ID NO: 119607 - DNA, 15 bp, Homo sapiens
cagccgagccccagg

SEQ ID NO: 119608 - DNA, 19 bp, Homo sapiens
cagccgagccccaggagcc

SEQ ID NO: 119609 - DNA, 17 bp, Homo sapiens
cagccgggtacctcagt

SEQ ID NO: 119610 - DNA, 18 bp, Homo sapiens
cagccgggtacctcagtt

SEQ ID NO: 119611 - DNA, 12 bp, Homo sapiens
cagcctacactg

SEQ ID NO: 119612 - DNA, 20 bp, Homo sapiens
cagcctacactgccagccgc

SEQ ID NO: 119613 - DNA, 12 bp, Homo sapiens
cagcgcctgccc

SEQ ID NO: 119614 - DNA, 23 bp, Homo sapiens
cagcgggggcggcccagcctctg

SEQ ID NO: 119615 - DNA, 16 bp, Homo sapiens
cagcttcatttccgtg

SEQ ID NO: 119616 - DNA, 17 bp, Homo sapiens
cagcttcatttccgtga

SEQ ID NO: 119617 - DNA, 23 bp, Homo sapiens
cagcttcatttccgtgaagggca

SEQ ID NO: 119618 - DNA, 16 bp, Homo sapiens
caggccccgccccctc

SEQ ID NO: 119619 - DNA, 20 bp, Homo sapiens
caggccccgccccctcggcc

SEQ ID NO: 119620 - DNA, 20 bp, Homo sapiens
caggtatgaccttctaggaa

SEQ ID NO: 119621 - DNA, 14 bp, Homo sapiens
caggtggcctccct

SEQ ID NO: 119622 - DNA, 17 bp, Homo sapiens
caggtggcctccctcca

SEQ ID NO: 119623 - DNA, 12 bp, Homo sapiens
cagtcctggaag

SEQ ID NO: 119624 - DNA, 23 bp, Homo sapiens
cagtcctggaagccggccggctg

SEQ ID NO: 119625 - DNA, 17 bp, Homo sapiens
cagtgactgggccctgt

SEQ ID NO: 119626 - DNA, 18 bp, Homo sapiens
cagtgactgggccctgtc

SEQ ID NO: 119627 - DNA, 19 bp, Homo sapiens
cagtgactgggccctgtcc

SEQ ID NO: 119628 - DNA, 12 bp, Homo sapiens
cagtgctcggca

SEQ ID NO: 119629 - DNA, 14 bp, Homo sapiens
cagtgctcggcagt

SEQ ID NO: 119630 - DNA, 18 bp, Homo sapiens
cagtgctggccacacagc

SEQ ID NO: 119631 - DNA, 19 bp, Homo sapiens
cagtgcttgattgcgtgga

SEQ ID NO: 119632 - DNA, 15 bp, Homo sapiens
cagtggtaccagctc

SEQ ID NO: 119633 - DNA, 17 bp, Homo sapiens
cagtggtaccagctcac

SEQ ID NO: 119634 - DNA, 21 bp, Homo sapiens
cagtggtaccagctcactccc

SEQ ID NO: 119635 - DNA, 12 bp, Homo sapiens
catatttcaatt

SEQ ID NO: 119636 - DNA, 16 bp, Homo sapiens
catcatgtgcctggaa

SEQ ID NO: 119637 - DNA, 13 bp, Homo sapiens
catgaaaatgcaa

SEQ ID NO: 119638 - DNA, 15 bp, Homo sapiens
catgaaggtttctga

SEQ ID NO: 119639 - DNA, 18 bp, Homo sapiens
catgaaggtttctgaaaa

SEQ ID NO: 119640 - DNA, 23 bp, Homo sapiens
catgcacgcaccccgcccctgca

SEQ ID NO: 119641 - DNA, 13 bp, Homo sapiens
catgcctggcccc

SEQ ID NO: 119642 - DNA, 15 bp, Homo sapiens
catggacagaagaag

SEQ ID NO: 119643 - DNA, 21 bp, Homo sapiens
catggacagaagaaggcagca

SEQ ID NO: 119644 - DNA, 15 bp, Homo sapiens
catggtccatcccct

SEQ ID NO: 119645 - DNA, 15 bp, Homo sapiens
catgtataatatttt

SEQ ID NO: 119646 - DNA, 20 bp, Homo sapiens
catgtataatatttttaatt

SEQ ID NO: 119647 - DNA, 13 bp, Homo sapiens
catgtgcctggaa

SEQ ID NO: 119648 - DNA, 16 bp, Homo sapiens
catgttcccagctcag

SEQ ID NO: 119649 - DNA, 13 bp, Homo sapiens
catttccgtgaag

SEQ ID NO: 119650 - DNA, 19 bp, Homo sapiens
catttccgtgaagggcacc

SEQ ID NO: 119651 - DNA, 15 bp, Homo sapiens
ccaaacccagcccct

SEQ ID NO: 119652 - DNA, 17 bp, Homo sapiens
ccaaacccagcccctgc

SEQ ID NO: 119653 - DNA, 12 bp, Homo sapiens
ccaaagatccca

SEQ ID NO: 119654 - DNA, 20 bp, Homo sapiens
ccaacctccccgcagagctc

SEQ ID NO: 119655 - DNA, 19 bp, Homo sapiens
ccaagctcggatcacatga

SEQ ID NO: 119656 - DNA, 16 bp, Homo sapiens
ccaaggctcccgttcc

SEQ ID NO: 119657 - DNA, 22 bp, Homo sapiens
ccaatgtgactaccgtgccagc

SEQ ID NO: 119658 - DNA, 14 bp, Homo sapiens
ccacaagagcccca

SEQ ID NO: 119659 - DNA, 14 bp, Homo sapiens
ccacagcccctggc

SEQ ID NO: 119660 - DNA, 19 bp, Homo sapiens
ccacagtgactgggccctg

SEQ ID NO: 119661 - DNA, 22 bp, Homo sapiens
ccacagtgactgggccctgtcc

SEQ ID NO: 119662 - DNA, 23 bp, Homo sapiens
ccacagtgactgggccctgtcca

SEQ ID NO: 119663 - DNA, 24 bp, Homo sapiens
ccacagtgactgggccctgtccag

SEQ ID NO: 119664 - DNA, 17 bp, Homo sapiens
ccaccgccaccgtgtgc

SEQ ID NO: 119665 - DNA, 18 bp, Homo sapiens
ccaccgccaccgtgtgcc

SEQ ID NO: 119666 - DNA, 15 bp, Homo sapiens
ccaccggtgccaaac

SEQ ID NO: 119667 - DNA, 17 bp, Homo sapiens
ccacctcttgtcagtgc

SEQ ID NO: 119668 - DNA, 21 bp, Homo sapiens
ccacctctttctacagcctaa

SEQ ID NO: 119669 - DNA, 23 bp, Homo sapiens
ccactccctgggggcgctgttcc

SEQ ID NO: 119670 - DNA, 19 bp, Homo sapiens
ccagagactcgagtcccca

SEQ ID NO: 119671 - DNA, 21 bp, Homo sapiens
ccagagactcgagtccccatg

SEQ ID NO: 119672 - DNA, 21 bp, Homo sapiens
ccagcccctgcggccgtcacc

SEQ ID NO: 119673 - DNA, 13 bp, Homo sapiens
ccagcgcctgccc

SEQ ID NO: 119674 - DNA, 14 bp, Homo sapiens
ccagctcactccct

SEQ ID NO: 119675 - DNA, 15 bp, Homo sapiens
ccaggagcccgtcag

SEQ ID NO: 119676 - DNA, 13 bp, Homo sapiens
ccagggggagctg

SEQ ID NO: 119677 - DNA, 21 bp, Homo sapiens
ccagtgatgctaaaggttgta

SEQ ID NO: 119678 - DNA, 20 bp, Homo sapiens
ccagtgctggccacacagca

SEQ ID NO: 119679 - DNA, 17 bp, Homo sapiens
ccagtggtaccagctca

SEQ ID NO: 119680 - DNA, 18 bp, Homo sapiens
ccatcatgtgcctggaaa

SEQ ID NO: 119681 - DNA, 16 bp, Homo sapiens
ccatctgctcctccca

SEQ ID NO: 119682 - DNA, 15 bp, Homo sapiens
ccatgattccctcct

SEQ ID NO: 119683 - DNA, 22 bp, Homo sapiens
ccatgcacgcaccccgcccctg

SEQ ID NO: 119684 - DNA, 17 bp, Homo sapiens
ccatggtccatcccctg

SEQ ID NO: 119685 - DNA, 16 bp, Homo sapiens
ccatgttcccagctca

SEQ ID NO: 119686 - DNA, 17 bp, Homo sapiens
gcatgcctggcccctcc

SEQ ID NO: 119687 - DNA, 19 bp, Homo sapiens
gccaaacccagcccctgcg

SEQ ID NO: 119688 - DNA, 19 bp, Homo sapiens
gccacacagcagcgcagcc

SEQ ID NO: 119689 - DNA, 18 bp, Homo sapiens
gccagcctacactgccag

SEQ ID NO: 119690 - DNA, 20 bp, Homo sapiens
gccagtgatgctaaaggttg

SEQ ID NO: 119691 - DNA, 18 bp, Homo sapiens
gccatggacagaagaagg

SEQ ID NO: 119692 - DNA, 22 bp, Homo sapiens
gcccaattcttacaaacatgtg

SEQ ID NO: 119693 - DNA, 13 bp, Homo sapiens
gcccagcctctga

SEQ ID NO: 119694 - DNA, 16 bp, Homo sapiens
gcccagtgctggccac

SEQ ID NO: 119695 - DNA, 20 bp, Homo sapiens
gcccagtgctggccacacag

SEQ ID NO: 119696 - DNA, 20 bp, Homo sapiens
gccccctcggcccctcacca

SEQ ID NO: 119697 - DNA, 23 bp, Homo sapiens
gccccctcggcccctcaccacct

SEQ ID NO: 119698 - DNA, 21 bp, Homo sapiens
gccccgccccctcggcccctc

SEQ ID NO: 119699 - DNA, 14 bp, Homo sapiens
gccccggctcccac

SEQ ID NO: 119700 - DNA, 17 bp, Homo sapiens
gccccggctcccaccgg

SEQ ID NO: 119701 - DNA, 14 bp, Homo sapiens
gcccctcaccacct

SEQ ID NO: 119702 - DNA, 14 bp, Homo sapiens
gcccctgcatgcct

SEQ ID NO: 119703 - DNA, 18 bp, Homo sapiens
gcccctgccccgccccca

SEQ ID NO: 119704 - DNA, 18 bp, Homo sapiens
gcccctgcggccgtcacc

SEQ ID NO: 119705 - DNA, 15 bp, Homo sapiens
gcccctggcactgca

SEQ ID NO: 119706 - DNA, 17 bp, Homo sapiens
gcccctggcactgcagg

SEQ ID NO: 119707 - DNA, 14 bp, Homo sapiens
gcccgtcaggccac

SEQ ID NO: 119708 - DNA, 19 bp, Homo sapiens
gccctgcgtaaccctcgcc

SEQ ID NO: 119709 - DNA, 15 bp, Homo sapiens
gccctgtccctccca

SEQ ID NO: 119710 - DNA, 18 bp, Homo sapiens
gccctgtccctcccactc

SEQ ID NO: 119711 - DNA, 20 bp, Homo sapiens
gccctgtccctcccactccc

SEQ ID NO: 119712 - DNA, 16 bp, Homo sapiens
gcccttccagtggtac

SEQ ID NO: 119713 - DNA, 22 bp, Homo sapiens
gcccttccagtggtaccagctc

SEQ ID NO: 119714 - DNA, 22 bp, Homo sapiens
gccgagccccaggagcccgtca

SEQ ID NO: 119715 - DNA, 23 bp, Homo sapiens
gccgcccagtgggacccacagtc

SEQ ID NO: 119716 - DNA, 16 bp, Homo sapiens
gccgggtacctcagtt

SEQ ID NO: 119717 - DNA, 20 bp, Homo sapiens
gccgggtacctcagtttctc

SEQ ID NO: 119718 - DNA, 20 bp, Homo sapiens
gccgtcaccccgccagccta

SEQ ID NO: 119719 - DNA, 18 bp, Homo sapiens
gcctcacctgcatcctct

SEQ ID NO: 119720 - DNA, 15 bp, Homo sapiens
gcctccccccgctgg

SEQ ID NO: 119721 - DNA, 16 bp, Homo sapiens
gcctccctccagagac

SEQ ID NO: 119722 - DNA, 16 bp, Homo sapiens
gcctctccttgcctgg

SEQ ID NO: 119723 - DNA, 15 bp, Homo sapiens
gcctctgcttgccag

SEQ ID NO: 119724 - DNA, 16 bp, Homo sapiens
ccctcgccctgtccct

SEQ ID NO: 119725 - DNA, 16 bp, Homo sapiens
ccctcggcccctcacc

SEQ ID NO: 119726 - DNA, 20 bp, Homo sapiens
ccctcggcccctcaccacct

SEQ ID NO: 119727 - DNA, 15 bp, Homo sapiens
ccctgcatgcctggc

SEQ ID NO: 119728 - DNA, 23 bp, Homo sapiens
ccctgcgtaaccctcgccctgtc

SEQ ID NO: 119729 - DNA, 24 bp, Homo sapiens
ccctgcgtaaccctcgccctgtcc

SEQ ID NO: 119730 - DNA, 10 bp, Homo sapiens
ccctggctct

SEQ ID NO: 119731 - DNA, 13 bp, Homo sapiens
ccctggctcttct

SEQ ID NO: 119732 - DNA, 14 bp, Homo sapiens
ccctgtccctccca

SEQ ID NO: 119733 - DNA, 20 bp, Homo sapiens
cccttaaggaggtagctccc

SEQ ID NO: 119734 - DNA, 11 bp, Homo sapiens
cccttccagtg

SEQ ID NO: 119735 - DNA, 24 bp, Homo sapiens
cccttccagtggtaccagctcact

SEQ ID NO: 119736 - DNA, 20 bp, Homo sapiens
ccgagagagaccccaccgcc

SEQ ID NO: 119737 - DNA, 12 bp, Homo sapiens
ccgccagcctac

SEQ ID NO: 119738 - DNA, 12 bp, Homo sapiens
ccgcccctgcat

SEQ ID NO: 119739 - DNA, 13 bp, Homo sapiens
ccgcccctgcatg

SEQ ID NO: 119740 - DNA, 23 bp, Homo sapiens
ccgctggggagcgaaagtttctt

SEQ ID NO: 119741 - DNA, 11 bp, Homo sapiens
ccggcccctgc

SEQ ID NO: 119742 - DNA, 14 bp, Homo sapiens
ccggctcccaccgg

SEQ ID NO: 119743 - DNA, 23 bp, Homo sapiens
ccggctcccaccggtgccaaacc

SEQ ID NO: 119744 - DNA, 20 bp, Homo sapiens
ccgggcaccacccccagtcc

SEQ ID NO: 119745 - DNA, 15 bp, Homo sapiens
ccgggtacctcagtt

SEQ ID NO: 119746 - DNA, 17 bp, Homo sapiens
ccgggtacctcagtttc

SEQ ID NO: 119747 - DNA, 22 bp, Homo sapiens
ccggtgccaaacccagcccctg

SEQ ID NO: 119748 - DNA, 15 bp, Homo sapiens
ccgtcaccccgccag

SEQ ID NO: 119749 - DNA, 11 bp, Homo sapiens
ccgtgccagca

SEQ ID NO: 119750 - DNA, 14 bp, Homo sapiens
ccgtgccagcagcg

SEQ ID NO: 119751 - DNA, 14 bp, Homo sapiens
ccgtgtgcctttcc

SEQ ID NO: 119752 - DNA, 20 bp, Homo sapiens
cctaatttattggattccct

SEQ ID NO: 119753 - DNA, 12 bp, Homo sapiens
cctacactgcca

SEQ ID NO: 119754 - DNA, 19 bp, Homo sapiens
cctattcgtagccatctcc

SEQ ID NO: 119755 - DNA, 13 bp, Homo sapiens
cctcaccacctct

SEQ ID NO: 119756 - DNA, 13 bp, Homo sapiens
cctcacctgcatc

SEQ ID NO: 119757 - DNA, 22 bp, Homo sapiens
cctcacctgcatcctctccccc

SEQ ID NO: 119758 - DNA, 12 bp, Homo sapiens
cctcagtgctcg

SEQ ID NO: 119759 - DNA, 12 bp, Homo sapiens
cctcagtttctc

SEQ ID NO: 119760 - DNA, 15 bp, Homo sapiens
cctcccactccctgg

SEQ ID NO: 119761 - DNA, 12 bp, Homo sapiens
cctcccccctgt

SEQ ID NO: 119762 - DNA, 19 bp, Homo sapiens
cctcctagaaaacccttcc

SEQ ID NO: 119763 - DNA, 21 bp, Homo sapiens
cctccttcctcagtcctggaa

SEQ ID NO: 119764 - DNA, 20 bp, Homo sapiens
cctcgccctgtccctcccac

SEQ ID NO: 119765 - DNA, 22 bp, Homo sapiens
cctcgccctgtccctcccactc

SEQ ID NO: 119766 - DNA, 18 bp, Homo sapiens
cctcggcccctcaccacc

SEQ ID NO: 119767 - DNA, 15 bp, Homo sapiens
cctctccttgcctgg

SEQ ID NO: 119768 - DNA, 17 bp, Homo sapiens
cctctgcttgccagcca

SEQ ID NO: 119769 - DNA, 16 bp, Homo sapiens
cctgcatgcctggccc

SEQ ID NO: 119770 - DNA, 22 bp, Homo sapiens
cctgcatgcctggcccctcctc

SEQ ID NO: 119771 - DNA, 22 bp, Homo sapiens
cctgcggccgtcaccccgccag

SEQ ID NO: 119772 - DNA, 21 bp, Homo sapiens
cctgcgtaaccctcgccctgt

SEQ ID NO: 119773 - DNA, 21 bp, Homo sapiens
cctggcactgcaggtggcctc

SEQ ID NO: 119774 - DNA, 12 bp, Homo sapiens
cctggctcttct

SEQ ID NO: 119775 - DNA, 12 bp, Homo sapiens
cctgtccctccc

SEQ ID NO: 119776 - DNA, 21 bp, Homo sapiens
ccttaaggaggtagctcccag

SEQ ID NO: 119777 - DNA, 22 bp, Homo sapiens
ccttccagtggtaccagctcac

SEQ ID NO: 119778 - DNA, 24 bp, Homo sapiens
ccttccagtggtaccagctcactc

SEQ ID NO: 119779 - DNA, 18 bp, Homo sapiens
ccttcctgaccctccgct

SEQ ID NO: 119780 - DNA, 14 bp, Homo sapiens
cctttcccgggccc

SEQ ID NO: 119781 - DNA, 20 bp, Homo sapiens
cctttcccgggccctcagcc

SEQ ID NO: 119782 - DNA, 21 bp, Homo sapiens
cctttcccgggccctcagccc

SEQ ID NO: 119783 - DNA, 12 bp, Homo sapiens
cgaaagtttctt

SEQ ID NO: 119784 - DNA, 22 bp, Homo sapiens
cgaaagtttcttggtctcagct

SEQ ID NO: 119785 - DNA, 14 bp, Homo sapiens
cgaagcccttccag

SEQ ID NO: 119786 - DNA, 16 bp, Homo sapiens
cgaagcccttccagtg

SEQ ID NO: 119787 - DNA, 19 bp, Homo sapiens
cgaagcccttccagtggta

SEQ ID NO: 119788 - DNA, 19 bp, Homo sapiens
cgagaactcgaagcccttc

SEQ ID NO: 119789 - DNA, 20 bp, Homo sapiens
cgagaactcgaagcccttcc

SEQ ID NO: 119790 - DNA, 19 bp, Homo sapiens
cgagaatgcaggccccgcc

SEQ ID NO: 119791 - DNA, 16 bp, Homo sapiens
cgagatcgctggcaga

SEQ ID NO: 119792 - DNA, 18 bp, Homo sapiens
cgagatcgctggcagaga

SEQ ID NO: 119793 - DNA, 15 bp, Homo sapiens
cgagccccaggagcc

SEQ ID NO: 119794 - DNA, 15 bp, Homo sapiens
cgcacagcactgcct

SEQ ID NO: 119795 - DNA, 17 bp, Homo sapiens
cgcacagcactgcctgc

SEQ ID NO: 119796 - DNA, 20 bp, Homo sapiens
cgcacagcactgcctgccaa

SEQ ID NO: 119797 - DNA, 13 bp, Homo sapiens
cgcagagctccct

SEQ ID NO: 119798 - DNA, 12 bp, Homo sapiens
cgcccctgcatg

SEQ ID NO: 119799 - DNA, 15 bp, Homo sapiens
cgcccctgcatgcct

SEQ ID NO: 119800 - DNA, 18 bp, Homo sapiens
cgcccctgcatgcctggc

SEQ ID NO: 119801 - DNA, 9 bp, Homo sapiens
cgccctgcg

SEQ ID NO: 119802 - DNA, 21 bp, Homo sapiens
cgccctgtccctcccactccc

SEQ ID NO: 119803 - DNA, 18 bp, Homo sapiens
tgcggccgtcaccccgcc

SEQ ID NO: 119804 - DNA, 21 bp, Homo sapiens
tgcggccgtcaccccgccagc

SEQ ID NO: 119805 - DNA, 20 bp, Homo sapiens
tgctaactagcttggaaact

SEQ ID NO: 119806 - DNA, 18 bp, Homo sapiens
tgctcctcccattcccct

SEQ ID NO: 119807 - DNA, 21 bp, Homo sapiens
tgctcctgtacgaacccctcc

SEQ ID NO: 119808 - DNA, 13 bp, Homo sapiens
tgcttgccagcca

SEQ ID NO: 119809 - DNA, 23 bp, Homo sapiens
tggatgcggaacccaaattacgt

SEQ ID NO: 119810 - DNA, 21 bp, Homo sapiens
tggattccctattcgtagcca

SEQ ID NO: 119811 - DNA, 18 bp, Homo sapiens
tggcacagcccaaagaag

SEQ ID NO: 119812 - DNA, 18 bp, Homo sapiens
tggcactgcaggtggcct

SEQ ID NO: 119813 - DNA, 16 bp, Homo sapiens
tggcagagaaggcttc

SEQ ID NO: 119814 - DNA, 21 bp, Homo sapiens
tggcagagaaggcttcctcca

SEQ ID NO: 119815 - DNA, 14 bp, Homo sapiens
tggccacacagcag

SEQ ID NO: 119816 - DNA, 13 bp, Homo sapiens
tggcgccctgcgt

SEQ ID NO: 119817 - DNA, 22 bp, Homo sapiens
tgggacccacagtcacacagag

SEQ ID NO: 119818 - DNA, 19 bp, Homo sapiens
tgggagcctgaggcatgag

SEQ ID NO: 119819 - DNA, 18 bp, Homo sapiens
tgggcagcagctcagcct

SEQ ID NO: 119820 - DNA, 14 bp, Homo sapiens
tggtaccagctcac

SEQ ID NO: 119821 - DNA, 15 bp, Homo sapiens
tggtaccagctcact

SEQ ID NO: 119822 - DNA, 22 bp, Homo sapiens
tggtcagccaaggctcccgttc

SEQ ID NO: 119823 - DNA, 16 bp, Homo sapiens
tggtcggcaagagtga

SEQ ID NO: 119824 - DNA, 17 bp, Homo sapiens
tggtttgcaaggaagcc

SEQ ID NO: 119825 - DNA, 12 bp, Homo sapiens
tgtactacaatt

SEQ ID NO: 119826 - DNA, 20 bp, Homo sapiens
tgtccctcccactccctggg

SEQ ID NO: 119827 - DNA, 19 bp, Homo sapiens
tgtgactaccgtgccagca

SEQ ID NO: 119828 - DNA, 19 bp, Homo sapiens
tgtgcatagagccacgtat

SEQ ID NO: 119829 - DNA, 15 bp, Homo sapiens
tgtggttaatgccat

SEQ ID NO: 119830 - DNA, 17 bp, Homo sapiens
tgttaatggtttgaata

SEQ ID NO: 119831 - DNA, 19 bp, Homo sapiens
ttaaggaggtagctcccag

SEQ ID NO: 119832 - DNA, 20 bp, Homo sapiens
ttaaggaggtagctcccagc

SEQ ID NO: 119833 - DNA, 18 bp, Homo sapiens
ttacatcaaggcttcaaa

SEQ ID NO: 119834 - DNA, 16 bp, Homo sapiens
ttatagccgaaatgat

SEQ ID NO: 119835 - DNA, 19 bp, Homo sapiens
ttatttcttaaacaaatgt

SEQ ID NO: 119836 - DNA, 16 bp, Homo sapiens
ttcagtgaaagcatca

SEQ ID NO: 119837 - DNA, 13 bp, Homo sapiens
ttcatttccgtga

SEQ ID NO: 119838 - DNA, 20 bp, Homo sapiens
ttccacagtgactgggccct

SEQ ID NO: 119839 - DNA, 15 bp, Homo sapiens
ttccatgaaaatgca

SEQ ID NO: 119840 - DNA, 20 bp, Homo sapiens
ttcccagctcagtgccaaag

SEQ ID NO: 119841 - DNA, 18 bp, Homo sapiens
ttcccgggccctcagccc

SEQ ID NO: 119842 - DNA, 16 bp, Homo sapiens
ttccgtgaagggcacc

SEQ ID NO: 119843 - DNA, 17 bp, Homo sapiens
ttcctcagtcctggaag

SEQ ID NO: 119844 - DNA, 20 bp, Homo sapiens
ttcgatgggcccaattctta

SEQ ID NO: 119845 - DNA, 20 bp, Homo sapiens
ttctcctttattgctcctgt

SEQ ID NO: 119846 - DNA, 16 bp, Homo sapiens
ttgaatataaacacta

SEQ ID NO: 119847 - DNA, 16 bp, Homo sapiens
ctccccgcagagctcc

SEQ ID NO: 119848 - DNA, 21 bp, Homo sapiens
ctccccgcagagctcccttcc

SEQ ID NO: 119849 - DNA, 15 bp, Homo sapiens
ctcccctcccccctg

SEQ ID NO: 119850 - DNA, 20 bp, Homo sapiens
ctcccgttccgtgggatgcc

SEQ ID NO: 119851 - DNA, 15 bp, Homo sapiens
ctcctcccattcccc

SEQ ID NO: 119852 - DNA, 19 bp, Homo sapiens
ctccttcctcagtcctgga

SEQ ID NO: 119853 - DNA, 20 bp, Homo sapiens
ctccttcctcagtcctggaa

SEQ ID NO: 119854 - DNA, 19 bp, Homo sapiens
ctcctttattgctcctgta

SEQ ID NO: 119855 - DNA, 14 bp, Homo sapiens
ctcgaagcccttcc

SEQ ID NO: 119856 - DNA, 16 bp, Homo sapiens
ctcgaagcccttccag

SEQ ID NO: 119857 - DNA, 18 bp, Homo sapiens
ctcgaagcccttccagtg

SEQ ID NO: 119858 - DNA, 20 bp, Homo sapiens
ctcgaccacttttcagttca

SEQ ID NO: 119859 - DNA, 14 bp, Homo sapiens
ctcggcccctcacc

SEQ ID NO: 119860 - DNA, 16 bp, Homo sapiens
ctctcaaagaccccat

SEQ ID NO: 119861 - DNA, 16 bp, Homo sapiens
ctctccttgcctggtg

SEQ ID NO: 119862 - DNA, 21 bp, Homo sapiens
ctctcggggcgacccctcagt

SEQ ID NO: 119863 - DNA, 18 bp, Homo sapiens
ctgaccctccgctgcaga

SEQ ID NO: 119864 - DNA, 19 bp, Homo sapiens
ctgagctggccctttccag

SEQ ID NO: 119865 - DNA, 20 bp, Homo sapiens
ctgagttgacttgacagaac

SEQ ID NO: 119866 - DNA, 15 bp, Homo sapiens
ctgcatcctctcccc

SEQ ID NO: 119867 - DNA, 16 bp, Homo sapiens
ctgcatcctctccccc

SEQ ID NO: 119868 - DNA, 19 bp, Homo sapiens
ctgcgtaaccctcgccctg

SEQ ID NO: 119869 - DNA, 14 bp, Homo sapiens
ctgcttgccagcca

SEQ ID NO: 119870 - DNA, 19 bp, Homo sapiens
ctgcttgccagccaggagt

SEQ ID NO: 119871 - DNA, 12 bp, Homo sapiens
ctggccacacag

SEQ ID NO: 119872 - DNA, 14 bp, Homo sapiens
ctggctcttctctc

SEQ ID NO: 119873 - DNA, 14 bp, Homo sapiens
ctgggatgtttctg

SEQ ID NO: 119874 - DNA, 12 bp, Homo sapiens
ctgggccctgtc

SEQ ID NO: 119875 - DNA, 13 bp, Homo sapiens
ctgggccctgtcc

SEQ ID NO: 119876 - DNA, 22 bp, Homo sapiens
ctggggtacaaggggcccagtg

SEQ ID NO: 119877 - DNA, 23 bp, Homo sapiens
ctggggtacaaggggcccagtgc

SEQ ID NO: 119878 - DNA, 13 bp, Homo sapiens
ctgtaaacacagt

SEQ ID NO: 119879 - DNA, 14 bp, Homo sapiens
ctgtccctcccact

SEQ ID NO: 119880 - DNA, 15 bp, Homo sapiens
ctgtctgcggagcca

SEQ ID NO: 119881 - DNA, 23 bp, Homo sapiens
ctgtctgcggagccagcgcctgc

SEQ ID NO: 119882 - DNA, 24 bp, Homo sapiens
ctgtctgcggagccagcgcctgcc

SEQ ID NO: 119883 - DNA, 18 bp, Homo sapiens
cttaaggaggtagctccc

SEQ ID NO: 119884 - DNA, 22 bp, Homo sapiens
cttaattctgagctggcccttt

SEQ ID NO: 119885 - DNA, 14 bp, Homo sapiens
cttactccaggaga

SEQ ID NO: 119886 - DNA, 22 bp, Homo sapiens
cttcatttccgtgaagggcacc

SEQ ID NO: 119887 - DNA, 14 bp, Homo sapiens
cttcccgccctcgg

SEQ ID NO: 119888 - DNA, 17 bp, Homo sapiens
cttctctactctggaag

SEQ ID NO: 119889 - DNA, 16 bp, Homo sapiens
cttgacagaacactgt

SEQ ID NO: 119890 - DNA, 17 bp, Homo sapiens
cttgggtcccagggaag

SEQ ID NO: 119891 - DNA, 20 bp, Homo sapiens
ctttggggcttttacaccag

SEQ ID NO: 119892 - DNA, 18 bp, Homo sapiens
gaaaatgcaacaacatgt

SEQ ID NO: 119893 - DNA, 13 bp, Homo sapiens
gaaaattaacact

SEQ ID NO: 119894 - DNA, 21 bp, Homo sapiens
gaaaccattatgaagaagaga

SEQ ID NO: 119895 - DNA, 16 bp, Homo sapiens
gaaagacagagctggg

SEQ ID NO: 119896 - DNA, 19 bp, Homo sapiens
gaacccctcccctcccccc

SEQ ID NO: 119897 - DNA, 16 bp, Homo sapiens
gaagcccttccagtgg

SEQ ID NO: 119898 - DNA, 23 bp, Homo sapiens
gaagcccttccagtggtaccagc

SEQ ID NO: 119899 - DNA, 14 bp, Homo sapiens
gaagctggggtaca

SEQ ID NO: 119900 - DNA, 20 bp, Homo sapiens
gaaggaaaaggcagggagcg

SEQ ID NO: 119901 - DNA, 16 bp, Homo sapiens
gaaggaccctggctct

SEQ ID NO: 119902 - DNA, 16 bp, Homo sapiens
gaaggagacagcagca

SEQ ID NO: 119903 - DNA, 11 bp, Homo sapiens
gaagggcaccg

SEQ ID NO: 119904 - DNA, 14 bp, Homo sapiens
gaagggcaccgaga

SEQ ID NO: 119905 - DNA, 13 bp, Homo sapiens
gaatataaacact

SEQ ID NO: 119906 - DNA, 18 bp, Homo sapiens
gacaccatgttcccagct

SEQ ID NO: 119907 - DNA, 21 bp, Homo sapiens
gacaccatgttcccagctcag

SEQ ID NO: 119908 - DNA, 13 bp, Homo sapiens
gacagaacactgt

SEQ ID NO: 119909 - DNA, 20 bp, Homo sapiens
gacctactaaaaatataaaa

SEQ ID NO: 119910 - DNA, 15 bp, Homo sapiens
gaccttctaggaagc

SEQ ID NO: 119911 - DNA, 12 bp, Homo sapiens
gacgcacagcac

SEQ ID NO: 119912 - DNA, 17 bp, Homo sapiens
gactaccgtgccagcag

SEQ ID NO: 119913 - DNA, 18 bp, Homo sapiens
gactatattgtacacacc

SEQ ID NO: 119914 - DNA, 18 bp, Homo sapiens
gacttgacagaacactgt

SEQ ID NO: 119915 - DNA, 20 bp, Homo sapiens
gagaactcgaagcccttcca

SEQ ID NO: 119916 - DNA, 20 bp, Homo sapiens
gagaatgcaggccccgcccc

SEQ ID NO: 119917 - DNA, 12 bp, Homo sapiens
gagacagcagca

SEQ ID NO: 119918 - DNA, 15 bp, Homo sapiens
gagaccccaccgcca

SEQ ID NO: 119919 - DNA, 11 bp, Homo sapiens
ggcccctcacc

SEQ ID NO: 119920 - DNA, 17 bp, Homo sapiens
ggcccctcaccacctct

SEQ ID NO: 119921 - DNA, 14 bp, Homo sapiens
ggcccctcctccta

SEQ ID NO: 119922 - DNA, 14 bp, Homo sapiens
ggccctcagccctc

SEQ ID NO: 119923 - DNA, 22 bp, Homo sapiens
ggccgggcaccacccccagtcc

SEQ ID NO: 119924 - DNA, 14 bp, Homo sapiens
ggcctccctccaga

SEQ ID NO: 119925 - DNA, 17 bp, Homo sapiens
ggcgacccctcagtgct

SEQ ID NO: 119926 - DNA, 14 bp, Homo sapiens
ggctcttctctcgg

SEQ ID NO: 119927 - DNA, 23 bp, Homo sapiens
ggcttcctccagcggctgggtgg

SEQ ID NO: 119928 - DNA, 16 bp, Homo sapiens
gggaatggcacagccc

SEQ ID NO: 119929 - DNA, 16 bp, Homo sapiens
gggcaccacccccagt

SEQ ID NO: 119930 - DNA, 17 bp, Homo sapiens
gggccccggctcccacc

SEQ ID NO: 119931 - DNA, 15 bp, Homo sapiens
gggccctcagccctc

SEQ ID NO: 119932 - DNA, 19 bp, Homo sapiens
gggcctctgcttgccagcc

SEQ ID NO: 119933 - DNA, 15 bp, Homo sapiens
gggcggcccagcctc

SEQ ID NO: 119934 - DNA, 15 bp, Homo sapiens
ggggaattcatctct

SEQ ID NO: 119935 - DNA, 14 bp, Homo sapiens
ggggccccggctcc

SEQ ID NO: 119936 - DNA, 17 bp, Homo sapiens
ggggcgacccctcagtg

SEQ ID NO: 119937 - DNA, 14 bp, Homo sapiens
ggggcggcccagcc

SEQ ID NO: 119938 - DNA, 21 bp, Homo sapiens
ggggtacaaggggcccagtgc

SEQ ID NO: 119939 - DNA, 18 bp, Homo sapiens
gggtacaaggggcccagt

SEQ ID NO: 119940 - DNA, 14 bp, Homo sapiens
gggtacctcagttt

SEQ ID NO: 119941 - DNA, 15 bp, Homo sapiens
ggtaccagctcactc

SEQ ID NO: 119942 - DNA, 17 bp, Homo sapiens
ggtaccagctcactccc

SEQ ID NO: 119943 - DNA, 19 bp, Homo sapiens
ggtaccagctcactccctg

SEQ ID NO: 119944 - DNA, 12 bp, Homo sapiens
ggtacctcagtt

SEQ ID NO: 119945 - DNA, 16 bp, Homo sapiens
ggtagctcccagcact

SEQ ID NO: 119946 - DNA, 21 bp, Homo sapiens
ggtcaccagggggagctgtct

SEQ ID NO: 119947 - DNA, 13 bp, Homo sapiens
ggtccatcccctg

SEQ ID NO: 119948 - DNA, 19 bp, Homo sapiens
ggtcggcaagagtgagact

SEQ ID NO: 119949 - DNA, 16 bp, Homo sapiens
ggtctcagcttcattt

SEQ ID NO: 119950 - DNA, 17 bp, Homo sapiens
ggtgccaaacccagccc

SEQ ID NO: 119951 - DNA, 19 bp, Homo sapiens
ggtgccaaacccagcccct

SEQ ID NO: 119952 - DNA, 22 bp, Homo sapiens
ggtgccaaacccagcccctgcg

SEQ ID NO: 119953 - DNA, 22 bp, Homo sapiens
ggtgcgagagaggtgggcagca

SEQ ID NO: 119954 - DNA, 23 bp, Homo sapiens
ggtgcgagagaggtgggcagcag

SEQ ID NO: 119955 - DNA, 19 bp, Homo sapiens
ggtggaggttgcagtgagc

SEQ ID NO: 119956 - DNA, 13 bp, Homo sapiens
ggtggcgccctgc

SEQ ID NO: 119957 - DNA, 16 bp, Homo sapiens
gtacaaggggcccagt

SEQ ID NO: 119958 - DNA, 18 bp, Homo sapiens
gtacaaggggcccagtgc

SEQ ID NO: 119959 - DNA, 19 bp, Homo sapiens
gtacaaggggcccagtgct

SEQ ID NO: 119960 - DNA, 17 bp, Homo sapiens
gtaccagctcactccct

SEQ ID NO: 119961 - DNA, 14 bp, Homo sapiens
gtacctcagtttct

SEQ ID NO: 119962 - DNA, 15 bp, Homo sapiens
gtacctcagtttctc

SEQ ID NO: 119963 - DNA, 17 bp, Homo sapiens
gtagccatctccgtggc

SEQ ID NO: 119964 - DNA, 23 bp, Homo sapiens
gtatgtttttgtgtatttgttaa

SEQ ID NO: 119965 - DNA, 14 bp, Homo sapiens
gtatttgttaatgg

SEQ ID NO: 119966 - DNA, 19 bp, Homo sapiens
gtcacacagagcgcctcac

SEQ ID NO: 119967 - DNA, 14 bp, Homo sapiens
gtcccatctgctcc

SEQ ID NO: 119968 - DNA, 16 bp, Homo sapiens
gtccccggcccctgcc

SEQ ID NO: 119969 - DNA, 17 bp, Homo sapiens
gtccccggcccctgccc

SEQ ID NO: 119970 - DNA, 20 bp, Homo sapiens
gtcccgtggggccccggctc

SEQ ID NO: 119971 - DNA, 17 bp, Homo sapiens
gtctgcggagccagcgc

SEQ ID NO: 119972 - DNA, 20 bp, Homo sapiens
gtgaaagcatcacttgggat

SEQ ID NO: 119973 - DNA, 20 bp, Homo sapiens
gtgaaggaccctggctcttc

SEQ ID NO: 119974 - DNA, 18 bp, Homo sapiens
gtgactaccgtgccagca

SEQ ID NO: 119975 - DNA, 19 bp, Homo sapiens
gtgactaccgtgccagcag

SEQ ID NO: 119976 - DNA, 20 bp, Homo sapiens
gtgactaccgtgccagcagc

SEQ ID NO: 119977 - DNA, 18 bp, Homo sapiens
gtgactgggccctgtcca

SEQ ID NO: 119978 - DNA, 21 bp, Homo sapiens
gtgccaaacccagcccctgcg

SEQ ID NO: 119979 - DNA, 19 bp, Homo sapiens
gtgcctttcccgggccctc

SEQ ID NO: 119980 - DNA, 20 bp, Homo sapiens
gtgcgagagaggtgggcagc

SEQ ID NO: 119981 - DNA, 22 bp, Homo sapiens
gtgctgcgagatcgctggcaga

SEQ ID NO: 119982 - DNA, 23 bp, Homo sapiens
gtggaggagctcaggacactaat

SEQ ID NO: 119983 - DNA, 22 bp, Homo sapiens
gtggaggttgcagtgagctgag

SEQ ID NO: 119984 - DNA, 14 bp, Homo sapiens
gtggcctccctcca

SEQ ID NO: 119985 - DNA, 14 bp, Homo sapiens
gtgggtcaaggaat

SEQ ID NO: 119986 - DNA, 18 bp, Homo sapiens
gttcccagctcagtgcca

SEQ ID NO: 119987 - DNA, 19 bp, Homo sapiens
gttccgtgggatgccataa

SEQ ID NO: 119988 - DNA, 16 bp, Homo sapiens
taaccctcgccctgtc

SEQ ID NO: 119989 - DNA, 21 bp, Homo sapiens
taaccctcgccctgtccctcc

SEQ ID NO: 119990 - DNA, 22 bp, Homo sapiens
taactcaatattttccatgaaa

SEQ ID NO: 119991 - DNA, 19 bp, Homo sapiens
taaggaggtagctcccagc

SEQ ID NO: 119992 - DNA, 17 bp, Homo sapiens
tacaaacatgtggttaa

SEQ ID NO: 119993 - DNA, 12 bp, Homo sapiens
tacagcctaatt

SEQ ID NO: 119994 - DNA, 23 bp, Homo sapiens
tacagcctaatttattggattcc

SEQ ID NO: 119995 - DNA, 15 bp, Homo sapiens
taccagctcactccc

SEQ ID NO: 119996 - DNA, 17 bp, Homo sapiens
taccagctcactccctg

SEQ ID NO: 119997 - DNA, 18 bp, Homo sapiens
taccagctcactccctgg

SEQ ID NO: 119998 - DNA, 21 bp, Homo sapiens
tacgaacccctcccctccccc

SEQ ID NO: 119999 - DNA, 17 bp, Homo sapiens
tagaaagacagagctgg

SEQ ID NO: 120000 - DNA, 20 bp, Homo sapiens
tatttgttaatggtttgaat

SEQ ID NO: 120001 - DNA, 17 bp, Homo sapiens
tatttttatttgtttgt

SEQ ID NO: 120002 - DNA, 12 bp, Homo sapiens
tcaaagacccca

SEQ ID NO: 120003 - DNA, 14 bp, Homo sapiens
tcaagagagagtca

SEQ ID NO: 120004 - DNA, 17 bp, Homo sapiens
tcaatggtttgcaagga

SEQ ID NO: 120005 - DNA, 18 bp, Homo sapiens
tcaatggtttgcaaggaa

SEQ ID NO: 120006 - DNA, 19 bp, Homo sapiens
tcaatggtttgcaaggaag

SEQ ID NO: 120007 - DNA, 21 bp, Homo sapiens
tcacacagagcgcctcacctg

SEQ ID NO: 120008 - DNA, 13 bp, Homo sapiens
tcaccccgccagc

SEQ ID NO: 120009 - DNA, 15 bp, Homo sapiens
tcaccccgccagcct

SEQ ID NO: 120010 - DNA, 14 bp, Homo sapiens
tcacctgcatcctc

SEQ ID NO: 120011 - DNA, 19 bp, Homo sapiens
tcaggccacagcccctggc

SEQ ID NO: 120012 - DNA, 21 bp, Homo sapiens
tcaggccacagcccctggcac

SEQ ID NO: 120013 - DNA, 12 bp, Homo sapiens
tcagtcctggaa

SEQ ID NO: 120014 - DNA, 15 bp, Homo sapiens
tcagtgctcggcagt

SEQ ID NO: 120015 - DNA, 22 bp, Homo sapiens
tcatactggggtgcgagagagg

SEQ ID NO: 120016 - DNA, 14 bp, Homo sapiens
tcatgtgcctggaa

SEQ ID NO: 120017 - DNA, 18 bp, Homo sapiens
tccacagtgactgggccc

SEQ ID NO: 120018 - DNA, 20 bp, Homo sapiens
tccagagactcgagtcccca

SEQ ID NO: 120019 - DNA, 21 bp, Homo sapiens
tccagctatttttatttgttt

SEQ ID NO: 120020 - DNA, 17 bp, Homo sapiens
tccagtggtaccagctc

SEQ ID NO: 120021 - DNA, 12 bp, Homo sapiens
tccatcccctga

SEQ ID NO: 120022 - DNA, 16 bp, Homo sapiens
tcccaccggtgccaaa

SEQ ID NO: 120023 - DNA, 14 bp, Homo sapiens
tcccactccctggg

SEQ ID NO: 120024 - DNA, 19 bp, Homo sapiens
tcccagctcagtgccaaag

SEQ ID NO: 120025 - DNA, 15 bp, Homo sapiens
tcccatctgctcctc

SEQ ID NO: 120026 - DNA, 12 bp, Homo sapiens
tcccattcccct

SEQ ID NO: 120027 - DNA, 13 bp, Homo sapiens
tcccctcccccct

SEQ ID NO: 120028 - DNA, 12 bp, Homo sapiens
tcccgggccctc

SEQ ID NO: 120029 - DNA, 16 bp, Homo sapiens
tcccgggccctcagcc

SEQ ID NO: 120030 - DNA, 17 bp, Homo sapiens
tcccgggccctcagccc

SEQ ID NO: 120031 - DNA, 19 bp, Homo sapiens
tcccgggccctcagccctc

SEQ ID NO: 120032 - DNA, 19 bp, Homo sapiens
tcccgtggggccccggctc

SEQ ID NO: 120033 - DNA, 21 bp, Homo sapiens
tccctattcgtagccatctcc

SEQ ID NO: 120034 - DNA, 17 bp, Homo sapiens
tcctagaaaacccttcc

SEQ ID NO: 120035 - DNA, 17 bp, Homo sapiens
tcctcagtcctggaagc

SEQ ID NO: 120036 - DNA, 19 bp, Homo sapiens
tgcggccgtcaccccgcca

SEQ ID NO: 120037 - DNA, 20 bp, Homo sapiens
tgcggccgtcaccccgccag

SEQ ID NO: 120038 - DNA, 23 bp, Homo sapiens
tgcggccgtcaccccgccagcct

SEQ ID NO: 120039 - DNA, 21 bp, Homo sapiens
tgcgtaaccctcgccctgtcc

SEQ ID NO: 120040 - DNA, 15 bp, Homo sapiens
tgctgagttggtgtt

SEQ ID NO: 120041 - DNA, 12 bp, Homo sapiens
tgcttgccagcc

SEQ ID NO: 120042 - DNA, 15 bp, Homo sapiens
tgcttgccagccagg

SEQ ID NO: 120043 - DNA, 12 bp, Homo sapiens
tggacagaagaa

SEQ ID NO: 120044 - DNA, 19 bp, Homo sapiens
tggaggagctcaggacact

SEQ ID NO: 120045 - DNA, 20 bp, Homo sapiens
tggagggtggcgccctgcgt

SEQ ID NO: 120046 - DNA, 20 bp, Homo sapiens
tggaggttgcagtgagctga

SEQ ID NO: 120047 - DNA, 13 bp, Homo sapiens
tggcactgcaggt

SEQ ID NO: 120048 - DNA, 23 bp, Homo sapiens
tggcactgcaggtggcctccctc

SEQ ID NO: 120049 - DNA, 17 bp, Homo sapiens
tggcagagaaggcttcc

SEQ ID NO: 120050 - DNA, 16 bp, Homo sapiens
tggccacacagcagcg

SEQ ID NO: 120051 - DNA, 13 bp, Homo sapiens
tggcccctcctcc

SEQ ID NO: 120052 - DNA, 11 bp, Homo sapiens
tggcgccctgc

SEQ ID NO: 120053 - DNA, 19 bp, Homo sapiens
tggcgccctgcgtaaccct

SEQ ID NO: 120054 - DNA, 16 bp, Homo sapiens
tgggacccacagtcac

SEQ ID NO: 120055 - DNA, 17 bp, Homo sapiens
tggggccccggctccca

SEQ ID NO: 120056 - DNA, 16 bp, Homo sapiens
tggtccatcccctgag

SEQ ID NO: 120057 - DNA, 15 bp, Homo sapiens
tggtggtatctgagt

SEQ ID NO: 120058 - DNA, 19 bp, Homo sapiens
tgtattgcatatatacata

SEQ ID NO: 120059 - DNA, 18 bp, Homo sapiens
tgtcaagagagagtcaaa

SEQ ID NO: 120060 - DNA, 15 bp, Homo sapiens
tgtccctcccactcc

SEQ ID NO: 120061 - DNA, 16 bp, Homo sapiens
tgtctgcggagccagc

SEQ ID NO: 120062 - DNA, 16 bp, Homo sapiens
tgtgactaccgtgcca

SEQ ID NO: 120063 - DNA, 17 bp, Homo sapiens
tgtgactaccgtgccag

SEQ ID NO: 120064 - DNA, 20 bp, Homo sapiens
tgtgactaccgtgccagcag

SEQ ID NO: 120065 - DNA, 20 bp, Homo sapiens
tgtggttaatgccatggaca

SEQ ID NO: 120066 - DNA, 22 bp, Homo sapiens
ttaaacaaatgtatgattacat

SEQ ID NO: 120067 - DNA, 19 bp, Homo sapiens
ttaacactgcttgtgtttt

SEQ ID NO: 120068 - DNA, 12 bp, Homo sapiens
ttacaaacatgt

SEQ ID NO: 120069 - DNA, 21 bp, Homo sapiens
ttatcatctcgaccacttttc

SEQ ID NO: 120070 - DNA, 17 bp, Homo sapiens
ttcaagttaaattttat

SEQ ID NO: 120071 - DNA, 22 bp, Homo sapiens
ttcaatggtttgcaaggaagcc

SEQ ID NO: 120072 - DNA, 19 bp, Homo sapiens
ttcaatttccaagagctga

SEQ ID NO: 120073 - DNA, 19 bp, Homo sapiens
ttccacagtgactgggccc

SEQ ID NO: 120074 - DNA, 22 bp, Homo sapiens
ttccacagtgactgggccctgt

SEQ ID NO: 120075 - DNA, 13 bp, Homo sapiens
ttctacagcctaa

SEQ ID NO: 120076 - DNA, 17 bp, Homo sapiens
ttctcctttattgctcc

SEQ ID NO: 120077 - DNA, 20 bp, Homo sapiens
ttctctcggggcgacccctc

SEQ ID NO: 120078 - DNA, 16 bp, Homo sapiens
ttgacagaacactgtc

SEQ ID NO: 120079 - DNA, 19 bp, Homo sapiens
ttgacttgacagaacactg

SEQ ID NO: 120080 - DNA, 21 bp, Homo sapiens
ttgacttgacagaacactgtc

SEQ ID NO: 120081 - DNA, 13 bp, Homo sapiens
ttgggattaatat

SEQ ID NO: 120082 - DNA, 19 bp, Homo sapiens
ttgttaatggtttgaatat

SEQ ID NO: 120083 - DNA, 21 bp, Homo sapiens
tttacaccagttcctttcaat

SEQ ID NO: 120084 - DNA, 17 bp, Homo sapiens
tttcagtgaaagcatca

SEQ ID NO: 120085 - DNA, 13 bp, Homo sapiens
tttccaagagctg

SEQ ID NO: 120086 - DNA, 17 bp, Homo sapiens
tttccatgaaaatgcaa

SEQ ID NO: 120087 - DNA, 13 bp, Homo sapiens
tttgtttgtgcat

SEQ ID NO: 120088 - DNA, 18 bp, Homo sapiens
ttttccatgaaaatgcaa

SEQ ID NO: 120089 - DNA, 19 bp, Homo sapiens
tttttatttgtttgtgcat

SEQ ID NO: 120090 - DNA, 15 bp, Homo sapiens
tttttgtgtatttgt

SEQ ID NO: 120091 - DNA, 17 bp, Homo sapiens
agctgtctgcggagcca

SEQ ID NO: 120092 - DNA, 14 bp, Homo sapiens
aggaccctggctct

SEQ ID NO: 120093 - DNA, 14 bp, Homo sapiens
aggagacagcagca

SEQ ID NO: 120094 - DNA, 20 bp, Homo sapiens
aggagacagcagcacccacc

SEQ ID NO: 120095 - DNA, 12 bp, Homo sapiens
aggagcccgtca

SEQ ID NO: 120096 - DNA, 20 bp, Homo sapiens
aggagcccgtcaggccacag

SEQ ID NO: 120097 - DNA, 13 bp, Homo sapiens
agggaagttttgt

SEQ ID NO: 120098 - DNA, 16 bp, Homo sapiens
agggagcgagggagaa

SEQ ID NO: 120099 - DNA, 16 bp, Homo sapiens
agggcaccgagaactc

SEQ ID NO: 120100 - DNA, 19 bp, Homo sapiens
aggggcccagtgctggcca

SEQ ID NO: 120101 - DNA, 14 bp, Homo sapiens
agggtggcgccctg

SEQ ID NO: 120102 - DNA, 15 bp, Homo sapiens
agggtggcgccctgc

SEQ ID NO: 120103 - DNA, 20 bp, Homo sapiens
aggtggaggttgcagtgagc

SEQ ID NO: 120104 - DNA, 14 bp, Homo sapiens
aggtggcctccctc

SEQ ID NO: 120105 - DNA, 18 bp, Homo sapiens
aggtgggcagcagctcag

SEQ ID NO: 120106 - DNA, 20 bp, Homo sapiens
aggttgcagtgagctgagat

SEQ ID NO: 120107 - DNA, 14 bp, Homo sapiens
aggtttctgaaaat

SEQ ID NO: 120108 - DNA, 20 bp, Homo sapiens
agtagaaagacagagctggg

SEQ ID NO: 120109 - DNA, 21 bp, Homo sapiens
agtagaaagacagagctggga

SEQ ID NO: 120110 - DNA, 21 bp, Homo sapiens
agtccatatttcaatttccaa

SEQ ID NO: 120111 - DNA, 14 bp, Homo sapiens
agtgactgggccct

SEQ ID NO: 120112 - DNA, 20 bp, Homo sapiens
agtgctggccacacagcagc

SEQ ID NO: 120113 - DNA, 21 bp, Homo sapiens
agtgctggccacacagcagcg

SEQ ID NO: 120114 - DNA, 13 bp, Homo sapiens
agtggtaccagct

SEQ ID NO: 120115 - DNA, 17 bp, Homo sapiens
agttagggaatggcaca

SEQ ID NO: 120116 - DNA, 20 bp, Homo sapiens
agtttctcctttattgctcc

SEQ ID NO: 120117 - DNA, 18 bp, Homo sapiens
agtttcttggtctcagct

SEQ ID NO: 120118 - DNA, 13 bp, Homo sapiens
atatattttaatt

SEQ ID NO: 120119 - DNA, 20 bp, Homo sapiens
atatggggatgcagcattat

SEQ ID NO: 120120 - DNA, 18 bp, Homo sapiens
atattttccatgaaaatg

SEQ ID NO: 120121 - DNA, 15 bp, Homo sapiens
atatttttaattaaa

SEQ ID NO: 120122 - DNA, 18 bp, Homo sapiens
atcagctccactttcagt

SEQ ID NO: 120123 - DNA, 19 bp, Homo sapiens
atcccagctacatgggagc

SEQ ID NO: 120124 - DNA, 21 bp, Homo sapiens
atcctctcccccacaagagcc

SEQ ID NO: 120125 - DNA, 17 bp, Homo sapiens
atgaaggagacagcagc

SEQ ID NO: 120126 - DNA, 18 bp, Homo sapiens
atgaccttctaggaagct

SEQ ID NO: 120127 - DNA, 16 bp, Homo sapiens
atgcaacaacatgtat

SEQ ID NO: 120128 - DNA, 23 bp, Homo sapiens
atgcacgcaccccgcccctgcat

SEQ ID NO: 120129 - DNA, 15 bp, Homo sapiens
atgcaggccccgccc

SEQ ID NO: 120130 - DNA, 19 bp, Homo sapiens
atgccataaaagccgccca

SEQ ID NO: 120131 - DNA, 19 bp, Homo sapiens
atgccatggacagaagaag

SEQ ID NO: 120132 - DNA, 17 bp, Homo sapiens
atgcctggcccctcctc

SEQ ID NO: 120133 - DNA, 21 bp, Homo sapiens
atgcctggcccctcctcctag

SEQ ID NO: 120134 - DNA, 15 bp, Homo sapiens
atggcagtgtctttc

SEQ ID NO: 120135 - DNA, 12 bp, Homo sapiens
atggggatgcag

SEQ ID NO: 120136 - DNA, 21 bp, Homo sapiens
atggtttgaatataaacacta

SEQ ID NO: 120137 - DNA, 22 bp, Homo sapiens
atggtttgaatataaacactat

SEQ ID NO: 120138 - DNA, 17 bp, Homo sapiens
atggtttgcaaggaagc

SEQ ID NO: 120139 - DNA, 23 bp, Homo sapiens
atgtataatatttttaattaaat

SEQ ID NO: 120140 - DNA, 21 bp, Homo sapiens
atgtcccatctgctcctccca

SEQ ID NO: 120141 - DNA, 21 bp, Homo sapiens
attatgatgtgggtcaaggaa

SEQ ID NO: 120142 - DNA, 17 bp, Homo sapiens
attcatctctctttaat

SEQ ID NO: 120143 - DNA, 21 bp, Homo sapiens
attcttacaaacatgtggtta

SEQ ID NO: 120144 - DNA, 19 bp, Homo sapiens
attgtacacaccttatatt

SEQ ID NO: 120145 - DNA, 21 bp, Homo sapiens
atttcaatttccaagagctga

SEQ ID NO: 120146 - DNA, 16 bp, Homo sapiens
ccagctcagtgccaaa

SEQ ID NO: 120147 - DNA, 16 bp, Homo sapiens
ccaggagcccgtcagg

SEQ ID NO: 120148 - DNA, 21 bp, Homo sapiens
ccaggagcccgtcaggccaca

SEQ ID NO: 120149 - DNA, 17 bp, Homo sapiens
ccagggcagtgagtcct

SEQ ID NO: 120150 - DNA, 18 bp, Homo sapiens
ccagtgctggccacacag

SEQ ID NO: 120151 - DNA, 18 bp, Homo sapiens
ccagtggtaccagctcac

SEQ ID NO: 120152 - DNA, 21 bp, Homo sapiens
ccagttcctttcaatggtttg

SEQ ID NO: 120153 - DNA, 22 bp, Homo sapiens
ccagttcctttcaatggtttgc

SEQ ID NO: 120154 - DNA, 23 bp, Homo sapiens
ccagttcctttcaatggtttgca

SEQ ID NO: 120155 - DNA, 14 bp, Homo sapiens
ccatctgctcctcc

SEQ ID NO: 120156 - DNA, 22 bp, Homo sapiens
ccatgaaaatgcaacaacatgt

SEQ ID NO: 120157 - DNA, 16 bp, Homo sapiens
ccatgattccctcctc

SEQ ID NO: 120158 - DNA, 15 bp, Homo sapiens
ccatgttcccagctc

SEQ ID NO: 120159 - DNA, 12 bp, Homo sapiens
cccaaagaagga

SEQ ID NO: 120160 - DNA, 16 bp, Homo sapiens
cccacagtcacacaga

SEQ ID NO: 120161 - DNA, 20 bp, Homo sapiens
cccacagtcacacagagcgc

SEQ ID NO: 120162 - DNA, 16 bp, Homo sapiens
cccaccggtgccaaac

SEQ ID NO: 120163 - DNA, 12 bp, Homo sapiens
cccagcccctgc

SEQ ID NO: 120164 - DNA, 20 bp, Homo sapiens
cccagcccctgcggccgtca

SEQ ID NO: 120165 - DNA, 16 bp, Homo sapiens
cccagctcagtgccaa

SEQ ID NO: 120166 - DNA, 15 bp, Homo sapiens
cccagggaagttttg

SEQ ID NO: 120167 - DNA, 15 bp, Homo sapiens
cccagtgctggccac

SEQ ID NO: 120168 - DNA, 22 bp, Homo sapiens
cccagtgctggccacacagcag

SEQ ID NO: 120169 - DNA, 19 bp, Homo sapiens
cccatgcacgcaccccgcc

SEQ ID NO: 120170 - DNA, 17 bp, Homo sapiens
cccatggtccatcccct

SEQ ID NO: 120171 - DNA, 15 bp, Homo sapiens
ccccacaagagcccc

SEQ ID NO: 120172 - DNA, 18 bp, Homo sapiens
ccccatggtccatcccct

SEQ ID NO: 120173 - DNA, 21 bp, Homo sapiens
ccccatggtccatcccctgag

SEQ ID NO: 120174 - DNA, 14 bp, Homo sapiens
ccccgccagcctac

SEQ ID NO: 120175 - DNA, 14 bp, Homo sapiens
ccccgcccctgcat

SEQ ID NO: 120176 - DNA, 19 bp, Homo sapiens
cccctcagtgctcggcagt

SEQ ID NO: 120177 - DNA, 17 bp, Homo sapiens
cccctcccccctgtaaa

SEQ ID NO: 120178 - DNA, 17 bp, Homo sapiens
cccctcggcccctcacc

SEQ ID NO: 120179 - DNA, 20 bp, Homo sapiens
cccctgagggtggtcagcca

SEQ ID NO: 120180 - DNA, 22 bp, Homo sapiens
cccctgagggtggtcagccaag

SEQ ID NO: 120181 - DNA, 14 bp, Homo sapiens
cccctgcatgcctg

SEQ ID NO: 120182 - DNA, 14 bp, Homo sapiens
cccctgccccgccc

SEQ ID NO: 120183 - DNA, 16 bp, Homo sapiens
cccgagagagacccca

SEQ ID NO: 120184 - DNA, 18 bp, Homo sapiens
cccgagagagaccccacc

SEQ ID NO: 120185 - DNA, 13 bp, Homo sapiens
cccgccagcctac

SEQ ID NO: 120186 - DNA, 21 bp, Homo sapiens
cccgccagcctacactgccag

SEQ ID NO: 120187 - DNA, 22 bp, Homo sapiens
cccgccagcctacactgccagc

SEQ ID NO: 120188 - DNA, 14 bp, Homo sapiens
cccgcccctgcatg

SEQ ID NO: 120189 - DNA, 22 bp, Homo sapiens
cccgcccctgcatgcctggccc

SEQ ID NO: 120190 - DNA, 16 bp, Homo sapiens
cccgtcaggccacagc

SEQ ID NO: 120191 - DNA, 20 bp, Homo sapiens
ccctattcgtagccatctcc

SEQ ID NO: 120192 - DNA, 12 bp, Homo sapiens
ccctcagccctc

SEQ ID NO: 120193 - DNA, 17 bp, Homo sapiens
ccctcagtgctcggcag

SEQ ID NO: 120194 - DNA, 21 bp, Homo sapiens
ccctccagagactcgagtccc

SEQ ID NO: 120195 - DNA, 15 bp, Homo sapiens
ccctcccactccctg

SEQ ID NO: 120196 - DNA, 15 bp, Homo sapiens
ccctcccccctgtaa

SEQ ID NO: 120197 - DNA, 14 bp, Homo sapiens
ccctcgccctgtcc

SEQ ID NO: 120198 - DNA, 22 bp, Homo sapiens
ccctgagggtggtcagccaagg

SEQ ID NO: 120199 - DNA, 21 bp, Homo sapiens
ccctgcatgcctggcccctcc

SEQ ID NO: 120200 - DNA, 19 bp, Homo sapiens
ccctgccccgcccccaagc

SEQ ID NO: 120201 - DNA, 21 bp, Homo sapiens
ccctgcggccgtcaccccgcc

SEQ ID NO: 120202 - DNA, 23 bp, Homo sapiens
ccctgcggccgtcaccccgccag

SEQ ID NO: 120203 - DNA, 18 bp, Homo sapiens
ccctgcgtaaccctcgcc

SEQ ID NO: 120204 - DNA, 21 bp, Homo sapiens
ccctgcgtaaccctcgccctg

SEQ ID NO: 120205 - DNA, 22 bp, Homo sapiens
ccctggcactgcaggtggcctc

SEQ ID NO: 120206 - DNA, 14 bp, Homo sapiens
ccctgtccagggca

SEQ ID NO: 120207 - DNA, 16 bp, Homo sapiens
ccctgtccctcccact

SEQ ID NO: 120208 - DNA, 18 bp, Homo sapiens
ccctgtccctcccactcc

SEQ ID NO: 120209 - DNA, 15 bp, Homo sapiens
ccgagagagacccca

SEQ ID NO: 120210 - DNA, 18 bp, Homo sapiens
ccgcagagctcccttcct

SEQ ID NO: 120211 - DNA, 20 bp, Homo sapiens
ccgccagcctacactgccag

SEQ ID NO: 120212 - DNA, 12 bp, Homo sapiens
ccggctcccacc

SEQ ID NO: 120213 - DNA, 19 bp, Homo sapiens
ccgggcaccacccccagtc

SEQ ID NO: 120214 - DNA, 18 bp, Homo sapiens
ccgggtacctcagtttct

SEQ ID NO: 120215 - DNA, 18 bp, Homo sapiens
ccggtgccaaacccagcc

SEQ ID NO: 120216 - DNA, 17 bp, Homo sapiens
ccgtcaggccacagccc

SEQ ID NO: 120217 - DNA, 19 bp, Homo sapiens
ccgtgaagggcaccgagaa

SEQ ID NO: 120218 - DNA, 14 bp, Homo sapiens
ccgtggaggaagct

SEQ ID NO: 120219 - DNA, 16 bp, Homo sapiens
cctacactgccagccg

SEQ ID NO: 120220 - DNA, 18 bp, Homo sapiens
cctagaaaacccttcccg

SEQ ID NO: 120221 - DNA, 20 bp, Homo sapiens
cctattcgtagccatctccg

SEQ ID NO: 120222 - DNA, 20 bp, Homo sapiens
cctcacctgcatcctctccc

SEQ ID NO: 120223 - DNA, 13 bp, Homo sapiens
cctcagtcctgga

SEQ ID NO: 120224 - DNA, 14 bp, Homo sapiens
cctcagtcctggaa

SEQ ID NO: 120225 - DNA, 15 bp, Homo sapiens
cctcagtcctggaag

SEQ ID NO: 120226 - DNA, 19 bp, Homo sapiens
cctcagtgctcggcagtca

SEQ ID NO: 120227 - DNA, 20 bp, Homo sapiens
cctcagtgctcggcagtcat

SEQ ID NO: 120228 - DNA, 16 bp, Homo sapiens
cctcgccctgtccctc

SEQ ID NO: 120229 - DNA, 19 bp, Homo sapiens
cctcgggccgggcaccacc

SEQ ID NO: 120230 - DNA, 18 bp, Homo sapiens
cctctactttgctccgtg

SEQ ID NO: 120231 - DNA, 16 bp, Homo sapiens
cctctcccccacaaga

SEQ ID NO: 120232 - DNA, 20 bp, Homo sapiens
cctctgcttgccagccagga

SEQ ID NO: 120233 - DNA, 15 bp, Homo sapiens
cctctttctacagcc

SEQ ID NO: 120234 - DNA, 19 bp, Homo sapiens
cctctttctacagcctaat

SEQ ID NO: 120235 - DNA, 20 bp, Homo sapiens
cctgagggtggtcagccaag

SEQ ID NO: 120236 - DNA, 23 bp, Homo sapiens
cctgcatcctctcccccacaaga

SEQ ID NO: 120237 - DNA, 22 bp, Homo sapiens
cctgcgtaaccctcgccctgtc

SEQ ID NO: 120238 - DNA, 13 bp, Homo sapiens
cctggcactgcag

SEQ ID NO: 120239 - DNA, 15 bp, Homo sapiens
cctgtccctcccact

SEQ ID NO: 120240 - DNA, 19 bp, Homo sapiens
ccttccagtggtaccagct

SEQ ID NO: 120241 - DNA, 20 bp, Homo sapiens
ccttccagtggtaccagctc

SEQ ID NO: 120242 - DNA, 17 bp, Homo sapiens
ccttcctcagtcctgga

SEQ ID NO: 120243 - DNA, 15 bp, Homo sapiens
cctttcccgggccct

SEQ ID NO: 120244 - DNA, 18 bp, Homo sapiens
cctttcccgggccctcag

SEQ ID NO: 120245 - DNA, 14 bp, Homo sapiens
cgaacccctcccct

SEQ ID NO: 120246 - DNA, 21 bp, Homo sapiens
cgaacccctcccctcccccct

SEQ ID NO: 120247 - DNA, 15 bp, Homo sapiens
cgaagcccttccagt

SEQ ID NO: 120248 - DNA, 17 bp, Homo sapiens
cgaagcccttccagtgg

SEQ ID NO: 120249 - DNA, 22 bp, Homo sapiens
cgaagcccttccagtggtacca

SEQ ID NO: 120250 - DNA, 17 bp, Homo sapiens
cgaccacttttcagttc

SEQ ID NO: 120251 - DNA, 21 bp, Homo sapiens
cgaccacttttcagttcagtg

SEQ ID NO: 120252 - DNA, 16 bp, Homo sapiens
cgacccctcagtgctc

SEQ ID NO: 120253 - DNA, 15 bp, Homo sapiens
cgagagagaccccac

SEQ ID NO: 120254 - DNA, 17 bp, Homo sapiens
cgagagaggtgggcagc

SEQ ID NO: 120255 - DNA, 18 bp, Homo sapiens
cgagagaggtgggcagca

SEQ ID NO: 120256 - DNA, 22 bp, Homo sapiens
cgagagaggtgggcagcagctc

SEQ ID NO: 120257 - DNA, 21 bp, Homo sapiens
cgagccccaggagcccgtcag

SEQ ID NO: 120258 - DNA, 22 bp, Homo sapiens
cgcacagcactgcctgccaagc

SEQ ID NO: 120259 - DNA, 14 bp, Homo sapiens
cgcagagctccctt

SEQ ID NO: 120260 - DNA, 19 bp, Homo sapiens
cgcagccgagccccaggag

SEQ ID NO: 120261 - DNA, 17 bp, Homo sapiens
cgccagcctacactgcc

SEQ ID NO: 120262 - DNA, 15 bp, Homo sapiens
taaatcaactccagc

SEQ ID NO: 120263 - DNA, 19 bp, Homo sapiens
taaccctcgccctgtccct

SEQ ID NO: 120264 - DNA, 15 bp, Homo sapiens
taactagcttggaaa

SEQ ID NO: 120265 - DNA, 14 bp, Homo sapiens
taatatttttaatt

SEQ ID NO: 120266 - DNA, 21 bp, Homo sapiens
taattaaataaaaatctgtgg

SEQ ID NO: 120267 - DNA, 22 bp, Homo sapiens
taatttgatagtattgtgcata

SEQ ID NO: 120268 - DNA, 13 bp, Homo sapiens
tacaaggggccca

SEQ ID NO: 120269 - DNA, 17 bp, Homo sapiens
tacaaggggcccagtgc

SEQ ID NO: 120270 - DNA, 12 bp, Homo sapiens
tacactgccagc

SEQ ID NO: 120271 - DNA, 13 bp, Homo sapiens
tacactgccagcc

SEQ ID NO: 120272 - DNA, 14 bp, Homo sapiens
taccgtgccagcag

SEQ ID NO: 120273 - DNA, 15 bp, Homo sapiens
taccgtgccagcagc

SEQ ID NO: 120274 - DNA, 10 bp, Homo sapiens
tacctcagtt

SEQ ID NO: 120275 - DNA, 21 bp, Homo sapiens
tagggaatggcacagcccaaa

SEQ ID NO: 120276 - DNA, 18 bp, Homo sapiens
tatgatgtgggtcaagga

SEQ ID NO: 120277 - DNA, 20 bp, Homo sapiens
tatttcttaaacaaatgtat

SEQ ID NO: 120278 - DNA, 22 bp, Homo sapiens
tatttgttaatggtttgaatat

SEQ ID NO: 120279 - DNA, 23 bp, Homo sapiens
tcaaagaccccatggtccatccc

SEQ ID NO: 120280 - DNA, 15 bp, Homo sapiens
tcaactccagctccc

SEQ ID NO: 120281 - DNA, 13 bp, Homo sapiens
tcaatttccaaga

SEQ ID NO: 120282 - DNA, 20 bp, Homo sapiens
tcaatttccaagagctgagg

SEQ ID NO: 120283 - DNA, 22 bp, Homo sapiens
tcacacagagcgcctcacctgc

SEQ ID NO: 120284 - DNA, 21 bp, Homo sapiens
tcaccacctctttctacagcc

SEQ ID NO: 120285 - DNA, 17 bp, Homo sapiens
tcagcctccccccgctg

SEQ ID NO: 120286 - DNA, 18 bp, Homo sapiens
tcagctccactttcagtg

SEQ ID NO: 120287 - DNA, 14 bp, Homo sapiens
tcagcttcatttcc

SEQ ID NO: 120288 - DNA, 17 bp, Homo sapiens
tcaggccacagcccctg

SEQ ID NO: 120289 - DNA, 17 bp, Homo sapiens
tcagtgctcggcagtca

SEQ ID NO: 120290 - DNA, 15 bp, Homo sapiens
tcatgtgcctggaaa

SEQ ID NO: 120291 - DNA, 12 bp, Homo sapiens
tcatttccgtga

SEQ ID NO: 120292 - DNA, 12 bp, Homo sapiens
tccaagagctga

SEQ ID NO: 120293 - DNA, 10 bp, Homo sapiens
tccagctccc

SEQ ID NO: 120294 - DNA, 16 bp, Homo sapiens
tccatgaaaatgcaac

SEQ ID NO: 120295 - DNA, 17 bp, Homo sapiens
tcccaccggtgccaaac

SEQ ID NO: 120296 - DNA, 23 bp, Homo sapiens
tcccaccggtgccaaacccagcc

SEQ ID NO: 120297 - DNA, 17 bp, Homo sapiens
tcccatctgctcctccc

SEQ ID NO: 120298 - DNA, 14 bp, Homo sapiens
tccccgcagagctc

SEQ ID NO: 120299 - DNA, 18 bp, Homo sapiens
tccccgcagagctccctt

SEQ ID NO: 120300 - DNA, 15 bp, Homo sapiens
tccccggcccctgcc

SEQ ID NO: 120301 - DNA, 15 bp, Homo sapiens
tcccctcccccctgt

SEQ ID NO: 120302 - DNA, 16 bp, Homo sapiens
tcccctcccccctgta

SEQ ID NO: 120303 - DNA, 21 bp, Homo sapiens
tcccctgagggtggtcagcca

SEQ ID NO: 120304 - DNA, 13 bp, Homo sapiens
tccctcccactcc

SEQ ID NO: 120305 - DNA, 17 bp, Homo sapiens
tccctcccactccctgg

SEQ ID NO: 120306 - DNA, 19 bp, Homo sapiens
tccctgggggcgctgttcc

SEQ ID NO: 120307 - DNA, 16 bp, Homo sapiens
tcccttcctgaccctc

SEQ ID NO: 120308 - DNA, 13 bp, Homo sapiens
tcctcccattccc

SEQ ID NO: 120309 - DNA, 21 bp, Homo sapiens
tcctctactttgctccgtgga

SEQ ID NO: 120310 - DNA, 18 bp, Homo sapiens
tccttcctcagtcctgga

SEQ ID NO: 120311 - DNA, 16 bp, Homo sapiens
tcgccctgtccctccc

SEQ ID NO: 120312 - DNA, 19 bp, Homo sapiens
tcgccctgtccctcccact

SEQ ID NO: 120313 - DNA, 16 bp, Homo sapiens
tcgctggcagagaagg

SEQ ID NO: 120314 - DNA, 19 bp, Homo sapiens
tcgggccgggcaccacccc

SEQ ID NO: 120315 - DNA, 20 bp, Homo sapiens
tcggggcgacccctcagtgc

SEQ ID NO: 120316 - DNA, 23 bp, Homo sapiens
tcgtcagtctctcaaagacccca

SEQ ID NO: 120317 - DNA, 13 bp, Homo sapiens
tctcagcttcatt

SEQ ID NO: 120318 - DNA, 15 bp, Homo sapiens
tctcctttattgctc

SEQ ID NO: 120319 - DNA, 17 bp, Homo sapiens
tctcctttattgctcct

SEQ ID NO: 120320 - DNA, 21 bp, Homo sapiens
tctctcggggcgacccctcag

SEQ ID NO: 120321 - DNA, 18 bp, Homo sapiens
tctgaaaattaacactgc

SEQ ID NO: 120322 - DNA, 23 bp, Homo sapiens
tctgcggagccagcgcctgcccg

SEQ ID NO: 120323 - DNA, 13 bp, Homo sapiens
tctgcttgccagc

SEQ ID NO: 120324 - DNA, 16 bp, Homo sapiens
tctgcttgccagccag

SEQ ID NO: 120325 - DNA, 17 bp, Homo sapiens
tctgcttgccagccagg

SEQ ID NO: 120326 - DNA, 18 bp, Homo sapiens
tctgcttgccagccagga

SEQ ID NO: 120327 - DNA, 17 bp, Homo sapiens
tcttaaacaaatgtatg

SEQ ID NO: 120328 - DNA, 16 bp, Homo sapiens
tctttctacagcctaa

SEQ ID NO: 120329 - DNA, 23 bp, Homo sapiens
tgaaggaccctggctcttctctc

SEQ ID NO: 120330 - DNA, 14 bp, Homo sapiens
tgaatataaacact

SEQ ID NO: 120331 - DNA, 14 bp, Homo sapiens
tgacagaacactgt

SEQ ID NO: 120332 - DNA, 15 bp, Homo sapiens
tgacagaacactgtc

SEQ ID NO: 120333 - DNA, 21 bp, Homo sapiens
tgacagaacactgtcttgaag

SEQ ID NO: 120334 - DNA, 17 bp, Homo sapiens
tgaccttctaggaagct

SEQ ID NO: 120335 - DNA, 14 bp, Homo sapiens
tgactaccgtgcca

SEQ ID NO: 120336 - DNA, 18 bp, Homo sapiens
tgactaccgtgccagcag

SEQ ID NO: 120337 - DNA, 12 bp, Homo sapiens
tgactgggccct

SEQ ID NO: 120338 - DNA, 19 bp, Homo sapiens
tgactgggccctgtccagg

SEQ ID NO: 120339 - DNA, 17 bp, Homo sapiens
tgacttgacagaacact

SEQ ID NO: 120340 - DNA, 15 bp, Homo sapiens
tgagagagtgctgag

SEQ ID NO: 120341 - DNA, 19 bp, Homo sapiens
tgagctggccctttccagc

SEQ ID NO: 120342 - DNA, 18 bp, Homo sapiens
tgaggtcatagcagtgct

SEQ ID NO: 120343 - DNA, 18 bp, Homo sapiens
tgatgtgggtcaaggaat

SEQ ID NO: 120344 - DNA, 20 bp, Homo sapiens
tgcaaggaagccacagctgg

SEQ ID NO: 120345 - DNA, 21 bp, Homo sapiens
tgcacgcaccccgcccctgca

SEQ ID NO: 120346 - DNA, 23 bp, Homo sapiens
tgcacgcaccccgcccctgcatg

SEQ ID NO: 120347 - DNA, 11 bp, Homo sapiens
tgcaggccccg

SEQ ID NO: 120348 - DNA, 16 bp, Homo sapiens
tgcaggtggcctccct

SEQ ID NO: 120349 - DNA, 17 bp, Homo sapiens
tgcatagagccacgtat

SEQ ID NO: 120350 - DNA, 17 bp, Homo sapiens
tgcatatatacatatat

SEQ ID NO: 120351 - DNA, 13 bp, Homo sapiens
tgcatgaaggttt

SEQ ID NO: 120352 - DNA, 14 bp, Homo sapiens
tgccaaacccagcc

SEQ ID NO: 120353 - DNA, 23 bp, Homo sapiens
tgccaagcgagaatgcaggcccc

SEQ ID NO: 120354 - DNA, 18 bp, Homo sapiens
tgccccgcccccaagctc

SEQ ID NO: 120355 - DNA, 19 bp, Homo sapiens
tgcgagagaggtgggcagc

SEQ ID NO: 120356 - DNA, 22 bp, Homo sapiens
tgcggacaccatgttcccagct

SEQ ID NO: 120357 - DNA, 18 bp, Homo sapiens
tgcggagccagcgcctgc

SEQ ID NO: 120358 - DNA, 15 bp, Homo sapiens
tgcgtaaccctcgcc

SEQ ID NO: 120359 - DNA, 22 bp, Homo sapiens
tgctaactagcttggaaactgg

SEQ ID NO: 120360 - DNA, 19 bp, Homo sapiens
tgctatccagctattttta

SEQ ID NO: 120361 - DNA, 14 bp, Homo sapiens
tgcttgccagccag

SEQ ID NO: 120362 - DNA, 21 bp, Homo sapiens
tggaaactggatgaggtcata

SEQ ID NO: 120363 - DNA, 22 bp, Homo sapiens
tggaagccggccggctgggatc

SEQ ID NO: 120364 - DNA, 20 bp, Homo sapiens
tggaggagctcaggacacta

SEQ ID NO: 120365 - DNA, 22 bp, Homo sapiens
tggaggagctcaggacactaat

SEQ ID NO: 120366 - DNA, 20 bp, Homo sapiens
tggcacagcccaaagaagga

SEQ ID NO: 120367 - DNA, 19 bp, Homo sapiens
tggcagagaaggcttcctc

SEQ ID NO: 120368 - DNA, 23 bp, Homo sapiens
tggccaatgtgactaccgtgcca

SEQ ID NO: 120369 - DNA, 13 bp, Homo sapiens
tggcctccctcca

SEQ ID NO: 120370 - DNA, 12 bp, Homo sapiens
tggcgccctgcg

SEQ ID NO: 120371 - DNA, 14 bp, Homo sapiens
tgggatgtttctgt

SEQ ID NO: 120372 - DNA, 17 bp, Homo sapiens
tgggcagcagctcagcc

SEQ ID NO: 120373 - DNA, 19 bp, Homo sapiens
tgggcagcagctcagcctc

SEQ ID NO: 120374 - DNA, 18 bp, Homo sapiens
tggggccccggctcccac

SEQ ID NO: 120375 - DNA, 19 bp, Homo sapiens
tggggccccggctcccacc

SEQ ID NO: 120376 - DNA, 13 bp, Homo sapiens
tgggtcaaggaat

SEQ ID NO: 120377 - DNA, 15 bp, Homo sapiens
tgtacgaacccctcc

SEQ ID NO: 120378 - DNA, 16 bp, Homo sapiens
tgtacgaacccctccc

SEQ ID NO: 120379 - DNA, 19 bp, Homo sapiens
tgtacgaacccctcccctc

SEQ ID NO: 120380 - DNA, 15 bp, Homo sapiens
tgtataatattttta

SEQ ID NO: 120381 - DNA, 18 bp, Homo sapiens
ctcccctcccccctgtaa

SEQ ID NO: 120382 - DNA, 22 bp, Homo sapiens
ctccttcctcagtcctggaagc

SEQ ID NO: 120383 - DNA, 15 bp, Homo sapiens
ctccttgcctggtga

SEQ ID NO: 120384 - DNA, 15 bp, Homo sapiens
ctcgagtccccatga

SEQ ID NO: 120385 - DNA, 23 bp, Homo sapiens
ctcgagtccccatgattccctcc

SEQ ID NO: 120386 - DNA, 12 bp, Homo sapiens
ctcgccctgtcc

SEQ ID NO: 120387 - DNA, 12 bp, Homo sapiens
ctcggcccctca

SEQ ID NO: 120388 - DNA, 19 bp, Homo sapiens
ctcggggcgacccctcagt

SEQ ID NO: 120389 - DNA, 14 bp, Homo sapiens
ctcgtcagtctctc

SEQ ID NO: 120390 - DNA, 21 bp, Homo sapiens
ctctcccccacaagagcccca

SEQ ID NO: 120391 - DNA, 22 bp, Homo sapiens
ctctcggggcgacccctcagtg

SEQ ID NO: 120392 - DNA, 15 bp, Homo sapiens
ctctgcttgccagcc

SEQ ID NO: 120393 - DNA, 15 bp, Homo sapiens
ctgagattgcgccac

SEQ ID NO: 120394 - DNA, 18 bp, Homo sapiens
ctgagctggccctttcca

SEQ ID NO: 120395 - DNA, 19 bp, Homo sapiens
ctgcagaggattgaggctt

SEQ ID NO: 120396 - DNA, 20 bp, Homo sapiens
ctgcaggtggcctccctcca

SEQ ID NO: 120397 - DNA, 21 bp, Homo sapiens
ctgcatgcctggcccctcctc

SEQ ID NO: 120398 - DNA, 14 bp, Homo sapiens
ctgccagccgccac

SEQ ID NO: 120399 - DNA, 17 bp, Homo sapiens
ctgccccgcccccaagc

SEQ ID NO: 120400 - DNA, 13 bp, Homo sapiens
ctgcctgccaagc

SEQ ID NO: 120401 - DNA, 19 bp, Homo sapiens
ctgcgagatcgctggcaga

SEQ ID NO: 120402 - DNA, 23 bp, Homo sapiens
ctgcggagccagcgcctgcccga

SEQ ID NO: 120403 - DNA, 15 bp, Homo sapiens
ctgcttgccagccag

SEQ ID NO: 120404 - DNA, 15 bp, Homo sapiens
ctggcagagaaggct

SEQ ID NO: 120405 - DNA, 16 bp, Homo sapiens
ctggcagagaaggctt

SEQ ID NO: 120406 - DNA, 19 bp, Homo sapiens
ctgggatgtttctgtcaca

SEQ ID NO: 120407 - DNA, 16 bp, Homo sapiens
ctgggccctgtccagg

SEQ ID NO: 120408 - DNA, 20 bp, Homo sapiens
ctggggagcgaaagtttctt

SEQ ID NO: 120409 - DNA, 15 bp, Homo sapiens
ctgggtggtgaagga

SEQ ID NO: 120410 - DNA, 15 bp, Homo sapiens
ctgtccctcccactc

SEQ ID NO: 120411 - DNA, 21 bp, Homo sapiens
ctgtccctcccactccctggg

SEQ ID NO: 120412 - DNA, 19 bp, Homo sapiens
cccaaagatcccacgggag

SEQ ID NO: 120413 - DNA, 21 bp, Homo sapiens
cccaattcttacaaacatgtg

SEQ ID NO: 120414 - DNA, 23 bp, Homo sapiens
cccacccatgcacgcaccccgcc

SEQ ID NO: 120415 - DNA, 15 bp, Homo sapiens
cccagctcagtgcca

SEQ ID NO: 120416 - DNA, 17 bp, Homo sapiens
cccagctcagtgccaaa

SEQ ID NO: 120417 - DNA, 12 bp, Homo sapiens
cccagtcccccc

SEQ ID NO: 120418 - DNA, 20 bp, Homo sapiens
cccagtgctggccacacagc

SEQ ID NO: 120419 - DNA, 13 bp, Homo sapiens
cccatgattccct

SEQ ID NO: 120420 - DNA, 20 bp, Homo sapiens
cccatgcacgcaccccgccc

SEQ ID NO: 120421 - DNA, 15 bp, Homo sapiens
cccatggtccatccc

SEQ ID NO: 120422 - DNA, 15 bp, Homo sapiens
cccattccccttaag

SEQ ID NO: 120423 - DNA, 19 bp, Homo sapiens
ccccacttctctactctgg

SEQ ID NO: 120424 - DNA, 20 bp, Homo sapiens
ccccacttctctactctgga

SEQ ID NO: 120425 - DNA, 17 bp, Homo sapiens
ccccatgattccctcct

SEQ ID NO: 120426 - DNA, 19 bp, Homo sapiens
ccccatggtccatcccctg

SEQ ID NO: 120427 - DNA, 12 bp, Homo sapiens
ccccgccagcct

SEQ ID NO: 120428 - DNA, 16 bp, Homo sapiens
ccccgcccccaagctc

SEQ ID NO: 120429 - DNA, 12 bp, Homo sapiens
ccccgcccctgc

SEQ ID NO: 120430 - DNA, 16 bp, Homo sapiens
ccccggcccctgcccc

SEQ ID NO: 120431 - DNA, 13 bp, Homo sapiens
ccccggctcccac

SEQ ID NO: 120432 - DNA, 22 bp, Homo sapiens
ccccggctcccaccggtgccaa

SEQ ID NO: 120433 - DNA, 18 bp, Homo sapiens
cccctgagggtggtcagc

SEQ ID NO: 120434 - DNA, 19 bp, Homo sapiens
cccctgcatgcctggcccc

SEQ ID NO: 120435 - DNA, 15 bp, Homo sapiens
cccctggcactgcag

SEQ ID NO: 120436 - DNA, 19 bp, Homo sapiens
cccctgtaaacacagtgct

SEQ ID NO: 120437 - DNA, 22 bp, Homo sapiens
cccgccccctcggcccctcacc

SEQ ID NO: 120438 - DNA, 13 bp, Homo sapiens
cccgcccctgcat

SEQ ID NO: 120439 - DNA, 14 bp, Homo sapiens
cccggctcccaccg

SEQ ID NO: 120440 - DNA, 12 bp, Homo sapiens
cccgggccctca

SEQ ID NO: 120441 - DNA, 17 bp, Homo sapiens
cccgtcaggccacagcc

SEQ ID NO: 120442 - DNA, 20 bp, Homo sapiens
cccgtcaggccacagcccct

SEQ ID NO: 120443 - DNA, 21 bp, Homo sapiens
ccctcagtgctcggcagtcat

SEQ ID NO: 120444 - DNA, 14 bp, Homo sapiens
ccctcccccctgta

SEQ ID NO: 120445 - DNA, 13 bp, Homo sapiens
ccctcgccctgtc

SEQ ID NO: 120446 - DNA, 15 bp, Homo sapiens
ccctcgccctgtccc

SEQ ID NO: 120447 - DNA, 16 bp, Homo sapiens
cactgcctgccaagcg

SEQ ID NO: 120448 - DNA, 18 bp, Homo sapiens
cactttcagtgaaagcat

SEQ ID NO: 120449 - DNA, 11 bp, Homo sapiens
cagaacactgt

SEQ ID NO: 120450 - DNA, 14 bp, Homo sapiens
cagaagaaggcagc

SEQ ID NO: 120451 - DNA, 15 bp, Homo sapiens
cagaagaaggcagca

SEQ ID NO: 120452 - DNA, 18 bp, Homo sapiens
cagaatggggtgcatgaa

SEQ ID NO: 120453 - DNA, 16 bp, Homo sapiens
cagagaaggcttcctc

SEQ ID NO: 120454 - DNA, 14 bp, Homo sapiens
cagagcgcctcacc

SEQ ID NO: 120455 - DNA, 19 bp, Homo sapiens
cagagcgcctcacctgcat

SEQ ID NO: 120456 - DNA, 12 bp, Homo sapiens
cagcagcaccca

SEQ ID NO: 120457 - DNA, 15 bp, Homo sapiens
cagcagcacccaccc

SEQ ID NO: 120458 - DNA, 23 bp, Homo sapiens
cagccaataaatcaactccagct

SEQ ID NO: 120459 - DNA, 17 bp, Homo sapiens
cagcccaaagaaggaaa

SEQ ID NO: 120460 - DNA, 19 bp, Homo sapiens
cagcccctgcggccgtcac

SEQ ID NO: 120461 - DNA, 15 bp, Homo sapiens
cagcccctggcactg

SEQ ID NO: 120462 - DNA, 17 bp, Homo sapiens
cagcccctggcactgca

SEQ ID NO: 120463 - DNA, 19 bp, Homo sapiens
cagccgggtacctcagttt

SEQ ID NO: 120464 - DNA, 20 bp, Homo sapiens
cagccgggtacctcagtttc

SEQ ID NO: 120465 - DNA, 15 bp, Homo sapiens
cagcctacactgcca

SEQ ID NO: 120466 - DNA, 16 bp, Homo sapiens
cagcctacactgccag

SEQ ID NO: 120467 - DNA, 15 bp, Homo sapiens
tccctccagagactc

SEQ ID NO: 120468 - DNA, 16 bp, Homo sapiens
tccctcccactccctg

SEQ ID NO: 120469 - DNA, 21 bp, Homo sapiens
tccctgggaaaggggttgtca

SEQ ID NO: 120470 - DNA, 22 bp, Homo sapiens
tcctagaaaacccttcccgccc

SEQ ID NO: 120471 - DNA, 15 bp, Homo sapiens
tcctcagtcctggaa

SEQ ID NO: 120472 - DNA, 20 bp, Homo sapiens
tcctcctagaaaacccttcc

SEQ ID NO: 120473 - DNA, 21 bp, Homo sapiens
tcctcctagaaaacccttccc

SEQ ID NO: 120474 - DNA, 17 bp, Homo sapiens
tcctgtacgaacccctc

SEQ ID NO: 120475 - DNA, 23 bp, Homo sapiens
tcctgtacgaacccctcccctcc

SEQ ID NO: 120476 - DNA, 12 bp, Homo sapiens
tccttgcctggt

SEQ ID NO: 120477 - DNA, 19 bp, Homo sapiens
tcctttcaatggtttgcaa

SEQ ID NO: 120478 - DNA, 15 bp, Homo sapiens
tcgaagcccttccag

SEQ ID NO: 120479 - DNA, 13 bp, Homo sapiens
tcgagtccccatg

SEQ ID NO: 120480 - DNA, 12 bp, Homo sapiens
tcgccctgtccc

SEQ ID NO: 120481 - DNA, 21 bp, Homo sapiens
tcgccctgtccctcccactcc

SEQ ID NO: 120482 - DNA, 12 bp, Homo sapiens
tctacagcctaa

SEQ ID NO: 120483 - DNA, 14 bp, Homo sapiens
tctcaaagacccca

SEQ ID NO: 120484 - DNA, 11 bp, Homo sapiens
tctcagcttca

SEQ ID NO: 120485 - DNA, 16 bp, Homo sapiens
tctcagcttcatttcc

SEQ ID NO: 120486 - DNA, 18 bp, Homo sapiens
tctcagcttcatttccgt

SEQ ID NO: 120487 - DNA, 20 bp, Homo sapiens
tctcccccacaagagcccca

SEQ ID NO: 120488 - DNA, 21 bp, Homo sapiens
tctcggggcgacccctcagtg

SEQ ID NO: 120489 - DNA, 22 bp, Homo sapiens
tctcggggcgacccctcagtgc

SEQ ID NO: 120490 - DNA, 14 bp, Homo sapiens
tctctactctggaa

SEQ ID NO: 120491 - DNA, 19 bp, Homo sapiens
tctgaaaattaacactgct

SEQ ID NO: 120492 - DNA, 13 bp, Homo sapiens
tctgagctggccc

SEQ ID NO: 120493 - DNA, 21 bp, Homo sapiens
tctgcggagccagcgcctgcc

SEQ ID NO: 120494 - DNA, 20 bp, Homo sapiens
tctggaagtccccgggagcc

SEQ ID NO: 120495 - DNA, 20 bp, Homo sapiens
tgaaaatgcaacaacatgta

SEQ ID NO: 120496 - DNA, 23 bp, Homo sapiens
tgaaaatgcaacaacatgtataa

SEQ ID NO: 120497 - DNA, 16 bp, Homo sapiens
tgaaaattaacactgc

SEQ ID NO: 120498 - DNA, 17 bp, Homo sapiens
tgaaggaccctggctct

SEQ ID NO: 120499 - DNA, 16 bp, Homo sapiens
tgaatataaacactat

SEQ ID NO: 120500 - DNA, 15 bp, Homo sapiens
tgactaccgtgccag

SEQ ID NO: 120501 - DNA, 17 bp, Homo sapiens
tgactgggccctgtcca

SEQ ID NO: 120502 - DNA, 19 bp, Homo sapiens
tgacttgacagaacactgt

SEQ ID NO: 120503 - DNA, 14 bp, Homo sapiens
tgagagagtgctga

SEQ ID NO: 120504 - DNA, 23 bp, Homo sapiens
tgagagagtgctgagaaggacac

SEQ ID NO: 120505 - DNA, 20 bp, Homo sapiens
tgagttggtgttgacatgtg

SEQ ID NO: 120506 - DNA, 23 bp, Homo sapiens
tgattccctcctcgtcagtctct

SEQ ID NO: 120507 - DNA, 13 bp, Homo sapiens
tgcaacaacatgt

SEQ ID NO: 120508 - DNA, 18 bp, Homo sapiens
tgcaggccccgccccctc

SEQ ID NO: 120509 - DNA, 18 bp, Homo sapiens
tgcaggtggcctccctcc

SEQ ID NO: 120510 - DNA, 20 bp, Homo sapiens
tgcaggtggcctccctccag

SEQ ID NO: 120511 - DNA, 18 bp, Homo sapiens
tgcatcctctcccccaca

SEQ ID NO: 120512 - DNA, 19 bp, Homo sapiens
tgcatgaaggtttctgaaa

SEQ ID NO: 120513 - DNA, 21 bp, Homo sapiens
tgcatgaaggtttctgaaaat

SEQ ID NO: 120514 - DNA, 19 bp, Homo sapiens
tgccaaacccagcccctgc

SEQ ID NO: 120515 - DNA, 20 bp, Homo sapiens
tgccaaacccagcccctgcg

SEQ ID NO: 120516 - DNA, 22 bp, Homo sapiens
tgccaaacccagcccctgcggc

SEQ ID NO: 120517 - DNA, 22 bp, Homo sapiens
tgccaaagaggggtcaccaggg

SEQ ID NO: 120518 - DNA, 18 bp, Homo sapiens
tgccatggacagaagaag

SEQ ID NO: 120519 - DNA, 20 bp, Homo sapiens
tgccatggacagaagaaggc

SEQ ID NO: 120520 - DNA, 22 bp, Homo sapiens
tgcccgagagagaccccaccgc

SEQ ID NO: 120521 - DNA, 22 bp, Homo sapiens
tgcctttcccgggccctcagcc

SEQ ID NO: 120522 - DNA, 22 bp, Homo sapiens
tgcgagagaggtgggcagcagc

SEQ ID NO: 120523 - DNA, 18 bp, Homo sapiens
tgcgagatcgctggcaga

SEQ ID NO: 120524 - DNA, 13 bp, Homo sapiens
tgcggagccagcg

SEQ ID NO: 120525 - DNA, 16 bp, Homo sapiens
tgcgtaaccctcgccc

SEQ ID NO: 120526 - DNA, 20 bp, Homo sapiens
tgcgtaaccctcgccctgtc

SEQ ID NO: 120527 - DNA, 13 bp, Homo sapiens
tgctcctcccatt

SEQ ID NO: 120528 - DNA, 15 bp, Homo sapiens
tgctggccacacagc

SEQ ID NO: 120529 - DNA, 19 bp, Homo sapiens
tggagggtggcgccctgcg

SEQ ID NO: 120530 - DNA, 21 bp, Homo sapiens
tggaggttgcagtgagctgag

SEQ ID NO: 120531 - DNA, 22 bp, Homo sapiens
tggcagaatggggtgcatgaag

SEQ ID NO: 120532 - DNA, 15 bp, Homo sapiens
tggccacacagcagc

SEQ ID NO: 120533 - DNA, 14 bp, Homo sapiens
tggcctccctccag

SEQ ID NO: 120534 - DNA, 15 bp, Homo sapiens
tggcctccctccaga

SEQ ID NO: 120535 - DNA, 18 bp, Homo sapiens
tgggagcctgaggcatga

SEQ ID NO: 120536 - DNA, 21 bp, Homo sapiens
tgggatgccataaaagccgcc

SEQ ID NO: 120537 - DNA, 14 bp, Homo sapiens
tgggcagcagctca

SEQ ID NO: 120538 - DNA, 15 bp, Homo sapiens
tgggcagcagctcag

SEQ ID NO: 120539 - DNA, 14 bp, Homo sapiens
tgggccctgtccag

SEQ ID NO: 120540 - DNA, 18 bp, Homo sapiens
tggggtacaaggggccca

SEQ ID NO: 120541 - DNA, 20 bp, Homo sapiens
tggggtacaaggggcccagt

SEQ ID NO: 120542 - DNA, 12 bp, Homo sapiens
tggtccatcccc

SEQ ID NO: 120543 - DNA, 13 bp, Homo sapiens
tggtctcagcttc

SEQ ID NO: 120544 - DNA, 13 bp, Homo sapiens
tggttaatgccat

SEQ ID NO: 120545 - DNA, 15 bp, Homo sapiens
tggtttgcaaggaag

SEQ ID NO: 120546 - DNA, 12 bp, Homo sapiens
tgtccctcccac

SEQ ID NO: 120547 - DNA, 17 bp, Homo sapiens
tgtccctcccactccct

SEQ ID NO: 120548 - DNA, 18 bp, Homo sapiens
tgtccctcccactccctg

SEQ ID NO: 120549 - DNA, 20 bp, Homo sapiens
tgtctgcggagccagcgcct

SEQ ID NO: 120550 - DNA, 12 bp, Homo sapiens
tgtgcctggaaa

SEQ ID NO: 120551 - DNA, 16 bp, Homo sapiens
tgtgcctttcccgggc

SEQ ID NO: 120552 - DNA, 22 bp, Homo sapiens
tgtgcctttcccgggccctcag

SEQ ID NO: 120553 - DNA, 18 bp, Homo sapiens
tgtggagggtggcgccct

SEQ ID NO: 120554 - DNA, 15 bp, Homo sapiens
tgtgggtcaaggaat

SEQ ID NO: 120555 - DNA, 14 bp, Homo sapiens
tgtggttaatgcca

SEQ ID NO: 120556 - DNA, 17 bp, Homo sapiens
tgttcccagctcagtgc

SEQ ID NO: 120557 - DNA, 14 bp, Homo sapiens
tgttgacatgtgct

SEQ ID NO: 120558 - DNA, 12 bp, Homo sapiens
tgtttttaactc

SEQ ID NO: 120559 - DNA, 14 bp, Homo sapiens
ttaaagcaaaggag

SEQ ID NO: 120560 - DNA, 16 bp, Homo sapiens
ttaatatggggatgca

SEQ ID NO: 120561 - DNA, 22 bp, Homo sapiens
ttaatatggggatgcagcatta

SEQ ID NO: 120562 - DNA, 20 bp, Homo sapiens
ttatgatgtgggtcaaggaa

SEQ ID NO: 120563 - DNA, 21 bp, Homo sapiens
ttatgatgtgggtcaaggaat

SEQ ID NO: 120564 - DNA, 14 bp, Homo sapiens
atttccgtgaaggg

SEQ ID NO: 120565 - DNA, 15 bp, Homo sapiens
caaacccagcccctg

SEQ ID NO: 120566 - DNA, 19 bp, Homo sapiens
caaagaaggaaaaggcagg

SEQ ID NO: 120567 - DNA, 15 bp, Homo sapiens
caaagaccccatggt

SEQ ID NO: 120568 - DNA, 17 bp, Homo sapiens
caacatgtataatattt

SEQ ID NO: 120569 - DNA, 18 bp, Homo sapiens
caacatgtataatatttt

SEQ ID NO: 120570 - DNA, 22 bp, Homo sapiens
caaccgtccccggcccctgccc

SEQ ID NO: 120571 - DNA, 21 bp, Homo sapiens
caacctccccgcagagctccc

SEQ ID NO: 120572 - DNA, 13 bp, Homo sapiens
caactccagctcc

SEQ ID NO: 120573 - DNA, 12 bp, Homo sapiens
caaggggcccag

SEQ ID NO: 120574 - DNA, 15 bp, Homo sapiens
caaggggcccagtgc

SEQ ID NO: 120575 - DNA, 21 bp, Homo sapiens
caaggggcccagtgctggcca

SEQ ID NO: 120576 - DNA, 15 bp, Homo sapiens
caatattttccatga

SEQ ID NO: 120577 - DNA, 17 bp, Homo sapiens
caatggtttgcaaggaa

SEQ ID NO: 120578 - DNA, 13 bp, Homo sapiens
caatttaaagcaa

SEQ ID NO: 120579 - DNA, 22 bp, Homo sapiens
cacaaccgtccccggcccctgc

SEQ ID NO: 120580 - DNA, 14 bp, Homo sapiens
cacacgggcctctg

SEQ ID NO: 120581 - DNA, 16 bp, Homo sapiens
cacacgggcctctgct

SEQ ID NO: 120582 - DNA, 21 bp, Homo sapiens
cacacgggcctctgcttgcca

SEQ ID NO: 120583 - DNA, 23 bp, Homo sapiens
cacacgggcctctgcttgccagc

SEQ ID NO: 120584 - DNA, 19 bp, Homo sapiens
cacagagcgcctcacctgc

SEQ ID NO: 120585 - DNA, 20 bp, Homo sapiens
cacagagcgcctcacctgca

SEQ ID NO: 120586 - DNA, 13 bp, Homo sapiens
cacagcactgcct

SEQ ID NO: 120587 - DNA, 16 bp, Homo sapiens
cacagcactgcctgcc

SEQ ID NO: 120588 - DNA, 19 bp, Homo sapiens
cacagcccaaagaaggaaa

SEQ ID NO: 120589 - DNA, 13 bp, Homo sapiens
cacagcccctggc

SEQ ID NO: 120590 - DNA, 15 bp, Homo sapiens
cacagcccctggcac

SEQ ID NO: 120591 - DNA, 23 bp, Homo sapiens
cacaggtatgaccttctaggaag

SEQ ID NO: 120592 - DNA, 17 bp, Homo sapiens
cacagtgactgggccct

SEQ ID NO: 120593 - DNA, 23 bp, Homo sapiens
cacagtgctgcgagatcgctggc

SEQ ID NO: 120594 - DNA, 17 bp, Homo sapiens
caccacccccagtcccc

SEQ ID NO: 120595 - DNA, 18 bp, Homo sapiens
caccatgttcccagctca

SEQ ID NO: 120596 - DNA, 15 bp, Homo sapiens
cacccccagtccccc

SEQ ID NO: 120597 - DNA, 15 bp, Homo sapiens
caccccgcccctgca

SEQ ID NO: 120598 - DNA, 23 bp, Homo sapiens
caccgccaccgtgtgcctttccc

SEQ ID NO: 120599 - DNA, 21 bp, Homo sapiens
caccggtgccaaacccagccc

SEQ ID NO: 120600 - DNA, 23 bp, Homo sapiens
caccggtgccaaacccagcccct

SEQ ID NO: 120601 - DNA, 23 bp, Homo sapiens
cacgggcctctgcttgccagcca

SEQ ID NO: 120602 - DNA, 17 bp, Homo sapiens
cactcaaccaacctccc

SEQ ID NO: 120603 - DNA, 17 bp, Homo sapiens
cactgcaggtggcctcc

SEQ ID NO: 120604 - DNA, 19 bp, Homo sapiens
cactgcaggtggcctccct

SEQ ID NO: 120605 - DNA, 20 bp, Homo sapiens
cactgcaggtggcctccctc

SEQ ID NO: 120606 - DNA, 21 bp, Homo sapiens
cactgcaggtggcctccctcc

SEQ ID NO: 120607 - DNA, 22 bp, Homo sapiens
cactgcaggtggcctccctcca

SEQ ID NO: 120608 - DNA, 14 bp, Homo sapiens
cactgccagccgcc

SEQ ID NO: 120609 - DNA, 16 bp, Homo sapiens
cactgccagccgccac

SEQ ID NO: 120610 - DNA, 17 bp, Homo sapiens
cactgcctgccaagcga

SEQ ID NO: 120611 - DNA, 16 bp, Homo sapiens
cacttctctactctgg

SEQ ID NO: 120612 - DNA, 20 bp, Homo sapiens
cacttctctactctggaagt

SEQ ID NO: 120613 - DNA, 17 bp, Homo sapiens
cactttcagtgaaagca

SEQ ID NO: 120614 - DNA, 13 bp, Homo sapiens
cagagaaggcttc

SEQ ID NO: 120615 - DNA, 14 bp, Homo sapiens
cagagaaggcttcc

SEQ ID NO: 120616 - DNA, 9 bp, Homo sapiens
cagagctgg

SEQ ID NO: 120617 - DNA, 20 bp, Homo sapiens
cagagctgggatgtttctgt

SEQ ID NO: 120618 - DNA, 16 bp, Homo sapiens
cagaggattgaggctt

SEQ ID NO: 120619 - DNA, 12 bp, Homo sapiens
cagcacccaccc

SEQ ID NO: 120620 - DNA, 20 bp, Homo sapiens
cagcagcgggggcggcccag

SEQ ID NO: 120621 - DNA, 23 bp, Homo sapiens
cagcagcgggggcggcccagcct

SEQ ID NO: 120622 - DNA, 13 bp, Homo sapiens
cagcagctcagcc

SEQ ID NO: 120623 - DNA, 17 bp, Homo sapiens
cagcagctcagcctccc

SEQ ID NO: 120624 - DNA, 16 bp, Homo sapiens
cagccaaggctcccgt

SEQ ID NO: 120625 - DNA, 13 bp, Homo sapiens
cagcccctggcac

SEQ ID NO: 120626 - DNA, 19 bp, Homo sapiens
cagcccctggcactgcagg

SEQ ID NO: 120627 - DNA, 14 bp, Homo sapiens
cagccgagccccag

SEQ ID NO: 120628 - DNA, 16 bp, Homo sapiens
cagcctccccccgctg

SEQ ID NO: 120629 - DNA, 17 bp, Homo sapiens
cagcctccccccgctgg

SEQ ID NO: 120630 - DNA, 22 bp, Homo sapiens
cagcctccccccgctggggagc

SEQ ID NO: 120631 - DNA, 23 bp, Homo sapiens
cagcgcagccgagccccaggagc

SEQ ID NO: 120632 - DNA, 14 bp, Homo sapiens
cagcggctgggtgg

SEQ ID NO: 120633 - DNA, 20 bp, Homo sapiens
cagcgggggcggcccagcct

SEQ ID NO: 120634 - DNA, 14 bp, Homo sapiens
cagctcactccctg

SEQ ID NO: 120635 - DNA, 12 bp, Homo sapiens
cagctcagcctc

SEQ ID NO: 120636 - DNA, 16 bp, Homo sapiens
cagctcagtgccaaag

SEQ ID NO: 120637 - DNA, 10 bp, Homo sapiens
cagcttcatt

SEQ ID NO: 120638 - DNA, 19 bp, Homo sapiens
cagcttcatttccgtgaag

SEQ ID NO: 120639 - DNA, 19 bp, Homo sapiens
caggccacagcccctggca

SEQ ID NO: 120640 - DNA, 13 bp, Homo sapiens
caggtggcctccc

SEQ ID NO: 120641 - DNA, 18 bp, Homo sapiens
caggtggcctccctccag

SEQ ID NO: 120642 - DNA, 14 bp, Homo sapiens
cagtggtaccagct

SEQ ID NO: 120643 - DNA, 18 bp, Homo sapiens
cagtggtaccagctcact

SEQ ID NO: 120644 - DNA, 15 bp, Homo sapiens
cagttcctttcaatg

SEQ ID NO: 120645 - DNA, 17 bp, Homo sapiens
catcatgtgcctggaaa

SEQ ID NO: 120646 - DNA, 16 bp, Homo sapiens
catctgctcctcccat

SEQ ID NO: 120647 - DNA, 15 bp, Homo sapiens
catgaaaatgcaaca

SEQ ID NO: 120648 - DNA, 18 bp, Homo sapiens
catgaaggagacagcagc

SEQ ID NO: 120649 - DNA, 15 bp, Homo sapiens
catgattccctcctc

SEQ ID NO: 120650 - DNA, 22 bp, Homo sapiens
catgcacgcaccccgcccctgc

SEQ ID NO: 120651 - DNA, 12 bp, Homo sapiens
catgcagctctg

SEQ ID NO: 120652 - DNA, 17 bp, Homo sapiens
catgcctggcccctcct

SEQ ID NO: 120653 - DNA, 14 bp, Homo sapiens
catggtccatcccc

SEQ ID NO: 120654 - DNA, 21 bp, Homo sapiens
catgttcccagctcagtgcca

SEQ ID NO: 120655 - DNA, 23 bp, Homo sapiens
catgttcccagctcagtgccaaa

SEQ ID NO: 120656 - DNA, 22 bp, Homo sapiens
cattatgatgtgggtcaaggaa

SEQ ID NO: 120657 - DNA, 16 bp, Homo sapiens
ccaaacccagcccctg

SEQ ID NO: 120658 - DNA, 22 bp, Homo sapiens
ccaagcgagaatgcaggccccg

SEQ ID NO: 120659 - DNA, 23 bp, Homo sapiens
ccaatgtgactaccgtgccagca

SEQ ID NO: 120660 - DNA, 11 bp, Homo sapiens
ccaattcttac

SEQ ID NO: 120661 - DNA, 18 bp, Homo sapiens
ccaattcttacaaacatg

SEQ ID NO: 120662 - DNA, 19 bp, Homo sapiens
ccaattcttacaaacatgt

SEQ ID NO: 120663 - DNA, 13 bp, Homo sapiens
ccacagcccctgg

SEQ ID NO: 120664 - DNA, 15 bp, Homo sapiens
ccacagtcacacaga

SEQ ID NO: 120665 - DNA, 16 bp, Homo sapiens
ccacagtcacacagag

SEQ ID NO: 120666 - DNA, 18 bp, Homo sapiens
ccacagtgactgggccct

SEQ ID NO: 120667 - DNA, 20 bp, Homo sapiens
ccacagtgactgggccctgt

SEQ ID NO: 120668 - DNA, 22 bp, Homo sapiens
ccaccggtgccaaacccagccc

SEQ ID NO: 120669 - DNA, 18 bp, Homo sapiens
ccacctctttctacagcc

SEQ ID NO: 120670 - DNA, 20 bp, Homo sapiens
ccacctctttctacagccta

SEQ ID NO: 120671 - DNA, 18 bp, Homo sapiens
ccacttctctactctgga

SEQ ID NO: 120672 - DNA, 21 bp, Homo sapiens
ccacttctctactctggaagt

SEQ ID NO: 120673 - DNA, 13 bp, Homo sapiens
ccagccaggagtg

SEQ ID NO: 120674 - DNA, 21 bp, Homo sapiens
ccagccatcatgtgcctggaa

SEQ ID NO: 120675 - DNA, 23 bp, Homo sapiens
ccagccgggtacctcagtttctc

SEQ ID NO: 120676 - DNA, 18 bp, Homo sapiens
ccagcctacactgccagc

SEQ ID NO: 120677 - DNA, 19 bp, Homo sapiens
ccagcctacactgccagcc

SEQ ID NO: 120678 - DNA, 15 bp, Homo sapiens
ccagctcactccctg

SEQ ID NO: 120679 - DNA, 13 bp, Homo sapiens
ccagctcagtgcc

SEQ ID NO: 120680 - DNA, 21 bp, Homo sapiens
cgccagcctacactgccagcc

SEQ ID NO: 120681 - DNA, 20 bp, Homo sapiens
cgcccagtgggacccacagt

SEQ ID NO: 120682 - DNA, 21 bp, Homo sapiens
cgcccagtgggacccacagtc

SEQ ID NO: 120683 - DNA, 14 bp, Homo sapiens
cgctggcagagaag

SEQ ID NO: 120684 - DNA, 20 bp, Homo sapiens
cggagccagcgcctgcccga

SEQ ID NO: 120685 - DNA, 22 bp, Homo sapiens
cggccgtcaccccgccagccta

SEQ ID NO: 120686 - DNA, 14 bp, Homo sapiens
cggctcccaccggt

SEQ ID NO: 120687 - DNA, 21 bp, Homo sapiens
cggctcccaccggtgccaaac

SEQ ID NO: 120688 - DNA, 20 bp, Homo sapiens
cgggaggtggaggttgcagt

SEQ ID NO: 120689 - DNA, 19 bp, Homo sapiens
cgggcctctgcttgccagc

SEQ ID NO: 120690 - DNA, 19 bp, Homo sapiens
cggggcgacccctcagtgc

SEQ ID NO: 120691 - DNA, 16 bp, Homo sapiens
cgggggcggcccagcc

SEQ ID NO: 120692 - DNA, 17 bp, Homo sapiens
cgggggcggcccagcct

SEQ ID NO: 120693 - DNA, 19 bp, Homo sapiens
cgggggcggcccagcctct

SEQ ID NO: 120694 - DNA, 14 bp, Homo sapiens
cgggtacctcagtt

SEQ ID NO: 120695 - DNA, 17 bp, Homo sapiens
cggtgccaaacccagcc

SEQ ID NO: 120696 - DNA, 19 bp, Homo sapiens
cgtcaggccacagcccctg

SEQ ID NO: 120697 - DNA, 21 bp, Homo sapiens
cgtgtgcctttcccgggccct

SEQ ID NO: 120698 - DNA, 12 bp, Homo sapiens
ctaatacaccag

SEQ ID NO: 120699 - DNA, 15 bp, Homo sapiens
ctacactgccagccg

SEQ ID NO: 120700 - DNA, 18 bp, Homo sapiens
ctacactgccagccgcca

SEQ ID NO: 120701 - DNA, 18 bp, Homo sapiens
ctattcgtagccatctcc

SEQ ID NO: 120702 - DNA, 22 bp, Homo sapiens
ctattcgtagccatctccgtgg

SEQ ID NO: 120703 - DNA, 14 bp, Homo sapiens
ctcaaagaccccat

SEQ ID NO: 120704 - DNA, 20 bp, Homo sapiens
ctcagcttcatttccgtgaa

SEQ ID NO: 120705 - DNA, 23 bp, Homo sapiens
ctcagcttcatttccgtgaaggg

SEQ ID NO: 120706 - DNA, 13 bp, Homo sapiens
ctcagtgccaaag

SEQ ID NO: 120707 - DNA, 19 bp, Homo sapiens
ctccagagactcgagtccc

SEQ ID NO: 120708 - DNA, 17 bp, Homo sapiens
ctcccaccggtgccaaa

SEQ ID NO: 120709 - DNA, 14 bp, Homo sapiens
ctcccactccctgg

SEQ ID NO: 120710 - DNA, 15 bp, Homo sapiens
ctccccgcagagctc

SEQ ID NO: 120711 - DNA, 16 bp, Homo sapiens
ctcccctcccccctgt

SEQ ID NO: 120712 - DNA, 14 bp, Homo sapiens
ctccctccagagac

SEQ ID NO: 120713 - DNA, 12 bp, Homo sapiens
ctcccttcctga

SEQ ID NO: 120714 - DNA, 13 bp, Homo sapiens
ctcctcccattcc

SEQ ID NO: 120715 - DNA, 14 bp, Homo sapiens
ctcctcccattccc

SEQ ID NO: 120716 - DNA, 22 bp, Homo sapiens
ctcctcctagaaaacccttccc

SEQ ID NO: 120717 - DNA, 18 bp, Homo sapiens
ctcctgtacgaacccctc

SEQ ID NO: 120718 - DNA, 18 bp, Homo sapiens
ctcctttattgctcctgt

SEQ ID NO: 120719 - DNA, 15 bp, Homo sapiens
ctcgaagcccttcca

SEQ ID NO: 120720 - DNA, 19 bp, Homo sapiens
ctcgaagcccttccagtgg

SEQ ID NO: 120721 - DNA, 22 bp, Homo sapiens
ctcgccctgtccctcccactcc

SEQ ID NO: 120722 - DNA, 15 bp, Homo sapiens
ctcggcccctcacca

SEQ ID NO: 120723 - DNA, 20 bp, Homo sapiens
ctcggcccctcaccacctct

SEQ ID NO: 120724 - DNA, 14 bp, Homo sapiens
ctcgggccgggcac

SEQ ID NO: 120725 - DNA, 15 bp, Homo sapiens
ctctcaaagacccca

SEQ ID NO: 120726 - DNA, 14 bp, Homo sapiens
ctctccttgcctgg

SEQ ID NO: 120727 - DNA, 17 bp, Homo sapiens
ctctccttgcctggtga

SEQ ID NO: 120728 - DNA, 19 bp, Homo sapiens
ctctcggggcgacccctca

SEQ ID NO: 120729 - DNA, 23 bp, Homo sapiens
ctctgatgagagagtgctgagaa

SEQ ID NO: 120730 - DNA, 14 bp, Homo sapiens
ctctgcttgccagc

SEQ ID NO: 120731 - DNA, 16 bp, Homo sapiens
ctctgcttgccagcca

SEQ ID NO: 120732 - DNA, 17 bp, Homo sapiens
ctgaaaattaacactgc

SEQ ID NO: 120733 - DNA, 12 bp, Homo sapiens
ctgagctggccc

SEQ ID NO: 120734 - DNA, 19 bp, Homo sapiens
ctgcaggtggcctccctcc

SEQ ID NO: 120735 - DNA, 21 bp, Homo sapiens
ctgcaggtggcctccctccag

SEQ ID NO: 120736 - DNA, 22 bp, Homo sapiens
ctgcaggtggcctccctccaga

SEQ ID NO: 120737 - DNA, 21 bp, Homo sapiens
ctgccaagcgagaatgcaggc

SEQ ID NO: 120738 - DNA, 13 bp, Homo sapiens
ctgccagccgcca

SEQ ID NO: 120739 - DNA, 19 bp, Homo sapiens
ctgccagccgccaccgggg

SEQ ID NO: 120740 - DNA, 20 bp, Homo sapiens
ctgcccgagagagaccccac

SEQ ID NO: 120741 - DNA, 23 bp, Homo sapiens
ctgcccgagagagaccccaccgc

SEQ ID NO: 120742 - DNA, 14 bp, Homo sapiens
ctgcctgccaagcg

SEQ ID NO: 120743 - DNA, 21 bp, Homo sapiens
ctgcggccgtcaccccgccag

SEQ ID NO: 120744 - DNA, 16 bp, Homo sapiens
ctgcgtaaccctcgcc

SEQ ID NO: 120745 - DNA, 18 bp, Homo sapiens
ctgcgtaaccctcgccct

SEQ ID NO: 120746 - DNA, 23 bp, Homo sapiens
ctgcgtaaccctcgccctgtccc

SEQ ID NO: 120747 - DNA, 13 bp, Homo sapiens
ctgcttgccagcc

SEQ ID NO: 120748 - DNA, 22 bp, Homo sapiens
ctggcagagaaggcttcctcca

SEQ ID NO: 120749 - DNA, 13 bp, Homo sapiens
ctggctcttctct

SEQ ID NO: 120750 - DNA, 21 bp, Homo sapiens
ctgggaaaggggttgtcaaga

SEQ ID NO: 120751 - DNA, 20 bp, Homo sapiens
ctgggggcgctgttccacag

SEQ ID NO: 120752 - DNA, 24 bp, Homo sapiens
ctggggtacaaggggcccagtgct

SEQ ID NO: 120753 - DNA, 13 bp, Homo sapiens
ctggggtgcgaga

SEQ ID NO: 120754 - DNA, 12 bp, Homo sapiens
ctgtccagggca

SEQ ID NO: 120755 - DNA, 17 bp, Homo sapiens
ctgtccctcccactccc

SEQ ID NO: 120756 - DNA, 14 bp, Homo sapiens
cttaaacaaatgta

SEQ ID NO: 120757 - DNA, 14 bp, Homo sapiens
cttccagtggtacc

SEQ ID NO: 120758 - DNA, 17 bp, Homo sapiens
cttgacagaacactgtc

SEQ ID NO: 120759 - DNA, 12 bp, Homo sapiens
ctttaatataaa

SEQ ID NO: 120760 - DNA, 15 bp, Homo sapiens
ctttcagtgaaagca

SEQ ID NO: 120761 - DNA, 13 bp, Homo sapiens
gaaaacccttccc

SEQ ID NO: 120762 - DNA, 11 bp, Homo sapiens
gaaaaggcagg

SEQ ID NO: 120763 - DNA, 22 bp, Homo sapiens
gaaagtttcttggtctcagctt

SEQ ID NO: 120764 - DNA, 13 bp, Homo sapiens
gaacccctcccct

SEQ ID NO: 120765 - DNA, 17 bp, Homo sapiens
gaactcgaagcccttcc

SEQ ID NO: 120766 - DNA, 21 bp, Homo sapiens
gaagagagtccatatttcaat

SEQ ID NO: 120767 - DNA, 14 bp, Homo sapiens
gaagcccttccagt

SEQ ID NO: 120768 - DNA, 18 bp, Homo sapiens
gaaggaccctggctcttc

SEQ ID NO: 120769 - DNA, 22 bp, Homo sapiens
gaaggagacagcagcacccacc

SEQ ID NO: 120770 - DNA, 14 bp, Homo sapiens
gaaggcttcctcca

SEQ ID NO: 120771 - DNA, 20 bp, Homo sapiens
gaaggcttcctccagcggct

SEQ ID NO: 120772 - DNA, 19 bp, Homo sapiens
gaaggggacagcgccacct

SEQ ID NO: 120773 - DNA, 18 bp, Homo sapiens
gaatgcaggccccgcccc

SEQ ID NO: 120774 - DNA, 22 bp, Homo sapiens
gaatggcacagcccaaagaagg

SEQ ID NO: 120775 - DNA, 20 bp, Homo sapiens
gacaccatgttcccagctca

SEQ ID NO: 120776 - DNA, 15 bp, Homo sapiens
gacagaacactgtct

SEQ ID NO: 120777 - DNA, 16 bp, Homo sapiens
gacatgcagctctgat

SEQ ID NO: 120778 - DNA, 15 bp, Homo sapiens
gaccccaccgccacc

SEQ ID NO: 120779 - DNA, 19 bp, Homo sapiens
gaccccatggtccatcccc

SEQ ID NO: 120780 - DNA, 21 bp, Homo sapiens
gaccccatggtccatcccctg

SEQ ID NO: 120781 - DNA, 13 bp, Homo sapiens
gacccctcagtgc

SEQ ID NO: 120782 - DNA, 12 bp, Homo sapiens
gaccctggctct

SEQ ID NO: 120783 - DNA, 15 bp, Homo sapiens
gaccctggctcttct

SEQ ID NO: 120784 - DNA, 16 bp, Homo sapiens
gactaccgtgccagca

SEQ ID NO: 120785 - DNA, 15 bp, Homo sapiens
gactgggccctgtcc

SEQ ID NO: 120786 - DNA, 16 bp, Homo sapiens
gactgggccctgtcca

SEQ ID NO: 120787 - DNA, 17 bp, Homo sapiens
gactgggccctgtccag

SEQ ID NO: 120788 - DNA, 16 bp, Homo sapiens
gacttgacagaacact

SEQ ID NO: 120789 - DNA, 23 bp, Homo sapiens
gagaactcgaagcccttccagtg

SEQ ID NO: 120790 - DNA, 22 bp, Homo sapiens
gagacagcagcacccacccatg

SEQ ID NO: 120791 - DNA, 23 bp, Homo sapiens
gagaccccaccgccaccgtgtgc

SEQ ID NO: 120792 - DNA, 19 bp, Homo sapiens
gagactcgagtccccatga

SEQ ID NO: 120793 - DNA, 13 bp, Homo sapiens
gagagaccccacc

SEQ ID NO: 120794 - DNA, 16 bp, Homo sapiens
gagaggtgggcagcag

SEQ ID NO: 120795 - DNA, 21 bp, Homo sapiens
gagattgcgccactgcactcc

SEQ ID NO: 120796 - DNA, 15 bp, Homo sapiens
gagcccgtcaggcca

SEQ ID NO: 120797 - DNA, 17 bp, Homo sapiens
gagctcaggacactaat

SEQ ID NO: 120798 - DNA, 20 bp, Homo sapiens
gaggtagctcccagcactca

SEQ ID NO: 120799 - DNA, 19 bp, Homo sapiens
gaggtggaggttgcagtga

SEQ ID NO: 120800 - DNA, 20 bp, Homo sapiens
gaggtggaggttgcagtgag

SEQ ID NO: 120801 - DNA, 16 bp, Homo sapiens
gaggtgggcagcagct

SEQ ID NO: 120802 - DNA, 19 bp, Homo sapiens
gaggttgcagtgagctgag

SEQ ID NO: 120803 - DNA, 22 bp, Homo sapiens
gagtagaaagacagagctggga

SEQ ID NO: 120804 - DNA, 16 bp, Homo sapiens
gatagtattgtgcata

SEQ ID NO: 120805 - DNA, 14 bp, Homo sapiens
gatcgctggcagag

SEQ ID NO: 120806 - DNA, 17 bp, Homo sapiens
gcacagcccaaagaagg

SEQ ID NO: 120807 - DNA, 15 bp, Homo sapiens
gcaccacccccagtc

SEQ ID NO: 120808 - DNA, 14 bp, Homo sapiens
gcacccacccatgc

SEQ ID NO: 120809 - DNA, 16 bp, Homo sapiens
gcacccacccatgcac

SEQ ID NO: 120810 - DNA, 16 bp, Homo sapiens
gcaccccgcccctgca

SEQ ID NO: 120811 - DNA, 18 bp, Homo sapiens
gcaccccgcccctgcatg

SEQ ID NO: 120812 - DNA, 20 bp, Homo sapiens
gcaccccgcccctgcatgcc

SEQ ID NO: 120813 - DNA, 17 bp, Homo sapiens
gcactgcaggtggcctc

SEQ ID NO: 120814 - DNA, 14 bp, Homo sapiens
gcactgcctgccaa

SEQ ID NO: 120815 - DNA, 16 bp, Homo sapiens
gcactgcctgccaagc

SEQ ID NO: 120816 - DNA, 12 bp, Homo sapiens
gcagcagctcag

SEQ ID NO: 120817 - DNA, 17 bp, Homo sapiens
gcagccgagccccagga

SEQ ID NO: 120818 - DNA, 24 bp, Homo sapiens
gcagcgggggcggcccagcctctg

SEQ ID NO: 120819 - DNA, 17 bp, Homo sapiens
gcaggtggcctccctcc

SEQ ID NO: 120820 - DNA, 15 bp, Homo sapiens
gcatcctctccccca

SEQ ID NO: 120821 - DNA, 23 bp, Homo sapiens
gcatcctctcccccacaagagcc

SEQ ID NO: 120822 - DNA, 18 bp, Homo sapiens
gcatgcctggcccctcct

SEQ ID NO: 120823 - DNA, 17 bp, Homo sapiens
gccaaacccagcccctg

SEQ ID NO: 120824 - DNA, 21 bp, Homo sapiens
gccaagcgagaatgcaggccc

SEQ ID NO: 120825 - DNA, 21 bp, Homo sapiens
gccaatgtgactaccgtgcca

SEQ ID NO: 120826 - DNA, 22 bp, Homo sapiens
gccacacagcagcgcagccgag

SEQ ID NO: 120827 - DNA, 22 bp, Homo sapiens
gccagccgggtacctcagtttc

SEQ ID NO: 120828 - DNA, 17 bp, Homo sapiens
gccagcctacactgcca

SEQ ID NO: 120829 - DNA, 19 bp, Homo sapiens
gccagcctacactgccagc

SEQ ID NO: 120830 - DNA, 20 bp, Homo sapiens
gccagcctacactgccagcc

SEQ ID NO: 120831 - DNA, 14 bp, Homo sapiens
gccagcgcctgccc

SEQ ID NO: 120832 - DNA, 16 bp, Homo sapiens
gccagcgcctgcccga

SEQ ID NO: 120833 - DNA, 19 bp, Homo sapiens
gccagtgatgctaaaggtt

SEQ ID NO: 120834 - DNA, 16 bp, Homo sapiens
gccatcatgtgcctgg

SEQ ID NO: 120835 - DNA, 19 bp, Homo sapiens
gccatcatgtgcctggaaa

SEQ ID NO: 120836 - DNA, 19 bp, Homo sapiens
gcccagcctctgagtcccg

SEQ ID NO: 120837 - DNA, 15 bp, Homo sapiens
gcccagtgctggcca

SEQ ID NO: 120838 - DNA, 17 bp, Homo sapiens
gccccaaagatcccacg

SEQ ID NO: 120839 - DNA, 17 bp, Homo sapiens
gccccaggagcccgtca

SEQ ID NO: 120840 - DNA, 23 bp, Homo sapiens
gccccaggagcccgtcaggccac

SEQ ID NO: 120841 - DNA, 16 bp, Homo sapiens
gccccctcggcccctc

SEQ ID NO: 120842 - DNA, 15 bp, Homo sapiens
gccccggctcccacc

SEQ ID NO: 120843 - DNA, 16 bp, Homo sapiens
gcccctcaccacctct

SEQ ID NO: 120844 - DNA, 11 bp, Homo sapiens
gcccctgcatg

SEQ ID NO: 120845 - DNA, 15 bp, Homo sapiens
gcccctgcatgcctg

SEQ ID NO: 120846 - DNA, 20 bp, Homo sapiens
gcccctgcatgcctggcccc

SEQ ID NO: 120847 - DNA, 22 bp, Homo sapiens
gcccctgcatgcctggcccctc

SEQ ID NO: 120848 - DNA, 15 bp, Homo sapiens
gcccctgccccgccc

SEQ ID NO: 120849 - DNA, 16 bp, Homo sapiens
gcccctggcactgcag

SEQ ID NO: 120850 - DNA, 18 bp, Homo sapiens
gcccgtcaggccacagcc

SEQ ID NO: 120851 - DNA, 13 bp, Homo sapiens
gccctcagccctc

SEQ ID NO: 120852 - DNA, 20 bp, Homo sapiens
gccctgcgtaaccctcgccc

SEQ ID NO: 120853 - DNA, 23 bp, Homo sapiens
gccctgcgtaaccctcgccctgt

SEQ ID NO: 120854 - DNA, 19 bp, Homo sapiens
gccctgtccctcccactcc

SEQ ID NO: 120855 - DNA, 23 bp, Homo sapiens
gccctgtccctcccactccctgg

SEQ ID NO: 120856 - DNA, 13 bp, Homo sapiens
gcccttccagtgg

SEQ ID NO: 120857 - DNA, 14 bp, Homo sapiens
gccggccggctggg

SEQ ID NO: 120858 - DNA, 20 bp, Homo sapiens
gccgggcaccacccccagtc

SEQ ID NO: 120859 - DNA, 21 bp, Homo sapiens
gccgggcaccacccccagtcc

SEQ ID NO: 120860 - DNA, 18 bp, Homo sapiens
gccgggtacctcagtttc

SEQ ID NO: 120861 - DNA, 16 bp, Homo sapiens
gccgtcaccccgccag

SEQ ID NO: 120862 - DNA, 18 bp, Homo sapiens
gcctacactgccagccgc

SEQ ID NO: 120863 - DNA, 20 bp, Homo sapiens
gcctccccccgctggggagc

SEQ ID NO: 120864 - DNA, 17 bp, Homo sapiens
gcctctgcttgccagcc

SEQ ID NO: 120865 - DNA, 18 bp, Homo sapiens
gcctctgcttgccagcca

SEQ ID NO: 120866 - DNA, 23 bp, Homo sapiens
gcctctgcttgccagccaggagt

SEQ ID NO: 120867 - DNA, 15 bp, Homo sapiens
gcctggaaattaaac

SEQ ID NO: 120868 - DNA, 14 bp, Homo sapiens
gcctggcccctcct

SEQ ID NO: 120869 - DNA, 17 bp, Homo sapiens
gcctttcccgggccctc

SEQ ID NO: 120870 - DNA, 20 bp, Homo sapiens
gcctttcccgggccctcagc

SEQ ID NO: 120871 - DNA, 19 bp, Homo sapiens
gcgagatcgctggcagaga

SEQ ID NO: 120872 - DNA, 16 bp, Homo sapiens
gcgcctcacctgcatc

SEQ ID NO: 120873 - DNA, 21 bp, Homo sapiens
gcggacaccatgttcccagct

SEQ ID NO: 120874 - DNA, 21 bp, Homo sapiens
gcggccgtcaccccgccagcc

SEQ ID NO: 120875 - DNA, 16 bp, Homo sapiens
gcgtaaccctcgccct

SEQ ID NO: 120876 - DNA, 21 bp, Homo sapiens
gcgtaaccctcgccctgtccc

SEQ ID NO: 120877 - DNA, 21 bp, Homo sapiens
gctaactagcttggaaactgg

SEQ ID NO: 120878 - DNA, 12 bp, Homo sapiens
gctcactccctg

SEQ ID NO: 120879 - DNA, 13 bp, Homo sapiens
gctcactccctgg

SEQ ID NO: 120880 - DNA, 14 bp, Homo sapiens
gctcactccctggg

SEQ ID NO: 120881 - DNA, 15 bp, Homo sapiens
gctcccaccggtgcc

SEQ ID NO: 120882 - DNA, 16 bp, Homo sapiens
gctcccaccggtgcca

SEQ ID NO: 120883 - DNA, 18 bp, Homo sapiens
gctcccaccggtgccaaa

SEQ ID NO: 120884 - DNA, 19 bp, Homo sapiens
gctcccaccggtgccaaac

SEQ ID NO: 120885 - DNA, 23 bp, Homo sapiens
gctcctgtacgaacccctcccct

SEQ ID NO: 120886 - DNA, 22 bp, Homo sapiens
gctgagattgcgccactgcact

SEQ ID NO: 120887 - DNA, 14 bp, Homo sapiens
gctgaggcaattct

SEQ ID NO: 120888 - DNA, 21 bp, Homo sapiens
gctggggagcgaaagtttctt

SEQ ID NO: 120889 - DNA, 21 bp, Homo sapiens
gctgtctgcggagccagcgcc

SEQ ID NO: 120890 - DNA, 22 bp, Homo sapiens
gctgtctgcggagccagcgcct

SEQ ID NO: 120891 - DNA, 24 bp, Homo sapiens
gctgtctgcggagccagcgcctgc

SEQ ID NO: 120892 - DNA, 15 bp, Homo sapiens
ggaatggcacagccc

SEQ ID NO: 120893 - DNA, 20 bp, Homo sapiens
ggaattcatctctctttaat

SEQ ID NO: 120894 - DNA, 14 bp, Homo sapiens
ggacagaagaaggc

SEQ ID NO: 120895 - DNA, 16 bp, Homo sapiens
ggacatgcagctctga

SEQ ID NO: 120896 - DNA, 13 bp, Homo sapiens
ggacgcacagcac

SEQ ID NO: 120897 - DNA, 13 bp, Homo sapiens
ggagccagcgcct

SEQ ID NO: 120898 - DNA, 20 bp, Homo sapiens
ggagcccgtcaggccacagc

SEQ ID NO: 120899 - DNA, 18 bp, Homo sapiens
ggagctgtctgcggagcc

SEQ ID NO: 120900 - DNA, 18 bp, Homo sapiens
ggagggtggcgccctgcg

SEQ ID NO: 120901 - DNA, 22 bp, Homo sapiens
ggatgccataaaagccgcccag

SEQ ID NO: 120902 - DNA, 23 bp, Homo sapiens
ggatgccataaaagccgcccagt

SEQ ID NO: 120903 - DNA, 21 bp, Homo sapiens
ggcaccacccccagtcccccc

SEQ ID NO: 120904 - DNA, 16 bp, Homo sapiens
ggcagagaaggcttcc

SEQ ID NO: 120905 - DNA, 13 bp, Homo sapiens
ggcagcagctcag

SEQ ID NO: 120906 - DNA, 13 bp, Homo sapiens
ggccacagcccct

SEQ ID NO: 120907 - DNA, 17 bp, Homo sapiens
ggccacagcccctggca

SEQ ID NO: 120908 - DNA, 19 bp, Homo sapiens
ggccacagcccctggcact

SEQ ID NO: 120909 - DNA, 16 bp, Homo sapiens
ggcccctcaccacctc

SEQ ID NO: 120910 - DNA, 11 bp, Homo sapiens
ggcccctgccc

SEQ ID NO: 120911 - DNA, 13 bp, Homo sapiens
ggccctcagccct

SEQ ID NO: 120912 - DNA, 17 bp, Homo sapiens
ctgtctgcggagccagc

SEQ ID NO: 120913 - DNA, 23 bp, Homo sapiens
ctgttccacagtgactgggccct

SEQ ID NO: 120914 - DNA, 18 bp, Homo sapiens
cttccagtggtaccagct

SEQ ID NO: 120915 - DNA, 20 bp, Homo sapiens
cttccagtggtaccagctca

SEQ ID NO: 120916 - DNA, 22 bp, Homo sapiens
cttccagtggtaccagctcact

SEQ ID NO: 120917 - DNA, 16 bp, Homo sapiens
cttcctcagtcctgga

SEQ ID NO: 120918 - DNA, 18 bp, Homo sapiens
cttcctcagtcctggaag

SEQ ID NO: 120919 - DNA, 19 bp, Homo sapiens
cttcctgaccctccgctgc

SEQ ID NO: 120920 - DNA, 21 bp, Homo sapiens
cttctctcggggcgacccctc

SEQ ID NO: 120921 - DNA, 23 bp, Homo sapiens
cttctctcggggcgacccctcag

SEQ ID NO: 120922 - DNA, 14 bp, Homo sapiens
cttgacagaacact

SEQ ID NO: 120923 - DNA, 13 bp, Homo sapiens
cttggtctcagct

SEQ ID NO: 120924 - DNA, 14 bp, Homo sapiens
cttggtctcagctt

SEQ ID NO: 120925 - DNA, 15 bp, Homo sapiens
cttggtctcagcttc

SEQ ID NO: 120926 - DNA, 22 bp, Homo sapiens
cttgtgtttttaactcaatatt

SEQ ID NO: 120927 - DNA, 20 bp, Homo sapiens
ctttcaatggtttgcaagga

SEQ ID NO: 120928 - DNA, 22 bp, Homo sapiens
ctttcaatggtttgcaaggaag

SEQ ID NO: 120929 - DNA, 17 bp, Homo sapiens
ctttcagtgaaagcatc

SEQ ID NO: 120930 - DNA, 12 bp, Homo sapiens
ctttccagccaa

SEQ ID NO: 120931 - DNA, 21 bp, Homo sapiens
ctttggggcttttacaccagt

SEQ ID NO: 120932 - DNA, 17 bp, Homo sapiens
cttttatttcttaaaca

SEQ ID NO: 120933 - DNA, 14 bp, Homo sapiens
gaaagacagagctg

SEQ ID NO: 120934 - DNA, 15 bp, Homo sapiens
gaacccctcccctcc

SEQ ID NO: 120935 - DNA, 22 bp, Homo sapiens
gaactcgaagcccttccagtgg

SEQ ID NO: 120936 - DNA, 16 bp, Homo sapiens
gaaggcttcctccagc

SEQ ID NO: 120937 - DNA, 14 bp, Homo sapiens
gaatataaacacta

SEQ ID NO: 120938 - DNA, 21 bp, Homo sapiens
gaatataaacactatatggca

SEQ ID NO: 120939 - DNA, 17 bp, Homo sapiens
gaatggcacagcccaaa

SEQ ID NO: 120940 - DNA, 18 bp, Homo sapiens
gaattaagttagggaatg

SEQ ID NO: 120941 - DNA, 21 bp, Homo sapiens
gaattaagttagggaatggca

SEQ ID NO: 120942 - DNA, 19 bp, Homo sapiens
gacaccatgttcccagctc

SEQ ID NO: 120943 - DNA, 13 bp, Homo sapiens
gacagaagaaggc

SEQ ID NO: 120944 - DNA, 14 bp, Homo sapiens
gaccctggctcttc

SEQ ID NO: 120945 - DNA, 23 bp, Homo sapiens
gaccctggctcttctctcggggc

SEQ ID NO: 120946 - DNA, 17 bp, Homo sapiens
gacgcacagcactgcct

SEQ ID NO: 120947 - DNA, 15 bp, Homo sapiens
gactaccgtgccagc

SEQ ID NO: 120948 - DNA, 18 bp, Homo sapiens
gactaccgtgccagcagc

SEQ ID NO: 120949 - DNA, 19 bp, Homo sapiens
gactaccgtgccagcagcg

SEQ ID NO: 120950 - DNA, 18 bp, Homo sapiens
gactcgagtccccatgat

SEQ ID NO: 120951 - DNA, 14 bp, Homo sapiens
gactgggccctgtc

SEQ ID NO: 120952 - DNA, 16 bp, Homo sapiens
gagacagcagcaccca

SEQ ID NO: 120953 - DNA, 16 bp, Homo sapiens
gagaccccaccgccac

SEQ ID NO: 120954 - DNA, 16 bp, Homo sapiens
gagactcgagtcccca

SEQ ID NO: 120955 - DNA, 18 bp, Homo sapiens
gagactcgagtccccatg

SEQ ID NO: 120956 - DNA, 19 bp, Homo sapiens
gagccccaaagatcccacg

SEQ ID NO: 120957 - DNA, 16 bp, Homo sapiens
gagcccgtcaggccac

SEQ ID NO: 120958 - DNA, 19 bp, Homo sapiens
gagcccgtcaggccacagc

SEQ ID NO: 120959 - DNA, 18 bp, Homo sapiens
gagcgcctcacctgcatc

SEQ ID NO: 120960 - DNA, 20 bp, Homo sapiens
gagctgtctgcggagccagc

SEQ ID NO: 120961 - DNA, 22 bp, Homo sapiens
gagctgtctgcggagccagcgc

SEQ ID NO: 120962 - DNA, 23 bp, Homo sapiens
gagggacgcacagcactgcctgc

SEQ ID NO: 120963 - DNA, 15 bp, Homo sapiens
gaggtgggcagcagc

SEQ ID NO: 120964 - DNA, 18 bp, Homo sapiens
gaggtgggcagcagctca

SEQ ID NO: 120965 - DNA, 20 bp, Homo sapiens
gagtagaaagacagagctgg

SEQ ID NO: 120966 - DNA, 22 bp, Homo sapiens
gagtccccatgattccctcctc

SEQ ID NO: 120967 - DNA, 23 bp, Homo sapiens
gagttgacttgacagaacactgt

SEQ ID NO: 120968 - DNA, 18 bp, Homo sapiens
gatcgctggcagagaagg

SEQ ID NO: 120969 - DNA, 16 bp, Homo sapiens
gatgtcccatctgctc

SEQ ID NO: 120970 - DNA, 18 bp, Homo sapiens
gatgtcccatctgctcct

SEQ ID NO: 120971 - DNA, 18 bp, Homo sapiens
gattaatatggggatgca

SEQ ID NO: 120972 - DNA, 17 bp, Homo sapiens
gcaaaggagtagaaaga

SEQ ID NO: 120973 - DNA, 14 bp, Homo sapiens
gcacagcactgcct

SEQ ID NO: 120974 - DNA, 15 bp, Homo sapiens
gcacagcactgcctg

SEQ ID NO: 120975 - DNA, 16 bp, Homo sapiens
gcacagcactgcctgc

SEQ ID NO: 120976 - DNA, 16 bp, Homo sapiens
gcaccacccccagtcc

SEQ ID NO: 120977 - DNA, 17 bp, Homo sapiens
gcaccccgcccctgcat

SEQ ID NO: 120978 - DNA, 21 bp, Homo sapiens
gcacgcaccccgcccctgcat

SEQ ID NO: 120979 - DNA, 20 bp, Homo sapiens
gcactcaaccaacctccccg

SEQ ID NO: 120980 - DNA, 14 bp, Homo sapiens
gcagagaaggcttc

SEQ ID NO: 120981 - DNA, 20 bp, Homo sapiens
gcagcagctcagcctccccc

SEQ ID NO: 120982 - DNA, 20 bp, Homo sapiens
gcagcaggtggcagaatggg

SEQ ID NO: 120983 - DNA, 20 bp, Homo sapiens
gcagccgagccccaggagcc

SEQ ID NO: 120984 - DNA, 17 bp, Homo sapiens
gcagcgcagccgagccc

SEQ ID NO: 120985 - DNA, 23 bp, Homo sapiens
gcagcgcagccgagccccaggag

SEQ ID NO: 120986 - DNA, 21 bp, Homo sapiens
gcagcgggggcggcccagcct

SEQ ID NO: 120987 - DNA, 15 bp, Homo sapiens
gcaggtggcctccct

SEQ ID NO: 120988 - DNA, 20 bp, Homo sapiens
gcaggtggcctccctccaga

SEQ ID NO: 120989 - DNA, 21 bp, Homo sapiens
gcatcctctcccccacaagag

SEQ ID NO: 120990 - DNA, 13 bp, Homo sapiens
gcatgaaggtttc

SEQ ID NO: 120991 - DNA, 15 bp, Homo sapiens
gtgctcggcagtcat

SEQ ID NO: 120992 - DNA, 19 bp, Homo sapiens
gtgctggccacacagcagc

SEQ ID NO: 120993 - DNA, 16 bp, Homo sapiens
gtggaggagctcagga

SEQ ID NO: 120994 - DNA, 14 bp, Homo sapiens
gtgggacccacagt

SEQ ID NO: 120995 - DNA, 15 bp, Homo sapiens
gtgggcagcagctca

SEQ ID NO: 120996 - DNA, 16 bp, Homo sapiens
gtggtaccagctcact

SEQ ID NO: 120997 - DNA, 20 bp, Homo sapiens
gtggtcagccaaggctcccg

SEQ ID NO: 120998 - DNA, 21 bp, Homo sapiens
gtggtgaaggaccctggctct

SEQ ID NO: 120999 - DNA, 16 bp, Homo sapiens
gtggtgggtgcctgta

SEQ ID NO: 121000 - DNA, 15 bp, Homo sapiens
gtgtttttaactcaa

SEQ ID NO: 121001 - DNA, 22 bp, Homo sapiens
gttccacagtgactgggccctg

SEQ ID NO: 121002 - DNA, 12 bp, Homo sapiens
gttcccagctca

SEQ ID NO: 121003 - DNA, 20 bp, Homo sapiens
gttccgtgggatgccataaa

SEQ ID NO: 121004 - DNA, 20 bp, Homo sapiens
gttgacttgacagaacactg

SEQ ID NO: 121005 - DNA, 18 bp, Homo sapiens
gtttctcctttattgctc

SEQ ID NO: 121006 - DNA, 20 bp, Homo sapiens
gtttctcctttattgctcct

SEQ ID NO: 121007 - DNA, 20 bp, Homo sapiens
gtttctgaaaattaacactg

SEQ ID NO: 121008 - DNA, 18 bp, Homo sapiens
gtttcttggtctcagctt

SEQ ID NO: 121009 - DNA, 13 bp, Homo sapiens
gtttgaatataaa

SEQ ID NO: 121010 - DNA, 19 bp, Homo sapiens
gtttgaatataaacactat

SEQ ID NO: 121011 - DNA, 15 bp, Homo sapiens
gtttgcaaggaagcc

SEQ ID NO: 121012 - DNA, 19 bp, Homo sapiens
taaacaaatgtatgattac

SEQ ID NO: 121013 - DNA, 12 bp, Homo sapiens
taaacacagtgc

SEQ ID NO: 121014 - DNA, 17 bp, Homo sapiens
taaccctcgccctgtcc

SEQ ID NO: 121015 - DNA, 14 bp, Homo sapiens
taactcaatatttt

SEQ ID NO: 121016 - DNA, 14 bp, Homo sapiens
taatataaagttgg

SEQ ID NO: 121017 - DNA, 19 bp, Homo sapiens
taatataaagttggatgcg

SEQ ID NO: 121018 - DNA, 23 bp, Homo sapiens
tacaaggggcccagtgctggcca

SEQ ID NO: 121019 - DNA, 13 bp, Homo sapiens
taccgtgccagca

SEQ ID NO: 121020 - DNA, 15 bp, Homo sapiens
tagaaaacccttccc

SEQ ID NO: 121021 - DNA, 21 bp, Homo sapiens
tagccatctccgtggccaatg

SEQ ID NO: 121022 - DNA, 22 bp, Homo sapiens
tataatatttttaattaaataa

SEQ ID NO: 121023 - DNA, 15 bp, Homo sapiens
tatatacatatatat

SEQ ID NO: 121024 - DNA, 16 bp, Homo sapiens
tatgaccttctaggaa

SEQ ID NO: 121025 - DNA, 13 bp, Homo sapiens
tatggcagtgtct

SEQ ID NO: 121026 - DNA, 14 bp, Homo sapiens
tatgtttttgtgta

SEQ ID NO: 121027 - DNA, 22 bp, Homo sapiens
tatttcaatttccaagagctga

SEQ ID NO: 121028 - DNA, 17 bp, Homo sapiens
tatttttaattaaataa

SEQ ID NO: 121029 - DNA, 13 bp, Homo sapiens
tatttttatttgt

SEQ ID NO: 121030 - DNA, 14 bp, Homo sapiens
tcaaagaccccatg

SEQ ID NO: 121031 - DNA, 14 bp, Homo sapiens
tcaactccagctcc

SEQ ID NO: 121032 - DNA, 15 bp, Homo sapiens
tcaatattttccatg

SEQ ID NO: 121033 - DNA, 20 bp, Homo sapiens
gagaccccaccgccaccgtg

SEQ ID NO: 121034 - DNA, 17 bp, Homo sapiens
gagagaggtgggcagca

SEQ ID NO: 121035 - DNA, 14 bp, Homo sapiens
gagagagtgctgag

SEQ ID NO: 121036 - DNA, 14 bp, Homo sapiens
gagaggtgggcagc

SEQ ID NO: 121037 - DNA, 13 bp, Homo sapiens
gagagtgctgaga

SEQ ID NO: 121038 - DNA, 16 bp, Homo sapiens
gagatcgctggcagag

SEQ ID NO: 121039 - DNA, 17 bp, Homo sapiens
gagatcgctggcagaga

SEQ ID NO: 121040 - DNA, 17 bp, Homo sapiens
gagccagcgcctgcccg

SEQ ID NO: 121041 - DNA, 18 bp, Homo sapiens
gagccagcgcctgcccga

SEQ ID NO: 121042 - DNA, 20 bp, Homo sapiens
gagcccgtcaggccacagcc

SEQ ID NO: 121043 - DNA, 15 bp, Homo sapiens
gagctcccttcctga

SEQ ID NO: 121044 - DNA, 20 bp, Homo sapiens
gagctgagattgcgccactg

SEQ ID NO: 121045 - DNA, 17 bp, Homo sapiens
gagctgaggcaattcta

SEQ ID NO: 121046 - DNA, 18 bp, Homo sapiens
gaggagctcaggacacta

SEQ ID NO: 121047 - DNA, 19 bp, Homo sapiens
gaggcttaattctgagctg

SEQ ID NO: 121048 - DNA, 21 bp, Homo sapiens
gagggacgcacagcactgcct

SEQ ID NO: 121049 - DNA, 21 bp, Homo sapiens
gaggggagagggacgcacagc

SEQ ID NO: 121050 - DNA, 17 bp, Homo sapiens
gagtagaaagacagagc

SEQ ID NO: 121051 - DNA, 22 bp, Homo sapiens
gagtcccgtggggccccggctc

SEQ ID NO: 121052 - DNA, 13 bp, Homo sapiens
gatcccacgggag

SEQ ID NO: 121053 - DNA, 16 bp, Homo sapiens
gatgcagcattatgat

SEQ ID NO: 121054 - DNA, 23 bp, Homo sapiens
gatgccagccgggtacctcagtt

SEQ ID NO: 121055 - DNA, 16 bp, Homo sapiens
gatgggcccaattctt

SEQ ID NO: 121056 - DNA, 23 bp, Homo sapiens
gatgtggagggtggcgccctgcg

SEQ ID NO: 121057 - DNA, 17 bp, Homo sapiens
gatgtgggtcaaggaat

SEQ ID NO: 121058 - DNA, 16 bp, Homo sapiens
gcacacgggcctctgc

SEQ ID NO: 121059 - DNA, 17 bp, Homo sapiens
gcacacgggcctctgct

SEQ ID NO: 121060 - DNA, 13 bp, Homo sapiens
gcacagcactgcc

SEQ ID NO: 121061 - DNA, 18 bp, Homo sapiens
gcacagcactgcctgcca

SEQ ID NO: 121062 - DNA, 21 bp, Homo sapiens
gcaccacccccagtcccccca

SEQ ID NO: 121063 - DNA, 11 bp, Homo sapiens
gcacccaccca

SEQ ID NO: 121064 - DNA, 19 bp, Homo sapiens
gcacccacccatgcacgca

SEQ ID NO: 121065 - DNA, 23 bp, Homo sapiens
gcaccgagaactcgaagcccttc

SEQ ID NO: 121066 - DNA, 20 bp, Homo sapiens
gcacgcaccccgcccctgca

SEQ ID NO: 121067 - DNA, 19 bp, Homo sapiens
gcactcaaccaacctcccc

SEQ ID NO: 121068 - DNA, 22 bp, Homo sapiens
gcactcaaccaacctccccgca

SEQ ID NO: 121069 - DNA, 19 bp, Homo sapiens
gcactgcaggtggcctccc

SEQ ID NO: 121070 - DNA, 15 bp, Homo sapiens
gcactgcctgccaag

SEQ ID NO: 121071 - DNA, 13 bp, Homo sapiens
gcagagaaggctt

SEQ ID NO: 121072 - DNA, 17 bp, Homo sapiens
gcagagaaggcttcctc

SEQ ID NO: 121073 - DNA, 16 bp, Homo sapiens
gcagcagctcagcctc

SEQ ID NO: 121074 - DNA, 17 bp, Homo sapiens
gcagcagctcagcctcc

SEQ ID NO: 121075 - DNA, 21 bp, Homo sapiens
gcagcagctcagcctcccccc

SEQ ID NO: 121076 - DNA, 15 bp, Homo sapiens
gcagccgagccccag

SEQ ID NO: 121077 - DNA, 16 bp, Homo sapiens
gcagcgggggcggccc

SEQ ID NO: 121078 - DNA, 22 bp, Homo sapiens
gcagcgggggcggcccagcctc

SEQ ID NO: 121079 - DNA, 17 bp, Homo sapiens
gcagctcagcctccccc

SEQ ID NO: 121080 - DNA, 20 bp, Homo sapiens
ttgacttgacagaacactgt

SEQ ID NO: 121081 - DNA, 12 bp, Homo sapiens
ttgcaaggaagc

SEQ ID NO: 121082 - DNA, 13 bp, Homo sapiens
ttgcaaggaagcc

SEQ ID NO: 121083 - DNA, 22 bp, Homo sapiens
ttgtggaggagctcaggacact

SEQ ID NO: 121084 - DNA, 24 bp, Homo sapiens
tttaactcaatattttccatgaaa

SEQ ID NO: 121085 - DNA, 13 bp, Homo sapiens
tttaattaaataa

SEQ ID NO: 121086 - DNA, 20 bp, Homo sapiens
tttatgccttttatttctta

SEQ ID NO: 121087 - DNA, 21 bp, Homo sapiens
tttcaatggtttgcaaggaag

SEQ ID NO: 121088 - DNA, 14 bp, Homo sapiens
tttcaatttccaag

SEQ ID NO: 121089 - DNA, 16 bp, Homo sapiens
tttcttaaacaaatgt

SEQ ID NO: 121090 - DNA, 21 bp, Homo sapiens
tttcttggtctcagcttcatt

SEQ ID NO: 121091 - DNA, 17 bp, Homo sapiens
tttgaatataaacacta

SEQ ID NO: 121092 - DNA, 19 bp, Homo sapiens
tttgaatataaacactata

SEQ ID NO: 121093 - DNA, 12 bp, Homo sapiens
tttgcaaggaag

SEQ ID NO: 121094 - DNA, 19 bp, Homo sapiens
ttttatgccttttatttct

SEQ ID NO: 121095 - DNA, 22 bp, Homo sapiens
tttttaactcaatattttccat

SEQ ID NO: 121096 - DNA, 12 bp, Homo sapiens
tcctgaccctcc

SEQ ID NO: 121097 - DNA, 16 bp, Homo sapiens
tcgaagcccttccagt

SEQ ID NO: 121098 - DNA, 20 bp, Homo sapiens
tcgccctgtccctcccactc

SEQ ID NO: 121099 - DNA, 17 bp, Homo sapiens
tcgctggcagagaaggc

SEQ ID NO: 121100 - DNA, 19 bp, Homo sapiens
tcggcccctcaccacctct

SEQ ID NO: 121101 - DNA, 21 bp, Homo sapiens
tcggctgtaaacagctctgtg

SEQ ID NO: 121102 - DNA, 16 bp, Homo sapiens
tcggggcgacccctca

SEQ ID NO: 121103 - DNA, 17 bp, Homo sapiens
tcggggcgacccctcag

SEQ ID NO: 121104 - DNA, 19 bp, Homo sapiens
tcggggcgacccctcagtg

SEQ ID NO: 121105 - DNA, 23 bp, Homo sapiens
tctctcggggcgacccctcagtg

SEQ ID NO: 121106 - DNA, 20 bp, Homo sapiens
tctgagctggccctttccag

SEQ ID NO: 121107 - DNA, 20 bp, Homo sapiens
tctgagtcccgtggggcccc

SEQ ID NO: 121108 - DNA, 22 bp, Homo sapiens
tctgcggagccagcgcctgccc

SEQ ID NO: 121109 - DNA, 22 bp, Homo sapiens
tctgctcctcccattcccctta

SEQ ID NO: 121110 - DNA, 14 bp, Homo sapiens
tctgcttgccagcc

SEQ ID NO: 121111 - DNA, 15 bp, Homo sapiens
tctgcttgccagcca

SEQ ID NO: 121112 - DNA, 14 bp, Homo sapiens
tcttacaaacatgt

SEQ ID NO: 121113 - DNA, 14 bp, Homo sapiens
tcttggtctcagct

SEQ ID NO: 121114 - DNA, 17 bp, Homo sapiens
tcttggtctcagcttca

SEQ ID NO: 121115 - DNA, 15 bp, Homo sapiens
tctttctacagccta

SEQ ID NO: 121116 - DNA, 18 bp, Homo sapiens
tgaaaatgcaacaacatg

SEQ ID NO: 121117 - DNA, 21 bp, Homo sapiens
tgaaaatgcaacaacatgtat

SEQ ID NO: 121118 - DNA, 14 bp, Homo sapiens
tgaaaattaacact

SEQ ID NO: 121119 - DNA, 15 bp, Homo sapiens
tgaaaattaacactg

SEQ ID NO: 121120 - DNA, 18 bp, Homo sapiens
tgaaaattaacactgctt

SEQ ID NO: 121121 - DNA, 11 bp, Homo sapiens
tgaagaagaga

SEQ ID NO: 121122 - DNA, 21 bp, Homo sapiens
tgaaggaccctggctcttctc

SEQ ID NO: 121123 - DNA, 15 bp, Homo sapiens
tgaatataaacacta

SEQ ID NO: 121124 - DNA, 13 bp, Homo sapiens
tgacagaacactg

SEQ ID NO: 121125 - DNA, 20 bp, Homo sapiens
tgactaccgtgccagcagcg

SEQ ID NO: 121126 - DNA, 18 bp, Homo sapiens
tgactgggccctgtccag

SEQ ID NO: 121127 - DNA, 18 bp, Homo sapiens
tgagggtggtcagccaag

SEQ ID NO: 121128 - DNA, 15 bp, Homo sapiens
tgcacgcaccccgcc

SEQ ID NO: 121129 - DNA, 20 bp, Homo sapiens
tgcacgcaccccgcccctgc

SEQ ID NO: 121130 - DNA, 19 bp, Homo sapiens
tgcagaggattgaggctta

SEQ ID NO: 121131 - DNA, 15 bp, Homo sapiens
tgcaggtggcctccc

SEQ ID NO: 121132 - DNA, 19 bp, Homo sapiens
tgcaggtggcctccctcca

SEQ ID NO: 121133 - DNA, 19 bp, Homo sapiens
tgcatagagccacgtatgt

SEQ ID NO: 121134 - DNA, 14 bp, Homo sapiens
tgcatgcctggccc

SEQ ID NO: 121135 - DNA, 15 bp, Homo sapiens
tgcatgcctggcccc

SEQ ID NO: 121136 - DNA, 20 bp, Homo sapiens
tgccaagcgagaatgcaggc

SEQ ID NO: 121137 - DNA, 22 bp, Homo sapiens
tgccaagcgagaatgcaggccc

SEQ ID NO: 121138 - DNA, 23 bp, Homo sapiens
tgccagcagcgggggcggcccag

SEQ ID NO: 121139 - DNA, 11 bp, Homo sapiens
tgccagccagg

SEQ ID NO: 121140 - DNA, 21 bp, Homo sapiens
tgccagccgggtacctcagtt

SEQ ID NO: 121141 - DNA, 23 bp, Homo sapiens
tgccatggacagaagaaggcagc

SEQ ID NO: 121142 - DNA, 18 bp, Homo sapiens
tgcccgagagagacccca

SEQ ID NO: 121143 - DNA, 20 bp, Homo sapiens
tgcccgagagagaccccacc

SEQ ID NO: 121144 - DNA, 12 bp, Homo sapiens
tgcctgccaagc

SEQ ID NO: 121145 - DNA, 14 bp, Homo sapiens
tgcctggcccctcc

SEQ ID NO: 121146 - DNA, 17 bp, Homo sapiens
tgcctggcccctcctcc

SEQ ID NO: 121147 - DNA, 20 bp, Homo sapiens
tgcgagagaggtgggcagca

SEQ ID NO: 121148 - DNA, 24 bp, Homo sapiens
tgcggacaccatgttcccagctca

SEQ ID NO: 121149 - DNA, 20 bp, Homo sapiens
tgcggagccagcgcctgccc

SEQ ID NO: 121150 - DNA, 18 bp, Homo sapiens
tgtatttgttaatggttt

SEQ ID NO: 121151 - DNA, 20 bp, Homo sapiens
tgtatttgttaatggtttga

SEQ ID NO: 121152 - DNA, 15 bp, Homo sapiens
tgtcaagagagagtc

SEQ ID NO: 121153 - DNA, 19 bp, Homo sapiens
tgtcccatctgctcctccc

SEQ ID NO: 121154 - DNA, 13 bp, Homo sapiens
tgtccctcccact

SEQ ID NO: 121155 - DNA, 17 bp, Homo sapiens
tgtctgcggagccagcg

SEQ ID NO: 121156 - DNA, 19 bp, Homo sapiens
tgtgcctttcccgggccct

SEQ ID NO: 121157 - DNA, 20 bp, Homo sapiens
tgtggagggtggcgccctgc

SEQ ID NO: 121158 - DNA, 14 bp, Homo sapiens
tgttccacagtgac

SEQ ID NO: 121159 - DNA, 20 bp, Homo sapiens
tgttccacagtgactgggcc

SEQ ID NO: 121160 - DNA, 13 bp, Homo sapiens
tgttcccagctca

SEQ ID NO: 121161 - DNA, 19 bp, Homo sapiens
tgttcccagctcagtgcca

SEQ ID NO: 121162 - DNA, 22 bp, Homo sapiens
tgttcccagctcagtgccaaag

SEQ ID NO: 121163 - DNA, 12 bp, Homo sapiens
ttaactcaatat

SEQ ID NO: 121164 - DNA, 18 bp, Homo sapiens
ttaagttagggaatggca

SEQ ID NO: 121165 - DNA, 15 bp, Homo sapiens
ttacaaacatgtggt

SEQ ID NO: 121166 - DNA, 15 bp, Homo sapiens
ttatgccttttattt

SEQ ID NO: 121167 - DNA, 17 bp, Homo sapiens
ttcaatttccaagagct

SEQ ID NO: 121168 - DNA, 17 bp, Homo sapiens
ttcccgggccctcagcc

SEQ ID NO: 121169 - DNA, 15 bp, Homo sapiens
ttctctactctggaa

SEQ ID NO: 121170 - DNA, 19 bp, Homo sapiens
ttctgaaaattaacactgc

SEQ ID NO: 121171 - DNA, 17 bp, Homo sapiens
ttcttaaacaaatgtat

SEQ ID NO: 121172 - DNA, 15 bp, Homo sapiens
ttgaatataaacact

SEQ ID NO: 121173 - DNA, 18 bp, Homo sapiens
ttgaatataaacactata

SEQ ID NO: 121174 - DNA, 14 bp, Homo sapiens
ttgacagaacactg

SEQ ID NO: 121175 - DNA, 14 bp, Homo sapiens
ttgcatatatacat

SEQ ID NO: 121176 - DNA, 14 bp, Homo sapiens
ttgccagccaggag

SEQ ID NO: 121177 - DNA, 13 bp, Homo sapiens
ttggtgttgacat

SEQ ID NO: 121178 - DNA, 19 bp, Homo sapiens
ttgtacacaccttatattt

SEQ ID NO: 121179 - DNA, 23 bp, Homo sapiens
tttccgtgaagggcaccgagaac

SEQ ID NO: 121180 - DNA, 18 bp, Homo sapiens
tttcttggtctcagcttc

SEQ ID NO: 121181 - DNA, 18 bp, Homo sapiens
tttgaatataaacactat

SEQ ID NO: 121182 - DNA, 14 bp, Homo sapiens
tttgcaaggaagcc

SEQ ID NO: 121183 - DNA, 22 bp, Homo sapiens
tttgctaactagcttggaaact

SEQ ID NO: 121184 - DNA, 13 bp, Homo sapiens
ttttaactcaata

SEQ ID NO: 121185 - DNA, 13 bp, Homo sapiens
ttttaattaaata

SEQ ID NO: 121186 - DNA, 13 bp, Homo sapiens
ttttaatttgata

SEQ ID NO: 121187 - DNA, 19 bp, Homo sapiens
ttttccatgaaaatgcaac

SEQ ID NO: 121188 - DNA, 23 bp, Homo sapiens
tcaggagccgaagcccaggggcc

SEQ ID NO: 121189 - DNA, 20 bp, Homo sapiens
tccccagcatgcaccacggg

SEQ ID NO: 121190 - DNA, 19 bp, Homo sapiens
tccgccttaccaggagaag

SEQ ID NO: 121191 - DNA, 21 bp, Homo sapiens
tcctcaggagccgaagcccag

SEQ ID NO: 121192 - DNA, 22 bp, Homo sapiens
tcctcaggagccgaagcccagg

SEQ ID NO: 121193 - DNA, 16 bp, Homo sapiens
tcgctgtgccacaggc

SEQ ID NO: 121194 - DNA, 13 bp, Homo sapiens
tcggtcctggtgc

SEQ ID NO: 121195 - DNA, 15 bp, Homo sapiens
tgagggtcctgcagc

SEQ ID NO: 121196 - DNA, 19 bp, Homo sapiens
tgagggtcctgcagcctgc

SEQ ID NO: 121197 - DNA, 22 bp, Homo sapiens
tgagggtcctgcagcctgcagg

SEQ ID NO: 121198 - DNA, 17 bp, Homo sapiens
tgccacaggcttaggga

SEQ ID NO: 121199 - DNA, 13 bp, Homo sapiens
tgcctcctcagga

SEQ ID NO: 121200 - DNA, 16 bp, Homo sapiens
tgcctcctcaggagcc

SEQ ID NO: 121201 - DNA, 13 bp, Homo sapiens
tgcggcggtccca

SEQ ID NO: 121202 - DNA, 14 bp, Homo sapiens
tgcggcggtcccag

SEQ ID NO: 121203 - DNA, 21 bp, Homo sapiens
tggagtgtgagggtcctgcag

SEQ ID NO: 121204 - DNA, 13 bp, Homo sapiens
tggccgggcaggg

SEQ ID NO: 121205 - DNA, 19 bp, Homo sapiens
tggggccatgcctcctcag

SEQ ID NO: 121206 - DNA, 21 bp, Homo sapiens
tggggccatgcctcctcagga

SEQ ID NO: 121207 - DNA, 20 bp, Homo sapiens
tgggtcaccagacggggctg

SEQ ID NO: 121208 - DNA, 21 bp, Homo sapiens
tgtcctccgccttaccaggag

SEQ ID NO: 121209 - DNA, 17 bp, Homo sapiens
tgtgagggtcctgcagc

SEQ ID NO: 121210 - DNA, 16 bp, Homo sapiens
tgtgccacaggcttag

SEQ ID NO: 121211 - DNA, 23 bp, Homo sapiens
tgtggggccatgcctcctcagga

SEQ ID NO: 121212 - DNA, 22 bp, Homo sapiens
ttagggacaggaccccagctct

SEQ ID NO: 121213 - DNA, 15 bp, Homo sapiens
aagagtcgctgtgcc

SEQ ID NO: 121214 - DNA, 22 bp, Homo sapiens
aagagtcgctgtgccacaggct

SEQ ID NO: 121215 - DNA, 17 bp, Homo sapiens
acaggaccccagctctg

SEQ ID NO: 121216 - DNA, 19 bp, Homo sapiens
acaggaccccagctctgcg

SEQ ID NO: 121217 - DNA, 16 bp, Homo sapiens
acaggcttagggacag

SEQ ID NO: 121218 - DNA, 15 bp, Homo sapiens
accagacggggctgg

SEQ ID NO: 121219 - DNA, 16 bp, Homo sapiens
accagacggggctgga

SEQ ID NO: 121220 - DNA, 21 bp, Homo sapiens
accagacggggctggagtgtg

SEQ ID NO: 121221 - DNA, 15 bp, Homo sapiens
accccgagggctgag

SEQ ID NO: 121222 - DNA, 19 bp, Homo sapiens
acctcgtgccaccccgagg

SEQ ID NO: 121223 - DNA, 22 bp, Homo sapiens
agcctggtcccacgagggtgcc

SEQ ID NO: 121224 - DNA, 16 bp, Homo sapiens
aggaccccagctctgc

SEQ ID NO: 121225 - DNA, 17 bp, Homo sapiens
aggaccccagctctgcg

SEQ ID NO: 121226 - DNA, 16 bp, Homo sapiens
aggagccgaagcccag

SEQ ID NO: 121227 - DNA, 22 bp, Homo sapiens
aggagggaggcaggggaggggt

SEQ ID NO: 121228 - DNA, 16 bp, Homo sapiens
agggacaggaccccag

SEQ ID NO: 121229 - DNA, 18 bp, Homo sapiens
agggacaggaccccagct

SEQ ID NO: 121230 - DNA, 16 bp, Homo sapiens
agggctgagcctggtc

SEQ ID NO: 121231 - DNA, 23 bp, Homo sapiens
aggggtgcggcggtcccagctcc

SEQ ID NO: 121232 - DNA, 18 bp, Homo sapiens
agtcgctgtgccacaggc

SEQ ID NO: 121233 - DNA, 18 bp, Homo sapiens
agtggccttccccagcat

SEQ ID NO: 121234 - DNA, 16 bp, Homo sapiens
agtttggtgtgtcctc

SEQ ID NO: 121235 - DNA, 22 bp, Homo sapiens
attggttttccaatcatttgac

SEQ ID NO: 121236 - DNA, 19 bp, Homo sapiens
cacaggcttagggacagga

SEQ ID NO: 121237 - DNA, 16 bp, Homo sapiens
caccagacggggctgg

SEQ ID NO: 121238 - DNA, 15 bp, Homo sapiens
caccccgagggctga

SEQ ID NO: 121239 - DNA, 14 bp, Homo sapiens
caggaccccagctc

SEQ ID NO: 121240 - DNA, 17 bp, Homo sapiens
caggacctcgtgccacc

SEQ ID NO: 121241 - DNA, 13 bp, Homo sapiens
caggggaggggtg

SEQ ID NO: 121242 - DNA, 22 bp, Homo sapiens
cagggtgtggggccatgcctcc

SEQ ID NO: 121243 - DNA, 17 bp, Homo sapiens
cagtggccttccccagc

SEQ ID NO: 121244 - DNA, 18 bp, Homo sapiens
ccacaggcttagggacag

SEQ ID NO: 121245 - DNA, 19 bp, Homo sapiens
ccacaggcttagggacagg

SEQ ID NO: 121246 - DNA, 21 bp, Homo sapiens
ccacaggcttagggacaggac

SEQ ID NO: 121247 - DNA, 22 bp, Homo sapiens
ccaggagggaggcaggggaggg

SEQ ID NO: 121248 - DNA, 17 bp, Homo sapiens
ccagtggccttccccag

SEQ ID NO: 121249 - DNA, 19 bp, Homo sapiens
ccagtggccttccccagca

SEQ ID NO: 121250 - DNA, 17 bp, Homo sapiens
cccacgagggtgccgtg

SEQ ID NO: 121251 - DNA, 18 bp, Homo sapiens
ccccaggagggaggcagg

SEQ ID NO: 121252 - DNA, 14 bp, Homo sapiens
ccccgagggctgag

SEQ ID NO: 121253 - DNA, 23 bp, Homo sapiens
cccgagggctgagcctggtccca

SEQ ID NO: 121254 - DNA, 17 bp, Homo sapiens
ccgaagcccaggggccg

SEQ ID NO: 121255 - DNA, 16 bp, Homo sapiens
ccgagggctgagcctg

SEQ ID NO: 121256 - DNA, 12 bp, Homo sapiens
cctcaggagccg

SEQ ID NO: 121257 - DNA, 19 bp, Homo sapiens
cctcaggagccgaagccca

SEQ ID NO: 121258 - DNA, 17 bp, Homo sapiens
cctgcaggacctcgtgc

SEQ ID NO: 121259 - DNA, 21 bp, Homo sapiens
cctggtgccctggatgcccag

SEQ ID NO: 121260 - DNA, 16 bp, Homo sapiens
cggcggtcccagctcc

SEQ ID NO: 121261 - DNA, 12 bp, Homo sapiens
cggtcccagctc

SEQ ID NO: 121262 - DNA, 17 bp, Homo sapiens
ctccgccttaccaggag

SEQ ID NO: 121263 - DNA, 13 bp, Homo sapiens
ctcctcaggagcc

SEQ ID NO: 121264 - DNA, 12 bp, Homo sapiens
ctgagcctggtc

SEQ ID NO: 121265 - DNA, 14 bp, Homo sapiens
ctgcagcctgcagg

SEQ ID NO: 121266 - DNA, 18 bp, Homo sapiens
ctgcgtcggtcctggtgc

SEQ ID NO: 121267 - DNA, 14 bp, Homo sapiens
ctggtcccacgagg

SEQ ID NO: 121268 - DNA, 17 bp, Homo sapiens
ctggtcccacgagggtg

SEQ ID NO: 121269 - DNA, 11 bp, Homo sapiens
ctggtgccctg

SEQ ID NO: 121270 - DNA, 17 bp, Homo sapiens
ctggtgccctggatgcc

SEQ ID NO: 121271 - DNA, 20 bp, Homo sapiens
agcctgcaggacctcgtgcc

SEQ ID NO: 121272 - DNA, 13 bp, Homo sapiens
aggaccccagctc

SEQ ID NO: 121273 - DNA, 14 bp, Homo sapiens
aggacctcgtgcca

SEQ ID NO: 121274 - DNA, 13 bp, Homo sapiens
agggacaggaccc

SEQ ID NO: 121275 - DNA, 13 bp, Homo sapiens
agggaggcagggg

SEQ ID NO: 121276 - DNA, 17 bp, Homo sapiens
agggctgagcctggtcc

SEQ ID NO: 121277 - DNA, 22 bp, Homo sapiens
aggggtgcggcggtcccagctc

SEQ ID NO: 121278 - DNA, 17 bp, Homo sapiens
agggtcctgcagcctgc

SEQ ID NO: 121279 - DNA, 15 bp, Homo sapiens
agggtgccgtgtccc

SEQ ID NO: 121280 - DNA, 24 bp, Homo sapiens
agggtgccgtgtcccctgacaggg

SEQ ID NO: 121281 - DNA, 23 bp, Homo sapiens
agggtgtggggccatgcctcctc

SEQ ID NO: 121282 - DNA, 19 bp, Homo sapiens
agtgtgagggtcctgcagc

SEQ ID NO: 121283 - DNA, 14 bp, Homo sapiens
atggccgggcaggg

SEQ ID NO: 121284 - DNA, 19 bp, Homo sapiens
caagagtcgctgtgccaca

SEQ ID NO: 121285 - DNA, 22 bp, Homo sapiens
caagagtcgctgtgccacaggc

SEQ ID NO: 121286 - DNA, 22 bp, Homo sapiens
cacaggcttagggacaggaccc

SEQ ID NO: 121287 - DNA, 13 bp, Homo sapiens
cagacggggctgg

SEQ ID NO: 121288 - DNA, 19 bp, Homo sapiens
cagacggggctggagtgtg

SEQ ID NO: 121289 - DNA, 17 bp, Homo sapiens
cagcatgcaccacgggc

SEQ ID NO: 121290 - DNA, 21 bp, Homo sapiens
cagcctgcaggacctcgtgcc

SEQ ID NO: 121291 - DNA, 13 bp, Homo sapiens
caggaccccagct

SEQ ID NO: 121292 - DNA, 16 bp, Homo sapiens
caggaccccagctctg

SEQ ID NO: 121293 - DNA, 18 bp, Homo sapiens
caggaccccagctctgcg

SEQ ID NO: 121294 - DNA, 21 bp, Homo sapiens
caggagggaggcaggggaggg

SEQ ID NO: 121295 - DNA, 16 bp, Homo sapiens
cagggccagtgcagtt

SEQ ID NO: 121296 - DNA, 17 bp, Homo sapiens
caggggccggccagtgg

SEQ ID NO: 121297 - DNA, 16 bp, Homo sapiens
cagggtgtggggccat

SEQ ID NO: 121298 - DNA, 22 bp, Homo sapiens
cagtgcagtttggtgtgtcctc

SEQ ID NO: 121299 - DNA, 19 bp, Homo sapiens
cagtggccttccccagcat

SEQ ID NO: 121300 - DNA, 19 bp, Homo sapiens
catgtcaagagtcgctgtg

SEQ ID NO: 121301 - DNA, 15 bp, Homo sapiens
ccacaggcttaggga

SEQ ID NO: 121302 - DNA, 15 bp, Homo sapiens
ccagacggggctgga

SEQ ID NO: 121303 - DNA, 18 bp, Homo sapiens
ccagcatgcaccacgggc

SEQ ID NO: 121304 - DNA, 20 bp, Homo sapiens
ccagcatgcaccacgggccc

SEQ ID NO: 121305 - DNA, 16 bp, Homo sapiens
ccatgcctcctcagga

SEQ ID NO: 121306 - DNA, 23 bp, Homo sapiens
cccagcatgcaccacgggcccgg

SEQ ID NO: 121307 - DNA, 16 bp, Homo sapiens
cccctgacagggccag

SEQ ID NO: 121308 - DNA, 15 bp, Homo sapiens
ccctggatgcccagg

SEQ ID NO: 121309 - DNA, 16 bp, Homo sapiens
ccctggatgcccagga

SEQ ID NO: 121310 - DNA, 16 bp, Homo sapiens
ccgaagcccaggggcc

SEQ ID NO: 121311 - DNA, 15 bp, Homo sapiens
ccgggcagggtgtgg

SEQ ID NO: 121312 - DNA, 19 bp, Homo sapiens
cctgcagcctgcaggacct

SEQ ID NO: 121313 - DNA, 20 bp, Homo sapiens
cctggtcccacgagggtgcc

SEQ ID NO: 121314 - DNA, 12 bp, Homo sapiens
cctggtgccctg

SEQ ID NO: 121315 - DNA, 18 bp, Homo sapiens
cctggtgccctggatgcc

SEQ ID NO: 121316 - DNA, 20 bp, Homo sapiens
cctggtgccctggatgccca

SEQ ID NO: 121317 - DNA, 13 bp, Homo sapiens
ccttccccagcat

SEQ ID NO: 121318 - DNA, 16 bp, Homo sapiens
cgaagcccaggggccg

SEQ ID NO: 121319 - DNA, 22 bp, Homo sapiens
cggccagtggccttccccagca

SEQ ID NO: 121320 - DNA, 18 bp, Homo sapiens
cgtgtcccctgacagggc

SEQ ID NO: 121321 - DNA, 23 bp, Homo sapiens
ctcaggagccgaagcccaggggc

SEQ ID NO: 121322 - DNA, 17 bp, Homo sapiens
ctgacagggccagtgca

SEQ ID NO: 121323 - DNA, 17 bp, Homo sapiens
ctgcgtcggtcctggtg

SEQ ID NO: 121324 - DNA, 23 bp, Homo sapiens
ctggagtgtgagggtcctgcagc

SEQ ID NO: 121325 - DNA, 15 bp, Homo sapiens
ctggatgcccaggaa

SEQ ID NO: 121326 - DNA, 22 bp, Homo sapiens
ctgtatatatttatggccgggc

SEQ ID NO: 121327 - DNA, 20 bp, Homo sapiens
cttagggacaggaccccagc

SEQ ID NO: 121328 - DNA, 21 bp, Homo sapiens
cttagggacaggaccccagct

SEQ ID NO: 121329 - DNA, 22 bp, Homo sapiens
cttagggacaggaccccagctc

SEQ ID NO: 121330 - DNA, 16 bp, Homo sapiens
gaagcccaggggccgg

SEQ ID NO: 121331 - DNA, 20 bp, Homo sapiens
gacaggaccccagctctgcg

SEQ ID NO: 121332 - DNA, 18 bp, Homo sapiens
gagggtcctgcagcctgc

SEQ ID NO: 121333 - DNA, 13 bp, Homo sapiens
gcagcctgcagga

SEQ ID NO: 121334 - DNA, 20 bp, Homo sapiens
ttattggttttccaatcatt

SEQ ID NO: 121335 - DNA, 22 bp, Homo sapiens
ttccccagcatgcaccacgggc

SEQ ID NO: 121336 - DNA, 18 bp, Homo sapiens
ttttccaatcatttgact

SEQ ID NO: 121337 - DNA, 15 bp, Homo sapiens
aagcccaggggccgg

SEQ ID NO: 121338 - DNA, 12 bp, Homo sapiens
acaggaccccag

SEQ ID NO: 121339 - DNA, 15 bp, Homo sapiens
acaggaccccagctc

SEQ ID NO: 121340 - DNA, 16 bp, Homo sapiens
acaggaccccagctct

SEQ ID NO: 121341 - DNA, 18 bp, Homo sapiens
acaggaccccagctctgc

SEQ ID NO: 121342 - DNA, 19 bp, Homo sapiens
accacgggcccgggttggg

SEQ ID NO: 121343 - DNA, 11 bp, Homo sapiens
accccagctct

SEQ ID NO: 121344 - DNA, 17 bp, Homo sapiens
acgggcccgggttgggt

SEQ ID NO: 121345 - DNA, 21 bp, Homo sapiens
acgggcccgggttgggtcacc

SEQ ID NO: 121346 - DNA, 14 bp, Homo sapiens
agagtcgctgtgcc

SEQ ID NO: 121347 - DNA, 15 bp, Homo sapiens
agagtctccatttaa

SEQ ID NO: 121348 - DNA, 13 bp, Homo sapiens
agcccaggggccg

SEQ ID NO: 121349 - DNA, 21 bp, Homo sapiens
agcctgcaggacctcgtgcca

SEQ ID NO: 121350 - DNA, 23 bp, Homo sapiens
agctctgcgtcggtcctggtgcc

SEQ ID NO: 121351 - DNA, 18 bp, Homo sapiens
aggagccgaagcccaggg

SEQ ID NO: 121352 - DNA, 23 bp, Homo sapiens
aggcttagggacaggaccccagc

SEQ ID NO: 121353 - DNA, 21 bp, Homo sapiens
agggacaggaccccagctctg

SEQ ID NO: 121354 - DNA, 22 bp, Homo sapiens
agggtgtggggccatgcctcct

SEQ ID NO: 121355 - DNA, 17 bp, Homo sapiens
agtggccttccccagca

SEQ ID NO: 121356 - DNA, 19 bp, Homo sapiens
agtggccttccccagcatg

SEQ ID NO: 121357 - DNA, 23 bp, Homo sapiens
atatatttatggccgggcagggt

SEQ ID NO: 121358 - DNA, 14 bp, Homo sapiens
atgcctcctcagga

SEQ ID NO: 121359 - DNA, 18 bp, Homo sapiens
atgcctcctcaggagccg

SEQ ID NO: 121360 - DNA, 12 bp, Homo sapiens
cagcctgcagga

SEQ ID NO: 121361 - DNA, 19 bp, Homo sapiens
caggaatctgtatatattt

SEQ ID NO: 121362 - DNA, 17 bp, Homo sapiens
caggaccccagctctgc

SEQ ID NO: 121363 - DNA, 19 bp, Homo sapiens
caggagaagaacctgaaga

SEQ ID NO: 121364 - DNA, 18 bp, Homo sapiens
caggagccgaagcccagg

SEQ ID NO: 121365 - DNA, 15 bp, Homo sapiens
caggagggaggcagg

SEQ ID NO: 121366 - DNA, 16 bp, Homo sapiens
caggcttagggacagg

SEQ ID NO: 121367 - DNA, 17 bp, Homo sapiens
caggcttagggacagga

SEQ ID NO: 121368 - DNA, 22 bp, Homo sapiens
caggggccggccagtggccttc

SEQ ID NO: 121369 - DNA, 17 bp, Homo sapiens
cagggtgtggggccatg

SEQ ID NO: 121370 - DNA, 21 bp, Homo sapiens
catgtcaagagtcgctgtgcc

SEQ ID NO: 121371 - DNA, 23 bp, Homo sapiens
ccaccccgagggctgagcctggt

SEQ ID NO: 121372 - DNA, 22 bp, Homo sapiens
ccagctctgcgtcggtcctggt

SEQ ID NO: 121373 - DNA, 21 bp, Homo sapiens
ccaggagggaggcaggggagg

SEQ ID NO: 121374 - DNA, 19 bp, Homo sapiens
ccaggggccggccagtggc

SEQ ID NO: 121375 - DNA, 23 bp, Homo sapiens
ccagtgcagtttggtgtgtcctc

SEQ ID NO: 121376 - DNA, 22 bp, Homo sapiens
ccatgtcaagagtcgctgtgcc

SEQ ID NO: 121377 - DNA, 19 bp, Homo sapiens
ccccgagggctgagcctgg

SEQ ID NO: 121378 - DNA, 18 bp, Homo sapiens
cccgggttgggtcaccag

SEQ ID NO: 121379 - DNA, 16 bp, Homo sapiens
ccctgacagggccagt

SEQ ID NO: 121380 - DNA, 15 bp, Homo sapiens
ccgaagcccaggggc

SEQ ID NO: 121381 - DNA, 13 bp, Homo sapiens
ccgagggctgagc

SEQ ID NO: 121382 - DNA, 22 bp, Homo sapiens
ccgagggctgagcctggtccca

SEQ ID NO: 121383 - DNA, 13 bp, Homo sapiens
ccgccttaccagg

SEQ ID NO: 121384 - DNA, 19 bp, Homo sapiens
ccgtgtcccctgacagggc

SEQ ID NO: 121385 - DNA, 22 bp, Homo sapiens
cctcaggagccgaagcccaggg

SEQ ID NO: 121386 - DNA, 16 bp, Homo sapiens
cctgcagcctgcagga

SEQ ID NO: 121387 - DNA, 18 bp, Homo sapiens
cctgcaggacctcgtgcc

SEQ ID NO: 121388 - DNA, 22 bp, Homo sapiens
cctggtgccctggatgcccagg

SEQ ID NO: 121389 - DNA, 15 bp, Homo sapiens
cggcggtcccagctc

SEQ ID NO: 121390 - DNA, 19 bp, Homo sapiens
cggcggtcccagctccctg

SEQ ID NO: 121391 - DNA, 15 bp, Homo sapiens
cgtcggtcctggtgc

SEQ ID NO: 121392 - DNA, 15 bp, Homo sapiens
cgtgccaccccgagg

SEQ ID NO: 121393 - DNA, 19 bp, Homo sapiens
cgtgccaccccgagggctg

SEQ ID NO: 121394 - DNA, 16 bp, Homo sapiens
cgtgtcccctgacagg

SEQ ID NO: 121395 - DNA, 19 bp, Homo sapiens
cgtgtcccctgacagggcc

SEQ ID NO: 121396 - DNA, 21 bp, Homo sapiens
ctcgtgccaccccgagggctg

SEQ ID NO: 121397 - DNA, 19 bp, Homo sapiens
ctctgcgtcggtcctggtg

SEQ ID NO: 121398 - DNA, 21 bp, Homo sapiens
ctctgcgtcggtcctggtgcc

SEQ ID NO: 121399 - DNA, 22 bp, Homo sapiens
ctctgcgtcggtcctggtgccc

SEQ ID NO: 121400 - DNA, 15 bp, Homo sapiens
ctgcagcctgcagga

SEQ ID NO: 121401 - DNA, 13 bp, Homo sapiens
ctggatgcccagg

SEQ ID NO: 121402 - DNA, 14 bp, Homo sapiens
ctggatgcccagga

SEQ ID NO: 121403 - DNA, 20 bp, Homo sapiens
ctggtgccctggatgcccag

SEQ ID NO: 121404 - DNA, 13 bp, Homo sapiens
ctgtgccacaggc

SEQ ID NO: 121405 - DNA, 23 bp, Homo sapiens
cttagggacaggaccccagctct

SEQ ID NO: 121406 - DNA, 16 bp, Homo sapiens
gaatctgtatatattt

SEQ ID NO: 121407 - DNA, 15 bp, Homo sapiens
gacaggaccccagct

SEQ ID NO: 121408 - DNA, 16 bp, Homo sapiens
gacaggaccccagctc

SEQ ID NO: 121409 - DNA, 19 bp, Homo sapiens
gacaggaccccagctctgc

SEQ ID NO: 121410 - DNA, 14 bp, Homo sapiens
gaccccagctctgc

SEQ ID NO: 121411 - DNA, 15 bp, Homo sapiens
gagccgaagcccagg

SEQ ID NO: 121412 - DNA, 19 bp, Homo sapiens
gaggggtgcggcggtccca

SEQ ID NO: 121413 - DNA, 22 bp, Homo sapiens
gaggggtgcggcggtcccagct

SEQ ID NO: 121414 - DNA, 13 bp, Homo sapiens
gagggtcctgcag

SEQ ID NO: 121415 - DNA, 23 bp, Homo sapiens
gagggtgccgtgtcccctgacag

SEQ ID NO: 121416 - DNA, 13 bp, Homo sapiens
gagtcgctgtgcc

SEQ ID NO: 121417 - DNA, 16 bp, Homo sapiens
gccaccccgagggctg

SEQ ID NO: 121418 - DNA, 23 bp, Homo sapiens
gccaccccgagggctgagcctgg

SEQ ID NO: 121419 - DNA, 15 bp, Homo sapiens
gcctcctcaggagcc

SEQ ID NO: 121420 - DNA, 13 bp, Homo sapiens
gcctgcaggacct

SEQ ID NO: 121421 - DNA, 23 bp, Homo sapiens
gcctgcaggacctcgtgccaccc

SEQ ID NO: 121422 - DNA, 21 bp, Homo sapiens
gcctggtcccacgagggtgcc

SEQ ID NO: 121423 - DNA, 17 bp, Homo sapiens
gcggcggtcccagctcc

SEQ ID NO: 121424 - DNA, 13 bp, Homo sapiens
gcggtcccagctc

SEQ ID NO: 121425 - DNA, 14 bp, Homo sapiens
gcggtcccagctcc

SEQ ID NO: 121426 - DNA, 21 bp, Homo sapiens
tgagggtcctgcagcctgcag

SEQ ID NO: 121427 - DNA, 20 bp, Homo sapiens
tgccacaggcttagggacag

SEQ ID NO: 121428 - DNA, 21 bp, Homo sapiens
tgccacaggcttagggacagg

SEQ ID NO: 121429 - DNA, 17 bp, Homo sapiens
tgccaccccgagggctg

SEQ ID NO: 121430 - DNA, 14 bp, Homo sapiens
tggatgcccaggaa

SEQ ID NO: 121431 - DNA, 20 bp, Homo sapiens
tggggccatgcctcctcagg

SEQ ID NO: 121432 - DNA, 19 bp, Homo sapiens
tgtcaagagtcgctgtgcc

SEQ ID NO: 121433 - DNA, 16 bp, Homo sapiens
tgtcccctgacagggc

SEQ ID NO: 121434 - DNA, 12 bp, Homo sapiens
tgtgccacaggc

SEQ ID NO: 121435 - DNA, 16 bp, Homo sapiens
ttatggccgggcaggg

SEQ ID NO: 121436 - DNA, 13 bp, Homo sapiens
acaggaccccagc

SEQ ID NO: 121437 - DNA, 14 bp, Homo sapiens
acaggaccccagct

SEQ ID NO: 121438 - DNA, 23 bp, Homo sapiens
acctcgtgccaccccgagggctg

SEQ ID NO: 121439 - DNA, 15 bp, Homo sapiens
agagtcgctgtgcca

SEQ ID NO: 121440 - DNA, 19 bp, Homo sapiens
agagtcgctgtgccacagg

SEQ ID NO: 121441 - DNA, 15 bp, Homo sapiens
agcatgcaccacggg

SEQ ID NO: 121442 - DNA, 14 bp, Homo sapiens
agccgaagcccagg

SEQ ID NO: 121443 - DNA, 14 bp, Homo sapiens
ggtcctggtgccct

SEQ ID NO: 121444 - DNA, 19 bp, Homo sapiens
ggtgccctggatgcccagg

SEQ ID NO: 121445 - DNA, 18 bp, Homo sapiens
gtcctccgccttaccagg

SEQ ID NO: 121446 - DNA, 15 bp, Homo sapiens
gtcggtcctggtgcc

SEQ ID NO: 121447 - DNA, 21 bp, Homo sapiens
gtgcagtttggtgtgtcctcc

SEQ ID NO: 121448 - DNA, 18 bp, Homo sapiens
gtgccaccccgagggctg

SEQ ID NO: 121449 - DNA, 21 bp, Homo sapiens
gtggggccatgcctcctcagg

SEQ ID NO: 121450 - DNA, 22 bp, Homo sapiens
gtggggccatgcctcctcagga

SEQ ID NO: 121451 - DNA, 14 bp, Homo sapiens
gttgggtcaccaga

SEQ ID NO: 121452 - DNA, 16 bp, Homo sapiens
tatggccgggcagggt

SEQ ID NO: 121453 - DNA, 15 bp, Homo sapiens
tcaccagacggggct

SEQ ID NO: 121454 - DNA, 18 bp, Homo sapiens
tcctccgccttaccagga

SEQ ID NO: 121455 - DNA, 13 bp, Homo sapiens
tcctgcagcctgc

SEQ ID NO: 121456 - DNA, 16 bp, Homo sapiens
tcggtcctggtgccct

SEQ ID NO: 121457 - DNA, 22 bp, Homo sapiens
tcgtgccaccccgagggctgag

SEQ ID NO: 121458 - DNA, 22 bp, Homo sapiens
tgaccccaggagggaggcaggg

SEQ ID NO: 121459 - DNA, 18 bp, Homo sapiens
tgagggtcctgcagcctg

SEQ ID NO: 121460 - DNA, 23 bp, Homo sapiens
tgagggtcctgcagcctgcagga

SEQ ID NO: 121461 - DNA, 17 bp, Homo sapiens
tgcagcctgcaggacct

SEQ ID NO: 121462 - DNA, 21 bp, Homo sapiens
tgcagtttggtgtgtcctccg

SEQ ID NO: 121463 - DNA, 18 bp, Homo sapiens
tgccctggatgcccagga

SEQ ID NO: 121464 - DNA, 21 bp, Homo sapiens
tgccgtgtcccctgacagggc

SEQ ID NO: 121465 - DNA, 12 bp, Homo sapiens
tgcctcctcagg

SEQ ID NO: 121466 - DNA, 16 bp, Homo sapiens
tgcgtcggtcctggtg

SEQ ID NO: 121467 - DNA, 12 bp, Homo sapiens
tggccgggcagg

SEQ ID NO: 121468 - DNA, 13 bp, Homo sapiens
tggccttccccag

SEQ ID NO: 121469 - DNA, 15 bp, Homo sapiens
tggccttccccagca

SEQ ID NO: 121470 - DNA, 23 bp, Homo sapiens
tggccttccccagcatgcaccac

SEQ ID NO: 121471 - DNA, 19 bp, Homo sapiens
tgggtcaccagacggggct

SEQ ID NO: 121472 - DNA, 17 bp, Homo sapiens
tgtcaagagtcgctgtg

SEQ ID NO: 121473 - DNA, 15 bp, Homo sapiens
tgtcccctgacaggg

SEQ ID NO: 121474 - DNA, 17 bp, Homo sapiens
acagggccagtgcagtt

SEQ ID NO: 121475 - DNA, 14 bp, Homo sapiens
accagacggggctg

SEQ ID NO: 121476 - DNA, 14 bp, Homo sapiens
acgagggtgccgtg

SEQ ID NO: 121477 - DNA, 16 bp, Homo sapiens
acgggcccgggttggg

SEQ ID NO: 121478 - DNA, 20 bp, Homo sapiens
acgggcccgggttgggtcac

SEQ ID NO: 121479 - DNA, 13 bp, Homo sapiens
agacggggctgga

SEQ ID NO: 121480 - DNA, 22 bp, Homo sapiens
agctctgcgtcggtcctggtgc

SEQ ID NO: 121481 - DNA, 14 bp, Homo sapiens
aggaccccagctct

SEQ ID NO: 121482 - DNA, 17 bp, Homo sapiens
agggacaggaccccagc

SEQ ID NO: 121483 - DNA, 20 bp, Homo sapiens
agggacaggaccccagctct

SEQ ID NO: 121484 - DNA, 20 bp, Homo sapiens
aggggtgcggcggtcccagc

SEQ ID NO: 121485 - DNA, 21 bp, Homo sapiens
aggggtgcggcggtcccagct

SEQ ID NO: 121486 - DNA, 16 bp, Homo sapiens
agggtcctgcagcctg

SEQ ID NO: 121487 - DNA, 19 bp, Homo sapiens
agggtcctgcagcctgcag

SEQ ID NO: 121488 - DNA, 21 bp, Homo sapiens
agggtcctgcagcctgcagga

SEQ ID NO: 121489 - DNA, 13 bp, Homo sapiens
atgcctcctcagg

SEQ ID NO: 121490 - DNA, 15 bp, Homo sapiens
atgcctcctcaggag

SEQ ID NO: 121491 - DNA, 18 bp, Homo sapiens
cacaggcttagggacagg

SEQ ID NO: 121492 - DNA, 17 bp, Homo sapiens
caccagacggggctgga

SEQ ID NO: 121493 - DNA, 12 bp, Homo sapiens
caggaccccagc

SEQ ID NO: 121494 - DNA, 15 bp, Homo sapiens
caggaccccagctct

SEQ ID NO: 121495 - DNA, 18 bp, Homo sapiens
caggacctcgtgccaccc

SEQ ID NO: 121496 - DNA, 17 bp, Homo sapiens
caggagccgaagcccag

SEQ ID NO: 121497 - DNA, 21 bp, Homo sapiens
caggagccgaagcccaggggc

SEQ ID NO: 121498 - DNA, 18 bp, Homo sapiens
cagtggccttccccagca

SEQ ID NO: 121499 - DNA, 14 bp, Homo sapiens
catgcaccacgggc

SEQ ID NO: 121500 - DNA, 15 bp, Homo sapiens
catgcctcctcagga

SEQ ID NO: 121501 - DNA, 16 bp, Homo sapiens
ccacgagggtgccgtg

SEQ ID NO: 121502 - DNA, 15 bp, Homo sapiens
ccaggagggaggcag

SEQ ID NO: 121503 - DNA, 15 bp, Homo sapiens
ccatgcctcctcagg

SEQ ID NO: 121504 - DNA, 19 bp, Homo sapiens
cccagcatgcaccacgggc

SEQ ID NO: 121505 - DNA, 9 bp, Homo sapiens
cccagctcc

SEQ ID NO: 121506 - DNA, 11 bp, Homo sapiens
cccagctctgc

SEQ ID NO: 121507 - DNA, 12 bp, Homo sapiens
cccagctctgcg

SEQ ID NO: 121508 - DNA, 12 bp, Homo sapiens
cccaggggccgg

SEQ ID NO: 121509 - DNA, 19 bp, Homo sapiens
ccccaggagggaggcaggg

SEQ ID NO: 121510 - DNA, 21 bp, Homo sapiens
ccccgagggctgagcctggtc

SEQ ID NO: 121511 - DNA, 13 bp, Homo sapiens
ccctgacagggcc

SEQ ID NO: 121512 - DNA, 17 bp, Homo sapiens
ccgtgtcccctgacagg

SEQ ID NO: 121513 - DNA, 21 bp, Homo sapiens
cctcaggagccgaagcccagg

SEQ ID NO: 121514 - DNA, 16 bp, Homo sapiens
cctgaagaactatttt

SEQ ID NO: 121515 - DNA, 14 bp, Homo sapiens
cctggatgcccagg

SEQ ID NO: 121516 - DNA, 12 bp, Homo sapiens
ccttccccagca

SEQ ID NO: 121517 - DNA, 15 bp, Homo sapiens
cgctgtgccacaggc

SEQ ID NO: 121518 - DNA, 21 bp, Homo sapiens
cgggcagggtgtggggccatg

SEQ ID NO: 121519 - DNA, 13 bp, Homo sapiens
cggtcccagctcc

SEQ ID NO: 121520 - DNA, 13 bp, Homo sapiens
cggtcctggtgcc

SEQ ID NO: 121521 - DNA, 22 bp, Homo sapiens
cgtgccaccccgagggctgagc

SEQ ID NO: 121522 - DNA, 21 bp, Homo sapiens
ctcaggagccgaagcccaggg

SEQ ID NO: 121523 - DNA, 12 bp, Homo sapiens
ctcctcaggagc

SEQ ID NO: 121524 - DNA, 20 bp, Homo sapiens
ctctgcgtcggtcctggtgc

SEQ ID NO: 121525 - DNA, 14 bp, Homo sapiens
ctgaagaactattt

SEQ ID NO: 121526 - DNA, 12 bp, Homo sapiens
ctgacagggcca

SEQ ID NO: 121527 - DNA, 12 bp, Homo sapiens
ctgcagcctgca

SEQ ID NO: 121528 - DNA, 19 bp, Homo sapiens
ctgcagcctgcaggacctc

SEQ ID NO: 121529 - DNA, 16 bp, Homo sapiens
ctggatgcccaggaat

SEQ ID NO: 121530 - DNA, 19 bp, Homo sapiens
ctggtcccacgagggtgcc

SEQ ID NO: 121531 - DNA, 18 bp, Homo sapiens
gacagggccagtgcagtt

SEQ ID NO: 121532 - DNA, 18 bp, Homo sapiens
gacctcgtgccaccccga

SEQ ID NO: 121533 - DNA, 20 bp, Homo sapiens
gagggctgagcctggtccca

SEQ ID NO: 121534 - DNA, 16 bp, Homo sapiens
gcagcctgcaggacct

SEQ ID NO: 121535 - DNA, 12 bp, Homo sapiens
gcaggggagggg

SEQ ID NO: 121536 - DNA, 14 bp, Homo sapiens
gcatgcaccacggg

SEQ ID NO: 121537 - DNA, 15 bp, Homo sapiens
gccatgcctcctcag

SEQ ID NO: 121538 - DNA, 20 bp, Homo sapiens
gccctggatgcccaggaatc

SEQ ID NO: 121539 - DNA, 17 bp, Homo sapiens
gccggccagtggccttc

SEQ ID NO: 121540 - DNA, 17 bp, Homo sapiens
gccgggcagggtgtggg

SEQ ID NO: 121541 - DNA, 18 bp, Homo sapiens
gccgtgtcccctgacagg

SEQ ID NO: 121542 - DNA, 12 bp, Homo sapiens
gcctcctcagga

SEQ ID NO: 121543 - DNA, 17 bp, Homo sapiens
gcctgcaggacctcgtg

SEQ ID NO: 121544 - DNA, 14 bp, Homo sapiens
gcggcggtcccagc

SEQ ID NO: 121545 - DNA, 15 bp, Homo sapiens
gcgtcggtcctggtg

SEQ ID NO: 121546 - DNA, 14 bp, Homo sapiens
ggacaggaccccag

SEQ ID NO: 121547 - DNA, 15 bp, Homo sapiens
ggacaggaccccagc

SEQ ID NO: 121548 - DNA, 15 bp, Homo sapiens
ggaccccagctctgc

SEQ ID NO: 121549 - DNA, 13 bp, Homo sapiens
ggacctcgtgcca

SEQ ID NO: 121550 - DNA, 15 bp, Homo sapiens
ggagccgaagcccag

SEQ ID NO: 121551 - DNA, 17 bp, Homo sapiens
ggagccgaagcccaggg

SEQ ID NO: 121552 - DNA, 19 bp, Homo sapiens
ggagccgaagcccaggggc

SEQ ID NO: 121553 - DNA, 22 bp, Homo sapiens
ggccagtgcagtttggtgtgtc

SEQ ID NO: 121554 - DNA, 19 bp, Homo sapiens
ggccagtggccttccccag

SEQ ID NO: 121555 - DNA, 14 bp, Homo sapiens
ggccttccccagca

SEQ ID NO: 121556 - DNA, 11 bp, Homo sapiens
ggctgagcctg

SEQ ID NO: 121557 - DNA, 21 bp, Homo sapiens
gggacaggaccccagctctgc

SEQ ID NO: 121558 - DNA, 22 bp, Homo sapiens
gggacaggaccccagctctgcg

SEQ ID NO: 121559 - DNA, 22 bp, Homo sapiens
gggccatgcctcctcaggagcc

SEQ ID NO: 121560 - DNA, 23 bp, Homo sapiens
gggccatgcctcctcaggagccg

SEQ ID NO: 121561 - DNA, 22 bp, Homo sapiens
gggcccgggttgggtcaccaga

SEQ ID NO: 121562 - DNA, 13 bp, Homo sapiens
gggctgagcctgg

SEQ ID NO: 121563 - DNA, 23 bp, Homo sapiens
ggggccatgcctcctcaggagcc

SEQ ID NO: 121564 - DNA, 12 bp, Homo sapiens
ggtcccagctcc

SEQ ID NO: 121565 - DNA, 15 bp, Homo sapiens
ggtcctgcagcctgc

SEQ ID NO: 121566 - DNA, 21 bp, Homo sapiens
gctctgcgtcggtcctggtgc

SEQ ID NO: 121567 - DNA, 13 bp, Homo sapiens
gctgtgccacagg

SEQ ID NO: 121568 - DNA, 20 bp, Homo sapiens
gctgtgccacaggcttaggg

SEQ ID NO: 121569 - DNA, 22 bp, Homo sapiens
gcttagggacaggaccccagct

SEQ ID NO: 121570 - DNA, 17 bp, Homo sapiens
ggacaggaccccagctc

SEQ ID NO: 121571 - DNA, 21 bp, Homo sapiens
ggacaggaccccagctctgcg

SEQ ID NO: 121572 - DNA, 22 bp, Homo sapiens
ggccagtggccttccccagcat

SEQ ID NO: 121573 - DNA, 22 bp, Homo sapiens
ggcttagggacaggaccccagc

SEQ ID NO: 121574 - DNA, 15 bp, Homo sapiens
gggacaggaccccag

SEQ ID NO: 121575 - DNA, 19 bp, Homo sapiens
gggacaggaccccagctct

SEQ ID NO: 121576 - DNA, 14 bp, Homo sapiens
ggggccatgcctcc

SEQ ID NO: 121577 - DNA, 20 bp, Homo sapiens
ggggtgcggcggtcccagct

SEQ ID NO: 121578 - DNA, 22 bp, Homo sapiens
ggggtgcggcggtcccagctcc

SEQ ID NO: 121579 - DNA, 19 bp, Homo sapiens
gggtcctgcagcctgcagg

SEQ ID NO: 121580 - DNA, 19 bp, Homo sapiens
ggtcaccagacggggctgg

SEQ ID NO: 121581 - DNA, 14 bp, Homo sapiens
ggtcccagctccct

SEQ ID NO: 121582 - DNA, 16 bp, Homo sapiens
ggtcctgcagcctgca

SEQ ID NO: 121583 - DNA, 12 bp, Homo sapiens
ggtcctggtgcc

SEQ ID NO: 121584 - DNA, 15 bp, Homo sapiens
ggtgccctggatgcc

SEQ ID NO: 121585 - DNA, 18 bp, Homo sapiens
ggtgccctggatgcccag

SEQ ID NO: 121586 - DNA, 19 bp, Homo sapiens
ggtgcggcggtcccagctc

SEQ ID NO: 121587 - DNA, 17 bp, Homo sapiens
gtcaccagacggggctg

SEQ ID NO: 121588 - DNA, 10 bp, Homo sapiens
gtcctgcagc

SEQ ID NO: 121589 - DNA, 11 bp, Homo sapiens
gtcctggtgcc

SEQ ID NO: 121590 - DNA, 12 bp, Homo sapiens
gtcctggtgccc

SEQ ID NO: 121591 - DNA, 20 bp, Homo sapiens
gtcctggtgccctggatgcc

SEQ ID NO: 121592 - DNA, 23 bp, Homo sapiens
gtgagggtcctgcagcctgcagg

SEQ ID NO: 121593 - DNA, 24 bp, Homo sapiens
gtgagggtcctgcagcctgcagga

SEQ ID NO: 121594 - DNA, 22 bp, Homo sapiens
gtgccgtgtcccctgacagggc

SEQ ID NO: 121595 - DNA, 21 bp, Homo sapiens
gtggccttccccagcatgcac

SEQ ID NO: 121596 - DNA, 21 bp, Homo sapiens
gtgtggggccatgcctcctca

SEQ ID NO: 121597 - DNA, 23 bp, Homo sapiens
gtgtggggccatgcctcctcagg

SEQ ID NO: 121598 - DNA, 22 bp, Homo sapiens
tagggacaggaccccagctctg

SEQ ID NO: 121599 - DNA, 10 bp, Homo sapiens
tcccagctcc

SEQ ID NO: 121600 - DNA, 19 bp, Homo sapiens
tccccagcatgcaccacgg

SEQ ID NO: 121601 - DNA, 21 bp, Homo sapiens
tccccagcatgcaccacgggc

SEQ ID NO: 121602 - DNA, 12 bp, Homo sapiens
tcccctgacagg

SEQ ID NO: 121603 - DNA, 15 bp, Homo sapiens
tcccctgacagggcc

SEQ ID NO: 121604 - DNA, 17 bp, Homo sapiens
tcctgcagcctgcagga

SEQ ID NO: 121605 - DNA, 12 bp, Homo sapiens
tcctggtgccct

SEQ ID NO: 121606 - DNA, 13 bp, Homo sapiens
tcctggtgccctg

SEQ ID NO: 121607 - DNA, 22 bp, Homo sapiens
tcctggtgccctggatgcccag

SEQ ID NO: 121608 - DNA, 20 bp, Homo sapiens
tctgcgtcggtcctggtgcc

SEQ ID NO: 121609 - DNA, 16 bp, Homo sapiens
tgacagggccagtgca

SEQ ID NO: 121610 - DNA, 20 bp, Homo sapiens
tgaccccaggagggaggcag

SEQ ID NO: 121611 - DNA, 11 bp, Homo sapiens
tgagcctggtc

SEQ ID NO: 121612 - DNA, 14 bp, Homo sapiens
tgagggtcctgcag

SEQ ID NO: 121613 - DNA, 15 bp, Homo sapiens
gcaggacctcgtgcc

SEQ ID NO: 121614 - DNA, 15 bp, Homo sapiens
gcatgcaccacgggc

SEQ ID NO: 121615 - DNA, 17 bp, Homo sapiens
gccaccccgagggctga

SEQ ID NO: 121616 - DNA, 21 bp, Homo sapiens
gccagtggccttccccagcat

SEQ ID NO: 121617 - DNA, 13 bp, Homo sapiens
gccgaagcccagg

SEQ ID NO: 121618 - DNA, 16 bp, Homo sapiens
gcggcggtcccagctc

SEQ ID NO: 121619 - DNA, 22 bp, Homo sapiens
gcggtcccagctccctggctcc

SEQ ID NO: 121620 - DNA, 15 bp, Homo sapiens
gctggagtgtgaggg

SEQ ID NO: 121621 - DNA, 19 bp, Homo sapiens
gctgtgccacaggcttagg

SEQ ID NO: 121622 - DNA, 23 bp, Homo sapiens
gcttagggacaggaccccagctc

SEQ ID NO: 121623 - DNA, 12 bp, Homo sapiens
ggaccccagctc

SEQ ID NO: 121624 - DNA, 13 bp, Homo sapiens
ggaccccagctct

SEQ ID NO: 121625 - DNA, 18 bp, Homo sapiens
ggccatgcctcctcagga

SEQ ID NO: 121626 - DNA, 21 bp, Homo sapiens
ggccatgcctcctcaggagcc

SEQ ID NO: 121627 - DNA, 14 bp, Homo sapiens
ggcggtcccagctc

SEQ ID NO: 121628 - DNA, 17 bp, Homo sapiens
ggctcccatgtcaagag

SEQ ID NO: 121629 - DNA, 21 bp, Homo sapiens
gggcccgggttgggtcaccag

SEQ ID NO: 121630 - DNA, 15 bp, Homo sapiens
gggctgagcctggtc

SEQ ID NO: 121631 - DNA, 17 bp, Homo sapiens
ggggccatgcctcctca

SEQ ID NO: 121632 - DNA, 16 bp, Homo sapiens
ggggccggccagtggc

SEQ ID NO: 121633 - DNA, 15 bp, Homo sapiens
ggtcccagctccctg

SEQ ID NO: 121634 - DNA, 24 bp, Homo sapiens
ggtcctggtgccctggatgcccag

SEQ ID NO: 121635 - DNA, 20 bp, Homo sapiens
ggtgccctggatgcccagga

SEQ ID NO: 121636 - DNA, 21 bp, Homo sapiens
ggttttccaatcatttgacta

SEQ ID NO: 121637 - DNA, 11 bp, Homo sapiens
gtcccagctcc

SEQ ID NO: 121638 - DNA, 15 bp, Homo sapiens
gtcccagctccctgg

SEQ ID NO: 121639 - DNA, 14 bp, Homo sapiens
gtcccctgacaggg

SEQ ID NO: 121640 - DNA, 18 bp, Homo sapiens
gtcctgcagcctgcagga

SEQ ID NO: 121641 - DNA, 16 bp, Homo sapiens
gtcgctgtgccacagg

SEQ ID NO: 121642 - DNA, 15 bp, Homo sapiens
gtgagggtcctgcag

SEQ ID NO: 121643 - DNA, 19 bp, Homo sapiens
gtgccctggatgcccagga

SEQ ID NO: 121644 - DNA, 23 bp, Homo sapiens
gtgccgtgtcccctgacagggcc

SEQ ID NO: 121645 - DNA, 22 bp, Homo sapiens
gtgcggcggtcccagctccctg

SEQ ID NO: 121646 - DNA, 17 bp, Homo sapiens
gtggccttccccagcat

SEQ ID NO: 121647 - DNA, 19 bp, Homo sapiens
gtggccttccccagcatgc

SEQ ID NO: 121648 - DNA, 18 bp, Homo sapiens
gtgtcccctgacagggcc

SEQ ID NO: 121649 - DNA, 17 bp, Homo sapiens
gtgtgagggtcctgcag

SEQ ID NO: 121650 - DNA, 19 bp, Homo sapiens
tagggacaggaccccagct

SEQ ID NO: 121651 - DNA, 18 bp, Homo sapiens
tcatttgactaagagtct

SEQ ID NO: 121652 - DNA, 18 bp, Homo sapiens
tcccacgagggtgccgtg

SEQ ID NO: 121653 - DNA, 19 bp, Homo sapiens
tgacagggccagtgcagtt

SEQ ID NO: 121654 - DNA, 18 bp, Homo sapiens
tgcagcctgcaggacctc

SEQ ID NO: 121655 - DNA, 18 bp, Homo sapiens
tgccaccccgagggctga

SEQ ID NO: 121656 - DNA, 16 bp, Homo sapiens
tgccctggatgcccag

SEQ ID NO: 121657 - DNA, 17 bp, Homo sapiens
tgcggcggtcccagctc

SEQ ID NO: 121658 - DNA, 18 bp, Homo sapiens
tgcggcggtcccagctcc

SEQ ID NO: 121659 - DNA, 13 bp, Homo sapiens
tggatgcccagga

SEQ ID NO: 121660 - DNA, 14 bp, Homo sapiens
tggggccatgcctc

SEQ ID NO: 121661 - DNA, 21 bp, Homo sapiens
tgggtcaccagacggggctgg

SEQ ID NO: 121662 - DNA, 19 bp, Homo sapiens
tggtgccctggatgcccag

SEQ ID NO: 121663 - DNA, 18 bp, Homo sapiens
tgtcccctgacagggcca

SEQ ID NO: 121664 - DNA, 21 bp, Homo sapiens
ttagggacaggaccccagctc

SEQ ID NO: 121665 - DNA, 21 bp, Homo sapiens
ctggtgccctggatgcccagg

SEQ ID NO: 121666 - DNA, 18 bp, Homo sapiens
cttagggacaggacccca

SEQ ID NO: 121667 - DNA, 18 bp, Homo sapiens
gaacctgaagaactattt

SEQ ID NO: 121668 - DNA, 14 bp, Homo sapiens
gacaggaccccagc

SEQ ID NO: 121669 - DNA, 17 bp, Homo sapiens
gacaggaccccagctct

SEQ ID NO: 121670 - DNA, 18 bp, Homo sapiens
gacaggaccccagctctg

SEQ ID NO: 121671 - DNA, 12 bp, Homo sapiens
gaccccagctct

SEQ ID NO: 121672 - DNA, 14 bp, Homo sapiens
gagccgaagcccag

SEQ ID NO: 121673 - DNA, 19 bp, Homo sapiens
gagcctggtcccacgaggg

SEQ ID NO: 121674 - DNA, 23 bp, Homo sapiens
gagcctggtcccacgagggtgcc

SEQ ID NO: 121675 - DNA, 17 bp, Homo sapiens
gagggtcctgcagcctg

SEQ ID NO: 121676 - DNA, 21 bp, Homo sapiens
gagggtcctgcagcctgcagg

SEQ ID NO: 121677 - DNA, 15 bp, Homo sapiens
gcaccacgggcccgg

SEQ ID NO: 121678 - DNA, 18 bp, Homo sapiens
gcctgcaggacctcgtgc

SEQ ID NO: 121679 - DNA, 18 bp, Homo sapiens
gcggtcccagctccctgg

SEQ ID NO: 121680 - DNA, 20 bp, Homo sapiens
gctctgcgtcggtcctggtg

SEQ ID NO: 121681 - DNA, 21 bp, Homo sapiens
gctggagtgtgagggtcctgc

SEQ ID NO: 121682 - DNA, 14 bp, Homo sapiens
gctgtgccacaggc

SEQ ID NO: 121683 - DNA, 15 bp, Homo sapiens
gctgtgccacaggct

SEQ ID NO: 121684 - DNA, 16 bp, Homo sapiens
ggacaggaccccagct

SEQ ID NO: 121685 - DNA, 18 bp, Homo sapiens
ggacaggaccccagctct

SEQ ID NO: 121686 - DNA, 20 bp, Homo sapiens
ggacaggaccccagctctgc

SEQ ID NO: 121687 - DNA, 22 bp, Homo sapiens
ggagccgaagcccaggggccgg

SEQ ID NO: 121688 - DNA, 20 bp, Homo sapiens
ggagtgtgagggtcctgcag

SEQ ID NO: 121689 - DNA, 17 bp, Homo sapiens
ggccatgcctcctcagg

SEQ ID NO: 121690 - DNA, 13 bp, Homo sapiens
ggccttccccagc

SEQ ID NO: 121691 - DNA, 15 bp, Homo sapiens
ggcggtcccagctcc

SEQ ID NO: 121692 - DNA, 17 bp, Homo sapiens
gggacaggaccccagct

SEQ ID NO: 121693 - DNA, 13 bp, Homo sapiens
gggccatgcctcc

SEQ ID NO: 121694 - DNA, 17 bp, Homo sapiens
gggccggccagtggcct

SEQ ID NO: 121695 - DNA, 23 bp, Homo sapiens
gggctgagcctggtcccacgagg

SEQ ID NO: 121696 - DNA, 19 bp, Homo sapiens
ggggccatgcctcctcagg

SEQ ID NO: 121697 - DNA, 19 bp, Homo sapiens
ggggtgcggcggtcccagc

SEQ ID NO: 121698 - DNA, 18 bp, Homo sapiens
gggtcctgcagcctgcag

SEQ ID NO: 121699 - DNA, 23 bp, Homo sapiens
gggtcctgcagcctgcaggacct

SEQ ID NO: 121700 - DNA, 21 bp, Homo sapiens
gggtgcggcggtcccagctcc

SEQ ID NO: 121701 - DNA, 20 bp, Homo sapiens
ggtcccagctccctggctcc

SEQ ID NO: 121702 - DNA, 13 bp, Homo sapiens
ggtcctggtgccc

SEQ ID NO: 121703 - DNA, 16 bp, Homo sapiens
gtcaccagacggggct

SEQ ID NO: 121704 - DNA, 14 bp, Homo sapiens
gtcctgcagcctgc

SEQ ID NO: 121705 - DNA, 23 bp, Homo sapiens
gtcctggtgccctggatgcccag

SEQ ID NO: 121706 - DNA, 17 bp, Homo sapiens
gtcgctgtgccacaggc

SEQ ID NO: 121707 - DNA, 17 bp, Homo sapiens
gtcggtcctggtgccct

SEQ ID NO: 121708 - DNA, 18 bp, Homo sapiens
gtcggtcctggtgccctg

SEQ ID NO: 121709 - DNA, 14 bp, Homo sapiens
gtgagggtcctgca

SEQ ID NO: 121710 - DNA, 18 bp, Homo sapiens
gtgccctggatgcccagg

SEQ ID NO: 121711 - DNA, 18 bp, Homo sapiens
gtgcggcggtcccagctc

SEQ ID NO: 121712 - DNA, 19 bp, Homo sapiens
gtgcggcggtcccagctcc

SEQ ID NO: 121713 - DNA, 18 bp, Homo sapiens
gtggccttccccagcatg

SEQ ID NO: 121714 - DNA, 16 bp, Homo sapiens
gtggtgaccccaggag

SEQ ID NO: 121715 - DNA, 18 bp, Homo sapiens
gtggtgaccccaggaggg

SEQ ID NO: 121716 - DNA, 21 bp, Homo sapiens
gttgggtcaccagacggggct

SEQ ID NO: 121717 - DNA, 20 bp, Homo sapiens
tagggacaggaccccagctc

SEQ ID NO: 121718 - DNA, 21 bp, Homo sapiens
tagggacaggaccccagctct

SEQ ID NO: 121719 - DNA, 19 bp, Homo sapiens
tcaccagacggggctggag

SEQ ID NO: 121720 - DNA, 15 bp, Homo sapiens
aaaagattatatatc

SEQ ID NO: 121721 - DNA, 22 bp, Homo sapiens
aaaagattatatatcataaagt

SEQ ID NO: 121722 - DNA, 23 bp, Homo sapiens
aaaagattatatatcataaagta

SEQ ID NO: 121723 - DNA, 17 bp, Homo sapiens
aaaagattgtattgctg

SEQ ID NO: 121724 - DNA, 15 bp, Homo sapiens
aaaagcttttgtttt

SEQ ID NO: 121725 - DNA, 21 bp, Homo sapiens
aaaagcttttgttttgcttac

SEQ ID NO: 121726 - DNA, 15 bp, Homo sapiens
aaaaggaaattagtc

SEQ ID NO: 121727 - DNA, 20 bp, Homo sapiens
aaaaggaaattagtcttttt

SEQ ID NO: 121728 - DNA, 16 bp, Homo sapiens
aaaaggatgttacaag

SEQ ID NO: 121729 - DNA, 22 bp, Homo sapiens
aaaaggatgttacaagtttgct

SEQ ID NO: 121730 - DNA, 20 bp, Homo sapiens
aaaaggcaactcaaagatga

SEQ ID NO: 121731 - DNA, 14 bp, Homo sapiens
aaaagtaatgaaga

SEQ ID NO: 121732 - DNA, 14 bp, Homo sapiens
aaaagtgaactttt

SEQ ID NO: 121733 - DNA, 16 bp, Homo sapiens
aaaagtgaacttttgt

SEQ ID NO: 121734 - DNA, 22 bp, Homo sapiens
aaaagtgaacttttgtaatttg

SEQ ID NO: 121735 - DNA, 13 bp, Homo sapiens
aaaagtgcaatgc

SEQ ID NO: 121736 - DNA, 16 bp, Homo sapiens
aaaagttaaactactt

SEQ ID NO: 121737 - DNA, 16 bp, Homo sapiens
aaaagttataataact

SEQ ID NO: 121738 - DNA, 16 bp, Homo sapiens
aaaataacactgttgg

SEQ ID NO: 121739 - DNA, 21 bp, Homo sapiens
aaaataccataggaagacata

SEQ ID NO: 121740 - DNA, 16 bp, Homo sapiens
aaaatacctcaggaaa

SEQ ID NO: 121741 - DNA, 18 bp, Homo sapiens
aaaatacctcaggaaaga

SEQ ID NO: 121742 - DNA, 18 bp, Homo sapiens
aaaatagagcaaaatcaa

SEQ ID NO: 121743 - DNA, 19 bp, Homo sapiens
aaaatataaattgtacatt

SEQ ID NO: 121744 - DNA, 21 bp, Homo sapiens
aaaatataaattgtacatttt

SEQ ID NO: 121745 - DNA, 13 bp, Homo sapiens
aaaatatatgttc

SEQ ID NO: 121746 - DNA, 21 bp, Homo sapiens
aaaatatatgttctgcaagaa

SEQ ID NO: 121747 - DNA, 15 bp, Homo sapiens
aaaatattgctaaaa

SEQ ID NO: 121748 - DNA, 16 bp, Homo sapiens
aaaatattgctaaaag

SEQ ID NO: 121749 - DNA, 17 bp, Homo sapiens
aaaatattgctaaaagt

SEQ ID NO: 121750 - DNA, 13 bp, Homo sapiens
aaaatattttaag

SEQ ID NO: 121751 - DNA, 14 bp, Homo sapiens
aaaatattttaaga

SEQ ID NO: 121752 - DNA, 16 bp, Homo sapiens
aaaatattttaagaaa

SEQ ID NO: 121753 - DNA, 21 bp, Homo sapiens
aaaatattttaagaaagagaa

SEQ ID NO: 121754 - DNA, 20 bp, Homo sapiens
aaaatcctatatctgtttgt

SEQ ID NO: 121755 - DNA, 15 bp, Homo sapiens
aaaatgcaatatttg

SEQ ID NO: 121756 - DNA, 17 bp, Homo sapiens
aaaatgcaatatttgta

SEQ ID NO: 121757 - DNA, 15 bp, Homo sapiens
aaaattaaatctaga

SEQ ID NO: 121758 - DNA, 13 bp, Homo sapiens
aaaattatttgca

SEQ ID NO: 121759 - DNA, 17 bp, Homo sapiens
aaaattcagtgagatat

SEQ ID NO: 121760 - DNA, 22 bp, Homo sapiens
aaacaagtatataatttacttt

SEQ ID NO: 121761 - DNA, 20 bp, Homo sapiens
aaacaccatcattaagaata

SEQ ID NO: 121762 - DNA, 13 bp, Homo sapiens
aaacagagaaaga

SEQ ID NO: 121763 - DNA, 15 bp, Homo sapiens
aaacagagaaagaaa

SEQ ID NO: 121764 - DNA, 16 bp, Homo sapiens
aaacagagaaagaaaa

SEQ ID NO: 121765 - DNA, 17 bp, Homo sapiens
aaacagagaaagaaaag

SEQ ID NO: 121766 - DNA, 18 bp, Homo sapiens
aaacagagaaagaaaagg

SEQ ID NO: 121767 - DNA, 15 bp, Homo sapiens
aaacagtattttctt

SEQ ID NO: 121768 - DNA, 15 bp, Homo sapiens
aaacatgtgcccctg

SEQ ID NO: 121769 - DNA, 18 bp, Homo sapiens
aaacatgtgcccctgcca

SEQ ID NO: 121770 - DNA, 16 bp, Homo sapiens
aaaccagtttattctg

SEQ ID NO: 121771 - DNA, 15 bp, Homo sapiens
aaacccatgaagctg

SEQ ID NO: 121772 - DNA, 15 bp, Homo sapiens
aaaccctttgtatta

SEQ ID NO: 121773 - DNA, 18 bp, Homo sapiens
aaacctagcttttaaaaa

SEQ ID NO: 121774 - DNA, 21 bp, Homo sapiens
aaacctagcttttaaaaaata

SEQ ID NO: 121775 - DNA, 16 bp, Homo sapiens
aaacgagaagtgccct

SEQ ID NO: 121776 - DNA, 15 bp, Homo sapiens
aaacgcacttacaag

SEQ ID NO: 121777 - DNA, 23 bp, Homo sapiens
aaacgtgttgtatctacagtaat

SEQ ID NO: 121778 - DNA, 14 bp, Homo sapiens
aaactaaacagaaa

SEQ ID NO: 121779 - DNA, 17 bp, Homo sapiens
aaactaaacagaaaact

SEQ ID NO: 121780 - DNA, 11 bp, Homo sapiens
aaactcctgtg

SEQ ID NO: 121781 - DNA, 19 bp, Homo sapiens
aaactgagtccatgaaaat

SEQ ID NO: 121782 - DNA, 20 bp, Homo sapiens
aaactgagtccatgaaaata

SEQ ID NO: 121783 - DNA, 21 bp, Homo sapiens
aaactgagtccatgaaaatac

SEQ ID NO: 121784 - DNA, 17 bp, Homo sapiens
aaactgatttctcacgg

SEQ ID NO: 121785 - DNA, 14 bp, Homo sapiens
aaactgctgttaat

SEQ ID NO: 121786 - DNA, 17 bp, Homo sapiens
aaactgtgtatcattaa

SEQ ID NO: 121787 - DNA, 18 bp, Homo sapiens
aaactttctccatttaag

SEQ ID NO: 121788 - DNA, 12 bp, Homo sapiens
aaagaaaaggca

SEQ ID NO: 121789 - DNA, 16 bp, Homo sapiens
aaagaaaccatgacaa

SEQ ID NO: 121790 - DNA, 13 bp, Homo sapiens
aaagaaataattt

SEQ ID NO: 121791 - DNA, 22 bp, Homo sapiens
aaagaagagaggggaagaattt

SEQ ID NO: 121792 - DNA, 14 bp, Homo sapiens
aaagaatagaaaga

SEQ ID NO: 121793 - DNA, 19 bp, Homo sapiens
aaagactggtttgtttgct

SEQ ID NO: 121794 - DNA, 18 bp, Homo sapiens
aaagactgtcaaatgaac

SEQ ID NO: 121795 - DNA, 11 bp, Homo sapiens
aaagagactct

SEQ ID NO: 121796 - DNA, 15 bp, Homo sapiens
aaagcaattatattg

SEQ ID NO: 121797 - DNA, 22 bp, Homo sapiens
aaagcatgggaaaaagagactc

SEQ ID NO: 121798 - DNA, 23 bp, Homo sapiens
aaagcatgggaaaaagagactct

SEQ ID NO: 121799 - DNA, 14 bp, Homo sapiens
aaagcttcagggaa

SEQ ID NO: 121800 - DNA, 23 bp, Homo sapiens
aaaggaaatctcaccccatccca

SEQ ID NO: 121801 - DNA, 15 bp, Homo sapiens
aaaggaaattagtct

SEQ ID NO: 121802 - DNA, 13 bp, Homo sapiens
aaaggatgttaca

SEQ ID NO: 121803 - DNA, 14 bp, Homo sapiens
aaaggcaaaagact

SEQ ID NO: 121804 - DNA, 21 bp, Homo sapiens
aaagtaaaccacaaaaaaata

SEQ ID NO: 121805 - DNA, 13 bp, Homo sapiens
aaagtattcagaa

SEQ ID NO: 121806 - DNA, 14 bp, Homo sapiens
aaagtattcagaaa

SEQ ID NO: 121807 - DNA, 15 bp, Homo sapiens
aaagtattcagaaat

SEQ ID NO: 121808 - DNA, 18 bp, Homo sapiens
aaagtattcagaaattaa

SEQ ID NO: 121809 - DNA, 22 bp, Homo sapiens
aaagtattcagaaattaaaata

SEQ ID NO: 121810 - DNA, 21 bp, Homo sapiens
aaagtatttataaaaatataa

SEQ ID NO: 121811 - DNA, 22 bp, Homo sapiens
aaagtatttataaaaatataaa

SEQ ID NO: 121812 - DNA, 23 bp, Homo sapiens
aaagtatttataaaaatataaat

SEQ ID NO: 121813 - DNA, 12 bp, Homo sapiens
aaagtgaacttt

SEQ ID NO: 121814 - DNA, 18 bp, Homo sapiens
aaagtgaacttttgtaat

SEQ ID NO: 121815 - DNA, 19 bp, Homo sapiens
aaagtgaacttttgtaatt

SEQ ID NO: 121816 - DNA, 23 bp, Homo sapiens
aaagtgaacttttgtaatttgaa

SEQ ID NO: 121817 - DNA, 15 bp, Homo sapiens
aaagtgatgacatat

SEQ ID NO: 121818 - DNA, 15 bp, Homo sapiens
aaagtgcaatgcgtg

SEQ ID NO: 121819 - DNA, 12 bp, Homo sapiens
aaagtgcattta

SEQ ID NO: 121820 - DNA, 16 bp, Homo sapiens
aaagtgcatttaagga

SEQ ID NO: 121821 - DNA, 17 bp, Homo sapiens
aaagttataataactga

SEQ ID NO: 121822 - DNA, 23 bp, Homo sapiens
aagaaaaggcaaaagactggttt

SEQ ID NO: 121823 - DNA, 16 bp, Homo sapiens
aagaaaagtaatgaag

SEQ ID NO: 121824 - DNA, 9 bp, Homo sapiens
aagaaagag

SEQ ID NO: 121825 - DNA, 14 bp, Homo sapiens
aagaaagagaatga

SEQ ID NO: 121826 - DNA, 10 bp, Homo sapiens
aagaaaggat

SEQ ID NO: 121827 - DNA, 19 bp, Homo sapiens
aagaaaggatataaaagga

SEQ ID NO: 121828 - DNA, 20 bp, Homo sapiens
aagaaaggatataaaaggat

SEQ ID NO: 121829 - DNA, 21 bp, Homo sapiens
aagaaataattttattccaga

SEQ ID NO: 121830 - DNA, 19 bp, Homo sapiens
aagaaatatgatcagagct

SEQ ID NO: 121831 - DNA, 22 bp, Homo sapiens
aagaagggggagtgaaacagag

SEQ ID NO: 121832 - DNA, 20 bp, Homo sapiens
aagaatagcctagatatgaa

SEQ ID NO: 121833 - DNA, 19 bp, Homo sapiens
aagaatggtggcttctttt

SEQ ID NO: 121834 - DNA, 13 bp, Homo sapiens
aagaattaaaact

SEQ ID NO: 121835 - DNA, 14 bp, Homo sapiens
aagaattaaaactg

SEQ ID NO: 121836 - DNA, 15 bp, Homo sapiens
aagaattaaaactga

SEQ ID NO: 121837 - DNA, 20 bp, Homo sapiens
aagacacatgctgaggtttt

SEQ ID NO: 121838 - DNA, 18 bp, Homo sapiens
aagaccttctccctagcc

SEQ ID NO: 121839 - DNA, 22 bp, Homo sapiens
aagaccttctccctagcccttc

SEQ ID NO: 121840 - DNA, 18 bp, Homo sapiens
aagactcctctgggcctg

SEQ ID NO: 121841 - DNA, 12 bp, Homo sapiens
aagactggtttg

SEQ ID NO: 121842 - DNA, 19 bp, Homo sapiens
aagactggtttgtttgctt

SEQ ID NO: 121843 - DNA, 13 bp, Homo sapiens
aagagaatgaact

SEQ ID NO: 121844 - DNA, 13 bp, Homo sapiens
aagagacaaactg

SEQ ID NO: 121845 - DNA, 15 bp, Homo sapiens
aagagaggggaagaa

SEQ ID NO: 121846 - DNA, 18 bp, Homo sapiens
aagagaggggaagaattt

SEQ ID NO: 121847 - DNA, 20 bp, Homo sapiens
aagagaggggaagaatttaa

SEQ ID NO: 121848 - DNA, 12 bp, Homo sapiens
aagatatatgtg

SEQ ID NO: 121849 - DNA, 19 bp, Homo sapiens
aagatatatgtgtatacat

SEQ ID NO: 121850 - DNA, 20 bp, Homo sapiens
aagatatatgtgtatacata

SEQ ID NO: 121851 - DNA, 15 bp, Homo sapiens
aagattatatatcat

SEQ ID NO: 121852 - DNA, 16 bp, Homo sapiens
aagattatatatcata

SEQ ID NO: 121853 - DNA, 21 bp, Homo sapiens
aagattatatatcataaagta

SEQ ID NO: 121854 - DNA, 16 bp, Homo sapiens
aagattgtattgctgt

SEQ ID NO: 121855 - DNA, 16 bp, Homo sapiens
aagcacatctgcattt

SEQ ID NO: 121856 - DNA, 17 bp, Homo sapiens
aagcagaaacagcatat

SEQ ID NO: 121857 - DNA, 20 bp, Homo sapiens
aagcgctgttgcccgccctc

SEQ ID NO: 121858 - DNA, 15 bp, Homo sapiens
aagctgctgaggccc

SEQ ID NO: 121859 - DNA, 20 bp, Homo sapiens
aagctggccctcagctccct

SEQ ID NO: 121860 - DNA, 22 bp, Homo sapiens
aagctggccctcagctccctga

SEQ ID NO: 121861 - DNA, 14 bp, Homo sapiens
aagcttttgttttg

SEQ ID NO: 121862 - DNA, 22 bp, Homo sapiens
aagcttttgttttgcttacaaa

SEQ ID NO: 121863 - DNA, 23 bp, Homo sapiens
aagcttttgttttgcttacaaag

SEQ ID NO: 121864 - DNA, 16 bp, Homo sapiens
aaggaaaattgaaagt

SEQ ID NO: 121865 - DNA, 17 bp, Homo sapiens
aaggaaaattgaaagta

SEQ ID NO: 121866 - DNA, 16 bp, Homo sapiens
aaggaatataagaaaa

SEQ ID NO: 121867 - DNA, 20 bp, Homo sapiens
aaggagaaaatgcattatgt

SEQ ID NO: 121868 - DNA, 14 bp, Homo sapiens
aaggaggtggctgt

SEQ ID NO: 121869 - DNA, 15 bp, Homo sapiens
aaggatataaaagga

SEQ ID NO: 121870 - DNA, 22 bp, Homo sapiens
aaggatataaaaggatgttaca

SEQ ID NO: 121871 - DNA, 16 bp, Homo sapiens
aaggatcaccccagcc

SEQ ID NO: 121872 - DNA, 17 bp, Homo sapiens
aaggatcaccccagccc

SEQ ID NO: 121873 - DNA, 17 bp, Homo sapiens
aatggtgttactaaagt

SEQ ID NO: 121874 - DNA, 18 bp, Homo sapiens
aatggtgttactaaagtc

SEQ ID NO: 121875 - DNA, 21 bp, Homo sapiens
aatgtaatgatcataagtcta

SEQ ID NO: 121876 - DNA, 17 bp, Homo sapiens
aatgtgagtgtgtttgt

SEQ ID NO: 121877 - DNA, 13 bp, Homo sapiens
aatgtgatcatat

SEQ ID NO: 121878 - DNA, 12 bp, Homo sapiens
aatgtgtccaag

SEQ ID NO: 121879 - DNA, 23 bp, Homo sapiens
aatgtgtgtattcttaaaatgca

SEQ ID NO: 121880 - DNA, 20 bp, Homo sapiens
aatgtttaatagaaaattaa

SEQ ID NO: 121881 - DNA, 21 bp, Homo sapiens
aatgtttaatagaaaattaaa

SEQ ID NO: 121882 - DNA, 11 bp, Homo sapiens
aattaaaactg

SEQ ID NO: 121883 - DNA, 15 bp, Homo sapiens
aattaaaactgagtc

SEQ ID NO: 121884 - DNA, 15 bp, Homo sapiens
aattaaaatattatt

SEQ ID NO: 121885 - DNA, 17 bp, Homo sapiens
aattaaatctagacatt

SEQ ID NO: 121886 - DNA, 23 bp, Homo sapiens
aattaactgtaaacttggaatca

SEQ ID NO: 121887 - DNA, 20 bp, Homo sapiens
aattagcagaatggagaaag

SEQ ID NO: 121888 - DNA, 22 bp, Homo sapiens
aattagcagaatggagaaagta

SEQ ID NO: 121889 - DNA, 16 bp, Homo sapiens
aattagtgagattaaa

SEQ ID NO: 121890 - DNA, 21 bp, Homo sapiens
aattagtgagattaaaaatct

SEQ ID NO: 121891 - DNA, 16 bp, Homo sapiens
aattataatctcattt

SEQ ID NO: 121892 - DNA, 22 bp, Homo sapiens
aattatggtctggggtaaaatt

SEQ ID NO: 121893 - DNA, 17 bp, Homo sapiens
aattattaattgtcctg

SEQ ID NO: 121894 - DNA, 15 bp, Homo sapiens
aattattgtagacat

SEQ ID NO: 121895 - DNA, 17 bp, Homo sapiens
aattcaacctgtgtctt

SEQ ID NO: 121896 - DNA, 14 bp, Homo sapiens
aattccaagaaaat

SEQ ID NO: 121897 - DNA, 15 bp, Homo sapiens
aattgaaagtattca

SEQ ID NO: 121898 - DNA, 16 bp, Homo sapiens
aattgaacaataaagt

SEQ ID NO: 121899 - DNA, 17 bp, Homo sapiens
aattgaacaataaagtt

SEQ ID NO: 121900 - DNA, 15 bp, Homo sapiens
aattgagtttcagaa

SEQ ID NO: 121901 - DNA, 22 bp, Homo sapiens
aattgagtttcagaataaaatt

SEQ ID NO: 121902 - DNA, 14 bp, Homo sapiens
aattgattattctg

SEQ ID NO: 121903 - DNA, 22 bp, Homo sapiens
aattgattattctgattccact

SEQ ID NO: 121904 - DNA, 13 bp, Homo sapiens
aattgtcctgtgt

SEQ ID NO: 121905 - DNA, 15 bp, Homo sapiens
aattgtcctgtgtct

SEQ ID NO: 121906 - DNA, 14 bp, Homo sapiens
aattgttgatattt

SEQ ID NO: 121907 - DNA, 19 bp, Homo sapiens
aatttaagaaaacaagtat

SEQ ID NO: 121908 - DNA, 18 bp, Homo sapiens
aatttaatggactgtgaa

SEQ ID NO: 121909 - DNA, 22 bp, Homo sapiens
aatttaatggactgtgaatttc

SEQ ID NO: 121910 - DNA, 10 bp, Homo sapiens
aaaaaaagaa

SEQ ID NO: 121911 - DNA, 13 bp, Homo sapiens
aaaaaaagactgt

SEQ ID NO: 121912 - DNA, 11 bp, Homo sapiens
aaaaaactgaa

SEQ ID NO: 121913 - DNA, 12 bp, Homo sapiens
aaaaaagaacct

SEQ ID NO: 121914 - DNA, 11 bp, Homo sapiens
aaaaaagactg

SEQ ID NO: 121915 - DNA, 11 bp, Homo sapiens
aaaaaagtata

SEQ ID NO: 121916 - DNA, 16 bp, Homo sapiens
aaaaaataccattgaa

SEQ ID NO: 121917 - DNA, 12 bp, Homo sapiens
aaaaaatatttt

SEQ ID NO: 121918 - DNA, 14 bp, Homo sapiens
aaaaaatattttaa

SEQ ID NO: 121919 - DNA, 12 bp, Homo sapiens
aaaaaatgtaat

SEQ ID NO: 121920 - DNA, 23 bp, Homo sapiens
aatatctgagaagtgtatatagt

SEQ ID NO: 121921 - DNA, 15 bp, Homo sapiens
aatattatttgatat

SEQ ID NO: 121922 - DNA, 18 bp, Homo sapiens
aatattatttgatatctg

SEQ ID NO: 121923 - DNA, 12 bp, Homo sapiens
aatattgctaaa

SEQ ID NO: 121924 - DNA, 12 bp, Homo sapiens
aatattttaaga

SEQ ID NO: 121925 - DNA, 16 bp, Homo sapiens
aatattttaagaaaga

SEQ ID NO: 121926 - DNA, 15 bp, Homo sapiens
aatcaaaataaaaga

SEQ ID NO: 121927 - DNA, 16 bp, Homo sapiens
aatcaagatgagatat

SEQ ID NO: 121928 - DNA, 17 bp, Homo sapiens
aatcacttaacattcct

SEQ ID NO: 121929 - DNA, 18 bp, Homo sapiens
aatcacttaacattccta

SEQ ID NO: 121930 - DNA, 14 bp, Homo sapiens
aatcagcatgacaa

SEQ ID NO: 121931 - DNA, 15 bp, Homo sapiens
aatcagctctcctgg

SEQ ID NO: 121932 - DNA, 17 bp, Homo sapiens
aatcattttaggaaagg

SEQ ID NO: 121933 - DNA, 15 bp, Homo sapiens
aatccaaagaactat

SEQ ID NO: 121934 - DNA, 18 bp, Homo sapiens
aatccagagaagcgctgt

SEQ ID NO: 121935 - DNA, 23 bp, Homo sapiens
aatcctgtttttcctatgctctg

SEQ ID NO: 121936 - DNA, 20 bp, Homo sapiens
aatctagacattcttttaat

SEQ ID NO: 121937 - DNA, 13 bp, Homo sapiens
aatctcaccccat

SEQ ID NO: 121938 - DNA, 20 bp, Homo sapiens
aatctcatttcaatttataa

SEQ ID NO: 121939 - DNA, 14 bp, Homo sapiens
aatcttggcttctt

SEQ ID NO: 121940 - DNA, 16 bp, Homo sapiens
aatcttggcttcttaa

SEQ ID NO: 121941 - DNA, 22 bp, Homo sapiens
aatcttggcttcttaaaaactg

SEQ ID NO: 121942 - DNA, 23 bp, Homo sapiens
aatcttggcttcttaaaaactgt

SEQ ID NO: 121943 - DNA, 15 bp, Homo sapiens
aatgaactgtggaat

SEQ ID NO: 121944 - DNA, 17 bp, Homo sapiens
aatgaactgtggaattt

SEQ ID NO: 121945 - DNA, 14 bp, Homo sapiens
aatgaacttttaca

SEQ ID NO: 121946 - DNA, 15 bp, Homo sapiens
aatgaacttttacag

SEQ ID NO: 121947 - DNA, 21 bp, Homo sapiens
aatgaacttttacagaatgca

SEQ ID NO: 121948 - DNA, 15 bp, Homo sapiens
aatgaagaatcacga

SEQ ID NO: 121949 - DNA, 16 bp, Homo sapiens
aatgatcataagtcta

SEQ ID NO: 121950 - DNA, 22 bp, Homo sapiens
aatgcaagtgaacttgggaggg

SEQ ID NO: 121951 - DNA, 14 bp, Homo sapiens
aatgcattaaaaaa

SEQ ID NO: 121952 - DNA, 23 bp, Homo sapiens
aatgccatagtcaaagagagttt

SEQ ID NO: 121953 - DNA, 18 bp, Homo sapiens
aatggactgtgaatttca

SEQ ID NO: 121954 - DNA, 13 bp, Homo sapiens
aatgggtgatatg

SEQ ID NO: 121955 - DNA, 19 bp, Homo sapiens
aatggtgttactaaagtca

SEQ ID NO: 121956 - DNA, 17 bp, Homo sapiens
aatgtacatctggcctt

SEQ ID NO: 121957 - DNA, 14 bp, Homo sapiens
aatgtcagaaactc

SEQ ID NO: 121958 - DNA, 15 bp, Homo sapiens
aatgtgatcatatga

SEQ ID NO: 121959 - DNA, 16 bp, Homo sapiens
aatgtgatcatatgag

SEQ ID NO: 121960 - DNA, 14 bp, Homo sapiens
aatgtgatctatgt

SEQ ID NO: 121961 - DNA, 22 bp, Homo sapiens
aatgtgatctatgtttcatctt

SEQ ID NO: 121962 - DNA, 15 bp, Homo sapiens
aatgtgtccaagaca

SEQ ID NO: 121963 - DNA, 20 bp, Homo sapiens
aatgtgtgtgtgatggaggg

SEQ ID NO: 121964 - DNA, 20 bp, Homo sapiens
aatgttatttcttaaaattc

SEQ ID NO: 121965 - DNA, 20 bp, Homo sapiens
aatgtttactaagtggactg

SEQ ID NO: 121966 - DNA, 21 bp, Homo sapiens
aattaaaactgagtccatgaa

SEQ ID NO: 121967 - DNA, 22 bp, Homo sapiens
aattaaaactgagtccatgaaa

SEQ ID NO: 121968 - DNA, 17 bp, Homo sapiens
aattaaaatattatttg

SEQ ID NO: 121969 - DNA, 21 bp, Homo sapiens
aattaaaatattatttgatat

SEQ ID NO: 121970 - DNA, 15 bp, Homo sapiens
aattagcagaatgga

SEQ ID NO: 121971 - DNA, 21 bp, Homo sapiens
aattagcagaatggagaaagt

SEQ ID NO: 121972 - DNA, 12 bp, Homo sapiens
aaaattgaaagt

SEQ ID NO: 121973 - DNA, 14 bp, Homo sapiens
aaacaaaaaaaaga

SEQ ID NO: 121974 - DNA, 14 bp, Homo sapiens
aaacagagaaagaa

SEQ ID NO: 121975 - DNA, 22 bp, Homo sapiens
aaaccagctctgaacttccaag

SEQ ID NO: 121976 - DNA, 12 bp, Homo sapiens
aaaccatgacaa

SEQ ID NO: 121977 - DNA, 12 bp, Homo sapiens
aaaccctttgta

SEQ ID NO: 121978 - DNA, 19 bp, Homo sapiens
aaaccctttgtattataat

SEQ ID NO: 121979 - DNA, 23 bp, Homo sapiens
aaacctaaagaggaaaagtgcaa

SEQ ID NO: 121980 - DNA, 17 bp, Homo sapiens
aaactcatgatcaagat

SEQ ID NO: 121981 - DNA, 13 bp, Homo sapiens
aaactgaaggttt

SEQ ID NO: 121982 - DNA, 14 bp, Homo sapiens
aaactgaaggtttt

SEQ ID NO: 121983 - DNA, 13 bp, Homo sapiens
aaactgagaaatg

SEQ ID NO: 121984 - DNA, 14 bp, Homo sapiens
aaactgtaaaaaat

SEQ ID NO: 121985 - DNA, 15 bp, Homo sapiens
aaactgtgtatcatt

SEQ ID NO: 121986 - DNA, 16 bp, Homo sapiens
aaactgtgtatcatta

SEQ ID NO: 121987 - DNA, 18 bp, Homo sapiens
aaacttggaatcaaggta

SEQ ID NO: 121988 - DNA, 15 bp, Homo sapiens
aaactttaaaaggca

SEQ ID NO: 121989 - DNA, 13 bp, Homo sapiens
aaactttgctcca

SEQ ID NO: 121990 - DNA, 15 bp, Homo sapiens
aaagaaaccatgaca

SEQ ID NO: 121991 - DNA, 12 bp, Homo sapiens
aaagaaataatt

SEQ ID NO: 121992 - DNA, 14 bp, Homo sapiens
aaagaatcccaccc

SEQ ID NO: 121993 - DNA, 17 bp, Homo sapiens
aaagactgtcaaatgaa

SEQ ID NO: 121994 - DNA, 20 bp, Homo sapiens
aaagactgtcaaatgaactt

SEQ ID NO: 121995 - DNA, 22 bp, Homo sapiens
aaagactgtcaaatgaactttt

SEQ ID NO: 121996 - DNA, 14 bp, Homo sapiens
aaagagaatgaact

SEQ ID NO: 121997 - DNA, 21 bp, Homo sapiens
aaagagaatgaactgtggaat

SEQ ID NO: 121998 - DNA, 23 bp, Homo sapiens
aaagagagtttttaatagaacca

SEQ ID NO: 121999 - DNA, 18 bp, Homo sapiens
aaagagtgtaaaatattt

SEQ ID NO: 122000 - DNA, 14 bp, Homo sapiens
aaagatgatggaaa

SEQ ID NO: 122001 - DNA, 15 bp, Homo sapiens
aaagatgatggaaac

SEQ ID NO: 122002 - DNA, 18 bp, Homo sapiens
aaagatgatggaaacgca

SEQ ID NO: 122003 - DNA, 21 bp, Homo sapiens
aaagattatatatcataaagt

SEQ ID NO: 122004 - DNA, 22 bp, Homo sapiens
aaagattatatatcataaagta

SEQ ID NO: 122005 - DNA, 13 bp, Homo sapiens
aaagcaattatat

SEQ ID NO: 122006 - DNA, 18 bp, Homo sapiens
aaagcatgggaaaaagag

SEQ ID NO: 122007 - DNA, 13 bp, Homo sapiens
aaaggaatataag

SEQ ID NO: 122008 - DNA, 23 bp, Homo sapiens
aaaggatataaaaggatgttaca

SEQ ID NO: 122009 - DNA, 13 bp, Homo sapiens
aaaggcaaaagac

SEQ ID NO: 122010 - DNA, 15 bp, Homo sapiens
aaaggcaaaagactg

SEQ ID NO: 122011 - DNA, 13 bp, Homo sapiens
aaaggcaactcaa

SEQ ID NO: 122012 - DNA, 18 bp, Homo sapiens
aaaggcaactcaaagatg

SEQ ID NO: 122013 - DNA, 15 bp, Homo sapiens
aaagggcagtaaagt

SEQ ID NO: 122014 - DNA, 13 bp, Homo sapiens
aaagtaagtcttt

SEQ ID NO: 122015 - DNA, 16 bp, Homo sapiens
aaagtattcagaaatt

SEQ ID NO: 122016 - DNA, 19 bp, Homo sapiens
aaagtatttataaaaatat

SEQ ID NO: 122017 - DNA, 15 bp, Homo sapiens
aaagtgaacttttgt

SEQ ID NO: 122018 - DNA, 16 bp, Homo sapiens
aaagtgatgacatatt

SEQ ID NO: 122019 - DNA, 17 bp, Homo sapiens
aaagtgatgacatattt

SEQ ID NO: 122020 - DNA, 14 bp, Homo sapiens
aaagtgcaatgcgt

SEQ ID NO: 122021 - DNA, 18 bp, Homo sapiens
aaagttataataactgaa

SEQ ID NO: 122022 - DNA, 14 bp, Homo sapiens
acagagaaagaaaa

SEQ ID NO: 122023 - DNA, 13 bp, Homo sapiens
acagaggtaacta

SEQ ID NO: 122024 - DNA, 16 bp, Homo sapiens
acagatttgaggactg

SEQ ID NO: 122025 - DNA, 23 bp, Homo sapiens
acagatttgaggactgaagctgg

SEQ ID NO: 122026 - DNA, 10 bp, Homo sapiens
acagccctga

SEQ ID NO: 122027 - DNA, 13 bp, Homo sapiens
acagccctggaat

SEQ ID NO: 122028 - DNA, 21 bp, Homo sapiens
acagctgacggtttctccccg

SEQ ID NO: 122029 - DNA, 15 bp, Homo sapiens
acaggaattttaaaa

SEQ ID NO: 122030 - DNA, 14 bp, Homo sapiens
acagtttgtgtttt

SEQ ID NO: 122031 - DNA, 19 bp, Homo sapiens
acagtttttaactctactg

SEQ ID NO: 122032 - DNA, 21 bp, Homo sapiens
acataaaactttaaaaggcaa

SEQ ID NO: 122033 - DNA, 14 bp, Homo sapiens
acatataacactta

SEQ ID NO: 122034 - DNA, 16 bp, Homo sapiens
acatataacacttaac

SEQ ID NO: 122035 - DNA, 17 bp, Homo sapiens
acatatatgtatatgta

SEQ ID NO: 122036 - DNA, 14 bp, Homo sapiens
acatcctagcccca

SEQ ID NO: 122037 - DNA, 15 bp, Homo sapiens
acatcctagccccac

SEQ ID NO: 122038 - DNA, 17 bp, Homo sapiens
acatcctagccccaccc

SEQ ID NO: 122039 - DNA, 22 bp, Homo sapiens
acatcctagccccacccagagg

SEQ ID NO: 122040 - DNA, 13 bp, Homo sapiens
acatgacatccag

SEQ ID NO: 122041 - DNA, 19 bp, Homo sapiens
acatgctgaggttttgaat

SEQ ID NO: 122042 - DNA, 20 bp, Homo sapiens
acatgggaggaaggcccagg

SEQ ID NO: 122043 - DNA, 13 bp, Homo sapiens
acatgtgcccctg

SEQ ID NO: 122044 - DNA, 15 bp, Homo sapiens
acatgtgcccctgcc

SEQ ID NO: 122045 - DNA, 14 bp, Homo sapiens
acattcctaaaatg

SEQ ID NO: 122046 - DNA, 12 bp, Homo sapiens
acattcttttaa

SEQ ID NO: 122047 - DNA, 13 bp, Homo sapiens
acatttatatatt

SEQ ID NO: 122048 - DNA, 13 bp, Homo sapiens
acattttgtaaaa

SEQ ID NO: 122049 - DNA, 21 bp, Homo sapiens
accaaatgagcattagctact

SEQ ID NO: 122050 - DNA, 22 bp, Homo sapiens
accacatataacacttaacttc

SEQ ID NO: 122051 - DNA, 19 bp, Homo sapiens
accataggaagacataaaa

SEQ ID NO: 122052 - DNA, 22 bp, Homo sapiens
accataggaagacataaaactt

SEQ ID NO: 122053 - DNA, 12 bp, Homo sapiens
accatgacaaac

SEQ ID NO: 122054 - DNA, 16 bp, Homo sapiens
accatgacaaacctag

SEQ ID NO: 122055 - DNA, 15 bp, Homo sapiens
accatggccagccaa

SEQ ID NO: 122056 - DNA, 17 bp, Homo sapiens
acccacagccctgaaac

SEQ ID NO: 122057 - DNA, 14 bp, Homo sapiens
acccagaggtggcc

SEQ ID NO: 122058 - DNA, 15 bp, Homo sapiens
acccatgaagctggc

SEQ ID NO: 122059 - DNA, 16 bp, Homo sapiens
acccatgaagctggcc

SEQ ID NO: 122060 - DNA, 18 bp, Homo sapiens
acccatgaagctggccct

SEQ ID NO: 122061 - DNA, 19 bp, Homo sapiens
accccacccttcccctcct

SEQ ID NO: 122062 - DNA, 12 bp, Homo sapiens
acttttgtaatt

SEQ ID NO: 122063 - DNA, 15 bp, Homo sapiens
acttttgtaatttga

SEQ ID NO: 122064 - DNA, 16 bp, Homo sapiens
acttttgtaatttgaa

SEQ ID NO: 122065 - DNA, 18 bp, Homo sapiens
acttttgtaatttgaatt

SEQ ID NO: 122066 - DNA, 20 bp, Homo sapiens
acttttgtaatttgaattgg

SEQ ID NO: 122067 - DNA, 17 bp, Homo sapiens
agaaaaatagagcaaaa

SEQ ID NO: 122068 - DNA, 21 bp, Homo sapiens
agaaaactcccaatacaaaga

SEQ ID NO: 122069 - DNA, 15 bp, Homo sapiens
agaaaagtaatgaag

SEQ ID NO: 122070 - DNA, 16 bp, Homo sapiens
agaaaattaaaataac

SEQ ID NO: 122071 - DNA, 17 bp, Homo sapiens
agaaacagtattttctt

SEQ ID NO: 122072 - DNA, 21 bp, Homo sapiens
agaaacagtattttcttccca

SEQ ID NO: 122073 - DNA, 15 bp, Homo sapiens
agaaaccatgacaaa

SEQ ID NO: 122074 - DNA, 23 bp, Homo sapiens
agaaaccatgacaaacctagctt

SEQ ID NO: 122075 - DNA, 12 bp, Homo sapiens
agaaagaaaagg

SEQ ID NO: 122076 - DNA, 15 bp, Homo sapiens
agaaagaaaaggcaa

SEQ ID NO: 122077 - DNA, 15 bp, Homo sapiens
agaaagagaatgaac

SEQ ID NO: 122078 - DNA, 16 bp, Homo sapiens
agaaagagaatgaact

SEQ ID NO: 122079 - DNA, 24 bp, Homo sapiens
agaaagagaatgaactgtggaatt

SEQ ID NO: 122080 - DNA, 17 bp, Homo sapiens
agaaaggatataaaagg

SEQ ID NO: 122081 - DNA, 20 bp, Homo sapiens
agaaattttactgacagaaa

SEQ ID NO: 122082 - DNA, 18 bp, Homo sapiens
agaactatgtaaacaaaa

SEQ ID NO: 122083 - DNA, 14 bp, Homo sapiens
agaactccgctgga

SEQ ID NO: 122084 - DNA, 19 bp, Homo sapiens
agaagaatccgagtgtttg

SEQ ID NO: 122085 - DNA, 20 bp, Homo sapiens
agaagagaggggaagaattt

SEQ ID NO: 122086 - DNA, 23 bp, Homo sapiens
agaagagaggggaagaatttaat

SEQ ID NO: 122087 - DNA, 21 bp, Homo sapiens
agaagggggagtgaaacagag

SEQ ID NO: 122088 - DNA, 12 bp, Homo sapiens
agaataaaatta

SEQ ID NO: 122089 - DNA, 13 bp, Homo sapiens
agaatagaaagaa

SEQ ID NO: 122090 - DNA, 20 bp, Homo sapiens
agaatgaactgtggaattta

SEQ ID NO: 122091 - DNA, 17 bp, Homo sapiens
agaatggtggcttcttt

SEQ ID NO: 122092 - DNA, 17 bp, Homo sapiens
agaatgtttaatagaaa

SEQ ID NO: 122093 - DNA, 19 bp, Homo sapiens
agaatgtttaatagaaaat

SEQ ID NO: 122094 - DNA, 12 bp, Homo sapiens
agaattaaaact

SEQ ID NO: 122095 - DNA, 13 bp, Homo sapiens
agaattaaaactg

SEQ ID NO: 122096 - DNA, 14 bp, Homo sapiens
agaattaaaactga

SEQ ID NO: 122097 - DNA, 19 bp, Homo sapiens
agaattgaaggagaaaatg

SEQ ID NO: 122098 - DNA, 21 bp, Homo sapiens
agaatttaatggactgtgaat

SEQ ID NO: 122099 - DNA, 14 bp, Homo sapiens
agaatttagactga

SEQ ID NO: 122100 - DNA, 12 bp, Homo sapiens
agacaattagca

SEQ ID NO: 122101 - DNA, 16 bp, Homo sapiens
agacactccttgaaat

SEQ ID NO: 122102 - DNA, 13 bp, Homo sapiens
agacagggagaag

SEQ ID NO: 122103 - DNA, 15 bp, Homo sapiens
agacataaaacttta

SEQ ID NO: 122104 - DNA, 20 bp, Homo sapiens
agacataaaactttaaaagg

SEQ ID NO: 122105 - DNA, 16 bp, Homo sapiens
agacattcttttaatg

SEQ ID NO: 122106 - DNA, 15 bp, Homo sapiens
agaccacacatttta

SEQ ID NO: 122107 - DNA, 11 bp, Homo sapiens
agaccaggagg

SEQ ID NO: 122108 - DNA, 23 bp, Homo sapiens
agaccaggagggagagcctctgt

SEQ ID NO: 122109 - DNA, 13 bp, Homo sapiens
agacccacagccc

SEQ ID NO: 122110 - DNA, 14 bp, Homo sapiens
agaccttctcccta

SEQ ID NO: 122111 - DNA, 19 bp, Homo sapiens
agacgtgaatgtctcagcg

SEQ ID NO: 122112 - DNA, 13 bp, Homo sapiens
agactcctctggg

SEQ ID NO: 122113 - DNA, 14 bp, Homo sapiens
agactcctctgggc

SEQ ID NO: 122114 - DNA, 16 bp, Homo sapiens
agactcctctgggcct

SEQ ID NO: 122115 - DNA, 12 bp, Homo sapiens
agactgattacc

SEQ ID NO: 122116 - DNA, 19 bp, Homo sapiens
agactgggcacccctgcct

SEQ ID NO: 122117 - DNA, 16 bp, Homo sapiens
agactggtttgtttgc

SEQ ID NO: 122118 - DNA, 19 bp, Homo sapiens
agactggtttgtttgctta

SEQ ID NO: 122119 - DNA, 15 bp, Homo sapiens
agactgtcaaatgaa

SEQ ID NO: 122120 - DNA, 16 bp, Homo sapiens
agactgtcaaatgaac

SEQ ID NO: 122121 - DNA, 15 bp, Homo sapiens
agacttcactgcagc

SEQ ID NO: 122122 - DNA, 21 bp, Homo sapiens
agagaaagaaaaggcaaaaga

SEQ ID NO: 122123 - DNA, 18 bp, Homo sapiens
agagacaaactgtaaaaa

SEQ ID NO: 122124 - DNA, 20 bp, Homo sapiens
agagacaaactgtaaaaaat

SEQ ID NO: 122125 - DNA, 14 bp, Homo sapiens
agagaccacacatt

SEQ ID NO: 122126 - DNA, 20 bp, Homo sapiens
agagaccacacattttatga

SEQ ID NO: 122127 - DNA, 18 bp, Homo sapiens
agagactcagaggaccca

SEQ ID NO: 122128 - DNA, 19 bp, Homo sapiens
agagactcttttaggatca

SEQ ID NO: 122129 - DNA, 18 bp, Homo sapiens
agagaggggaagaattta

SEQ ID NO: 122130 - DNA, 19 bp, Homo sapiens
agagaggggaagaatttaa

SEQ ID NO: 122131 - DNA, 23 bp, Homo sapiens
agagcctctgttttgtaaactaa

SEQ ID NO: 122132 - DNA, 22 bp, Homo sapiens
agagctgtgggcaaaagagtgt

SEQ ID NO: 122133 - DNA, 16 bp, Homo sapiens
agaggacactaggaga

SEQ ID NO: 122134 - DNA, 21 bp, Homo sapiens
agaggcctcggctgtctcctg

SEQ ID NO: 122135 - DNA, 11 bp, Homo sapiens
agaggtggccc

SEQ ID NO: 122136 - DNA, 22 bp, Homo sapiens
agaggtggccctcccaggctgg

SEQ ID NO: 122137 - DNA, 16 bp, Homo sapiens
agatataggataaaat

SEQ ID NO: 122138 - DNA, 18 bp, Homo sapiens
agatataggataaaataa

SEQ ID NO: 122139 - DNA, 17 bp, Homo sapiens
agatatatgtgtataca

SEQ ID NO: 122140 - DNA, 14 bp, Homo sapiens
agatatgaatatat

SEQ ID NO: 122141 - DNA, 14 bp, Homo sapiens
agatatttttgtac

SEQ ID NO: 122142 - DNA, 17 bp, Homo sapiens
agatatttttgtacgtt

SEQ ID NO: 122143 - DNA, 12 bp, Homo sapiens
agatcagggata

SEQ ID NO: 122144 - DNA, 22 bp, Homo sapiens
agatgatggaaacgcacttaca

SEQ ID NO: 122145 - DNA, 15 bp, Homo sapiens
agattatatatcata

SEQ ID NO: 122146 - DNA, 16 bp, Homo sapiens
agattatatatcataa

SEQ ID NO: 122147 - DNA, 19 bp, Homo sapiens
agattatatatcataaagt

SEQ ID NO: 122148 - DNA, 21 bp, Homo sapiens
agattcagtttaagagttttc

SEQ ID NO: 122149 - DNA, 13 bp, Homo sapiens
agcacagcccagg

SEQ ID NO: 122150 - DNA, 15 bp, Homo sapiens
agcacagcccagggc

SEQ ID NO: 122151 - DNA, 16 bp, Homo sapiens
agcacagcccagggcc

SEQ ID NO: 122152 - DNA, 20 bp, Homo sapiens
agcacagcccagggcctgca

SEQ ID NO: 122153 - DNA, 16 bp, Homo sapiens
agcacatctgcatttt

SEQ ID NO: 122154 - DNA, 13 bp, Homo sapiens
agcaccagggaga

SEQ ID NO: 122155 - DNA, 16 bp, Homo sapiens
agcacgttggcgagga

SEQ ID NO: 122156 - DNA, 20 bp, Homo sapiens
agcactctaattagagaact

SEQ ID NO: 122157 - DNA, 14 bp, Homo sapiens
agcaggatgccctg

SEQ ID NO: 122158 - DNA, 16 bp, Homo sapiens
agcatagctctgtaca

SEQ ID NO: 122159 - DNA, 13 bp, Homo sapiens
agcatgacaaaaa

SEQ ID NO: 122160 - DNA, 18 bp, Homo sapiens
agcatgacaaaaataaca

SEQ ID NO: 122161 - DNA, 23 bp, Homo sapiens
agcatgacaaaaataacactgtt

SEQ ID NO: 122162 - DNA, 14 bp, Homo sapiens
agccaaaccctgtc

SEQ ID NO: 122163 - DNA, 15 bp, Homo sapiens
agccaaaccctgtct

SEQ ID NO: 122164 - DNA, 15 bp, Homo sapiens
acgcacttacaagtg

SEQ ID NO: 122165 - DNA, 15 bp, Homo sapiens
acgctctaccctgca

SEQ ID NO: 122166 - DNA, 17 bp, Homo sapiens
acgtgattgattcagta

SEQ ID NO: 122167 - DNA, 14 bp, Homo sapiens
acgttatatattgt

SEQ ID NO: 122168 - DNA, 19 bp, Homo sapiens
acgttatatattgtattaa

SEQ ID NO: 122169 - DNA, 14 bp, Homo sapiens
actaagtaagaaac

SEQ ID NO: 122170 - DNA, 15 bp, Homo sapiens
actaagtaagaaaca

SEQ ID NO: 122171 - DNA, 21 bp, Homo sapiens
actagccatgataactgcaat

SEQ ID NO: 122172 - DNA, 13 bp, Homo sapiens
actaggaaacgtg

SEQ ID NO: 122173 - DNA, 16 bp, Homo sapiens
actatcaatatttaag

SEQ ID NO: 122174 - DNA, 13 bp, Homo sapiens
actatgtaaacaa

SEQ ID NO: 122175 - DNA, 21 bp, Homo sapiens
actcatgatcaagatatatgt

SEQ ID NO: 122176 - DNA, 22 bp, Homo sapiens
actccgctggatggggagtctc

SEQ ID NO: 122177 - DNA, 23 bp, Homo sapiens
actccgctggatggggagtctca

SEQ ID NO: 122178 - DNA, 11 bp, Homo sapiens
actcctctggg

SEQ ID NO: 122179 - DNA, 12 bp, Homo sapiens
actcctctgggc

SEQ ID NO: 122180 - DNA, 14 bp, Homo sapiens
actcctctgggcct

SEQ ID NO: 122181 - DNA, 16 bp, Homo sapiens
actcctctgggcctgg

SEQ ID NO: 122182 - DNA, 17 bp, Homo sapiens
actcctttccaatagaa

SEQ ID NO: 122183 - DNA, 12 bp, Homo sapiens
actgaaactaca

SEQ ID NO: 122184 - DNA, 21 bp, Homo sapiens
actgaaccgacttttctaaag

SEQ ID NO: 122185 - DNA, 15 bp, Homo sapiens
actgaactgtttggt

SEQ ID NO: 122186 - DNA, 16 bp, Homo sapiens
actgaagctggggctt

SEQ ID NO: 122187 - DNA, 18 bp, Homo sapiens
actgacagcctcccaccc

SEQ ID NO: 122188 - DNA, 23 bp, Homo sapiens
actgaggcccaaagcacttgctt

SEQ ID NO: 122189 - DNA, 16 bp, Homo sapiens
actgagtccatgaaaa

SEQ ID NO: 122190 - DNA, 17 bp, Homo sapiens
actgagtccatgaaaat

SEQ ID NO: 122191 - DNA, 19 bp, Homo sapiens
actgagtccatgaaaatac

SEQ ID NO: 122192 - DNA, 17 bp, Homo sapiens
actgatgagtaaactga

SEQ ID NO: 122193 - DNA, 22 bp, Homo sapiens
actgatgagtaaactgaggccc

SEQ ID NO: 122194 - DNA, 15 bp, Homo sapiens
actgcaatgtgatct

SEQ ID NO: 122195 - DNA, 15 bp, Homo sapiens
actgccaaaacaatg

SEQ ID NO: 122196 - DNA, 22 bp, Homo sapiens
actgctgttaattgattaaaat

SEQ ID NO: 122197 - DNA, 24 bp, Homo sapiens
actggaggaaccacatataacact

SEQ ID NO: 122198 - DNA, 14 bp, Homo sapiens
actggcacttgcct

SEQ ID NO: 122199 - DNA, 17 bp, Homo sapiens
actggcacttgcctgct

SEQ ID NO: 122200 - DNA, 18 bp, Homo sapiens
actggcacttgcctgctg

SEQ ID NO: 122201 - DNA, 20 bp, Homo sapiens
actgggggcggggcctgggc

SEQ ID NO: 122202 - DNA, 17 bp, Homo sapiens
actggtttgtttgctta

SEQ ID NO: 122203 - DNA, 16 bp, Homo sapiens
actgtaaaagttataa

SEQ ID NO: 122204 - DNA, 20 bp, Homo sapiens
actgtaaaagttataataac

SEQ ID NO: 122205 - DNA, 16 bp, Homo sapiens
actgtcaaatgaactt

SEQ ID NO: 122206 - DNA, 21 bp, Homo sapiens
actgtgtaatataaaagatct

SEQ ID NO: 122207 - DNA, 22 bp, Homo sapiens
actgtgtaatataaaagatctt

SEQ ID NO: 122208 - DNA, 16 bp, Homo sapiens
actgtgtatcattaaa

SEQ ID NO: 122209 - DNA, 24 bp, Homo sapiens
actgtgtatcattaaaatatatgt

SEQ ID NO: 122210 - DNA, 22 bp, Homo sapiens
actgtgtgtttgggaaggtggg

SEQ ID NO: 122211 - DNA, 18 bp, Homo sapiens
actgtttcatgagcccaa

SEQ ID NO: 122212 - DNA, 15 bp, Homo sapiens
acttaacattcctaa

SEQ ID NO: 122213 - DNA, 21 bp, Homo sapiens
acttaacattcctaaaatgct

SEQ ID NO: 122214 - DNA, 12 bp, Homo sapiens
acttaacatttc

SEQ ID NO: 122215 - DNA, 17 bp, Homo sapiens
acttaacatttcattgt

SEQ ID NO: 122216 - DNA, 17 bp, Homo sapiens
acttatcatttttgtat

SEQ ID NO: 122217 - DNA, 20 bp, Homo sapiens
acttatcatttttgtataaa

SEQ ID NO: 122218 - DNA, 19 bp, Homo sapiens
acttcaaattttttaaaag

SEQ ID NO: 122219 - DNA, 16 bp, Homo sapiens
acttcatgcccactgc

SEQ ID NO: 122220 - DNA, 14 bp, Homo sapiens
acttctgagcccca

SEQ ID NO: 122221 - DNA, 19 bp, Homo sapiens
acttgacccccttgagggt

SEQ ID NO: 122222 - DNA, 18 bp, Homo sapiens
acttgctacttatcattt

SEQ ID NO: 122223 - DNA, 23 bp, Homo sapiens
acttggaatcaaggtaagctcag

SEQ ID NO: 122224 - DNA, 14 bp, Homo sapiens
acttgggagggggc

SEQ ID NO: 122225 - DNA, 14 bp, Homo sapiens
actttaaaaggcaa

SEQ ID NO: 122226 - DNA, 17 bp, Homo sapiens
acttttacagaatgcat

SEQ ID NO: 122227 - DNA, 22 bp, Homo sapiens
acttttctaaagctctgaacaa

SEQ ID NO: 122228 - DNA, 18 bp, Homo sapiens
acttttctggttccaaac

SEQ ID NO: 122229 - DNA, 19 bp, Homo sapiens
acttttctggttccaaacc

SEQ ID NO: 122230 - DNA, 19 bp, Homo sapiens
acttttgtaatttgaattg

SEQ ID NO: 122231 - DNA, 15 bp, Homo sapiens
agaaaacaagtatat

SEQ ID NO: 122232 - DNA, 13 bp, Homo sapiens
agaaaaggcaaaa

SEQ ID NO: 122233 - DNA, 17 bp, Homo sapiens
agaaaaggcaaaagact

SEQ ID NO: 122234 - DNA, 16 bp, Homo sapiens
agaaaagtaatgaaga

SEQ ID NO: 122235 - DNA, 20 bp, Homo sapiens
agaaaatatcactgtaatga

SEQ ID NO: 122236 - DNA, 14 bp, Homo sapiens
agaaaattaaaata

SEQ ID NO: 122237 - DNA, 16 bp, Homo sapiens
agaaaccatgacaaac

SEQ ID NO: 122238 - DNA, 13 bp, Homo sapiens
agaaagaaaaggc

SEQ ID NO: 122239 - DNA, 14 bp, Homo sapiens
agaaagaaaaggca

SEQ ID NO: 122240 - DNA, 18 bp, Homo sapiens
agaaagagaatgaactgt

SEQ ID NO: 122241 - DNA, 22 bp, Homo sapiens
agaaagagaatgaactgtggaa

SEQ ID NO: 122242 - DNA, 13 bp, Homo sapiens
agaaattaaaata

SEQ ID NO: 122243 - DNA, 16 bp, Homo sapiens
agaaattaaaatatta

SEQ ID NO: 122244 - DNA, 21 bp, Homo sapiens
agaaattaaaatattatttga

SEQ ID NO: 122245 - DNA, 18 bp, Homo sapiens
agaacaacttgctactta

SEQ ID NO: 122246 - DNA, 16 bp, Homo sapiens
agaactaagtaagaaa

SEQ ID NO: 122247 - DNA, 18 bp, Homo sapiens
agaactaagtaagaaaca

SEQ ID NO: 122248 - DNA, 15 bp, Homo sapiens
agaactatgtaaaca

SEQ ID NO: 122249 - DNA, 15 bp, Homo sapiens
agaagacatttgcca

SEQ ID NO: 122250 - DNA, 18 bp, Homo sapiens
agaagagaggggaagaat

SEQ ID NO: 122251 - DNA, 19 bp, Homo sapiens
agaagagaggggaagaatt

SEQ ID NO: 122252 - DNA, 21 bp, Homo sapiens
agaagagaggggaagaattta

SEQ ID NO: 122253 - DNA, 16 bp, Homo sapiens
agaaggagcaagagaa

SEQ ID NO: 122254 - DNA, 19 bp, Homo sapiens
agaagggctctttctctct

SEQ ID NO: 122255 - DNA, 22 bp, Homo sapiens
agaagggggagtgaaacagaga

SEQ ID NO: 122256 - DNA, 12 bp, Homo sapiens
agaagtgtatat

SEQ ID NO: 122257 - DNA, 15 bp, Homo sapiens
agaataattgaacaa

SEQ ID NO: 122258 - DNA, 17 bp, Homo sapiens
agaatcatacttaacat

SEQ ID NO: 122259 - DNA, 23 bp, Homo sapiens
agaatcccacccccacttcatgc

SEQ ID NO: 122260 - DNA, 24 bp, Homo sapiens
agaatcccacccccacttcatgcc

SEQ ID NO: 122261 - DNA, 15 bp, Homo sapiens
agaatgaactgtgga

SEQ ID NO: 122262 - DNA, 19 bp, Homo sapiens
agaatgaactgtggaattt

SEQ ID NO: 122263 - DNA, 15 bp, Homo sapiens
agaatgcattaaaaa

SEQ ID NO: 122264 - DNA, 14 bp, Homo sapiens
agaatggagaaagt

SEQ ID NO: 122265 - DNA, 15 bp, Homo sapiens
ataccattgaaatca

SEQ ID NO: 122266 - DNA, 19 bp, Homo sapiens
atacctcaggaaagaatag

SEQ ID NO: 122267 - DNA, 14 bp, Homo sapiens
atactactgctttg

SEQ ID NO: 122268 - DNA, 17 bp, Homo sapiens
atactgtaaaagttata

SEQ ID NO: 122269 - DNA, 13 bp, Homo sapiens
atacttaacattt

SEQ ID NO: 122270 - DNA, 14 bp, Homo sapiens
atacttaacatttc

SEQ ID NO: 122271 - DNA, 15 bp, Homo sapiens
atacttaacatttca

SEQ ID NO: 122272 - DNA, 23 bp, Homo sapiens
atacttgcagctcccattctatg

SEQ ID NO: 122273 - DNA, 21 bp, Homo sapiens
atagaaaattaaaataacttt

SEQ ID NO: 122274 - DNA, 14 bp, Homo sapiens
atagaaagaaacta

SEQ ID NO: 122275 - DNA, 13 bp, Homo sapiens
atagaaagaaagt

SEQ ID NO: 122276 - DNA, 14 bp, Homo sapiens
atagagaccaggag

SEQ ID NO: 122277 - DNA, 15 bp, Homo sapiens
atagagaccaggagg

SEQ ID NO: 122278 - DNA, 20 bp, Homo sapiens
atagagatatttttgtacgt

SEQ ID NO: 122279 - DNA, 21 bp, Homo sapiens
atagcgctgttgatcccctct

SEQ ID NO: 122280 - DNA, 17 bp, Homo sapiens
atagctggcaagaatgg

SEQ ID NO: 122281 - DNA, 16 bp, Homo sapiens
atagctgtttcaaatg

SEQ ID NO: 122282 - DNA, 18 bp, Homo sapiens
ataggaagacataaaact

SEQ ID NO: 122283 - DNA, 22 bp, Homo sapiens
ataggaagacataaaactttaa

SEQ ID NO: 122284 - DNA, 13 bp, Homo sapiens
ataggataaaata

SEQ ID NO: 122285 - DNA, 21 bp, Homo sapiens
ataggtaacgtgattgattca

SEQ ID NO: 122286 - DNA, 20 bp, Homo sapiens
atagtcaaagagagttttta

SEQ ID NO: 122287 - DNA, 13 bp, Homo sapiens
atagtgcctctgc

SEQ ID NO: 122288 - DNA, 20 bp, Homo sapiens
atagttgcttttgaaggaat

SEQ ID NO: 122289 - DNA, 15 bp, Homo sapiens
atataaattgtacat

SEQ ID NO: 122290 - DNA, 19 bp, Homo sapiens
atataatcttggcttctta

SEQ ID NO: 122291 - DNA, 21 bp, Homo sapiens
atataatcttggcttcttaaa

SEQ ID NO: 122292 - DNA, 22 bp, Homo sapiens
atataatcttggcttcttaaaa

SEQ ID NO: 122293 - DNA, 13 bp, Homo sapiens
atatagctggcaa

SEQ ID NO: 122294 - DNA, 16 bp, Homo sapiens
atatagctggcaagaa

SEQ ID NO: 122295 - DNA, 19 bp, Homo sapiens
atatagctggcaagaatgg

SEQ ID NO: 122296 - DNA, 15 bp, Homo sapiens
atataggataaaata

SEQ ID NO: 122297 - DNA, 16 bp, Homo sapiens
atataggataaaataa

SEQ ID NO: 122298 - DNA, 16 bp, Homo sapiens
atatatcataaagtat

SEQ ID NO: 122299 - DNA, 16 bp, Homo sapiens
atatatggcatttgca

SEQ ID NO: 122300 - DNA, 21 bp, Homo sapiens
atatatgtatatgtatatcta

SEQ ID NO: 122301 - DNA, 22 bp, Homo sapiens
atatatgtgtatacatacatgt

SEQ ID NO: 122302 - DNA, 13 bp, Homo sapiens
atatatgttctgc

SEQ ID NO: 122303 - DNA, 21 bp, Homo sapiens
atatatgttctgcaagaatta

SEQ ID NO: 122304 - DNA, 19 bp, Homo sapiens
atatattctacacatatat

SEQ ID NO: 122305 - DNA, 14 bp, Homo sapiens
atatcactaaataa

SEQ ID NO: 122306 - DNA, 23 bp, Homo sapiens
atatcactaaataaacacgattt

SEQ ID NO: 122307 - DNA, 18 bp, Homo sapiens
atatctatatctctaaac

SEQ ID NO: 122308 - DNA, 17 bp, Homo sapiens
atatctctaaactgctg

SEQ ID NO: 122309 - DNA, 18 bp, Homo sapiens
atatctgaacatttacta

SEQ ID NO: 122310 - DNA, 18 bp, Homo sapiens
atatctgagaagtgtata

SEQ ID NO: 122311 - DNA, 13 bp, Homo sapiens
atatgtatatcta

SEQ ID NO: 122312 - DNA, 14 bp, Homo sapiens
atatgtatatctat

SEQ ID NO: 122313 - DNA, 22 bp, Homo sapiens
atatgtatatctatatctctaa

SEQ ID NO: 122314 - DNA, 16 bp, Homo sapiens
atatgtatatgtatat

SEQ ID NO: 122315 - DNA, 16 bp, Homo sapiens
atatgtgtatacatac

SEQ ID NO: 122316 - DNA, 13 bp, Homo sapiens
atatgttctgcaa

SEQ ID NO: 122317 - DNA, 20 bp, Homo sapiens
atatgttctgcaagaattaa

SEQ ID NO: 122318 - DNA, 22 bp, Homo sapiens
atatgttctgcaagaattaaaa

SEQ ID NO: 122319 - DNA, 17 bp, Homo sapiens
atattacctaatgaaag

SEQ ID NO: 122320 - DNA, 13 bp, Homo sapiens
atattagttgctt

SEQ ID NO: 122321 - DNA, 16 bp, Homo sapiens
atattatttgatatct

SEQ ID NO: 122322 - DNA, 21 bp, Homo sapiens
atattctacacatatatgtat

SEQ ID NO: 122323 - DNA, 14 bp, Homo sapiens
atattgctaaaagt

SEQ ID NO: 122324 - DNA, 17 bp, Homo sapiens
atattttaaaataaact

SEQ ID NO: 122325 - DNA, 12 bp, Homo sapiens
atcaaaaataat

SEQ ID NO: 122326 - DNA, 16 bp, Homo sapiens
atcaaaggaatataag

SEQ ID NO: 122327 - DNA, 23 bp, Homo sapiens
atcaatagtgtcctatgcaataa

SEQ ID NO: 122328 - DNA, 22 bp, Homo sapiens
atcaatttctcaatagttctta

SEQ ID NO: 122329 - DNA, 20 bp, Homo sapiens
atcaccccagcccccacagc

SEQ ID NO: 122330 - DNA, 15 bp, Homo sapiens
atcactgattccctc

SEQ ID NO: 122331 - DNA, 20 bp, Homo sapiens
atcactgattccctctccca

SEQ ID NO: 122332 - DNA, 14 bp, Homo sapiens
aatttactttgtag

SEQ ID NO: 122333 - DNA, 14 bp, Homo sapiens
aatttattggcagc

SEQ ID NO: 122334 - DNA, 16 bp, Homo sapiens
aatttccttctgttaa

SEQ ID NO: 122335 - DNA, 21 bp, Homo sapiens
aatttccttctgttaagaaag

SEQ ID NO: 122336 - DNA, 21 bp, Homo sapiens
aatttctataaatttaagaaa

SEQ ID NO: 122337 - DNA, 16 bp, Homo sapiens
aatttgaattgggtcc

SEQ ID NO: 122338 - DNA, 15 bp, Homo sapiens
aattttaaataacct

SEQ ID NO: 122339 - DNA, 20 bp, Homo sapiens
aatttttgaaaaatattgct

SEQ ID NO: 122340 - DNA, 14 bp, Homo sapiens
acaaaaaaaagaac

SEQ ID NO: 122341 - DNA, 18 bp, Homo sapiens
acaaacaaaaaaaagaac

SEQ ID NO: 122342 - DNA, 13 bp, Homo sapiens
acaaacctagctt

SEQ ID NO: 122343 - DNA, 19 bp, Homo sapiens
acaaacctagcttttaaaa

SEQ ID NO: 122344 - DNA, 20 bp, Homo sapiens
acaaagactcctctgggcct

SEQ ID NO: 122345 - DNA, 18 bp, Homo sapiens
acaaagcatgggaaaaag

SEQ ID NO: 122346 - DNA, 20 bp, Homo sapiens
acaaagcatgggaaaaagag

SEQ ID NO: 122347 - DNA, 22 bp, Homo sapiens
acaaagtatatttaaggattat

SEQ ID NO: 122348 - DNA, 22 bp, Homo sapiens
acaaatgcaaatttctataaat

SEQ ID NO: 122349 - DNA, 21 bp, Homo sapiens
acaacgctctaccctgcagct

SEQ ID NO: 122350 - DNA, 21 bp, Homo sapiens
acaaggtaggctgcaaaatta

SEQ ID NO: 122351 - DNA, 20 bp, Homo sapiens
acaagtggtgaccaaaattt

SEQ ID NO: 122352 - DNA, 18 bp, Homo sapiens
acaagtttgctaaaagaa

SEQ ID NO: 122353 - DNA, 19 bp, Homo sapiens
acaagtttgctaaaagaag

SEQ ID NO: 122354 - DNA, 21 bp, Homo sapiens
acaagtttgctaaaagaagag

SEQ ID NO: 122355 - DNA, 13 bp, Homo sapiens
acaataaacagct

SEQ ID NO: 122356 - DNA, 18 bp, Homo sapiens
acaattagcagaatggag

SEQ ID NO: 122357 - DNA, 13 bp, Homo sapiens
acacaagtgcagt

SEQ ID NO: 122358 - DNA, 22 bp, Homo sapiens
acacatgctgaggttttgaata

SEQ ID NO: 122359 - DNA, 22 bp, Homo sapiens
acacattgactcctttccaata

SEQ ID NO: 122360 - DNA, 13 bp, Homo sapiens
acaccgctggctc

SEQ ID NO: 122361 - DNA, 15 bp, Homo sapiens
acaccgctggctccg

SEQ ID NO: 122362 - DNA, 17 bp, Homo sapiens
acacgattttattgctg

SEQ ID NO: 122363 - DNA, 15 bp, Homo sapiens
acactaggagactgg

SEQ ID NO: 122364 - DNA, 14 bp, Homo sapiens
acactccttgaaat

SEQ ID NO: 122365 - DNA, 17 bp, Homo sapiens
acactgttggcacttat

SEQ ID NO: 122366 - DNA, 22 bp, Homo sapiens
agactgggcacccctgcctcct

SEQ ID NO: 122367 - DNA, 17 bp, Homo sapiens
agactggtttgtttgct

SEQ ID NO: 122368 - DNA, 21 bp, Homo sapiens
agactggtttgtttgcttaat

SEQ ID NO: 122369 - DNA, 18 bp, Homo sapiens
agactgtcaaatgaactt

SEQ ID NO: 122370 - DNA, 20 bp, Homo sapiens
agactgtcaaatgaactttt

SEQ ID NO: 122371 - DNA, 14 bp, Homo sapiens
agactgtttcacat

SEQ ID NO: 122372 - DNA, 16 bp, Homo sapiens
agacttcactgcagcc

SEQ ID NO: 122373 - DNA, 17 bp, Homo sapiens
agacttcactgcagcct

SEQ ID NO: 122374 - DNA, 21 bp, Homo sapiens
agactttctttctgtaggtgg

SEQ ID NO: 122375 - DNA, 17 bp, Homo sapiens
agagaaagaaaaggcaa

SEQ ID NO: 122376 - DNA, 23 bp, Homo sapiens
agagaaagaaaaggcaaaagact

SEQ ID NO: 122377 - DNA, 12 bp, Homo sapiens
agagaatgaact

SEQ ID NO: 122378 - DNA, 16 bp, Homo sapiens
agagaatgaactgtgg

SEQ ID NO: 122379 - DNA, 20 bp, Homo sapiens
agagaatgaactgtggaatt

SEQ ID NO: 122380 - DNA, 22 bp, Homo sapiens
agagaatgaactgtggaattta

SEQ ID NO: 122381 - DNA, 15 bp, Homo sapiens
agagaccacacattt

SEQ ID NO: 122382 - DNA, 17 bp, Homo sapiens
agagaccacacatttta

SEQ ID NO: 122383 - DNA, 13 bp, Homo sapiens
agagaccaggagg

SEQ ID NO: 122384 - DNA, 22 bp, Homo sapiens
agagactcagaggacccacctg

SEQ ID NO: 122385 - DNA, 23 bp, Homo sapiens
agagactcagaggacccacctgg

SEQ ID NO: 122386 - DNA, 13 bp, Homo sapiens
agagaggggaaga

SEQ ID NO: 122387 - DNA, 17 bp, Homo sapiens
agagaggggaagaattt

SEQ ID NO: 122388 - DNA, 20 bp, Homo sapiens
agagaggggaagaatttaat

SEQ ID NO: 122389 - DNA, 14 bp, Homo sapiens
agaggagaaactga

SEQ ID NO: 122390 - DNA, 17 bp, Homo sapiens
agaggccgctgcccctg

SEQ ID NO: 122391 - DNA, 21 bp, Homo sapiens
agaggtaactatcaatattta

SEQ ID NO: 122392 - DNA, 16 bp, Homo sapiens
agaggtttttctcccc

SEQ ID NO: 122393 - DNA, 19 bp, Homo sapiens
agaggtttttctccccgct

SEQ ID NO: 122394 - DNA, 17 bp, Homo sapiens
agagtatttttgtattc

SEQ ID NO: 122395 - DNA, 11 bp, Homo sapiens
agagtgtaaaa

SEQ ID NO: 122396 - DNA, 22 bp, Homo sapiens
agagtttacagtttgtgtttta

SEQ ID NO: 122397 - DNA, 14 bp, Homo sapiens
agatatatgtgtat

SEQ ID NO: 122398 - DNA, 18 bp, Homo sapiens
agatcttgcagaagttct

SEQ ID NO: 122399 - DNA, 15 bp, Homo sapiens
agatctttttgtgaa

SEQ ID NO: 122400 - DNA, 16 bp, Homo sapiens
agatgatggaaacgca

SEQ ID NO: 122401 - DNA, 23 bp, Homo sapiens
agatgatggaaacgcacttacaa

SEQ ID NO: 122402 - DNA, 18 bp, Homo sapiens
agatgcagttttcaaatt

SEQ ID NO: 122403 - DNA, 18 bp, Homo sapiens
agattatatatcataaag

SEQ ID NO: 122404 - DNA, 22 bp, Homo sapiens
agattatatatcataaagtatg

SEQ ID NO: 122405 - DNA, 14 bp, Homo sapiens
agattgtattgctg

SEQ ID NO: 122406 - DNA, 22 bp, Homo sapiens
agatttttatattagttgcttt

SEQ ID NO: 122407 - DNA, 17 bp, Homo sapiens
agattttttttgtaact

SEQ ID NO: 122408 - DNA, 19 bp, Homo sapiens
agattttttttgtaacttc

SEQ ID NO: 122409 - DNA, 14 bp, Homo sapiens
agcaattatattgt

SEQ ID NO: 122410 - DNA, 12 bp, Homo sapiens
agcacagcccag

SEQ ID NO: 122411 - DNA, 19 bp, Homo sapiens
agcaccagggagaggcctc

SEQ ID NO: 122412 - DNA, 20 bp, Homo sapiens
agcaccagggagaggcctcg

SEQ ID NO: 122413 - DNA, 15 bp, Homo sapiens
agcagaatggagaaa

SEQ ID NO: 122414 - DNA, 15 bp, Homo sapiens
agcaggttgaatggg

SEQ ID NO: 122415 - DNA, 21 bp, Homo sapiens
agcaggttgaatgggttctca

SEQ ID NO: 122416 - DNA, 14 bp, Homo sapiens
agcagtacaataaa

SEQ ID NO: 122417 - DNA, 22 bp, Homo sapiens
agcagtcctgcctcagcctccg

SEQ ID NO: 122418 - DNA, 14 bp, Homo sapiens
agcatgacaaaaat

SEQ ID NO: 122419 - DNA, 17 bp, Homo sapiens
agcatgacaaaaataac

SEQ ID NO: 122420 - DNA, 21 bp, Homo sapiens
agcatgacaaaaataacactg

SEQ ID NO: 122421 - DNA, 15 bp, Homo sapiens
agcatgggaaaaaga

SEQ ID NO: 122422 - DNA, 16 bp, Homo sapiens
agccaaaccctgtctg

SEQ ID NO: 122423 - DNA, 17 bp, Homo sapiens
agccacaccgctggctc

SEQ ID NO: 122424 - DNA, 15 bp, Homo sapiens
agccactgcagcaca

SEQ ID NO: 122425 - DNA, 21 bp, Homo sapiens
agcccaaacaccctcctggca

SEQ ID NO: 122426 - DNA, 23 bp, Homo sapiens
agcccaaacaccctcctggcaca

SEQ ID NO: 122427 - DNA, 12 bp, Homo sapiens
agcccagggcct

SEQ ID NO: 122428 - DNA, 16 bp, Homo sapiens
agccccaatccagaga

SEQ ID NO: 122429 - DNA, 19 bp, Homo sapiens
agccccaatccagagaagc

SEQ ID NO: 122430 - DNA, 16 bp, Homo sapiens
agccccacccagaggt

SEQ ID NO: 122431 - DNA, 15 bp, Homo sapiens
agccccagccccaat

SEQ ID NO: 122432 - DNA, 17 bp, Homo sapiens
agcccccacagccctgg

SEQ ID NO: 122433 - DNA, 20 bp, Homo sapiens
agcccccacagccctggaat

SEQ ID NO: 122434 - DNA, 15 bp, Homo sapiens
agcccccaggccagg

SEQ ID NO: 122435 - DNA, 22 bp, Homo sapiens
agccctcagacatttatatatt

SEQ ID NO: 122436 - DNA, 12 bp, Homo sapiens
atcagaaacagt

SEQ ID NO: 122437 - DNA, 22 bp, Homo sapiens
atcagagcttgaacacaggctt

SEQ ID NO: 122438 - DNA, 16 bp, Homo sapiens
atcagcatgacaaaaa

SEQ ID NO: 122439 - DNA, 17 bp, Homo sapiens
atcagcatgacaaaaat

SEQ ID NO: 122440 - DNA, 14 bp, Homo sapiens
atcagctctcctgg

SEQ ID NO: 122441 - DNA, 16 bp, Homo sapiens
atcagctctcctggct

SEQ ID NO: 122442 - DNA, 18 bp, Homo sapiens
atcagctctcctggctcc

SEQ ID NO: 122443 - DNA, 18 bp, Homo sapiens
atcatacttaacatttca

SEQ ID NO: 122444 - DNA, 21 bp, Homo sapiens
atcatatgaggacctttatat

SEQ ID NO: 122445 - DNA, 15 bp, Homo sapiens
atcattaaaatatat

SEQ ID NO: 122446 - DNA, 16 bp, Homo sapiens
atcattaaaatatatg

SEQ ID NO: 122447 - DNA, 19 bp, Homo sapiens
atcattaaaatatatgttc

SEQ ID NO: 122448 - DNA, 22 bp, Homo sapiens
atcattaaaatatatgttctgc

SEQ ID NO: 122449 - DNA, 23 bp, Homo sapiens
atcattaaaatatatgttctgca

SEQ ID NO: 122450 - DNA, 16 bp, Homo sapiens
atcattttaggaaagg

SEQ ID NO: 122451 - DNA, 18 bp, Homo sapiens
atcatttttgtataaaaa

SEQ ID NO: 122452 - DNA, 16 bp, Homo sapiens
atccaaggaaacatgc

SEQ ID NO: 122453 - DNA, 20 bp, Homo sapiens
atccaaggaaacatgcagct

SEQ ID NO: 122454 - DNA, 14 bp, Homo sapiens
atccagagatgact

SEQ ID NO: 122455 - DNA, 15 bp, Homo sapiens
atcctagccccaccc

SEQ ID NO: 122456 - DNA, 12 bp, Homo sapiens
atcctatatctg

SEQ ID NO: 122457 - DNA, 17 bp, Homo sapiens
atcctatatctgtttgt

SEQ ID NO: 122458 - DNA, 17 bp, Homo sapiens
atcctcctcagccccca

SEQ ID NO: 122459 - DNA, 13 bp, Homo sapiens
atcctgtttttcc

SEQ ID NO: 122460 - DNA, 19 bp, Homo sapiens
atcgacatcctagccccac

SEQ ID NO: 122461 - DNA, 14 bp, Homo sapiens
atcgcattgcatac

SEQ ID NO: 122462 - DNA, 20 bp, Homo sapiens
atctaaaaattttgcatttc

SEQ ID NO: 122463 - DNA, 20 bp, Homo sapiens
atctaactgatgagtaaact

SEQ ID NO: 122464 - DNA, 14 bp, Homo sapiens
atctacagtaatga

SEQ ID NO: 122465 - DNA, 14 bp, Homo sapiens
atctatttacataa

SEQ ID NO: 122466 - DNA, 22 bp, Homo sapiens
atctgcatttatcttttttcct

SEQ ID NO: 122467 - DNA, 14 bp, Homo sapiens
attaagcagaaaca

SEQ ID NO: 122468 - DNA, 15 bp, Homo sapiens
attaagcagaaacag

SEQ ID NO: 122469 - DNA, 19 bp, Homo sapiens
attacctcctgtgtggaag

SEQ ID NO: 122470 - DNA, 13 bp, Homo sapiens
attagcagaatgg

SEQ ID NO: 122471 - DNA, 21 bp, Homo sapiens
attagcagaatggagaaagta

SEQ ID NO: 122472 - DNA, 19 bp, Homo sapiens
attagtctttttctttttt

SEQ ID NO: 122473 - DNA, 20 bp, Homo sapiens
attagtttgatttaatatct

SEQ ID NO: 122474 - DNA, 22 bp, Homo sapiens
attagtttgatttaatatctga

SEQ ID NO: 122475 - DNA, 16 bp, Homo sapiens
attataattgttgata

SEQ ID NO: 122476 - DNA, 17 bp, Homo sapiens
attataattgttgatat

SEQ ID NO: 122477 - DNA, 18 bp, Homo sapiens
attatgtttgatttctct

SEQ ID NO: 122478 - DNA, 22 bp, Homo sapiens
attcaattaaagaaataatttt

SEQ ID NO: 122479 - DNA, 13 bp, Homo sapiens
attcagaaattaa

SEQ ID NO: 122480 - DNA, 14 bp, Homo sapiens
attcagaaattaaa

SEQ ID NO: 122481 - DNA, 15 bp, Homo sapiens
attcagaaattaaaa

SEQ ID NO: 122482 - DNA, 22 bp, Homo sapiens
attcagaaattaaaatattatt

SEQ ID NO: 122483 - DNA, 16 bp, Homo sapiens
attcatcttcttcttt

SEQ ID NO: 122484 - DNA, 16 bp, Homo sapiens
attccaagaaaatatc

SEQ ID NO: 122485 - DNA, 23 bp, Homo sapiens
attccctctcccacccaaggaga

SEQ ID NO: 122486 - DNA, 13 bp, Homo sapiens
attctatgtgtca

SEQ ID NO: 122487 - DNA, 19 bp, Homo sapiens
attctgcaagcacatctgc

SEQ ID NO: 122488 - DNA, 22 bp, Homo sapiens
attctgcaagcacatctgcatt

SEQ ID NO: 122489 - DNA, 16 bp, Homo sapiens
attctgtggttctata

SEQ ID NO: 122490 - DNA, 20 bp, Homo sapiens
attcttaaaatgcaatattt

SEQ ID NO: 122491 - DNA, 22 bp, Homo sapiens
attcttaaaatgcaatatttgt

SEQ ID NO: 122492 - DNA, 14 bp, Homo sapiens
attctttttaaagt

SEQ ID NO: 122493 - DNA, 14 bp, Homo sapiens
attgaaagtattca

SEQ ID NO: 122494 - DNA, 16 bp, Homo sapiens
attgaaagtattcaga

SEQ ID NO: 122495 - DNA, 18 bp, Homo sapiens
attgaaagtattcagaaa

SEQ ID NO: 122496 - DNA, 17 bp, Homo sapiens
attgaaggagaaaatgc

SEQ ID NO: 122497 - DNA, 16 bp, Homo sapiens
attgattcagtatctt

SEQ ID NO: 122498 - DNA, 16 bp, Homo sapiens
attgctaaaagtgcat

SEQ ID NO: 122499 - DNA, 20 bp, Homo sapiens
attgctaaaagtgcatttaa

SEQ ID NO: 122500 - DNA, 17 bp, Homo sapiens
attggcagccaaggaat

SEQ ID NO: 122501 - DNA, 10 bp, Homo sapiens
attgggtccc

SEQ ID NO: 122502 - DNA, 22 bp, Homo sapiens
attgggtcccgcttagttcttg

SEQ ID NO: 122503 - DNA, 12 bp, Homo sapiens
attgtattgctg

SEQ ID NO: 122504 - DNA, 19 bp, Homo sapiens
attgtcagagttctgctct

SEQ ID NO: 122505 - DNA, 21 bp, Homo sapiens
attgtcctcccctattttaag

SEQ ID NO: 122506 - DNA, 14 bp, Homo sapiens
attgtttattcttt

SEQ ID NO: 122507 - DNA, 21 bp, Homo sapiens
atttaagtttgttgctgtcaa

SEQ ID NO: 122508 - DNA, 22 bp, Homo sapiens
atttaagtttgttgctgtcaag

SEQ ID NO: 122509 - DNA, 14 bp, Homo sapiens
atttaatggactgt

SEQ ID NO: 122510 - DNA, 18 bp, Homo sapiens
atttataaaaatataaat

SEQ ID NO: 122511 - DNA, 22 bp, Homo sapiens
atttataaaaatataaattgta

SEQ ID NO: 122512 - DNA, 16 bp, Homo sapiens
atttatcttttttcct

SEQ ID NO: 122513 - DNA, 20 bp, Homo sapiens
atttattggcagccaaggaa

SEQ ID NO: 122514 - DNA, 14 bp, Homo sapiens
atttcaaaatgctt

SEQ ID NO: 122515 - DNA, 23 bp, Homo sapiens
atttcatgctatcagaaacagta

SEQ ID NO: 122516 - DNA, 21 bp, Homo sapiens
atttccacataaaggtattta

SEQ ID NO: 122517 - DNA, 13 bp, Homo sapiens
atttccttctgtt

SEQ ID NO: 122518 - DNA, 14 bp, Homo sapiens
atttccttctgtta

SEQ ID NO: 122519 - DNA, 16 bp, Homo sapiens
atttccttctgttaag

SEQ ID NO: 122520 - DNA, 13 bp, Homo sapiens
atttctataaatt

SEQ ID NO: 122521 - DNA, 13 bp, Homo sapiens
atttctgtatact

SEQ ID NO: 122522 - DNA, 21 bp, Homo sapiens
atttctgtatactgtaaaagt

SEQ ID NO: 122523 - DNA, 16 bp, Homo sapiens
atttgaattgggtccc

SEQ ID NO: 122524 - DNA, 19 bp, Homo sapiens
atttgcaaaccctttgtat

SEQ ID NO: 122525 - DNA, 20 bp, Homo sapiens
atttgcaaaccctttgtatt

SEQ ID NO: 122526 - DNA, 21 bp, Homo sapiens
atttgcaaaccctttgtatta

SEQ ID NO: 122527 - DNA, 14 bp, Homo sapiens
attttaaaataaac

SEQ ID NO: 122528 - DNA, 17 bp, Homo sapiens
attttaaaataaacttt

SEQ ID NO: 122529 - DNA, 14 bp, Homo sapiens
attttaaataacct

SEQ ID NO: 122530 - DNA, 15 bp, Homo sapiens
attttaaataacctc

SEQ ID NO: 122531 - DNA, 19 bp, Homo sapiens
attttaaataacctctggc

SEQ ID NO: 122532 - DNA, 15 bp, Homo sapiens
attttactgacagaa

SEQ ID NO: 122533 - DNA, 13 bp, Homo sapiens
attttaggaaagg

SEQ ID NO: 122534 - DNA, 23 bp, Homo sapiens
attttccctttttaaaaaatacc

SEQ ID NO: 122535 - DNA, 18 bp, Homo sapiens
attttcctaatgtgatca

SEQ ID NO: 122536 - DNA, 18 bp, Homo sapiens
attttcctttttcatgta

SEQ ID NO: 122537 - DNA, 14 bp, Homo sapiens
attttcttcccaaa

SEQ ID NO: 122538 - DNA, 18 bp, Homo sapiens
attttgcattagacagat

SEQ ID NO: 122539 - DNA, 15 bp, Homo sapiens
attaaaatattattt

SEQ ID NO: 122540 - DNA, 19 bp, Homo sapiens
attaaagaaataattttat

SEQ ID NO: 122541 - DNA, 12 bp, Homo sapiens
attaagcagaaa

SEQ ID NO: 122542 - DNA, 16 bp, Homo sapiens
attaattgtcctgtgt

SEQ ID NO: 122543 - DNA, 23 bp, Homo sapiens
attaattgtcctgtgtctatgta

SEQ ID NO: 122544 - DNA, 14 bp, Homo sapiens
attacctaatgaaa

SEQ ID NO: 122545 - DNA, 17 bp, Homo sapiens
attacttctgagcccca

SEQ ID NO: 122546 - DNA, 13 bp, Homo sapiens
attacttgaactt

SEQ ID NO: 122547 - DNA, 14 bp, Homo sapiens
attacttgaacttt

SEQ ID NO: 122548 - DNA, 17 bp, Homo sapiens
attagcaactgtgctac

SEQ ID NO: 122549 - DNA, 21 bp, Homo sapiens
attagtgagattaaaaatcta

SEQ ID NO: 122550 - DNA, 15 bp, Homo sapiens
attagttgctttgtt

SEQ ID NO: 122551 - DNA, 19 bp, Homo sapiens
attataatctcatttcaat

SEQ ID NO: 122552 - DNA, 12 bp, Homo sapiens
attataattgtt

SEQ ID NO: 122553 - DNA, 13 bp, Homo sapiens
attataattgttg

SEQ ID NO: 122554 - DNA, 12 bp, Homo sapiens
attatatatcat

SEQ ID NO: 122555 - DNA, 17 bp, Homo sapiens
attatatatcataaagt

SEQ ID NO: 122556 - DNA, 18 bp, Homo sapiens
attatatatcataaagta

SEQ ID NO: 122557 - DNA, 14 bp, Homo sapiens
attatctgcattta

SEQ ID NO: 122558 - DNA, 17 bp, Homo sapiens
attatctgcatttatct

SEQ ID NO: 122559 - DNA, 20 bp, Homo sapiens
attattaattgtcctgtgtc

SEQ ID NO: 122560 - DNA, 16 bp, Homo sapiens
attattctgattccac

SEQ ID NO: 122561 - DNA, 15 bp, Homo sapiens
attattgtagacatg

SEQ ID NO: 122562 - DNA, 12 bp, Homo sapiens
attatttgatat

SEQ ID NO: 122563 - DNA, 14 bp, Homo sapiens
attatttgatatct

SEQ ID NO: 122564 - DNA, 15 bp, Homo sapiens
attatttgatatctg

SEQ ID NO: 122565 - DNA, 18 bp, Homo sapiens
attcaacctgtgtcttat

SEQ ID NO: 122566 - DNA, 18 bp, Homo sapiens
attcaattaaagaaataa

SEQ ID NO: 122567 - DNA, 21 bp, Homo sapiens
attcaattaaagaaataattt

SEQ ID NO: 122568 - DNA, 16 bp, Homo sapiens
attcagaaattaaaat

SEQ ID NO: 122569 - DNA, 10 bp, Homo sapiens
agctgggccc

SEQ ID NO: 122570 - DNA, 16 bp, Homo sapiens
agctgggcccagcccc

SEQ ID NO: 122571 - DNA, 22 bp, Homo sapiens
agctgtgggcaaaagagtgtaa

SEQ ID NO: 122572 - DNA, 23 bp, Homo sapiens
agctgtgggcaaaagagtgtaaa

SEQ ID NO: 122573 - DNA, 21 bp, Homo sapiens
agctgttcttttttgtacttt

SEQ ID NO: 122574 - DNA, 20 bp, Homo sapiens
agcttctagacactccttga

SEQ ID NO: 122575 - DNA, 21 bp, Homo sapiens
agcttgtgctgagcctgccca

SEQ ID NO: 122576 - DNA, 14 bp, Homo sapiens
agcttttaaaaaat

SEQ ID NO: 122577 - DNA, 17 bp, Homo sapiens
agcttttaaaaaatatt

SEQ ID NO: 122578 - DNA, 18 bp, Homo sapiens
agcttttaaaaaatattt

SEQ ID NO: 122579 - DNA, 22 bp, Homo sapiens
agcttttaaaaaatattttaag

SEQ ID NO: 122580 - DNA, 16 bp, Homo sapiens
aggaaaagtgcaatgc

SEQ ID NO: 122581 - DNA, 15 bp, Homo sapiens
aggaaaattgaaagt

SEQ ID NO: 122582 - DNA, 14 bp, Homo sapiens
aggaaatctcaccc

SEQ ID NO: 122583 - DNA, 17 bp, Homo sapiens
aggaaattagtcttttt

SEQ ID NO: 122584 - DNA, 19 bp, Homo sapiens
aggaaccacatataacact

SEQ ID NO: 122585 - DNA, 14 bp, Homo sapiens
aggaagacataaaa

SEQ ID NO: 122586 - DNA, 16 bp, Homo sapiens
aggaagacataaaact

SEQ ID NO: 122587 - DNA, 14 bp, Homo sapiens
aggaatgtgtccaa

SEQ ID NO: 122588 - DNA, 16 bp, Homo sapiens
aggaatgtgtccaaga

SEQ ID NO: 122589 - DNA, 19 bp, Homo sapiens
aggacaaaaagaccttctc

SEQ ID NO: 122590 - DNA, 13 bp, Homo sapiens
aggactgaagctg

SEQ ID NO: 122591 - DNA, 14 bp, Homo sapiens
aggacttcccgagc

SEQ ID NO: 122592 - DNA, 20 bp, Homo sapiens
aggagactgggcacccctgc

SEQ ID NO: 122593 - DNA, 21 bp, Homo sapiens
aggagactgggcacccctgcc

SEQ ID NO: 122594 - DNA, 11 bp, Homo sapiens
aggagccccag

SEQ ID NO: 122595 - DNA, 19 bp, Homo sapiens
aggaggctccgtgagccct

SEQ ID NO: 122596 - DNA, 20 bp, Homo sapiens
aggaggttcgggattccctg

SEQ ID NO: 122597 - DNA, 14 bp, Homo sapiens
aggatataaaagga

SEQ ID NO: 122598 - DNA, 17 bp, Homo sapiens
aggatataaaaggatgt

SEQ ID NO: 122599 - DNA, 15 bp, Homo sapiens
aggatcaccccagcc

SEQ ID NO: 122600 - DNA, 22 bp, Homo sapiens
aggatgttacaagtttgctaaa

SEQ ID NO: 122601 - DNA, 23 bp, Homo sapiens
aggcccaggggtggggcccatgg

SEQ ID NO: 122602 - DNA, 19 bp, Homo sapiens
aggccgctgcccctgagtt

SEQ ID NO: 122603 - DNA, 20 bp, Homo sapiens
aggccgctgcccctgagttc

SEQ ID NO: 122604 - DNA, 18 bp, Homo sapiens
aggccggagacccacagc

SEQ ID NO: 122605 - DNA, 19 bp, Homo sapiens
aggcctcggctgtctcctg

SEQ ID NO: 122606 - DNA, 15 bp, Homo sapiens
aggcctctggccctc

SEQ ID NO: 122607 - DNA, 18 bp, Homo sapiens
aggctccgtgagcccttg

SEQ ID NO: 122608 - DNA, 12 bp, Homo sapiens
aggctgggcagg

SEQ ID NO: 122609 - DNA, 16 bp, Homo sapiens
aggctgggcagggcct

SEQ ID NO: 122610 - DNA, 17 bp, Homo sapiens
aggctgggcagggcctg

SEQ ID NO: 122611 - DNA, 22 bp, Homo sapiens
aggcttatttttaaaataaaaa

SEQ ID NO: 122612 - DNA, 15 bp, Homo sapiens
agggaaggggacaga

SEQ ID NO: 122613 - DNA, 13 bp, Homo sapiens
agggagaggcctc

SEQ ID NO: 122614 - DNA, 22 bp, Homo sapiens
agggcaacaatacatgctgcta

SEQ ID NO: 122615 - DNA, 13 bp, Homo sapiens
agggcattttaaa

SEQ ID NO: 122616 - DNA, 21 bp, Homo sapiens
agggccccaactacacacccc

SEQ ID NO: 122617 - DNA, 21 bp, Homo sapiens
aggggacagatttgaggactg

SEQ ID NO: 122618 - DNA, 23 bp, Homo sapiens
agggggagtgaaacagagaaaga

SEQ ID NO: 122619 - DNA, 14 bp, Homo sapiens
aggggtctgagcca

SEQ ID NO: 122620 - DNA, 11 bp, Homo sapiens
agggtctccag

SEQ ID NO: 122621 - DNA, 12 bp, Homo sapiens
agggtctccagt

SEQ ID NO: 122622 - DNA, 23 bp, Homo sapiens
aggtgaggtccaccggcccctgg

SEQ ID NO: 122623 - DNA, 21 bp, Homo sapiens
aggtggccctcccaggctggt

SEQ ID NO: 122624 - DNA, 16 bp, Homo sapiens
aggtgggtgaggctgg

SEQ ID NO: 122625 - DNA, 14 bp, Homo sapiens
aggttttgaataaa

SEQ ID NO: 122626 - DNA, 21 bp, Homo sapiens
aggttttttttttaagtgcaa

SEQ ID NO: 122627 - DNA, 20 bp, Homo sapiens
agtaagtcttttttttttcc

SEQ ID NO: 122628 - DNA, 23 bp, Homo sapiens
agtaagtcttttttttttccaaa

SEQ ID NO: 122629 - DNA, 22 bp, Homo sapiens
agtaattagtgttgtgcacttc

SEQ ID NO: 122630 - DNA, 21 bp, Homo sapiens
agtacagctgacggtttctcc

SEQ ID NO: 122631 - DNA, 15 bp, Homo sapiens
agtatcttagagttt

SEQ ID NO: 122632 - DNA, 19 bp, Homo sapiens
agtattcagaaattaaaat

SEQ ID NO: 122633 - DNA, 18 bp, Homo sapiens
agtatttataaaaatata

SEQ ID NO: 122634 - DNA, 19 bp, Homo sapiens
agtatttataaaaatataa

SEQ ID NO: 122635 - DNA, 20 bp, Homo sapiens
agtatttataaaaatataaa

SEQ ID NO: 122636 - DNA, 23 bp, Homo sapiens
agtcaaagagagtttttaataga

SEQ ID NO: 122637 - DNA, 19 bp, Homo sapiens
agtcaagaggtttttctcc

SEQ ID NO: 122638 - DNA, 16 bp, Homo sapiens
agtcctgcctcagcct

SEQ ID NO: 122639 - DNA, 16 bp, Homo sapiens
agtcctttgttataat

SEQ ID NO: 122640 - DNA, 16 bp, Homo sapiens
agtcgagcactctaat

SEQ ID NO: 122641 - DNA, 13 bp, Homo sapiens
agtcgtcaagttg

SEQ ID NO: 122642 - DNA, 18 bp, Homo sapiens
agtctatctaatgacatg

SEQ ID NO: 122643 - DNA, 17 bp, Homo sapiens
agtctctgctggcccag

SEQ ID NO: 122644 - DNA, 17 bp, Homo sapiens
agtctttgtgtgttata

SEQ ID NO: 122645 - DNA, 20 bp, Homo sapiens
agtcttttttttttccaaat

SEQ ID NO: 122646 - DNA, 12 bp, Homo sapiens
agtgaaacagag

SEQ ID NO: 122647 - DNA, 19 bp, Homo sapiens
agtgaaacagagaaagaaa

SEQ ID NO: 122648 - DNA, 20 bp, Homo sapiens
agtgaaacagagaaagaaaa

SEQ ID NO: 122649 - DNA, 21 bp, Homo sapiens
agtgaaacagagaaagaaaag

SEQ ID NO: 122650 - DNA, 22 bp, Homo sapiens
agtgaacttttgtaatttgaat

SEQ ID NO: 122651 - DNA, 17 bp, Homo sapiens
agtgacaaagactcctc

SEQ ID NO: 122652 - DNA, 21 bp, Homo sapiens
agtgacaaagactcctctggg

SEQ ID NO: 122653 - DNA, 12 bp, Homo sapiens
agtgagcctctg

SEQ ID NO: 122654 - DNA, 16 bp, Homo sapiens
agtgcaacatttctgt

SEQ ID NO: 122655 - DNA, 14 bp, Homo sapiens
agtgcaatgcgtgt

SEQ ID NO: 122656 - DNA, 19 bp, Homo sapiens
agtgcaatgcgtgttgtac

SEQ ID NO: 122657 - DNA, 20 bp, Homo sapiens
agtgcaattccaagaaaata

SEQ ID NO: 122658 - DNA, 15 bp, Homo sapiens
agtgcagcgggccag

SEQ ID NO: 122659 - DNA, 22 bp, Homo sapiens
agtggccactggcacttgcctg

SEQ ID NO: 122660 - DNA, 16 bp, Homo sapiens
agtggtcaccttcctc

SEQ ID NO: 122661 - DNA, 17 bp, Homo sapiens
agtggtgaccaaaattt

SEQ ID NO: 122662 - DNA, 21 bp, Homo sapiens
agtggtgaccaaaatttttag

SEQ ID NO: 122663 - DNA, 22 bp, Homo sapiens
agtgtaaaatattttaaaataa

SEQ ID NO: 122664 - DNA, 20 bp, Homo sapiens
agtgtaaataattttaaata

SEQ ID NO: 122665 - DNA, 22 bp, Homo sapiens
agtgtaaataattttaaataac

SEQ ID NO: 122666 - DNA, 19 bp, Homo sapiens
agtgtcctatgcaataaaa

SEQ ID NO: 122667 - DNA, 19 bp, Homo sapiens
agtgtctcttgactggctc

SEQ ID NO: 122668 - DNA, 20 bp, Homo sapiens
agtgtctcttgactggctca

SEQ ID NO: 122669 - DNA, 23 bp, Homo sapiens
agtgttggtttaatattacctaa

SEQ ID NO: 122670 - DNA, 15 bp, Homo sapiens
caaacaaaaaaaaga

SEQ ID NO: 122671 - DNA, 18 bp, Homo sapiens
caaacaaaaaaaagaacc

SEQ ID NO: 122672 - DNA, 22 bp, Homo sapiens
caaaccagtttattctgtggtt

SEQ ID NO: 122673 - DNA, 19 bp, Homo sapiens
caaacccatgaagctggcc

SEQ ID NO: 122674 - DNA, 21 bp, Homo sapiens
caaacccatgaagctggccct

SEQ ID NO: 122675 - DNA, 16 bp, Homo sapiens
caaaccctttgtatta

SEQ ID NO: 122676 - DNA, 21 bp, Homo sapiens
caaaccctttgtattataatt

SEQ ID NO: 122677 - DNA, 18 bp, Homo sapiens
caaacctagcttttaaaa

SEQ ID NO: 122678 - DNA, 21 bp, Homo sapiens
caaacctagcttttaaaaaat

SEQ ID NO: 122679 - DNA, 16 bp, Homo sapiens
caaactaaggagtgac

SEQ ID NO: 122680 - DNA, 16 bp, Homo sapiens
caaactgatttctcac

SEQ ID NO: 122681 - DNA, 22 bp, Homo sapiens
caaagactcctctgggcctggg

SEQ ID NO: 122682 - DNA, 20 bp, Homo sapiens
caaagatatgctaagcagta

SEQ ID NO: 122683 - DNA, 14 bp, Homo sapiens
caaagccacatttt

SEQ ID NO: 122684 - DNA, 23 bp, Homo sapiens
caaagctctattaagatttccaa

SEQ ID NO: 122685 - DNA, 14 bp, Homo sapiens
caaagttatattta

SEQ ID NO: 122686 - DNA, 17 bp, Homo sapiens
caaagttatatttactt

SEQ ID NO: 122687 - DNA, 19 bp, Homo sapiens
caaatccaaggaaacatgc

SEQ ID NO: 122688 - DNA, 13 bp, Homo sapiens
caaatgaactttt

SEQ ID NO: 122689 - DNA, 14 bp, Homo sapiens
caaatgaactttta

SEQ ID NO: 122690 - DNA, 19 bp, Homo sapiens
caaatgaacttttacagaa

SEQ ID NO: 122691 - DNA, 22 bp, Homo sapiens
caaatgaacttttacagaatgc

SEQ ID NO: 122692 - DNA, 12 bp, Homo sapiens
caaatgcaaatt

SEQ ID NO: 122693 - DNA, 15 bp, Homo sapiens
caaattattaattgt

SEQ ID NO: 122694 - DNA, 19 bp, Homo sapiens
caaatttctataaatttaa

SEQ ID NO: 122695 - DNA, 22 bp, Homo sapiens
caacaatacatgctgctaattc

SEQ ID NO: 122696 - DNA, 21 bp, Homo sapiens
caacatttctgtatactgtaa

SEQ ID NO: 122697 - DNA, 14 bp, Homo sapiens
caactaggggagga

SEQ ID NO: 122698 - DNA, 16 bp, Homo sapiens
caactcaaagatgatg

SEQ ID NO: 122699 - DNA, 14 bp, Homo sapiens
caagaattaaaact

SEQ ID NO: 122700 - DNA, 16 bp, Homo sapiens
caagaattaaaactga

SEQ ID NO: 122701 - DNA, 17 bp, Homo sapiens
caagaattaaaactgag

SEQ ID NO: 122702 - DNA, 14 bp, Homo sapiens
caagacaaagcaaa

SEQ ID NO: 122703 - DNA, 13 bp, Homo sapiens
caagacacatgct

SEQ ID NO: 122704 - DNA, 19 bp, Homo sapiens
caagacacatgctgaggtt

SEQ ID NO: 122705 - DNA, 17 bp, Homo sapiens
caagacttcactgcagc

SEQ ID NO: 122706 - DNA, 21 bp, Homo sapiens
caagacttcactgcagccttt

SEQ ID NO: 122707 - DNA, 12 bp, Homo sapiens
caagagaacatt

SEQ ID NO: 122708 - DNA, 21 bp, Homo sapiens
caagatatatgtgtatacata

SEQ ID NO: 122709 - DNA, 14 bp, Homo sapiens
caaggaatgtgtcc

SEQ ID NO: 122710 - DNA, 19 bp, Homo sapiens
caaggtaggctgcaaaatt

SEQ ID NO: 122711 - DNA, 23 bp, Homo sapiens
caaggtttcccagtgagcctctg

SEQ ID NO: 122712 - DNA, 23 bp, Homo sapiens
caagtctctgctggcccagccaa

SEQ ID NO: 122713 - DNA, 22 bp, Homo sapiens
caagtgtcctggaccctggcct

SEQ ID NO: 122714 - DNA, 17 bp, Homo sapiens
caagtttgctaaaagaa

SEQ ID NO: 122715 - DNA, 13 bp, Homo sapiens
caataaacagctg

SEQ ID NO: 122716 - DNA, 14 bp, Homo sapiens
caatacaaagatga

SEQ ID NO: 122717 - DNA, 17 bp, Homo sapiens
caatacatgctgctaat

SEQ ID NO: 122718 - DNA, 15 bp, Homo sapiens
caatagaaagaaact

SEQ ID NO: 122719 - DNA, 15 bp, Homo sapiens
caatagttcttaaaa

SEQ ID NO: 122720 - DNA, 20 bp, Homo sapiens
caatatatagctggcaagaa

SEQ ID NO: 122721 - DNA, 22 bp, Homo sapiens
caatccaggcccggtgaggcca

SEQ ID NO: 122722 - DNA, 20 bp, Homo sapiens
caatcgacatcctagcccca

SEQ ID NO: 122723 - DNA, 20 bp, Homo sapiens
caatgccacatacttgcagc

SEQ ID NO: 122724 - DNA, 14 bp, Homo sapiens
caatgtcagaaact

SEQ ID NO: 122725 - DNA, 15 bp, Homo sapiens
caatgtgatctatgt

SEQ ID NO: 122726 - DNA, 16 bp, Homo sapiens
caatgtgatctatgtt

SEQ ID NO: 122727 - DNA, 22 bp, Homo sapiens
caatgtgatctatgtttcatct

SEQ ID NO: 122728 - DNA, 13 bp, Homo sapiens
caattaaagaaat

SEQ ID NO: 122729 - DNA, 15 bp, Homo sapiens
caattaaagaaataa

SEQ ID NO: 122730 - DNA, 15 bp, Homo sapiens
caattccaagaaaat

SEQ ID NO: 122731 - DNA, 11 bp, Homo sapiens
caatttataac

SEQ ID NO: 122732 - DNA, 21 bp, Homo sapiens
cacaacgctctaccctgcagc

SEQ ID NO: 122733 - DNA, 14 bp, Homo sapiens
cacacaagtgcagt

SEQ ID NO: 122734 - DNA, 14 bp, Homo sapiens
cacaccgctggctc

SEQ ID NO: 122735 - DNA, 15 bp, Homo sapiens
cacaccgctggctcc

SEQ ID NO: 122736 - DNA, 16 bp, Homo sapiens
cacagactccggcctg

SEQ ID NO: 122737 - DNA, 12 bp, Homo sapiens
cacagcccaggg

SEQ ID NO: 122738 - DNA, 14 bp, Homo sapiens
cacagccctgaaac

SEQ ID NO: 122739 - DNA, 22 bp, Homo sapiens
cacagccctgaaacgagaagtg

SEQ ID NO: 122740 - DNA, 11 bp, Homo sapiens
cacagccctgg

SEQ ID NO: 122741 - DNA, 14 bp, Homo sapiens
cacagccctggaat

SEQ ID NO: 122742 - DNA, 16 bp, Homo sapiens
cacaggactctgcaga

SEQ ID NO: 122743 - DNA, 20 bp, Homo sapiens
cacatataaaagttaaacta

SEQ ID NO: 122744 - DNA, 15 bp, Homo sapiens
cacatatatgtatat

SEQ ID NO: 122745 - DNA, 13 bp, Homo sapiens
cacattttatgag

SEQ ID NO: 122746 - DNA, 16 bp, Homo sapiens
atgctatcagaaacag

SEQ ID NO: 122747 - DNA, 20 bp, Homo sapiens
atgcttcaaagtccacatta

SEQ ID NO: 122748 - DNA, 22 bp, Homo sapiens
atgctttgagaagaatgtttaa

SEQ ID NO: 122749 - DNA, 16 bp, Homo sapiens
atggaaacgcacttac

SEQ ID NO: 122750 - DNA, 18 bp, Homo sapiens
atggaaacgcacttacaa

SEQ ID NO: 122751 - DNA, 16 bp, Homo sapiens
atggactgtgaatttc

SEQ ID NO: 122752 - DNA, 17 bp, Homo sapiens
atggactgtgaatttca

SEQ ID NO: 122753 - DNA, 20 bp, Homo sapiens
atggcccagccactgcagca

SEQ ID NO: 122754 - DNA, 20 bp, Homo sapiens
atggccgcagggctgtgcac

SEQ ID NO: 122755 - DNA, 19 bp, Homo sapiens
atggcctgagactttcttt

SEQ ID NO: 122756 - DNA, 13 bp, Homo sapiens
atgggaaaaagag

SEQ ID NO: 122757 - DNA, 17 bp, Homo sapiens
atgggaaaaagagactc

SEQ ID NO: 122758 - DNA, 17 bp, Homo sapiens
atgggcgcaggcccagt

SEQ ID NO: 122759 - DNA, 19 bp, Homo sapiens
atgggcgcaggcccagtga

SEQ ID NO: 122760 - DNA, 19 bp, Homo sapiens
atggtatactactgctttg

SEQ ID NO: 122761 - DNA, 22 bp, Homo sapiens
atggtggcttcttttctttgta

SEQ ID NO: 122762 - DNA, 19 bp, Homo sapiens
atgtaattaactgtaaact

SEQ ID NO: 122763 - DNA, 19 bp, Homo sapiens
atgtatatctatatctcta

SEQ ID NO: 122764 - DNA, 13 bp, Homo sapiens
atgtatatgtata

SEQ ID NO: 122765 - DNA, 18 bp, Homo sapiens
atgtatatgtatatctat

SEQ ID NO: 122766 - DNA, 19 bp, Homo sapiens
atgtatatgtatatctata

SEQ ID NO: 122767 - DNA, 18 bp, Homo sapiens
atgtattttcctaatgtg

SEQ ID NO: 122768 - DNA, 13 bp, Homo sapiens
atgtcagaaactc

SEQ ID NO: 122769 - DNA, 20 bp, Homo sapiens
atgttacaagtttgctaaaa

SEQ ID NO: 122770 - DNA, 14 bp, Homo sapiens
atgttctgcaagaa

SEQ ID NO: 122771 - DNA, 20 bp, Homo sapiens
caccgaggagccccagcccc

SEQ ID NO: 122772 - DNA, 13 bp, Homo sapiens
cacctatggccca

SEQ ID NO: 122773 - DNA, 18 bp, Homo sapiens
cacctatggcccagccac

SEQ ID NO: 122774 - DNA, 20 bp, Homo sapiens
cacctatggcccagccactg

SEQ ID NO: 122775 - DNA, 21 bp, Homo sapiens
cacctatggcccagccactgc

SEQ ID NO: 122776 - DNA, 23 bp, Homo sapiens
cacctatggcccagccactgcag

SEQ ID NO: 122777 - DNA, 15 bp, Homo sapiens
cacctgacctctgca

SEQ ID NO: 122778 - DNA, 18 bp, Homo sapiens
cacctgacctctgcaaga

SEQ ID NO: 122779 - DNA, 20 bp, Homo sapiens
cacctggtactgcacatttt

SEQ ID NO: 122780 - DNA, 15 bp, Homo sapiens
cacctgtctcagcct

SEQ ID NO: 122781 - DNA, 18 bp, Homo sapiens
cacctgtctcagcctccc

SEQ ID NO: 122782 - DNA, 19 bp, Homo sapiens
cacctgtctcagcctccca

SEQ ID NO: 122783 - DNA, 19 bp, Homo sapiens
cactaggtgaacagcagga

SEQ ID NO: 122784 - DNA, 15 bp, Homo sapiens
cactgacagcctccc

SEQ ID NO: 122785 - DNA, 16 bp, Homo sapiens
cactgacagcctccca

SEQ ID NO: 122786 - DNA, 17 bp, Homo sapiens
cactgacagcctcccac

SEQ ID NO: 122787 - DNA, 19 bp, Homo sapiens
cactgattccctctcccac

SEQ ID NO: 122788 - DNA, 13 bp, Homo sapiens
cactgcagccttt

SEQ ID NO: 122789 - DNA, 14 bp, Homo sapiens
cactgcagcctttc

SEQ ID NO: 122790 - DNA, 21 bp, Homo sapiens
cactggcacttgcctgctgct

SEQ ID NO: 122791 - DNA, 18 bp, Homo sapiens
cactgtttcatgagccca

SEQ ID NO: 122792 - DNA, 18 bp, Homo sapiens
cacttcatgcccactgcc

SEQ ID NO: 122793 - DNA, 14 bp, Homo sapiens
cacttgcctgctgc

SEQ ID NO: 122794 - DNA, 14 bp, Homo sapiens
cagaaacagcatat

SEQ ID NO: 122795 - DNA, 14 bp, Homo sapiens
cagaaattaaaata

SEQ ID NO: 122796 - DNA, 22 bp, Homo sapiens
cagaaattaaaatattatttga

SEQ ID NO: 122797 - DNA, 12 bp, Homo sapiens
cagaataaaatt

SEQ ID NO: 122798 - DNA, 15 bp, Homo sapiens
cagaatgcattaaaa

SEQ ID NO: 122799 - DNA, 16 bp, Homo sapiens
cagaatgcattaaaaa

SEQ ID NO: 122800 - DNA, 17 bp, Homo sapiens
cagaatgcattaaaaaa

SEQ ID NO: 122801 - DNA, 18 bp, Homo sapiens
cagaatgcattaaaaaaa

SEQ ID NO: 122802 - DNA, 16 bp, Homo sapiens
cagaatggagaaagta

SEQ ID NO: 122803 - DNA, 16 bp, Homo sapiens
cagaattgaaggagaa

SEQ ID NO: 122804 - DNA, 11 bp, Homo sapiens
cagagaaagaa

SEQ ID NO: 122805 - DNA, 15 bp, Homo sapiens
cagaggacccacctg

SEQ ID NO: 122806 - DNA, 20 bp, Homo sapiens
cagaggccgctgcccctgag

SEQ ID NO: 122807 - DNA, 20 bp, Homo sapiens
cagaggtggccctcccaggc

SEQ ID NO: 122808 - DNA, 23 bp, Homo sapiens
cagaggtggccctcccaggctgg

SEQ ID NO: 122809 - DNA, 15 bp, Homo sapiens
cagagttctgctcta

SEQ ID NO: 122810 - DNA, 14 bp, Homo sapiens
cagatagtgcctct

SEQ ID NO: 122811 - DNA, 15 bp, Homo sapiens
cagatctttttgtga

SEQ ID NO: 122812 - DNA, 15 bp, Homo sapiens
cagatttgaggactg

SEQ ID NO: 122813 - DNA, 17 bp, Homo sapiens
cagcacagcccagggcc

SEQ ID NO: 122814 - DNA, 14 bp, Homo sapiens
cagcaggatgccct

SEQ ID NO: 122815 - DNA, 17 bp, Homo sapiens
cagcatgacaaaaataa

SEQ ID NO: 122816 - DNA, 22 bp, Homo sapiens
cagcatgacaaaaataacactg

SEQ ID NO: 122817 - DNA, 23 bp, Homo sapiens
cagcatgacaaaaataacactgt

SEQ ID NO: 122818 - DNA, 17 bp, Homo sapiens
cagccaaaccctgtctg

SEQ ID NO: 122819 - DNA, 11 bp, Homo sapiens
cagccaaggaa

SEQ ID NO: 122820 - DNA, 18 bp, Homo sapiens
cagccaaggaatgtgtcc

SEQ ID NO: 122821 - DNA, 20 bp, Homo sapiens
cagccaaggaatgtgtccaa

SEQ ID NO: 122822 - DNA, 14 bp, Homo sapiens
cagccacaccgctg

SEQ ID NO: 122823 - DNA, 19 bp, Homo sapiens
cagccactgcagcacagga

SEQ ID NO: 122824 - DNA, 16 bp, Homo sapiens
cagcccacccagcaga

SEQ ID NO: 122825 - DNA, 16 bp, Homo sapiens
cagcccagggcctgca

SEQ ID NO: 122826 - DNA, 13 bp, Homo sapiens
cagcccccacagc

SEQ ID NO: 122827 - DNA, 19 bp, Homo sapiens
cagcccccacagccctgga

SEQ ID NO: 122828 - DNA, 16 bp, Homo sapiens
cagccccgtcccagag

SEQ ID NO: 122829 - DNA, 17 bp, Homo sapiens
cagccccgtcccagagg

SEQ ID NO: 122830 - DNA, 20 bp, Homo sapiens
cagccctgaaacgagaagtg

SEQ ID NO: 122831 - DNA, 16 bp, Homo sapiens
cagcctcccaccccca

SEQ ID NO: 122832 - DNA, 18 bp, Homo sapiens
cagcctcccacccccatc

SEQ ID NO: 122833 - DNA, 19 bp, Homo sapiens
cagcctcccacccccatct

SEQ ID NO: 122834 - DNA, 22 bp, Homo sapiens
cagcctttcacaggactctgca

SEQ ID NO: 122835 - DNA, 15 bp, Homo sapiens
cagctcagctgggcc

SEQ ID NO: 122836 - DNA, 14 bp, Homo sapiens
cagctccctgaccc

SEQ ID NO: 122837 - DNA, 16 bp, Homo sapiens
cagctccctgaccccc

SEQ ID NO: 122838 - DNA, 22 bp, Homo sapiens
cagctccctgaccccctgtcct

SEQ ID NO: 122839 - DNA, 15 bp, Homo sapiens
cagctctcctggctc

SEQ ID NO: 122840 - DNA, 15 bp, Homo sapiens
cagctctctctcctg

SEQ ID NO: 122841 - DNA, 20 bp, Homo sapiens
cagctgggccactcctcttc

SEQ ID NO: 122842 - DNA, 22 bp, Homo sapiens
cagctgggccactcctcttcac

SEQ ID NO: 122843 - DNA, 13 bp, Homo sapiens
cagcttggagaac

SEQ ID NO: 122844 - DNA, 16 bp, Homo sapiens
caggagcagcccaccc

SEQ ID NO: 122845 - DNA, 22 bp, Homo sapiens
caggagcagcccacccagcaga

SEQ ID NO: 122846 - DNA, 19 bp, Homo sapiens
caggagggagagcctctgt

SEQ ID NO: 122847 - DNA, 21 bp, Homo sapiens
caggatgccctgttgggggct

SEQ ID NO: 122848 - DNA, 19 bp, Homo sapiens
caggcgatccacctgtctc

SEQ ID NO: 122849 - DNA, 13 bp, Homo sapiens
caggctggtctca

SEQ ID NO: 122850 - DNA, 23 bp, Homo sapiens
atttctctgttccatagttaaag

SEQ ID NO: 122851 - DNA, 13 bp, Homo sapiens
atttcttaaaatt

SEQ ID NO: 122852 - DNA, 17 bp, Homo sapiens
atttgaggactgaagct

SEQ ID NO: 122853 - DNA, 19 bp, Homo sapiens
atttgaggactgaagctgg

SEQ ID NO: 122854 - DNA, 19 bp, Homo sapiens
attttaaaataaactttct

SEQ ID NO: 122855 - DNA, 23 bp, Homo sapiens
attttaaataacctctggccctt

SEQ ID NO: 122856 - DNA, 13 bp, Homo sapiens
attttaagaaaga

SEQ ID NO: 122857 - DNA, 21 bp, Homo sapiens
attttaagaaagagaatgaac

SEQ ID NO: 122858 - DNA, 17 bp, Homo sapiens
attttaagacgtgaatg

SEQ ID NO: 122859 - DNA, 21 bp, Homo sapiens
attttactgacagaaatgcaa

SEQ ID NO: 122860 - DNA, 15 bp, Homo sapiens
attttaggaaaggat

SEQ ID NO: 122861 - DNA, 18 bp, Homo sapiens
attttattgtcagaattt

SEQ ID NO: 122862 - DNA, 16 bp, Homo sapiens
attttcaccccaccct

SEQ ID NO: 122863 - DNA, 20 bp, Homo sapiens
attttccctttttaaaaaat

SEQ ID NO: 122864 - DNA, 22 bp, Homo sapiens
attttccctttttaaaaaatac

SEQ ID NO: 122865 - DNA, 22 bp, Homo sapiens
attttcctaatgtgatcatatg

SEQ ID NO: 122866 - DNA, 18 bp, Homo sapiens
atttttaaaataaaaata

SEQ ID NO: 122867 - DNA, 19 bp, Homo sapiens
atttttgaaaaatattgct

SEQ ID NO: 122868 - DNA, 23 bp, Homo sapiens
atttttgaaaaatattgctaaaa

SEQ ID NO: 122869 - DNA, 14 bp, Homo sapiens
atttttgtataaaa

SEQ ID NO: 122870 - DNA, 19 bp, Homo sapiens
atttttgtattcaattaaa

SEQ ID NO: 122871 - DNA, 14 bp, Homo sapiens
caaaaaaaagaacc

SEQ ID NO: 122872 - DNA, 20 bp, Homo sapiens
caccctgtctcagtacctcc

SEQ ID NO: 122873 - DNA, 13 bp, Homo sapiens
caccgaggagccc

SEQ ID NO: 122874 - DNA, 16 bp, Homo sapiens
caccgaggagccccag

SEQ ID NO: 122875 - DNA, 22 bp, Homo sapiens
caccgaggagccccagccccgt

SEQ ID NO: 122876 - DNA, 13 bp, Homo sapiens
caccgctggctcc

SEQ ID NO: 122877 - DNA, 17 bp, Homo sapiens
cacctgggccaaggact

SEQ ID NO: 122878 - DNA, 12 bp, Homo sapiens
caccttcctcag

SEQ ID NO: 122879 - DNA, 17 bp, Homo sapiens
cacgcgccctttctacc

SEQ ID NO: 122880 - DNA, 14 bp, Homo sapiens
cactaggagactgg

SEQ ID NO: 122881 - DNA, 15 bp, Homo sapiens
cactaggagactggt

SEQ ID NO: 122882 - DNA, 16 bp, Homo sapiens
cactaggtgaacagca

SEQ ID NO: 122883 - DNA, 13 bp, Homo sapiens
cactgacagcctc

SEQ ID NO: 122884 - DNA, 14 bp, Homo sapiens
cactgacagcctcc

SEQ ID NO: 122885 - DNA, 14 bp, Homo sapiens
cactgattccctct

SEQ ID NO: 122886 - DNA, 17 bp, Homo sapiens
cactgattccctctccc

SEQ ID NO: 122887 - DNA, 15 bp, Homo sapiens
cactgccgatgccca

SEQ ID NO: 122888 - DNA, 16 bp, Homo sapiens
cactgccgatgcccaa

SEQ ID NO: 122889 - DNA, 11 bp, Homo sapiens
cactggcactt

SEQ ID NO: 122890 - DNA, 20 bp, Homo sapiens
cactggcacttgcctgctgc

SEQ ID NO: 122891 - DNA, 13 bp, Homo sapiens
cactgttgaattt

SEQ ID NO: 122892 - DNA, 17 bp, Homo sapiens
cactgttgaattttctc

SEQ ID NO: 122893 - DNA, 16 bp, Homo sapiens
cacttcatgcccactg

SEQ ID NO: 122894 - DNA, 17 bp, Homo sapiens
cacttcatgcccactgc

SEQ ID NO: 122895 - DNA, 12 bp, Homo sapiens
cagaaattaaaa

SEQ ID NO: 122896 - DNA, 15 bp, Homo sapiens
cagaaattaaaatat

SEQ ID NO: 122897 - DNA, 13 bp, Homo sapiens
cagaagggctctt

SEQ ID NO: 122898 - DNA, 15 bp, Homo sapiens
cagaatggagaaagt

SEQ ID NO: 122899 - DNA, 17 bp, Homo sapiens
cagaatggagaaagtaa

SEQ ID NO: 122900 - DNA, 20 bp, Homo sapiens
cagaatggagaaagtaagtc

SEQ ID NO: 122901 - DNA, 20 bp, Homo sapiens
cagacagtcacaaatttctc

SEQ ID NO: 122902 - DNA, 12 bp, Homo sapiens
cagacatttata

SEQ ID NO: 122903 - DNA, 13 bp, Homo sapiens
cagagaaagaaaa

SEQ ID NO: 122904 - DNA, 17 bp, Homo sapiens
cagagaaagaaaaggca

SEQ ID NO: 122905 - DNA, 18 bp, Homo sapiens
cagagaaagaaaaggcaa

SEQ ID NO: 122906 - DNA, 14 bp, Homo sapiens
cagagcacctgtag

SEQ ID NO: 122907 - DNA, 16 bp, Homo sapiens
cagaggacccacctgg

SEQ ID NO: 122908 - DNA, 18 bp, Homo sapiens
cagaggccgctgcccctg

SEQ ID NO: 122909 - DNA, 22 bp, Homo sapiens
cagaggtaactatcaatattta

SEQ ID NO: 122910 - DNA, 21 bp, Homo sapiens
cagaggtcatcccttcctcct

SEQ ID NO: 122911 - DNA, 17 bp, Homo sapiens
cagaggtggccctccca

SEQ ID NO: 122912 - DNA, 18 bp, Homo sapiens
cagaggtggccctcccag

SEQ ID NO: 122913 - DNA, 14 bp, Homo sapiens
cagatgcagttttc

SEQ ID NO: 122914 - DNA, 21 bp, Homo sapiens
cagatgcagttttcaaattat

SEQ ID NO: 122915 - DNA, 13 bp, Homo sapiens
cagcacagcccag

SEQ ID NO: 122916 - DNA, 16 bp, Homo sapiens
cagcacagcccagggc

SEQ ID NO: 122917 - DNA, 16 bp, Homo sapiens
cagcaggatgccctgt

SEQ ID NO: 122918 - DNA, 21 bp, Homo sapiens
cagcatgacaaaaataacact

SEQ ID NO: 122919 - DNA, 23 bp, Homo sapiens
cagcattacgatcccccaagtgt

SEQ ID NO: 122920 - DNA, 15 bp, Homo sapiens
cagccaaaccctgtc

SEQ ID NO: 122921 - DNA, 16 bp, Homo sapiens
cagccaaaccctgtct

SEQ ID NO: 122922 - DNA, 19 bp, Homo sapiens
cagccaaggaatgtgtcca

SEQ ID NO: 122923 - DNA, 18 bp, Homo sapiens
cagccacaccgctggctc

SEQ ID NO: 122924 - DNA, 12 bp, Homo sapiens
cagccacatggg

SEQ ID NO: 122925 - DNA, 14 bp, Homo sapiens
cagccactgcagca

SEQ ID NO: 122926 - DNA, 15 bp, Homo sapiens
cagcccagggcctgc

SEQ ID NO: 122927 - DNA, 19 bp, Homo sapiens
cagcccagggcctgcatgg

SEQ ID NO: 122928 - DNA, 12 bp, Homo sapiens
cagcccccacag

SEQ ID NO: 122929 - DNA, 16 bp, Homo sapiens
cagcccccacagccct

SEQ ID NO: 122930 - DNA, 17 bp, Homo sapiens
cagcccccacagccctg

SEQ ID NO: 122931 - DNA, 18 bp, Homo sapiens
cagcccccacagccctgg

SEQ ID NO: 122932 - DNA, 11 bp, Homo sapiens
cagccctgaaa

SEQ ID NO: 122933 - DNA, 14 bp, Homo sapiens
cagcctgctcagca

SEQ ID NO: 122934 - DNA, 15 bp, Homo sapiens
cagcgggccaggcag

SEQ ID NO: 122935 - DNA, 16 bp, Homo sapiens
cagctctcctggctcc

SEQ ID NO: 122936 - DNA, 17 bp, Homo sapiens
cagctctcctggctccc

SEQ ID NO: 122937 - DNA, 17 bp, Homo sapiens
cagctctctctcctgga

SEQ ID NO: 122938 - DNA, 19 bp, Homo sapiens
cagctgacggtttctcccc

SEQ ID NO: 122939 - DNA, 22 bp, Homo sapiens
cagcttgtgctgagcctgccca

SEQ ID NO: 122940 - DNA, 19 bp, Homo sapiens
caggaggctccgtgagccc

SEQ ID NO: 122941 - DNA, 12 bp, Homo sapiens
caggagggagag

SEQ ID NO: 122942 - DNA, 18 bp, Homo sapiens
caggatgccctgttgggg

SEQ ID NO: 122943 - DNA, 22 bp, Homo sapiens
caggcatcactgattccctctc

SEQ ID NO: 122944 - DNA, 18 bp, Homo sapiens
caggccaggtgaggtcca

SEQ ID NO: 122945 - DNA, 23 bp, Homo sapiens
caggctggtatttatctgcaagg

SEQ ID NO: 122946 - DNA, 18 bp, Homo sapiens
caggcttatttttaaaat

SEQ ID NO: 122947 - DNA, 19 bp, Homo sapiens
cagggagaagttgagcagg

SEQ ID NO: 122948 - DNA, 21 bp, Homo sapiens
cagggagaggcctcggctgtc

SEQ ID NO: 122949 - DNA, 14 bp, Homo sapiens
cagggattctctca

SEQ ID NO: 122950 - DNA, 23 bp, Homo sapiens
cagggcctgcatgggggcaccgg

SEQ ID NO: 122951 - DNA, 13 bp, Homo sapiens
caggggtctgagc

SEQ ID NO: 122952 - DNA, 21 bp, Homo sapiens
cagggtgaagcaccagggaga

SEQ ID NO: 122953 - DNA, 22 bp, Homo sapiens
cagggtgaagcaccagggagag

SEQ ID NO: 122954 - DNA, 21 bp, Homo sapiens
ccaatgccacatacttgcagc

SEQ ID NO: 122955 - DNA, 16 bp, Homo sapiens
ccacaccgctggctcc

SEQ ID NO: 122956 - DNA, 17 bp, Homo sapiens
ccacaccgctggctccg

SEQ ID NO: 122957 - DNA, 11 bp, Homo sapiens
ccacagccctg

SEQ ID NO: 122958 - DNA, 12 bp, Homo sapiens
ccacagccctga

SEQ ID NO: 122959 - DNA, 15 bp, Homo sapiens
ccacagccctggaat

SEQ ID NO: 122960 - DNA, 20 bp, Homo sapiens
ccacatgggaggaaggccca

SEQ ID NO: 122961 - DNA, 21 bp, Homo sapiens
ccaccatggccagccaacttt

SEQ ID NO: 122962 - DNA, 16 bp, Homo sapiens
ccacccaaggagaacg

SEQ ID NO: 122963 - DNA, 15 bp, Homo sapiens
ccacccagaggtggc

SEQ ID NO: 122964 - DNA, 19 bp, Homo sapiens
ccacccagaggtggccctc

SEQ ID NO: 122965 - DNA, 17 bp, Homo sapiens
ccaccccacagactccg

SEQ ID NO: 122966 - DNA, 17 bp, Homo sapiens
ccaccggcccctggcag

SEQ ID NO: 122967 - DNA, 16 bp, Homo sapiens
ccacctgacctctgca

SEQ ID NO: 122968 - DNA, 12 bp, Homo sapiens
ccacctgtctca

SEQ ID NO: 122969 - DNA, 16 bp, Homo sapiens
ccacctgtctcagcct

SEQ ID NO: 122970 - DNA, 18 bp, Homo sapiens
ccacctgtctcagcctcc

SEQ ID NO: 122971 - DNA, 23 bp, Homo sapiens
ccacctgtctcagcctcccagag

SEQ ID NO: 122972 - DNA, 23 bp, Homo sapiens
ccacgtgatttccagtgagtgta

SEQ ID NO: 122973 - DNA, 16 bp, Homo sapiens
ccactgacagcctccc

SEQ ID NO: 122974 - DNA, 12 bp, Homo sapiens
ccgccaccctgt

SEQ ID NO: 122975 - DNA, 14 bp, Homo sapiens
ccgccctccaccca

SEQ ID NO: 122976 - DNA, 13 bp, Homo sapiens
ccgctgcccctga

SEQ ID NO: 122977 - DNA, 20 bp, Homo sapiens
ccgctggatggggagtctca

SEQ ID NO: 122978 - DNA, 21 bp, Homo sapiens
ccgctggatggggagtctcat

SEQ ID NO: 122979 - DNA, 15 bp, Homo sapiens
ccggagacccacagc

SEQ ID NO: 122980 - DNA, 17 bp, Homo sapiens
ccggagacccacagccc

SEQ ID NO: 122981 - DNA, 18 bp, Homo sapiens
ccggagacccacagccct

SEQ ID NO: 122982 - DNA, 19 bp, Homo sapiens
ccggagacccacagccctg

SEQ ID NO: 122983 - DNA, 15 bp, Homo sapiens
ccggcccctggcagc

SEQ ID NO: 122984 - DNA, 20 bp, Homo sapiens
ccggcccctggcagcacagc

SEQ ID NO: 122985 - DNA, 23 bp, Homo sapiens
ccggcctgtaatcagctctcctg

SEQ ID NO: 122986 - DNA, 11 bp, Homo sapiens
ccgtagtctcc

SEQ ID NO: 122987 - DNA, 14 bp, Homo sapiens
ccgtcccagaggcc

SEQ ID NO: 122988 - DNA, 23 bp, Homo sapiens
ccgtcccagaggccgctgcccct

SEQ ID NO: 122989 - DNA, 15 bp, Homo sapiens
cctaaagaggaaaag

SEQ ID NO: 122990 - DNA, 12 bp, Homo sapiens
cctaatgaaagt

SEQ ID NO: 122991 - DNA, 20 bp, Homo sapiens
cctagagactcagaggaccc

SEQ ID NO: 122992 - DNA, 21 bp, Homo sapiens
cctagagactcagaggaccca

SEQ ID NO: 122993 - DNA, 16 bp, Homo sapiens
cctagatatgaatata

SEQ ID NO: 122994 - DNA, 20 bp, Homo sapiens
cctagcccttctaccccacc

SEQ ID NO: 122995 - DNA, 23 bp, Homo sapiens
cctagcccttctaccccacctga

SEQ ID NO: 122996 - DNA, 15 bp, Homo sapiens
cctaggtcatgaagg

SEQ ID NO: 122997 - DNA, 22 bp, Homo sapiens
cctatatctgtttgtatatttg

SEQ ID NO: 122998 - DNA, 12 bp, Homo sapiens
cctatgcaataa

SEQ ID NO: 122999 - DNA, 14 bp, Homo sapiens
cctatggcccagcc

SEQ ID NO: 123000 - DNA, 23 bp, Homo sapiens
cctatggcccagccactgcagca

SEQ ID NO: 123001 - DNA, 16 bp, Homo sapiens
cctcactgttgaattt

SEQ ID NO: 123002 - DNA, 13 bp, Homo sapiens
cctcagcccccag

SEQ ID NO: 123003 - DNA, 14 bp, Homo sapiens
cctcagcccccagg

SEQ ID NO: 123004 - DNA, 18 bp, Homo sapiens
cctcagcccccaggccag

SEQ ID NO: 123005 - DNA, 19 bp, Homo sapiens
cctcagcccccaggccagg

SEQ ID NO: 123006 - DNA, 20 bp, Homo sapiens
cctcagcccccaggccaggt

SEQ ID NO: 123007 - DNA, 16 bp, Homo sapiens
cctcagctccctgacc

SEQ ID NO: 123008 - DNA, 12 bp, Homo sapiens
cctcaggaaaga

SEQ ID NO: 123009 - DNA, 13 bp, Homo sapiens
cctcaggaaagaa

SEQ ID NO: 123010 - DNA, 13 bp, Homo sapiens
cctcagtgctgca

SEQ ID NO: 123011 - DNA, 23 bp, Homo sapiens
cctcatagccctcagacatttat

SEQ ID NO: 123012 - DNA, 14 bp, Homo sapiens
cctcccctgccatt

SEQ ID NO: 123013 - DNA, 14 bp, Homo sapiens
cctccctgctccca

SEQ ID NO: 123014 - DNA, 21 bp, Homo sapiens
cctcctcagcccccaggccag

SEQ ID NO: 123015 - DNA, 14 bp, Homo sapiens
cctcctctcctgga

SEQ ID NO: 123016 - DNA, 15 bp, Homo sapiens
cctcgacgtcccttg

SEQ ID NO: 123017 - DNA, 13 bp, Homo sapiens
cctcggctgtctc

SEQ ID NO: 123018 - DNA, 17 bp, Homo sapiens
cctcggctgtctcctgt

SEQ ID NO: 123019 - DNA, 10 bp, Homo sapiens
cctctcctgg

SEQ ID NO: 123020 - DNA, 13 bp, Homo sapiens
cctctcctggaaa

SEQ ID NO: 123021 - DNA, 14 bp, Homo sapiens
cctctcctggaaac

SEQ ID NO: 123022 - DNA, 18 bp, Homo sapiens
cctctctgtggctccaac

SEQ ID NO: 123023 - DNA, 13 bp, Homo sapiens
cctctggccctcg

SEQ ID NO: 123024 - DNA, 13 bp, Homo sapiens
cctctggcccttg

SEQ ID NO: 123025 - DNA, 16 bp, Homo sapiens
cctctggcccttggaa

SEQ ID NO: 123026 - DNA, 21 bp, Homo sapiens
cctcttcacccaccccatgga

SEQ ID NO: 123027 - DNA, 23 bp, Homo sapiens
cctcttcacccaccccatggaga

SEQ ID NO: 123028 - DNA, 18 bp, Homo sapiens
cctgaaacatgtgcccct

SEQ ID NO: 123029 - DNA, 20 bp, Homo sapiens
cctgaaacatgtgcccctgc

SEQ ID NO: 123030 - DNA, 16 bp, Homo sapiens
cctgaccccctgtcct

SEQ ID NO: 123031 - DNA, 15 bp, Homo sapiens
cctgcagccacatgg

SEQ ID NO: 123032 - DNA, 22 bp, Homo sapiens
cctgcaggtccggggaggaggt

SEQ ID NO: 123033 - DNA, 21 bp, Homo sapiens
cctgccaaggccggagaccca

SEQ ID NO: 123034 - DNA, 22 bp, Homo sapiens
cctgccaaggccggagacccac

SEQ ID NO: 123035 - DNA, 19 bp, Homo sapiens
cctgcccagttggaggaga

SEQ ID NO: 123036 - DNA, 20 bp, Homo sapiens
cctgcccagttggaggagac

SEQ ID NO: 123037 - DNA, 23 bp, Homo sapiens
cctgcccagttggaggagactgg

SEQ ID NO: 123038 - DNA, 21 bp, Homo sapiens
cctgccccacccaccccacag

SEQ ID NO: 123039 - DNA, 13 bp, Homo sapiens
cctgcctcagcct

SEQ ID NO: 123040 - DNA, 22 bp, Homo sapiens
cctgctcccagctctctctcct

SEQ ID NO: 123041 - DNA, 14 bp, Homo sapiens
cctgctcctttctg

SEQ ID NO: 123042 - DNA, 20 bp, Homo sapiens
cctgctgcttggagtgcccc

SEQ ID NO: 123043 - DNA, 17 bp, Homo sapiens
cctggaaacagacaggg

SEQ ID NO: 123044 - DNA, 13 bp, Homo sapiens
cctggaccctggc

SEQ ID NO: 123045 - DNA, 16 bp, Homo sapiens
cctggaccctggccta

SEQ ID NO: 123046 - DNA, 18 bp, Homo sapiens
cctggagtctgaagcctg

SEQ ID NO: 123047 - DNA, 17 bp, Homo sapiens
cctggcagcacagccca

SEQ ID NO: 123048 - DNA, 19 bp, Homo sapiens
cctggcagcacagcccagg

SEQ ID NO: 123049 - DNA, 21 bp, Homo sapiens
cctggcagcacagcccagggc

SEQ ID NO: 123050 - DNA, 23 bp, Homo sapiens
cctggcagcacagcccagggcct

SEQ ID NO: 123051 - DNA, 14 bp, Homo sapiens
cctggcggaggtgg

SEQ ID NO: 123052 - DNA, 22 bp, Homo sapiens
cctggcggaggtggagtggcca

SEQ ID NO: 123053 - DNA, 23 bp, Homo sapiens
cctgggcggggccgcagccacac

SEQ ID NO: 123054 - DNA, 19 bp, Homo sapiens
cctgtaatcagctctcctg

SEQ ID NO: 123055 - DNA, 21 bp, Homo sapiens
cctgtaatcagctctcctggc

SEQ ID NO: 123056 - DNA, 15 bp, Homo sapiens
cctctctgtggctcc

SEQ ID NO: 123057 - DNA, 17 bp, Homo sapiens
cctctctgtggctccaa

SEQ ID NO: 123058 - DNA, 13 bp, Homo sapiens
cctctggaggcct

SEQ ID NO: 123059 - DNA, 15 bp, Homo sapiens
cctctggaggcctct

SEQ ID NO: 123060 - DNA, 21 bp, Homo sapiens
cctctggaggcctctggccct

SEQ ID NO: 123061 - DNA, 22 bp, Homo sapiens
cctctggaggcctctggccctc

SEQ ID NO: 123062 - DNA, 11 bp, Homo sapiens
cctctggccct

SEQ ID NO: 123063 - DNA, 15 bp, Homo sapiens
cctctggcccttgga

SEQ ID NO: 123064 - DNA, 14 bp, Homo sapiens
cctctgggcctggg

SEQ ID NO: 123065 - DNA, 15 bp, Homo sapiens
cctgagttctgacac

SEQ ID NO: 123066 - DNA, 16 bp, Homo sapiens
cctgagttctgacact

SEQ ID NO: 123067 - DNA, 17 bp, Homo sapiens
cctgagttctgacactg

SEQ ID NO: 123068 - DNA, 20 bp, Homo sapiens
cctgagttctgacactgtgt

SEQ ID NO: 123069 - DNA, 18 bp, Homo sapiens
cctgcatgggggcaccgg

SEQ ID NO: 123070 - DNA, 19 bp, Homo sapiens
cctgcatgggggcaccggg

SEQ ID NO: 123071 - DNA, 23 bp, Homo sapiens
cctgccaaggccggagacccaca

SEQ ID NO: 123072 - DNA, 14 bp, Homo sapiens
cctgcccagttgga

SEQ ID NO: 123073 - DNA, 21 bp, Homo sapiens
cctgcctcctgcctcccgcct

SEQ ID NO: 123074 - DNA, 20 bp, Homo sapiens
cctgcggagaccctgagtcc

SEQ ID NO: 123075 - DNA, 21 bp, Homo sapiens
cttatcatttttgtataaaaa

SEQ ID NO: 123076 - DNA, 14 bp, Homo sapiens
cttatttgtataat

SEQ ID NO: 123077 - DNA, 17 bp, Homo sapiens
cttatttttaaaataaa

SEQ ID NO: 123078 - DNA, 17 bp, Homo sapiens
cttcacccaccccatgg

SEQ ID NO: 123079 - DNA, 13 bp, Homo sapiens
cttcactgcagcc

SEQ ID NO: 123080 - DNA, 14 bp, Homo sapiens
cttcaggtctctgt

SEQ ID NO: 123081 - DNA, 17 bp, Homo sapiens
cttcatgcccactgccg

SEQ ID NO: 123082 - DNA, 21 bp, Homo sapiens
cttcccaaatcaaaataaaag

SEQ ID NO: 123083 - DNA, 19 bp, Homo sapiens
cttcctcagctcagctggg

SEQ ID NO: 123084 - DNA, 21 bp, Homo sapiens
cttcctcagctcagctgggcc

SEQ ID NO: 123085 - DNA, 22 bp, Homo sapiens
cttcctcagctcagctgggcca

SEQ ID NO: 123086 - DNA, 17 bp, Homo sapiens
cttcctcctctcctgga

SEQ ID NO: 123087 - DNA, 20 bp, Homo sapiens
cttctaccccacctgacctc

SEQ ID NO: 123088 - DNA, 19 bp, Homo sapiens
cttctagacactccttgaa

SEQ ID NO: 123089 - DNA, 17 bp, Homo sapiens
cttctccctagcccttc

SEQ ID NO: 123090 - DNA, 15 bp, Homo sapiens
cttctgagccccagc

SEQ ID NO: 123091 - DNA, 16 bp, Homo sapiens
cttctgagccccagcc

SEQ ID NO: 123092 - DNA, 15 bp, Homo sapiens
cttctgttaagaaag

SEQ ID NO: 123093 - DNA, 17 bp, Homo sapiens
cttctgttaagaaagga

SEQ ID NO: 123094 - DNA, 14 bp, Homo sapiens
cttcttaaaaactg

SEQ ID NO: 123095 - DNA, 19 bp, Homo sapiens
cttcttaaaaactgtgtat

SEQ ID NO: 123096 - DNA, 13 bp, Homo sapiens
cttcttgttcccc

SEQ ID NO: 123097 - DNA, 20 bp, Homo sapiens
cttctttaatcacttaacat

SEQ ID NO: 123098 - DNA, 13 bp, Homo sapiens
cttgaactttcca

SEQ ID NO: 123099 - DNA, 20 bp, Homo sapiens
cttgaattgttatgaaaatc

SEQ ID NO: 123100 - DNA, 14 bp, Homo sapiens
cttgcctgctgctt

SEQ ID NO: 123101 - DNA, 23 bp, Homo sapiens
cttgctacttatcatttttgtat

SEQ ID NO: 123102 - DNA, 17 bp, Homo sapiens
cttgcttacatcctctg

SEQ ID NO: 123103 - DNA, 17 bp, Homo sapiens
cttggagaactccgctg

SEQ ID NO: 123104 - DNA, 13 bp, Homo sapiens
cttggagtgcccc

SEQ ID NO: 123105 - DNA, 14 bp, Homo sapiens
cttggatcagaggt

SEQ ID NO: 123106 - DNA, 12 bp, Homo sapiens
cttggccttggc

SEQ ID NO: 123107 - DNA, 13 bp, Homo sapiens
cttggccttggca

SEQ ID NO: 123108 - DNA, 23 bp, Homo sapiens
cttggccttggcatgggcgcagg

SEQ ID NO: 123109 - DNA, 16 bp, Homo sapiens
cttggcttcttaaaaa

SEQ ID NO: 123110 - DNA, 17 bp, Homo sapiens
cttggcttcttaaaaac

SEQ ID NO: 123111 - DNA, 18 bp, Homo sapiens
cttggcttcttaaaaact

SEQ ID NO: 123112 - DNA, 19 bp, Homo sapiens
cttgggcgcttcccacctg

SEQ ID NO: 123113 - DNA, 20 bp, Homo sapiens
cttgtgctgagcctgcccag

SEQ ID NO: 123114 - DNA, 15 bp, Homo sapiens
ctttaaatcatttta

SEQ ID NO: 123115 - DNA, 23 bp, Homo sapiens
ctttcatgttactgttgcagctt

SEQ ID NO: 123116 - DNA, 22 bp, Homo sapiens
ctttccaaaacctaaagaggaa

SEQ ID NO: 123117 - DNA, 14 bp, Homo sapiens
ctttccaatagaaa

SEQ ID NO: 123118 - DNA, 16 bp, Homo sapiens
ctttccaatagaaaga

SEQ ID NO: 123119 - DNA, 13 bp, Homo sapiens
ctttctgcccagc

SEQ ID NO: 123120 - DNA, 23 bp, Homo sapiens
ctttcttaatatttttacatgca

SEQ ID NO: 123121 - DNA, 13 bp, Homo sapiens
ctttgagaagaat

SEQ ID NO: 123122 - DNA, 12 bp, Homo sapiens
ctttgctccagg

SEQ ID NO: 123123 - DNA, 13 bp, Homo sapiens
ctttgctccaggc

SEQ ID NO: 123124 - DNA, 19 bp, Homo sapiens
ctttgtatcattcatcttc

SEQ ID NO: 123125 - DNA, 16 bp, Homo sapiens
ctttgtattataattg

SEQ ID NO: 123126 - DNA, 18 bp, Homo sapiens
ctttgtattataattgtt

SEQ ID NO: 123127 - DNA, 21 bp, Homo sapiens
ctttgtgtgttatattccaag

SEQ ID NO: 123128 - DNA, 16 bp, Homo sapiens
ctttgttgcccaggct

SEQ ID NO: 123129 - DNA, 12 bp, Homo sapiens
cttttaaaaaat

SEQ ID NO: 123130 - DNA, 16 bp, Homo sapiens
cttttaaaaaatattt

SEQ ID NO: 123131 - DNA, 21 bp, Homo sapiens
cttttaaagtatttataaaaa

SEQ ID NO: 123132 - DNA, 15 bp, Homo sapiens
cttttacagaatgca

SEQ ID NO: 123133 - DNA, 19 bp, Homo sapiens
cttttacagaatgcattaa

SEQ ID NO: 123134 - DNA, 17 bp, Homo sapiens
cttttattcatttgagt

SEQ ID NO: 123135 - DNA, 12 bp, Homo sapiens
cttttctggttc

SEQ ID NO: 123136 - DNA, 16 bp, Homo sapiens
cttttctggttccaaa

SEQ ID NO: 123137 - DNA, 21 bp, Homo sapiens
cttttctggttccaaaccagt

SEQ ID NO: 123138 - DNA, 13 bp, Homo sapiens
cttttctttgtat

SEQ ID NO: 123139 - DNA, 14 bp, Homo sapiens
cttttctttgtatc

SEQ ID NO: 123140 - DNA, 20 bp, Homo sapiens
cttttgaaaatcaagatgag

SEQ ID NO: 123141 - DNA, 17 bp, Homo sapiens
cttttgtcctgttattt

SEQ ID NO: 123142 - DNA, 13 bp, Homo sapiens
ctttttaaaaaat

SEQ ID NO: 123143 - DNA, 16 bp, Homo sapiens
ctttttaaaaaatacc

SEQ ID NO: 123144 - DNA, 22 bp, Homo sapiens
ctttttgtgaaattcaacctgt

SEQ ID NO: 123145 - DNA, 15 bp, Homo sapiens
ctttttttggtaaat

SEQ ID NO: 123146 - DNA, 21 bp, Homo sapiens
ctttttttggtaaatttttga

SEQ ID NO: 123147 - DNA, 16 bp, Homo sapiens
cttttttttttccaaa

SEQ ID NO: 123148 - DNA, 12 bp, Homo sapiens
gaaaaatagagc

SEQ ID NO: 123149 - DNA, 11 bp, Homo sapiens
gaaaaatattg

SEQ ID NO: 123150 - DNA, 17 bp, Homo sapiens
gaaaaatattgctaaaa

SEQ ID NO: 123151 - DNA, 17 bp, Homo sapiens
gaaaacccccagcatta

SEQ ID NO: 123152 - DNA, 13 bp, Homo sapiens
gaaaactcccaat

SEQ ID NO: 123153 - DNA, 21 bp, Homo sapiens
gaaaaggcaaaagactggttt

SEQ ID NO: 123154 - DNA, 14 bp, Homo sapiens
gaaaatcaagatga

SEQ ID NO: 123155 - DNA, 17 bp, Homo sapiens
gaaaatcaagatgagat

SEQ ID NO: 123156 - DNA, 16 bp, Homo sapiens
gaaaatcctatatctg

SEQ ID NO: 123157 - DNA, 23 bp, Homo sapiens
gaaaatcctatatctgtttgtat

SEQ ID NO: 123158 - DNA, 13 bp, Homo sapiens
gaaaattaaaata

SEQ ID NO: 123159 - DNA, 21 bp, Homo sapiens
gaaaattgaaagtattcagaa

SEQ ID NO: 123160 - DNA, 18 bp, Homo sapiens
gaaacaccgagtctctgt

SEQ ID NO: 123161 - DNA, 13 bp, Homo sapiens
gaaacagagaaag

SEQ ID NO: 123162 - DNA, 22 bp, Homo sapiens
gaaacagagaaagaaaaggcaa

SEQ ID NO: 123163 - DNA, 16 bp, Homo sapiens
gaaacatgtgcccctg

SEQ ID NO: 123164 - DNA, 12 bp, Homo sapiens
gagcaggtatca

SEQ ID NO: 123165 - DNA, 17 bp, Homo sapiens
gagcccaaacaccctcc

SEQ ID NO: 123166 - DNA, 23 bp, Homo sapiens
gagcccaaacaccctcctggcac

SEQ ID NO: 123167 - DNA, 13 bp, Homo sapiens
gagcctctgcgcc

SEQ ID NO: 123168 - DNA, 14 bp, Homo sapiens
gagcctctgcgcct

SEQ ID NO: 123169 - DNA, 12 bp, Homo sapiens
gagcctctgttt

SEQ ID NO: 123170 - DNA, 21 bp, Homo sapiens
gagctacaaagcatgggaaaa

SEQ ID NO: 123171 - DNA, 11 bp, Homo sapiens
gagctgggccc

SEQ ID NO: 123172 - DNA, 18 bp, Homo sapiens
gagctgggcccagcccct

SEQ ID NO: 123173 - DNA, 22 bp, Homo sapiens
gagctgtgggcaaaagagtgta

SEQ ID NO: 123174 - DNA, 17 bp, Homo sapiens
gaggaaccacatataac

SEQ ID NO: 123175 - DNA, 18 bp, Homo sapiens
gaggacactaggagactg

SEQ ID NO: 123176 - DNA, 19 bp, Homo sapiens
gaggacactaggagactgg

SEQ ID NO: 123177 - DNA, 23 bp, Homo sapiens
cttcctcagctcagctgggccac

SEQ ID NO: 123178 - DNA, 14 bp, Homo sapiens
cttcctcctctcct

SEQ ID NO: 123179 - DNA, 16 bp, Homo sapiens
cttcctcctctcctgg

SEQ ID NO: 123180 - DNA, 14 bp, Homo sapiens
cttctaccccacct

SEQ ID NO: 123181 - DNA, 15 bp, Homo sapiens
cttctaccccacctg

SEQ ID NO: 123182 - DNA, 16 bp, Homo sapiens
cttctaccccacctga

SEQ ID NO: 123183 - DNA, 14 bp, Homo sapiens
cttctccctagccc

SEQ ID NO: 123184 - DNA, 18 bp, Homo sapiens
cttctgagccccagcccc

SEQ ID NO: 123185 - DNA, 14 bp, Homo sapiens
cttctgttaagaaa

SEQ ID NO: 123186 - DNA, 13 bp, Homo sapiens
cttcttaaaaact

SEQ ID NO: 123187 - DNA, 16 bp, Homo sapiens
cttcttaaaaactgtg

SEQ ID NO: 123188 - DNA, 17 bp, Homo sapiens
cttcttaaaaactgtgt

SEQ ID NO: 123189 - DNA, 16 bp, Homo sapiens
cttgaatcctatgtat

SEQ ID NO: 123190 - DNA, 12 bp, Homo sapiens
cttgaattgtta

SEQ ID NO: 123191 - DNA, 16 bp, Homo sapiens
cttgaattgttatgaa

SEQ ID NO: 123192 - DNA, 18 bp, Homo sapiens
cttgaattgttatgaaaa

SEQ ID NO: 123193 - DNA, 21 bp, Homo sapiens
cttgcacgcgccctttctacc

SEQ ID NO: 123194 - DNA, 23 bp, Homo sapiens
cttgctgcaaacccatgaagctg

SEQ ID NO: 123195 - DNA, 16 bp, Homo sapiens
cttggccttggcatgg

SEQ ID NO: 123196 - DNA, 20 bp, Homo sapiens
cttggcttcttaaaaactgt

SEQ ID NO: 123197 - DNA, 19 bp, Homo sapiens
cttggggtggtgctgggtc

SEQ ID NO: 123198 - DNA, 15 bp, Homo sapiens
cttgtgctgagcctg

SEQ ID NO: 123199 - DNA, 18 bp, Homo sapiens
cttgtgctgagcctgccc

SEQ ID NO: 123200 - DNA, 21 bp, Homo sapiens
cttgttccaatgccacatact

SEQ ID NO: 123201 - DNA, 15 bp, Homo sapiens
cttgtttttataata

SEQ ID NO: 123202 - DNA, 12 bp, Homo sapiens
ctttaaaaggca

SEQ ID NO: 123203 - DNA, 18 bp, Homo sapiens
ctttcagatgcagttttc

SEQ ID NO: 123204 - DNA, 22 bp, Homo sapiens
ctttccaatagaaagaaactaa

SEQ ID NO: 123205 - DNA, 11 bp, Homo sapiens
ctttgctgcca

SEQ ID NO: 123206 - DNA, 17 bp, Homo sapiens
ctttgtagactgtttca

SEQ ID NO: 123207 - DNA, 20 bp, Homo sapiens
ctttgtagtgtttggtgctc

SEQ ID NO: 123208 - DNA, 18 bp, Homo sapiens
ctttgtatcattcatctt

SEQ ID NO: 123209 - DNA, 20 bp, Homo sapiens
ctttgtattataattgttga

SEQ ID NO: 123210 - DNA, 23 bp, Homo sapiens
ctttgtattataattgttgatat

SEQ ID NO: 123211 - DNA, 15 bp, Homo sapiens
ctttgtcccggggct

SEQ ID NO: 123212 - DNA, 15 bp, Homo sapiens
ctttgtgtgttatat

SEQ ID NO: 123213 - DNA, 14 bp, Homo sapiens
cttttaaaaaatat

SEQ ID NO: 123214 - DNA, 15 bp, Homo sapiens
cttttaaaaaatatt

SEQ ID NO: 123215 - DNA, 22 bp, Homo sapiens
cttttaaaaaatattttaagaa

SEQ ID NO: 123216 - DNA, 17 bp, Homo sapiens
cttttacagaatgcatt

SEQ ID NO: 123217 - DNA, 20 bp, Homo sapiens
cttttacagaatgcattaaa

SEQ ID NO: 123218 - DNA, 16 bp, Homo sapiens
cttttgtaatttgaat

SEQ ID NO: 123219 - DNA, 17 bp, Homo sapiens
cttttgtaatttgaatt

SEQ ID NO: 123220 - DNA, 17 bp, Homo sapiens
ctttttctttttttggt

SEQ ID NO: 123221 - DNA, 18 bp, Homo sapiens
cttttttcctagtttttc

SEQ ID NO: 123222 - DNA, 19 bp, Homo sapiens
ctttttttggtaaattttt

SEQ ID NO: 123223 - DNA, 10 bp, Homo sapiens
gaaaaatatt

SEQ ID NO: 123224 - DNA, 14 bp, Homo sapiens
gaaaaatattgcta

SEQ ID NO: 123225 - DNA, 20 bp, Homo sapiens
gaaaaatattgctaaaagtg

SEQ ID NO: 123226 - DNA, 23 bp, Homo sapiens
gaaaaatattgctaaaagtgcat

SEQ ID NO: 123227 - DNA, 15 bp, Homo sapiens
gaaaacccccagcat

SEQ ID NO: 123228 - DNA, 18 bp, Homo sapiens
gaaaactcccaatacaaa

SEQ ID NO: 123229 - DNA, 16 bp, Homo sapiens
gaaaaggcaaaagact

SEQ ID NO: 123230 - DNA, 19 bp, Homo sapiens
gaaaaggcaaaagactggt

SEQ ID NO: 123231 - DNA, 19 bp, Homo sapiens
gaaaagtaatgaagaatca

SEQ ID NO: 123232 - DNA, 20 bp, Homo sapiens
gaaaataccataggaagaca

SEQ ID NO: 123233 - DNA, 14 bp, Homo sapiens
gaaacagagaaaga

SEQ ID NO: 123234 - DNA, 15 bp, Homo sapiens
gaaacagagaaagaa

SEQ ID NO: 123235 - DNA, 21 bp, Homo sapiens
gaaacagagaaagaaaaggca

SEQ ID NO: 123236 - DNA, 19 bp, Homo sapiens
gaaacatgcagctcttcaa

SEQ ID NO: 123237 - DNA, 18 bp, Homo sapiens
gaaacatgtgcccctgcc

SEQ ID NO: 123238 - DNA, 20 bp, Homo sapiens
gaaacctgtccataaagtaa

SEQ ID NO: 123239 - DNA, 16 bp, Homo sapiens
gaaagaaaaggcaaaa

SEQ ID NO: 123240 - DNA, 20 bp, Homo sapiens
gaaagaaaaggcaaaagact

SEQ ID NO: 123241 - DNA, 23 bp, Homo sapiens
gaaagaaaaggcaaaagactggt

SEQ ID NO: 123242 - DNA, 12 bp, Homo sapiens
gaaagaatagaa

SEQ ID NO: 123243 - DNA, 13 bp, Homo sapiens
gaaagaatagaaa

SEQ ID NO: 123244 - DNA, 19 bp, Homo sapiens
gaaagaatagaaagaaagt

SEQ ID NO: 123245 - DNA, 11 bp, Homo sapiens
gaaagagaatg

SEQ ID NO: 123246 - DNA, 16 bp, Homo sapiens
gaaagagaatgaactg

SEQ ID NO: 123247 - DNA, 14 bp, Homo sapiens
gaaagtattcagaa

SEQ ID NO: 123248 - DNA, 15 bp, Homo sapiens
gaaagtattcagaaa

SEQ ID NO: 123249 - DNA, 21 bp, Homo sapiens
gaaagtattcagaaattaaaa

SEQ ID NO: 123250 - DNA, 18 bp, Homo sapiens
gaaataattttattccag

SEQ ID NO: 123251 - DNA, 12 bp, Homo sapiens
gaaatcagcatg

SEQ ID NO: 123252 - DNA, 13 bp, Homo sapiens
gaaattaaaatat

SEQ ID NO: 123253 - DNA, 14 bp, Homo sapiens
gaaattaaaatatt

SEQ ID NO: 123254 - DNA, 15 bp, Homo sapiens
gaaattagtcttttt

SEQ ID NO: 123255 - DNA, 22 bp, Homo sapiens
gaaattttactgacagaaatgc

SEQ ID NO: 123256 - DNA, 15 bp, Homo sapiens
gaacaatgtcagaaa

SEQ ID NO: 123257 - DNA, 23 bp, Homo sapiens
gaacacaggcttatttttaaaat

SEQ ID NO: 123258 - DNA, 16 bp, Homo sapiens
gaacagcaggatgccc

SEQ ID NO: 123259 - DNA, 17 bp, Homo sapiens
gaacagcaggatgccct

SEQ ID NO: 123260 - DNA, 19 bp, Homo sapiens
gaacagcaggatgccctgt

SEQ ID NO: 123261 - DNA, 15 bp, Homo sapiens
gaacagtaaaatcca

SEQ ID NO: 123262 - DNA, 21 bp, Homo sapiens
gaaccatgttggttgcacttt

SEQ ID NO: 123263 - DNA, 14 bp, Homo sapiens
gaacttttacagaa

SEQ ID NO: 123264 - DNA, 18 bp, Homo sapiens
gaacttttgtaatttgaa

SEQ ID NO: 123265 - DNA, 20 bp, Homo sapiens
gaacttttgtaatttgaatt

SEQ ID NO: 123266 - DNA, 15 bp, Homo sapiens
gaagacataaaactt

SEQ ID NO: 123267 - DNA, 15 bp, Homo sapiens
gcatgaaagagaaag

SEQ ID NO: 123268 - DNA, 16 bp, Homo sapiens
gcatgacaaaaataac

SEQ ID NO: 123269 - DNA, 14 bp, Homo sapiens
gcatgggaaaaaga

SEQ ID NO: 123270 - DNA, 19 bp, Homo sapiens
gcatgggaaaaagagactc

SEQ ID NO: 123271 - DNA, 18 bp, Homo sapiens
gcatgggcgcaggcccag

SEQ ID NO: 123272 - DNA, 22 bp, Homo sapiens
gcatgggcgcaggcccagtgac

SEQ ID NO: 123273 - DNA, 18 bp, Homo sapiens
gcatgtatagttgctttt

SEQ ID NO: 123274 - DNA, 19 bp, Homo sapiens
gcatgtatagttgcttttg

SEQ ID NO: 123275 - DNA, 14 bp, Homo sapiens
gcatttaaggagat

SEQ ID NO: 123276 - DNA, 17 bp, Homo sapiens
gcatttgcagattttta

SEQ ID NO: 123277 - DNA, 22 bp, Homo sapiens
gcattttaaaagcaattatatt

SEQ ID NO: 123278 - DNA, 18 bp, Homo sapiens
gcattttcaccccaccct

SEQ ID NO: 123279 - DNA, 13 bp, Homo sapiens
gctgggcccagcc

SEQ ID NO: 123280 - DNA, 18 bp, Homo sapiens
gctggggcttggggattg

SEQ ID NO: 123281 - DNA, 14 bp, Homo sapiens
gctgtctcctgtcc

SEQ ID NO: 123282 - DNA, 21 bp, Homo sapiens
gctgtgcacccagaagaagat

SEQ ID NO: 123283 - DNA, 15 bp, Homo sapiens
gctgttcttttttgt

SEQ ID NO: 123284 - DNA, 20 bp, Homo sapiens
gcttaatttccttctgttaa

SEQ ID NO: 123285 - DNA, 14 bp, Homo sapiens
gcttagttcttgaa

SEQ ID NO: 123286 - DNA, 17 bp, Homo sapiens
gcttagttcttgaattg

SEQ ID NO: 123287 - DNA, 19 bp, Homo sapiens
gcttagttcttgaattgtt

SEQ ID NO: 123288 - DNA, 20 bp, Homo sapiens
gcttagttcttgaattgtta

SEQ ID NO: 123289 - DNA, 17 bp, Homo sapiens
gcttatttttaaaataa

SEQ ID NO: 123290 - DNA, 19 bp, Homo sapiens
gcttatttttaaaataaaa

SEQ ID NO: 123291 - DNA, 21 bp, Homo sapiens
gcttatttttaaaataaaaat

SEQ ID NO: 123292 - DNA, 22 bp, Homo sapiens
gcttctagacactccttgaaat

SEQ ID NO: 123293 - DNA, 12 bp, Homo sapiens
gcttcttaaaaa

SEQ ID NO: 123294 - DNA, 13 bp, Homo sapiens
gcttcttaaaaac

SEQ ID NO: 123295 - DNA, 15 bp, Homo sapiens
gcttcttaaaaactg

SEQ ID NO: 123296 - DNA, 17 bp, Homo sapiens
gcttcttaaaaactgtg

SEQ ID NO: 123297 - DNA, 24 bp, Homo sapiens
gcttcttaaaaactgtgtatcatt

SEQ ID NO: 123298 - DNA, 14 bp, Homo sapiens
gcttggagtgcccc

SEQ ID NO: 123299 - DNA, 17 bp, Homo sapiens
gcttggggattgccact

SEQ ID NO: 123300 - DNA, 17 bp, Homo sapiens
gctttcagatgcagttt

SEQ ID NO: 123301 - DNA, 20 bp, Homo sapiens
ggaaaaaactttgctccagg

SEQ ID NO: 123302 - DNA, 13 bp, Homo sapiens
ggaaaattgaaag

SEQ ID NO: 123303 - DNA, 17 bp, Homo sapiens
ggaaaattgaaagtatt

SEQ ID NO: 123304 - DNA, 22 bp, Homo sapiens
ggaaacaccgagtctctgtata

SEQ ID NO: 123305 - DNA, 15 bp, Homo sapiens
ggaaacgcacttaca

SEQ ID NO: 123306 - DNA, 22 bp, Homo sapiens
ggaaccacatataacacttaac

SEQ ID NO: 123307 - DNA, 13 bp, Homo sapiens
ggaagaatttaat

SEQ ID NO: 123308 - DNA, 14 bp, Homo sapiens
ggaaggcccagggg

SEQ ID NO: 123309 - DNA, 21 bp, Homo sapiens
ggaagtgcagcgggccaggca

SEQ ID NO: 123310 - DNA, 22 bp, Homo sapiens
ggaagtgcagcgggccaggcag

SEQ ID NO: 123311 - DNA, 16 bp, Homo sapiens
ggaattattgtagaca

SEQ ID NO: 123312 - DNA, 18 bp, Homo sapiens
ggacagatttgaggactg

SEQ ID NO: 123313 - DNA, 14 bp, Homo sapiens
ggactgaagctggg

SEQ ID NO: 123314 - DNA, 21 bp, Homo sapiens
ggagacaattagcagaatgga

SEQ ID NO: 123315 - DNA, 15 bp, Homo sapiens
ggagacccacagccc

SEQ ID NO: 123316 - DNA, 16 bp, Homo sapiens
ggagaccctgagtccg

SEQ ID NO: 123317 - DNA, 20 bp, Homo sapiens
ggagactgggcacccctgcc

SEQ ID NO: 123318 - DNA, 17 bp, Homo sapiens
ggagagagggtctccag

SEQ ID NO: 123319 - DNA, 14 bp, Homo sapiens
ggagagcctctgtt

SEQ ID NO: 123320 - DNA, 22 bp, Homo sapiens
ggagattgggagacaattagca

SEQ ID NO: 123321 - DNA, 19 bp, Homo sapiens
ggagcaggggtctgagcca

SEQ ID NO: 123322 - DNA, 13 bp, Homo sapiens
ggagccccagccc

SEQ ID NO: 123323 - DNA, 15 bp, Homo sapiens
ggagccccagccccg

SEQ ID NO: 123324 - DNA, 17 bp, Homo sapiens
ggaggaaggcccagggg

SEQ ID NO: 123325 - DNA, 12 bp, Homo sapiens
ggaggcctctgg

SEQ ID NO: 123326 - DNA, 18 bp, Homo sapiens
ggaggctccgtgagccct

SEQ ID NO: 123327 - DNA, 18 bp, Homo sapiens
ggagggagagcctctgtt

SEQ ID NO: 123328 - DNA, 22 bp, Homo sapiens
ggagggccgagacaggagcagc

SEQ ID NO: 123329 - DNA, 20 bp, Homo sapiens
ggaggttcgggattccctgg

SEQ ID NO: 123330 - DNA, 21 bp, Homo sapiens
ggaggttcgggattccctggt

SEQ ID NO: 123331 - DNA, 16 bp, Homo sapiens
ggagtctgaagcctgc

SEQ ID NO: 123332 - DNA, 21 bp, Homo sapiens
ggagtgccccaaggaggtggc

SEQ ID NO: 123333 - DNA, 22 bp, Homo sapiens
ggagttgtcaagtctctgctgg

SEQ ID NO: 123334 - DNA, 14 bp, Homo sapiens
ggatataaaaggat

SEQ ID NO: 123335 - DNA, 23 bp, Homo sapiens
ggatcaccccagcccccacagcc

SEQ ID NO: 123336 - DNA, 14 bp, Homo sapiens
ggattccctggtgg

SEQ ID NO: 123337 - DNA, 13 bp, Homo sapiens
ggcaaaagactgg

SEQ ID NO: 123338 - DNA, 15 bp, Homo sapiens
ggcaccagtgcctca

SEQ ID NO: 123339 - DNA, 16 bp, Homo sapiens
ggcaccagtgcctcag

SEQ ID NO: 123340 - DNA, 12 bp, Homo sapiens
ggcacccctgcc

SEQ ID NO: 123341 - DNA, 19 bp, Homo sapiens
ggcaccgggctccatgcct

SEQ ID NO: 123342 - DNA, 12 bp, Homo sapiens
ggcacgggcctg

SEQ ID NO: 123343 - DNA, 19 bp, Homo sapiens
ggcagcacagcccagggcc

SEQ ID NO: 123344 - DNA, 23 bp, Homo sapiens
ggcagcacagcccagggcctgca

SEQ ID NO: 123345 - DNA, 19 bp, Homo sapiens
ggcatcactgattccctct

SEQ ID NO: 123346 - DNA, 20 bp, Homo sapiens
ggcatcactgattccctctc

SEQ ID NO: 123347 - DNA, 17 bp, Homo sapiens
ggccaaggtttcccagt

SEQ ID NO: 123348 - DNA, 23 bp, Homo sapiens
ggccaaggtttcccagtgagcct

SEQ ID NO: 123349 - DNA, 15 bp, Homo sapiens
ggccactcctcttca

SEQ ID NO: 123350 - DNA, 17 bp, Homo sapiens
ggccataattatgaaaa

SEQ ID NO: 123351 - DNA, 15 bp, Homo sapiens
ggcccagccactgca

SEQ ID NO: 123352 - DNA, 12 bp, Homo sapiens
ggcccagcccct

SEQ ID NO: 123353 - DNA, 13 bp, Homo sapiens
ggcccagcccctc

SEQ ID NO: 123354 - DNA, 17 bp, Homo sapiens
ggcccagcccctccacg

SEQ ID NO: 123355 - DNA, 21 bp, Homo sapiens
ggcccaggggtggggcccatg

SEQ ID NO: 123356 - DNA, 20 bp, Homo sapiens
ggcccagtgacaaagactcc

SEQ ID NO: 123357 - DNA, 22 bp, Homo sapiens
ggcccagtgacaaagactcctc

SEQ ID NO: 123358 - DNA, 21 bp, Homo sapiens
ggcccctggcagcacagccca

SEQ ID NO: 123359 - DNA, 23 bp, Homo sapiens
ggcccctggcagcacagcccagg

SEQ ID NO: 123360 - DNA, 14 bp, Homo sapiens
ggccctagaggaca

SEQ ID NO: 123361 - DNA, 18 bp, Homo sapiens
ggccctcagctccctgac

SEQ ID NO: 123362 - DNA, 13 bp, Homo sapiens
ggccctcccaggc

SEQ ID NO: 123363 - DNA, 14 bp, Homo sapiens
ggcccttggaataa

SEQ ID NO: 123364 - DNA, 13 bp, Homo sapiens
ggccgctgcccct

SEQ ID NO: 123365 - DNA, 17 bp, Homo sapiens
ggccgctgcccctgagt

SEQ ID NO: 123366 - DNA, 18 bp, Homo sapiens
ggcctaaagaatcccacc

SEQ ID NO: 123367 - DNA, 18 bp, Homo sapiens
ggcctcggctgtctcctg

SEQ ID NO: 123368 - DNA, 14 bp, Homo sapiens
ggcgaggaaaaaca

SEQ ID NO: 123369 - DNA, 13 bp, Homo sapiens
ggcgcaggcccag

SEQ ID NO: 123370 - DNA, 16 bp, Homo sapiens
gctcctttctgcccag

SEQ ID NO: 123371 - DNA, 17 bp, Homo sapiens
gctcgagcagtcctgcc

SEQ ID NO: 123372 - DNA, 21 bp, Homo sapiens
gctcgagcagtcctgcctcag

SEQ ID NO: 123373 - DNA, 19 bp, Homo sapiens
gctctaccctgcagcttgg

SEQ ID NO: 123374 - DNA, 14 bp, Homo sapiens
gctctcctggctcc

SEQ ID NO: 123375 - DNA, 15 bp, Homo sapiens
gctctcctggctccc

SEQ ID NO: 123376 - DNA, 18 bp, Homo sapiens
gctctcctggctccctcc

SEQ ID NO: 123377 - DNA, 14 bp, Homo sapiens
gctctctctcctgg

SEQ ID NO: 123378 - DNA, 16 bp, Homo sapiens
gctctgacagccctgc

SEQ ID NO: 123379 - DNA, 14 bp, Homo sapiens
gctgagctgggccc

SEQ ID NO: 123380 - DNA, 17 bp, Homo sapiens
ggcttatttttaaaata

SEQ ID NO: 123381 - DNA, 15 bp, Homo sapiens
gggaaaaagagactc

SEQ ID NO: 123382 - DNA, 13 bp, Homo sapiens
gggaggagagagg

SEQ ID NO: 123383 - DNA, 21 bp, Homo sapiens
gggagtgaaacagagaaagaa

SEQ ID NO: 123384 - DNA, 16 bp, Homo sapiens
gggccactcctcttca

SEQ ID NO: 123385 - DNA, 20 bp, Homo sapiens
gggcccagcccctccacgtg

SEQ ID NO: 123386 - DNA, 23 bp, Homo sapiens
gggccgcagccacaccgctggct

SEQ ID NO: 123387 - DNA, 18 bp, Homo sapiens
gggcctcgacgtcccttg

SEQ ID NO: 123388 - DNA, 13 bp, Homo sapiens
gggcctgggcggg

SEQ ID NO: 123389 - DNA, 13 bp, Homo sapiens
gggcgcaggccca

SEQ ID NO: 123390 - DNA, 16 bp, Homo sapiens
gggcgcttcccacctg

SEQ ID NO: 123391 - DNA, 20 bp, Homo sapiens
gggcgcttcccacctgcccc

SEQ ID NO: 123392 - DNA, 18 bp, Homo sapiens
gggcggggccgggactgg

SEQ ID NO: 123393 - DNA, 19 bp, Homo sapiens
gggctctttctctctgctg

SEQ ID NO: 123394 - DNA, 18 bp, Homo sapiens
ggggccgggactgggggc

SEQ ID NO: 123395 - DNA, 18 bp, Homo sapiens
ggggcggggccgggactg

SEQ ID NO: 123396 - DNA, 20 bp, Homo sapiens
ggggtctctgcatcttcagt

SEQ ID NO: 123397 - DNA, 21 bp, Homo sapiens
gggtgcatcctcctcagcccc

SEQ ID NO: 123398 - DNA, 22 bp, Homo sapiens
gggtgcatcctcctcagccccc

SEQ ID NO: 123399 - DNA, 23 bp, Homo sapiens
ggtaaaaagattatatatcataa

SEQ ID NO: 123400 - DNA, 12 bp, Homo sapiens
ggtaaatttttg

SEQ ID NO: 123401 - DNA, 17 bp, Homo sapiens
ggtaaatttttgaaaaa

SEQ ID NO: 123402 - DNA, 20 bp, Homo sapiens
ggtaaatttttgaaaaatat

SEQ ID NO: 123403 - DNA, 21 bp, Homo sapiens
ggtaaatttttgaaaaatatt

SEQ ID NO: 123404 - DNA, 22 bp, Homo sapiens
ggtaacgtgattgattcagtat

SEQ ID NO: 123405 - DNA, 16 bp, Homo sapiens
ggtactgcacattttg

SEQ ID NO: 123406 - DNA, 19 bp, Homo sapiens
ggtcattacttctgagccc

SEQ ID NO: 123407 - DNA, 21 bp, Homo sapiens
ggtcattacttctgagcccca

SEQ ID NO: 123408 - DNA, 22 bp, Homo sapiens
ggtcccaagtagtagtgtcttc

SEQ ID NO: 123409 - DNA, 16 bp, Homo sapiens
ggtccggggaggaggt

SEQ ID NO: 123410 - DNA, 21 bp, Homo sapiens
ggtctcacagtgttgcccagg

SEQ ID NO: 123411 - DNA, 22 bp, Homo sapiens
ggtgaacagcaggatgccctgt

SEQ ID NO: 123412 - DNA, 21 bp, Homo sapiens
ggtgtgtttggcttggccttg

SEQ ID NO: 123413 - DNA, 20 bp, Homo sapiens
ggttcattttctgatgccca

SEQ ID NO: 123414 - DNA, 10 bp, Homo sapiens
ggttccaaac

SEQ ID NO: 123415 - DNA, 11 bp, Homo sapiens
ggttccaaacc

SEQ ID NO: 123416 - DNA, 16 bp, Homo sapiens
ggttccaaaccagttt

SEQ ID NO: 123417 - DNA, 17 bp, Homo sapiens
ggttcgggattccctgg

SEQ ID NO: 123418 - DNA, 15 bp, Homo sapiens
ggttgcactttgtag

SEQ ID NO: 123419 - DNA, 13 bp, Homo sapiens
ggtttaatattac

SEQ ID NO: 123420 - DNA, 18 bp, Homo sapiens
ggtttcccagtgagcctc

SEQ ID NO: 123421 - DNA, 19 bp, Homo sapiens
ggtttcccagtgagcctct

SEQ ID NO: 123422 - DNA, 14 bp, Homo sapiens
ggtttgtttgctta

SEQ ID NO: 123423 - DNA, 15 bp, Homo sapiens
ggtttgtttgcttaa

SEQ ID NO: 123424 - DNA, 19 bp, Homo sapiens
ggtttgtttgcttaatttc

SEQ ID NO: 123425 - DNA, 21 bp, Homo sapiens
gtaaaagttataataactgaa

SEQ ID NO: 123426 - DNA, 22 bp, Homo sapiens
gtaaaagttataataactgaac

SEQ ID NO: 123427 - DNA, 18 bp, Homo sapiens
gtaaaattgagtttcaga

SEQ ID NO: 123428 - DNA, 14 bp, Homo sapiens
gtaaactgaggccc

SEQ ID NO: 123429 - DNA, 11 bp, Homo sapiens
gtaaataattt

SEQ ID NO: 123430 - DNA, 12 bp, Homo sapiens
gtaaatttttga

SEQ ID NO: 123431 - DNA, 13 bp, Homo sapiens
gtaaatttttgaa

SEQ ID NO: 123432 - DNA, 16 bp, Homo sapiens
gtaaatttttgaaaaa

SEQ ID NO: 123433 - DNA, 16 bp, Homo sapiens
gtaatcagctctcctg

SEQ ID NO: 123434 - DNA, 14 bp, Homo sapiens
gtaatgaaatgttt

SEQ ID NO: 123435 - DNA, 20 bp, Homo sapiens
gtacaaagatatgctaagca

SEQ ID NO: 123436 - DNA, 16 bp, Homo sapiens
gtacaataaaagtaaa

SEQ ID NO: 123437 - DNA, 23 bp, Homo sapiens
gtacctcccctccccgccccctg

SEQ ID NO: 123438 - DNA, 18 bp, Homo sapiens
gtacctctagctgttctt

SEQ ID NO: 123439 - DNA, 15 bp, Homo sapiens
gtacgttatatattg

SEQ ID NO: 123440 - DNA, 18 bp, Homo sapiens
gtacgttatatattgtat

SEQ ID NO: 123441 - DNA, 20 bp, Homo sapiens
gtacttcccaattgccacat

SEQ ID NO: 123442 - DNA, 21 bp, Homo sapiens
gtagtcaagaggtttttctcc

SEQ ID NO: 123443 - DNA, 17 bp, Homo sapiens
gtagtcgtcaagttgca

SEQ ID NO: 123444 - DNA, 12 bp, Homo sapiens
gtataaaaagga

SEQ ID NO: 123445 - DNA, 15 bp, Homo sapiens
gtataaaaaggaaat

SEQ ID NO: 123446 - DNA, 21 bp, Homo sapiens
gtatatattctacacatatat

SEQ ID NO: 123447 - DNA, 16 bp, Homo sapiens
gtatatctatatctct

SEQ ID NO: 123448 - DNA, 17 bp, Homo sapiens
gtatatgtatatctata

SEQ ID NO: 123449 - DNA, 14 bp, Homo sapiens
gtatattagtttga

SEQ ID NO: 123450 - DNA, 13 bp, Homo sapiens
gtatcattaaaat

SEQ ID NO: 123451 - DNA, 14 bp, Homo sapiens
gtatcattaaaata

SEQ ID NO: 123452 - DNA, 15 bp, Homo sapiens
gtatcattaaaatat

SEQ ID NO: 123453 - DNA, 17 bp, Homo sapiens
gtatcattaaaatatat

SEQ ID NO: 123454 - DNA, 17 bp, Homo sapiens
gtatctacagtaatgaa

SEQ ID NO: 123455 - DNA, 19 bp, Homo sapiens
gtatcttagagtttacagt

SEQ ID NO: 123456 - DNA, 23 bp, Homo sapiens
gtatcttagagtttacagtttgt

SEQ ID NO: 123457 - DNA, 18 bp, Homo sapiens
gtatgccttcctgtttaa

SEQ ID NO: 123458 - DNA, 22 bp, Homo sapiens
gtattcaattaaagaaataatt

SEQ ID NO: 123459 - DNA, 20 bp, Homo sapiens
gtattgctgtccttgaatgc

SEQ ID NO: 123460 - DNA, 18 bp, Homo sapiens
gtatttataaaaatataa

SEQ ID NO: 123461 - DNA, 17 bp, Homo sapiens
gtatttatctgcaaggt

SEQ ID NO: 123462 - DNA, 17 bp, Homo sapiens
gtatttttgtattcaat

SEQ ID NO: 123463 - DNA, 18 bp, Homo sapiens
gtcaaatgaacttttaca

SEQ ID NO: 123464 - DNA, 20 bp, Homo sapiens
gtcaaatgaacttttacaga

SEQ ID NO: 123465 - DNA, 19 bp, Homo sapiens
gtcaagaggtttttctccc

SEQ ID NO: 123466 - DNA, 14 bp, Homo sapiens
gtcaagtctctgct

SEQ ID NO: 123467 - DNA, 21 bp, Homo sapiens
gtcaccttcctcagctcagct

SEQ ID NO: 123468 - DNA, 13 bp, Homo sapiens
gtcagtttctaca

SEQ ID NO: 123469 - DNA, 19 bp, Homo sapiens
gtcatcccttcctcctctc

SEQ ID NO: 123470 - DNA, 18 bp, Homo sapiens
gtcatgaaggacactctg

SEQ ID NO: 123471 - DNA, 17 bp, Homo sapiens
gtccaccggcccctggc

SEQ ID NO: 123472 - DNA, 11 bp, Homo sapiens
gtccataaagt

SEQ ID NO: 123473 - DNA, 12 bp, Homo sapiens
gtccataaagta

SEQ ID NO: 123474 - DNA, 15 bp, Homo sapiens
gaagagaggggaaga

SEQ ID NO: 123475 - DNA, 19 bp, Homo sapiens
gaagagaggggaagaattt

SEQ ID NO: 123476 - DNA, 20 bp, Homo sapiens
gaagcaccagggagaggcct

SEQ ID NO: 123477 - DNA, 14 bp, Homo sapiens
gaagcgctgttgcc

SEQ ID NO: 123478 - DNA, 24 bp, Homo sapiens
gaagcgctgttgcccgccctccac

SEQ ID NO: 123479 - DNA, 21 bp, Homo sapiens
gaaggtgggtgaggctgggca

SEQ ID NO: 123480 - DNA, 20 bp, Homo sapiens
gaaggttttttttttaagtg

SEQ ID NO: 123481 - DNA, 16 bp, Homo sapiens
tacagaatgcattaaa

SEQ ID NO: 123482 - DNA, 19 bp, Homo sapiens
tacagagcacctgtagctg

SEQ ID NO: 123483 - DNA, 14 bp, Homo sapiens
tacagtaatgaaat

SEQ ID NO: 123484 - DNA, 21 bp, Homo sapiens
tacagtaatgaaatgtttact

SEQ ID NO: 123485 - DNA, 23 bp, Homo sapiens
tacagtttgtgttttaaaaaaac

SEQ ID NO: 123486 - DNA, 22 bp, Homo sapiens
tacattttattgtcagaattta

SEQ ID NO: 123487 - DNA, 15 bp, Homo sapiens
tacattttgtaaaat

SEQ ID NO: 123488 - DNA, 17 bp, Homo sapiens
taccattgaaatcagca

SEQ ID NO: 123489 - DNA, 13 bp, Homo sapiens
taccctgcagctt

SEQ ID NO: 123490 - DNA, 19 bp, Homo sapiens
tacctaaaaggaaatctca

SEQ ID NO: 123491 - DNA, 22 bp, Homo sapiens
tacctaaaaggaaatctcaccc

SEQ ID NO: 123492 - DNA, 23 bp, Homo sapiens
tacctcccctccccgccccctga

SEQ ID NO: 123493 - DNA, 17 bp, Homo sapiens
tacctctagctgttctt

SEQ ID NO: 123494 - DNA, 15 bp, Homo sapiens
tactaatgttatttc

SEQ ID NO: 123495 - DNA, 22 bp, Homo sapiens
tactgcagcctttgcctccccg

SEQ ID NO: 123496 - DNA, 13 bp, Homo sapiens
tactgtaaaagtt

SEQ ID NO: 123497 - DNA, 14 bp, Homo sapiens
tactgtaaaagtta

SEQ ID NO: 123498 - DNA, 22 bp, Homo sapiens
tacttatcatttttgtataaaa

SEQ ID NO: 123499 - DNA, 16 bp, Homo sapiens
tacttctgagccccag

SEQ ID NO: 123500 - DNA, 16 bp, Homo sapiens
tacttgaactttccaa

SEQ ID NO: 123501 - DNA, 17 bp, Homo sapiens
tacttgaactttccaaa

SEQ ID NO: 123502 - DNA, 22 bp, Homo sapiens
tacttgaactttccaaaaccta

SEQ ID NO: 123503 - DNA, 21 bp, Homo sapiens
tacttttctggttccaaacca

SEQ ID NO: 123504 - DNA, 22 bp, Homo sapiens
tacttttctgtttagttttaca

SEQ ID NO: 123505 - DNA, 16 bp, Homo sapiens
tacttttgaaaatcaa

SEQ ID NO: 123506 - DNA, 17 bp, Homo sapiens
tagaaaattaaaataac

SEQ ID NO: 123507 - DNA, 16 bp, Homo sapiens
tagaacttgaccccct

SEQ ID NO: 123508 - DNA, 19 bp, Homo sapiens
tagacatgcccaaaactta

SEQ ID NO: 123509 - DNA, 14 bp, Homo sapiens
tagagaccaggagg

SEQ ID NO: 123510 - DNA, 17 bp, Homo sapiens
tagagcaaaatcaacat

SEQ ID NO: 123511 - DNA, 21 bp, Homo sapiens
tagagcaaaatcaacatgact

SEQ ID NO: 123512 - DNA, 19 bp, Homo sapiens
tagcccttctaccccacct

SEQ ID NO: 123513 - DNA, 18 bp, Homo sapiens
tagccttgctcaggtgca

SEQ ID NO: 123514 - DNA, 15 bp, Homo sapiens
tagctgtttcaaatg

SEQ ID NO: 123515 - DNA, 19 bp, Homo sapiens
tagcttttaaaaaatattt

SEQ ID NO: 123516 - DNA, 11 bp, Homo sapiens
taggaaaggat

SEQ ID NO: 123517 - DNA, 16 bp, Homo sapiens
taggaagacataaaac

SEQ ID NO: 123518 - DNA, 19 bp, Homo sapiens
taggaagacataaaacttt

SEQ ID NO: 123519 - DNA, 22 bp, Homo sapiens
taggaagacataaaactttaaa

SEQ ID NO: 123520 - DNA, 15 bp, Homo sapiens
tagtgagattaaaaa

SEQ ID NO: 123521 - DNA, 13 bp, Homo sapiens
tagtgcctctgca

SEQ ID NO: 123522 - DNA, 20 bp, Homo sapiens
tagtgttgtgcacttcatgt

SEQ ID NO: 123523 - DNA, 14 bp, Homo sapiens
tagttcttgaattg

SEQ ID NO: 123524 - DNA, 16 bp, Homo sapiens
tagttcttgaattgtt

SEQ ID NO: 123525 - DNA, 21 bp, Homo sapiens
tagttcttgaattgttatgaa

SEQ ID NO: 123526 - DNA, 18 bp, Homo sapiens
tagttgcttttgaaggaa

SEQ ID NO: 123527 - DNA, 20 bp, Homo sapiens
tagtttgatttaatatctga

SEQ ID NO: 123528 - DNA, 22 bp, Homo sapiens
tagttttacactaggaaacgtg

SEQ ID NO: 123529 - DNA, 13 bp, Homo sapiens
tataaaaaggaaa

SEQ ID NO: 123530 - DNA, 22 bp, Homo sapiens
tataaaaaggaaattagtcttt

SEQ ID NO: 123531 - DNA, 19 bp, Homo sapiens
tataaaaggatgttacaag

SEQ ID NO: 123532 - DNA, 20 bp, Homo sapiens
tataaaaggatgttacaagt

SEQ ID NO: 123533 - DNA, 14 bp, Homo sapiens
tataaattgtacat

SEQ ID NO: 123534 - DNA, 19 bp, Homo sapiens
tataaattgtacattttgt

SEQ ID NO: 123535 - DNA, 21 bp, Homo sapiens
tataaatttaagaaaacaagt

SEQ ID NO: 123536 - DNA, 16 bp, Homo sapiens
tataacttcaaatttt

SEQ ID NO: 123537 - DNA, 22 bp, Homo sapiens
tataagaaaagtaatgaagaat

SEQ ID NO: 123538 - DNA, 14 bp, Homo sapiens
tataataactgaac

SEQ ID NO: 123539 - DNA, 20 bp, Homo sapiens
tataataactgaactgtttg

SEQ ID NO: 123540 - DNA, 21 bp, Homo sapiens
tataataagttttgatataat

SEQ ID NO: 123541 - DNA, 18 bp, Homo sapiens
tataatctatttacataa

SEQ ID NO: 123542 - DNA, 18 bp, Homo sapiens
tataatcttggcttctta

SEQ ID NO: 123543 - DNA, 20 bp, Homo sapiens
tataatcttggcttcttaaa

SEQ ID NO: 123544 - DNA, 21 bp, Homo sapiens
tataatcttggcttcttaaaa

SEQ ID NO: 123545 - DNA, 22 bp, Homo sapiens
tataatcttggcttcttaaaaa

SEQ ID NO: 123546 - DNA, 16 bp, Homo sapiens
tataattgttgatatt

SEQ ID NO: 123547 - DNA, 20 bp, Homo sapiens
tataatttactttgtagact

SEQ ID NO: 123548 - DNA, 15 bp, Homo sapiens
tatactgtaaaagtt

SEQ ID NO: 123549 - DNA, 19 bp, Homo sapiens
tatactgtaaaagttataa

SEQ ID NO: 123550 - DNA, 15 bp, Homo sapiens
tataggtaacgtgat

SEQ ID NO: 123551 - DNA, 22 bp, Homo sapiens
tataggtaacgtgattgattca

SEQ ID NO: 123552 - DNA, 23 bp, Homo sapiens
tataggtaacgtgattgattcag

SEQ ID NO: 123553 - DNA, 17 bp, Homo sapiens
tatataatttactttgt

SEQ ID NO: 123554 - DNA, 14 bp, Homo sapiens
tatatagctggcaa

SEQ ID NO: 123555 - DNA, 17 bp, Homo sapiens
tatatatcataaagtat

SEQ ID NO: 123556 - DNA, 21 bp, Homo sapiens
tatatattctacacatatatg

SEQ ID NO: 123557 - DNA, 17 bp, Homo sapiens
tatatctatatctctaa

SEQ ID NO: 123558 - DNA, 18 bp, Homo sapiens
tatatctatatctctaaa

SEQ ID NO: 123559 - DNA, 16 bp, Homo sapiens
tatatctgtttgtata

SEQ ID NO: 123560 - DNA, 15 bp, Homo sapiens
tatatggcatttgca

SEQ ID NO: 123561 - DNA, 17 bp, Homo sapiens
tatatgtatatgtatat

SEQ ID NO: 123562 - DNA, 14 bp, Homo sapiens
tatatgttctgcaa

SEQ ID NO: 123563 - DNA, 14 bp, Homo sapiens
tatattccaaggaa

SEQ ID NO: 123564 - DNA, 22 bp, Homo sapiens
tatattgtcctcccctatttta

SEQ ID NO: 123565 - DNA, 21 bp, Homo sapiens
tatatttgcaaaccctttgta

SEQ ID NO: 123566 - DNA, 13 bp, Homo sapiens
tatcactaaataa

SEQ ID NO: 123567 - DNA, 16 bp, Homo sapiens
tatcactaaataaaca

SEQ ID NO: 123568 - DNA, 20 bp, Homo sapiens
tatcactaaataaacacgat

SEQ ID NO: 123569 - DNA, 21 bp, Homo sapiens
tatcagaaacagtattttctt

SEQ ID NO: 123570 - DNA, 13 bp, Homo sapiens
tatcataaagtat

SEQ ID NO: 123571 - DNA, 18 bp, Homo sapiens
tatcattaaaatatatgt

SEQ ID NO: 123572 - DNA, 18 bp, Homo sapiens
tatcatttttgtataaaa

SEQ ID NO: 123573 - DNA, 20 bp, Homo sapiens
tatcatttttgtataaaaag

SEQ ID NO: 123574 - DNA, 16 bp, Homo sapiens
tatcgatctcttattt

SEQ ID NO: 123575 - DNA, 15 bp, Homo sapiens
tatctatatctctaa

SEQ ID NO: 123576 - DNA, 15 bp, Homo sapiens
gagtctgaagcctgc

SEQ ID NO: 123577 - DNA, 11 bp, Homo sapiens
gagtgaaacag

SEQ ID NO: 123578 - DNA, 18 bp, Homo sapiens
gagtgaaacagagaaaga

SEQ ID NO: 123579 - DNA, 23 bp, Homo sapiens
gagttattttaattatcttttct

SEQ ID NO: 123580 - DNA, 19 bp, Homo sapiens
gagtttacagtttgtgttt

SEQ ID NO: 123581 - DNA, 21 bp, Homo sapiens
gagtttgctaaattgagaggg

SEQ ID NO: 123582 - DNA, 21 bp, Homo sapiens
tatgcaataaaattatttgca

SEQ ID NO: 123583 - DNA, 13 bp, Homo sapiens
tatggcatttgca

SEQ ID NO: 123584 - DNA, 19 bp, Homo sapiens
tatggcatttgcagatttt

SEQ ID NO: 123585 - DNA, 18 bp, Homo sapiens
tatggcccagccactgca

SEQ ID NO: 123586 - DNA, 19 bp, Homo sapiens
tatggtctggggtaaaatt

SEQ ID NO: 123587 - DNA, 20 bp, Homo sapiens
tatggtctggggtaaaattg

SEQ ID NO: 123588 - DNA, 23 bp, Homo sapiens
tatgttctgcaagaattaaaact

SEQ ID NO: 123589 - DNA, 15 bp, Homo sapiens
tatgtttgatttctc

SEQ ID NO: 123590 - DNA, 15 bp, Homo sapiens
tattaagatttccaa

SEQ ID NO: 123591 - DNA, 21 bp, Homo sapiens
tattacaaatgcaaatttcta

SEQ ID NO: 123592 - DNA, 17 bp, Homo sapiens
tattagtcataaaacac

SEQ ID NO: 123593 - DNA, 12 bp, Homo sapiens
tattagttgctt

SEQ ID NO: 123594 - DNA, 14 bp, Homo sapiens
tattagttgctttg

SEQ ID NO: 123595 - DNA, 22 bp, Homo sapiens
tattagtttgatttaatatctg

SEQ ID NO: 123596 - DNA, 12 bp, Homo sapiens
tattatttgata

SEQ ID NO: 123597 - DNA, 17 bp, Homo sapiens
tattcaattaaagaaat

SEQ ID NO: 123598 - DNA, 13 bp, Homo sapiens
tattcagaaatta

SEQ ID NO: 123599 - DNA, 20 bp, Homo sapiens
tattcagaaattaaaatatt

SEQ ID NO: 123600 - DNA, 16 bp, Homo sapiens
tattccaaggaaaatt

SEQ ID NO: 123601 - DNA, 20 bp, Homo sapiens
tattctacacatatatgtat

SEQ ID NO: 123602 - DNA, 17 bp, Homo sapiens
tattctgtggttctata

SEQ ID NO: 123603 - DNA, 13 bp, Homo sapiens
tattcttaaaatg

SEQ ID NO: 123604 - DNA, 14 bp, Homo sapiens
tattgaaaaatcag

SEQ ID NO: 123605 - DNA, 14 bp, Homo sapiens
tattgctaaaagtg

SEQ ID NO: 123606 - DNA, 14 bp, Homo sapiens
tattggaagctgct

SEQ ID NO: 123607 - DNA, 21 bp, Homo sapiens
tattggaagctgctgaggccc

SEQ ID NO: 123608 - DNA, 17 bp, Homo sapiens
tattggcagccaaggaa

SEQ ID NO: 123609 - DNA, 22 bp, Homo sapiens
tatttaagtttgttgctgtcaa

SEQ ID NO: 123610 - DNA, 13 bp, Homo sapiens
tatttagaatata

SEQ ID NO: 123611 - DNA, 20 bp, Homo sapiens
tatttagaatatattaaatc

SEQ ID NO: 123612 - DNA, 18 bp, Homo sapiens
tatttccacataaaggta

SEQ ID NO: 123613 - DNA, 19 bp, Homo sapiens
tatttgcaaaccctttgta

SEQ ID NO: 123614 - DNA, 17 bp, Homo sapiens
tattttaagaaagagaa

SEQ ID NO: 123615 - DNA, 13 bp, Homo sapiens
tatttttaaaata

SEQ ID NO: 123616 - DNA, 15 bp, Homo sapiens
tatttttaaaataaa

SEQ ID NO: 123617 - DNA, 16 bp, Homo sapiens
tatttttacatgcaga

SEQ ID NO: 123618 - DNA, 19 bp, Homo sapiens
tcaaaaaaaaaaaaaaaga

SEQ ID NO: 123619 - DNA, 23 bp, Homo sapiens
tcaaaaaaaaaaaaaaagactgt

SEQ ID NO: 123620 - DNA, 12 bp, Homo sapiens
tcaaaatgcttc

SEQ ID NO: 123621 - DNA, 18 bp, Homo sapiens
tcaaatgaacttttacag

SEQ ID NO: 123622 - DNA, 19 bp, Homo sapiens
tcaaatgaacttttacaga

SEQ ID NO: 123623 - DNA, 17 bp, Homo sapiens
tcaaatgtgcattttgt

SEQ ID NO: 123624 - DNA, 21 bp, Homo sapiens
tcaaattttttaaaagagaca

SEQ ID NO: 123625 - DNA, 14 bp, Homo sapiens
tcaagatgagatat

SEQ ID NO: 123626 - DNA, 19 bp, Homo sapiens
tcaagattttttttgtaac

SEQ ID NO: 123627 - DNA, 22 bp, Homo sapiens
tcaagattttttttgtaacttc

SEQ ID NO: 123628 - DNA, 14 bp, Homo sapiens
tcaagtctctgctg

SEQ ID NO: 123629 - DNA, 16 bp, Homo sapiens
tcaagtctctgctggc

SEQ ID NO: 123630 - DNA, 17 bp, Homo sapiens
tcacaggactctgcaga

SEQ ID NO: 123631 - DNA, 18 bp, Homo sapiens
tcacaggactctgcagat

SEQ ID NO: 123632 - DNA, 13 bp, Homo sapiens
tcaccccaccctt

SEQ ID NO: 123633 - DNA, 14 bp, Homo sapiens
tcaccccagccccc

SEQ ID NO: 123634 - DNA, 15 bp, Homo sapiens
tcaccccagccccca

SEQ ID NO: 123635 - DNA, 16 bp, Homo sapiens
tcaccccagcccccac

SEQ ID NO: 123636 - DNA, 13 bp, Homo sapiens
tcaccccatccca

SEQ ID NO: 123637 - DNA, 14 bp, Homo sapiens
tcactagccatgat

SEQ ID NO: 123638 - DNA, 16 bp, Homo sapiens
tcactattacttgaac

SEQ ID NO: 123639 - DNA, 13 bp, Homo sapiens
tcactgcagcctt

SEQ ID NO: 123640 - DNA, 19 bp, Homo sapiens
tcagaaacagtattttctt

SEQ ID NO: 123641 - DNA, 17 bp, Homo sapiens
tcagaattgaaggagaa

SEQ ID NO: 123642 - DNA, 17 bp, Homo sapiens
tcagaggtcatcccttc

SEQ ID NO: 123643 - DNA, 18 bp, Homo sapiens
tcagatgcagttttcaaa

SEQ ID NO: 123644 - DNA, 23 bp, Homo sapiens
tcagatgcagttttcaaattata

SEQ ID NO: 123645 - DNA, 12 bp, Homo sapiens
tcagcatgacaa

SEQ ID NO: 123646 - DNA, 24 bp, Homo sapiens
tcagcatgacaaaaataacactgt

SEQ ID NO: 123647 - DNA, 13 bp, Homo sapiens
tcagctccctgac

SEQ ID NO: 123648 - DNA, 13 bp, Homo sapiens
tcagctctcctgg

SEQ ID NO: 123649 - DNA, 14 bp, Homo sapiens
tcagctctcctggc

SEQ ID NO: 123650 - DNA, 15 bp, Homo sapiens
tcagctctcctggct

SEQ ID NO: 123651 - DNA, 20 bp, Homo sapiens
tcaggaaagaatagaaagaa

SEQ ID NO: 123652 - DNA, 23 bp, Homo sapiens
tcaggaaagaatagaaagaaagt

SEQ ID NO: 123653 - DNA, 22 bp, Homo sapiens
tcaggatatggcttaggaatga

SEQ ID NO: 123654 - DNA, 20 bp, Homo sapiens
tcaggcgatccacctgtctc

SEQ ID NO: 123655 - DNA, 16 bp, Homo sapiens
tcagggatagcgctgt

SEQ ID NO: 123656 - DNA, 20 bp, Homo sapiens
tcagtatcttagagtttaca

SEQ ID NO: 123657 - DNA, 16 bp, Homo sapiens
tcagtgaagtctagaa

SEQ ID NO: 123658 - DNA, 12 bp, Homo sapiens
tcagtttctaca

SEQ ID NO: 123659 - DNA, 13 bp, Homo sapiens
tcataaagtatgc

SEQ ID NO: 123660 - DNA, 22 bp, Homo sapiens
tcatagccctcagacatttata

SEQ ID NO: 123661 - DNA, 21 bp, Homo sapiens
tcatcaatagtgtcctatgca

SEQ ID NO: 123662 - DNA, 19 bp, Homo sapiens
tcatcccttcctcctctcc

SEQ ID NO: 123663 - DNA, 22 bp, Homo sapiens
tcatctaactgatgagtaaact

SEQ ID NO: 123664 - DNA, 19 bp, Homo sapiens
tcatgaaggacactctgca

SEQ ID NO: 123665 - DNA, 21 bp, Homo sapiens
tcatgaaggacactctgcagg

SEQ ID NO: 123666 - DNA, 22 bp, Homo sapiens
tcatgaaggacactctgcaggg

SEQ ID NO: 123667 - DNA, 13 bp, Homo sapiens
tcatgcccactgc

SEQ ID NO: 123668 - DNA, 14 bp, Homo sapiens
tcatgcccactgcc

SEQ ID NO: 123669 - DNA, 12 bp, Homo sapiens
tcatgtaagttt

SEQ ID NO: 123670 - DNA, 19 bp, Homo sapiens
tcattaaaatatatgttct

SEQ ID NO: 123671 - DNA, 22 bp, Homo sapiens
tcattaaaatatatgttctgca

SEQ ID NO: 123672 - DNA, 13 bp, Homo sapiens
tcattaagaataa

SEQ ID NO: 123673 - DNA, 13 bp, Homo sapiens
tcattacttctga

SEQ ID NO: 123674 - DNA, 13 bp, Homo sapiens
tcatttttgtata

SEQ ID NO: 123675 - DNA, 17 bp, Homo sapiens
tcatttttgtataaaaa

SEQ ID NO: 123676 - DNA, 20 bp, Homo sapiens
tccaaagggcagtaaagttt

SEQ ID NO: 123677 - DNA, 11 bp, Homo sapiens
tccaagaaaat

SEQ ID NO: 123678 - DNA, 14 bp, Homo sapiens
gcccccaggccagg

SEQ ID NO: 123679 - DNA, 13 bp, Homo sapiens
gccccgtcccaga

SEQ ID NO: 123680 - DNA, 14 bp, Homo sapiens
gccccgtcccagag

SEQ ID NO: 123681 - DNA, 21 bp, Homo sapiens
gccccgtccccctagagactc

SEQ ID NO: 123682 - DNA, 20 bp, Homo sapiens
gcccctgccaaggccggaga

SEQ ID NO: 123683 - DNA, 15 bp, Homo sapiens
gcccctggcagcaca

SEQ ID NO: 123684 - DNA, 19 bp, Homo sapiens
tcactgattccctctccca

SEQ ID NO: 123685 - DNA, 20 bp, Homo sapiens
tcacttaacattcctaaaat

SEQ ID NO: 123686 - DNA, 22 bp, Homo sapiens
tcacttaacattcctaaaatgc

SEQ ID NO: 123687 - DNA, 20 bp, Homo sapiens
tcagaaacagtattttcttc

SEQ ID NO: 123688 - DNA, 14 bp, Homo sapiens
tcagaaattaaaat

SEQ ID NO: 123689 - DNA, 17 bp, Homo sapiens
tcagaggacccacctgg

SEQ ID NO: 123690 - DNA, 18 bp, Homo sapiens
tcagcatgacaaaaataa

SEQ ID NO: 123691 - DNA, 16 bp, Homo sapiens
tcagcccccaggccag

SEQ ID NO: 123692 - DNA, 16 bp, Homo sapiens
tcagctcagctgggcc

SEQ ID NO: 123693 - DNA, 21 bp, Homo sapiens
tcaggcgatccacctgtctca

SEQ ID NO: 123694 - DNA, 20 bp, Homo sapiens
tcaggtctctgtgggtggga

SEQ ID NO: 123695 - DNA, 15 bp, Homo sapiens
tcagtcgtctgtccc

SEQ ID NO: 123696 - DNA, 12 bp, Homo sapiens
tcagtgagatat

SEQ ID NO: 123697 - DNA, 23 bp, Homo sapiens
tcataaaacaccatcattaagaa

SEQ ID NO: 123698 - DNA, 22 bp, Homo sapiens
tcatacttaacatttcattgta

SEQ ID NO: 123699 - DNA, 18 bp, Homo sapiens
tcatagccctcagacatt

SEQ ID NO: 123700 - DNA, 21 bp, Homo sapiens
tcatatgaggacctttatatc

SEQ ID NO: 123701 - DNA, 22 bp, Homo sapiens
tcatcccttcctcctctcctgg

SEQ ID NO: 123702 - DNA, 23 bp, Homo sapiens
tcatcccttcctcctctcctgga

SEQ ID NO: 123703 - DNA, 17 bp, Homo sapiens
tcatgcaagacttcact

SEQ ID NO: 123704 - DNA, 19 bp, Homo sapiens
tcatgccaccatggccagc

SEQ ID NO: 123705 - DNA, 13 bp, Homo sapiens
tcatgtaagttta

SEQ ID NO: 123706 - DNA, 15 bp, Homo sapiens
tcattaaaatatatg

SEQ ID NO: 123707 - DNA, 18 bp, Homo sapiens
tcattaaaatatatgttc

SEQ ID NO: 123708 - DNA, 20 bp, Homo sapiens
tcattaaaatatatgttctg

SEQ ID NO: 123709 - DNA, 21 bp, Homo sapiens
tcattaaaatatatgttctgc

SEQ ID NO: 123710 - DNA, 23 bp, Homo sapiens
tcattaaaatatatgttctgcaa

SEQ ID NO: 123711 - DNA, 17 bp, Homo sapiens
tcattaatcaatttctc

SEQ ID NO: 123712 - DNA, 19 bp, Homo sapiens
tcattacttctgagcccca

SEQ ID NO: 123713 - DNA, 16 bp, Homo sapiens
tcattgtacaagtatt

SEQ ID NO: 123714 - DNA, 21 bp, Homo sapiens
tcattgtacaagtattacaac

SEQ ID NO: 123715 - DNA, 18 bp, Homo sapiens
tcatttcaaaatgcttca

SEQ ID NO: 123716 - DNA, 15 bp, Homo sapiens
tcatttttgtataaa

SEQ ID NO: 123717 - DNA, 16 bp, Homo sapiens
tccaaaccagtttatt

SEQ ID NO: 123718 - DNA, 20 bp, Homo sapiens
tccaaaccagtttattctgt

SEQ ID NO: 123719 - DNA, 21 bp, Homo sapiens
tccaaaccagtttattctgtg

SEQ ID NO: 123720 - DNA, 18 bp, Homo sapiens
tccaaatccaaggaaaca

SEQ ID NO: 123721 - DNA, 12 bp, Homo sapiens
tccaaattatta

SEQ ID NO: 123722 - DNA, 17 bp, Homo sapiens
tccaaattattaattgt

SEQ ID NO: 123723 - DNA, 21 bp, Homo sapiens
tccaacccgttgggtcccttg

SEQ ID NO: 123724 - DNA, 15 bp, Homo sapiens
tccaaggaaaattga

SEQ ID NO: 123725 - DNA, 17 bp, Homo sapiens
tccaaggaaaattgaaa

SEQ ID NO: 123726 - DNA, 21 bp, Homo sapiens
tccaaggaaaattgaaagtat

SEQ ID NO: 123727 - DNA, 15 bp, Homo sapiens
tccaaggaaacatgc

SEQ ID NO: 123728 - DNA, 15 bp, Homo sapiens
tccaagtgccaatat

SEQ ID NO: 123729 - DNA, 13 bp, Homo sapiens
tccaatagaaaga

SEQ ID NO: 123730 - DNA, 17 bp, Homo sapiens
tccaatagaaagaaact

SEQ ID NO: 123731 - DNA, 14 bp, Homo sapiens
tccaccggcccctg

SEQ ID NO: 123732 - DNA, 15 bp, Homo sapiens
tccaccggcccctgg

SEQ ID NO: 123733 - DNA, 16 bp, Homo sapiens
tccaccggcccctggc

SEQ ID NO: 123734 - DNA, 17 bp, Homo sapiens
tccaccggcccctggca

SEQ ID NO: 123735 - DNA, 18 bp, Homo sapiens
tccaccggcccctggcag

SEQ ID NO: 123736 - DNA, 13 bp, Homo sapiens
tccacctgtctca

SEQ ID NO: 123737 - DNA, 20 bp, Homo sapiens
tccacctgtctcagcctccc

SEQ ID NO: 123738 - DNA, 13 bp, Homo sapiens
tccactgtttcat

SEQ ID NO: 123739 - DNA, 13 bp, Homo sapiens
tccatgcctctgg

SEQ ID NO: 123740 - DNA, 14 bp, Homo sapiens
tccatgcctctgga

SEQ ID NO: 123741 - DNA, 19 bp, Homo sapiens
tcccaaatcaaaataaaag

SEQ ID NO: 123742 - DNA, 19 bp, Homo sapiens
tcccaagattttttcattt

SEQ ID NO: 123743 - DNA, 21 bp, Homo sapiens
tcccaagtcctgctcctttct

SEQ ID NO: 123744 - DNA, 13 bp, Homo sapiens
tcccacaccctgg

SEQ ID NO: 123745 - DNA, 16 bp, Homo sapiens
tcccacccaaggagaa

SEQ ID NO: 123746 - DNA, 19 bp, Homo sapiens
tcccagaggccgctgcccc

SEQ ID NO: 123747 - DNA, 20 bp, Homo sapiens
tcccagaggccgctgcccct

SEQ ID NO: 123748 - DNA, 20 bp, Homo sapiens
tcccagctctctctcctgga

SEQ ID NO: 123749 - DNA, 16 bp, Homo sapiens
tcccagtgagcctctg

SEQ ID NO: 123750 - DNA, 18 bp, Homo sapiens
tcccagtgagcctctgcg

SEQ ID NO: 123751 - DNA, 19 bp, Homo sapiens
tcccagtgagcctctgcgc

SEQ ID NO: 123752 - DNA, 15 bp, Homo sapiens
tgattgattcagtat

SEQ ID NO: 123753 - DNA, 19 bp, Homo sapiens
tgatttccagtgagtgtaa

SEQ ID NO: 123754 - DNA, 21 bp, Homo sapiens
tgcaaaattaaatctagacat

SEQ ID NO: 123755 - DNA, 21 bp, Homo sapiens
tgcaaaccctttgtattataa

SEQ ID NO: 123756 - DNA, 19 bp, Homo sapiens
tgcaaatttctataaattt

SEQ ID NO: 123757 - DNA, 15 bp, Homo sapiens
tgcaacatttctgta

SEQ ID NO: 123758 - DNA, 16 bp, Homo sapiens
tgcaacatttctgtat

SEQ ID NO: 123759 - DNA, 14 bp, Homo sapiens
tgcaagaattaaaa

SEQ ID NO: 123760 - DNA, 17 bp, Homo sapiens
tgcaagaattaaaactg

SEQ ID NO: 123761 - DNA, 19 bp, Homo sapiens
tgcaagacttcactgcagc

SEQ ID NO: 123762 - DNA, 17 bp, Homo sapiens
tgcaagtgaacttggga

SEQ ID NO: 123763 - DNA, 19 bp, Homo sapiens
tgcaattccaagaaaatat

SEQ ID NO: 123764 - DNA, 16 bp, Homo sapiens
tgcacagaagggctct

SEQ ID NO: 123765 - DNA, 17 bp, Homo sapiens
tgcacagaagggctctt

SEQ ID NO: 123766 - DNA, 22 bp, Homo sapiens
tgcacagaagggctctttctct

SEQ ID NO: 123767 - DNA, 23 bp, Homo sapiens
tgcacattttgtacaaagatatg

SEQ ID NO: 123768 - DNA, 19 bp, Homo sapiens
tgcacctatggcccagcca

SEQ ID NO: 123769 - DNA, 15 bp, Homo sapiens
tgcactcatcatatt

SEQ ID NO: 123770 - DNA, 12 bp, Homo sapiens
tgcactttgtag

SEQ ID NO: 123771 - DNA, 15 bp, Homo sapiens
tgcactttgtagtgt

SEQ ID NO: 123772 - DNA, 20 bp, Homo sapiens
tgcagaagttcttagtgttg

SEQ ID NO: 123773 - DNA, 21 bp, Homo sapiens
tgcagatctttttgtgaaatt

SEQ ID NO: 123774 - DNA, 15 bp, Homo sapiens
tgcagccacatggga

SEQ ID NO: 123775 - DNA, 17 bp, Homo sapiens
tgcagcctttcacagga

SEQ ID NO: 123776 - DNA, 19 bp, Homo sapiens
tgcagcgggccaggcaggc

SEQ ID NO: 123777 - DNA, 21 bp, Homo sapiens
tgcaggtctttaaatcatttt

SEQ ID NO: 123778 - DNA, 20 bp, Homo sapiens
tgcatacaactgtgcattac

SEQ ID NO: 123779 - DNA, 15 bp, Homo sapiens
tgcatcctcctcagc

SEQ ID NO: 123780 - DNA, 12 bp, Homo sapiens
tgcattaaaaaa

SEQ ID NO: 123781 - DNA, 23 bp, Homo sapiens
tgcattaaaaaaaaaaaaaaact

SEQ ID NO: 123782 - DNA, 16 bp, Homo sapiens
tgcattagacagatga

SEQ ID NO: 123783 - DNA, 13 bp, Homo sapiens
tgcatttaaggag

SEQ ID NO: 123784 - DNA, 17 bp, Homo sapiens
tgcattttcaccccacc

SEQ ID NO: 123785 - DNA, 23 bp, Homo sapiens
tgccaaggccggagacccacagc

SEQ ID NO: 123786 - DNA, 18 bp, Homo sapiens
tgccaccatggccagcca

SEQ ID NO: 123787 - DNA, 16 bp, Homo sapiens
tgcccaatccaggccc

SEQ ID NO: 123788 - DNA, 21 bp, Homo sapiens
tgcccaccgaggagccccagc

SEQ ID NO: 123789 - DNA, 23 bp, Homo sapiens
tgcccaccgaggagccccagccc

SEQ ID NO: 123790 - DNA, 13 bp, Homo sapiens
tgccccaaggagg

SEQ ID NO: 123791 - DNA, 21 bp, Homo sapiens
tgccccacccaccccacagac

SEQ ID NO: 123792 - DNA, 13 bp, Homo sapiens
tgcccctgagttc

SEQ ID NO: 123793 - DNA, 21 bp, Homo sapiens
tgcccctgccaaggccggaga

SEQ ID NO: 123794 - DNA, 23 bp, Homo sapiens
tgcccttaaggatcaccccagcc

SEQ ID NO: 123795 - DNA, 15 bp, Homo sapiens
tgcctcctgcctccc

SEQ ID NO: 123796 - DNA, 16 bp, Homo sapiens
tgcctcctgcctcccg

SEQ ID NO: 123797 - DNA, 21 bp, Homo sapiens
tgcctctggaggcctctggcc

SEQ ID NO: 123798 - DNA, 15 bp, Homo sapiens
tgcctgccccaccca

SEQ ID NO: 123799 - DNA, 13 bp, Homo sapiens
tgctaaaagaaga

SEQ ID NO: 123800 - DNA, 15 bp, Homo sapiens
tgctaaaagaagaga

SEQ ID NO: 123801 - DNA, 21 bp, Homo sapiens
tgctacttatcatttttgtat

SEQ ID NO: 123802 - DNA, 20 bp, Homo sapiens
tgctcagggtcaatttcttt

SEQ ID NO: 123803 - DNA, 16 bp, Homo sapiens
tgctgagcctgcccag

SEQ ID NO: 123804 - DNA, 12 bp, Homo sapiens
tgctgagctggg

SEQ ID NO: 123805 - DNA, 16 bp, Homo sapiens
tgctgagctgggccca

SEQ ID NO: 123806 - DNA, 18 bp, Homo sapiens
tgctgcttggagtgcccc

SEQ ID NO: 123807 - DNA, 20 bp, Homo sapiens
tgctgcttggagtgccccaa

SEQ ID NO: 123808 - DNA, 13 bp, Homo sapiens
tgcttaatttcct

SEQ ID NO: 123809 - DNA, 19 bp, Homo sapiens
tgcttaatttccttctgtt

SEQ ID NO: 123810 - DNA, 20 bp, Homo sapiens
tgcttaatttccttctgtta

SEQ ID NO: 123811 - DNA, 19 bp, Homo sapiens
tgcttggagtgccccaagg

SEQ ID NO: 123812 - DNA, 21 bp, Homo sapiens
tgcttggagtgccccaaggag

SEQ ID NO: 123813 - DNA, 16 bp, Homo sapiens
tgcttgttccctctcc

SEQ ID NO: 123814 - DNA, 20 bp, Homo sapiens
tgcttttgaaggaatacaat

SEQ ID NO: 123815 - DNA, 21 bp, Homo sapiens
tggaataaagttctgttttct

SEQ ID NO: 123816 - DNA, 15 bp, Homo sapiens
tggaatgtgagtgtg

SEQ ID NO: 123817 - DNA, 14 bp, Homo sapiens
tggagaaagtaagt

SEQ ID NO: 123818 - DNA, 16 bp, Homo sapiens
tggagacaataaacag

SEQ ID NO: 123819 - DNA, 18 bp, Homo sapiens
tggagacaataaacagct

SEQ ID NO: 123820 - DNA, 17 bp, Homo sapiens
tggaggcctctggccct

SEQ ID NO: 123821 - DNA, 22 bp, Homo sapiens
tggagtgccccaaggaggtggc

SEQ ID NO: 123822 - DNA, 14 bp, Homo sapiens
tggatcagaggtca

SEQ ID NO: 123823 - DNA, 15 bp, Homo sapiens
tggcacttgcctgct

SEQ ID NO: 123824 - DNA, 19 bp, Homo sapiens
tggcagcacagcccagggc

SEQ ID NO: 123825 - DNA, 22 bp, Homo sapiens
tggcagcacagcccagggcctg

SEQ ID NO: 123826 - DNA, 23 bp, Homo sapiens
tggcagccaaggaatgtgtccaa

SEQ ID NO: 123827 - DNA, 17 bp, Homo sapiens
tggcatgggcgcaggcc

SEQ ID NO: 123828 - DNA, 21 bp, Homo sapiens
tggcatgggcgcaggcccagt

SEQ ID NO: 123829 - DNA, 17 bp, Homo sapiens
tggccactggcacttgc

SEQ ID NO: 123830 - DNA, 22 bp, Homo sapiens
tggcccagccaaaccctgtctg

SEQ ID NO: 123831 - DNA, 13 bp, Homo sapiens
tggcccagccact

SEQ ID NO: 123832 - DNA, 16 bp, Homo sapiens
tggcccagccactgca

SEQ ID NO: 123833 - DNA, 19 bp, Homo sapiens
tggcccagccactgcagca

SEQ ID NO: 123834 - DNA, 17 bp, Homo sapiens
tggccctcccaggctgg

SEQ ID NO: 123835 - DNA, 16 bp, Homo sapiens
tggccctcggtggctg

SEQ ID NO: 123836 - DNA, 21 bp, Homo sapiens
tggctgcacagaagggctctt

SEQ ID NO: 123837 - DNA, 16 bp, Homo sapiens
tggcttatttgtataa

SEQ ID NO: 123838 - DNA, 18 bp, Homo sapiens
tggcttcttaaaaactgt

SEQ ID NO: 123839 - DNA, 13 bp, Homo sapiens
tgggaaaaagaga

SEQ ID NO: 123840 - DNA, 19 bp, Homo sapiens
tctgtcccaagtcctgctc

SEQ ID NO: 123841 - DNA, 15 bp, Homo sapiens
tctgtggttctataa

SEQ ID NO: 123842 - DNA, 19 bp, Homo sapiens
tctgtggttctataataag

SEQ ID NO: 123843 - DNA, 24 bp, Homo sapiens
tctgttccatagttaaagaagaca

SEQ ID NO: 123844 - DNA, 18 bp, Homo sapiens
tctgtttgtatatttgca

SEQ ID NO: 123845 - DNA, 14 bp, Homo sapiens
tcttaaaaactgtg

SEQ ID NO: 123846 - DNA, 16 bp, Homo sapiens
tcttaaaatgcaatat

SEQ ID NO: 123847 - DNA, 17 bp, Homo sapiens
tcttataggtttccact

SEQ ID NO: 123848 - DNA, 14 bp, Homo sapiens
tcttcaacatgaca

SEQ ID NO: 123849 - DNA, 20 bp, Homo sapiens
tcttcagtcgtctgtcccaa

SEQ ID NO: 123850 - DNA, 22 bp, Homo sapiens
tcttcccaaatcaaaataaaag

SEQ ID NO: 123851 - DNA, 19 bp, Homo sapiens
tcttcctagtatattagtt

SEQ ID NO: 123852 - DNA, 15 bp, Homo sapiens
tcttgaattgttatg

SEQ ID NO: 123853 - DNA, 16 bp, Homo sapiens
tcttggcttcttaaaa

SEQ ID NO: 123854 - DNA, 23 bp, Homo sapiens
tcttggcttcttaaaaactgtgt

SEQ ID NO: 123855 - DNA, 23 bp, Homo sapiens
tctttaaatcattttaggaaagg

SEQ ID NO: 123856 - DNA, 18 bp, Homo sapiens
tctttaatcacttaacat

SEQ ID NO: 123857 - DNA, 23 bp, Homo sapiens
tctttaatcacttaacattccta

SEQ ID NO: 123858 - DNA, 17 bp, Homo sapiens
tctttgtatcattcatc

SEQ ID NO: 123859 - DNA, 14 bp, Homo sapiens
tctttgtgtgttat

SEQ ID NO: 123860 - DNA, 21 bp, Homo sapiens
tcttttaaagtatttataaaa

SEQ ID NO: 123861 - DNA, 18 bp, Homo sapiens
tcttttaggatcagatct

SEQ ID NO: 123862 - DNA, 15 bp, Homo sapiens
tcttttatttaacaa

SEQ ID NO: 123863 - DNA, 18 bp, Homo sapiens
tcttttatttaacaaaaa

SEQ ID NO: 123864 - DNA, 17 bp, Homo sapiens
tcttttctttgtatcat

SEQ ID NO: 123865 - DNA, 20 bp, Homo sapiens
tcttttctttgtatcattca

SEQ ID NO: 123866 - DNA, 16 bp, Homo sapiens
tcttttttttttccaa

SEQ ID NO: 123867 - DNA, 14 bp, Homo sapiens
tgaaaaatattgct

SEQ ID NO: 123868 - DNA, 20 bp, Homo sapiens
tgaaaaatattgctaaaagt

SEQ ID NO: 123869 - DNA, 17 bp, Homo sapiens
tgaaaataccataggaa

SEQ ID NO: 123870 - DNA, 19 bp, Homo sapiens
tgaaaatcctatatctgtt

SEQ ID NO: 123871 - DNA, 11 bp, Homo sapiens
tgaaacagaga

SEQ ID NO: 123872 - DNA, 15 bp, Homo sapiens
tgaaacagagaaaga

SEQ ID NO: 123873 - DNA, 22 bp, Homo sapiens
tgaaacagagaaagaaaaggca

SEQ ID NO: 123874 - DNA, 23 bp, Homo sapiens
tgaaacagagaaagaaaaggcaa

SEQ ID NO: 123875 - DNA, 19 bp, Homo sapiens
tgaaacatgtgcccctgcc

SEQ ID NO: 123876 - DNA, 20 bp, Homo sapiens
tgaaacgagaagtgccctta

SEQ ID NO: 123877 - DNA, 16 bp, Homo sapiens
tgaaatgctggcattt

SEQ ID NO: 123878 - DNA, 17 bp, Homo sapiens
tgaaattcaacctgtgt

SEQ ID NO: 123879 - DNA, 12 bp, Homo sapiens
tgaacaaaagct

SEQ ID NO: 123880 - DNA, 18 bp, Homo sapiens
tgaacagcaggatgccct

SEQ ID NO: 123881 - DNA, 15 bp, Homo sapiens
tgaacatttactaca

SEQ ID NO: 123882 - DNA, 13 bp, Homo sapiens
tgaacccttgctt

SEQ ID NO: 123883 - DNA, 15 bp, Homo sapiens
tgaacccttgcttgc

SEQ ID NO: 123884 - DNA, 15 bp, Homo sapiens
tgaaccgacttttct

SEQ ID NO: 123885 - DNA, 20 bp, Homo sapiens
tgaactgaaggcagcatgta

SEQ ID NO: 123886 - DNA, 16 bp, Homo sapiens
tgaacttccaagctcc

SEQ ID NO: 123887 - DNA, 14 bp, Homo sapiens
tgaactttccaaaa

SEQ ID NO: 123888 - DNA, 14 bp, Homo sapiens
tgaacttttacaga

SEQ ID NO: 123889 - DNA, 16 bp, Homo sapiens
tgaacttttacagaat

SEQ ID NO: 123890 - DNA, 13 bp, Homo sapiens
tgaacttttgtaa

SEQ ID NO: 123891 - DNA, 16 bp, Homo sapiens
tgaacttttgtaattt

SEQ ID NO: 123892 - DNA, 20 bp, Homo sapiens
tgaacttttgtaatttgaat

SEQ ID NO: 123893 - DNA, 22 bp, Homo sapiens
tgaacttttgtaatttgaattg

SEQ ID NO: 123894 - DNA, 20 bp, Homo sapiens
tgaagcaccagggagaggcc

SEQ ID NO: 123895 - DNA, 21 bp, Homo sapiens
tgaagcaccagggagaggcct

SEQ ID NO: 123896 - DNA, 13 bp, Homo sapiens
tgaagctggccct

SEQ ID NO: 123897 - DNA, 15 bp, Homo sapiens
tgaagctggggcttg

SEQ ID NO: 123898 - DNA, 23 bp, Homo sapiens
tgaaggagaaaatgcattatgtg

SEQ ID NO: 123899 - DNA, 18 bp, Homo sapiens
tgaagtcgagcactctaa

SEQ ID NO: 123900 - DNA, 18 bp, Homo sapiens
tgaataaaaagtgaactt

SEQ ID NO: 123901 - DNA, 19 bp, Homo sapiens
tgaataaaaagtgaacttt

SEQ ID NO: 123902 - DNA, 20 bp, Homo sapiens
tgaatatatggcatttgcag

SEQ ID NO: 123903 - DNA, 11 bp, Homo sapiens
tgaattgttat

SEQ ID NO: 123904 - DNA, 14 bp, Homo sapiens
tgaattgttatgaa

SEQ ID NO: 123905 - DNA, 15 bp, Homo sapiens
tgacaaaaataacac

SEQ ID NO: 123906 - DNA, 16 bp, Homo sapiens
tgacaaacctagcttt

SEQ ID NO: 123907 - DNA, 20 bp, Homo sapiens
tgacaaacctagcttttaaa

SEQ ID NO: 123908 - DNA, 15 bp, Homo sapiens
tgacaaagactcctc

SEQ ID NO: 123909 - DNA, 18 bp, Homo sapiens
tgacaaagactcctctgg

SEQ ID NO: 123910 - DNA, 11 bp, Homo sapiens
tgacagcctcc

SEQ ID NO: 123911 - DNA, 22 bp, Homo sapiens
tgacagcctcccacccccatct

SEQ ID NO: 123912 - DNA, 23 bp, Homo sapiens
tgacatgcctatatgagaagaat

SEQ ID NO: 123913 - DNA, 15 bp, Homo sapiens
tgacggtttctcccc

SEQ ID NO: 123914 - DNA, 11 bp, Homo sapiens
tgactggctca

SEQ ID NO: 123915 - DNA, 12 bp, Homo sapiens
tgagaagaatag

SEQ ID NO: 123916 - DNA, 18 bp, Homo sapiens
tgagagaccacacatttt

SEQ ID NO: 123917 - DNA, 19 bp, Homo sapiens
tgagcattagctacttttc

SEQ ID NO: 123918 - DNA, 18 bp, Homo sapiens
tgagcccaaacaccctcc

SEQ ID NO: 123919 - DNA, 22 bp, Homo sapiens
tgagcccaaacaccctcctggc

SEQ ID NO: 123920 - DNA, 13 bp, Homo sapiens
tgagccccagccc

SEQ ID NO: 123921 - DNA, 13 bp, Homo sapiens
tgagcctgcccag

SEQ ID NO: 123922 - DNA, 13 bp, Homo sapiens
tgagctgggccca

SEQ ID NO: 123923 - DNA, 16 bp, Homo sapiens
tgagctgggcccagcc

SEQ ID NO: 123924 - DNA, 19 bp, Homo sapiens
tgagctgggcccagcccct

SEQ ID NO: 123925 - DNA, 15 bp, Homo sapiens
tgaggacctttatat

SEQ ID NO: 123926 - DNA, 18 bp, Homo sapiens
tgaggacctttatatctg

SEQ ID NO: 123927 - DNA, 18 bp, Homo sapiens
tgaggactgaagctgggg

SEQ ID NO: 123928 - DNA, 14 bp, Homo sapiens
tgaggctgggcagg

SEQ ID NO: 123929 - DNA, 17 bp, Homo sapiens
tgaggctgggcagggcc

SEQ ID NO: 123930 - DNA, 19 bp, Homo sapiens
tgaggttttgaataaaaag

SEQ ID NO: 123931 - DNA, 22 bp, Homo sapiens
tgaggttttgaataaaaagtga

SEQ ID NO: 123932 - DNA, 17 bp, Homo sapiens
tgagtaaactgaggccc

SEQ ID NO: 123933 - DNA, 14 bp, Homo sapiens
tgagtccatgaaaa

SEQ ID NO: 123934 - DNA, 21 bp, Homo sapiens
tgatagctgtttcaaatgtgc

SEQ ID NO: 123935 - DNA, 23 bp, Homo sapiens
tgatataatcttggcttcttaaa

SEQ ID NO: 123936 - DNA, 21 bp, Homo sapiens
tgatattttccctttttaaaa

SEQ ID NO: 123937 - DNA, 23 bp, Homo sapiens
tgatcaagatatatgtgtataca

SEQ ID NO: 123938 - DNA, 17 bp, Homo sapiens
tgatcccctctctgtgg

SEQ ID NO: 123939 - DNA, 21 bp, Homo sapiens
tgatgagtaaactgaggccca

SEQ ID NO: 123940 - DNA, 22 bp, Homo sapiens
tgatggaaacgcacttacaagt

SEQ ID NO: 123941 - DNA, 21 bp, Homo sapiens
tgtgctgagcctgcccagttg

SEQ ID NO: 123942 - DNA, 21 bp, Homo sapiens
tgtggaattttgagaaaaata

SEQ ID NO: 123943 - DNA, 20 bp, Homo sapiens
tgtggttctataataagttt

SEQ ID NO: 123944 - DNA, 18 bp, Homo sapiens
tgtgttttaaaaaaactg

SEQ ID NO: 123945 - DNA, 22 bp, Homo sapiens
tgtgttttaaaaaaactgaagg

SEQ ID NO: 123946 - DNA, 13 bp, Homo sapiens
tgttaagaaagga

SEQ ID NO: 123947 - DNA, 14 bp, Homo sapiens
tgttaagaaaggat

SEQ ID NO: 123948 - DNA, 21 bp, Homo sapiens
tgttaagaaaggatataaaag

SEQ ID NO: 123949 - DNA, 10 bp, Homo sapiens
tgttacaagt

SEQ ID NO: 123950 - DNA, 15 bp, Homo sapiens
tgttacaagtttgct

SEQ ID NO: 123951 - DNA, 17 bp, Homo sapiens
tgttacaagtttgctaa

SEQ ID NO: 123952 - DNA, 18 bp, Homo sapiens
tgttacaagtttgctaaa

SEQ ID NO: 123953 - DNA, 19 bp, Homo sapiens
tgttacaagtttgctaaaa

SEQ ID NO: 123954 - DNA, 22 bp, Homo sapiens
tgttacaagtttgctaaaagaa

SEQ ID NO: 123955 - DNA, 22 bp, Homo sapiens
tgttatattccaaggaaaattg

SEQ ID NO: 123956 - DNA, 15 bp, Homo sapiens
tgttatgaaaatcct

SEQ ID NO: 123957 - DNA, 23 bp, Homo sapiens
tgttatgaaaatcctatatctgt

SEQ ID NO: 123958 - DNA, 17 bp, Homo sapiens
tgttatttcttaaaatt

SEQ ID NO: 123959 - DNA, 21 bp, Homo sapiens
tgttattttttatttccacat

SEQ ID NO: 123960 - DNA, 21 bp, Homo sapiens
tgttccaatgccacatacttg

SEQ ID NO: 123961 - DNA, 22 bp, Homo sapiens
tgttccccactgacagcctccc

SEQ ID NO: 123962 - DNA, 15 bp, Homo sapiens
tgttccccccataga

SEQ ID NO: 123963 - DNA, 21 bp, Homo sapiens
tgttccgcttctctcttttaa

SEQ ID NO: 123964 - DNA, 20 bp, Homo sapiens
tgttctgtccagtttccaaa

SEQ ID NO: 123965 - DNA, 21 bp, Homo sapiens
tgttctgtccagtttccaaag

SEQ ID NO: 123966 - DNA, 17 bp, Homo sapiens
tgttgatttgagaaatt

SEQ ID NO: 123967 - DNA, 22 bp, Homo sapiens
tgttggcacttataggtaacgt

SEQ ID NO: 123968 - DNA, 18 bp, Homo sapiens
tgttgggatcgcattgca

SEQ ID NO: 123969 - DNA, 15 bp, Homo sapiens
tgtttcatgagccca

SEQ ID NO: 123970 - DNA, 20 bp, Homo sapiens
tgtttgtgtgcatgaaagag

SEQ ID NO: 123971 - DNA, 12 bp, Homo sapiens
tgttttaaaaaa

SEQ ID NO: 123972 - DNA, 12 bp, Homo sapiens
tgttttgcttac

SEQ ID NO: 123973 - DNA, 13 bp, Homo sapiens
ttaaaaaaactga

SEQ ID NO: 123974 - DNA, 14 bp, Homo sapiens
ttaaaaaaactgaa

SEQ ID NO: 123975 - DNA, 20 bp, Homo sapiens
ttaaaaaataccattgaaat

SEQ ID NO: 123976 - DNA, 20 bp, Homo sapiens
ttaaaaaatattttaagaaa

SEQ ID NO: 123977 - DNA, 11 bp, Homo sapiens
ttaaaaactgt

SEQ ID NO: 123978 - DNA, 18 bp, Homo sapiens
ttgtttgcttaatttcct

SEQ ID NO: 123979 - DNA, 22 bp, Homo sapiens
tttaaaaaaagtatatattcta

SEQ ID NO: 123980 - DNA, 16 bp, Homo sapiens
tttaaaaaataccatt

SEQ ID NO: 123981 - DNA, 20 bp, Homo sapiens
tttaaaaaataccattgaaa

SEQ ID NO: 123982 - DNA, 24 bp, Homo sapiens
tttaaaaaataccattgaaatcag

SEQ ID NO: 123983 - DNA, 16 bp, Homo sapiens
tttaaaagagacaaac

SEQ ID NO: 123984 - DNA, 20 bp, Homo sapiens
tttaaaagcaattatattgt

SEQ ID NO: 123985 - DNA, 18 bp, Homo sapiens
tttaactctactgtgtaa

SEQ ID NO: 123986 - DNA, 17 bp, Homo sapiens
tttaagaaagagaatga

SEQ ID NO: 123987 - DNA, 22 bp, Homo sapiens
tttaaggagattgggagacaat

SEQ ID NO: 123988 - DNA, 14 bp, Homo sapiens
tttaagtgcaacat

SEQ ID NO: 123989 - DNA, 21 bp, Homo sapiens
tttaagtgcaacatttctgta

SEQ ID NO: 123990 - DNA, 20 bp, Homo sapiens
tttaatagaaaattaaaata

SEQ ID NO: 123991 - DNA, 19 bp, Homo sapiens
tttaattaagcagaaacag

SEQ ID NO: 123992 - DNA, 14 bp, Homo sapiens
tttacagtttgtgt

SEQ ID NO: 123993 - DNA, 22 bp, Homo sapiens
tttacagtttgtgttttaaaaa

SEQ ID NO: 123994 - DNA, 13 bp, Homo sapiens
tttactacagttt

SEQ ID NO: 123995 - DNA, 15 bp, Homo sapiens
tttactgacagaaat

SEQ ID NO: 123996 - DNA, 14 bp, Homo sapiens
tttagaatatatta

SEQ ID NO: 123997 - DNA, 16 bp, Homo sapiens
tttatattagttgctt

SEQ ID NO: 123998 - DNA, 21 bp, Homo sapiens
tttatattagttgctttgtta

SEQ ID NO: 123999 - DNA, 15 bp, Homo sapiens
tttatcttttttcct

SEQ ID NO: 124000 - DNA, 15 bp, Homo sapiens
tttattacaaatgca

SEQ ID NO: 124001 - DNA, 19 bp, Homo sapiens
tttattacaaatgcaaatt

SEQ ID NO: 124002 - DNA, 21 bp, Homo sapiens
tttcaaaaaaaaaaaaaaaga

SEQ ID NO: 124003 - DNA, 23 bp, Homo sapiens
tttcaaaaaaaaaaaaaaagact

SEQ ID NO: 124004 - DNA, 13 bp, Homo sapiens
tttcaaattataa

SEQ ID NO: 124005 - DNA, 22 bp, Homo sapiens
tttcaccccacccttcccctcc

SEQ ID NO: 124006 - DNA, 14 bp, Homo sapiens
tttcagaataaaat

SEQ ID NO: 124007 - DNA, 21 bp, Homo sapiens
tttcagctattagcaactgtg

SEQ ID NO: 124008 - DNA, 19 bp, Homo sapiens
tttcatgctatcagaaaca

SEQ ID NO: 124009 - DNA, 23 bp, Homo sapiens
tttcatgttactgttgcagcttg

SEQ ID NO: 124010 - DNA, 13 bp, Homo sapiens
tttcattgtacaa

SEQ ID NO: 124011 - DNA, 16 bp, Homo sapiens
tttcatttcaaaatgc

SEQ ID NO: 124012 - DNA, 18 bp, Homo sapiens
tttccaaattattaattg

SEQ ID NO: 124013 - DNA, 15 bp, Homo sapiens
tttccaatagaaaga

SEQ ID NO: 124014 - DNA, 17 bp, Homo sapiens
tttccagtgagtgtaaa

SEQ ID NO: 124015 - DNA, 13 bp, Homo sapiens
tttcccagtgagc

SEQ ID NO: 124016 - DNA, 18 bp, Homo sapiens
tttccctttttaaaaaat

SEQ ID NO: 124017 - DNA, 18 bp, Homo sapiens
tttcctatgctctgggtg

SEQ ID NO: 124018 - DNA, 19 bp, Homo sapiens
tttccttattgaaaaatca

SEQ ID NO: 124019 - DNA, 15 bp, Homo sapiens
tttccttctgttaag

SEQ ID NO: 124020 - DNA, 23 bp, Homo sapiens
tttccttctgttaagaaaggata

SEQ ID NO: 124021 - DNA, 19 bp, Homo sapiens
tttctaaagctctgaacaa

SEQ ID NO: 124022 - DNA, 19 bp, Homo sapiens
tttctcaatagttcttaaa

SEQ ID NO: 124023 - DNA, 11 bp, Homo sapiens
tttctctctgc

SEQ ID NO: 124024 - DNA, 13 bp, Homo sapiens
tttctggttccaa

SEQ ID NO: 124025 - DNA, 17 bp, Homo sapiens
tttctgtatactgtaaa

SEQ ID NO: 124026 - DNA, 21 bp, Homo sapiens
tttctgtatactgtaaaagtt

SEQ ID NO: 124027 - DNA, 14 bp, Homo sapiens
tttgaaaaatattg

SEQ ID NO: 124028 - DNA, 23 bp, Homo sapiens
tttgaaaaatattgctaaaagtg

SEQ ID NO: 124029 - DNA, 16 bp, Homo sapiens
tttgaataaaaagtga

SEQ ID NO: 124030 - DNA, 13 bp, Homo sapiens
ttaaaaactgtgt

SEQ ID NO: 124031 - DNA, 14 bp, Homo sapiens
ttaaaaactgtgta

SEQ ID NO: 124032 - DNA, 11 bp, Homo sapiens
ttaaaactgag

SEQ ID NO: 124033 - DNA, 12 bp, Homo sapiens
ttaaaactgagt

SEQ ID NO: 124034 - DNA, 21 bp, Homo sapiens
ttaaaactgagtccatgaaaa

SEQ ID NO: 124035 - DNA, 22 bp, Homo sapiens
ttaaaactgagtccatgaaaat

SEQ ID NO: 124036 - DNA, 16 bp, Homo sapiens
ttaaaaggcaactcaa

SEQ ID NO: 124037 - DNA, 12 bp, Homo sapiens
ttaaaataaaaa

SEQ ID NO: 124038 - DNA, 18 bp, Homo sapiens
ttaaaataaaaatatttt

SEQ ID NO: 124039 - DNA, 13 bp, Homo sapiens
ttaaaatgcaata

SEQ ID NO: 124040 - DNA, 19 bp, Homo sapiens
ttaaataacctctggccct

SEQ ID NO: 124041 - DNA, 21 bp, Homo sapiens
ttaaataacctctggcccttg

SEQ ID NO: 124042 - DNA, 23 bp, Homo sapiens
ttaaataacctctggcccttgga

SEQ ID NO: 124043 - DNA, 22 bp, Homo sapiens
ttaaatatctgaacatttacta

SEQ ID NO: 124044 - DNA, 13 bp, Homo sapiens
ttaaatcatttta

SEQ ID NO: 124045 - DNA, 18 bp, Homo sapiens
ttaaatcattttaggaaa

SEQ ID NO: 124046 - DNA, 20 bp, Homo sapiens
ttaaatcattttaggaaagg

SEQ ID NO: 124047 - DNA, 13 bp, Homo sapiens
ttaaatcgttaga

SEQ ID NO: 124048 - DNA, 19 bp, Homo sapiens
ttaaatctagacattcttt

SEQ ID NO: 124049 - DNA, 13 bp, Homo sapiens
ttaactctactgt

SEQ ID NO: 124050 - DNA, 17 bp, Homo sapiens
ttaactctactgtgtaa

SEQ ID NO: 124051 - DNA, 15 bp, Homo sapiens
ttaactgtaaacttg

SEQ ID NO: 124052 - DNA, 16 bp, Homo sapiens
ttaactgtaaacttgg

SEQ ID NO: 124053 - DNA, 13 bp, Homo sapiens
ttaagaaaacaag

SEQ ID NO: 124054 - DNA, 12 bp, Homo sapiens
ttaagaaagaga

SEQ ID NO: 124055 - DNA, 13 bp, Homo sapiens
ttaagaaagagaa

SEQ ID NO: 124056 - DNA, 22 bp, Homo sapiens
ttaagaaagagaatgaactgtg

SEQ ID NO: 124057 - DNA, 23 bp, Homo sapiens
ttaagaaagagaatgaactgtgg

SEQ ID NO: 124058 - DNA, 20 bp, Homo sapiens
ttaagaaaggatataaaagg

SEQ ID NO: 124059 - DNA, 15 bp, Homo sapiens
ttaagggcattttaa

SEQ ID NO: 124060 - DNA, 23 bp, Homo sapiens
ttaagtgcaacatttctgtatac

SEQ ID NO: 124061 - DNA, 20 bp, Homo sapiens
ttaatagaaaattaaaataa

SEQ ID NO: 124062 - DNA, 21 bp, Homo sapiens
ttaatagaaaattaaaataac

SEQ ID NO: 124063 - DNA, 21 bp, Homo sapiens
ttaatattacctaatgaaagt

SEQ ID NO: 124064 - DNA, 17 bp, Homo sapiens
ttaatatttttacatgc

SEQ ID NO: 124065 - DNA, 20 bp, Homo sapiens
ttaatcacttaacattccta

SEQ ID NO: 124066 - DNA, 22 bp, Homo sapiens
ttaatggactgtgaatttcaaa

SEQ ID NO: 124067 - DNA, 15 bp, Homo sapiens
ttaattatcttttct

SEQ ID NO: 124068 - DNA, 22 bp, Homo sapiens
ttaattgattattctgattcca

SEQ ID NO: 124069 - DNA, 15 bp, Homo sapiens
ttaattgtcctgtgt

SEQ ID NO: 124070 - DNA, 16 bp, Homo sapiens
ttaattgtcctgtgtc

SEQ ID NO: 124071 - DNA, 21 bp, Homo sapiens
ttaatttccttctgttaagaa

SEQ ID NO: 124072 - DNA, 14 bp, Homo sapiens
ttacaagtttgcta

SEQ ID NO: 124073 - DNA, 21 bp, Homo sapiens
ttacaataaaactttgctgcc

SEQ ID NO: 124074 - DNA, 18 bp, Homo sapiens
ttacactaggaaacgtgt

SEQ ID NO: 124075 - DNA, 17 bp, Homo sapiens
ttacagaatgcattaaa

SEQ ID NO: 124076 - DNA, 20 bp, Homo sapiens
ttacagaatgcattaaaaaa

SEQ ID NO: 124077 - DNA, 13 bp, Homo sapiens
ttacagtttgtgt

SEQ ID NO: 124078 - DNA, 17 bp, Homo sapiens
ttacatcctctgatagc

SEQ ID NO: 124079 - DNA, 15 bp, Homo sapiens
ttactgacagaaatg

SEQ ID NO: 124080 - DNA, 17 bp, Homo sapiens
ttactgacagaaatgca

SEQ ID NO: 124081 - DNA, 12 bp, Homo sapiens
ttacttgaactt

SEQ ID NO: 124082 - DNA, 17 bp, Homo sapiens
ttagagtttacagtttg

SEQ ID NO: 124083 - DNA, 17 bp, Homo sapiens
ttaggaacagtaaaatc

SEQ ID NO: 124084 - DNA, 14 bp, Homo sapiens
ttagtcataaaaca

SEQ ID NO: 124085 - DNA, 15 bp, Homo sapiens
ttagttcttgaattg

SEQ ID NO: 124086 - DNA, 19 bp, Homo sapiens
ttagttcttgaattgttat

SEQ ID NO: 124087 - DNA, 20 bp, Homo sapiens
ttagttcttgaattgttatg

SEQ ID NO: 124088 - DNA, 17 bp, Homo sapiens
ttagtttacaatcagcc

SEQ ID NO: 124089 - DNA, 20 bp, Homo sapiens
ttagttttacactaggaaac

SEQ ID NO: 124090 - DNA, 23 bp, Homo sapiens
ttataaaagaataaaattgcact

SEQ ID NO: 124091 - DNA, 17 bp, Homo sapiens
ttataataactgaactg

SEQ ID NO: 124092 - DNA, 20 bp, Homo sapiens
ttataataactgaactgttt

SEQ ID NO: 124093 - DNA, 13 bp, Homo sapiens
ttatatatcataa

SEQ ID NO: 124094 - DNA, 20 bp, Homo sapiens
ttatatatcataaagtatgc

SEQ ID NO: 124095 - DNA, 13 bp, Homo sapiens
ttatatattgtat

SEQ ID NO: 124096 - DNA, 13 bp, Homo sapiens
ttatattccaagg

SEQ ID NO: 124097 - DNA, 15 bp, Homo sapiens
ttatattccaaggaa

SEQ ID NO: 124098 - DNA, 22 bp, Homo sapiens
ttatattccaaggaaaattgaa

SEQ ID NO: 124099 - DNA, 19 bp, Homo sapiens
ttatcatttttgtataaaa

SEQ ID NO: 124100 - DNA, 13 bp, Homo sapiens
ttatctgcattta

SEQ ID NO: 124101 - DNA, 19 bp, Homo sapiens
ttatgaaaatcctatatct

SEQ ID NO: 124102 - DNA, 11 bp, Homo sapiens
ttattctgtgg

SEQ ID NO: 124103 - DNA, 18 bp, Homo sapiens
ttattggcagccaaggaa

SEQ ID NO: 124104 - DNA, 22 bp, Homo sapiens
ttattggcagccaaggaatgtg

SEQ ID NO: 124105 - DNA, 14 bp, Homo sapiens
ttattgtagacatg

SEQ ID NO: 124106 - DNA, 18 bp, Homo sapiens
ttatttaacaaaaaatgt

SEQ ID NO: 124107 - DNA, 13 bp, Homo sapiens
ttatttgtataat

SEQ ID NO: 124108 - DNA, 21 bp, Homo sapiens
ttcaaaaaaaaaaaaaaagac

SEQ ID NO: 124109 - DNA, 19 bp, Homo sapiens
ttcacaggactctgcagat

SEQ ID NO: 124110 - DNA, 20 bp, Homo sapiens
ttcacccaccccatggagac

SEQ ID NO: 124111 - DNA, 14 bp, Homo sapiens
ttcactaccaaatg

SEQ ID NO: 124112 - DNA, 13 bp, Homo sapiens
ttcaggtctctgt

SEQ ID NO: 124113 - DNA, 17 bp, Homo sapiens
ttcagtcgtctgtccca

SEQ ID NO: 124114 - DNA, 21 bp, Homo sapiens
ttcagtgagatataggataaa

SEQ ID NO: 124115 - DNA, 16 bp, Homo sapiens
ttccaaaacctaaaga

SEQ ID NO: 124116 - DNA, 16 bp, Homo sapiens
ttccaaattattaatt

SEQ ID NO: 124117 - DNA, 19 bp, Homo sapiens
ttccaaattattaattgtc

SEQ ID NO: 124118 - DNA, 19 bp, Homo sapiens
ttccaagctccaaatccaa

SEQ ID NO: 124119 - DNA, 20 bp, Homo sapiens
ttccaaggaaaattgaaagt

SEQ ID NO: 124120 - DNA, 21 bp, Homo sapiens
ttccaaggaaaattgaaagta

SEQ ID NO: 124121 - DNA, 17 bp, Homo sapiens
ttccaatagaaagaaac

SEQ ID NO: 124122 - DNA, 18 bp, Homo sapiens
ttccaatagaaagaaact

SEQ ID NO: 124123 - DNA, 20 bp, Homo sapiens
ttccaatagaaagaaactaa

SEQ ID NO: 124124 - DNA, 14 bp, Homo sapiens
ttccagtgagtgta

SEQ ID NO: 124125 - DNA, 16 bp, Homo sapiens
ttccatagttaaagaa

SEQ ID NO: 124126 - DNA, 18 bp, Homo sapiens
ttcccagtgagcctctgc

SEQ ID NO: 124127 - DNA, 17 bp, Homo sapiens
ttccccactgacagcct

SEQ ID NO: 124128 - DNA, 21 bp, Homo sapiens
ttccccactgacagcctccca

SEQ ID NO: 124129 - DNA, 14 bp, Homo sapiens
ttccctctccctgt

SEQ ID NO: 124130 - DNA, 16 bp, Homo sapiens
ttccctggtgggcctc

SEQ ID NO: 124131 - DNA, 15 bp, Homo sapiens
ttccctttttaaaaa

SEQ ID NO: 124132 - DNA, 13 bp, Homo sapiens
tcccattctatgt

SEQ ID NO: 124133 - DNA, 13 bp, Homo sapiens
tccccccatagag

SEQ ID NO: 124134 - DNA, 22 bp, Homo sapiens
tccccccatagagaccaggagg

SEQ ID NO: 124135 - DNA, 13 bp, Homo sapiens
tccccctagagac

SEQ ID NO: 124136 - DNA, 19 bp, Homo sapiens
tccccgaaaacccccagca

SEQ ID NO: 124137 - DNA, 17 bp, Homo sapiens
tccccgccccctgaaac

SEQ ID NO: 124138 - DNA, 18 bp, Homo sapiens
tccccgccccctgaaaca

SEQ ID NO: 124139 - DNA, 22 bp, Homo sapiens
tccccggcggggtgcctgctgt

SEQ ID NO: 124140 - DNA, 20 bp, Homo sapiens
tcccctctctgtggctccaa

SEQ ID NO: 124141 - DNA, 16 bp, Homo sapiens
tcccgccaccctgtct

SEQ ID NO: 124142 - DNA, 15 bp, Homo sapiens
tcccgcttagttctt

SEQ ID NO: 124143 - DNA, 17 bp, Homo sapiens
tcccgtagtctcctggg

SEQ ID NO: 124144 - DNA, 18 bp, Homo sapiens
tccctagcctgcttttgt

SEQ ID NO: 124145 - DNA, 16 bp, Homo sapiens
tccctcccctgccatt

SEQ ID NO: 124146 - DNA, 21 bp, Homo sapiens
tccctcccgtagtctcctggg

SEQ ID NO: 124147 - DNA, 12 bp, Homo sapiens
tccctctccctg

SEQ ID NO: 124148 - DNA, 15 bp, Homo sapiens
tccctgctcccagct

SEQ ID NO: 124149 - DNA, 18 bp, Homo sapiens
tccctgctcccagctctc

SEQ ID NO: 124150 - DNA, 18 bp, Homo sapiens
tcccttcctcctctcctg

SEQ ID NO: 124151 - DNA, 18 bp, Homo sapiens
tcccttggatcagaggtc

SEQ ID NO: 124152 - DNA, 12 bp, Homo sapiens
tccgtgagccct

SEQ ID NO: 124153 - DNA, 15 bp, Homo sapiens
tcctaatgtgatcat

SEQ ID NO: 124154 - DNA, 13 bp, Homo sapiens
tcctagccccacc

SEQ ID NO: 124155 - DNA, 20 bp, Homo sapiens
tcctagccccacccagaggt

SEQ ID NO: 124156 - DNA, 21 bp, Homo sapiens
tcctagtttttctaatactaa

SEQ ID NO: 124157 - DNA, 16 bp, Homo sapiens
tcctatatctgtttgt

SEQ ID NO: 124158 - DNA, 16 bp, Homo sapiens
tcctatgcaataaaat

SEQ ID NO: 124159 - DNA, 12 bp, Homo sapiens
tcctcagccccc

SEQ ID NO: 124160 - DNA, 20 bp, Homo sapiens
tcctcagcccccaggccagg

SEQ ID NO: 124161 - DNA, 13 bp, Homo sapiens
tcctgctcctttc

SEQ ID NO: 124162 - DNA, 14 bp, Homo sapiens
tcctggaccctggc

SEQ ID NO: 124163 - DNA, 17 bp, Homo sapiens
tcctggagtctgaagcc

SEQ ID NO: 124164 - DNA, 20 bp, Homo sapiens
tcctggagtctgaagcctgc

SEQ ID NO: 124165 - DNA, 12 bp, Homo sapiens
tcctgggctcag

SEQ ID NO: 124166 - DNA, 13 bp, Homo sapiens
tcctgggctcagg

SEQ ID NO: 124167 - DNA, 13 bp, Homo sapiens
tcctgtccccggc

SEQ ID NO: 124168 - DNA, 14 bp, Homo sapiens
tcctgtttttccta

SEQ ID NO: 124169 - DNA, 19 bp, Homo sapiens
tccttattgaaaaatcagt

SEQ ID NO: 124170 - DNA, 16 bp, Homo sapiens
tccttctgttaagaaa

SEQ ID NO: 124171 - DNA, 21 bp, Homo sapiens
tcctttccaatagaaagaaac

SEQ ID NO: 124172 - DNA, 23 bp, Homo sapiens
tcctttccaatagaaagaaacta

SEQ ID NO: 124173 - DNA, 21 bp, Homo sapiens
tccttttgcaacaagacaaag

SEQ ID NO: 124174 - DNA, 23 bp, Homo sapiens
tcgaagaacaatgtcagaaactc

SEQ ID NO: 124175 - DNA, 15 bp, Homo sapiens
tcgacatcctagccc

SEQ ID NO: 124176 - DNA, 17 bp, Homo sapiens
tcgacatcctagcccca

SEQ ID NO: 124177 - DNA, 15 bp, Homo sapiens
tcgacgtcccttgga

SEQ ID NO: 124178 - DNA, 21 bp, Homo sapiens
tcgagcagtcctgcctcagcc

SEQ ID NO: 124179 - DNA, 22 bp, Homo sapiens
tcgcctactaagtacccttggg

SEQ ID NO: 124180 - DNA, 23 bp, Homo sapiens
tcgggaaaaaactttgctccagg

SEQ ID NO: 124181 - DNA, 24 bp, Homo sapiens
tcggtcagaacaacttgctactta

SEQ ID NO: 124182 - DNA, 24 bp, Homo sapiens
tctaaaaattttgcatttcatgct

SEQ ID NO: 124183 - DNA, 21 bp, Homo sapiens
tctaactgatgagtaaactga

SEQ ID NO: 124184 - DNA, 17 bp, Homo sapiens
tctacacatatatgtat

SEQ ID NO: 124185 - DNA, 16 bp, Homo sapiens
tctacagtaatgaaat

SEQ ID NO: 124186 - DNA, 14 bp, Homo sapiens
tctagctgttcttt

SEQ ID NO: 124187 - DNA, 17 bp, Homo sapiens
tctagctgttctttttt

SEQ ID NO: 124188 - DNA, 18 bp, Homo sapiens
tctataaatttaagaaaa

SEQ ID NO: 124189 - DNA, 19 bp, Homo sapiens
tctataaatttaagaaaac

SEQ ID NO: 124190 - DNA, 19 bp, Homo sapiens
tctataataagttttgata

SEQ ID NO: 124191 - DNA, 13 bp, Homo sapiens
tctatgtacctct

SEQ ID NO: 124192 - DNA, 14 bp, Homo sapiens
tctcaatagttctt

SEQ ID NO: 124193 - DNA, 17 bp, Homo sapiens
tctcaatagttcttaaa

SEQ ID NO: 124194 - DNA, 21 bp, Homo sapiens
tctcaatagttcttaaaatta

SEQ ID NO: 124195 - DNA, 21 bp, Homo sapiens
tctcaccccatcccacaccct

SEQ ID NO: 124196 - DNA, 16 bp, Homo sapiens
tctcagtacctcccct

SEQ ID NO: 124197 - DNA, 19 bp, Homo sapiens
tctcagtcctttgttataa

SEQ ID NO: 124198 - DNA, 16 bp, Homo sapiens
tctccatttaagacac

SEQ ID NO: 124199 - DNA, 12 bp, Homo sapiens
tctcccacccaa

SEQ ID NO: 124200 - DNA, 12 bp, Homo sapiens
tctccctagccc

SEQ ID NO: 124201 - DNA, 13 bp, Homo sapiens
tctccctagccct

SEQ ID NO: 124202 - DNA, 15 bp, Homo sapiens
tctccctagcccttc

SEQ ID NO: 124203 - DNA, 15 bp, Homo sapiens
tctcctgtccccggc

SEQ ID NO: 124204 - DNA, 20 bp, Homo sapiens
tctctaaactgctgttaatt

SEQ ID NO: 124205 - DNA, 21 bp, Homo sapiens
tctctccctcccctgccattt

SEQ ID NO: 124206 - DNA, 12 bp, Homo sapiens
tctctgctggcc

SEQ ID NO: 124207 - DNA, 14 bp, Homo sapiens
tctctgctggccca

SEQ ID NO: 124208 - DNA, 16 bp, Homo sapiens
tctctgctggcccagc

SEQ ID NO: 124209 - DNA, 17 bp, Homo sapiens
tctctgtggctccaacc

SEQ ID NO: 124210 - DNA, 15 bp, Homo sapiens
tctgaagcctgcagg

SEQ ID NO: 124211 - DNA, 16 bp, Homo sapiens
tctgagaagtgtatat

SEQ ID NO: 124212 - DNA, 16 bp, Homo sapiens
tctgatgcccaccgag

SEQ ID NO: 124213 - DNA, 11 bp, Homo sapiens
tctgattccac

SEQ ID NO: 124214 - DNA, 18 bp, Homo sapiens
tctgcaagaattaaaact

SEQ ID NO: 124215 - DNA, 18 bp, Homo sapiens
tctgcaagagggggcatt

SEQ ID NO: 124216 - DNA, 18 bp, Homo sapiens
tctgcagatagtgcctct

SEQ ID NO: 124217 - DNA, 21 bp, Homo sapiens
tctgcagatagtgcctctgca

SEQ ID NO: 124218 - DNA, 13 bp, Homo sapiens
tctgcatcttcag

SEQ ID NO: 124219 - DNA, 21 bp, Homo sapiens
tctgcattttcaccccaccct

SEQ ID NO: 124220 - DNA, 18 bp, Homo sapiens
tctgctgagctgggccca

SEQ ID NO: 124221 - DNA, 22 bp, Homo sapiens
tctgctgagctgggcccagccc

SEQ ID NO: 124222 - DNA, 12 bp, Homo sapiens
tctgctggccca

SEQ ID NO: 124223 - DNA, 14 bp, Homo sapiens
tctgctggcccagc

SEQ ID NO: 124224 - DNA, 14 bp, Homo sapiens
tctggaatgagcct

SEQ ID NO: 124225 - DNA, 18 bp, Homo sapiens
tctggaggcctctggccc

SEQ ID NO: 124226 - DNA, 18 bp, Homo sapiens
tctggcaaagttatattt

SEQ ID NO: 124227 - DNA, 13 bp, Homo sapiens
tctggcccttgga

SEQ ID NO: 124228 - DNA, 15 bp, Homo sapiens
tctggcccttggaat

SEQ ID NO: 124229 - DNA, 18 bp, Homo sapiens
tctggcccttggaataaa

SEQ ID NO: 124230 - DNA, 13 bp, Homo sapiens
tctgggcctgggg

SEQ ID NO: 124231 - DNA, 15 bp, Homo sapiens
tctgggcctggggtg

SEQ ID NO: 124232 - DNA, 17 bp, Homo sapiens
tctgggcctggggtgca

SEQ ID NO: 124233 - DNA, 12 bp, Homo sapiens
tctggttccaaa

SEQ ID NO: 124234 - DNA, 11 bp, Homo sapiens
tttaagaaaga

SEQ ID NO: 124235 - DNA, 15 bp, Homo sapiens
tttaagaaagagaat

SEQ ID NO: 124236 - DNA, 21 bp, Homo sapiens
tttaagaaagagaatgaactg

SEQ ID NO: 124237 - DNA, 16 bp, Homo sapiens
tttaagacgtgaatgt

SEQ ID NO: 124238 - DNA, 23 bp, Homo sapiens
tttaagtgcaacatttctgtata

SEQ ID NO: 124239 - DNA, 19 bp, Homo sapiens
tttaatagaaaattaaaat

SEQ ID NO: 124240 - DNA, 21 bp, Homo sapiens
tttaatatctgagaagtgtat

SEQ ID NO: 124241 - DNA, 23 bp, Homo sapiens
tttaatatctgagaagtgtatat

SEQ ID NO: 124242 - DNA, 19 bp, Homo sapiens
tttaatggactgtgaattt

SEQ ID NO: 124243 - DNA, 21 bp, Homo sapiens
tttacagaatgcattaaaaaa

SEQ ID NO: 124244 - DNA, 14 bp, Homo sapiens
tttactgacagaaa

SEQ ID NO: 124245 - DNA, 12 bp, Homo sapiens
tttagttttaca

SEQ ID NO: 124246 - DNA, 14 bp, Homo sapiens
tttataaaaatata

SEQ ID NO: 124247 - DNA, 16 bp, Homo sapiens
tttataaaaatataaa

SEQ ID NO: 124248 - DNA, 23 bp, Homo sapiens
tttataaaagaataaaattgcac

SEQ ID NO: 124249 - DNA, 13 bp, Homo sapiens
tttattacaaatg

SEQ ID NO: 124250 - DNA, 12 bp, Homo sapiens
tttattctgtgg

SEQ ID NO: 124251 - DNA, 13 bp, Homo sapiens
tttattctgtggt

SEQ ID NO: 124252 - DNA, 15 bp, Homo sapiens
tttattctgtggttc

SEQ ID NO: 124253 - DNA, 23 bp, Homo sapiens
tttattctgtggttctataataa

SEQ ID NO: 124254 - DNA, 23 bp, Homo sapiens
tttattggcagccaaggaatgtg

SEQ ID NO: 124255 - DNA, 22 bp, Homo sapiens
tttcaaaaaaaaaaaaaaagac

SEQ ID NO: 124256 - DNA, 13 bp, Homo sapiens
tttcatgagccca

SEQ ID NO: 124257 - DNA, 14 bp, Homo sapiens
tttcatgtaagttt

SEQ ID NO: 124258 - DNA, 15 bp, Homo sapiens
tttcatgtaagttta

SEQ ID NO: 124259 - DNA, 14 bp, Homo sapiens
tttccacataaagg

SEQ ID NO: 124260 - DNA, 18 bp, Homo sapiens
tttccagtgagtgtaaat

SEQ ID NO: 124261 - DNA, 13 bp, Homo sapiens
tttccttctgtta

SEQ ID NO: 124262 - DNA, 18 bp, Homo sapiens
tttccttctgttaagaaa

SEQ ID NO: 124263 - DNA, 21 bp, Homo sapiens
tttccttttgcaacaagacaa

SEQ ID NO: 124264 - DNA, 16 bp, Homo sapiens
tttctcaatagttctt

SEQ ID NO: 124265 - DNA, 12 bp, Homo sapiens
tttctccccgct

SEQ ID NO: 124266 - DNA, 12 bp, Homo sapiens
tttctgtatact

SEQ ID NO: 124267 - DNA, 14 bp, Homo sapiens
tttctgtatactgt

SEQ ID NO: 124268 - DNA, 14 bp, Homo sapiens
tttcttaatgggtg

SEQ ID NO: 124269 - DNA, 17 bp, Homo sapiens
tttctttgtatcattca

SEQ ID NO: 124270 - DNA, 19 bp, Homo sapiens
tttctttttttggtaaatt

SEQ ID NO: 124271 - DNA, 12 bp, Homo sapiens
tttgaaaaatat

SEQ ID NO: 124272 - DNA, 18 bp, Homo sapiens
tttgaaaaatattgctaa

SEQ ID NO: 124273 - DNA, 17 bp, Homo sapiens
tttgaataaaaagtgaa

SEQ ID NO: 124274 - DNA, 15 bp, Homo sapiens
tttgaggactgaagc

SEQ ID NO: 124275 - DNA, 16 bp, Homo sapiens
tttgaggactgaagct

SEQ ID NO: 124276 - DNA, 19 bp, Homo sapiens
tttgagttattttaattat

SEQ ID NO: 124277 - DNA, 17 bp, Homo sapiens
tttgcaaaccctttgta

SEQ ID NO: 124278 - DNA, 22 bp, Homo sapiens
tttgcaacaagacaaagcaaag

SEQ ID NO: 124279 - DNA, 16 bp, Homo sapiens
tttgcaggtctttaaa

SEQ ID NO: 124280 - DNA, 19 bp, Homo sapiens
tttgctaaaagaagagagg

SEQ ID NO: 124281 - DNA, 13 bp, Homo sapiens
tttggcttggcct

SEQ ID NO: 124282 - DNA, 19 bp, Homo sapiens
tttggtcgagtctttgtgt

SEQ ID NO: 124283 - DNA, 14 bp, Homo sapiens
tttgtaatttgaat

SEQ ID NO: 124284 - DNA, 15 bp, Homo sapiens
tttgtaatttgaatt

SEQ ID NO: 124285 - DNA, 16 bp, Homo sapiens
tttgtaatttgaattg

SEQ ID NO: 124286 - DNA, 19 bp, Homo sapiens
tttgtacgttatatattgt

SEQ ID NO: 124287 - DNA, 12 bp, Homo sapiens
tttgtataaaaa

SEQ ID NO: 124288 - DNA, 15 bp, Homo sapiens
tttgtataaaaagga

SEQ ID NO: 124289 - DNA, 17 bp, Homo sapiens
tttgtatatttgcaaac

SEQ ID NO: 124290 - DNA, 17 bp, Homo sapiens
tttgtattataattgtt

SEQ ID NO: 124291 - DNA, 22 bp, Homo sapiens
tttgtattataattgttgatat

SEQ ID NO: 124292 - DNA, 19 bp, Homo sapiens
tttgtggtaaaaagattat

SEQ ID NO: 124293 - DNA, 19 bp, Homo sapiens
tttgtgtgttatattccaa

SEQ ID NO: 124294 - DNA, 17 bp, Homo sapiens
ttttaaaaaaactgaag

SEQ ID NO: 124295 - DNA, 24 bp, Homo sapiens
ttttaaaaaataccattgaaatca

SEQ ID NO: 124296 - DNA, 21 bp, Homo sapiens
ttttaaaaaatattttaagaa

SEQ ID NO: 124297 - DNA, 13 bp, Homo sapiens
ttttaaataacct

SEQ ID NO: 124298 - DNA, 21 bp, Homo sapiens
ttttaaataacctctggccct

SEQ ID NO: 124299 - DNA, 13 bp, Homo sapiens
ttttaagaaagag

SEQ ID NO: 124300 - DNA, 22 bp, Homo sapiens
ttttaagaaagagaatgaactg

SEQ ID NO: 124301 - DNA, 20 bp, Homo sapiens
ttttctttgtatcattcatc

SEQ ID NO: 124302 - DNA, 12 bp, Homo sapiens
ttttgaaaaata

SEQ ID NO: 124303 - DNA, 21 bp, Homo sapiens
ttttgaaaaatattgctaaaa

SEQ ID NO: 124304 - DNA, 23 bp, Homo sapiens
ttttgaaaaatattgctaaaagt

SEQ ID NO: 124305 - DNA, 15 bp, Homo sapiens
ttttgaaaatcaaga

SEQ ID NO: 124306 - DNA, 15 bp, Homo sapiens
ttttgaataaaaagt

SEQ ID NO: 124307 - DNA, 13 bp, Homo sapiens
ttttgtaaaatat

SEQ ID NO: 124308 - DNA, 12 bp, Homo sapiens
ttttgtataaaa

SEQ ID NO: 124309 - DNA, 22 bp, Homo sapiens
ttttgtattcaattaaagaaat

SEQ ID NO: 124310 - DNA, 23 bp, Homo sapiens
tttttaagtgcaacatttctgta

SEQ ID NO: 124311 - DNA, 13 bp, Homo sapiens
tttttaatagaac

SEQ ID NO: 124312 - DNA, 11 bp, Homo sapiens
tttttccaaat

SEQ ID NO: 124313 - DNA, 21 bp, Homo sapiens
tttttccaaattattaattgt

SEQ ID NO: 124314 - DNA, 15 bp, Homo sapiens
agtagtagtgtcttc

SEQ ID NO: 124315 - DNA, 15 bp, Homo sapiens
agtatatattctaca

SEQ ID NO: 124316 - DNA, 21 bp, Homo sapiens
agtatatattctacacatata

SEQ ID NO: 124317 - DNA, 19 bp, Homo sapiens
agtatattagtttgattta

SEQ ID NO: 124318 - DNA, 20 bp, Homo sapiens
agtatcttagagtttacagt

SEQ ID NO: 124319 - DNA, 22 bp, Homo sapiens
agtatcttagagtttacagttt

SEQ ID NO: 124320 - DNA, 21 bp, Homo sapiens
agtatgccttcctgtttaaaa

SEQ ID NO: 124321 - DNA, 17 bp, Homo sapiens
agtattacaaccatata

SEQ ID NO: 124322 - DNA, 15 bp, Homo sapiens
agtattcagaaatta

SEQ ID NO: 124323 - DNA, 21 bp, Homo sapiens
agtattcagaaattaaaatat

SEQ ID NO: 124324 - DNA, 22 bp, Homo sapiens
agtcaaagagagtttttaatag

SEQ ID NO: 124325 - DNA, 20 bp, Homo sapiens
agtcaagaggtttttctccc

SEQ ID NO: 124326 - DNA, 15 bp, Homo sapiens
agtcagtttctacac

SEQ ID NO: 124327 - DNA, 13 bp, Homo sapiens
agtcataaaacac

SEQ ID NO: 124328 - DNA, 14 bp, Homo sapiens
agtccatgaaaata

SEQ ID NO: 124329 - DNA, 15 bp, Homo sapiens
agtccatgaaaatac

SEQ ID NO: 124330 - DNA, 14 bp, Homo sapiens
agtcctgctccttt

SEQ ID NO: 124331 - DNA, 22 bp, Homo sapiens
agtcctgctcctttctgcccag

SEQ ID NO: 124332 - DNA, 23 bp, Homo sapiens
agtcctgctcctttctgcccagc

SEQ ID NO: 124333 - DNA, 18 bp, Homo sapiens
agtcctttgttataattt

SEQ ID NO: 124334 - DNA, 21 bp, Homo sapiens
agtcgagcactctaattagag

SEQ ID NO: 124335 - DNA, 16 bp, Homo sapiens
agtctctgctggccca

SEQ ID NO: 124336 - DNA, 21 bp, Homo sapiens
agtctttgtgtgttatattcc

SEQ ID NO: 124337 - DNA, 23 bp, Homo sapiens
agtctttgtgtgttatattccaa

SEQ ID NO: 124338 - DNA, 21 bp, Homo sapiens
agtctttttctttttttggta

SEQ ID NO: 124339 - DNA, 14 bp, Homo sapiens
agtgaaacagagaa

SEQ ID NO: 124340 - DNA, 15 bp, Homo sapiens
agtgaacttttgtaa

SEQ ID NO: 124341 - DNA, 18 bp, Homo sapiens
agtgaacttttgtaattt

SEQ ID NO: 124342 - DNA, 21 bp, Homo sapiens
agtgaacttttgtaatttgaa

SEQ ID NO: 124343 - DNA, 23 bp, Homo sapiens
agtgaacttttgtaatttgaatt

SEQ ID NO: 124344 - DNA, 13 bp, Homo sapiens
agtgagcctctgc

SEQ ID NO: 124345 - DNA, 14 bp, Homo sapiens
agtgagcctctgcg

SEQ ID NO: 124346 - DNA, 18 bp, Homo sapiens
agtgagcctctgcgcctc

SEQ ID NO: 124347 - DNA, 12 bp, Homo sapiens
agtgagtgtaaa

SEQ ID NO: 124348 - DNA, 15 bp, Homo sapiens
agtgagtgtaaataa

SEQ ID NO: 124349 - DNA, 22 bp, Homo sapiens
agtgcaacatttctgtatactg

SEQ ID NO: 124350 - DNA, 17 bp, Homo sapiens
agtgcaattccaagaaa

SEQ ID NO: 124351 - DNA, 17 bp, Homo sapiens
agtgcatttaaggagat

SEQ ID NO: 124352 - DNA, 21 bp, Homo sapiens
agtgcatttaaggagattggg

SEQ ID NO: 124353 - DNA, 13 bp, Homo sapiens
agtgcctcagtgc

SEQ ID NO: 124354 - DNA, 12 bp, Homo sapiens
agtggccactgg

SEQ ID NO: 124355 - DNA, 13 bp, Homo sapiens
agtggccactggc

SEQ ID NO: 124356 - DNA, 14 bp, Homo sapiens
agtgtaaataattt

SEQ ID NO: 124357 - DNA, 19 bp, Homo sapiens
agtgtcctggaccctggcc

SEQ ID NO: 124358 - DNA, 21 bp, Homo sapiens
agttaaagaagacatttgcca

SEQ ID NO: 124359 - DNA, 17 bp, Homo sapiens
agttataataactgaac

SEQ ID NO: 124360 - DNA, 19 bp, Homo sapiens
agttataataactgaactg

SEQ ID NO: 124361 - DNA, 20 bp, Homo sapiens
agttataataactgaactgt

SEQ ID NO: 124362 - DNA, 18 bp, Homo sapiens
agttctgacactgtgtgt

SEQ ID NO: 124363 - DNA, 12 bp, Homo sapiens
agttctgctcta

SEQ ID NO: 124364 - DNA, 15 bp, Homo sapiens
agttctgttttctgt

SEQ ID NO: 124365 - DNA, 15 bp, Homo sapiens
agttcttaaaattag

SEQ ID NO: 124366 - DNA, 12 bp, Homo sapiens
agttcttgaatt

SEQ ID NO: 124367 - DNA, 17 bp, Homo sapiens
agttcttgaattgttat

SEQ ID NO: 124368 - DNA, 22 bp, Homo sapiens
agttcttgaattgttatgaaaa

SEQ ID NO: 124369 - DNA, 12 bp, Homo sapiens
agttggaggaga

SEQ ID NO: 124370 - DNA, 19 bp, Homo sapiens
agttgtcaagtctctgctg

SEQ ID NO: 124371 - DNA, 19 bp, Homo sapiens
agtttaattatctgcattt

SEQ ID NO: 124372 - DNA, 15 bp, Homo sapiens
agtttacagtttgtg

SEQ ID NO: 124373 - DNA, 16 bp, Homo sapiens
agtttacagtttgtgt

SEQ ID NO: 124374 - DNA, 21 bp, Homo sapiens
agtttattctgtggttctata

SEQ ID NO: 124375 - DNA, 23 bp, Homo sapiens
agtttattctgtggttctataat

SEQ ID NO: 124376 - DNA, 12 bp, Homo sapiens
agtttcagaata

SEQ ID NO: 124377 - DNA, 16 bp, Homo sapiens
agtttgatttaatatc

SEQ ID NO: 124378 - DNA, 15 bp, Homo sapiens
agtttgctaaaagaa

SEQ ID NO: 124379 - DNA, 20 bp, Homo sapiens
agtttgctaaaagaagagag

SEQ ID NO: 124380 - DNA, 14 bp, Homo sapiens
agtttgtgttttaa

SEQ ID NO: 124381 - DNA, 22 bp, Homo sapiens
agtttgtgttttaaaaaaactg

SEQ ID NO: 124382 - DNA, 23 bp, Homo sapiens
agtttgtgttttaaaaaaactga

SEQ ID NO: 124383 - DNA, 18 bp, Homo sapiens
agttttgatataatcttg

SEQ ID NO: 124384 - DNA, 23 bp, Homo sapiens
agtttttaactctactgtgtaat

SEQ ID NO: 124385 - DNA, 12 bp, Homo sapiens
ataaaaaggaaa

SEQ ID NO: 124386 - DNA, 13 bp, Homo sapiens
ataaaaaggaaat

SEQ ID NO: 124387 - DNA, 16 bp, Homo sapiens
ataaaaaggaaattag

SEQ ID NO: 124388 - DNA, 17 bp, Homo sapiens
caatagttcttaaaatt

SEQ ID NO: 124389 - DNA, 19 bp, Homo sapiens
caatagttcttaaaattag

SEQ ID NO: 124390 - DNA, 20 bp, Homo sapiens
caatatttaagtttgttgct

SEQ ID NO: 124391 - DNA, 20 bp, Homo sapiens
caatccagagaagcgctgtt

SEQ ID NO: 124392 - DNA, 17 bp, Homo sapiens
caatcctgtttttccta

SEQ ID NO: 124393 - DNA, 18 bp, Homo sapiens
caatcgacatcctagccc

SEQ ID NO: 124394 - DNA, 21 bp, Homo sapiens
caatgcccgtaagatggctta

SEQ ID NO: 124395 - DNA, 12 bp, Homo sapiens
caattagcagaa

SEQ ID NO: 124396 - DNA, 23 bp, Homo sapiens
caattagcagaatggagaaagta

SEQ ID NO: 124397 - DNA, 12 bp, Homo sapiens
caattatattgt

SEQ ID NO: 124398 - DNA, 17 bp, Homo sapiens
caattccaagaaaatat

SEQ ID NO: 124399 - DNA, 18 bp, Homo sapiens
caattgtgagccaccacg

SEQ ID NO: 124400 - DNA, 11 bp, Homo sapiens
cacagcccagg

SEQ ID NO: 124401 - DNA, 11 bp, Homo sapiens
cacagccctga

SEQ ID NO: 124402 - DNA, 14 bp, Homo sapiens
cacaggactctgca

SEQ ID NO: 124403 - DNA, 15 bp, Homo sapiens
cacaggactctgcag

SEQ ID NO: 124404 - DNA, 22 bp, Homo sapiens
cacaggcttatttttaaaataa

SEQ ID NO: 124405 - DNA, 19 bp, Homo sapiens
cacagtgttgcccaggctg

SEQ ID NO: 124406 - DNA, 13 bp, Homo sapiens
cacataaaggtat

SEQ ID NO: 124407 - DNA, 20 bp, Homo sapiens
cacatgctgaggttttgaat

SEQ ID NO: 124408 - DNA, 23 bp, Homo sapiens
cacatgggaggaaggcccagggg

SEQ ID NO: 124409 - DNA, 16 bp, Homo sapiens
caccagggagaggcct

SEQ ID NO: 124410 - DNA, 23 bp, Homo sapiens
caccagggagaggcctcggctgt

SEQ ID NO: 124411 - DNA, 18 bp, Homo sapiens
caccagtgcctcagtgct

SEQ ID NO: 124412 - DNA, 22 bp, Homo sapiens
caccatgagggaagaataaaga

SEQ ID NO: 124413 - DNA, 14 bp, Homo sapiens
cacccaccccacag

SEQ ID NO: 124414 - DNA, 15 bp, Homo sapiens
cacccagaggtggcc

SEQ ID NO: 124415 - DNA, 17 bp, Homo sapiens
cacccagcagaaataca

SEQ ID NO: 124416 - DNA, 17 bp, Homo sapiens
caccccacagactccgg

SEQ ID NO: 124417 - DNA, 19 bp, Homo sapiens
caccccacagactccggcc

SEQ ID NO: 124418 - DNA, 12 bp, Homo sapiens
caccccagcccc

SEQ ID NO: 124419 - DNA, 14 bp, Homo sapiens
caccccagccccca

SEQ ID NO: 124420 - DNA, 19 bp, Homo sapiens
caccccagcccccacagcc

SEQ ID NO: 124421 - DNA, 15 bp, Homo sapiens
caccccatcccacac

SEQ ID NO: 124422 - DNA, 13 bp, Homo sapiens
cacccccatctct

SEQ ID NO: 124423 - DNA, 16 bp, Homo sapiens
cacccctgcctcctgc

SEQ ID NO: 124424 - DNA, 21 bp, Homo sapiens
caccctggaggatttcatctc

SEQ ID NO: 124425 - DNA, 21 bp, Homo sapiens
caccgaggagccccagccccg

SEQ ID NO: 124426 - DNA, 14 bp, Homo sapiens
caccgctggctccg

SEQ ID NO: 124427 - DNA, 22 bp, Homo sapiens
caccgggctccatgcctctgga

SEQ ID NO: 124428 - DNA, 12 bp, Homo sapiens
cacctatggccc

SEQ ID NO: 124429 - DNA, 16 bp, Homo sapiens
cacctatggcccagcc

SEQ ID NO: 124430 - DNA, 17 bp, Homo sapiens
cacctatggcccagcca

SEQ ID NO: 124431 - DNA, 16 bp, Homo sapiens
cactaggaaacgtgtt

SEQ ID NO: 124432 - DNA, 21 bp, Homo sapiens
cactagtgcaattccaagaaa

SEQ ID NO: 124433 - DNA, 23 bp, Homo sapiens
cactagtgcaattccaagaaaat

SEQ ID NO: 124434 - DNA, 17 bp, Homo sapiens
cactattacttgaactt

SEQ ID NO: 124435 - DNA, 20 bp, Homo sapiens
cactgacagcctcccacccc

SEQ ID NO: 124436 - DNA, 20 bp, Homo sapiens
cactgattccctctcccacc

SEQ ID NO: 124437 - DNA, 19 bp, Homo sapiens
cactgtgtgtttgggaagg

SEQ ID NO: 124438 - DNA, 18 bp, Homo sapiens
cactgttggcacttatag

SEQ ID NO: 124439 - DNA, 22 bp, Homo sapiens
cactgttggcacttataggtaa

SEQ ID NO: 124440 - DNA, 17 bp, Homo sapiens
cactgtttcatgagccc

SEQ ID NO: 124441 - DNA, 12 bp, Homo sapiens
cacttacaagtg

SEQ ID NO: 124442 - DNA, 11 bp, Homo sapiens
cacttcatgtc

SEQ ID NO: 124443 - DNA, 18 bp, Homo sapiens
cacttcttgttccccact

SEQ ID NO: 124444 - DNA, 13 bp, Homo sapiens
cagaaattaaaat

SEQ ID NO: 124445 - DNA, 20 bp, Homo sapiens
cagaacaacttgctacttat

SEQ ID NO: 124446 - DNA, 22 bp, Homo sapiens
cagaagggctctttctctctgc

SEQ ID NO: 124447 - DNA, 17 bp, Homo sapiens
cagacagtcacaaattt

SEQ ID NO: 124448 - DNA, 14 bp, Homo sapiens
cagagaaagaaaag

SEQ ID NO: 124449 - DNA, 15 bp, Homo sapiens
cagagaaagaaaagg

SEQ ID NO: 124450 - DNA, 19 bp, Homo sapiens
cagagaaagaaaaggcaaa

SEQ ID NO: 124451 - DNA, 14 bp, Homo sapiens
cagaggccgctgcc

SEQ ID NO: 124452 - DNA, 17 bp, Homo sapiens
cagaggccgctgcccct

SEQ ID NO: 124453 - DNA, 13 bp, Homo sapiens
cagaggtggccct

SEQ ID NO: 124454 - DNA, 18 bp, Homo sapiens
cagagtatttttgtattc

SEQ ID NO: 124455 - DNA, 17 bp, Homo sapiens
cagatagtgcctctgca

SEQ ID NO: 124456 - DNA, 13 bp, Homo sapiens
cagatctttttgt

SEQ ID NO: 124457 - DNA, 20 bp, Homo sapiens
cagatttgaggactgaagct

SEQ ID NO: 124458 - DNA, 14 bp, Homo sapiens
cagcatgacaaaaa

SEQ ID NO: 124459 - DNA, 18 bp, Homo sapiens
cagcatgacaaaaataac

SEQ ID NO: 124460 - DNA, 19 bp, Homo sapiens
cagcatgacaaaaataaca

SEQ ID NO: 124461 - DNA, 20 bp, Homo sapiens
cagccacaccgctggctccg

SEQ ID NO: 124462 - DNA, 13 bp, Homo sapiens
cagccactgcagc

SEQ ID NO: 124463 - DNA, 12 bp, Homo sapiens
cagcccagggcc

SEQ ID NO: 124464 - DNA, 16 bp, Homo sapiens
cagccccaatccagag

SEQ ID NO: 124465 - DNA, 18 bp, Homo sapiens
cagccccaatccagagaa

SEQ ID NO: 124466 - DNA, 14 bp, Homo sapiens
cagcccccacagcc

SEQ ID NO: 124467 - DNA, 19 bp, Homo sapiens
aacaacttgctacttatca

SEQ ID NO: 124468 - DNA, 14 bp, Homo sapiens
aacaagcccaaagc

SEQ ID NO: 124469 - DNA, 20 bp, Homo sapiens
aactgtggaatttattggca

SEQ ID NO: 124470 - DNA, 23 bp, Homo sapiens
aactgtggaatttattggcagcc

SEQ ID NO: 124471 - DNA, 15 bp, Homo sapiens
aactgtgtatcatta

SEQ ID NO: 124472 - DNA, 22 bp, Homo sapiens
aactgtttggtcgagtctttgt

SEQ ID NO: 124473 - DNA, 23 bp, Homo sapiens
aacttgctacttatcatttttgt

SEQ ID NO: 124474 - DNA, 19 bp, Homo sapiens
aacttggaatcaaggtaag

SEQ ID NO: 124475 - DNA, 15 bp, Homo sapiens
aactttaaaaggcaa

SEQ ID NO: 124476 - DNA, 23 bp, Homo sapiens
aactttctccatttaagacacat

SEQ ID NO: 124477 - DNA, 21 bp, Homo sapiens
aactttcttaatatttttaca

SEQ ID NO: 124478 - DNA, 17 bp, Homo sapiens
aacttttacagaatgca

SEQ ID NO: 124479 - DNA, 13 bp, Homo sapiens
aagaaaaggcaaa

SEQ ID NO: 124480 - DNA, 16 bp, Homo sapiens
aagaaaccatgacaaa

SEQ ID NO: 124481 - DNA, 18 bp, Homo sapiens
aagaaagagaatgaactg

SEQ ID NO: 124482 - DNA, 19 bp, Homo sapiens
aagaaagtctatctaatga

SEQ ID NO: 124483 - DNA, 12 bp, Homo sapiens
aagaaataattt

SEQ ID NO: 124484 - DNA, 12 bp, Homo sapiens
aagaattaaaac

SEQ ID NO: 124485 - DNA, 22 bp, Homo sapiens
aagaatttaatggactgtgaat

SEQ ID NO: 124486 - DNA, 11 bp, Homo sapiens
aagacacattg

SEQ ID NO: 124487 - DNA, 13 bp, Homo sapiens
aagacataaaact

SEQ ID NO: 124488 - DNA, 15 bp, Homo sapiens
aagacataaaacttt

SEQ ID NO: 124489 - DNA, 17 bp, Homo sapiens
aagacataaaactttaa

SEQ ID NO: 124490 - DNA, 18 bp, Homo sapiens
aagacataaaactttaaa

SEQ ID NO: 124491 - DNA, 23 bp, Homo sapiens
aagacataaaactttaaaaggca

SEQ ID NO: 124492 - DNA, 15 bp, Homo sapiens
aagaccttctcccta

SEQ ID NO: 124493 - DNA, 18 bp, Homo sapiens
aagacgtgaatgtctcag

SEQ ID NO: 124494 - DNA, 17 bp, Homo sapiens
aagactcctctgggcct

SEQ ID NO: 124495 - DNA, 20 bp, Homo sapiens
aagactggtttgtttgctta

SEQ ID NO: 124496 - DNA, 21 bp, Homo sapiens
aagactggtttgtttgcttaa

SEQ ID NO: 124497 - DNA, 18 bp, Homo sapiens
aagactgtcaaatgaact

SEQ ID NO: 124498 - DNA, 19 bp, Homo sapiens
aagactgtcaaatgaactt

SEQ ID NO: 124499 - DNA, 16 bp, Homo sapiens
aagacttcactgcagc

SEQ ID NO: 124500 - DNA, 15 bp, Homo sapiens
aagagaatgaactgt

SEQ ID NO: 124501 - DNA, 22 bp, Homo sapiens
aagagaatgaactgtggaattt

SEQ ID NO: 124502 - DNA, 19 bp, Homo sapiens
aagagaggggaagaattta

SEQ ID NO: 124503 - DNA, 19 bp, Homo sapiens
aagaggaaaagtgcaatgc

SEQ ID NO: 124504 - DNA, 19 bp, Homo sapiens
aagatcttgcagaagttct

SEQ ID NO: 124505 - DNA, 14 bp, Homo sapiens
aagatgatggaaac

SEQ ID NO: 124506 - DNA, 19 bp, Homo sapiens
aagatgatggaaacgcact

SEQ ID NO: 124507 - DNA, 21 bp, Homo sapiens
aagatggcttatttgtataat

SEQ ID NO: 124508 - DNA, 14 bp, Homo sapiens
aagattatatatca

SEQ ID NO: 124509 - DNA, 14 bp, Homo sapiens
aagattgtattgct

SEQ ID NO: 124510 - DNA, 14 bp, Homo sapiens
aagattttttcatt

SEQ ID NO: 124511 - DNA, 17 bp, Homo sapiens
aagattttttcatttca

SEQ ID NO: 124512 - DNA, 19 bp, Homo sapiens
aagcaccagggagaggcct

SEQ ID NO: 124513 - DNA, 16 bp, Homo sapiens
aagcatgggaaaaaga

SEQ ID NO: 124514 - DNA, 20 bp, Homo sapiens
aagcatgggaaaaagagact

SEQ ID NO: 124515 - DNA, 22 bp, Homo sapiens
aagcctcactattacttgaact

SEQ ID NO: 124516 - DNA, 17 bp, Homo sapiens
aagctcaggatatggct

SEQ ID NO: 124517 - DNA, 15 bp, Homo sapiens
aagctctattaagat

SEQ ID NO: 124518 - DNA, 18 bp, Homo sapiens
aagctctgaacaaaagct

SEQ ID NO: 124519 - DNA, 19 bp, Homo sapiens
aagctctgaacaaaagctt

SEQ ID NO: 124520 - DNA, 13 bp, Homo sapiens
aagctggggcttg

SEQ ID NO: 124521 - DNA, 18 bp, Homo sapiens
aagcttctagacactcct

SEQ ID NO: 124522 - DNA, 14 bp, Homo sapiens
aaggaaaattgaaa

SEQ ID NO: 124523 - DNA, 15 bp, Homo sapiens
aaggaaaattgaaag

SEQ ID NO: 124524 - DNA, 18 bp, Homo sapiens
aaggaaaattgaaagtat

SEQ ID NO: 124525 - DNA, 16 bp, Homo sapiens
aaggaaatctcacccc

SEQ ID NO: 124526 - DNA, 21 bp, Homo sapiens
aaggaatgtgtccaagacaca

SEQ ID NO: 124527 - DNA, 21 bp, Homo sapiens
aaggagattgggagacaatta

SEQ ID NO: 124528 - DNA, 23 bp, Homo sapiens
aaggatataaaaggatgttacaa

SEQ ID NO: 124529 - DNA, 22 bp, Homo sapiens
aaggatgttacaagtttgctaa

SEQ ID NO: 124530 - DNA, 12 bp, Homo sapiens
aaggcaaaagac

SEQ ID NO: 124531 - DNA, 13 bp, Homo sapiens
aaggcaaaagact

SEQ ID NO: 124532 - DNA, 18 bp, Homo sapiens
aaggtaagctcaggatat

SEQ ID NO: 124533 - DNA, 21 bp, Homo sapiens
aaggtaagctcaggatatggc

SEQ ID NO: 124534 - DNA, 22 bp, Homo sapiens
aaggtgggtgaggctgggcagg

SEQ ID NO: 124535 - DNA, 22 bp, Homo sapiens
aaggttttttttttaagtgcaa

SEQ ID NO: 124536 - DNA, 13 bp, Homo sapiens
aagtaagaaacac

SEQ ID NO: 124537 - DNA, 22 bp, Homo sapiens
aagtaagtcttttttttttcca

SEQ ID NO: 124538 - DNA, 13 bp, Homo sapiens
aagtaatgaagaa

SEQ ID NO: 124539 - DNA, 17 bp, Homo sapiens
aattgttgatattttcc

SEQ ID NO: 124540 - DNA, 18 bp, Homo sapiens
aatttactttgtagactg

SEQ ID NO: 124541 - DNA, 12 bp, Homo sapiens
aatttattggca

SEQ ID NO: 124542 - DNA, 22 bp, Homo sapiens
aatttattggcagccaaggaat

SEQ ID NO: 124543 - DNA, 15 bp, Homo sapiens
aatttccttctgtta

SEQ ID NO: 124544 - DNA, 17 bp, Homo sapiens
aatttccttctgttaag

SEQ ID NO: 124545 - DNA, 19 bp, Homo sapiens
aatttccttctgttaagaa

SEQ ID NO: 124546 - DNA, 22 bp, Homo sapiens
aatttctataaatttaagaaaa

SEQ ID NO: 124547 - DNA, 12 bp, Homo sapiens
aattttaaataa

SEQ ID NO: 124548 - DNA, 22 bp, Homo sapiens
aattttaaataacctctggccc

SEQ ID NO: 124549 - DNA, 18 bp, Homo sapiens
aattttactgacagaaat

SEQ ID NO: 124550 - DNA, 19 bp, Homo sapiens
aattttactgacagaaatg

SEQ ID NO: 124551 - DNA, 13 bp, Homo sapiens
aattttgagaaaa

SEQ ID NO: 124552 - DNA, 15 bp, Homo sapiens
aatttttgaaaaata

SEQ ID NO: 124553 - DNA, 18 bp, Homo sapiens
aatttttgaaaaatattg

SEQ ID NO: 124554 - DNA, 23 bp, Homo sapiens
aatttttgaaaaatattgctaaa

SEQ ID NO: 124555 - DNA, 12 bp, Homo sapiens
acaaaaaaaaga

SEQ ID NO: 124556 - DNA, 13 bp, Homo sapiens
acaaaaaaaagaa

SEQ ID NO: 124557 - DNA, 21 bp, Homo sapiens
acaaaaaaatacctcaggaaa

SEQ ID NO: 124558 - DNA, 19 bp, Homo sapiens
acaaaaataacactgttgg

SEQ ID NO: 124559 - DNA, 16 bp, Homo sapiens
acaaactacatgtaat

SEQ ID NO: 124560 - DNA, 16 bp, Homo sapiens
acaaactgatttctca

SEQ ID NO: 124561 - DNA, 17 bp, Homo sapiens
acaaactgatttctcac

SEQ ID NO: 124562 - DNA, 19 bp, Homo sapiens
acaaagcatgggaaaaaga

SEQ ID NO: 124563 - DNA, 22 bp, Homo sapiens
acaaagcatgggaaaaagagac

SEQ ID NO: 124564 - DNA, 21 bp, Homo sapiens
acaaagtatatttaaggatta

SEQ ID NO: 124565 - DNA, 18 bp, Homo sapiens
acaaatgcaaatttctat

SEQ ID NO: 124566 - DNA, 20 bp, Homo sapiens
acaaatttctctgttccata

SEQ ID NO: 124567 - DNA, 21 bp, Homo sapiens
acaaggaatagtcgcgcaagc

SEQ ID NO: 124568 - DNA, 13 bp, Homo sapiens
acaagtttgctaa

SEQ ID NO: 124569 - DNA, 17 bp, Homo sapiens
acaagtttgctaaaaga

SEQ ID NO: 124570 - DNA, 22 bp, Homo sapiens
acaagtttgctaaaagaagaga

SEQ ID NO: 124571 - DNA, 17 bp, Homo sapiens
acaataaacagctgaac

SEQ ID NO: 124572 - DNA, 18 bp, Homo sapiens
acaataaagtttgctttc

SEQ ID NO: 124573 - DNA, 18 bp, Homo sapiens
acacaggcttatttttaa

SEQ ID NO: 124574 - DNA, 20 bp, Homo sapiens
acacatgctgaggttttgaa

SEQ ID NO: 124575 - DNA, 14 bp, Homo sapiens
acacattttatgag

SEQ ID NO: 124576 - DNA, 18 bp, Homo sapiens
acaccatcattaagaata

SEQ ID NO: 124577 - DNA, 24 bp, Homo sapiens
acaccgagtctctgtataatctat

SEQ ID NO: 124578 - DNA, 14 bp, Homo sapiens
acaccgctggctcc

SEQ ID NO: 124579 - DNA, 23 bp, Homo sapiens
acaccgggaagtgcagcgggcca

SEQ ID NO: 124580 - DNA, 16 bp, Homo sapiens
acactaggagactggt

SEQ ID NO: 124581 - DNA, 13 bp, Homo sapiens
acactccttgaaa

SEQ ID NO: 124582 - DNA, 20 bp, Homo sapiens
acactgtgtgtttgggaagg

SEQ ID NO: 124583 - DNA, 16 bp, Homo sapiens
acagaatgcattaaaa

SEQ ID NO: 124584 - DNA, 10 bp, Homo sapiens
acagagaaag

SEQ ID NO: 124585 - DNA, 13 bp, Homo sapiens
acagagaaagaaa

SEQ ID NO: 124586 - DNA, 18 bp, Homo sapiens
acagagcacctgtagctg

SEQ ID NO: 124587 - DNA, 14 bp, Homo sapiens
acagaggtaactat

SEQ ID NO: 124588 - DNA, 21 bp, Homo sapiens
acagatttgaggactgaagct

SEQ ID NO: 124589 - DNA, 18 bp, Homo sapiens
acagcaggatgccctgtt

SEQ ID NO: 124590 - DNA, 15 bp, Homo sapiens
acagcccagggcctg

SEQ ID NO: 124591 - DNA, 13 bp, Homo sapiens
acagccctgaaac

SEQ ID NO: 124592 - DNA, 23 bp, Homo sapiens
acagctgacggtttctccccgga

SEQ ID NO: 124593 - DNA, 16 bp, Homo sapiens
acaggaggctccgtga

SEQ ID NO: 124594 - DNA, 22 bp, Homo sapiens
acaggaggctccgtgagccctt

SEQ ID NO: 124595 - DNA, 21 bp, Homo sapiens
acaggcttatttttaaaataa

SEQ ID NO: 124596 - DNA, 19 bp, Homo sapiens
acagtaatgaaatgtttac

SEQ ID NO: 124597 - DNA, 19 bp, Homo sapiens
acagtttgtgttttaaaaa

SEQ ID NO: 124598 - DNA, 20 bp, Homo sapiens
acagtttgtgttttaaaaaa

SEQ ID NO: 124599 - DNA, 21 bp, Homo sapiens
acagtttgtgttttaaaaaaa

SEQ ID NO: 124600 - DNA, 23 bp, Homo sapiens
acagtttgtgttttaaaaaaact

SEQ ID NO: 124601 - DNA, 13 bp, Homo sapiens
acataaaacttta

SEQ ID NO: 124602 - DNA, 12 bp, Homo sapiens
acatataaaagt

SEQ ID NO: 124603 - DNA, 22 bp, Homo sapiens
acatattttttatatctggaat

SEQ ID NO: 124604 - DNA, 21 bp, Homo sapiens
acatcctagccccacccagag

SEQ ID NO: 124605 - DNA, 21 bp, Homo sapiens
acatgcagctcttcaacatga

SEQ ID NO: 124606 - DNA, 16 bp, Homo sapiens
acatgcccaaaactta

SEQ ID NO: 124607 - DNA, 21 bp, Homo sapiens
acatgggaggaaggcccaggg

SEQ ID NO: 124608 - DNA, 12 bp, Homo sapiens
acatgtgcccct

SEQ ID NO: 124609 - DNA, 16 bp, Homo sapiens
acatgtgcccctgcca

SEQ ID NO: 124610 - DNA, 20 bp, Homo sapiens
acattcagctgaggttcatt

SEQ ID NO: 124611 - DNA, 22 bp, Homo sapiens
acattcagctgaggttcattac

SEQ ID NO: 124612 - DNA, 21 bp, Homo sapiens
acatttactacagtttttaac

SEQ ID NO: 124613 - DNA, 15 bp, Homo sapiens
acatttcattgtaca

SEQ ID NO: 124614 - DNA, 14 bp, Homo sapiens
acattttatgagag

SEQ ID NO: 124615 - DNA, 12 bp, Homo sapiens
accaaaattttt

SEQ ID NO: 124616 - DNA, 14 bp, Homo sapiens
accacacattttat

SEQ ID NO: 124617 - DNA, 22 bp, Homo sapiens
accacaggttcatgccaccatg

SEQ ID NO: 124618 - DNA, 16 bp, Homo sapiens
accacatataacactt

SEQ ID NO: 124619 - DNA, 20 bp, Homo sapiens
accacatataacacttaact

SEQ ID NO: 124620 - DNA, 17 bp, Homo sapiens
accaccttttattacat

SEQ ID NO: 124621 - DNA, 14 bp, Homo sapiens
accacgtccagctg

SEQ ID NO: 124622 - DNA, 14 bp, Homo sapiens
accagggagaggcc

SEQ ID NO: 124623 - DNA, 15 bp, Homo sapiens
accagggagaggcct

SEQ ID NO: 124624 - DNA, 16 bp, Homo sapiens
accagggcgcaagcct

SEQ ID NO: 124625 - DNA, 17 bp, Homo sapiens
accagtgcctcagtgct

SEQ ID NO: 124626 - DNA, 18 bp, Homo sapiens
accagtgcctcagtgctg

SEQ ID NO: 124627 - DNA, 14 bp, Homo sapiens
accagtttattctg

SEQ ID NO: 124628 - DNA, 21 bp, Homo sapiens
accataggaagacataaaact

SEQ ID NO: 124629 - DNA, 22 bp, Homo sapiens
accatcaaaggaatataagaaa

SEQ ID NO: 124630 - DNA, 21 bp, Homo sapiens
accattgaaatcagcatgaca

SEQ ID NO: 124631 - DNA, 14 bp, Homo sapiens
acccacagccctga

SEQ ID NO: 124632 - DNA, 14 bp, Homo sapiens
acccaccccatgga

SEQ ID NO: 124633 - DNA, 15 bp, Homo sapiens
acccaccccatggag

SEQ ID NO: 124634 - DNA, 21 bp, Homo sapiens
acccatgaagctggccctcag

SEQ ID NO: 124635 - DNA, 23 bp, Homo sapiens
acccatgaagctggccctcagct

SEQ ID NO: 124636 - DNA, 13 bp, Homo sapiens
agaaaagtaatga

SEQ ID NO: 124637 - DNA, 13 bp, Homo sapiens
agaaaccatgaca

SEQ ID NO: 124638 - DNA, 17 bp, Homo sapiens
agaaagaaaaggcaaaa

SEQ ID NO: 124639 - DNA, 23 bp, Homo sapiens
agaaagaaaaggcaaaagactgg

SEQ ID NO: 124640 - DNA, 17 bp, Homo sapiens
agaaagtaagtcttttt

SEQ ID NO: 124641 - DNA, 13 bp, Homo sapiens
agaaatgaatgct

SEQ ID NO: 124642 - DNA, 23 bp, Homo sapiens
agaaattttactgacagaaatgc

SEQ ID NO: 124643 - DNA, 16 bp, Homo sapiens
agaacaacttgctact

SEQ ID NO: 124644 - DNA, 23 bp, Homo sapiens
agaactccctttggctacttttg

SEQ ID NO: 124645 - DNA, 20 bp, Homo sapiens
agaagggggagtgaaacaga

SEQ ID NO: 124646 - DNA, 23 bp, Homo sapiens
agaataaaattaggaacagtaaa

SEQ ID NO: 124647 - DNA, 14 bp, Homo sapiens
agaatagaaagaaa

SEQ ID NO: 124648 - DNA, 22 bp, Homo sapiens
agaatcatacttaacatttcat

SEQ ID NO: 124649 - DNA, 13 bp, Homo sapiens
agaatgcattaaa

SEQ ID NO: 124650 - DNA, 18 bp, Homo sapiens
agacaaactgtaaaaaat

SEQ ID NO: 124651 - DNA, 15 bp, Homo sapiens
agacaataaacagct

SEQ ID NO: 124652 - DNA, 21 bp, Homo sapiens
agacaataaacagctgaacca

SEQ ID NO: 124653 - DNA, 19 bp, Homo sapiens
agacaattagcagaatgga

SEQ ID NO: 124654 - DNA, 21 bp, Homo sapiens
agacacatgctgaggttttga

SEQ ID NO: 124655 - DNA, 18 bp, Homo sapiens
agacagtcacaaatttct

SEQ ID NO: 124656 - DNA, 17 bp, Homo sapiens
agacataaaactttaaa

SEQ ID NO: 124657 - DNA, 23 bp, Homo sapiens
agacataaaactttaaaaggcaa

SEQ ID NO: 124658 - DNA, 19 bp, Homo sapiens
agaccaggagggagagcct

SEQ ID NO: 124659 - DNA, 14 bp, Homo sapiens
agacccacagccct

SEQ ID NO: 124660 - DNA, 18 bp, Homo sapiens
agacccacagccctgaaa

SEQ ID NO: 124661 - DNA, 16 bp, Homo sapiens
agaccttctccctagc

SEQ ID NO: 124662 - DNA, 19 bp, Homo sapiens
agaccttctccctagccct

SEQ ID NO: 124663 - DNA, 17 bp, Homo sapiens
agacgtgaatgtctcag

SEQ ID NO: 124664 - DNA, 15 bp, Homo sapiens
agactccggcctgta

SEQ ID NO: 124665 - DNA, 19 bp, Homo sapiens
agactccggcctgtaatca

SEQ ID NO: 124666 - DNA, 19 bp, Homo sapiens
agactcctctgggcctggg

SEQ ID NO: 124667 - DNA, 21 bp, Homo sapiens
agactgggcacccctgcctcc

SEQ ID NO: 124668 - DNA, 13 bp, Homo sapiens
agactggtttgtt

SEQ ID NO: 124669 - DNA, 15 bp, Homo sapiens
agactggtttgtttg

SEQ ID NO: 124670 - DNA, 19 bp, Homo sapiens
agactgtcaaatgaacttt

SEQ ID NO: 124671 - DNA, 18 bp, Homo sapiens
agacttcactgcagcctt

SEQ ID NO: 124672 - DNA, 14 bp, Homo sapiens
agagaatgaactgt

SEQ ID NO: 124673 - DNA, 19 bp, Homo sapiens
agagaatgaactgtggaat

SEQ ID NO: 124674 - DNA, 22 bp, Homo sapiens
agagacaaactgtaaaaaatgt

SEQ ID NO: 124675 - DNA, 16 bp, Homo sapiens
agagaggggaagaatt

SEQ ID NO: 124676 - DNA, 21 bp, Homo sapiens
agagaggggaagaatttaatg

SEQ ID NO: 124677 - DNA, 13 bp, Homo sapiens
agaggccgctgcc

SEQ ID NO: 124678 - DNA, 18 bp, Homo sapiens
agaggcctcggctgtctc

SEQ ID NO: 124679 - DNA, 19 bp, Homo sapiens
agaggcctcggctgtctcc

SEQ ID NO: 124680 - DNA, 22 bp, Homo sapiens
agaggcctcggctgtctcctgt

SEQ ID NO: 124681 - DNA, 12 bp, Homo sapiens
agaggggaagaa

SEQ ID NO: 124682 - DNA, 14 bp, Homo sapiens
agagggtctccagt

SEQ ID NO: 124683 - DNA, 21 bp, Homo sapiens
agaggtcatcccttcctcctc

SEQ ID NO: 124684 - DNA, 14 bp, Homo sapiens
agaggtggccctcc

SEQ ID NO: 124685 - DNA, 19 bp, Homo sapiens
agaggtggccctcccaggc

SEQ ID NO: 124686 - DNA, 14 bp, Homo sapiens
agagttctgctcta

SEQ ID NO: 124687 - DNA, 13 bp, Homo sapiens
agagtttacagtt

SEQ ID NO: 124688 - DNA, 23 bp, Homo sapiens
agagtttggaattattgtagaca

SEQ ID NO: 124689 - DNA, 14 bp, Homo sapiens
agatagtgcctctg

SEQ ID NO: 124690 - DNA, 15 bp, Homo sapiens
agatagtgcctctgc

SEQ ID NO: 124691 - DNA, 17 bp, Homo sapiens
agatataggataaaata

SEQ ID NO: 124692 - DNA, 15 bp, Homo sapiens
agatatatagatata

SEQ ID NO: 124693 - DNA, 19 bp, Homo sapiens
agatatgctaagcagtagt

SEQ ID NO: 124694 - DNA, 22 bp, Homo sapiens
agatattgtcagagttctgctc

SEQ ID NO: 124695 - DNA, 15 bp, Homo sapiens
agatgactattactt

SEQ ID NO: 124696 - DNA, 20 bp, Homo sapiens
agatggcttatttgtataat

SEQ ID NO: 124697 - DNA, 20 bp, Homo sapiens
agattatatatcataaagta

SEQ ID NO: 124698 - DNA, 23 bp, Homo sapiens
agattcagtttaagagttttcct

SEQ ID NO: 124699 - DNA, 21 bp, Homo sapiens
agatttttatattagttgctt

SEQ ID NO: 124700 - DNA, 18 bp, Homo sapiens
agattttttttgtaactt

SEQ ID NO: 124701 - DNA, 23 bp, Homo sapiens
agcacatctgcattttcacccca

SEQ ID NO: 124702 - DNA, 14 bp, Homo sapiens
agcaccagggagag

SEQ ID NO: 124703 - DNA, 19 bp, Homo sapiens
agcacttgcttacatcctc

SEQ ID NO: 124704 - DNA, 18 bp, Homo sapiens
agcagaatggagaaagta

SEQ ID NO: 124705 - DNA, 21 bp, Homo sapiens
agcagaatggagaaagtaagt

SEQ ID NO: 124706 - DNA, 18 bp, Homo sapiens
agcagcccacccagcaga

SEQ ID NO: 124707 - DNA, 15 bp, Homo sapiens
agcagtacaataaaa

SEQ ID NO: 124708 - DNA, 19 bp, Homo sapiens
agcagtcctgcctcagcct

SEQ ID NO: 124709 - DNA, 16 bp, Homo sapiens
agcatgacaaaaataa

SEQ ID NO: 124710 - DNA, 16 bp, Homo sapiens
agcatgggaaaaagag

SEQ ID NO: 124711 - DNA, 19 bp, Homo sapiens
agcatgggaaaaagagact

SEQ ID NO: 124712 - DNA, 22 bp, Homo sapiens
agcatgtactgtacttcccaat

SEQ ID NO: 124713 - DNA, 17 bp, Homo sapiens
agcatgtatagttgctt

SEQ ID NO: 124714 - DNA, 22 bp, Homo sapiens
agcattagctacttttcagaat

SEQ ID NO: 124715 - DNA, 14 bp, Homo sapiens
agccaaggaatgtg

SEQ ID NO: 124716 - DNA, 18 bp, Homo sapiens
agccaaggaatgtgtcca

SEQ ID NO: 124717 - DNA, 23 bp, Homo sapiens
agccaaggaatgtgtccaagaca

SEQ ID NO: 124718 - DNA, 16 bp, Homo sapiens
agccacaccgctggct

SEQ ID NO: 124719 - DNA, 15 bp, Homo sapiens
agccacagccgtgct

SEQ ID NO: 124720 - DNA, 23 bp, Homo sapiens
agccacatgggaggaaggcccag

SEQ ID NO: 124721 - DNA, 17 bp, Homo sapiens
agccaccacgtccagct

SEQ ID NO: 124722 - DNA, 13 bp, Homo sapiens
agccactgcagca

SEQ ID NO: 124723 - DNA, 17 bp, Homo sapiens
agccactgcagcacagg

SEQ ID NO: 124724 - DNA, 18 bp, Homo sapiens
agccatgataactgcaat

SEQ ID NO: 124725 - DNA, 15 bp, Homo sapiens
agccccaatccagag

SEQ ID NO: 124726 - DNA, 14 bp, Homo sapiens
agccccacccagag

SEQ ID NO: 124727 - DNA, 13 bp, Homo sapiens
agccccagcccca

SEQ ID NO: 124728 - DNA, 14 bp, Homo sapiens
agccccagccccgt

SEQ ID NO: 124729 - DNA, 21 bp, Homo sapiens
agccccagccccgtcccagag

SEQ ID NO: 124730 - DNA, 19 bp, Homo sapiens
agcccccacagccctggaa

SEQ ID NO: 124731 - DNA, 16 bp, Homo sapiens
agccccgtcccagagg

SEQ ID NO: 124732 - DNA, 18 bp, Homo sapiens
agccccgtcccagaggcc

SEQ ID NO: 124733 - DNA, 15 bp, Homo sapiens
agcccctccacgtga

SEQ ID NO: 124734 - DNA, 16 bp, Homo sapiens
agcccctccacgtgat

SEQ ID NO: 124735 - DNA, 23 bp, Homo sapiens
agccctgaaacgagaagtgccct

SEQ ID NO: 124736 - DNA, 19 bp, Homo sapiens
agcccttctaccccacctg

SEQ ID NO: 124737 - DNA, 18 bp, Homo sapiens
agcccttggttcctcccc

SEQ ID NO: 124738 - DNA, 23 bp, Homo sapiens
agcctcactattacttgaacttt

SEQ ID NO: 124739 - DNA, 13 bp, Homo sapiens
agcctcccacccc

SEQ ID NO: 124740 - DNA, 22 bp, Homo sapiens
agcctctgcgcctctccactgt

SEQ ID NO: 124741 - DNA, 23 bp, Homo sapiens
agcctgcaggtccggggaggagg

SEQ ID NO: 124742 - DNA, 11 bp, Homo sapiens
agcctgcccag

SEQ ID NO: 124743 - DNA, 20 bp, Homo sapiens
agcctgcccagttggaggag

SEQ ID NO: 124744 - DNA, 16 bp, Homo sapiens
agccttgctcaggtgc

SEQ ID NO: 124745 - DNA, 15 bp, Homo sapiens
agcgctgttgatccc

SEQ ID NO: 124746 - DNA, 19 bp, Homo sapiens
agcgctgttgcccgccctc

SEQ ID NO: 124747 - DNA, 15 bp, Homo sapiens
agcgggccaggcagg

SEQ ID NO: 124748 - DNA, 20 bp, Homo sapiens
agctattagcaactgtgcta

SEQ ID NO: 124749 - DNA, 15 bp, Homo sapiens
agctcagctgggcca

SEQ ID NO: 124750 - DNA, 19 bp, Homo sapiens
agctcagctgggccactcc

SEQ ID NO: 124751 - DNA, 20 bp, Homo sapiens
agctcccattctatgtgtca

SEQ ID NO: 124752 - DNA, 20 bp, Homo sapiens
agctccctgaccccctgtcc

SEQ ID NO: 124753 - DNA, 14 bp, Homo sapiens
agctctctctcctg

SEQ ID NO: 124754 - DNA, 15 bp, Homo sapiens
agctctctctcctgg

SEQ ID NO: 124755 - DNA, 16 bp, Homo sapiens
agctctctctcctgga

SEQ ID NO: 124756 - DNA, 15 bp, Homo sapiens
agctggccctcagct

SEQ ID NO: 124757 - DNA, 18 bp, Homo sapiens
agctggccctcagctccc

SEQ ID NO: 124758 - DNA, 22 bp, Homo sapiens
agctggccctcagctccctgac

SEQ ID NO: 124759 - DNA, 18 bp, Homo sapiens
agctgggccactcctctt

SEQ ID NO: 124760 - DNA, 21 bp, Homo sapiens
agctgggccactcctcttcac

SEQ ID NO: 124761 - DNA, 14 bp, Homo sapiens
agctgggcccagcc

SEQ ID NO: 124762 - DNA, 17 bp, Homo sapiens
agctgggcccagcccct

SEQ ID NO: 124763 - DNA, 18 bp, Homo sapiens
agctgggcccagcccctc

SEQ ID NO: 124764 - DNA, 17 bp, Homo sapiens
agcttgtgctgagcctg

SEQ ID NO: 124765 - DNA, 16 bp, Homo sapiens
agcttttaaaaaatat

SEQ ID NO: 124766 - DNA, 20 bp, Homo sapiens
agcttttaaaaaatatttta

SEQ ID NO: 124767 - DNA, 22 bp, Homo sapiens
agcttttgttttgcttacaaag

SEQ ID NO: 124768 - DNA, 18 bp, Homo sapiens
aggaaaagtgcaatgcgt

SEQ ID NO: 124769 - DNA, 19 bp, Homo sapiens
aggaaaattgaaagtattc

SEQ ID NO: 124770 - DNA, 12 bp, Homo sapiens
aggaaattagtc

SEQ ID NO: 124771 - DNA, 15 bp, Homo sapiens
aggaatacaatatat

SEQ ID NO: 124772 - DNA, 20 bp, Homo sapiens
aggaatgtgtccaagacaca

SEQ ID NO: 124773 - DNA, 23 bp, Homo sapiens
aggacaaaaagaccttctcccta

SEQ ID NO: 124774 - DNA, 19 bp, Homo sapiens
aggacactaggagactggt

SEQ ID NO: 124775 - DNA, 12 bp, Homo sapiens
aggacccacctg

SEQ ID NO: 124776 - DNA, 13 bp, Homo sapiens
aggactctgcaga

SEQ ID NO: 124777 - DNA, 17 bp, Homo sapiens
aggactgaagctggggc

SEQ ID NO: 124778 - DNA, 17 bp, Homo sapiens
aggagagagggtctcca

SEQ ID NO: 124779 - DNA, 18 bp, Homo sapiens
aggagagagggtctccag

SEQ ID NO: 124780 - DNA, 22 bp, Homo sapiens
aggagattgggagacaattagc

SEQ ID NO: 124781 - DNA, 20 bp, Homo sapiens
aggagcagcccacccagcag

SEQ ID NO: 124782 - DNA, 14 bp, Homo sapiens
aggagccccagccc

SEQ ID NO: 124783 - DNA, 20 bp, Homo sapiens
aggaggctccgtgagccctt

SEQ ID NO: 124784 - DNA, 19 bp, Homo sapiens
aggataaaataatgctttg

SEQ ID NO: 124785 - DNA, 15 bp, Homo sapiens
aggatataaaaggat

SEQ ID NO: 124786 - DNA, 18 bp, Homo sapiens
aggatcaccccagccccc

SEQ ID NO: 124787 - DNA, 20 bp, Homo sapiens
aggatcaccccagcccccac

SEQ ID NO: 124788 - DNA, 22 bp, Homo sapiens
aggatcaccccagcccccacag

SEQ ID NO: 124789 - DNA, 21 bp, Homo sapiens
aggatgttacaagtttgctaa

SEQ ID NO: 124790 - DNA, 23 bp, Homo sapiens
aggatgttacaagtttgctaaaa

SEQ ID NO: 124791 - DNA, 12 bp, Homo sapiens
aggcaaaagact

SEQ ID NO: 124792 - DNA, 21 bp, Homo sapiens
aggcagcatgtatagttgctt

SEQ ID NO: 124793 - DNA, 14 bp, Homo sapiens
aggcatcactgatt

SEQ ID NO: 124794 - DNA, 17 bp, Homo sapiens
aggccaggtgaggtcca

SEQ ID NO: 124795 - DNA, 19 bp, Homo sapiens
aggcccaaagcacttgctt

SEQ ID NO: 124796 - DNA, 23 bp, Homo sapiens
aggcccagtgacaaagactcctc

SEQ ID NO: 124797 - DNA, 14 bp, Homo sapiens
aggccgctgcccct

SEQ ID NO: 124798 - DNA, 16 bp, Homo sapiens
aggccgctgcccctga

SEQ ID NO: 124799 - DNA, 19 bp, Homo sapiens
aggccggagacccacagcc

SEQ ID NO: 124800 - DNA, 23 bp, Homo sapiens
aggcgatccacctgtctcagcct

SEQ ID NO: 124801 - DNA, 17 bp, Homo sapiens
aggctccgtgagccctt

SEQ ID NO: 124802 - DNA, 19 bp, Homo sapiens
aggctccgtgagcccttgg

SEQ ID NO: 124803 - DNA, 20 bp, Homo sapiens
aggctgcaaaattaaatcta

SEQ ID NO: 124804 - DNA, 21 bp, Homo sapiens
aggctgcaaaattaaatctag

SEQ ID NO: 124805 - DNA, 20 bp, Homo sapiens
aggctggagtggagtggcgt

SEQ ID NO: 124806 - DNA, 21 bp, Homo sapiens
aggctggtatttatctgcaag

SEQ ID NO: 124807 - DNA, 22 bp, Homo sapiens
aggcttaaggagaggagaaact

SEQ ID NO: 124808 - DNA, 18 bp, Homo sapiens
aggcttatttttaaaata

SEQ ID NO: 124809 - DNA, 19 bp, Homo sapiens
aggcttatttttaaaataa

SEQ ID NO: 124810 - DNA, 20 bp, Homo sapiens
aggcttatttttaaaataaa

SEQ ID NO: 124811 - DNA, 21 bp, Homo sapiens
aggcttatttttaaaataaaa

SEQ ID NO: 124812 - DNA, 18 bp, Homo sapiens
agggagaagttgagcagg

SEQ ID NO: 124813 - DNA, 14 bp, Homo sapiens
agggagagcctctg

SEQ ID NO: 124814 - DNA, 19 bp, Homo sapiens
agggagaggcctcggctgt

SEQ ID NO: 124815 - DNA, 14 bp, Homo sapiens
agggaggagggccg

SEQ ID NO: 124816 - DNA, 17 bp, Homo sapiens
aggggtggggcccatgg

SEQ ID NO: 124817 - DNA, 23 bp, Homo sapiens
aggtaacgtgattgattcagtat

SEQ ID NO: 124818 - DNA, 17 bp, Homo sapiens
aggtaactatcaatatt

SEQ ID NO: 124819 - DNA, 17 bp, Homo sapiens
aggtaagctcaggatat

SEQ ID NO: 124820 - DNA, 18 bp, Homo sapiens
aggtaggctgcaaaatta

SEQ ID NO: 124821 - DNA, 17 bp, Homo sapiens
aggtcatcccttcctcc

SEQ ID NO: 124822 - DNA, 21 bp, Homo sapiens
aggtcatgaaggacactctgc

SEQ ID NO: 124823 - DNA, 17 bp, Homo sapiens
aggtccaccggcccctg

SEQ ID NO: 124824 - DNA, 19 bp, Homo sapiens
aggtccaccggcccctggc

SEQ ID NO: 124825 - DNA, 16 bp, Homo sapiens
aggtccggggaggagg

SEQ ID NO: 124826 - DNA, 14 bp, Homo sapiens
aggtctctgtgggt

SEQ ID NO: 124827 - DNA, 21 bp, Homo sapiens
aggtgaacagcaggatgccct

SEQ ID NO: 124828 - DNA, 15 bp, Homo sapiens
aggtgggtgaggctg

SEQ ID NO: 124829 - DNA, 19 bp, Homo sapiens
aggtgggtgaggctgggca

SEQ ID NO: 124830 - DNA, 21 bp, Homo sapiens
aggtgggtgaggctgggcagg

SEQ ID NO: 124831 - DNA, 19 bp, Homo sapiens
aggttcgggattccctggt

SEQ ID NO: 124832 - DNA, 19 bp, Homo sapiens
aggtttcccagtgagcctc

SEQ ID NO: 124833 - DNA, 20 bp, Homo sapiens
aggttttgaataaaaagtga

SEQ ID NO: 124834 - DNA, 21 bp, Homo sapiens
aggttttgaataaaaagtgaa

SEQ ID NO: 124835 - DNA, 23 bp, Homo sapiens
aggttttgaataaaaagtgaact

SEQ ID NO: 124836 - DNA, 14 bp, Homo sapiens
agtaaactgaggcc

SEQ ID NO: 124837 - DNA, 12 bp, Homo sapiens
agtacccttggg

SEQ ID NO: 124838 - DNA, 22 bp, Homo sapiens
cagcccccacagccctggaata

SEQ ID NO: 124839 - DNA, 12 bp, Homo sapiens
cagcccccaggc

SEQ ID NO: 124840 - DNA, 15 bp, Homo sapiens
cagcccccaggccag

SEQ ID NO: 124841 - DNA, 17 bp, Homo sapiens
cagcccccaggccaggt

SEQ ID NO: 124842 - DNA, 18 bp, Homo sapiens
cagccccgtcccagaggc

SEQ ID NO: 124843 - DNA, 20 bp, Homo sapiens
cagccccgtcccagaggccg

SEQ ID NO: 124844 - DNA, 13 bp, Homo sapiens
cagcccctccacg

SEQ ID NO: 124845 - DNA, 12 bp, Homo sapiens
cagccctgaaac

SEQ ID NO: 124846 - DNA, 14 bp, Homo sapiens
cagcctcccacccc

SEQ ID NO: 124847 - DNA, 17 bp, Homo sapiens
cagcctttgcctccccg

SEQ ID NO: 124848 - DNA, 13 bp, Homo sapiens
cagcgggccaggc

SEQ ID NO: 124849 - DNA, 16 bp, Homo sapiens
cagcgggccaggcagg

SEQ ID NO: 124850 - DNA, 19 bp, Homo sapiens
cagctattagcaactgtgc

SEQ ID NO: 124851 - DNA, 21 bp, Homo sapiens
cagctccctgaccccctgtcc

SEQ ID NO: 124852 - DNA, 16 bp, Homo sapiens
cagctctctctcctgg

SEQ ID NO: 124853 - DNA, 18 bp, Homo sapiens
cagcttgtgctgagcctg

SEQ ID NO: 124854 - DNA, 19 bp, Homo sapiens
cagcttgtgctgagcctgc

SEQ ID NO: 124855 - DNA, 12 bp, Homo sapiens
caggaaagaata

SEQ ID NO: 124856 - DNA, 13 bp, Homo sapiens
caggaaagaatag

SEQ ID NO: 124857 - DNA, 15 bp, Homo sapiens
caggactctgcagat

SEQ ID NO: 124858 - DNA, 17 bp, Homo sapiens
caggagcagcccaccca

SEQ ID NO: 124859 - DNA, 20 bp, Homo sapiens
caggaggctccgtgagccct

SEQ ID NO: 124860 - DNA, 22 bp, Homo sapiens
caggaggctccgtgagcccttg

SEQ ID NO: 124861 - DNA, 18 bp, Homo sapiens
caggagggagagcctctg

SEQ ID NO: 124862 - DNA, 18 bp, Homo sapiens
caggcatcactgattccc

SEQ ID NO: 124863 - DNA, 18 bp, Homo sapiens
caggcccagtgacaaaga

SEQ ID NO: 124864 - DNA, 17 bp, Homo sapiens
caggcccggtgaggcca

SEQ ID NO: 124865 - DNA, 18 bp, Homo sapiens
caggcccggtgaggccaa

SEQ ID NO: 124866 - DNA, 19 bp, Homo sapiens
ccaaatcaaaataaaagaa

SEQ ID NO: 124867 - DNA, 22 bp, Homo sapiens
ccaaattattaattgtcctgtg

SEQ ID NO: 124868 - DNA, 23 bp, Homo sapiens
ccaaattattaattgtcctgtgt

SEQ ID NO: 124869 - DNA, 14 bp, Homo sapiens
ccaagctccaaatc

SEQ ID NO: 124870 - DNA, 16 bp, Homo sapiens
ccaaggaaaattgaaa

SEQ ID NO: 124871 - DNA, 19 bp, Homo sapiens
ccaaggaaaattgaaagta

SEQ ID NO: 124872 - DNA, 18 bp, Homo sapiens
ccaaggaatgtgtccaag

SEQ ID NO: 124873 - DNA, 23 bp, Homo sapiens
ccaaggaatgtgtccaagacaca

SEQ ID NO: 124874 - DNA, 11 bp, Homo sapiens
ccaaggagaac

SEQ ID NO: 124875 - DNA, 22 bp, Homo sapiens
ccaaggtttcccagtgagcctc

SEQ ID NO: 124876 - DNA, 16 bp, Homo sapiens
ccaagtcctgctcctt

SEQ ID NO: 124877 - DNA, 22 bp, Homo sapiens
ccaagtgtctcttgactggctc

SEQ ID NO: 124878 - DNA, 13 bp, Homo sapiens
ccaatccaggccc

SEQ ID NO: 124879 - DNA, 16 bp, Homo sapiens
ccacaaactgatttct

SEQ ID NO: 124880 - DNA, 15 bp, Homo sapiens
ccacacaagtgcagt

SEQ ID NO: 124881 - DNA, 23 bp, Homo sapiens
ccacagccctgaaacgagaagtg

SEQ ID NO: 124882 - DNA, 12 bp, Homo sapiens
ccacagccctgg

SEQ ID NO: 124883 - DNA, 13 bp, Homo sapiens
ccacagccctgga

SEQ ID NO: 124884 - DNA, 19 bp, Homo sapiens
ccacagggaagcatgtact

SEQ ID NO: 124885 - DNA, 22 bp, Homo sapiens
ccacaggttcatgccaccatgg

SEQ ID NO: 124886 - DNA, 12 bp, Homo sapiens
ccacccaaggag

SEQ ID NO: 124887 - DNA, 14 bp, Homo sapiens
ccaccggcccctgg

SEQ ID NO: 124888 - DNA, 13 bp, Homo sapiens
ccacctgacctct

SEQ ID NO: 124889 - DNA, 14 bp, Homo sapiens
ccacctgacctctg

SEQ ID NO: 124890 - DNA, 18 bp, Homo sapiens
ccacctgggccaaggact

SEQ ID NO: 124891 - DNA, 11 bp, Homo sapiens
ccacctgtctc

SEQ ID NO: 124892 - DNA, 20 bp, Homo sapiens
ccacctgtctcagcctccca

SEQ ID NO: 124893 - DNA, 20 bp, Homo sapiens
ccactaggtgaacagcagga

SEQ ID NO: 124894 - DNA, 17 bp, Homo sapiens
ccactgacagcctccca

SEQ ID NO: 124895 - DNA, 19 bp, Homo sapiens
ccactgtttcatgagccca

SEQ ID NO: 124896 - DNA, 20 bp, Homo sapiens
ccacttcttgttccccactg

SEQ ID NO: 124897 - DNA, 18 bp, Homo sapiens
ccagaggccgctgcccct

SEQ ID NO: 124898 - DNA, 19 bp, Homo sapiens
ccagaggtggccctcccag

SEQ ID NO: 124899 - DNA, 21 bp, Homo sapiens
ccagaggtggccctcccaggc

SEQ ID NO: 124900 - DNA, 15 bp, Homo sapiens
ccagcagtacaataa

SEQ ID NO: 124901 - DNA, 22 bp, Homo sapiens
ccagccaacttttgcatgtttt

SEQ ID NO: 124902 - DNA, 18 bp, Homo sapiens
ccagccccaatccagaga

SEQ ID NO: 124903 - DNA, 18 bp, Homo sapiens
ccagcccccacagccctg

SEQ ID NO: 124904 - DNA, 17 bp, Homo sapiens
ccagccccgtcccagag

SEQ ID NO: 124905 - DNA, 19 bp, Homo sapiens
ccagccccgtcccagaggc

SEQ ID NO: 124906 - DNA, 17 bp, Homo sapiens
ccaggagggagagcctc

SEQ ID NO: 124907 - DNA, 21 bp, Homo sapiens
ccaggagggagagcctctgtt

SEQ ID NO: 124908 - DNA, 21 bp, Homo sapiens
ccaggcatcactgattccctc

SEQ ID NO: 124909 - DNA, 22 bp, Homo sapiens
ccaggcatcactgattccctct

SEQ ID NO: 124910 - DNA, 18 bp, Homo sapiens
ccaggcccggtgaggcca

SEQ ID NO: 124911 - DNA, 23 bp, Homo sapiens
ccaggcttaaggagaggagaaac

SEQ ID NO: 124912 - DNA, 16 bp, Homo sapiens
ccaggggtggggccca

SEQ ID NO: 124913 - DNA, 22 bp, Homo sapiens
ccaggggtggggcccatggggt

SEQ ID NO: 124914 - DNA, 19 bp, Homo sapiens
ccaggtgaggtccaccggc

SEQ ID NO: 124915 - DNA, 19 bp, Homo sapiens
ccagtgacaaagactcctc

SEQ ID NO: 124916 - DNA, 22 bp, Homo sapiens
ccagtgacaaagactcctctgg

SEQ ID NO: 124917 - DNA, 23 bp, Homo sapiens
ccagtgacaaagactcctctggg

SEQ ID NO: 124918 - DNA, 16 bp, Homo sapiens
ccagtgagcctctgcg

SEQ ID NO: 124919 - DNA, 18 bp, Homo sapiens
ccagtgagcctctgcgcc

SEQ ID NO: 124920 - DNA, 20 bp, Homo sapiens
ccagtgagcctctgcgcctc

SEQ ID NO: 124921 - DNA, 20 bp, Homo sapiens
ccagtgagtgtaaataattt

SEQ ID NO: 124922 - DNA, 19 bp, Homo sapiens
ccagtgttccccccataga

SEQ ID NO: 124923 - DNA, 16 bp, Homo sapiens
ccagtttattctgtgg

SEQ ID NO: 124924 - DNA, 21 bp, Homo sapiens
ccataggaagacataaaactt

SEQ ID NO: 124925 - DNA, 16 bp, Homo sapiens
ccatagtcaaagagag

SEQ ID NO: 124926 - DNA, 23 bp, Homo sapiens
ccatcaaaggaatataagaaaag

SEQ ID NO: 124927 - DNA, 16 bp, Homo sapiens
ccatcccacaccctgg

SEQ ID NO: 124928 - DNA, 14 bp, Homo sapiens
ccatctctccctcc

SEQ ID NO: 124929 - DNA, 13 bp, Homo sapiens
ccatgaagctggc

SEQ ID NO: 124930 - DNA, 11 bp, Homo sapiens
ccatgacaaac

SEQ ID NO: 124931 - DNA, 12 bp, Homo sapiens
ccatgcctctgg

SEQ ID NO: 124932 - DNA, 18 bp, Homo sapiens
ccatggagacaataaaca

SEQ ID NO: 124933 - DNA, 22 bp, Homo sapiens
ccatggagacaataaacagctg

SEQ ID NO: 124934 - DNA, 20 bp, Homo sapiens
ccatggggtctctgcatctt

SEQ ID NO: 124935 - DNA, 21 bp, Homo sapiens
ccatgtgcacctatggcccag

SEQ ID NO: 124936 - DNA, 16 bp, Homo sapiens
ccattgaaatcagcat

SEQ ID NO: 124937 - DNA, 18 bp, Homo sapiens
cccaagtcctgctccttt

SEQ ID NO: 124938 - DNA, 16 bp, Homo sapiens
cccaagttttttaatt

SEQ ID NO: 124939 - DNA, 15 bp, Homo sapiens
cccaattgccacatt

SEQ ID NO: 124940 - DNA, 12 bp, Homo sapiens
cccacagccctg

SEQ ID NO: 124941 - DNA, 15 bp, Homo sapiens
ctggcccttggaata

SEQ ID NO: 124942 - DNA, 14 bp, Homo sapiens
ctgggcacccctgc

SEQ ID NO: 124943 - DNA, 15 bp, Homo sapiens
ctgggcacccctgcc

SEQ ID NO: 124944 - DNA, 19 bp, Homo sapiens
ctgggcacccctgcctcct

SEQ ID NO: 124945 - DNA, 15 bp, Homo sapiens
ctgggcagggcctgg

SEQ ID NO: 124946 - DNA, 17 bp, Homo sapiens
ctgggccactcctcttc

SEQ ID NO: 124947 - DNA, 19 bp, Homo sapiens
ctgggccactcctcttcac

SEQ ID NO: 124948 - DNA, 12 bp, Homo sapiens
ctgggcccagcc

SEQ ID NO: 124949 - DNA, 15 bp, Homo sapiens
ctgggcccagcccct

SEQ ID NO: 124950 - DNA, 13 bp, Homo sapiens
ctgggcctggggt

SEQ ID NO: 124951 - DNA, 23 bp, Homo sapiens
ctgggcggggccgcagccacacc

SEQ ID NO: 124952 - DNA, 22 bp, Homo sapiens
ctggggcttggggattgccact

SEQ ID NO: 124953 - DNA, 23 bp, Homo sapiens
ctggggcttggggattgccacta

SEQ ID NO: 124954 - DNA, 17 bp, Homo sapiens
ctgggggcggggcctgg

SEQ ID NO: 124955 - DNA, 16 bp, Homo sapiens
ctgggtgctgatcctt

SEQ ID NO: 124956 - DNA, 20 bp, Homo sapiens
ctgggtgctgatccttgcac

SEQ ID NO: 124957 - DNA, 21 bp, Homo sapiens
ctggtctcaaactcctgggct

SEQ ID NO: 124958 - DNA, 21 bp, Homo sapiens
ctggtgggcctcgacgtccct

SEQ ID NO: 124959 - DNA, 16 bp, Homo sapiens
ctggtgtcataaactt

SEQ ID NO: 124960 - DNA, 12 bp, Homo sapiens
ctggttccaaac

SEQ ID NO: 124961 - DNA, 21 bp, Homo sapiens
ctggtttgtttgcttaatttc

SEQ ID NO: 124962 - DNA, 15 bp, Homo sapiens
ctgtaaaagttataa

SEQ ID NO: 124963 - DNA, 19 bp, Homo sapiens
ctgtaatcagctctcctgg

SEQ ID NO: 124964 - DNA, 21 bp, Homo sapiens
ctgtaatcagctctcctggct

SEQ ID NO: 124965 - DNA, 15 bp, Homo sapiens
ctgtatactgtaaaa

SEQ ID NO: 124966 - DNA, 20 bp, Homo sapiens
ctgtatactgtaaaagttat

SEQ ID NO: 124967 - DNA, 18 bp, Homo sapiens
ctgtcaaatgaactttta

SEQ ID NO: 124968 - DNA, 22 bp, Homo sapiens
ctgtcaaatgaacttttacaga

SEQ ID NO: 124969 - DNA, 13 bp, Homo sapiens
ctgtccataaagt

SEQ ID NO: 124970 - DNA, 14 bp, Homo sapiens
ctgtccataaagta

SEQ ID NO: 124971 - DNA, 12 bp, Homo sapiens
ctgtccctcact

SEQ ID NO: 124972 - DNA, 19 bp, Homo sapiens
ctgtccttgaatgccatag

SEQ ID NO: 124973 - DNA, 12 bp, Homo sapiens
ctgtctcagcct

SEQ ID NO: 124974 - DNA, 14 bp, Homo sapiens
ctgtctcagcctcc

SEQ ID NO: 124975 - DNA, 16 bp, Homo sapiens
ctgtgaaatgctggca

SEQ ID NO: 124976 - DNA, 14 bp, Homo sapiens
ctgtgaatttcaaa

SEQ ID NO: 124977 - DNA, 17 bp, Homo sapiens
ctgtgcattacaaagtt

SEQ ID NO: 124978 - DNA, 18 bp, Homo sapiens
ctgtggttctataataag

SEQ ID NO: 124979 - DNA, 17 bp, Homo sapiens
ctgtgtatcattaaaat

SEQ ID NO: 124980 - DNA, 21 bp, Homo sapiens
ctgtgtatcattaaaatatat

SEQ ID NO: 124981 - DNA, 19 bp, Homo sapiens
ctgttattttttatttcca

SEQ ID NO: 124982 - DNA, 21 bp, Homo sapiens
ctgttgatcccctctctgtgg

SEQ ID NO: 124983 - DNA, 22 bp, Homo sapiens
ctgttgcagcttgtgctgagcc

SEQ ID NO: 124984 - DNA, 18 bp, Homo sapiens
ctgttgcccgccctccac

SEQ ID NO: 124985 - DNA, 21 bp, Homo sapiens
ctgttgggggcttcaggtctc

SEQ ID NO: 124986 - DNA, 18 bp, Homo sapiens
ctgtttcatgagcccaaa

SEQ ID NO: 124987 - DNA, 20 bp, Homo sapiens
ctgtttggtcgagtctttgt

SEQ ID NO: 124988 - DNA, 19 bp, Homo sapiens
ctgtttgtatatttgcaaa

SEQ ID NO: 124989 - DNA, 13 bp, Homo sapiens
cttaaaatgcaat

SEQ ID NO: 124990 - DNA, 20 bp, Homo sapiens
cttaaaatgcaatatttgta

SEQ ID NO: 124991 - DNA, 22 bp, Homo sapiens
cttaaaatgcaatatttgtaag

SEQ ID NO: 124992 - DNA, 21 bp, Homo sapiens
cttaaaattagtgagattaaa

SEQ ID NO: 124993 - DNA, 16 bp, Homo sapiens
cttaacattcctaaaa

SEQ ID NO: 124994 - DNA, 19 bp, Homo sapiens
cttaacattcctaaaatgc

SEQ ID NO: 124995 - DNA, 19 bp, Homo sapiens
cttaaggagaggagaaact

SEQ ID NO: 124996 - DNA, 22 bp, Homo sapiens
cttaaggagaggagaaactgag

SEQ ID NO: 124997 - DNA, 22 bp, Homo sapiens
cttaaggatcaccccagccccc

SEQ ID NO: 124998 - DNA, 14 bp, Homo sapiens
cttaatatttttac

SEQ ID NO: 124999 - DNA, 17 bp, Homo sapiens
cttaatttccttctgtt

SEQ ID NO: 125000 - DNA, 19 bp, Homo sapiens
cttacaagtggtgaccaaa

SEQ ID NO: 125001 - DNA, 14 bp, Homo sapiens
cttactttcctgtg

SEQ ID NO: 125002 - DNA, 21 bp, Homo sapiens
gcccttaaggatcaccccagc

SEQ ID NO: 125003 - DNA, 13 bp, Homo sapiens
gcccttggaataa

SEQ ID NO: 125004 - DNA, 19 bp, Homo sapiens
gccgcgtggaatgtgagtg

SEQ ID NO: 125005 - DNA, 19 bp, Homo sapiens
gcctcactattacttgaac

SEQ ID NO: 125006 - DNA, 13 bp, Homo sapiens
gcctcccgccacc

SEQ ID NO: 125007 - DNA, 16 bp, Homo sapiens
gcctcccgccaccctg

SEQ ID NO: 125008 - DNA, 17 bp, Homo sapiens
gcctcccgccaccctgt

SEQ ID NO: 125009 - DNA, 16 bp, Homo sapiens
gcctcgacgtcccttg

SEQ ID NO: 125010 - DNA, 13 bp, Homo sapiens
gcctctccactgt

SEQ ID NO: 125011 - DNA, 16 bp, Homo sapiens
gcctctgcaaactaag

SEQ ID NO: 125012 - DNA, 22 bp, Homo sapiens
gcctctggaggcctctggccct

SEQ ID NO: 125013 - DNA, 23 bp, Homo sapiens
gcctgcaggtccggggaggaggt

SEQ ID NO: 125014 - DNA, 18 bp, Homo sapiens
gcctgccccacccacccc

SEQ ID NO: 125015 - DNA, 22 bp, Homo sapiens
gcctggcggaggtggagtggcc

SEQ ID NO: 125016 - DNA, 21 bp, Homo sapiens
gcctgtaatcagctctcctgg

SEQ ID NO: 125017 - DNA, 15 bp, Homo sapiens
gcctttgcctccccg

SEQ ID NO: 125018 - DNA, 21 bp, Homo sapiens
gcgatccacctgtctcagcct

SEQ ID NO: 125019 - DNA, 16 bp, Homo sapiens
gcgcaggcccagtgac

SEQ ID NO: 125020 - DNA, 20 bp, Homo sapiens
gcgccacccaccatcaaagg

SEQ ID NO: 125021 - DNA, 14 bp, Homo sapiens
gcgcctctccactg

SEQ ID NO: 125022 - DNA, 14 bp, Homo sapiens
gcgcttcccacctg

SEQ ID NO: 125023 - DNA, 22 bp, Homo sapiens
gcggaattgcatacaactgtgc

SEQ ID NO: 125024 - DNA, 17 bp, Homo sapiens
gcggaggtggagtggcc

SEQ ID NO: 125025 - DNA, 17 bp, Homo sapiens
gcggggacaccgggaag

SEQ ID NO: 125026 - DNA, 24 bp, Homo sapiens
gcggggacaccgggaagtgcagcg

SEQ ID NO: 125027 - DNA, 15 bp, Homo sapiens
gcggggtgcctgctg

SEQ ID NO: 125028 - DNA, 15 bp, Homo sapiens
gctaaaagtgcattt

SEQ ID NO: 125029 - DNA, 18 bp, Homo sapiens
gctacttatcatttttgt

SEQ ID NO: 125030 - DNA, 23 bp, Homo sapiens
gctacttatcatttttgtataaa

SEQ ID NO: 125031 - DNA, 22 bp, Homo sapiens
gctatcagaaacagtattttct

SEQ ID NO: 125032 - DNA, 23 bp, Homo sapiens
gctatcagaaacagtattttctt

SEQ ID NO: 125033 - DNA, 13 bp, Homo sapiens
gctcagctgggcc

SEQ ID NO: 125034 - DNA, 22 bp, Homo sapiens
gctcaggatatggcttaggaat

SEQ ID NO: 125035 - DNA, 17 bp, Homo sapiens
gctccaggcatcactga

SEQ ID NO: 125036 - DNA, 9 bp, Homo sapiens
gctcccagc

SEQ ID NO: 125037 - DNA, 18 bp, Homo sapiens
gctcccagctctctctcc

SEQ ID NO: 125038 - DNA, 21 bp, Homo sapiens
gctcccagctctctctcctgg

SEQ ID NO: 125039 - DNA, 21 bp, Homo sapiens
gctccctcccgtagtctcctg

SEQ ID NO: 125040 - DNA, 15 bp, Homo sapiens
gctctaccctgcagc

SEQ ID NO: 125041 - DNA, 18 bp, Homo sapiens
gctctaccctgcagcttg

SEQ ID NO: 125042 - DNA, 13 bp, Homo sapiens
gctctcctggctc

SEQ ID NO: 125043 - DNA, 15 bp, Homo sapiens
gctctctctcctgga

SEQ ID NO: 125044 - DNA, 16 bp, Homo sapiens
gctctgaacttccaag

SEQ ID NO: 125045 - DNA, 18 bp, Homo sapiens
gctcttcaacatgacatc

SEQ ID NO: 125046 - DNA, 15 bp, Homo sapiens
gctgacggtttctcc

SEQ ID NO: 125047 - DNA, 18 bp, Homo sapiens
gctgagctgggcccagcc

SEQ ID NO: 125048 - DNA, 21 bp, Homo sapiens
gctgagctgggcccagcccct

SEQ ID NO: 125049 - DNA, 15 bp, Homo sapiens
gctgaggttttgaat

SEQ ID NO: 125050 - DNA, 22 bp, Homo sapiens
gctgaggttttgaataaaaagt

SEQ ID NO: 125051 - DNA, 13 bp, Homo sapiens
gctgctgaggccc

SEQ ID NO: 125052 - DNA, 17 bp, Homo sapiens
gctgcttggagtgcccc

SEQ ID NO: 125053 - DNA, 18 bp, Homo sapiens
gctgcttggagtgcccca

SEQ ID NO: 125054 - DNA, 19 bp, Homo sapiens
gctgggcagggcctggcgg

SEQ ID NO: 125055 - DNA, 17 bp, Homo sapiens
gctgggccactcctctt

SEQ ID NO: 125056 - DNA, 20 bp, Homo sapiens
gctgggccactcctcttcac

SEQ ID NO: 125057 - DNA, 22 bp, Homo sapiens
gctgggtcattacttctgagcc

SEQ ID NO: 125058 - DNA, 23 bp, Homo sapiens
gctgttcttttttgtacttttct

SEQ ID NO: 125059 - DNA, 16 bp, Homo sapiens
gctgttgatcccctct

SEQ ID NO: 125060 - DNA, 10 bp, Homo sapiens
gcttaatttc

SEQ ID NO: 125061 - DNA, 18 bp, Homo sapiens
gcttaatttccttctgtt

SEQ ID NO: 125062 - DNA, 22 bp, Homo sapiens
gcttacaaagtatatttaagga

SEQ ID NO: 125063 - DNA, 13 bp, Homo sapiens
gcttagttcttga

SEQ ID NO: 125064 - DNA, 20 bp, Homo sapiens
gcttatttttaaaataaaaa

SEQ ID NO: 125065 - DNA, 16 bp, Homo sapiens
gcttcaggtctctgtg

SEQ ID NO: 125066 - DNA, 13 bp, Homo sapiens
gcttcccacctgc

SEQ ID NO: 125067 - DNA, 17 bp, Homo sapiens
gcttccttagccttgct

SEQ ID NO: 125068 - DNA, 17 bp, Homo sapiens
gcttctagacactcctt

SEQ ID NO: 125069 - DNA, 14 bp, Homo sapiens
gcttcttaaaaact

SEQ ID NO: 125070 - DNA, 17 bp, Homo sapiens
gcttcttttctttgtat

SEQ ID NO: 125071 - DNA, 20 bp, Homo sapiens
gcttcttttctttgtatcat

SEQ ID NO: 125072 - DNA, 22 bp, Homo sapiens
gcttggagtgccccaaggaggt

SEQ ID NO: 125073 - DNA, 15 bp, Homo sapiens
gcttgtgctgagcct

SEQ ID NO: 125074 - DNA, 16 bp, Homo sapiens
gcttgtgctgagcctg

SEQ ID NO: 125075 - DNA, 17 bp, Homo sapiens
gcttgtgctgagcctgc

SEQ ID NO: 125076 - DNA, 19 bp, Homo sapiens
gcttgttccaatgccacat

SEQ ID NO: 125077 - DNA, 15 bp, Homo sapiens
gctttgttaaaaaaa

SEQ ID NO: 125078 - DNA, 23 bp, Homo sapiens
gctttgttaaaaaaaaaaagatt

SEQ ID NO: 125079 - DNA, 12 bp, Homo sapiens
gcttttaaaaaa

SEQ ID NO: 125080 - DNA, 20 bp, Homo sapiens
ggtcatgaaggacactctgc

SEQ ID NO: 125081 - DNA, 16 bp, Homo sapiens
ggtccaccggcccctg

SEQ ID NO: 125082 - DNA, 13 bp, Homo sapiens
ggtcccttgctgc

SEQ ID NO: 125083 - DNA, 21 bp, Homo sapiens
ggtctcaaactcctgggctca

SEQ ID NO: 125084 - DNA, 23 bp, Homo sapiens
ggtctcaaactcctgggctcagg

SEQ ID NO: 125085 - DNA, 20 bp, Homo sapiens
ggtctcacagtgttgcccag

SEQ ID NO: 125086 - DNA, 18 bp, Homo sapiens
ggtctctgcatcttcagt

SEQ ID NO: 125087 - DNA, 21 bp, Homo sapiens
ggtgagagaccacacatttta

SEQ ID NO: 125088 - DNA, 23 bp, Homo sapiens
ggtgaggctgggcagggcctggc

SEQ ID NO: 125089 - DNA, 12 bp, Homo sapiens
ggtgcatcctcc

SEQ ID NO: 125090 - DNA, 12 bp, Homo sapiens
ggtgcctgctgt

SEQ ID NO: 125091 - DNA, 14 bp, Homo sapiens
ggtgcctgctgtcc

SEQ ID NO: 125092 - DNA, 17 bp, Homo sapiens
ggtggccctcccaggct

SEQ ID NO: 125093 - DNA, 21 bp, Homo sapiens
ggtggcttcttttctttgtat

SEQ ID NO: 125094 - DNA, 13 bp, Homo sapiens
ggtggggcccatg

SEQ ID NO: 125095 - DNA, 20 bp, Homo sapiens
ggttcgggattccctggtgg

SEQ ID NO: 125096 - DNA, 23 bp, Homo sapiens
tgtgaaattcaacctgtgtctta

SEQ ID NO: 125097 - DNA, 16 bp, Homo sapiens
tgtgaatttcaaaaaa

SEQ ID NO: 125098 - DNA, 17 bp, Homo sapiens
tgtgcatgaaagagaaa

SEQ ID NO: 125099 - DNA, 22 bp, Homo sapiens
tgtgcattacaaagttaatatg

SEQ ID NO: 125100 - DNA, 17 bp, Homo sapiens
tgtgctgagcctgccca

SEQ ID NO: 125101 - DNA, 14 bp, Homo sapiens
tgtgtatcattaaa

SEQ ID NO: 125102 - DNA, 12 bp, Homo sapiens
tgtgtattctta

SEQ ID NO: 125103 - DNA, 14 bp, Homo sapiens
tgtgtattcttaaa

SEQ ID NO: 125104 - DNA, 23 bp, Homo sapiens
tgtgtattcttaaaatgcaatat

SEQ ID NO: 125105 - DNA, 20 bp, Homo sapiens
tgtgtcatcaatagtgtcct

SEQ ID NO: 125106 - DNA, 17 bp, Homo sapiens
tgtgtggaagaaggaaa

SEQ ID NO: 125107 - DNA, 17 bp, Homo sapiens
tgtgtttggcttggcct

SEQ ID NO: 125108 - DNA, 18 bp, Homo sapiens
tgtgtttggcttggcctt

SEQ ID NO: 125109 - DNA, 21 bp, Homo sapiens
tgtgttttaaaaaaactgaag

SEQ ID NO: 125110 - DNA, 22 bp, Homo sapiens
tgttaagaaaggatataaaagg

SEQ ID NO: 125111 - DNA, 16 bp, Homo sapiens
tgttatattccaagga

SEQ ID NO: 125112 - DNA, 17 bp, Homo sapiens
tgttatattccaaggaa

SEQ ID NO: 125113 - DNA, 19 bp, Homo sapiens
tgttatattccaaggaaaa

SEQ ID NO: 125114 - DNA, 20 bp, Homo sapiens
tgttattttttatttccaca

SEQ ID NO: 125115 - DNA, 18 bp, Homo sapiens
tgttccatagttaaagaa

SEQ ID NO: 125116 - DNA, 20 bp, Homo sapiens
tgttctgcaagaattaaaac

SEQ ID NO: 125117 - DNA, 21 bp, Homo sapiens
tgttgcccgccctccacccac

SEQ ID NO: 125118 - DNA, 22 bp, Homo sapiens
tgttgtacatacagaggtaact

SEQ ID NO: 125119 - DNA, 19 bp, Homo sapiens
tgttgtgcactagtgcaat

SEQ ID NO: 125120 - DNA, 22 bp, Homo sapiens
tgtttaatagaaaattaaaata

SEQ ID NO: 125121 - DNA, 24 bp, Homo sapiens
tgtttgcttaatttccttctgtta

SEQ ID NO: 125122 - DNA, 16 bp, Homo sapiens
tgtttggtcgagtctt

SEQ ID NO: 125123 - DNA, 18 bp, Homo sapiens
tgtttggtgctcatttaa

SEQ ID NO: 125124 - DNA, 17 bp, Homo sapiens
tgtttgtatatttgcaa

SEQ ID NO: 125125 - DNA, 18 bp, Homo sapiens
tgttttaaaaaaactgaa

SEQ ID NO: 125126 - DNA, 21 bp, Homo sapiens
tgttttaaaaaaactgaaggt

SEQ ID NO: 125127 - DNA, 19 bp, Homo sapiens
ttaaaaaaactgaaggttt

SEQ ID NO: 125128 - DNA, 18 bp, Homo sapiens
ttaaaaaaagtatatatt

SEQ ID NO: 125129 - DNA, 11 bp, Homo sapiens
ttaaaaaatat

SEQ ID NO: 125130 - DNA, 18 bp, Homo sapiens
ttaaaaaatattttaaga

SEQ ID NO: 125131 - DNA, 21 bp, Homo sapiens
ttaaaaaatattttaagaaag

SEQ ID NO: 125132 - DNA, 23 bp, Homo sapiens
ttaaaaaatattttaagaaagag

SEQ ID NO: 125133 - DNA, 23 bp, Homo sapiens
ttaaaaactgtgtatcattaaaa

SEQ ID NO: 125134 - DNA, 13 bp, Homo sapiens
ttaaaactgagtc

SEQ ID NO: 125135 - DNA, 20 bp, Homo sapiens
ttaaaactgagtccatgaaa

SEQ ID NO: 125136 - DNA, 22 bp, Homo sapiens
ttaaaagcaattatattgtcct

SEQ ID NO: 125137 - DNA, 11 bp, Homo sapiens
ttaaaaggcaa

SEQ ID NO: 125138 - DNA, 15 bp, Homo sapiens
ttaaaataaaaatat

SEQ ID NO: 125139 - DNA, 11 bp, Homo sapiens
ttaaaatatat

SEQ ID NO: 125140 - DNA, 13 bp, Homo sapiens
ttaaaatatatgt

SEQ ID NO: 125141 - DNA, 18 bp, Homo sapiens
ttaaaatatatgttctgc

SEQ ID NO: 125142 - DNA, 18 bp, Homo sapiens
ttaaacctctcttctacc

SEQ ID NO: 125143 - DNA, 18 bp, Homo sapiens
ttaaagtatgttattgca

SEQ ID NO: 125144 - DNA, 23 bp, Homo sapiens
ttaaagtatttataaaaatataa

SEQ ID NO: 125145 - DNA, 15 bp, Homo sapiens
ttaaataacctctgg

SEQ ID NO: 125146 - DNA, 21 bp, Homo sapiens
ttaaatatctgaacatttact

SEQ ID NO: 125147 - DNA, 12 bp, Homo sapiens
ttaaatctagac

SEQ ID NO: 125148 - DNA, 22 bp, Homo sapiens
ttaacattcctaaaatgcttca

SEQ ID NO: 125149 - DNA, 18 bp, Homo sapiens
ttaacatttcattgtaca

SEQ ID NO: 125150 - DNA, 19 bp, Homo sapiens
ttaacatttcattgtacaa

SEQ ID NO: 125151 - DNA, 9 bp, Homo sapiens
ttaagaaag

SEQ ID NO: 125152 - DNA, 15 bp, Homo sapiens
ttaagacgtgaatgt

SEQ ID NO: 125153 - DNA, 19 bp, Homo sapiens
ttaagacgtgaatgtctca

SEQ ID NO: 125154 - DNA, 20 bp, Homo sapiens
ttaagtgcaacatttctgta

SEQ ID NO: 125155 - DNA, 24 bp, Homo sapiens
ttaagtgcaacatttctgtatact

SEQ ID NO: 125156 - DNA, 14 bp, Homo sapiens
ttaatatctgagaa

SEQ ID NO: 125157 - DNA, 14 bp, Homo sapiens
ttaatggactgtga

SEQ ID NO: 125158 - DNA, 17 bp, Homo sapiens
ttaattgtcctgtgtct

SEQ ID NO: 125159 - DNA, 18 bp, Homo sapiens
ttaatttccttctgttaa

SEQ ID NO: 125160 - DNA, 22 bp, Homo sapiens
ttaatttccttctgttaagaaa

SEQ ID NO: 125161 - DNA, 23 bp, Homo sapiens
ttacaagtggtgaccaaaatttt

SEQ ID NO: 125162 - DNA, 16 bp, Homo sapiens
ttacaagtttgctaaa

SEQ ID NO: 125163 - DNA, 18 bp, Homo sapiens
ttacagaatgcattaaaa

SEQ ID NO: 125164 - DNA, 14 bp, Homo sapiens
ttacagtttgtgtt

SEQ ID NO: 125165 - DNA, 12 bp, Homo sapiens
ttagaatatatt

SEQ ID NO: 125166 - DNA, 13 bp, Homo sapiens
ttagagaactgga

SEQ ID NO: 125167 - DNA, 15 bp, Homo sapiens
ttagagaactggagg

SEQ ID NO: 125168 - DNA, 14 bp, Homo sapiens
ttagagtttacagt

SEQ ID NO: 125169 - DNA, 18 bp, Homo sapiens
ttagagtttacagtttgt

SEQ ID NO: 125170 - DNA, 22 bp, Homo sapiens
ttagcagaatggagaaagtaag

SEQ ID NO: 125171 - DNA, 17 bp, Homo sapiens
ttagtgagattaaaaat

SEQ ID NO: 125172 - DNA, 18 bp, Homo sapiens
ttagtgagattaaaaatc

SEQ ID NO: 125173 - DNA, 12 bp, Homo sapiens
ttagttcttgaa

SEQ ID NO: 125174 - DNA, 19 bp, Homo sapiens
ttataaaaatataaattgt

SEQ ID NO: 125175 - DNA, 16 bp, Homo sapiens
ttataataactgaact

SEQ ID NO: 125176 - DNA, 18 bp, Homo sapiens
ttataataactgaactgt

SEQ ID NO: 125177 - DNA, 23 bp, Homo sapiens
ttataggtaacgtgattgattca

SEQ ID NO: 125178 - DNA, 12 bp, Homo sapiens
ttatatatcata

SEQ ID NO: 125179 - DNA, 14 bp, Homo sapiens
ttatatatcataaa

SEQ ID NO: 125180 - DNA, 12 bp, Homo sapiens
ttatattgtcct

SEQ ID NO: 125181 - DNA, 12 bp, Homo sapiens
ttatgaaaactc

SEQ ID NO: 125182 - DNA, 14 bp, Homo sapiens
ttatgctcagggtc

SEQ ID NO: 125183 - DNA, 17 bp, Homo sapiens
ttattacaaatgcaaat

SEQ ID NO: 125184 - DNA, 19 bp, Homo sapiens
ttattctgtggttctataa

SEQ ID NO: 125185 - DNA, 13 bp, Homo sapiens
ttattctttttaa

SEQ ID NO: 125186 - DNA, 20 bp, Homo sapiens
ttatttaacaaaaaatgtaa

SEQ ID NO: 125187 - DNA, 16 bp, Homo sapiens
ttatttttaaaataaa

SEQ ID NO: 125188 - DNA, 14 bp, Homo sapiens
ggttctataataag

SEQ ID NO: 125189 - DNA, 17 bp, Homo sapiens
ggttctataataagttt

SEQ ID NO: 125190 - DNA, 23 bp, Homo sapiens
ggttctcagtggtcaccttcctc

SEQ ID NO: 125191 - DNA, 13 bp, Homo sapiens
ggtttgtttgctt

SEQ ID NO: 125192 - DNA, 18 bp, Homo sapiens
ggtttgtttgcttaattt

SEQ ID NO: 125193 - DNA, 17 bp, Homo sapiens
ggttttgaataaaaagt

SEQ ID NO: 125194 - DNA, 17 bp, Homo sapiens
gtaaaaagattatatat

SEQ ID NO: 125195 - DNA, 17 bp, Homo sapiens
gtaaaagttataataac

SEQ ID NO: 125196 - DNA, 19 bp, Homo sapiens
gtaaaagttataataactg

SEQ ID NO: 125197 - DNA, 19 bp, Homo sapiens
gtaaaattgagtttcagaa

SEQ ID NO: 125198 - DNA, 21 bp, Homo sapiens
gtaaatttttgaaaaatattg

SEQ ID NO: 125199 - DNA, 21 bp, Homo sapiens
gtaacgtgattgattcagtat

SEQ ID NO: 125200 - DNA, 11 bp, Homo sapiens
gtaacttcaaa

SEQ ID NO: 125201 - DNA, 22 bp, Homo sapiens
gtaagtcttttttttttccaaa

SEQ ID NO: 125202 - DNA, 12 bp, Homo sapiens
gtaatataaaag

SEQ ID NO: 125203 - DNA, 19 bp, Homo sapiens
gtaatcagctctcctggct

SEQ ID NO: 125204 - DNA, 17 bp, Homo sapiens
gtaatccatcactagcc

SEQ ID NO: 125205 - DNA, 12 bp, Homo sapiens
gtaatttgaatt

SEQ ID NO: 125206 - DNA, 13 bp, Homo sapiens
gtaatttgaattg

SEQ ID NO: 125207 - DNA, 14 bp, Homo sapiens
gtaatttgaattgg

SEQ ID NO: 125208 - DNA, 16 bp, Homo sapiens
gtaattttgtgaaaga

SEQ ID NO: 125209 - DNA, 22 bp, Homo sapiens
gtacagctgacggtttctcccc

SEQ ID NO: 125210 - DNA, 23 bp, Homo sapiens
gtacagctgacggtttctccccg

SEQ ID NO: 125211 - DNA, 14 bp, Homo sapiens
gtacatctggcctt

SEQ ID NO: 125212 - DNA, 23 bp, Homo sapiens
gtacattttgtaaaatattatgt

SEQ ID NO: 125213 - DNA, 11 bp, Homo sapiens
gtacttttctg

SEQ ID NO: 125214 - DNA, 14 bp, Homo sapiens
gtagtctcctgggt

SEQ ID NO: 125215 - DNA, 21 bp, Homo sapiens
gtagtgtcttcctagtatatt

SEQ ID NO: 125216 - DNA, 13 bp, Homo sapiens
gtataaaaaggaa

SEQ ID NO: 125217 - DNA, 17 bp, Homo sapiens
gtataaaaaggaaatta

SEQ ID NO: 125218 - DNA, 21 bp, Homo sapiens
gtataaaaaggaaattagtct

SEQ ID NO: 125219 - DNA, 12 bp, Homo sapiens
gtatactgtaaa

SEQ ID NO: 125220 - DNA, 17 bp, Homo sapiens
gtatactgtaaaagtta

SEQ ID NO: 125221 - DNA, 14 bp, Homo sapiens
gtatatattctaca

SEQ ID NO: 125222 - DNA, 18 bp, Homo sapiens
gtatatctatatctctaa

SEQ ID NO: 125223 - DNA, 18 bp, Homo sapiens
gtatatgtatatctatat

SEQ ID NO: 125224 - DNA, 12 bp, Homo sapiens
gtatatttgcaa

SEQ ID NO: 125225 - DNA, 20 bp, Homo sapiens
gtatcaactaggggaggaga

SEQ ID NO: 125226 - DNA, 16 bp, Homo sapiens
gtatcattaaaatata

SEQ ID NO: 125227 - DNA, 19 bp, Homo sapiens
gtatctacagtaatgaaat

SEQ ID NO: 125228 - DNA, 14 bp, Homo sapiens
gtatcttagagttt

SEQ ID NO: 125229 - DNA, 21 bp, Homo sapiens
gtatcttagagtttacagttt

SEQ ID NO: 125230 - DNA, 13 bp, Homo sapiens
gtattataattgt

SEQ ID NO: 125231 - DNA, 16 bp, Homo sapiens
gtattcagaaattaaa

SEQ ID NO: 125232 - DNA, 20 bp, Homo sapiens
gtattcagaaattaaaatat

SEQ ID NO: 125233 - DNA, 20 bp, Homo sapiens
gtattcttaaaatgcaatat

SEQ ID NO: 125234 - DNA, 17 bp, Homo sapiens
gtatttataaaaatata

SEQ ID NO: 125235 - DNA, 20 bp, Homo sapiens
gtattttcttcccaaatcaa

SEQ ID NO: 125236 - DNA, 13 bp, Homo sapiens
gtcaaatgaactt

SEQ ID NO: 125237 - DNA, 14 bp, Homo sapiens
gtcaccttcctcag

SEQ ID NO: 125238 - DNA, 14 bp, Homo sapiens
gtcatcccttcctc

SEQ ID NO: 125239 - DNA, 24 bp, Homo sapiens
gtcatcccttcctcctctcctgga

SEQ ID NO: 125240 - DNA, 22 bp, Homo sapiens
gtcatgaaggacactctgcagg

SEQ ID NO: 125241 - DNA, 16 bp, Homo sapiens
gtccaccggcccctgg

SEQ ID NO: 125242 - DNA, 19 bp, Homo sapiens
gtccaccggcccctggcag

SEQ ID NO: 125243 - DNA, 12 bp, Homo sapiens
gtccatgaaaat

SEQ ID NO: 125244 - DNA, 21 bp, Homo sapiens
gtcccaagtagtagtgtcttc

SEQ ID NO: 125245 - DNA, 22 bp, Homo sapiens
gtcccagaggccgctgcccctg

SEQ ID NO: 125246 - DNA, 21 bp, Homo sapiens
gtccccggcggggtgcctgct

SEQ ID NO: 125247 - DNA, 16 bp, Homo sapiens
gtcccgcttagttctt

SEQ ID NO: 125248 - DNA, 15 bp, Homo sapiens
gtcccggggctccac

SEQ ID NO: 125249 - DNA, 15 bp, Homo sapiens
gtcccttgctgcaaa

SEQ ID NO: 125250 - DNA, 19 bp, Homo sapiens
gtcccttggatcagaggtc

SEQ ID NO: 125251 - DNA, 15 bp, Homo sapiens
gtcctatgcaataaa

SEQ ID NO: 125252 - DNA, 16 bp, Homo sapiens
gtcctatgcaataaaa

SEQ ID NO: 125253 - DNA, 21 bp, Homo sapiens
gtcctatgcaataaaattatt

SEQ ID NO: 125254 - DNA, 15 bp, Homo sapiens
gtcctcccctatttt

SEQ ID NO: 125255 - DNA, 16 bp, Homo sapiens
gtcctcccctatttta

SEQ ID NO: 125256 - DNA, 18 bp, Homo sapiens
gtcctcccctattttaag

SEQ ID NO: 125257 - DNA, 11 bp, Homo sapiens
gtcctgtgtct

SEQ ID NO: 125258 - DNA, 16 bp, Homo sapiens
gtccttgaatgccata

SEQ ID NO: 125259 - DNA, 21 bp, Homo sapiens
gtcctttgttataattttcct

SEQ ID NO: 125260 - DNA, 17 bp, Homo sapiens
gtctatctaatgacatg

SEQ ID NO: 125261 - DNA, 16 bp, Homo sapiens
gtctcaaactcctggg

SEQ ID NO: 125262 - DNA, 19 bp, Homo sapiens
gtctcacagtgttgcccag

SEQ ID NO: 125263 - DNA, 13 bp, Homo sapiens
gtctcagcctccc

SEQ ID NO: 125264 - DNA, 9 bp, Homo sapiens
gtctccagt

SEQ ID NO: 125265 - DNA, 16 bp, Homo sapiens
gtctcctgtccccggc

SEQ ID NO: 125266 - DNA, 23 bp, Homo sapiens
gtctcgctttgttgcccaggctg

SEQ ID NO: 125267 - DNA, 15 bp, Homo sapiens
gtctctgcatcttca

SEQ ID NO: 125268 - DNA, 16 bp, Homo sapiens
gtctctgcatcttcag

SEQ ID NO: 125269 - DNA, 17 bp, Homo sapiens
gtctctgcatcttcagt

SEQ ID NO: 125270 - DNA, 15 bp, Homo sapiens
gtctctgctggccca

SEQ ID NO: 125271 - DNA, 17 bp, Homo sapiens
gtctctgctggcccagc

SEQ ID NO: 125272 - DNA, 20 bp, Homo sapiens
gtctctgtataatctattta

SEQ ID NO: 125273 - DNA, 19 bp, Homo sapiens
gtctctgtgggtgggaatg

SEQ ID NO: 125274 - DNA, 21 bp, Homo sapiens
gtctcttgactggctcaagaa

SEQ ID NO: 125275 - DNA, 22 bp, Homo sapiens
gtctttttctttttttggtaaa

SEQ ID NO: 125276 - DNA, 14 bp, Homo sapiens
gtgaaacagagaaa

SEQ ID NO: 125277 - DNA, 16 bp, Homo sapiens
gtgaaacagagaaaga

SEQ ID NO: 125278 - DNA, 15 bp, Homo sapiens
gtgaagcaccaggga

SEQ ID NO: 125279 - DNA, 18 bp, Homo sapiens
gtgaagtctagaatcata

SEQ ID NO: 125280 - DNA, 13 bp, Homo sapiens
gtgaatgtctcag

SEQ ID NO: 125281 - DNA, 16 bp, Homo sapiens
gtgacaaagactcctc

SEQ ID NO: 125282 - DNA, 18 bp, Homo sapiens
gtgacaaagactcctctg

SEQ ID NO: 125283 - DNA, 20 bp, Homo sapiens
gtgacaaagactcctctggg

SEQ ID NO: 125284 - DNA, 17 bp, Homo sapiens
gtgagattaaaaatcta

SEQ ID NO: 125285 - DNA, 15 bp, Homo sapiens
ctccctcccctgcca

SEQ ID NO: 125286 - DNA, 18 bp, Homo sapiens
ctccctcccctgccattt

SEQ ID NO: 125287 - DNA, 14 bp, Homo sapiens
ctccctgctcccag

SEQ ID NO: 125288 - DNA, 15 bp, Homo sapiens
ctccctgctcccagc

SEQ ID NO: 125289 - DNA, 21 bp, Homo sapiens
ctccctttttatatcccattt

SEQ ID NO: 125290 - DNA, 13 bp, Homo sapiens
ctccgtgagccct

SEQ ID NO: 125291 - DNA, 18 bp, Homo sapiens
ctcctcagcccccaggcc

SEQ ID NO: 125292 - DNA, 20 bp, Homo sapiens
ctcctcagcccccaggccag

SEQ ID NO: 125293 - DNA, 12 bp, Homo sapiens
ctcctctcctgg

SEQ ID NO: 125294 - DNA, 13 bp, Homo sapiens
ctcctctcctgga

SEQ ID NO: 125295 - DNA, 13 bp, Homo sapiens
ctcctctgggcct

SEQ ID NO: 125296 - DNA, 14 bp, Homo sapiens
ctcctctgggcctg

SEQ ID NO: 125297 - DNA, 21 bp, Homo sapiens
ctcctggagtctgaagcctgc

SEQ ID NO: 125298 - DNA, 11 bp, Homo sapiens
ctcctggcaca

SEQ ID NO: 125299 - DNA, 21 bp, Homo sapiens
ctcctgggtgtgtttggcttg

SEQ ID NO: 125300 - DNA, 9 bp, Homo sapiens
ctcctgtgt

SEQ ID NO: 125301 - DNA, 10 bp, Homo sapiens
ctcctgtgtc

SEQ ID NO: 125302 - DNA, 17 bp, Homo sapiens
ctcgctttgttgcccag

SEQ ID NO: 125303 - DNA, 12 bp, Homo sapiens
ctcggctgtctc

SEQ ID NO: 125304 - DNA, 18 bp, Homo sapiens
ctctaaactgctgttaat

SEQ ID NO: 125305 - DNA, 17 bp, Homo sapiens
ctctaattagagaactg

SEQ ID NO: 125306 - DNA, 13 bp, Homo sapiens
ctctaccctgcag

SEQ ID NO: 125307 - DNA, 13 bp, Homo sapiens
ctctcccacccaa

SEQ ID NO: 125308 - DNA, 17 bp, Homo sapiens
ctctcccacccaaggag

SEQ ID NO: 125309 - DNA, 17 bp, Homo sapiens
ctctccctcccctgcca

SEQ ID NO: 125310 - DNA, 15 bp, Homo sapiens
ctctctgtggctcca

SEQ ID NO: 125311 - DNA, 16 bp, Homo sapiens
ctctctgtggctccaa

SEQ ID NO: 125312 - DNA, 13 bp, Homo sapiens
ctctcttttaaag

SEQ ID NO: 125313 - DNA, 23 bp, Homo sapiens
ctctgaacttccaagctccaaat

SEQ ID NO: 125314 - DNA, 22 bp, Homo sapiens
ctctgacagccctgcggagacc

SEQ ID NO: 125315 - DNA, 20 bp, Homo sapiens
ctctgatagctgtttcaaat

SEQ ID NO: 125316 - DNA, 21 bp, Homo sapiens
ctctgatagctgtttcaaatg

SEQ ID NO: 125317 - DNA, 21 bp, Homo sapiens
ctctgcagatagtgcctctgc

SEQ ID NO: 125318 - DNA, 22 bp, Homo sapiens
ctctgcagatagtgcctctgca

SEQ ID NO: 125319 - DNA, 15 bp, Homo sapiens
ctctgcatcttcagt

SEQ ID NO: 125320 - DNA, 19 bp, Homo sapiens
ctctgcgcctctccactgt

SEQ ID NO: 125321 - DNA, 14 bp, Homo sapiens
ctctgctggcccag

SEQ ID NO: 125322 - DNA, 13 bp, Homo sapiens
ctctggccctcgg

SEQ ID NO: 125323 - DNA, 20 bp, Homo sapiens
ctctggccctcggtggctgc

SEQ ID NO: 125324 - DNA, 15 bp, Homo sapiens
ctctgtggctccaac

SEQ ID NO: 125325 - DNA, 15 bp, Homo sapiens
ctcttgactggctca

SEQ ID NO: 125326 - DNA, 17 bp, Homo sapiens
ctgaaacatgtgcccct

SEQ ID NO: 125327 - DNA, 21 bp, Homo sapiens
ctgaaacatgtgcccctgcca

SEQ ID NO: 125328 - DNA, 22 bp, Homo sapiens
ctgaaacatgtgcccctgccaa

SEQ ID NO: 125329 - DNA, 15 bp, Homo sapiens
ctgaaacgagaagtg

SEQ ID NO: 125330 - DNA, 12 bp, Homo sapiens
ctgaactgtttg

SEQ ID NO: 125331 - DNA, 14 bp, Homo sapiens
ctgaactgtttggt

SEQ ID NO: 125332 - DNA, 23 bp, Homo sapiens
ctgaagattcagtttaagagttt

SEQ ID NO: 125333 - DNA, 15 bp, Homo sapiens
ctgaagcctgcaggt

SEQ ID NO: 125334 - DNA, 11 bp, Homo sapiens
ctgaagctggg

SEQ ID NO: 125335 - DNA, 14 bp, Homo sapiens
ctgaagctggggct

SEQ ID NO: 125336 - DNA, 18 bp, Homo sapiens
ctgaaggcagcatgtata

SEQ ID NO: 125337 - DNA, 14 bp, Homo sapiens
ctgacagcctccca

SEQ ID NO: 125338 - DNA, 20 bp, Homo sapiens
ctgacagcctcccaccccca

SEQ ID NO: 125339 - DNA, 15 bp, Homo sapiens
ctgacggtttctccc

SEQ ID NO: 125340 - DNA, 16 bp, Homo sapiens
ctgagaagtgtatata

SEQ ID NO: 125341 - DNA, 11 bp, Homo sapiens
ctgagccccag

SEQ ID NO: 125342 - DNA, 15 bp, Homo sapiens
ctgagccccagcccc

SEQ ID NO: 125343 - DNA, 14 bp, Homo sapiens
ctgagcctgcccag

SEQ ID NO: 125344 - DNA, 14 bp, Homo sapiens
ctgagctgggccca

SEQ ID NO: 125345 - DNA, 15 bp, Homo sapiens
ctgaggttttgaata

SEQ ID NO: 125346 - DNA, 21 bp, Homo sapiens
gcccagtgacaaagactcctc

SEQ ID NO: 125347 - DNA, 24 bp, Homo sapiens
gcccagtgacaaagactcctctgg

SEQ ID NO: 125348 - DNA, 17 bp, Homo sapiens
gccccaatccagagaag

SEQ ID NO: 125349 - DNA, 15 bp, Homo sapiens
gccccacccacccca

SEQ ID NO: 125350 - DNA, 16 bp, Homo sapiens
gccccacccagaggtg

SEQ ID NO: 125351 - DNA, 13 bp, Homo sapiens
gccccagccccaa

SEQ ID NO: 125352 - DNA, 20 bp, Homo sapiens
gccccagggggcggggtgca

SEQ ID NO: 125353 - DNA, 18 bp, Homo sapiens
gcccccacagccctggaa

SEQ ID NO: 125354 - DNA, 12 bp, Homo sapiens
gcccccaggcca

SEQ ID NO: 125355 - DNA, 11 bp, Homo sapiens
gccccctgaaa

SEQ ID NO: 125356 - DNA, 12 bp, Homo sapiens
gccccctgaaac

SEQ ID NO: 125357 - DNA, 23 bp, Homo sapiens
gccccctgaaacatgtgcccctg

SEQ ID NO: 125358 - DNA, 19 bp, Homo sapiens
gccccgccccctccctgct

SEQ ID NO: 125359 - DNA, 22 bp, Homo sapiens
gccccgccccctccctgctccc

SEQ ID NO: 125360 - DNA, 16 bp, Homo sapiens
gccccgtcccagaggc

SEQ ID NO: 125361 - DNA, 17 bp, Homo sapiens
gcccctccccaaaagaa

SEQ ID NO: 125362 - DNA, 20 bp, Homo sapiens
gcccctccccaaaagaaacc

SEQ ID NO: 125363 - DNA, 14 bp, Homo sapiens
gcccctgccaaggc

SEQ ID NO: 125364 - DNA, 21 bp, Homo sapiens
gcccctggcagcacagcccag

SEQ ID NO: 125365 - DNA, 15 bp, Homo sapiens
gccctcagctccctg

SEQ ID NO: 125366 - DNA, 19 bp, Homo sapiens
gccctcagctccctgaccc

SEQ ID NO: 125367 - DNA, 20 bp, Homo sapiens
gccctcagctccctgacccc

SEQ ID NO: 125368 - DNA, 12 bp, Homo sapiens
gccctcccaggc

SEQ ID NO: 125369 - DNA, 16 bp, Homo sapiens
ccttgggccataatta

SEQ ID NO: 125370 - DNA, 21 bp, Homo sapiens
ccttgggcgcttcccacctgc

SEQ ID NO: 125371 - DNA, 19 bp, Homo sapiens
cctttcacaggactctgca

SEQ ID NO: 125372 - DNA, 20 bp, Homo sapiens
cctttgtattataattgttg

SEQ ID NO: 125373 - DNA, 19 bp, Homo sapiens
cgaaacctgtccataaagt

SEQ ID NO: 125374 - DNA, 20 bp, Homo sapiens
cgaaacctgtccataaagta

SEQ ID NO: 125375 - DNA, 17 bp, Homo sapiens
cgacatcctagccccac

SEQ ID NO: 125376 - DNA, 22 bp, Homo sapiens
cgacttttctaaagctctgaac

SEQ ID NO: 125377 - DNA, 14 bp, Homo sapiens
cgagactgcaatgt

SEQ ID NO: 125378 - DNA, 23 bp, Homo sapiens
cgagcagtcctgcctcagcctcc

SEQ ID NO: 125379 - DNA, 14 bp, Homo sapiens
cgagtctttgtgtg

SEQ ID NO: 125380 - DNA, 12 bp, Homo sapiens
cgagtttgctaa

SEQ ID NO: 125381 - DNA, 22 bp, Homo sapiens
cgatccacctgtctcagcctcc

SEQ ID NO: 125382 - DNA, 17 bp, Homo sapiens
cgatctcttattttaca

SEQ ID NO: 125383 - DNA, 23 bp, Homo sapiens
cgatgaatgtgttgatttgagaa

SEQ ID NO: 125384 - DNA, 19 bp, Homo sapiens
cgatgcccaatccaggccc

SEQ ID NO: 125385 - DNA, 13 bp, Homo sapiens
cgcacttacaagt

SEQ ID NO: 125386 - DNA, 14 bp, Homo sapiens
cgcacttacaagtg

SEQ ID NO: 125387 - DNA, 16 bp, Homo sapiens
cgcagccacaccgctg

SEQ ID NO: 125388 - DNA, 14 bp, Homo sapiens
cgcaggcccagtga

SEQ ID NO: 125389 - DNA, 14 bp, Homo sapiens
cgccccctccctgc

SEQ ID NO: 125390 - DNA, 17 bp, Homo sapiens
cgccccctccctgctcc

SEQ ID NO: 125391 - DNA, 13 bp, Homo sapiens
cgccccctgaaac

SEQ ID NO: 125392 - DNA, 22 bp, Homo sapiens
cgccccctgaaacatgtgcccc

SEQ ID NO: 125393 - DNA, 13 bp, Homo sapiens
cgccctccaccca

SEQ ID NO: 125394 - DNA, 14 bp, Homo sapiens
cgcctcccgccacc

SEQ ID NO: 125395 - DNA, 11 bp, Homo sapiens
cgctgcccctg

SEQ ID NO: 125396 - DNA, 12 bp, Homo sapiens
cgctgcccctga

SEQ ID NO: 125397 - DNA, 13 bp, Homo sapiens
cgctgcccctgag

SEQ ID NO: 125398 - DNA, 23 bp, Homo sapiens
cgctggatggggagtctcatgca

SEQ ID NO: 125399 - DNA, 20 bp, Homo sapiens
cgctgttgatcccctctctg

SEQ ID NO: 125400 - DNA, 17 bp, Homo sapiens
cgcttagttcttgaatt

SEQ ID NO: 125401 - DNA, 18 bp, Homo sapiens
cgcttagttcttgaattg

SEQ ID NO: 125402 - DNA, 22 bp, Homo sapiens
cgctttcatgttactgttgcag

SEQ ID NO: 125403 - DNA, 14 bp, Homo sapiens
cggagacccacagc

SEQ ID NO: 125404 - DNA, 15 bp, Homo sapiens
cggagacccacagcc

SEQ ID NO: 125405 - DNA, 19 bp, Homo sapiens
cggagcaggggtctgagcc

SEQ ID NO: 125406 - DNA, 18 bp, Homo sapiens
cggcaccagtgcctcagt

SEQ ID NO: 125407 - DNA, 23 bp, Homo sapiens
cggcctgtaatcagctctcctgg

SEQ ID NO: 125408 - DNA, 17 bp, Homo sapiens
cggcggggtgcctgctg

SEQ ID NO: 125409 - DNA, 14 bp, Homo sapiens
cggctgtctcctgt

SEQ ID NO: 125410 - DNA, 14 bp, Homo sapiens
cgggactgggggcg

SEQ ID NO: 125411 - DNA, 21 bp, Homo sapiens
cgggactgggggcggggcctg

SEQ ID NO: 125412 - DNA, 14 bp, Homo sapiens
cgggattccctggt

SEQ ID NO: 125413 - DNA, 18 bp, Homo sapiens
cggggccgcagccacacc

SEQ ID NO: 125414 - DNA, 14 bp, Homo sapiens
cggggccgggactg

SEQ ID NO: 125415 - DNA, 15 bp, Homo sapiens
cggtcagaacaactt

SEQ ID NO: 125416 - DNA, 15 bp, Homo sapiens
cggtggctgcacaga

SEQ ID NO: 125417 - DNA, 23 bp, Homo sapiens
cggttttcagctattagcaactg

SEQ ID NO: 125418 - DNA, 13 bp, Homo sapiens
cgtagtctcctgg

SEQ ID NO: 125419 - DNA, 17 bp, Homo sapiens
cgtcagaagcacccagg

SEQ ID NO: 125420 - DNA, 12 bp, Homo sapiens
cgtcccagaggc

SEQ ID NO: 125421 - DNA, 14 bp, Homo sapiens
cgtgaatgtctcag

SEQ ID NO: 125422 - DNA, 13 bp, Homo sapiens
cgtgatcttggct

SEQ ID NO: 125423 - DNA, 22 bp, Homo sapiens
ctaaaaattttgcatttcatgc

SEQ ID NO: 125424 - DNA, 13 bp, Homo sapiens
ctaaaagaagaga

SEQ ID NO: 125425 - DNA, 23 bp, Homo sapiens
ctaaaagtgcatttaaggagatt

SEQ ID NO: 125426 - DNA, 21 bp, Homo sapiens
ctaaagctctgaacaaaagct

SEQ ID NO: 125427 - DNA, 22 bp, Homo sapiens
ctaaagctctgaacaaaagctt

SEQ ID NO: 125428 - DNA, 18 bp, Homo sapiens
ctaatgaaagtgatgaca

SEQ ID NO: 125429 - DNA, 20 bp, Homo sapiens
ctaatgaaagtgatgacata

SEQ ID NO: 125430 - DNA, 22 bp, Homo sapiens
ctaatgttatttcttaaaattc

SEQ ID NO: 125431 - DNA, 18 bp, Homo sapiens
ctacacatatatgtatat

SEQ ID NO: 125432 - DNA, 16 bp, Homo sapiens
ctacagtaatgaaatg

SEQ ID NO: 125433 - DNA, 22 bp, Homo sapiens
ctacagtaatgaaatgtttact

SEQ ID NO: 125434 - DNA, 16 bp, Homo sapiens
ctaccccacctgacct

SEQ ID NO: 125435 - DNA, 13 bp, Homo sapiens
ctaccctgcagct

SEQ ID NO: 125436 - DNA, 17 bp, Homo sapiens
ctacttatcatttttgt

SEQ ID NO: 125437 - DNA, 24 bp, Homo sapiens
ctacttatcatttttgtataaaaa

SEQ ID NO: 125438 - DNA, 10 bp, Homo sapiens
ctagagactc

SEQ ID NO: 125439 - DNA, 15 bp, Homo sapiens
ctagaggacactagg

SEQ ID NO: 125440 - DNA, 22 bp, Homo sapiens
ctagatatgaatatatggcatt

SEQ ID NO: 125441 - DNA, 18 bp, Homo sapiens
ctagcccttctaccccac

SEQ ID NO: 125442 - DNA, 15 bp, Homo sapiens
ctagctgttcttttt

SEQ ID NO: 125443 - DNA, 17 bp, Homo sapiens
ctaggtgaacagcagga

SEQ ID NO: 125444 - DNA, 19 bp, Homo sapiens
ctataataagttttgatat

SEQ ID NO: 125445 - DNA, 22 bp, Homo sapiens
ctataataagttttgatataat

SEQ ID NO: 125446 - DNA, 17 bp, Homo sapiens
ctatatctgtttgtata

SEQ ID NO: 125447 - DNA, 15 bp, Homo sapiens
ctatcaatatttaag

SEQ ID NO: 125448 - DNA, 15 bp, Homo sapiens
ctatctaatgacatg

SEQ ID NO: 125449 - DNA, 13 bp, Homo sapiens
ctatggcccagcc

SEQ ID NO: 125450 - DNA, 15 bp, Homo sapiens
ctatggcccagccac

SEQ ID NO: 125451 - DNA, 17 bp, Homo sapiens
ctatggcccagccactg

SEQ ID NO: 125452 - DNA, 17 bp, Homo sapiens
ctatgtattttcctaat

SEQ ID NO: 125453 - DNA, 23 bp, Homo sapiens
ctattaagatttccaagtgccaa

SEQ ID NO: 125454 - DNA, 22 bp, Homo sapiens
cccctgaaacatgtgcccctgc

SEQ ID NO: 125455 - DNA, 14 bp, Homo sapiens
cccctgccaaggcc

SEQ ID NO: 125456 - DNA, 21 bp, Homo sapiens
cccctggcagcacagcccagg

SEQ ID NO: 125457 - DNA, 17 bp, Homo sapiens
cccgccaccctgtctca

SEQ ID NO: 125458 - DNA, 11 bp, Homo sapiens
cccgccctcca

SEQ ID NO: 125459 - DNA, 19 bp, Homo sapiens
cccgcttagttcttgaatt

SEQ ID NO: 125460 - DNA, 14 bp, Homo sapiens
cccgtcccagaggc

SEQ ID NO: 125461 - DNA, 15 bp, Homo sapiens
cccgtcccagaggcc

SEQ ID NO: 125462 - DNA, 13 bp, Homo sapiens
cccgttgggtccc

SEQ ID NO: 125463 - DNA, 20 bp, Homo sapiens
cccgttgggtcccttgctgc

SEQ ID NO: 125464 - DNA, 18 bp, Homo sapiens
ccctcagacatttatata

SEQ ID NO: 125465 - DNA, 18 bp, Homo sapiens
ccctccccgccccctgaa

SEQ ID NO: 125466 - DNA, 14 bp, Homo sapiens
ccctcctggcacaa

SEQ ID NO: 125467 - DNA, 13 bp, Homo sapiens
ccctctcccaccc

SEQ ID NO: 125468 - DNA, 15 bp, Homo sapiens
ccctctcccacccaa

SEQ ID NO: 125469 - DNA, 17 bp, Homo sapiens
ccctctcccacccaagg

SEQ ID NO: 125470 - DNA, 23 bp, Homo sapiens
ccctctcccacccaaggagaacg

SEQ ID NO: 125471 - DNA, 17 bp, Homo sapiens
cttctaccccacctgac

SEQ ID NO: 125472 - DNA, 14 bp, Homo sapiens
cttctgagccccag

SEQ ID NO: 125473 - DNA, 19 bp, Homo sapiens
cttctgagccccagcccca

SEQ ID NO: 125474 - DNA, 13 bp, Homo sapiens
cttctgttaagaa

SEQ ID NO: 125475 - DNA, 16 bp, Homo sapiens
cttctgttaagaaagg

SEQ ID NO: 125476 - DNA, 18 bp, Homo sapiens
cttctgttaagaaaggat

SEQ ID NO: 125477 - DNA, 15 bp, Homo sapiens
cttcttaaaaactgt

SEQ ID NO: 125478 - DNA, 20 bp, Homo sapiens
cttcttaaaaactgtgtatc

SEQ ID NO: 125479 - DNA, 15 bp, Homo sapiens
cttcttttctttgta

SEQ ID NO: 125480 - DNA, 16 bp, Homo sapiens
cttcttttctttgtat

SEQ ID NO: 125481 - DNA, 15 bp, Homo sapiens
cttgaactttccaaa

SEQ ID NO: 125482 - DNA, 16 bp, Homo sapiens
cttgaactttccaaaa

SEQ ID NO: 125483 - DNA, 21 bp, Homo sapiens
cttgctgcaaacccatgaagc

SEQ ID NO: 125484 - DNA, 14 bp, Homo sapiens
cttggagtgcccca

SEQ ID NO: 125485 - DNA, 15 bp, Homo sapiens
cttggatcagaggtc

SEQ ID NO: 125486 - DNA, 16 bp, Homo sapiens
cttggatcagaggtca

SEQ ID NO: 125487 - DNA, 19 bp, Homo sapiens
cttggcttcttaaaaactg

SEQ ID NO: 125488 - DNA, 22 bp, Homo sapiens
cttgggagaactaagtaagaaa

SEQ ID NO: 125489 - DNA, 14 bp, Homo sapiens
cttgggagggggca

SEQ ID NO: 125490 - DNA, 19 bp, Homo sapiens
cttgtcatatcactaaata

SEQ ID NO: 125491 - DNA, 18 bp, Homo sapiens
cttgttccaatgccacat

SEQ ID NO: 125492 - DNA, 21 bp, Homo sapiens
cttgttccccactgacagcct

SEQ ID NO: 125493 - DNA, 14 bp, Homo sapiens
cttgttccctctcc

SEQ ID NO: 125494 - DNA, 15 bp, Homo sapiens
ctttaaaaggcaact

SEQ ID NO: 125495 - DNA, 21 bp, Homo sapiens
ctttaaaaggcaactcaaaga

SEQ ID NO: 125496 - DNA, 22 bp, Homo sapiens
ctttaatcacttaacattccta

SEQ ID NO: 125497 - DNA, 17 bp, Homo sapiens
ctttcagatgcagtttt

SEQ ID NO: 125498 - DNA, 21 bp, Homo sapiens
ctttcttaatatttttacatg

SEQ ID NO: 125499 - DNA, 23 bp, Homo sapiens
ctttgagaagaatgtttaataga

SEQ ID NO: 125500 - DNA, 17 bp, Homo sapiens
ctttgagactgggtctc

SEQ ID NO: 125501 - DNA, 20 bp, Homo sapiens
ctttgtagactgtttcacat

SEQ ID NO: 125502 - DNA, 14 bp, Homo sapiens
ctttgtattataat

SEQ ID NO: 125503 - DNA, 20 bp, Homo sapiens
ctttgtgtgttatattccaa

SEQ ID NO: 125504 - DNA, 13 bp, Homo sapiens
cttttaaaaaata

SEQ ID NO: 125505 - DNA, 23 bp, Homo sapiens
cttttaaaaaatattttaagaaa

SEQ ID NO: 125506 - DNA, 12 bp, Homo sapiens
cttttaaagtat

SEQ ID NO: 125507 - DNA, 13 bp, Homo sapiens
cttttaaagtatt

SEQ ID NO: 125508 - DNA, 21 bp, Homo sapiens
cttttacagaatgcattaaaa

SEQ ID NO: 125509 - DNA, 22 bp, Homo sapiens
cttttacagaatgcattaaaaa

SEQ ID NO: 125510 - DNA, 15 bp, Homo sapiens
cttttatttaacaaa

SEQ ID NO: 125511 - DNA, 22 bp, Homo sapiens
cttttatttaacaaaaaatgta

SEQ ID NO: 125512 - DNA, 14 bp, Homo sapiens
cttttgaaaatcaa

SEQ ID NO: 125513 - DNA, 14 bp, Homo sapiens
cttttgtaatttga

SEQ ID NO: 125514 - DNA, 18 bp, Homo sapiens
cttttgtaatttgaattg

SEQ ID NO: 125515 - DNA, 16 bp, Homo sapiens
cttttgtcctgttatt

SEQ ID NO: 125516 - DNA, 12 bp, Homo sapiens
ctttttaaaaaa

SEQ ID NO: 125517 - DNA, 23 bp, Homo sapiens
ctttttttggtaaatttttgaaa

SEQ ID NO: 125518 - DNA, 15 bp, Homo sapiens
cttttttttttccaa

SEQ ID NO: 125519 - DNA, 17 bp, Homo sapiens
cttttttttttccaaat

SEQ ID NO: 125520 - DNA, 20 bp, Homo sapiens
cttttttttttccaaattat

SEQ ID NO: 125521 - DNA, 20 bp, Homo sapiens
gaaaaaactttgctccaggc

SEQ ID NO: 125522 - DNA, 14 bp, Homo sapiens
gaaaaacaaaacaa

SEQ ID NO: 125523 - DNA, 14 bp, Homo sapiens
gaaaaagagactct

SEQ ID NO: 125524 - DNA, 19 bp, Homo sapiens
gaaaaatagagcaaaatca

SEQ ID NO: 125525 - DNA, 22 bp, Homo sapiens
gaaaaatattgctaaaagtgca

SEQ ID NO: 125526 - DNA, 14 bp, Homo sapiens
gaaaacccccagca

SEQ ID NO: 125527 - DNA, 18 bp, Homo sapiens
gaaaaggcaaaagactgg

SEQ ID NO: 125528 - DNA, 14 bp, Homo sapiens
gaaaagtaatgaag

SEQ ID NO: 125529 - DNA, 22 bp, Homo sapiens
gaaaataccataggaagacata

SEQ ID NO: 125530 - DNA, 14 bp, Homo sapiens
gaaaattaaaataa

SEQ ID NO: 125531 - DNA, 18 bp, Homo sapiens
gaaaattgaaagtattca

SEQ ID NO: 125532 - DNA, 16 bp, Homo sapiens
gaaacagagaaagaaa

SEQ ID NO: 125533 - DNA, 17 bp, Homo sapiens
gaaacagagaaagaaaa

SEQ ID NO: 125534 - DNA, 18 bp, Homo sapiens
gaaacagagaaagaaaag

SEQ ID NO: 125535 - DNA, 16 bp, Homo sapiens
gaaacagtattttctt

SEQ ID NO: 125536 - DNA, 19 bp, Homo sapiens
gaaacatgtgcccctgcca

SEQ ID NO: 125537 - DNA, 12 bp, Homo sapiens
gaaaccatgaca

SEQ ID NO: 125538 - DNA, 18 bp, Homo sapiens
gaaacctgtccataaagt

SEQ ID NO: 125539 - DNA, 15 bp, Homo sapiens
gaaacgcacttacaa

SEQ ID NO: 125540 - DNA, 17 bp, Homo sapiens
gaaacgcacttacaagt

SEQ ID NO: 125541 - DNA, 17 bp, Homo sapiens
gaaactaaacagaaaac

SEQ ID NO: 125542 - DNA, 22 bp, Homo sapiens
gaaagaaaaggcaaaagactgg

SEQ ID NO: 125543 - DNA, 15 bp, Homo sapiens
gaaagaatagaaaga

SEQ ID NO: 125544 - DNA, 18 bp, Homo sapiens
gaaagagaatgaactgtg

SEQ ID NO: 125545 - DNA, 14 bp, Homo sapiens
gaaagtaagtcttt

SEQ ID NO: 125546 - DNA, 15 bp, Homo sapiens
gaaagtaagtctttt

SEQ ID NO: 125547 - DNA, 23 bp, Homo sapiens
gaaagtattcagaaattaaaata

SEQ ID NO: 125548 - DNA, 21 bp, Homo sapiens
gaaagtctatctaatgacatg

SEQ ID NO: 125549 - DNA, 15 bp, Homo sapiens
gaaatcagcatgaca

SEQ ID NO: 125550 - DNA, 20 bp, Homo sapiens
gaaattcaacctgtgtctta

SEQ ID NO: 125551 - DNA, 18 bp, Homo sapiens
gaaattttactgacagaa

SEQ ID NO: 125552 - DNA, 19 bp, Homo sapiens
gaaattttactgacagaaa

SEQ ID NO: 125553 - DNA, 13 bp, Homo sapiens
gaacaacttgcta

SEQ ID NO: 125554 - DNA, 19 bp, Homo sapiens
gaacaataaagtttgcttt

SEQ ID NO: 125555 - DNA, 22 bp, Homo sapiens
gaaccgacttttctaaagctct

SEQ ID NO: 125556 - DNA, 14 bp, Homo sapiens
gaactgtggaattt

SEQ ID NO: 125557 - DNA, 22 bp, Homo sapiens
cctcttcacccaccccatggag

SEQ ID NO: 125558 - DNA, 19 bp, Homo sapiens
cctgaaacatgtgcccctg

SEQ ID NO: 125559 - DNA, 21 bp, Homo sapiens
cctgaaacatgtgcccctgcc

SEQ ID NO: 125560 - DNA, 23 bp, Homo sapiens
cctgaaacatgtgcccctgccaa

SEQ ID NO: 125561 - DNA, 13 bp, Homo sapiens
cctgacctctgca

SEQ ID NO: 125562 - DNA, 14 bp, Homo sapiens
cctgacctctgcaa

SEQ ID NO: 125563 - DNA, 15 bp, Homo sapiens
cctgacctctgcaag

SEQ ID NO: 125564 - DNA, 12 bp, Homo sapiens
cctgagttctga

SEQ ID NO: 125565 - DNA, 20 bp, Homo sapiens
cctgcaggtccggggaggag

SEQ ID NO: 125566 - DNA, 21 bp, Homo sapiens
cctgcaggtccggggaggagg

SEQ ID NO: 125567 - DNA, 20 bp, Homo sapiens
cctgcatgggggcaccgggc

SEQ ID NO: 125568 - DNA, 22 bp, Homo sapiens
cctgcccctccccaaaagaaac

SEQ ID NO: 125569 - DNA, 14 bp, Homo sapiens
cctgcctcagcctc

SEQ ID NO: 125570 - DNA, 23 bp, Homo sapiens
cctgcctcccgcctcccgccacc

SEQ ID NO: 125571 - DNA, 14 bp, Homo sapiens
cctgcctcctgcct

SEQ ID NO: 125572 - DNA, 12 bp, Homo sapiens
ctatgtaaacaa

SEQ ID NO: 125573 - DNA, 18 bp, Homo sapiens
ctatgtattttcctaatg

SEQ ID NO: 125574 - DNA, 17 bp, Homo sapiens
ctattaagatttccaag

SEQ ID NO: 125575 - DNA, 16 bp, Homo sapiens
ctattacttgaacttt

SEQ ID NO: 125576 - DNA, 16 bp, Homo sapiens
ctattgggccctagag

SEQ ID NO: 125577 - DNA, 19 bp, Homo sapiens
ctcaatagttcttaaaatt

SEQ ID NO: 125578 - DNA, 21 bp, Homo sapiens
ctcacagtgttgcccaggctg

SEQ ID NO: 125579 - DNA, 21 bp, Homo sapiens
ctcaccccatcccacaccctg

SEQ ID NO: 125580 - DNA, 15 bp, Homo sapiens
ctcactgttgaattt

SEQ ID NO: 125581 - DNA, 14 bp, Homo sapiens
ctcagacatttata

SEQ ID NO: 125582 - DNA, 11 bp, Homo sapiens
ctcaggaaaga

SEQ ID NO: 125583 - DNA, 15 bp, Homo sapiens
ctcagtacctcccct

SEQ ID NO: 125584 - DNA, 21 bp, Homo sapiens
ctcagtcctttgttataattt

SEQ ID NO: 125585 - DNA, 19 bp, Homo sapiens
ctcagtggtcaccttcctc

SEQ ID NO: 125586 - DNA, 17 bp, Homo sapiens
ctcatagccctcagaca

SEQ ID NO: 125587 - DNA, 14 bp, Homo sapiens
ctcatgatcaagat

SEQ ID NO: 125588 - DNA, 18 bp, Homo sapiens
ctccactgtttcatgagc

SEQ ID NO: 125589 - DNA, 21 bp, Homo sapiens
ctccactgtttcatgagccca

SEQ ID NO: 125590 - DNA, 22 bp, Homo sapiens
ctccactgtttcatgagcccaa

SEQ ID NO: 125591 - DNA, 22 bp, Homo sapiens
ctccagtgttccccccatagag

SEQ ID NO: 125592 - DNA, 14 bp, Homo sapiens
ctccatttaagaca

SEQ ID NO: 125593 - DNA, 20 bp, Homo sapiens
ctccatttaagacacattga

SEQ ID NO: 125594 - DNA, 15 bp, Homo sapiens
ctcccacccccatct

SEQ ID NO: 125595 - DNA, 19 bp, Homo sapiens
ctcccacccccatctctcc

SEQ ID NO: 125596 - DNA, 18 bp, Homo sapiens
ctcccagctctctctcct

SEQ ID NO: 125597 - DNA, 19 bp, Homo sapiens
ctcccagctctctctcctg

SEQ ID NO: 125598 - DNA, 20 bp, Homo sapiens
ctcccagctctctctcctgg

SEQ ID NO: 125599 - DNA, 16 bp, Homo sapiens
ctccccgccccctgaa

SEQ ID NO: 125600 - DNA, 19 bp, Homo sapiens
ctccccgccccctgaaaca

SEQ ID NO: 125601 - DNA, 14 bp, Homo sapiens
ctcccctattttaa

SEQ ID NO: 125602 - DNA, 19 bp, Homo sapiens
ctcccctattttaagacgt

SEQ ID NO: 125603 - DNA, 14 bp, Homo sapiens
ctcccctgccattt

SEQ ID NO: 125604 - DNA, 20 bp, Homo sapiens
ctccctagcccttctacccc

SEQ ID NO: 125605 - DNA, 23 bp, Homo sapiens
ctccctagcccttctaccccacc

SEQ ID NO: 125606 - DNA, 22 bp, Homo sapiens
ctccctcccgtagtctcctggg

SEQ ID NO: 125607 - DNA, 14 bp, Homo sapiens
ctccctgaccccct

SEQ ID NO: 125608 - DNA, 17 bp, Homo sapiens
ctccctgaccccctgtc

SEQ ID NO: 125609 - DNA, 16 bp, Homo sapiens
ctccctgctcccagct

SEQ ID NO: 125610 - DNA, 23 bp, Homo sapiens
ctccgctggatggggagtctcat

SEQ ID NO: 125611 - DNA, 12 bp, Homo sapiens
ctccggcctgta

SEQ ID NO: 125612 - DNA, 23 bp, Homo sapiens
ctcctcagcccccaggccaggtg

SEQ ID NO: 125613 - DNA, 15 bp, Homo sapiens
ctcctctgggcctgg

SEQ ID NO: 125614 - DNA, 20 bp, Homo sapiens
ctcctctgggcctggggtgc

SEQ ID NO: 125615 - DNA, 17 bp, Homo sapiens
ctcctggagtctgaagc

SEQ ID NO: 125616 - DNA, 16 bp, Homo sapiens
ctcctggctccctccc

SEQ ID NO: 125617 - DNA, 11 bp, Homo sapiens
ctcctgtgtcg

SEQ ID NO: 125618 - DNA, 17 bp, Homo sapiens
ctcctgtgtggaagaag

SEQ ID NO: 125619 - DNA, 13 bp, Homo sapiens
ctccttctccctt

SEQ ID NO: 125620 - DNA, 14 bp, Homo sapiens
ctcctttctgccca

SEQ ID NO: 125621 - DNA, 16 bp, Homo sapiens
ctcgacgtcccttgga

SEQ ID NO: 125622 - DNA, 17 bp, Homo sapiens
ctcgcccacaaactgat

SEQ ID NO: 125623 - DNA, 18 bp, Homo sapiens
ctcggcaccagtgcctca

SEQ ID NO: 125624 - DNA, 19 bp, Homo sapiens
ctcggcaccagtgcctcag

SEQ ID NO: 125625 - DNA, 13 bp, Homo sapiens
ctcggctgtctcc

SEQ ID NO: 125626 - DNA, 17 bp, Homo sapiens
ctcggctgtctcctgtc

SEQ ID NO: 125627 - DNA, 19 bp, Homo sapiens
ctctaattagagaactgga

SEQ ID NO: 125628 - DNA, 14 bp, Homo sapiens
ctctaccctgcagc

SEQ ID NO: 125629 - DNA, 15 bp, Homo sapiens
ctctaccctgcagct

SEQ ID NO: 125630 - DNA, 21 bp, Homo sapiens
ctctagctgttcttttttgta

SEQ ID NO: 125631 - DNA, 18 bp, Homo sapiens
ctctattaagatttccaa

SEQ ID NO: 125632 - DNA, 15 bp, Homo sapiens
ctctcccacccaagg

SEQ ID NO: 125633 - DNA, 14 bp, Homo sapiens
ctctctcctggagt

SEQ ID NO: 125634 - DNA, 14 bp, Homo sapiens
ctctctctcctgga

SEQ ID NO: 125635 - DNA, 12 bp, Homo sapiens
ctctcttttaaa

SEQ ID NO: 125636 - DNA, 23 bp, Homo sapiens
ctctgatagctgtttcaaatgtg

SEQ ID NO: 125637 - DNA, 18 bp, Homo sapiens
ctctgctgagctgggccc

SEQ ID NO: 125638 - DNA, 19 bp, Homo sapiens
ctctggaggcctctggccc

SEQ ID NO: 125639 - DNA, 21 bp, Homo sapiens
ctctggaggcctctggccctc

SEQ ID NO: 125640 - DNA, 13 bp, Homo sapiens
ctctggcccttgg

SEQ ID NO: 125641 - DNA, 15 bp, Homo sapiens
ctctggcccttggaa

SEQ ID NO: 125642 - DNA, 17 bp, Homo sapiens
ctctggcccttggaata

SEQ ID NO: 125643 - DNA, 18 bp, Homo sapiens
ctgaaacatgtgcccctg

SEQ ID NO: 125644 - DNA, 20 bp, Homo sapiens
ctgaaacgagaagtgccctt

SEQ ID NO: 125645 - DNA, 11 bp, Homo sapiens
ctgaactgttt

SEQ ID NO: 125646 - DNA, 16 bp, Homo sapiens
ctgaagctggggcttg

SEQ ID NO: 125647 - DNA, 20 bp, Homo sapiens
ctgaagctggggcttgggga

SEQ ID NO: 125648 - DNA, 13 bp, Homo sapiens
ctgaaggtttttt

SEQ ID NO: 125649 - DNA, 12 bp, Homo sapiens
ctgacactgtgt

SEQ ID NO: 125650 - DNA, 22 bp, Homo sapiens
ctgagaaatgaatgctgagacc

SEQ ID NO: 125651 - DNA, 18 bp, Homo sapiens
ctgagccacagccgtgct

SEQ ID NO: 125652 - DNA, 13 bp, Homo sapiens
ctgagccccagcc

SEQ ID NO: 125653 - DNA, 13 bp, Homo sapiens
ctgagctgggccc

SEQ ID NO: 125654 - DNA, 15 bp, Homo sapiens
ctgagctgggcccag

SEQ ID NO: 125655 - DNA, 20 bp, Homo sapiens
ctgagctgggcccagcccct

SEQ ID NO: 125656 - DNA, 13 bp, Homo sapiens
ctgaggttttgaa

SEQ ID NO: 125657 - DNA, 16 bp, Homo sapiens
ctgaggttttgaataa

SEQ ID NO: 125658 - DNA, 18 bp, Homo sapiens
ctgaggttttgaataaaa

SEQ ID NO: 125659 - DNA, 14 bp, Homo sapiens
ctgagttctgacac

SEQ ID NO: 125660 - DNA, 18 bp, Homo sapiens
ctgagttctgacactgtg

SEQ ID NO: 125661 - DNA, 21 bp, Homo sapiens
ctgatagctgtttcaaatgtg

SEQ ID NO: 125662 - DNA, 22 bp, Homo sapiens
ctgatagctgtttcaaatgtgc

SEQ ID NO: 125663 - DNA, 18 bp, Homo sapiens
ctgatgcccaccgaggag

SEQ ID NO: 125664 - DNA, 20 bp, Homo sapiens
ctgattccctctcccaccca

SEQ ID NO: 125665 - DNA, 20 bp, Homo sapiens
ctgcaagaattaaaactgag

SEQ ID NO: 125666 - DNA, 21 bp, Homo sapiens
ctgcaagaattaaaactgagt

SEQ ID NO: 125667 - DNA, 18 bp, Homo sapiens
ctgcaatgtgatctatgt

SEQ ID NO: 125668 - DNA, 12 bp, Homo sapiens
ctgcacagaagg

SEQ ID NO: 125669 - DNA, 18 bp, Homo sapiens
ctgcagatagtgcctctg

SEQ ID NO: 125670 - DNA, 19 bp, Homo sapiens
ctgcagatagtgcctctgc

SEQ ID NO: 125671 - DNA, 20 bp, Homo sapiens
ctgcagatagtgcctctgca

SEQ ID NO: 125672 - DNA, 18 bp, Homo sapiens
ctgcagcctttgcctccc

SEQ ID NO: 125673 - DNA, 12 bp, Homo sapiens
gaaattaaaata

SEQ ID NO: 125674 - DNA, 22 bp, Homo sapiens
gaaattaaaatattatttgata

SEQ ID NO: 125675 - DNA, 14 bp, Homo sapiens
gaaattagtctttt

SEQ ID NO: 125676 - DNA, 18 bp, Homo sapiens
gaactccgctggatgggg

SEQ ID NO: 125677 - DNA, 15 bp, Homo sapiens
gaacttttacagaat

SEQ ID NO: 125678 - DNA, 20 bp, Homo sapiens
gaacttttacagaatgcatt

SEQ ID NO: 125679 - DNA, 18 bp, Homo sapiens
gaagaatttaatggactg

SEQ ID NO: 125680 - DNA, 19 bp, Homo sapiens
gaagaatttaatggactgt

SEQ ID NO: 125681 - DNA, 22 bp, Homo sapiens
gaagaatttaatggactgtgaa

SEQ ID NO: 125682 - DNA, 23 bp, Homo sapiens
gaagaatttaatggactgtgaat

SEQ ID NO: 125683 - DNA, 16 bp, Homo sapiens
gaagagaggggaagaa

SEQ ID NO: 125684 - DNA, 14 bp, Homo sapiens
gaagcacacctaca

SEQ ID NO: 125685 - DNA, 16 bp, Homo sapiens
gaagctgctgaggccc

SEQ ID NO: 125686 - DNA, 12 bp, Homo sapiens
gaagctggccct

SEQ ID NO: 125687 - DNA, 14 bp, Homo sapiens
gaaggcccaggggt

SEQ ID NO: 125688 - DNA, 16 bp, Homo sapiens
gaaggtgggtgaggct

SEQ ID NO: 125689 - DNA, 18 bp, Homo sapiens
gaagtcgagcactctaat

SEQ ID NO: 125690 - DNA, 13 bp, Homo sapiens
gaagtgtatatag

SEQ ID NO: 125691 - DNA, 13 bp, Homo sapiens
gaataaaaagtga

SEQ ID NO: 125692 - DNA, 22 bp, Homo sapiens
gaatacaatatatagctggcaa

SEQ ID NO: 125693 - DNA, 12 bp, Homo sapiens
gaatataagaaa

SEQ ID NO: 125694 - DNA, 13 bp, Homo sapiens
gaatataagaaaa

SEQ ID NO: 125695 - DNA, 12 bp, Homo sapiens
gaatgaactgtg

SEQ ID NO: 125696 - DNA, 15 bp, Homo sapiens
gaatgaactgtggaa

SEQ ID NO: 125697 - DNA, 16 bp, Homo sapiens
gaatgggttctcagtg

SEQ ID NO: 125698 - DNA, 11 bp, Homo sapiens
gaatgtctcag

SEQ ID NO: 125699 - DNA, 13 bp, Homo sapiens
gaattaaaactga

SEQ ID NO: 125700 - DNA, 14 bp, Homo sapiens
gaattaaaactgag

SEQ ID NO: 125701 - DNA, 19 bp, Homo sapiens
gaatttaatggactgtgaa

SEQ ID NO: 125702 - DNA, 19 bp, Homo sapiens
gacaaaaataacactgttg

SEQ ID NO: 125703 - DNA, 18 bp, Homo sapiens
gacaaacctagcttttaa

SEQ ID NO: 125704 - DNA, 19 bp, Homo sapiens
gacaaacctagcttttaaa

SEQ ID NO: 125705 - DNA, 20 bp, Homo sapiens
gacaaacctagcttttaaaa

SEQ ID NO: 125706 - DNA, 21 bp, Homo sapiens
gacaaagactcctctgggcct

SEQ ID NO: 125707 - DNA, 23 bp, Homo sapiens
gacacatgctgaggttttgaata

SEQ ID NO: 125708 - DNA, 23 bp, Homo sapiens
gacaccgggaagtgcagcgggcc

SEQ ID NO: 125709 - DNA, 23 bp, Homo sapiens
gacagatttgaggactgaagctg

SEQ ID NO: 125710 - DNA, 16 bp, Homo sapiens
gacagcctcccacccc

SEQ ID NO: 125711 - DNA, 16 bp, Homo sapiens
gacaggagcagcccac

SEQ ID NO: 125712 - DNA, 13 bp, Homo sapiens
gacataaaacttt

SEQ ID NO: 125713 - DNA, 21 bp, Homo sapiens
gacataaaactttaaaaggca

SEQ ID NO: 125714 - DNA, 22 bp, Homo sapiens
gacataaaactttaaaaggcaa

SEQ ID NO: 125715 - DNA, 20 bp, Homo sapiens
gacatcctagccccacccag

SEQ ID NO: 125716 - DNA, 14 bp, Homo sapiens
gacatttatatatt

SEQ ID NO: 125717 - DNA, 19 bp, Homo sapiens
gaccaatcctgtttttcct

SEQ ID NO: 125718 - DNA, 18 bp, Homo sapiens
gaccaggagggagagcct

SEQ ID NO: 125719 - DNA, 22 bp, Homo sapiens
gaccaggagggagagcctctgt

SEQ ID NO: 125720 - DNA, 15 bp, Homo sapiens
gacccacagccctga

SEQ ID NO: 125721 - DNA, 16 bp, Homo sapiens
gacccacagccctgaa

SEQ ID NO: 125722 - DNA, 17 bp, Homo sapiens
gacccacagccctgaaa

SEQ ID NO: 125723 - DNA, 19 bp, Homo sapiens
gaccctgagtccgggaggc

SEQ ID NO: 125724 - DNA, 15 bp, Homo sapiens
gaccttctccctagc

SEQ ID NO: 125725 - DNA, 14 bp, Homo sapiens
gacgtcccttggat

SEQ ID NO: 125726 - DNA, 19 bp, Homo sapiens
gactcagaggacccacctg

SEQ ID NO: 125727 - DNA, 14 bp, Homo sapiens
gactccggcctgta

SEQ ID NO: 125728 - DNA, 18 bp, Homo sapiens
gactccggcctgtaatca

SEQ ID NO: 125729 - DNA, 16 bp, Homo sapiens
gactgaagctggggct

SEQ ID NO: 125730 - DNA, 16 bp, Homo sapiens
gactgggcacccctgc

SEQ ID NO: 125731 - DNA, 22 bp, Homo sapiens
gactgggcacccctgcctcctg

SEQ ID NO: 125732 - DNA, 18 bp, Homo sapiens
gactgggggcggggcctg

SEQ ID NO: 125733 - DNA, 23 bp, Homo sapiens
gactgggtctcgctttgttgccc

SEQ ID NO: 125734 - DNA, 18 bp, Homo sapiens
gacttcactgcagccttt

SEQ ID NO: 125735 - DNA, 18 bp, Homo sapiens
gacttgttttatgctcag

SEQ ID NO: 125736 - DNA, 15 bp, Homo sapiens
gagaaagaaaaggca

SEQ ID NO: 125737 - DNA, 16 bp, Homo sapiens
gagaaagaaaaggcaa

SEQ ID NO: 125738 - DNA, 20 bp, Homo sapiens
gagaaatgaatgctgagacc

SEQ ID NO: 125739 - DNA, 20 bp, Homo sapiens
gagaactaagtaagaaacac

SEQ ID NO: 125740 - DNA, 12 bp, Homo sapiens
gagaagtgccct

SEQ ID NO: 125741 - DNA, 13 bp, Homo sapiens
gagaatgaactgt

SEQ ID NO: 125742 - DNA, 22 bp, Homo sapiens
gagacaataaacagctgaacca

SEQ ID NO: 125743 - DNA, 15 bp, Homo sapiens
gagacaggagcagcc

SEQ ID NO: 125744 - DNA, 18 bp, Homo sapiens
gagaccaggagggagagc

SEQ ID NO: 125745 - DNA, 17 bp, Homo sapiens
gagactgggcacccctg

SEQ ID NO: 125746 - DNA, 22 bp, Homo sapiens
gagactgggcacccctgcctcc

SEQ ID NO: 125747 - DNA, 20 bp, Homo sapiens
gagagcctctgttttgtaaa

SEQ ID NO: 125748 - DNA, 14 bp, Homo sapiens
gagaggggaagaat

SEQ ID NO: 125749 - DNA, 16 bp, Homo sapiens
gagaggggaagaattt

SEQ ID NO: 125750 - DNA, 17 bp, Homo sapiens
gagaggggaagaattta

SEQ ID NO: 125751 - DNA, 17 bp, Homo sapiens
gagagtttttaatagaa

SEQ ID NO: 125752 - DNA, 13 bp, Homo sapiens
gagcaaaatcaac

SEQ ID NO: 125753 - DNA, 21 bp, Homo sapiens
gagcacgttggcgaggaaaaa

SEQ ID NO: 125754 - DNA, 21 bp, Homo sapiens
gagcactctaattagagaact

SEQ ID NO: 125755 - DNA, 15 bp, Homo sapiens
gagcagcccacccag

SEQ ID NO: 125756 - DNA, 16 bp, Homo sapiens
gagcaggggtctgagc

SEQ ID NO: 125757 - DNA, 16 bp, Homo sapiens
gagcagtcctgcctca

SEQ ID NO: 125758 - DNA, 20 bp, Homo sapiens
gagcagtcctgcctcagcct

SEQ ID NO: 125759 - DNA, 14 bp, Homo sapiens
gagccccagcccca

SEQ ID NO: 125760 - DNA, 23 bp, Homo sapiens
gagccccagccccgtcccagagg

SEQ ID NO: 125761 - DNA, 11 bp, Homo sapiens
gagcctctgcg

SEQ ID NO: 125762 - DNA, 22 bp, Homo sapiens
gagcctgatggtatactactgc

SEQ ID NO: 125763 - DNA, 16 bp, Homo sapiens
cttcaaatatagagat

SEQ ID NO: 125764 - DNA, 19 bp, Homo sapiens
cttcaaatatagagatatt

SEQ ID NO: 125765 - DNA, 12 bp, Homo sapiens
cttcaacatgac

SEQ ID NO: 125766 - DNA, 12 bp, Homo sapiens
cttcactgcagc

SEQ ID NO: 125767 - DNA, 22 bp, Homo sapiens
cttcactgcagcctttcacagg

SEQ ID NO: 125768 - DNA, 15 bp, Homo sapiens
cttcaggtctctgtg

SEQ ID NO: 125769 - DNA, 17 bp, Homo sapiens
cttcagtcgtctgtccc

SEQ ID NO: 125770 - DNA, 13 bp, Homo sapiens
cttcatgcccact

SEQ ID NO: 125771 - DNA, 16 bp, Homo sapiens
cttccaagctccaaat

SEQ ID NO: 125772 - DNA, 19 bp, Homo sapiens
cttcccaaatcaaaataaa

SEQ ID NO: 125773 - DNA, 14 bp, Homo sapiens
cttcctcagctcag

SEQ ID NO: 125774 - DNA, 15 bp, Homo sapiens
cttcctcagctcagc

SEQ ID NO: 125775 - DNA, 22 bp, Homo sapiens
gccaaggtttcccagtgagcct

SEQ ID NO: 125776 - DNA, 16 bp, Homo sapiens
gccacaccgctggctc

SEQ ID NO: 125777 - DNA, 18 bp, Homo sapiens
gccacaccgctggctccg

SEQ ID NO: 125778 - DNA, 15 bp, Homo sapiens
gccaccacgtccagc

SEQ ID NO: 125779 - DNA, 14 bp, Homo sapiens
gccaccatggccag

SEQ ID NO: 125780 - DNA, 18 bp, Homo sapiens
gccaccatggccagccaa

SEQ ID NO: 125781 - DNA, 12 bp, Homo sapiens
gccaccctgtct

SEQ ID NO: 125782 - DNA, 14 bp, Homo sapiens
gccaccctgtctca

SEQ ID NO: 125783 - DNA, 23 bp, Homo sapiens
gccaccctgtctcagtacctccc

SEQ ID NO: 125784 - DNA, 14 bp, Homo sapiens
gccactgcagcaca

SEQ ID NO: 125785 - DNA, 15 bp, Homo sapiens
gccactggcacttgc

SEQ ID NO: 125786 - DNA, 20 bp, Homo sapiens
gccactggcacttgcctgct

SEQ ID NO: 125787 - DNA, 22 bp, Homo sapiens
gccactggcacttgcctgctgc

SEQ ID NO: 125788 - DNA, 15 bp, Homo sapiens
gccataattatgaaa

SEQ ID NO: 125789 - DNA, 23 bp, Homo sapiens
gccatagtcaaagagagttttta

SEQ ID NO: 125790 - DNA, 22 bp, Homo sapiens
gcccaaacaccctcctggcaca

SEQ ID NO: 125791 - DNA, 16 bp, Homo sapiens
gcccaatccaggcccg

SEQ ID NO: 125792 - DNA, 21 bp, Homo sapiens
gcccaggggtggggcccatgg

SEQ ID NO: 125793 - DNA, 22 bp, Homo sapiens
gcccaggggtggggcccatggg

SEQ ID NO: 125794 - DNA, 16 bp, Homo sapiens
gcccagttggaggaga

SEQ ID NO: 125795 - DNA, 19 bp, Homo sapiens
gcccatggggtctctgcat

SEQ ID NO: 125796 - DNA, 15 bp, Homo sapiens
gccccaatccagaga

SEQ ID NO: 125797 - DNA, 15 bp, Homo sapiens
gccccacccagaggt

SEQ ID NO: 125798 - DNA, 14 bp, Homo sapiens
gccccagccccaat

SEQ ID NO: 125799 - DNA, 12 bp, Homo sapiens
gccccagccccg

SEQ ID NO: 125800 - DNA, 20 bp, Homo sapiens
gccccagccccgtcccagag

SEQ ID NO: 125801 - DNA, 22 bp, Homo sapiens
gccccagccccgtcccagaggc

SEQ ID NO: 125802 - DNA, 13 bp, Homo sapiens
gcccccacagccc

SEQ ID NO: 125803 - DNA, 14 bp, Homo sapiens
gcccccacagccct

SEQ ID NO: 125804 - DNA, 17 bp, Homo sapiens
gcccccacagccctgga

SEQ ID NO: 125805 - DNA, 19 bp, Homo sapiens
gcccccacagccctggaat

SEQ ID NO: 125806 - DNA, 15 bp, Homo sapiens
gcccccaggccaggt

SEQ ID NO: 125807 - DNA, 16 bp, Homo sapiens
gccccctccctgctcc

SEQ ID NO: 125808 - DNA, 18 bp, Homo sapiens
gccccctccctgctccca

SEQ ID NO: 125809 - DNA, 22 bp, Homo sapiens
gccccctgaaacatgtgcccct

SEQ ID NO: 125810 - DNA, 18 bp, Homo sapiens
gccccgccccctccctgc

SEQ ID NO: 125811 - DNA, 16 bp, Homo sapiens
gcccctggcagcacag

SEQ ID NO: 125812 - DNA, 14 bp, Homo sapiens
gcccggtgaggcca

SEQ ID NO: 125813 - DNA, 19 bp, Homo sapiens
gccctagaggacactagga

SEQ ID NO: 125814 - DNA, 21 bp, Homo sapiens
gccctagaggacactaggaga

SEQ ID NO: 125815 - DNA, 23 bp, Homo sapiens
gccctagaggacactaggagact

SEQ ID NO: 125816 - DNA, 14 bp, Homo sapiens
gccctcagctccct

SEQ ID NO: 125817 - DNA, 16 bp, Homo sapiens
gccctcagctccctga

SEQ ID NO: 125818 - DNA, 17 bp, Homo sapiens
gccctcagctccctgac

SEQ ID NO: 125819 - DNA, 18 bp, Homo sapiens
gccctccacccactaggt

SEQ ID NO: 125820 - DNA, 14 bp, Homo sapiens
gccctcccaggctg

SEQ ID NO: 125821 - DNA, 14 bp, Homo sapiens
gccctcggtggctg

SEQ ID NO: 125822 - DNA, 16 bp, Homo sapiens
gccctcggtggctgca

SEQ ID NO: 125823 - DNA, 18 bp, Homo sapiens
gccctgaaacgagaagtg

SEQ ID NO: 125824 - DNA, 22 bp, Homo sapiens
gccgcagccacaccgctggctc

SEQ ID NO: 125825 - DNA, 13 bp, Homo sapiens
gccgctgcccctg

SEQ ID NO: 125826 - DNA, 16 bp, Homo sapiens
gccggagacccacagc

SEQ ID NO: 125827 - DNA, 17 bp, Homo sapiens
gccggagacccacagcc

SEQ ID NO: 125828 - DNA, 13 bp, Homo sapiens
gccgggactgggg

SEQ ID NO: 125829 - DNA, 23 bp, Homo sapiens
gccgtgctcgcccacaaactgat

SEQ ID NO: 125830 - DNA, 19 bp, Homo sapiens
gcctatatgagaagaatag

SEQ ID NO: 125831 - DNA, 14 bp, Homo sapiens
gcctcagtgctgca

SEQ ID NO: 125832 - DNA, 19 bp, Homo sapiens
gcctcggctgtctcctgtc

SEQ ID NO: 125833 - DNA, 21 bp, Homo sapiens
gcctctggaggcctctggccc

SEQ ID NO: 125834 - DNA, 20 bp, Homo sapiens
gcctgatggtatactactgc

SEQ ID NO: 125835 - DNA, 20 bp, Homo sapiens
gcctgcagccacatgggagg

SEQ ID NO: 125836 - DNA, 22 bp, Homo sapiens
gcctgcaggtccggggaggagg

SEQ ID NO: 125837 - DNA, 15 bp, Homo sapiens
gcctgccccacccac

SEQ ID NO: 125838 - DNA, 21 bp, Homo sapiens
gcctgctgcttggagtgcccc

SEQ ID NO: 125839 - DNA, 21 bp, Homo sapiens
gcctggggtgcatcctcctca

SEQ ID NO: 125840 - DNA, 22 bp, Homo sapiens
gcctgtaatcagctctcctggc

SEQ ID NO: 125841 - DNA, 19 bp, Homo sapiens
gcctgtagatcagggatag

SEQ ID NO: 125842 - DNA, 23 bp, Homo sapiens
gccttggcatgggcgcaggccca

SEQ ID NO: 125843 - DNA, 15 bp, Homo sapiens
gcgaggaaaaacaaa

SEQ ID NO: 125844 - DNA, 14 bp, Homo sapiens
gcgaggtgtaaagt

SEQ ID NO: 125845 - DNA, 13 bp, Homo sapiens
gcgctgttgcccg

SEQ ID NO: 125846 - DNA, 18 bp, Homo sapiens
gcggagaccctgagtccg

SEQ ID NO: 125847 - DNA, 21 bp, Homo sapiens
gcggaggtggagtggccactg

SEQ ID NO: 125848 - DNA, 22 bp, Homo sapiens
gcggaggtggagtggccactgg

SEQ ID NO: 125849 - DNA, 14 bp, Homo sapiens
gcgggactgggggc

SEQ ID NO: 125850 - DNA, 14 bp, Homo sapiens
gcggggtgcctgct

SEQ ID NO: 125851 - DNA, 13 bp, Homo sapiens
gctaaatcccaag

SEQ ID NO: 125852 - DNA, 14 bp, Homo sapiens
gctacttatcattt

SEQ ID NO: 125853 - DNA, 17 bp, Homo sapiens
gctacttttgaaaatca

SEQ ID NO: 125854 - DNA, 14 bp, Homo sapiens
gctcagctgggcca

SEQ ID NO: 125855 - DNA, 21 bp, Homo sapiens
gctccaacccgttgggtccct

SEQ ID NO: 125856 - DNA, 16 bp, Homo sapiens
gctccatgcctctgga

SEQ ID NO: 125857 - DNA, 13 bp, Homo sapiens
gctcccagctctc

SEQ ID NO: 125858 - DNA, 22 bp, Homo sapiens
gctcccagctctctctcctgga

SEQ ID NO: 125859 - DNA, 22 bp, Homo sapiens
gctccctcccgtagtctcctgg

SEQ ID NO: 125860 - DNA, 15 bp, Homo sapiens
gctccgtgagccctt

SEQ ID NO: 125861 - DNA, 16 bp, Homo sapiens
gctccgtgagcccttg

SEQ ID NO: 125862 - DNA, 17 bp, Homo sapiens
gctcctttctgcccagc

SEQ ID NO: 125863 - DNA, 16 bp, Homo sapiens
gctctaccctgcagct

SEQ ID NO: 125864 - DNA, 12 bp, Homo sapiens
gctctcctggct

SEQ ID NO: 125865 - DNA, 12 bp, Homo sapiens
gagcctgcccag

SEQ ID NO: 125866 - DNA, 22 bp, Homo sapiens
gagctacaaagcatgggaaaaa

SEQ ID NO: 125867 - DNA, 12 bp, Homo sapiens
gagctgggccca

SEQ ID NO: 125868 - DNA, 13 bp, Homo sapiens
gagctgggcccag

SEQ ID NO: 125869 - DNA, 14 bp, Homo sapiens
gagctgggcccagc

SEQ ID NO: 125870 - DNA, 17 bp, Homo sapiens
gagctgggcccagcccc

SEQ ID NO: 125871 - DNA, 16 bp, Homo sapiens
gaggaaaagtgcaatg

SEQ ID NO: 125872 - DNA, 20 bp, Homo sapiens
gaggaaccacatataacact

SEQ ID NO: 125873 - DNA, 16 bp, Homo sapiens
gaggaaggcccagggg

SEQ ID NO: 125874 - DNA, 14 bp, Homo sapiens
gaggacccacctgg

SEQ ID NO: 125875 - DNA, 22 bp, Homo sapiens
gaggacccacctgggccaagga

SEQ ID NO: 125876 - DNA, 19 bp, Homo sapiens
ggcttcttaaaaactgtgt

SEQ ID NO: 125877 - DNA, 21 bp, Homo sapiens
ggcttcttaaaaactgtgtat

SEQ ID NO: 125878 - DNA, 12 bp, Homo sapiens
gggaaggtgggt

SEQ ID NO: 125879 - DNA, 16 bp, Homo sapiens
gggaggaaggcccagg

SEQ ID NO: 125880 - DNA, 22 bp, Homo sapiens
gggaggagggccgagacaggag

SEQ ID NO: 125881 - DNA, 20 bp, Homo sapiens
gggagtgaaacagagaaaga

SEQ ID NO: 125882 - DNA, 12 bp, Homo sapiens
gggcacccctgc

SEQ ID NO: 125883 - DNA, 14 bp, Homo sapiens
gggcacccctgcct

SEQ ID NO: 125884 - DNA, 16 bp, Homo sapiens
gggcacccctgcctcc

SEQ ID NO: 125885 - DNA, 13 bp, Homo sapiens
gggccaaggactc

SEQ ID NO: 125886 - DNA, 11 bp, Homo sapiens
gggcccagccc

SEQ ID NO: 125887 - DNA, 16 bp, Homo sapiens
gggccgggggcggggc

SEQ ID NO: 125888 - DNA, 20 bp, Homo sapiens
gggcctgcatgggggcaccg

SEQ ID NO: 125889 - DNA, 14 bp, Homo sapiens
gggcctggcggagg

SEQ ID NO: 125890 - DNA, 22 bp, Homo sapiens
gggcctgggcggggccgcagcc

SEQ ID NO: 125891 - DNA, 18 bp, Homo sapiens
gggcctgtagatcaggga

SEQ ID NO: 125892 - DNA, 15 bp, Homo sapiens
gggcgcaggcccagt

SEQ ID NO: 125893 - DNA, 17 bp, Homo sapiens
gggcgcttcccacctgc

SEQ ID NO: 125894 - DNA, 15 bp, Homo sapiens
gggcttcaggtctct

SEQ ID NO: 125895 - DNA, 14 bp, Homo sapiens
ggggaggagagagg

SEQ ID NO: 125896 - DNA, 14 bp, Homo sapiens
ggggccgggactgg

SEQ ID NO: 125897 - DNA, 15 bp, Homo sapiens
ggggcggggccggga

SEQ ID NO: 125898 - DNA, 13 bp, Homo sapiens
ggggcttggggat

SEQ ID NO: 125899 - DNA, 14 bp, Homo sapiens
gggggcaccgggct

SEQ ID NO: 125900 - DNA, 16 bp, Homo sapiens
gggtggggcccatggg

SEQ ID NO: 125901 - DNA, 22 bp, Homo sapiens
ggtacaatcgacatcctagccc

SEQ ID NO: 125902 - DNA, 21 bp, Homo sapiens
ggtatcaactaggggaggaga

SEQ ID NO: 125903 - DNA, 18 bp, Homo sapiens
ggtcatcccttcctcctc

SEQ ID NO: 125904 - DNA, 18 bp, Homo sapiens
ggtcatgaaggacactct

SEQ ID NO: 125905 - DNA, 23 bp, Homo sapiens
ggtcatgaaggacactctgcagg

SEQ ID NO: 125906 - DNA, 22 bp, Homo sapiens
ggtcattacttctgagccccag

SEQ ID NO: 125907 - DNA, 18 bp, Homo sapiens
ggtccaccggcccctggc

SEQ ID NO: 125908 - DNA, 15 bp, Homo sapiens
ggtccggggaggagg

SEQ ID NO: 125909 - DNA, 19 bp, Homo sapiens
ggtctcgctttgttgccca

SEQ ID NO: 125910 - DNA, 20 bp, Homo sapiens
ggtctcgctttgttgcccag

SEQ ID NO: 125911 - DNA, 15 bp, Homo sapiens
ggtctgagccacagc

SEQ ID NO: 125912 - DNA, 22 bp, Homo sapiens
ggtgaggtccaccggcccctgg

SEQ ID NO: 125913 - DNA, 21 bp, Homo sapiens
ggtgcttgttccctctccctg

SEQ ID NO: 125914 - DNA, 15 bp, Homo sapiens
ggtggccctcccagg

SEQ ID NO: 125915 - DNA, 16 bp, Homo sapiens
ggtggccctcccaggc

SEQ ID NO: 125916 - DNA, 22 bp, Homo sapiens
ggtggggcccatggggtctctg

SEQ ID NO: 125917 - DNA, 17 bp, Homo sapiens
ggtgtaaagttgttcgc

SEQ ID NO: 125918 - DNA, 13 bp, Homo sapiens
ggttctataataa

SEQ ID NO: 125919 - DNA, 17 bp, Homo sapiens
ggtttcccagtgagcct

SEQ ID NO: 125920 - DNA, 14 bp, Homo sapiens
ggtttctccccgga

SEQ ID NO: 125921 - DNA, 20 bp, Homo sapiens
ggtttctccccggacactcg

SEQ ID NO: 125922 - DNA, 15 bp, Homo sapiens
gtaaaaagattatat

SEQ ID NO: 125923 - DNA, 21 bp, Homo sapiens
gtaaaaagattatatatcata

SEQ ID NO: 125924 - DNA, 12 bp, Homo sapiens
gtaaaagttata

SEQ ID NO: 125925 - DNA, 13 bp, Homo sapiens
gtaaaagttataa

SEQ ID NO: 125926 - DNA, 17 bp, Homo sapiens
gtaaatttttgaaaaat

SEQ ID NO: 125927 - DNA, 19 bp, Homo sapiens
gtaaatttttgaaaaatat

SEQ ID NO: 125928 - DNA, 19 bp, Homo sapiens
gtaactatcaatatttaag

SEQ ID NO: 125929 - DNA, 19 bp, Homo sapiens
gtaagatggcttatttgta

SEQ ID NO: 125930 - DNA, 20 bp, Homo sapiens
gtaagtcttttttttttcca

SEQ ID NO: 125931 - DNA, 23 bp, Homo sapiens
gtaagtttaattatctgcattta

SEQ ID NO: 125932 - DNA, 14 bp, Homo sapiens
gtaatataaaagat

SEQ ID NO: 125933 - DNA, 20 bp, Homo sapiens
gtaatgagtcagtgaagtct

SEQ ID NO: 125934 - DNA, 17 bp, Homo sapiens
gtacaagtcagtttcta

SEQ ID NO: 125935 - DNA, 19 bp, Homo sapiens
gtacttttctggttccaaa

SEQ ID NO: 125936 - DNA, 20 bp, Homo sapiens
gtacttttctggttccaaac

SEQ ID NO: 125937 - DNA, 12 bp, Homo sapiens
gtagtctcctgg

SEQ ID NO: 125938 - DNA, 22 bp, Homo sapiens
gtagtgtcttcctagtatatta

SEQ ID NO: 125939 - DNA, 15 bp, Homo sapiens
gtatactgtaaaagt

SEQ ID NO: 125940 - DNA, 18 bp, Homo sapiens
gtatactgtaaaagttat

SEQ ID NO: 125941 - DNA, 23 bp, Homo sapiens
gtatactgtaaaagttataataa

SEQ ID NO: 125942 - DNA, 23 bp, Homo sapiens
gtatataatttactttgtagact

SEQ ID NO: 125943 - DNA, 15 bp, Homo sapiens
gtatatgtatatcta

SEQ ID NO: 125944 - DNA, 16 bp, Homo sapiens
gtatatgtatatctat

SEQ ID NO: 125945 - DNA, 19 bp, Homo sapiens
gtatcattaaaatatatgt

SEQ ID NO: 125946 - DNA, 18 bp, Homo sapiens
gtatctacagtaatgaaa

SEQ ID NO: 125947 - DNA, 22 bp, Homo sapiens
gtatctacagtaatgaaatgtt

SEQ ID NO: 125948 - DNA, 14 bp, Homo sapiens
gtattataattgtt

SEQ ID NO: 125949 - DNA, 14 bp, Homo sapiens
gtattcagaaatta

SEQ ID NO: 125950 - DNA, 19 bp, Homo sapiens
gtattcagaaattaaaata

SEQ ID NO: 125951 - DNA, 15 bp, Homo sapiens
gtattcttaaaatgc

SEQ ID NO: 125952 - DNA, 19 bp, Homo sapiens
gtattcttaaaatgcaata

SEQ ID NO: 125953 - DNA, 13 bp, Homo sapiens
gtatttataaaaa

SEQ ID NO: 125954 - DNA, 20 bp, Homo sapiens
gtatttataaaaatataaat

SEQ ID NO: 125955 - DNA, 18 bp, Homo sapiens
gtatttatctgcaaggtt

SEQ ID NO: 125956 - DNA, 18 bp, Homo sapiens
gtcaagattttttttgta

SEQ ID NO: 125957 - DNA, 16 bp, Homo sapiens
gtcaggctacaaggta

SEQ ID NO: 125958 - DNA, 20 bp, Homo sapiens
gtcatatcactaaataaaca

SEQ ID NO: 125959 - DNA, 23 bp, Homo sapiens
gtcatcaatagtgtcctatgcaa

SEQ ID NO: 125960 - DNA, 13 bp, Homo sapiens
gtcatcccttcct

SEQ ID NO: 125961 - DNA, 16 bp, Homo sapiens
gtcatcccttcctcct

SEQ ID NO: 125962 - DNA, 19 bp, Homo sapiens
gtcatgaaggacactctgc

SEQ ID NO: 125963 - DNA, 17 bp, Homo sapiens
gtcattacttctgagcc

SEQ ID NO: 125964 - DNA, 20 bp, Homo sapiens
gtcattacttctgagcccca

SEQ ID NO: 125965 - DNA, 12 bp, Homo sapiens
gtcccagaggcc

SEQ ID NO: 125966 - DNA, 13 bp, Homo sapiens
gtcccagaggccg

SEQ ID NO: 125967 - DNA, 21 bp, Homo sapiens
gtcccagaggccgctgcccct

SEQ ID NO: 125968 - DNA, 23 bp, Homo sapiens
gtcccagaggccgctgcccctga

SEQ ID NO: 125969 - DNA, 22 bp, Homo sapiens
gtccccggcggggtgcctgctg

SEQ ID NO: 125970 - DNA, 20 bp, Homo sapiens
gtcccttggatcagaggtca

SEQ ID NO: 125971 - DNA, 17 bp, Homo sapiens
gtcctgcctcagcctcc

SEQ ID NO: 125972 - DNA, 23 bp, Homo sapiens
gtcctggaccctggcctaaagaa

SEQ ID NO: 125973 - DNA, 20 bp, Homo sapiens
gtcgagtctttgtgtgttat

SEQ ID NO: 125974 - DNA, 22 bp, Homo sapiens
gtcgagtctttgtgtgttatat

SEQ ID NO: 125975 - DNA, 20 bp, Homo sapiens
gtctcaaactcctgggctca

SEQ ID NO: 125976 - DNA, 23 bp, Homo sapiens
gtctcacagtgttgcccaggctg

SEQ ID NO: 125977 - DNA, 21 bp, Homo sapiens
taaaaaatattttaagaaaga

SEQ ID NO: 125978 - DNA, 23 bp, Homo sapiens
taaaaaatgtgtgtattcttaaa

SEQ ID NO: 125979 - DNA, 23 bp, Homo sapiens
taaaaacaaaaacatcccaagat

SEQ ID NO: 125980 - DNA, 13 bp, Homo sapiens
taaaaactgtgta

SEQ ID NO: 125981 - DNA, 18 bp, Homo sapiens
taaaaactgtgtatcatt

SEQ ID NO: 125982 - DNA, 22 bp, Homo sapiens
taaaaactgtgtatcattaaaa

SEQ ID NO: 125983 - DNA, 15 bp, Homo sapiens
taaaaaggaaattag

SEQ ID NO: 125984 - DNA, 16 bp, Homo sapiens
taaaaagtgaactttt

SEQ ID NO: 125985 - DNA, 20 bp, Homo sapiens
taaaaagtgaacttttgtaa

SEQ ID NO: 125986 - DNA, 17 bp, Homo sapiens
taaaaatataaattgta

SEQ ID NO: 125987 - DNA, 13 bp, Homo sapiens
taaaaatattttt

SEQ ID NO: 125988 - DNA, 21 bp, Homo sapiens
taaaactgagtccatgaaaat

SEQ ID NO: 125989 - DNA, 15 bp, Homo sapiens
taaaactttgctgcc

SEQ ID NO: 125990 - DNA, 22 bp, Homo sapiens
taaaagaagagaggggaagaat

SEQ ID NO: 125991 - DNA, 19 bp, Homo sapiens
taaaagagacaaactgtaa

SEQ ID NO: 125992 - DNA, 21 bp, Homo sapiens
taaaaggcaactcaaagatga

SEQ ID NO: 125993 - DNA, 13 bp, Homo sapiens
taaaagtgcattt

SEQ ID NO: 125994 - DNA, 14 bp, Homo sapiens
taaaagtgcattta

SEQ ID NO: 125995 - DNA, 19 bp, Homo sapiens
taaaagtgcatttaaggag

SEQ ID NO: 125996 - DNA, 15 bp, Homo sapiens
taaaagttataataa

SEQ ID NO: 125997 - DNA, 20 bp, Homo sapiens
taaaagttataataactgaa

SEQ ID NO: 125998 - DNA, 13 bp, Homo sapiens
taaaataaacttt

SEQ ID NO: 125999 - DNA, 14 bp, Homo sapiens
taaaataaactttc

SEQ ID NO: 126000 - DNA, 13 bp, Homo sapiens
taaaatatatgtt

SEQ ID NO: 126001 - DNA, 14 bp, Homo sapiens
taaaatatatgttc

SEQ ID NO: 126002 - DNA, 22 bp, Homo sapiens
taaaatatatgttctgcaagaa

SEQ ID NO: 126003 - DNA, 16 bp, Homo sapiens
taaaatgcaatatttg

SEQ ID NO: 126004 - DNA, 18 bp, Homo sapiens
taaaatgcaatatttgta

SEQ ID NO: 126005 - DNA, 22 bp, Homo sapiens
taaaattaggaacagtaaaatc

SEQ ID NO: 126006 - DNA, 14 bp, Homo sapiens
taaaattgcacttt

SEQ ID NO: 126007 - DNA, 19 bp, Homo sapiens
taaacagaaaactcccaat

SEQ ID NO: 126008 - DNA, 20 bp, Homo sapiens
taaacagaaaactcccaata

SEQ ID NO: 126009 - DNA, 15 bp, Homo sapiens
taaacttggaatcaa

SEQ ID NO: 126010 - DNA, 12 bp, Homo sapiens
taaagaaataat

SEQ ID NO: 126011 - DNA, 14 bp, Homo sapiens
taaagaaataattt

SEQ ID NO: 126012 - DNA, 22 bp, Homo sapiens
taaaggtatttagaatatatta

SEQ ID NO: 126013 - DNA, 21 bp, Homo sapiens
taaagtatttataaaaatata

SEQ ID NO: 126014 - DNA, 18 bp, Homo sapiens
taaagtttgctttcagat

SEQ ID NO: 126015 - DNA, 21 bp, Homo sapiens
taaataattttaaataacctc

SEQ ID NO: 126016 - DNA, 19 bp, Homo sapiens
taaatcattttaggaaagg

SEQ ID NO: 126017 - DNA, 15 bp, Homo sapiens
taaattgtacatttt

SEQ ID NO: 126018 - DNA, 18 bp, Homo sapiens
taaattgtacattttgta

SEQ ID NO: 126019 - DNA, 22 bp, Homo sapiens
taaattgtacattttgtaaaat

SEQ ID NO: 126020 - DNA, 16 bp, Homo sapiens
taaatttaagaaaaca

SEQ ID NO: 126021 - DNA, 23 bp, Homo sapiens
taaatttaagaaaacaagtatat

SEQ ID NO: 126022 - DNA, 16 bp, Homo sapiens
taacattcctaaaatg

SEQ ID NO: 126023 - DNA, 17 bp, Homo sapiens
taacattcctaaaatgc

SEQ ID NO: 126024 - DNA, 11 bp, Homo sapiens
taacctctggc

SEQ ID NO: 126025 - DNA, 15 bp, Homo sapiens
taacctctggccctt

SEQ ID NO: 126026 - DNA, 22 bp, Homo sapiens
taacctctggcccttggaataa

SEQ ID NO: 126027 - DNA, 15 bp, Homo sapiens
taactgaactgtttg

SEQ ID NO: 126028 - DNA, 16 bp, Homo sapiens
taactgaactgtttgg

SEQ ID NO: 126029 - DNA, 16 bp, Homo sapiens
taactgatgagtaaac

SEQ ID NO: 126030 - DNA, 20 bp, Homo sapiens
taactgcaattttaattgat

SEQ ID NO: 126031 - DNA, 14 bp, Homo sapiens
taagaaaacaagta

SEQ ID NO: 126032 - DNA, 17 bp, Homo sapiens
taagaaaagtaatgaag

SEQ ID NO: 126033 - DNA, 16 bp, Homo sapiens
taagaaagagaatgaa

SEQ ID NO: 126034 - DNA, 20 bp, Homo sapiens
taagaaagagaatgaactgt

SEQ ID NO: 126035 - DNA, 14 bp, Homo sapiens
taagaaaggatata

SEQ ID NO: 126036 - DNA, 18 bp, Homo sapiens
taagaaaggatataaaag

SEQ ID NO: 126037 - DNA, 18 bp, Homo sapiens
taagaagggggagtgaaa

SEQ ID NO: 126038 - DNA, 20 bp, Homo sapiens
taagaagggggagtgaaaca

SEQ ID NO: 126039 - DNA, 13 bp, Homo sapiens
taagacgtgaatg

SEQ ID NO: 126040 - DNA, 13 bp, Homo sapiens
taagggcatttta

SEQ ID NO: 126041 - DNA, 20 bp, Homo sapiens
taagggttagtttacaatca

SEQ ID NO: 126042 - DNA, 19 bp, Homo sapiens
taagtcttttttttttcca

SEQ ID NO: 126043 - DNA, 21 bp, Homo sapiens
taagtcttttttttttccaaa

SEQ ID NO: 126044 - DNA, 20 bp, Homo sapiens
taagtgcaacatttctgtat

SEQ ID NO: 126045 - DNA, 23 bp, Homo sapiens
taagtgcaacatttctgtatact

SEQ ID NO: 126046 - DNA, 18 bp, Homo sapiens
taagttttgatataatct

SEQ ID NO: 126047 - DNA, 14 bp, Homo sapiens
taataactgaactg

SEQ ID NO: 126048 - DNA, 19 bp, Homo sapiens
taataagttttgatataat

SEQ ID NO: 126049 - DNA, 21 bp, Homo sapiens
taataagttttgatataatct

SEQ ID NO: 126050 - DNA, 22 bp, Homo sapiens
taataagttttgatataatctt

SEQ ID NO: 126051 - DNA, 14 bp, Homo sapiens
taatagaaaattaa

SEQ ID NO: 126052 - DNA, 16 bp, Homo sapiens
taatagaaaattaaaa

SEQ ID NO: 126053 - DNA, 20 bp, Homo sapiens
taatagaaaattaaaataac

SEQ ID NO: 126054 - DNA, 19 bp, Homo sapiens
taatatctgagaagtgtat

SEQ ID NO: 126055 - DNA, 14 bp, Homo sapiens
taatctatttacat

SEQ ID NO: 126056 - DNA, 17 bp, Homo sapiens
taatcttggcttcttaa

SEQ ID NO: 126057 - DNA, 21 bp, Homo sapiens
taatcttggcttcttaaaaac

SEQ ID NO: 126058 - DNA, 22 bp, Homo sapiens
taatcttggcttcttaaaaact

SEQ ID NO: 126059 - DNA, 19 bp, Homo sapiens
taatgaaagtgatgacata

SEQ ID NO: 126060 - DNA, 15 bp, Homo sapiens
taatgaaatgtttac

SEQ ID NO: 126061 - DNA, 14 bp, Homo sapiens
taatgaagaatcac

SEQ ID NO: 126062 - DNA, 15 bp, Homo sapiens
taatgtgatcatatg

SEQ ID NO: 126063 - DNA, 22 bp, Homo sapiens
taatgtgatcatatgaggacct

SEQ ID NO: 126064 - DNA, 16 bp, Homo sapiens
taatgttatttcttaa

SEQ ID NO: 126065 - DNA, 15 bp, Homo sapiens
taattaagcagaaac

SEQ ID NO: 126066 - DNA, 17 bp, Homo sapiens
taattagagaactggag

SEQ ID NO: 126067 - DNA, 22 bp, Homo sapiens
taattatggtctggggtaaaat

SEQ ID NO: 126068 - DNA, 23 bp, Homo sapiens
taattgtcctgtgtctatgtacc

SEQ ID NO: 126069 - DNA, 15 bp, Homo sapiens
taattgttgatattt

SEQ ID NO: 126070 - DNA, 18 bp, Homo sapiens
taatttactttgtagact

SEQ ID NO: 126071 - DNA, 20 bp, Homo sapiens
gtcccagaggccgctgcccc

SEQ ID NO: 126072 - DNA, 13 bp, Homo sapiens
gtccccctagaga

SEQ ID NO: 126073 - DNA, 22 bp, Homo sapiens
gtcccgcttagttcttgaattg

SEQ ID NO: 126074 - DNA, 18 bp, Homo sapiens
gtcccttggatcagaggt

SEQ ID NO: 126075 - DNA, 21 bp, Homo sapiens
gtcccttggatcagaggtcat

SEQ ID NO: 126076 - DNA, 12 bp, Homo sapiens
gtcctaggtcat

SEQ ID NO: 126077 - DNA, 15 bp, Homo sapiens
gtcctgcctcagcct

SEQ ID NO: 126078 - DNA, 22 bp, Homo sapiens
gcccctggcagcacagcccagg

SEQ ID NO: 126079 - DNA, 23 bp, Homo sapiens
gcccctggcagcacagcccaggg

SEQ ID NO: 126080 - DNA, 13 bp, Homo sapiens
gccctagaggaca

SEQ ID NO: 126081 - DNA, 15 bp, Homo sapiens
gccctccacccacta

SEQ ID NO: 126082 - DNA, 20 bp, Homo sapiens
gccctcggtggctgcacaga

SEQ ID NO: 126083 - DNA, 22 bp, Homo sapiens
gccctgaaacgagaagtgccct

SEQ ID NO: 126084 - DNA, 14 bp, Homo sapiens
gccctgcggagacc

SEQ ID NO: 126085 - DNA, 17 bp, Homo sapiens
gccctgttgggggcttc

SEQ ID NO: 126086 - DNA, 18 bp, Homo sapiens
gcccttaaggatcacccc

SEQ ID NO: 126087 - DNA, 20 bp, Homo sapiens
gcccttaaggatcaccccag

SEQ ID NO: 126088 - DNA, 17 bp, Homo sapiens
gcccttggaataaagtt

SEQ ID NO: 126089 - DNA, 18 bp, Homo sapiens
gccgagacaggagcagcc

SEQ ID NO: 126090 - DNA, 20 bp, Homo sapiens
gccgcggggacaccgggaag

SEQ ID NO: 126091 - DNA, 16 bp, Homo sapiens
gccgctgcccctgagt

SEQ ID NO: 126092 - DNA, 18 bp, Homo sapiens
gccgctgcccctgagttc

SEQ ID NO: 126093 - DNA, 20 bp, Homo sapiens
gccggagacccacagccctg

SEQ ID NO: 126094 - DNA, 15 bp, Homo sapiens
gccgggggcggggcc

SEQ ID NO: 126095 - DNA, 19 bp, Homo sapiens
gcctactaagtacccttgg

SEQ ID NO: 126096 - DNA, 15 bp, Homo sapiens
gcctcggctgtctcc

SEQ ID NO: 126097 - DNA, 16 bp, Homo sapiens
gcctcggctgtctcct

SEQ ID NO: 126098 - DNA, 17 bp, Homo sapiens
gcctcggctgtctcctg

SEQ ID NO: 126099 - DNA, 18 bp, Homo sapiens
gcctctggaggcctctgg

SEQ ID NO: 126100 - DNA, 12 bp, Homo sapiens
gcctctggccct

SEQ ID NO: 126101 - DNA, 13 bp, Homo sapiens
gcctctggccctc

SEQ ID NO: 126102 - DNA, 15 bp, Homo sapiens
gcctgcagccacatg

SEQ ID NO: 126103 - DNA, 19 bp, Homo sapiens
gcctgccccacccacccca

SEQ ID NO: 126104 - DNA, 22 bp, Homo sapiens
gcctggggtgcatcctcctcag

SEQ ID NO: 126105 - DNA, 20 bp, Homo sapiens
gcctttcacaggactctgca

SEQ ID NO: 126106 - DNA, 13 bp, Homo sapiens
gcgaggtgtaaag

SEQ ID NO: 126107 - DNA, 13 bp, Homo sapiens
gcgcaggcccagt

SEQ ID NO: 126108 - DNA, 22 bp, Homo sapiens
gcgctgttgcccgccctccacc

SEQ ID NO: 126109 - DNA, 15 bp, Homo sapiens
gcgcttcccacctgc

SEQ ID NO: 126110 - DNA, 13 bp, Homo sapiens
gcgggccaggcag

SEQ ID NO: 126111 - DNA, 13 bp, Homo sapiens
gcggggtgcagaa

SEQ ID NO: 126112 - DNA, 14 bp, Homo sapiens
gctaaaagaagaga

SEQ ID NO: 126113 - DNA, 15 bp, Homo sapiens
gctaaaagaagagag

SEQ ID NO: 126114 - DNA, 16 bp, Homo sapiens
gctaaaagaagagagg

SEQ ID NO: 126115 - DNA, 19 bp, Homo sapiens
gctaaaagtgcatttaagg

SEQ ID NO: 126116 - DNA, 23 bp, Homo sapiens
gctaaaagtgcatttaaggagat

SEQ ID NO: 126117 - DNA, 19 bp, Homo sapiens
gctacttttgaaaatcaag

SEQ ID NO: 126118 - DNA, 12 bp, Homo sapiens
gctcagctgggc

SEQ ID NO: 126119 - DNA, 16 bp, Homo sapiens
gctcagctgggccact

SEQ ID NO: 126120 - DNA, 19 bp, Homo sapiens
gctcaggcgatccacctgt

SEQ ID NO: 126121 - DNA, 13 bp, Homo sapiens
gctcaggtgcaag

SEQ ID NO: 126122 - DNA, 18 bp, Homo sapiens
gctccaacccgttgggtc

SEQ ID NO: 126123 - DNA, 22 bp, Homo sapiens
gctccaacccgttgggtccctt

SEQ ID NO: 126124 - DNA, 14 bp, Homo sapiens
gctccatgcctctg

SEQ ID NO: 126125 - DNA, 20 bp, Homo sapiens
gctccatgcctctggaggcc

SEQ ID NO: 126126 - DNA, 20 bp, Homo sapiens
gctcccagctctctctcctg

SEQ ID NO: 126127 - DNA, 23 bp, Homo sapiens
gctccctcccgtagtctcctggg

SEQ ID NO: 126128 - DNA, 13 bp, Homo sapiens
gctccctgacccc

SEQ ID NO: 126129 - DNA, 14 bp, Homo sapiens
gctccgtgagccct

SEQ ID NO: 126130 - DNA, 20 bp, Homo sapiens
gctcgagcagtcctgcctca

SEQ ID NO: 126131 - DNA, 16 bp, Homo sapiens
gctcgcccacaaactg

SEQ ID NO: 126132 - DNA, 21 bp, Homo sapiens
gctctgaacttccaagctcca

SEQ ID NO: 126133 - DNA, 16 bp, Homo sapiens
gctgacggtttctccc

SEQ ID NO: 126134 - DNA, 19 bp, Homo sapiens
gctgacggtttctccccgg

SEQ ID NO: 126135 - DNA, 14 bp, Homo sapiens
gctgagcctgccca

SEQ ID NO: 126136 - DNA, 11 bp, Homo sapiens
gctgagctggg

SEQ ID NO: 126137 - DNA, 16 bp, Homo sapiens
gctgagctgggcccag

SEQ ID NO: 126138 - DNA, 16 bp, Homo sapiens
gctgcaaaattaaatc

SEQ ID NO: 126139 - DNA, 16 bp, Homo sapiens
gctgcaattgagggct

SEQ ID NO: 126140 - DNA, 14 bp, Homo sapiens
gctgcacagaaggg

SEQ ID NO: 126141 - DNA, 13 bp, Homo sapiens
gctgcccctgagt

SEQ ID NO: 126142 - DNA, 20 bp, Homo sapiens
gctgcttggagtgccccaag

SEQ ID NO: 126143 - DNA, 21 bp, Homo sapiens
gctgcttggagtgccccaagg

SEQ ID NO: 126144 - DNA, 16 bp, Homo sapiens
gctggcatttgcacct

SEQ ID NO: 126145 - DNA, 16 bp, Homo sapiens
gctgggcccagcccct

SEQ ID NO: 126146 - DNA, 13 bp, Homo sapiens
gctgtctcctgtc

SEQ ID NO: 126147 - DNA, 14 bp, Homo sapiens
gctgtttcaaatgt

SEQ ID NO: 126148 - DNA, 12 bp, Homo sapiens
gcttaatttcct

SEQ ID NO: 126149 - DNA, 21 bp, Homo sapiens
gcttaatttccttctgttaag

SEQ ID NO: 126150 - DNA, 23 bp, Homo sapiens
gcttaatttccttctgttaagaa

SEQ ID NO: 126151 - DNA, 14 bp, Homo sapiens
gcttatttttaaaa

SEQ ID NO: 126152 - DNA, 16 bp, Homo sapiens
gcttatttttaaaata

SEQ ID NO: 126153 - DNA, 23 bp, Homo sapiens
gcttatttttaaaataaaaatat

SEQ ID NO: 126154 - DNA, 22 bp, Homo sapiens
gcttcgcttccttagccttgct

SEQ ID NO: 126155 - DNA, 17 bp, Homo sapiens
gcttggagtgccccaag

SEQ ID NO: 126156 - DNA, 18 bp, Homo sapiens
gcttgttccctctccctg

SEQ ID NO: 126157 - DNA, 23 bp, Homo sapiens
gcttttaaaaaatattttaagaa

SEQ ID NO: 126158 - DNA, 16 bp, Homo sapiens
gcttttgttttgctta

SEQ ID NO: 126159 - DNA, 21 bp, Homo sapiens
ggaaaaaactttgctccaggc

SEQ ID NO: 126160 - DNA, 15 bp, Homo sapiens
ggaaaattgaaagta

SEQ ID NO: 126161 - DNA, 18 bp, Homo sapiens
ggaaatctcaccccatcc

SEQ ID NO: 126162 - DNA, 14 bp, Homo sapiens
ggaaattagtcttt

SEQ ID NO: 126163 - DNA, 16 bp, Homo sapiens
ggaagaatttaatgga

SEQ ID NO: 126164 - DNA, 16 bp, Homo sapiens
ggaagctgctgaggcc

SEQ ID NO: 126165 - DNA, 15 bp, Homo sapiens
ggaaggcccaggggt

SEQ ID NO: 126166 - DNA, 23 bp, Homo sapiens
ggaaggcccaggggtggggccca

SEQ ID NO: 126167 - DNA, 15 bp, Homo sapiens
ggaagtgcagcgggc

SEQ ID NO: 126168 - DNA, 23 bp, Homo sapiens
ggaagtgcagcgggccaggcagg

SEQ ID NO: 126169 - DNA, 14 bp, Homo sapiens
ggaatataagaaaa

SEQ ID NO: 126170 - DNA, 15 bp, Homo sapiens
ggaatgtgtccaaga

SEQ ID NO: 126171 - DNA, 17 bp, Homo sapiens
ggaatgtgtccaagaca

SEQ ID NO: 126172 - DNA, 20 bp, Homo sapiens
ggaattgcatacaactgtgc

SEQ ID NO: 126173 - DNA, 13 bp, Homo sapiens
ggacactaggaga

SEQ ID NO: 126174 - DNA, 16 bp, Homo sapiens
tccaaggaaaattgaa

SEQ ID NO: 126175 - DNA, 19 bp, Homo sapiens
tccaaggaaaattgaaagt

SEQ ID NO: 126176 - DNA, 14 bp, Homo sapiens
tccaaggaaacatg

SEQ ID NO: 126177 - DNA, 20 bp, Homo sapiens
tccaatgccacatacttgca

SEQ ID NO: 126178 - DNA, 22 bp, Homo sapiens
tccaatgccacatacttgcagc

SEQ ID NO: 126179 - DNA, 14 bp, Homo sapiens
tctctgtggctcca

SEQ ID NO: 126180 - DNA, 15 bp, Homo sapiens
tctcttttaaagtat

SEQ ID NO: 126181 - DNA, 14 bp, Homo sapiens
tctgagaagtgtat

SEQ ID NO: 126182 - DNA, 15 bp, Homo sapiens
tctgagccccagccc

SEQ ID NO: 126183 - DNA, 17 bp, Homo sapiens
tctgagccccagcccca

SEQ ID NO: 126184 - DNA, 22 bp, Homo sapiens
tctgatagctgtttcaaatgtg

SEQ ID NO: 126185 - DNA, 14 bp, Homo sapiens
tctgatgcccaccg

SEQ ID NO: 126186 - DNA, 21 bp, Homo sapiens
tctgatgcccaccgaggagcc

SEQ ID NO: 126187 - DNA, 23 bp, Homo sapiens
tctgcagggtgaagcaccaggga

SEQ ID NO: 126188 - DNA, 14 bp, Homo sapiens
tctgcatcttcagt

SEQ ID NO: 126189 - DNA, 17 bp, Homo sapiens
tctgcattttcacccca

SEQ ID NO: 126190 - DNA, 19 bp, Homo sapiens
tctgctgaagattcagttt

SEQ ID NO: 126191 - DNA, 17 bp, Homo sapiens
tctgctgagctgggccc

SEQ ID NO: 126192 - DNA, 23 bp, Homo sapiens
tctgctgagctgggcccagcccc

SEQ ID NO: 126193 - DNA, 14 bp, Homo sapiens
tctggagctgtccg

SEQ ID NO: 126194 - DNA, 15 bp, Homo sapiens
tctggaggcctctgg

SEQ ID NO: 126195 - DNA, 19 bp, Homo sapiens
tctggaggcctctggccct

SEQ ID NO: 126196 - DNA, 14 bp, Homo sapiens
tctggcccttggaa

SEQ ID NO: 126197 - DNA, 12 bp, Homo sapiens
tctgggcctggg

SEQ ID NO: 126198 - DNA, 14 bp, Homo sapiens
tctgtataatctat

SEQ ID NO: 126199 - DNA, 15 bp, Homo sapiens
tctgtccagtttcca

SEQ ID NO: 126200 - DNA, 20 bp, Homo sapiens
tctgtcccaagtcctgctcc

SEQ ID NO: 126201 - DNA, 12 bp, Homo sapiens
tctgtggctcca

SEQ ID NO: 126202 - DNA, 13 bp, Homo sapiens
tctgttaagaaag

SEQ ID NO: 126203 - DNA, 16 bp, Homo sapiens
tctgttaagaaaggat

SEQ ID NO: 126204 - DNA, 13 bp, Homo sapiens
tcttaaaaactgt

SEQ ID NO: 126205 - DNA, 18 bp, Homo sapiens
tcttaaaaactgtgtatc

SEQ ID NO: 126206 - DNA, 19 bp, Homo sapiens
tcttaaaaactgtgtatca

SEQ ID NO: 126207 - DNA, 21 bp, Homo sapiens
tcttaaaaactgtgtatcatt

SEQ ID NO: 126208 - DNA, 10 bp, Homo sapiens
tcttaaaatt

SEQ ID NO: 126209 - DNA, 22 bp, Homo sapiens
tcttagagtttacagtttgtgt

SEQ ID NO: 126210 - DNA, 20 bp, Homo sapiens
tcttcccaaatcaaaataaa

SEQ ID NO: 126211 - DNA, 17 bp, Homo sapiens
tcttgaattgttatgaa

SEQ ID NO: 126212 - DNA, 21 bp, Homo sapiens
tcttgaattgttatgaaaatc

SEQ ID NO: 126213 - DNA, 14 bp, Homo sapiens
tcttgactggctca

SEQ ID NO: 126214 - DNA, 19 bp, Homo sapiens
tcttggcttactgcagcct

SEQ ID NO: 126215 - DNA, 19 bp, Homo sapiens
tcttggcttcttaaaaact

SEQ ID NO: 126216 - DNA, 16 bp, Homo sapiens
tctttaaatcatttta

SEQ ID NO: 126217 - DNA, 16 bp, Homo sapiens
tctttgtgtgttatat

SEQ ID NO: 126218 - DNA, 20 bp, Homo sapiens
tcttttaaagtatttataaa

SEQ ID NO: 126219 - DNA, 16 bp, Homo sapiens
tcttttatttaacaaa

SEQ ID NO: 126220 - DNA, 17 bp, Homo sapiens
tcttttttttttccaaa

SEQ ID NO: 126221 - DNA, 18 bp, Homo sapiens
tcttttttttttccaaat

SEQ ID NO: 126222 - DNA, 11 bp, Homo sapiens
tgaaaaatatt

SEQ ID NO: 126223 - DNA, 16 bp, Homo sapiens
tgaaaaatattgctaa

SEQ ID NO: 126224 - DNA, 22 bp, Homo sapiens
tgaaaaatattgctaaaagtgc

SEQ ID NO: 126225 - DNA, 17 bp, Homo sapiens
tgaaaatcctatatctg

SEQ ID NO: 126226 - DNA, 12 bp, Homo sapiens
tgaaacagagaa

SEQ ID NO: 126227 - DNA, 16 bp, Homo sapiens
tgaaacagagaaagaa

SEQ ID NO: 126228 - DNA, 17 bp, Homo sapiens
tgaaacagagaaagaaa

SEQ ID NO: 126229 - DNA, 17 bp, Homo sapiens
tgaaacatgtgcccctg

SEQ ID NO: 126230 - DNA, 14 bp, Homo sapiens
tgaaacgagaagtg

SEQ ID NO: 126231 - DNA, 14 bp, Homo sapiens
tgaaagaaggagca

SEQ ID NO: 126232 - DNA, 15 bp, Homo sapiens
tgaaagtattcagaa

SEQ ID NO: 126233 - DNA, 16 bp, Homo sapiens
tgaaagtattcagaaa

SEQ ID NO: 126234 - DNA, 17 bp, Homo sapiens
tgaaagtattcagaaat

SEQ ID NO: 126235 - DNA, 18 bp, Homo sapiens
tgaaagtattcagaaatt

SEQ ID NO: 126236 - DNA, 19 bp, Homo sapiens
tgaaagtattcagaaatta

SEQ ID NO: 126237 - DNA, 21 bp, Homo sapiens
tgaaagtattcagaaattaaa

SEQ ID NO: 126238 - DNA, 22 bp, Homo sapiens
tgaaagtattcagaaattaaaa

SEQ ID NO: 126239 - DNA, 15 bp, Homo sapiens
tgaaagtgatgacat

SEQ ID NO: 126240 - DNA, 19 bp, Homo sapiens
tgaaatcagcatgacaaaa

SEQ ID NO: 126241 - DNA, 22 bp, Homo sapiens
tgaaatgtttactaagtggact

SEQ ID NO: 126242 - DNA, 21 bp, Homo sapiens
tgaacaataaagtttgctttc

SEQ ID NO: 126243 - DNA, 16 bp, Homo sapiens
tgaacagcaggatgcc

SEQ ID NO: 126244 - DNA, 22 bp, Homo sapiens
tgaaccgacttttctaaagctc

SEQ ID NO: 126245 - DNA, 10 bp, Homo sapiens
tgaactgtgg

SEQ ID NO: 126246 - DNA, 12 bp, Homo sapiens
tgaactgtggaa

SEQ ID NO: 126247 - DNA, 14 bp, Homo sapiens
tgaacttgggaggg

SEQ ID NO: 126248 - DNA, 15 bp, Homo sapiens
tgaacttttacagaa

SEQ ID NO: 126249 - DNA, 23 bp, Homo sapiens
tgaacttttacagaatgcattaa

SEQ ID NO: 126250 - DNA, 15 bp, Homo sapiens
tgaacttttgtaatt

SEQ ID NO: 126251 - DNA, 18 bp, Homo sapiens
tgaacttttgtaatttga

SEQ ID NO: 126252 - DNA, 19 bp, Homo sapiens
tgaacttttgtaatttgaa

SEQ ID NO: 126253 - DNA, 23 bp, Homo sapiens
tgaagaatcacgatttcatcctt

SEQ ID NO: 126254 - DNA, 22 bp, Homo sapiens
tgaagcaccagggagaggcctc

SEQ ID NO: 126255 - DNA, 17 bp, Homo sapiens
tgaagctggccctcagc

SEQ ID NO: 126256 - DNA, 19 bp, Homo sapiens
tgaagctggccctcagctc

SEQ ID NO: 126257 - DNA, 20 bp, Homo sapiens
tgaaggttttttttttaagt

SEQ ID NO: 126258 - DNA, 21 bp, Homo sapiens
tgaaggttttttttttaagtg

SEQ ID NO: 126259 - DNA, 23 bp, Homo sapiens
tgaaggttttttttttaagtgca

SEQ ID NO: 126260 - DNA, 22 bp, Homo sapiens
tgaagtcgagcactctaattag

SEQ ID NO: 126261 - DNA, 16 bp, Homo sapiens
tgaagtctagaatcat

SEQ ID NO: 126262 - DNA, 19 bp, Homo sapiens
tgaagtctagaatcatact

SEQ ID NO: 126263 - DNA, 14 bp, Homo sapiens
tgaataaaaagtga

SEQ ID NO: 126264 - DNA, 16 bp, Homo sapiens
tgaatatatggcattt

SEQ ID NO: 126265 - DNA, 21 bp, Homo sapiens
tgaatatatggcatttgcaga

SEQ ID NO: 126266 - DNA, 18 bp, Homo sapiens
tgaatgtctcagcgaggt

SEQ ID NO: 126267 - DNA, 17 bp, Homo sapiens
tgaattgttatgaaaat

SEQ ID NO: 126268 - DNA, 14 bp, Homo sapiens
tgacaaaaataaca

SEQ ID NO: 126269 - DNA, 16 bp, Homo sapiens
tgacaaaaataacact

SEQ ID NO: 126270 - DNA, 22 bp, Homo sapiens
tgacaaagactcctctgggcct

SEQ ID NO: 126271 - DNA, 14 bp, Homo sapiens
tgacagaaatgcaa

SEQ ID NO: 126272 - DNA, 12 bp, Homo sapiens
tgacagcctccc

SEQ ID NO: 126273 - DNA, 17 bp, Homo sapiens
tgacagcctcccacccc

SEQ ID NO: 126274 - DNA, 19 bp, Homo sapiens
tgacagcctcccaccccca

SEQ ID NO: 126275 - DNA, 17 bp, Homo sapiens
tgacatgcctatatgag

SEQ ID NO: 126276 - DNA, 14 bp, Homo sapiens
tgactcctttccaa

SEQ ID NO: 126277 - DNA, 20 bp, Homo sapiens
tgactcctttccaatagaaa

SEQ ID NO: 126278 - DNA, 22 bp, Homo sapiens
tgagaaaaatagagcaaaatca

SEQ ID NO: 126279 - DNA, 16 bp, Homo sapiens
tgagaaatgaatgctg

SEQ ID NO: 126280 - DNA, 13 bp, Homo sapiens
ggactctgcagat

SEQ ID NO: 126281 - DNA, 16 bp, Homo sapiens
ggactgaagctggggc

SEQ ID NO: 126282 - DNA, 10 bp, Homo sapiens
ggactggggg

SEQ ID NO: 126283 - DNA, 21 bp, Homo sapiens
ggagaactaagtaagaaacac

SEQ ID NO: 126284 - DNA, 20 bp, Homo sapiens
ggagacaataaacagctgaa

SEQ ID NO: 126285 - DNA, 14 bp, Homo sapiens
ggagacaattagca

SEQ ID NO: 126286 - DNA, 17 bp, Homo sapiens
ggagacccacagccctg

SEQ ID NO: 126287 - DNA, 22 bp, Homo sapiens
ggagactgggcacccctgcctc

SEQ ID NO: 126288 - DNA, 22 bp, Homo sapiens
ggagaggcctcggctgtctcct

SEQ ID NO: 126289 - DNA, 22 bp, Homo sapiens
ggagccccagccccgtcccaga

SEQ ID NO: 126290 - DNA, 16 bp, Homo sapiens
ggaggaaggcccaggg

SEQ ID NO: 126291 - DNA, 12 bp, Homo sapiens
ggaggagactgg

SEQ ID NO: 126292 - DNA, 16 bp, Homo sapiens
ggaggagagagggtct

SEQ ID NO: 126293 - DNA, 14 bp, Homo sapiens
ggaggcctctggcc

SEQ ID NO: 126294 - DNA, 20 bp, Homo sapiens
ggaggctccgtgagcccttg

SEQ ID NO: 126295 - DNA, 13 bp, Homo sapiens
ggatataaaagga

SEQ ID NO: 126296 - DNA, 14 bp, Homo sapiens
ggatcaccccagcc

SEQ ID NO: 126297 - DNA, 17 bp, Homo sapiens
ggatcaccccagccccc

SEQ ID NO: 126298 - DNA, 18 bp, Homo sapiens
ggatcaccccagccccca

SEQ ID NO: 126299 - DNA, 19 bp, Homo sapiens
ggatcaccccagcccccac

SEQ ID NO: 126300 - DNA, 12 bp, Homo sapiens
ggatgccctgtt

SEQ ID NO: 126301 - DNA, 19 bp, Homo sapiens
ggatgccctgttgggggct

SEQ ID NO: 126302 - DNA, 17 bp, Homo sapiens
ggcaccagtgcctcagt

SEQ ID NO: 126303 - DNA, 15 bp, Homo sapiens
ggcacccctgcctcc

SEQ ID NO: 126304 - DNA, 18 bp, Homo sapiens
ggcacccctgcctcctgc

SEQ ID NO: 126305 - DNA, 16 bp, Homo sapiens
ggcaccgggctccatg

SEQ ID NO: 126306 - DNA, 23 bp, Homo sapiens
ggcaccgggctccatgcctctgg

SEQ ID NO: 126307 - DNA, 14 bp, Homo sapiens
ggcacttgcctgct

SEQ ID NO: 126308 - DNA, 17 bp, Homo sapiens
ggcagcacagcccaggg

SEQ ID NO: 126309 - DNA, 14 bp, Homo sapiens
ggcagggcctggcg

SEQ ID NO: 126310 - DNA, 18 bp, Homo sapiens
ggcatgggcgcaggccca

SEQ ID NO: 126311 - DNA, 13 bp, Homo sapiens
ggccaaggactcc

SEQ ID NO: 126312 - DNA, 23 bp, Homo sapiens
ggccactggcacttgcctgctgc

SEQ ID NO: 126313 - DNA, 15 bp, Homo sapiens
ggccataattatgaa

SEQ ID NO: 126314 - DNA, 21 bp, Homo sapiens
ggcccagtgacaaagactcct

SEQ ID NO: 126315 - DNA, 22 bp, Homo sapiens
ggcccctggcagcacagcccag

SEQ ID NO: 126316 - DNA, 16 bp, Homo sapiens
ggccctcagctccctg

SEQ ID NO: 126317 - DNA, 17 bp, Homo sapiens
ggccctcagctccctga

SEQ ID NO: 126318 - DNA, 20 bp, Homo sapiens
ggccctcggtggctgcacag

SEQ ID NO: 126319 - DNA, 11 bp, Homo sapiens
ggcccttggaa

SEQ ID NO: 126320 - DNA, 16 bp, Homo sapiens
ggcccttggaataaag

SEQ ID NO: 126321 - DNA, 13 bp, Homo sapiens
ggccgcagccaca

SEQ ID NO: 126322 - DNA, 12 bp, Homo sapiens
ggccgctgcccc

SEQ ID NO: 126323 - DNA, 15 bp, Homo sapiens
ggccgctgcccctga

SEQ ID NO: 126324 - DNA, 19 bp, Homo sapiens
ggccggagacccacagccc

SEQ ID NO: 126325 - DNA, 18 bp, Homo sapiens
ggcctcgacgtcccttgg

SEQ ID NO: 126326 - DNA, 17 bp, Homo sapiens
ggcctcggctgtctcct

SEQ ID NO: 126327 - DNA, 22 bp, Homo sapiens
ggcctgcctgccccacccaccc

SEQ ID NO: 126328 - DNA, 14 bp, Homo sapiens
ggcctggggtgcat

SEQ ID NO: 126329 - DNA, 20 bp, Homo sapiens
ggcctggggtgcatcctcct

SEQ ID NO: 126330 - DNA, 15 bp, Homo sapiens
ggcctgtaatcagct

SEQ ID NO: 126331 - DNA, 19 bp, Homo sapiens
ggccttggcatgggcgcag

SEQ ID NO: 126332 - DNA, 22 bp, Homo sapiens
ggccttggcatgggcgcaggcc

SEQ ID NO: 126333 - DNA, 17 bp, Homo sapiens
ggcgatccacctgtctc

SEQ ID NO: 126334 - DNA, 22 bp, Homo sapiens
ggcgatccacctgtctcagcct

SEQ ID NO: 126335 - DNA, 16 bp, Homo sapiens
ggcgcaggcccagtga

SEQ ID NO: 126336 - DNA, 16 bp, Homo sapiens
ggctccatgcctctgg

SEQ ID NO: 126337 - DNA, 17 bp, Homo sapiens
ggctccatgcctctgga

SEQ ID NO: 126338 - DNA, 18 bp, Homo sapiens
ggctccatgcctctggag

SEQ ID NO: 126339 - DNA, 13 bp, Homo sapiens
ggctgcaaaatta

SEQ ID NO: 126340 - DNA, 17 bp, Homo sapiens
ggctgcaaaattaaatc

SEQ ID NO: 126341 - DNA, 19 bp, Homo sapiens
ggctgcacagaagggctct

SEQ ID NO: 126342 - DNA, 20 bp, Homo sapiens
ggctgttaaccacccgcccc

SEQ ID NO: 126343 - DNA, 19 bp, Homo sapiens
ggcttatttttaaaataaa

SEQ ID NO: 126344 - DNA, 15 bp, Homo sapiens
ggcttggccttggca

SEQ ID NO: 126345 - DNA, 22 bp, Homo sapiens
gggaaaaaactttgctccaggc

SEQ ID NO: 126346 - DNA, 14 bp, Homo sapiens
gggaaaaagagact

SEQ ID NO: 126347 - DNA, 22 bp, Homo sapiens
gggaaggtgggtgaggctgggc

SEQ ID NO: 126348 - DNA, 19 bp, Homo sapiens
gggagacaattagcagaat

SEQ ID NO: 126349 - DNA, 20 bp, Homo sapiens
gggagacaattagcagaatg

SEQ ID NO: 126350 - DNA, 19 bp, Homo sapiens
gggagtgaaacagagaaag

SEQ ID NO: 126351 - DNA, 13 bp, Homo sapiens
gggattccctggt

SEQ ID NO: 126352 - DNA, 19 bp, Homo sapiens
gggattccctggtgggcct

SEQ ID NO: 126353 - DNA, 13 bp, Homo sapiens
gggattgccacta

SEQ ID NO: 126354 - DNA, 18 bp, Homo sapiens
gggcctggcggaggtgga

SEQ ID NO: 126355 - DNA, 15 bp, Homo sapiens
gggcctgggcggggc

SEQ ID NO: 126356 - DNA, 13 bp, Homo sapiens
gggcctggggtgc

SEQ ID NO: 126357 - DNA, 15 bp, Homo sapiens
gggcctggggtgcat

SEQ ID NO: 126358 - DNA, 16 bp, Homo sapiens
gggcgcaggcccagtg

SEQ ID NO: 126359 - DNA, 21 bp, Homo sapiens
gggctattgggccctagagga

SEQ ID NO: 126360 - DNA, 17 bp, Homo sapiens
gggctccatgcctctgg

SEQ ID NO: 126361 - DNA, 22 bp, Homo sapiens
gggctgtgcacccagaagaaga

SEQ ID NO: 126362 - DNA, 18 bp, Homo sapiens
gggcttcgcttccttagc

SEQ ID NO: 126363 - DNA, 14 bp, Homo sapiens
ggggagtgaaacag

SEQ ID NO: 126364 - DNA, 23 bp, Homo sapiens
ggggtgcatcctcctcagccccc

SEQ ID NO: 126365 - DNA, 23 bp, Homo sapiens
gggtcattacttctgagccccag

SEQ ID NO: 126366 - DNA, 21 bp, Homo sapiens
gggtgaagcaccagggagagg

SEQ ID NO: 126367 - DNA, 15 bp, Homo sapiens
gggtgcatcctcctc

SEQ ID NO: 126368 - DNA, 18 bp, Homo sapiens
gggtgcatcctcctcagc

SEQ ID NO: 126369 - DNA, 23 bp, Homo sapiens
gggtgcatcctcctcagccccca

SEQ ID NO: 126370 - DNA, 24 bp, Homo sapiens
gggtgcatcctcctcagcccccag

SEQ ID NO: 126371 - DNA, 22 bp, Homo sapiens
gggtgtgtttggcttggccttg

SEQ ID NO: 126372 - DNA, 13 bp, Homo sapiens
ggtaaatttttga

SEQ ID NO: 126373 - DNA, 16 bp, Homo sapiens
ggtaaatttttgaaaa

SEQ ID NO: 126374 - DNA, 23 bp, Homo sapiens
ggtaacgtgattgattcagtatc

SEQ ID NO: 126375 - DNA, 19 bp, Homo sapiens
ggtatcaactaggggagga

SEQ ID NO: 126376 - DNA, 23 bp, Homo sapiens
ggtcaacatcttttacattctgc

SEQ ID NO: 126377 - DNA, 19 bp, Homo sapiens
ggtccaccggcccctggca

SEQ ID NO: 126378 - DNA, 20 bp, Homo sapiens
ggtccaccggcccctggcag

SEQ ID NO: 126379 - DNA, 15 bp, Homo sapiens
tggagtggccactgg

SEQ ID NO: 126380 - DNA, 19 bp, Homo sapiens
tggagtggccactggcact

SEQ ID NO: 126381 - DNA, 13 bp, Homo sapiens
tcccacccaagga

SEQ ID NO: 126382 - DNA, 14 bp, Homo sapiens
tcccacccaaggag

SEQ ID NO: 126383 - DNA, 12 bp, Homo sapiens
tcccagaggccg

SEQ ID NO: 126384 - DNA, 23 bp, Homo sapiens
tcccagaggccgctgcccctgag

SEQ ID NO: 126385 - DNA, 15 bp, Homo sapiens
tcccagagtgctggg

SEQ ID NO: 126386 - DNA, 15 bp, Homo sapiens
tcccagtgagcctct

SEQ ID NO: 126387 - DNA, 22 bp, Homo sapiens
tcccagtgagcctctgcgcctc

SEQ ID NO: 126388 - DNA, 18 bp, Homo sapiens
tcccattctatgtgtcat

SEQ ID NO: 126389 - DNA, 13 bp, Homo sapiens
tccccaaaagaaa

SEQ ID NO: 126390 - DNA, 22 bp, Homo sapiens
tccccaaaagaaaccatgacaa

SEQ ID NO: 126391 - DNA, 23 bp, Homo sapiens
tccccaaaagaaaccatgacaaa

SEQ ID NO: 126392 - DNA, 16 bp, Homo sapiens
tccccactgacagcct

SEQ ID NO: 126393 - DNA, 16 bp, Homo sapiens
tccccgccccctgaaa

SEQ ID NO: 126394 - DNA, 19 bp, Homo sapiens
tcccctccccgccccctga

SEQ ID NO: 126395 - DNA, 23 bp, Homo sapiens
tcccctccccgccccctgaaaca

SEQ ID NO: 126396 - DNA, 19 bp, Homo sapiens
tcccctctctgtggctcca

SEQ ID NO: 126397 - DNA, 13 bp, Homo sapiens
tcccctgccattt

SEQ ID NO: 126398 - DNA, 20 bp, Homo sapiens
tcccgcctcccgccaccctg

SEQ ID NO: 126399 - DNA, 16 bp, Homo sapiens
tcccgtagtctcctgg

SEQ ID NO: 126400 - DNA, 22 bp, Homo sapiens
tccctcccgtagtctcctgggt

SEQ ID NO: 126401 - DNA, 21 bp, Homo sapiens
tccctgaccccctgtcctagg

SEQ ID NO: 126402 - DNA, 13 bp, Homo sapiens
tccctgctcccag

SEQ ID NO: 126403 - DNA, 18 bp, Homo sapiens
tccctgttggtcggtggg

SEQ ID NO: 126404 - DNA, 15 bp, Homo sapiens
tcccttcctcctctc

SEQ ID NO: 126405 - DNA, 21 bp, Homo sapiens
tccgctggatggggagtctca

SEQ ID NO: 126406 - DNA, 23 bp, Homo sapiens
tccgcttctctcttttaaagtat

SEQ ID NO: 126407 - DNA, 19 bp, Homo sapiens
tccggcggcgagctctggc

SEQ ID NO: 126408 - DNA, 11 bp, Homo sapiens
tccgtgagccc

SEQ ID NO: 126409 - DNA, 13 bp, Homo sapiens
tccgtgagccctt

SEQ ID NO: 126410 - DNA, 14 bp, Homo sapiens
tccgtgagcccttg

SEQ ID NO: 126411 - DNA, 19 bp, Homo sapiens
tcctaatgtgatcatatga

SEQ ID NO: 126412 - DNA, 18 bp, Homo sapiens
tcctagccccacccagag

SEQ ID NO: 126413 - DNA, 13 bp, Homo sapiens
tcctatatctgtt

SEQ ID NO: 126414 - DNA, 19 bp, Homo sapiens
tcctatatctgtttgtata

SEQ ID NO: 126415 - DNA, 12 bp, Homo sapiens
tcctatgcaata

SEQ ID NO: 126416 - DNA, 18 bp, Homo sapiens
tcctcagcccccaggcca

SEQ ID NO: 126417 - DNA, 24 bp, Homo sapiens
tcctcagcccccaggccaggtgag

SEQ ID NO: 126418 - DNA, 20 bp, Homo sapiens
tcctcagctcagctgggcca

SEQ ID NO: 126419 - DNA, 17 bp, Homo sapiens
tcctcccctattttaag

SEQ ID NO: 126420 - DNA, 13 bp, Homo sapiens
tcctcctctcctg

SEQ ID NO: 126421 - DNA, 15 bp, Homo sapiens
tcctcctctcctgga

SEQ ID NO: 126422 - DNA, 22 bp, Homo sapiens
tcctctgatagctgtttcaaat

SEQ ID NO: 126423 - DNA, 15 bp, Homo sapiens
tcctctgggcctggg

SEQ ID NO: 126424 - DNA, 17 bp, Homo sapiens
tcctgcctcccgcctcc

SEQ ID NO: 126425 - DNA, 13 bp, Homo sapiens
tcctggagtctga

SEQ ID NO: 126426 - DNA, 18 bp, Homo sapiens
tcctgtggttttattaca

SEQ ID NO: 126427 - DNA, 23 bp, Homo sapiens
tccttgcacgcgccctttctacc

SEQ ID NO: 126428 - DNA, 15 bp, Homo sapiens
tcctttctgcccagc

SEQ ID NO: 126429 - DNA, 20 bp, Homo sapiens
tcgaaacctgtccataaagt

SEQ ID NO: 126430 - DNA, 20 bp, Homo sapiens
tcgacatcctagccccaccc

SEQ ID NO: 126431 - DNA, 21 bp, Homo sapiens
tcgacatcctagccccaccca

SEQ ID NO: 126432 - DNA, 16 bp, Homo sapiens
tcgacgtcccttggat

SEQ ID NO: 126433 - DNA, 14 bp, Homo sapiens
tcgagcactctaat

SEQ ID NO: 126434 - DNA, 13 bp, Homo sapiens
tcgagtctttgtg

SEQ ID NO: 126435 - DNA, 23 bp, Homo sapiens
tcgatgaatgtgttgatttgaga

SEQ ID NO: 126436 - DNA, 19 bp, Homo sapiens
tcggcaccagtgcctcagt

SEQ ID NO: 126437 - DNA, 14 bp, Homo sapiens
tcggctgtctcctg

SEQ ID NO: 126438 - DNA, 12 bp, Homo sapiens
tcgggattccct

SEQ ID NO: 126439 - DNA, 18 bp, Homo sapiens
tctaaaaattttgcattt

SEQ ID NO: 126440 - DNA, 22 bp, Homo sapiens
tctaatactaatgttatttctt

SEQ ID NO: 126441 - DNA, 12 bp, Homo sapiens
tctaccccacct

SEQ ID NO: 126442 - DNA, 14 bp, Homo sapiens
tctaccccacctga

SEQ ID NO: 126443 - DNA, 12 bp, Homo sapiens
tctaccctgcag

SEQ ID NO: 126444 - DNA, 23 bp, Homo sapiens
tctactgtgtaatataaaagatc

SEQ ID NO: 126445 - DNA, 22 bp, Homo sapiens
tctacttgtcatatcactaaat

SEQ ID NO: 126446 - DNA, 18 bp, Homo sapiens
tctagaacttgaccccct

SEQ ID NO: 126447 - DNA, 17 bp, Homo sapiens
tctagacattcttttaa

SEQ ID NO: 126448 - DNA, 17 bp, Homo sapiens
tctataaatttaagaaa

SEQ ID NO: 126449 - DNA, 20 bp, Homo sapiens
tctataaatttaagaaaaca

SEQ ID NO: 126450 - DNA, 21 bp, Homo sapiens
tctataaatttaagaaaacaa

SEQ ID NO: 126451 - DNA, 12 bp, Homo sapiens
tctatctaatga

SEQ ID NO: 126452 - DNA, 16 bp, Homo sapiens
tctattaagatttcca

SEQ ID NO: 126453 - DNA, 15 bp, Homo sapiens
tctcaccccatccca

SEQ ID NO: 126454 - DNA, 19 bp, Homo sapiens
tctcaccccatcccacacc

SEQ ID NO: 126455 - DNA, 13 bp, Homo sapiens
tctcagcctccca

SEQ ID NO: 126456 - DNA, 22 bp, Homo sapiens
tctcagcgaggtgtaaagttgt

SEQ ID NO: 126457 - DNA, 17 bp, Homo sapiens
tctcagtacctcccctc

SEQ ID NO: 126458 - DNA, 17 bp, Homo sapiens
tctccatttaagacaca

SEQ ID NO: 126459 - DNA, 16 bp, Homo sapiens
tctcccacccaaggag

SEQ ID NO: 126460 - DNA, 12 bp, Homo sapiens
tctccctcccct

SEQ ID NO: 126461 - DNA, 18 bp, Homo sapiens
tctccctcccctgccatt

SEQ ID NO: 126462 - DNA, 15 bp, Homo sapiens
tctctgcatcttcag

SEQ ID NO: 126463 - DNA, 22 bp, Homo sapiens
tctctgtataatctatttacat

SEQ ID NO: 126464 - DNA, 22 bp, Homo sapiens
tctcttttaaagtatttataaa

SEQ ID NO: 126465 - DNA, 21 bp, Homo sapiens
tctgacagccctgcggagacc

SEQ ID NO: 126466 - DNA, 12 bp, Homo sapiens
tctgagccccag

SEQ ID NO: 126467 - DNA, 14 bp, Homo sapiens
tctgagccccagcc

SEQ ID NO: 126468 - DNA, 18 bp, Homo sapiens
tctgatagctgtttcaaa

SEQ ID NO: 126469 - DNA, 13 bp, Homo sapiens
tctgattccactt

SEQ ID NO: 126470 - DNA, 19 bp, Homo sapiens
tctgcaagaattaaaactg

SEQ ID NO: 126471 - DNA, 20 bp, Homo sapiens
tctgcaagaattaaaactga

SEQ ID NO: 126472 - DNA, 21 bp, Homo sapiens
tctgcaagaattaaaactgag

SEQ ID NO: 126473 - DNA, 22 bp, Homo sapiens
tctgcaagaattaaaactgagt

SEQ ID NO: 126474 - DNA, 12 bp, Homo sapiens
tctgcaagaggg

SEQ ID NO: 126475 - DNA, 22 bp, Homo sapiens
tctgcagatagtgcctctgcaa

SEQ ID NO: 126476 - DNA, 13 bp, Homo sapiens
tctgcccagcctg

SEQ ID NO: 126477 - DNA, 18 bp, Homo sapiens
tctgcccagcctgctcag

SEQ ID NO: 126478 - DNA, 20 bp, Homo sapiens
tctgctggcccagccaaacc

SEQ ID NO: 126479 - DNA, 16 bp, Homo sapiens
tctggaggcctctggc

SEQ ID NO: 126480 - DNA, 20 bp, Homo sapiens
tctggaggcctctggccctc

SEQ ID NO: 126481 - DNA, 12 bp, Homo sapiens
tctggcccttgg

SEQ ID NO: 126482 - DNA, 17 bp, Homo sapiens
tctggcccttggaataa

SEQ ID NO: 126483 - DNA, 13 bp, Homo sapiens
tctggttccaaac

SEQ ID NO: 126484 - DNA, 17 bp, Homo sapiens
tctggttccaaaccagt

SEQ ID NO: 126485 - DNA, 17 bp, Homo sapiens
tctgtataatctattta

SEQ ID NO: 126486 - DNA, 15 bp, Homo sapiens
tctgtatactgtaaa

SEQ ID NO: 126487 - DNA, 17 bp, Homo sapiens
tctgtatactgtaaaag

SEQ ID NO: 126488 - DNA, 22 bp, Homo sapiens
tctgtcccaagtcctgctcctt

SEQ ID NO: 126489 - DNA, 17 bp, Homo sapiens
tctgtgaaatgctggca

SEQ ID NO: 126490 - DNA, 21 bp, Homo sapiens
tctgtggttctataataagtt

SEQ ID NO: 126491 - DNA, 15 bp, Homo sapiens
tctgttaagaaagga

SEQ ID NO: 126492 - DNA, 17 bp, Homo sapiens
tcttaaaaactgtgtat

SEQ ID NO: 126493 - DNA, 14 bp, Homo sapiens
tcttaaaatgcaat

SEQ ID NO: 126494 - DNA, 15 bp, Homo sapiens
tcttaaaatgcaata

SEQ ID NO: 126495 - DNA, 22 bp, Homo sapiens
tcttaatatttttacatgcaga

SEQ ID NO: 126496 - DNA, 16 bp, Homo sapiens
tcttagagtttacagt

SEQ ID NO: 126497 - DNA, 17 bp, Homo sapiens
tcttagagtttacagtt

SEQ ID NO: 126498 - DNA, 19 bp, Homo sapiens
tcttcacccaccccatgga

SEQ ID NO: 126499 - DNA, 20 bp, Homo sapiens
tcttcacccaccccatggag

SEQ ID NO: 126500 - DNA, 19 bp, Homo sapiens
tcttcagtcgtctgtccca

SEQ ID NO: 126501 - DNA, 15 bp, Homo sapiens
tcttcccaaatcaaa

SEQ ID NO: 126502 - DNA, 18 bp, Homo sapiens
tcttggcttcttaaaaac

SEQ ID NO: 126503 - DNA, 21 bp, Homo sapiens
tcttggcttcttaaaaactgt

SEQ ID NO: 126504 - DNA, 14 bp, Homo sapiens
tctttaatcactta

SEQ ID NO: 126505 - DNA, 13 bp, Homo sapiens
tctttctctctgc

SEQ ID NO: 126506 - DNA, 14 bp, Homo sapiens
tcttttacattctg

SEQ ID NO: 126507 - DNA, 14 bp, Homo sapiens
tcttttctttgtat

SEQ ID NO: 126508 - DNA, 22 bp, Homo sapiens
tctttttttggtaaatttttga

SEQ ID NO: 126509 - DNA, 23 bp, Homo sapiens
tgaaaaatattgctaaaagtgca

SEQ ID NO: 126510 - DNA, 19 bp, Homo sapiens
tgaaaataccataggaaga

SEQ ID NO: 126511 - DNA, 20 bp, Homo sapiens
tgaaaataccataggaagac

SEQ ID NO: 126512 - DNA, 16 bp, Homo sapiens
tgaaaatcctatatct

SEQ ID NO: 126513 - DNA, 20 bp, Homo sapiens
tgaaaatcctatatctgttt

SEQ ID NO: 126514 - DNA, 22 bp, Homo sapiens
tgaaaatcctatatctgtttgt

SEQ ID NO: 126515 - DNA, 23 bp, Homo sapiens
tgaaaatcctatatctgtttgta

SEQ ID NO: 126516 - DNA, 18 bp, Homo sapiens
tgaaacagagaaagaaaa

SEQ ID NO: 126517 - DNA, 20 bp, Homo sapiens
tgaaacagagaaagaaaagg

SEQ ID NO: 126518 - DNA, 18 bp, Homo sapiens
tgaaacatgtgcccctgc

SEQ ID NO: 126519 - DNA, 20 bp, Homo sapiens
tgaaacatgtgcccctgcca

SEQ ID NO: 126520 - DNA, 22 bp, Homo sapiens
tgaaacatgtgcccctgccaag

SEQ ID NO: 126521 - DNA, 18 bp, Homo sapiens
tgaaacgagaagtgccct

SEQ ID NO: 126522 - DNA, 13 bp, Homo sapiens
tgaaagtattcag

SEQ ID NO: 126523 - DNA, 16 bp, Homo sapiens
tgaaagtgatgacata

SEQ ID NO: 126524 - DNA, 20 bp, Homo sapiens
tgaaagtgatgacatatttt

SEQ ID NO: 126525 - DNA, 18 bp, Homo sapiens
tgaaatcagcatgacaaa

SEQ ID NO: 126526 - DNA, 17 bp, Homo sapiens
tgaacaaaagcttttct

SEQ ID NO: 126527 - DNA, 20 bp, Homo sapiens
tgaacatttactacagtttt

SEQ ID NO: 126528 - DNA, 22 bp, Homo sapiens
tgaacatttactacagttttta

SEQ ID NO: 126529 - DNA, 23 bp, Homo sapiens
tgaactgtttggtcgagtctttg

SEQ ID NO: 126530 - DNA, 21 bp, Homo sapiens
tgaacttccaagctccaaatc

SEQ ID NO: 126531 - DNA, 19 bp, Homo sapiens
tgaacttttacagaatgca

SEQ ID NO: 126532 - DNA, 12 bp, Homo sapiens
tgaacttttgta

SEQ ID NO: 126533 - DNA, 21 bp, Homo sapiens
tgaacttttgtaatttgaatt

SEQ ID NO: 126534 - DNA, 14 bp, Homo sapiens
tgaagcaccaggga

SEQ ID NO: 126535 - DNA, 14 bp, Homo sapiens
tgaagctggccctc

SEQ ID NO: 126536 - DNA, 22 bp, Homo sapiens
tgaagctggccctcagctccct

SEQ ID NO: 126537 - DNA, 16 bp, Homo sapiens
tgaaggaatacaatat

SEQ ID NO: 126538 - DNA, 15 bp, Homo sapiens
tgaagtctagaatca

SEQ ID NO: 126539 - DNA, 11 bp, Homo sapiens
tgaataaaaag

SEQ ID NO: 126540 - DNA, 17 bp, Homo sapiens
tgaataaaaagtgaact

SEQ ID NO: 126541 - DNA, 15 bp, Homo sapiens
tgaatatatggcatt

SEQ ID NO: 126542 - DNA, 21 bp, Homo sapiens
tgaatgccatagtcaaagaga

SEQ ID NO: 126543 - DNA, 14 bp, Homo sapiens
tgaatgctgagacc

SEQ ID NO: 126544 - DNA, 16 bp, Homo sapiens
tgaatgtgttgatttg

SEQ ID NO: 126545 - DNA, 15 bp, Homo sapiens
tgaattgttatgaaa

SEQ ID NO: 126546 - DNA, 16 bp, Homo sapiens
tgaattgttatgaaaa

SEQ ID NO: 126547 - DNA, 22 bp, Homo sapiens
tgacaaacctagcttttaaaaa

SEQ ID NO: 126548 - DNA, 17 bp, Homo sapiens
tgacaaagactcctctg

SEQ ID NO: 126549 - DNA, 19 bp, Homo sapiens
tgacaaagactcctctggg

SEQ ID NO: 126550 - DNA, 18 bp, Homo sapiens
tgacatccagagatgact

SEQ ID NO: 126551 - DNA, 17 bp, Homo sapiens
tgacctctgcaagaggg

SEQ ID NO: 126552 - DNA, 22 bp, Homo sapiens
tgactattacttttctgtttag

SEQ ID NO: 126553 - DNA, 23 bp, Homo sapiens
tgagaaaaatagagcaaaatcaa

SEQ ID NO: 126554 - DNA, 18 bp, Homo sapiens
tgagactgggtctcgctt

SEQ ID NO: 126555 - DNA, 19 bp, Homo sapiens
tgagcacgttggcgaggaa

SEQ ID NO: 126556 - DNA, 21 bp, Homo sapiens
tgagcaggtatcaactagggg

SEQ ID NO: 126557 - DNA, 12 bp, Homo sapiens
tgagccaccacg

SEQ ID NO: 126558 - DNA, 21 bp, Homo sapiens
tgagcccaaacaccctcctgg

SEQ ID NO: 126559 - DNA, 15 bp, Homo sapiens
tgagccccagcccca

SEQ ID NO: 126560 - DNA, 17 bp, Homo sapiens
tgagccccagccccaat

SEQ ID NO: 126561 - DNA, 14 bp, Homo sapiens
tgagcctctgcgcc

SEQ ID NO: 126562 - DNA, 12 bp, Homo sapiens
tgagcctgccca

SEQ ID NO: 126563 - DNA, 12 bp, Homo sapiens
tgagctgggccc

SEQ ID NO: 126564 - DNA, 14 bp, Homo sapiens
tgagctgggcccag

SEQ ID NO: 126565 - DNA, 14 bp, Homo sapiens
tgaggactgaagct

SEQ ID NO: 126566 - DNA, 21 bp, Homo sapiens
tgagggtgcttgttccctctc

SEQ ID NO: 126567 - DNA, 19 bp, Homo sapiens
tgaggtccaccggcccctg

SEQ ID NO: 126568 - DNA, 14 bp, Homo sapiens
tgagtgtaaataat

SEQ ID NO: 126569 - DNA, 16 bp, Homo sapiens
tgagtgtaaataattt

SEQ ID NO: 126570 - DNA, 15 bp, Homo sapiens
tgagttctgacactg

SEQ ID NO: 126571 - DNA, 18 bp, Homo sapiens
tgagtttcagaataaaat

SEQ ID NO: 126572 - DNA, 19 bp, Homo sapiens
tgataactgcaattttaat

SEQ ID NO: 126573 - DNA, 14 bp, Homo sapiens
tgatagctgtttca

SEQ ID NO: 126574 - DNA, 16 bp, Homo sapiens
tgatattttccctttt

SEQ ID NO: 126575 - DNA, 15 bp, Homo sapiens
tgatcataagtctaa

SEQ ID NO: 126576 - DNA, 21 bp, Homo sapiens
tgatcataagtctaaataaat

SEQ ID NO: 126577 - DNA, 22 bp, Homo sapiens
tgatcccctctctgtggctcca

SEQ ID NO: 126578 - DNA, 21 bp, Homo sapiens
tgatcttggcttactgcagcc

SEQ ID NO: 126579 - DNA, 15 bp, Homo sapiens
tgatgagtaaactga

SEQ ID NO: 126580 - DNA, 14 bp, Homo sapiens
tgattcagtatctt

SEQ ID NO: 126581 - DNA, 22 bp, Homo sapiens
tgattcagtatcttagagttta

SEQ ID NO: 126582 - DNA, 15 bp, Homo sapiens
tgattccacttttat

SEQ ID NO: 126583 - DNA, 17 bp, Homo sapiens
ggtcccgcttagttctt

SEQ ID NO: 126584 - DNA, 18 bp, Homo sapiens
ggtctcacagtgttgccc

SEQ ID NO: 126585 - DNA, 19 bp, Homo sapiens
ggtctcacagtgttgccca

SEQ ID NO: 126586 - DNA, 21 bp, Homo sapiens
ggtctcgctttgttgcccagg

SEQ ID NO: 126587 - DNA, 23 bp, Homo sapiens
ggtctttaaatcattttaggaaa

SEQ ID NO: 126588 - DNA, 21 bp, Homo sapiens
ggtgaacagcaggatgccctg

SEQ ID NO: 126589 - DNA, 18 bp, Homo sapiens
ggtgaagcaccagggaga

SEQ ID NO: 126590 - DNA, 20 bp, Homo sapiens
ggtgcatcctcctcagcccc

SEQ ID NO: 126591 - DNA, 21 bp, Homo sapiens
ggtgcatcctcctcagccccc

SEQ ID NO: 126592 - DNA, 18 bp, Homo sapiens
ggttccaaaccagtttat

SEQ ID NO: 126593 - DNA, 21 bp, Homo sapiens
ggtttcccagtgagcctctgc

SEQ ID NO: 126594 - DNA, 12 bp, Homo sapiens
ggtttgtttgct

SEQ ID NO: 126595 - DNA, 21 bp, Homo sapiens
ggtttgtttgcttaatttcct

SEQ ID NO: 126596 - DNA, 12 bp, Homo sapiens
ggtttttctccc

SEQ ID NO: 126597 - DNA, 20 bp, Homo sapiens
gtaaaaagattatatatcat

SEQ ID NO: 126598 - DNA, 20 bp, Homo sapiens
gtaaaacaaaaatgtaatga

SEQ ID NO: 126599 - DNA, 20 bp, Homo sapiens
gtaaaagttataataactga

SEQ ID NO: 126600 - DNA, 20 bp, Homo sapiens
gtaaaattgagtttcagaat

SEQ ID NO: 126601 - DNA, 15 bp, Homo sapiens
gtaaacttggaatca

SEQ ID NO: 126602 - DNA, 17 bp, Homo sapiens
gtaaacttggaatcaag

SEQ ID NO: 126603 - DNA, 12 bp, Homo sapiens
gtaaataatttt

SEQ ID NO: 126604 - DNA, 20 bp, Homo sapiens
gtaaatttttgaaaaatatt

SEQ ID NO: 126605 - DNA, 17 bp, Homo sapiens
gtaacgtgattgattca

SEQ ID NO: 126606 - DNA, 12 bp, Homo sapiens
gtaagtcttttt

SEQ ID NO: 126607 - DNA, 23 bp, Homo sapiens
gtaagtcttttttttttccaaat

SEQ ID NO: 126608 - DNA, 18 bp, Homo sapiens
gtaatcagctctcctggc

SEQ ID NO: 126609 - DNA, 15 bp, Homo sapiens
gtaatgaagaatcac

SEQ ID NO: 126610 - DNA, 17 bp, Homo sapiens
gtaattaactgtaaact

SEQ ID NO: 126611 - DNA, 16 bp, Homo sapiens
gtacaaagatatgcta

SEQ ID NO: 126612 - DNA, 23 bp, Homo sapiens
gtacaatcgacatcctagcccca

SEQ ID NO: 126613 - DNA, 19 bp, Homo sapiens
gtacattttgtaaaatatt

SEQ ID NO: 126614 - DNA, 15 bp, Homo sapiens
gtacctcccctcccc

SEQ ID NO: 126615 - DNA, 16 bp, Homo sapiens
gtacgttatatattgt

SEQ ID NO: 126616 - DNA, 17 bp, Homo sapiens
gtacttttctggttcca

SEQ ID NO: 126617 - DNA, 17 bp, Homo sapiens
gtagactgtttcacatt

SEQ ID NO: 126618 - DNA, 16 bp, Homo sapiens
gtaggctgcaaaatta

SEQ ID NO: 126619 - DNA, 14 bp, Homo sapiens
gtagtagtgtcttc

SEQ ID NO: 126620 - DNA, 13 bp, Homo sapiens
gtagtctcctggg

SEQ ID NO: 126621 - DNA, 11 bp, Homo sapiens
gtagtgtcttc

SEQ ID NO: 126622 - DNA, 14 bp, Homo sapiens
gtataaaaaggaaa

SEQ ID NO: 126623 - DNA, 14 bp, Homo sapiens
gtataatctattta

SEQ ID NO: 126624 - DNA, 17 bp, Homo sapiens
gtatactactgctttgc

SEQ ID NO: 126625 - DNA, 16 bp, Homo sapiens
gtatactgtaaaagtt

SEQ ID NO: 126626 - DNA, 20 bp, Homo sapiens
gtatactgtaaaagttataa

SEQ ID NO: 126627 - DNA, 13 bp, Homo sapiens
gtatagttgcttt

SEQ ID NO: 126628 - DNA, 19 bp, Homo sapiens
gtatataatttactttgta

SEQ ID NO: 126629 - DNA, 21 bp, Homo sapiens
gtatatttgcaaaccctttgt

SEQ ID NO: 126630 - DNA, 22 bp, Homo sapiens
gtatcattaaaatatatgttct

SEQ ID NO: 126631 - DNA, 15 bp, Homo sapiens
gtatcttagagttta

SEQ ID NO: 126632 - DNA, 19 bp, Homo sapiens
gtattaagggcattttaaa

SEQ ID NO: 126633 - DNA, 15 bp, Homo sapiens
gtattcagaaattaa

SEQ ID NO: 126634 - DNA, 21 bp, Homo sapiens
gtatttataaaaatataaatt

SEQ ID NO: 126635 - DNA, 13 bp, Homo sapiens
gtattttcttccc

SEQ ID NO: 126636 - DNA, 14 bp, Homo sapiens
gtcaaatgaacttt

SEQ ID NO: 126637 - DNA, 15 bp, Homo sapiens
gtcaaatgaactttt

SEQ ID NO: 126638 - DNA, 20 bp, Homo sapiens
gtcaagaggtttttctcccc

SEQ ID NO: 126639 - DNA, 22 bp, Homo sapiens
gtcaagattttttttgtaactt

SEQ ID NO: 126640 - DNA, 17 bp, Homo sapiens
gtcaagtctctgctggc

SEQ ID NO: 126641 - DNA, 21 bp, Homo sapiens
gtcaagtctctgctggcccag

SEQ ID NO: 126642 - DNA, 15 bp, Homo sapiens
gtcacaaatttctct

SEQ ID NO: 126643 - DNA, 23 bp, Homo sapiens
gtcatcccttcctcctctcctgg

SEQ ID NO: 126644 - DNA, 21 bp, Homo sapiens
gtcattacttctgagccccag

SEQ ID NO: 126645 - DNA, 23 bp, Homo sapiens
gtcattacttctgagccccagcc

SEQ ID NO: 126646 - DNA, 16 bp, Homo sapiens
gtccaagacacatgct

SEQ ID NO: 126647 - DNA, 14 bp, Homo sapiens
gtccaccggcccct

SEQ ID NO: 126648 - DNA, 15 bp, Homo sapiens
gtccaccggcccctg

SEQ ID NO: 126649 - DNA, 18 bp, Homo sapiens
gtccaccggcccctggca

SEQ ID NO: 126650 - DNA, 17 bp, Homo sapiens
gtccatgaaaataccat

SEQ ID NO: 126651 - DNA, 23 bp, Homo sapiens
gtcccaagtcctgctcctttctg

SEQ ID NO: 126652 - DNA, 15 bp, Homo sapiens
gtccccctagagact

SEQ ID NO: 126653 - DNA, 16 bp, Homo sapiens
gtccccctagagactc

SEQ ID NO: 126654 - DNA, 23 bp, Homo sapiens
gtccccggcggggtgcctgctgt

SEQ ID NO: 126655 - DNA, 13 bp, Homo sapiens
gtcctaggtcatg

SEQ ID NO: 126656 - DNA, 17 bp, Homo sapiens
gtcctaggtcatgaagg

SEQ ID NO: 126657 - DNA, 13 bp, Homo sapiens
gtcctatgcaata

SEQ ID NO: 126658 - DNA, 14 bp, Homo sapiens
gtcctatgcaataa

SEQ ID NO: 126659 - DNA, 20 bp, Homo sapiens
gtcctatgcaataaaattat

SEQ ID NO: 126660 - DNA, 13 bp, Homo sapiens
gtcctggaccctg

SEQ ID NO: 126661 - DNA, 13 bp, Homo sapiens
gtcgagcactcta

SEQ ID NO: 126662 - DNA, 16 bp, Homo sapiens
gtcgagtctttgtgtg

SEQ ID NO: 126663 - DNA, 18 bp, Homo sapiens
gtctcagtacctcccctc

SEQ ID NO: 126664 - DNA, 18 bp, Homo sapiens
gtctccagtgttcccccc

SEQ ID NO: 126665 - DNA, 15 bp, Homo sapiens
gtctcctgtccccgg

SEQ ID NO: 126666 - DNA, 17 bp, Homo sapiens
gtctcctgtccccggcg

SEQ ID NO: 126667 - DNA, 19 bp, Homo sapiens
gtctcgctttgttgcccag

SEQ ID NO: 126668 - DNA, 20 bp, Homo sapiens
gtctctgctggcccagccaa

SEQ ID NO: 126669 - DNA, 17 bp, Homo sapiens
gtctctgtataatctat

SEQ ID NO: 126670 - DNA, 17 bp, Homo sapiens
gtctgaagcctgcaggt

SEQ ID NO: 126671 - DNA, 16 bp, Homo sapiens
gtctggggtaaaattg

SEQ ID NO: 126672 - DNA, 21 bp, Homo sapiens
gtctgtcccaagtcctgctcc

SEQ ID NO: 126673 - DNA, 18 bp, Homo sapiens
gtcttataggtttccact

SEQ ID NO: 126674 - DNA, 23 bp, Homo sapiens
gtctttttctttttttggtaaat

SEQ ID NO: 126675 - DNA, 19 bp, Homo sapiens
gtcttttttttttccaaat

SEQ ID NO: 126676 - DNA, 13 bp, Homo sapiens
gtgaaacagagaa

SEQ ID NO: 126677 - DNA, 15 bp, Homo sapiens
gtgaacttttgtaat

SEQ ID NO: 126678 - DNA, 23 bp, Homo sapiens
gtgaacttttgtaatttgaattg

SEQ ID NO: 126679 - DNA, 17 bp, Homo sapiens
gtgacaaagactcctct

SEQ ID NO: 126680 - DNA, 19 bp, Homo sapiens
gtgacaaagactcctctgg

SEQ ID NO: 126681 - DNA, 21 bp, Homo sapiens
gtgacaaagactcctctgggc

SEQ ID NO: 126682 - DNA, 18 bp, Homo sapiens
gtgaccaatcctgttttt

SEQ ID NO: 126683 - DNA, 12 bp, Homo sapiens
gtgagcctctgc

SEQ ID NO: 126684 - DNA, 16 bp, Homo sapiens
tgggccactcctcttc

SEQ ID NO: 126685 - DNA, 18 bp, Homo sapiens
tgggccataattatgaaa

SEQ ID NO: 126686 - DNA, 14 bp, Homo sapiens
tgggcccagcccct

SEQ ID NO: 126687 - DNA, 13 bp, Homo sapiens
tgggcgcaggccc

SEQ ID NO: 126688 - DNA, 17 bp, Homo sapiens
tgggcgcaggcccagtg

SEQ ID NO: 126689 - DNA, 18 bp, Homo sapiens
tgggcgcttcccacctgc

SEQ ID NO: 126690 - DNA, 16 bp, Homo sapiens
tggggaccccctcagg

SEQ ID NO: 126691 - DNA, 23 bp, Homo sapiens
tgggggcaccgggctccatgcct

SEQ ID NO: 126692 - DNA, 15 bp, Homo sapiens
tggggtgcatcctcc

SEQ ID NO: 126693 - DNA, 16 bp, Homo sapiens
tggggtggtgctgggt

SEQ ID NO: 126694 - DNA, 20 bp, Homo sapiens
tgggtctcgctttgttgccc

SEQ ID NO: 126695 - DNA, 17 bp, Homo sapiens
tgggtgaggctgggcag

SEQ ID NO: 126696 - DNA, 18 bp, Homo sapiens
tggtaaaaagattatata

SEQ ID NO: 126697 - DNA, 23 bp, Homo sapiens
tggtaaaaagattatatatcata

SEQ ID NO: 126698 - DNA, 18 bp, Homo sapiens
tggtaaatttttgaaaaa

SEQ ID NO: 126699 - DNA, 22 bp, Homo sapiens
tggtaaatttttgaaaaatatt

SEQ ID NO: 126700 - DNA, 23 bp, Homo sapiens
tggtatttatctgcaaggttgta

SEQ ID NO: 126701 - DNA, 17 bp, Homo sapiens
tggtcaccttcctcagc

SEQ ID NO: 126702 - DNA, 23 bp, Homo sapiens
tggtcccaagtagtagtgtcttc

SEQ ID NO: 126703 - DNA, 21 bp, Homo sapiens
tggttccaaaccagtttattc

SEQ ID NO: 126704 - DNA, 17 bp, Homo sapiens
tggttttattacaaatg

SEQ ID NO: 126705 - DNA, 23 bp, Homo sapiens
tgtaaaacaaaaatgtaatgatc

SEQ ID NO: 126706 - DNA, 12 bp, Homo sapiens
tgtaacttcaaa

SEQ ID NO: 126707 - DNA, 21 bp, Homo sapiens
tgtaaggcttgttccaatgcc

SEQ ID NO: 126708 - DNA, 12 bp, Homo sapiens
tgtaagtttaat

SEQ ID NO: 126709 - DNA, 13 bp, Homo sapiens
tgtaatgatcata

SEQ ID NO: 126710 - DNA, 17 bp, Homo sapiens
tgtaattaactgtaaac

SEQ ID NO: 126711 - DNA, 19 bp, Homo sapiens
tgtacctctagctgttctt

SEQ ID NO: 126712 - DNA, 20 bp, Homo sapiens
tgtacttttctggttccaaa

SEQ ID NO: 126713 - DNA, 14 bp, Homo sapiens
tgtagtcaagaggt

SEQ ID NO: 126714 - DNA, 17 bp, Homo sapiens
tgtataaaaaggaaatt

SEQ ID NO: 126715 - DNA, 18 bp, Homo sapiens
tgtatactgtaaaagtta

SEQ ID NO: 126716 - DNA, 13 bp, Homo sapiens
tgtatagttgctt

SEQ ID NO: 126717 - DNA, 12 bp, Homo sapiens
tgtatatagttt

SEQ ID NO: 126718 - DNA, 13 bp, Homo sapiens
tgtatatttgcaa

SEQ ID NO: 126719 - DNA, 13 bp, Homo sapiens
tgtatcattaaaa

SEQ ID NO: 126720 - DNA, 17 bp, Homo sapiens
tgtatcattaaaatata

SEQ ID NO: 126721 - DNA, 23 bp, Homo sapiens
tgtatcattaaaatatatgttct

SEQ ID NO: 126722 - DNA, 17 bp, Homo sapiens
tgtattcaattaaagaa

SEQ ID NO: 126723 - DNA, 14 bp, Homo sapiens
tgtattcttaaaat

SEQ ID NO: 126724 - DNA, 22 bp, Homo sapiens
tgtattcttaaaatgcaatatt

SEQ ID NO: 126725 - DNA, 14 bp, Homo sapiens
tgtcaaatgaactt

SEQ ID NO: 126726 - DNA, 15 bp, Homo sapiens
tgtcaaatgaacttt

SEQ ID NO: 126727 - DNA, 21 bp, Homo sapiens
tgtcaaatgaacttttacaga

SEQ ID NO: 126728 - DNA, 18 bp, Homo sapiens
tgtcataaactttctcca

SEQ ID NO: 126729 - DNA, 23 bp, Homo sapiens
tgtcatcaatagtgtcctatgca

SEQ ID NO: 126730 - DNA, 23 bp, Homo sapiens
tgtccataaagtaattttgtgaa

SEQ ID NO: 126731 - DNA, 21 bp, Homo sapiens
tgtccctcactgttgaatttt

SEQ ID NO: 126732 - DNA, 16 bp, Homo sapiens
tgtcctggaccctggc

SEQ ID NO: 126733 - DNA, 17 bp, Homo sapiens
tgtcctggaccctggcc

SEQ ID NO: 126734 - DNA, 12 bp, Homo sapiens
tgtcctgtgtct

SEQ ID NO: 126735 - DNA, 16 bp, Homo sapiens
tgtccttgaatgccat

SEQ ID NO: 126736 - DNA, 19 bp, Homo sapiens
tgtcttataggtttccact

SEQ ID NO: 126737 - DNA, 22 bp, Homo sapiens
tgtcttcctagtatattagttt

SEQ ID NO: 126738 - DNA, 19 bp, Homo sapiens
tgtgaaattcaacctgtgt

SEQ ID NO: 126739 - DNA, 17 bp, Homo sapiens
tgtgaatttcaaaaaaa

SEQ ID NO: 126740 - DNA, 21 bp, Homo sapiens
tgtgcacctatggcccagcca

SEQ ID NO: 126741 - DNA, 12 bp, Homo sapiens
tgtgcccctgcc

SEQ ID NO: 126742 - DNA, 13 bp, Homo sapiens
tgtgcccctgcca

SEQ ID NO: 126743 - DNA, 14 bp, Homo sapiens
tgtgctgagcctgc

SEQ ID NO: 126744 - DNA, 16 bp, Homo sapiens
tgtgctgagcctgccc

SEQ ID NO: 126745 - DNA, 22 bp, Homo sapiens
tgtggttctataataagttttg

SEQ ID NO: 126746 - DNA, 18 bp, Homo sapiens
tgtgtatcattaaaatat

SEQ ID NO: 126747 - DNA, 16 bp, Homo sapiens
tgtgtctatgtacctc

SEQ ID NO: 126748 - DNA, 19 bp, Homo sapiens
tgtgtgatggagggaaggg

SEQ ID NO: 126749 - DNA, 13 bp, Homo sapiens
tgtgttatattcc

SEQ ID NO: 126750 - DNA, 19 bp, Homo sapiens
tgtgttttaaaaaaactga

SEQ ID NO: 126751 - DNA, 14 bp, Homo sapiens
tgttaattgattaa

SEQ ID NO: 126752 - DNA, 18 bp, Homo sapiens
tgttaattgattaaaatc

SEQ ID NO: 126753 - DNA, 13 bp, Homo sapiens
tgttactaaagtc

SEQ ID NO: 126754 - DNA, 22 bp, Homo sapiens
tgttactaaagtcacatataaa

SEQ ID NO: 126755 - DNA, 20 bp, Homo sapiens
tgttatattccaaggaaaat

SEQ ID NO: 126756 - DNA, 21 bp, Homo sapiens
tgttatattccaaggaaaatt

SEQ ID NO: 126757 - DNA, 12 bp, Homo sapiens
tgttatgaaaat

SEQ ID NO: 126758 - DNA, 21 bp, Homo sapiens
tgttatgaaaatcctatatct

SEQ ID NO: 126759 - DNA, 20 bp, Homo sapiens
tgttccaatgccacatactt

SEQ ID NO: 126760 - DNA, 18 bp, Homo sapiens
tgttccctctccctgttg

SEQ ID NO: 126761 - DNA, 18 bp, Homo sapiens
tgttctgcaagaattaaa

SEQ ID NO: 126762 - DNA, 19 bp, Homo sapiens
tgttgcccgccctccaccc

SEQ ID NO: 126763 - DNA, 15 bp, Homo sapiens
tgttggttgcacttt

SEQ ID NO: 126764 - DNA, 19 bp, Homo sapiens
tgttggttgcactttgtag

SEQ ID NO: 126765 - DNA, 23 bp, Homo sapiens
tgttgtacatacagaggtaacta

SEQ ID NO: 126766 - DNA, 20 bp, Homo sapiens
tgtttaaaaaaagtatatat

SEQ ID NO: 126767 - DNA, 14 bp, Homo sapiens
tgtttagttttaca

SEQ ID NO: 126768 - DNA, 16 bp, Homo sapiens
tgtttcatgagcccaa

SEQ ID NO: 126769 - DNA, 22 bp, Homo sapiens
tgtttctcggcaccagtgcctc

SEQ ID NO: 126770 - DNA, 11 bp, Homo sapiens
tgttttgctta

SEQ ID NO: 126771 - DNA, 15 bp, Homo sapiens
ttaaaaaaactgaag

SEQ ID NO: 126772 - DNA, 22 bp, Homo sapiens
ttaaaaaaagtatatattctac

SEQ ID NO: 126773 - DNA, 15 bp, Homo sapiens
ttaaaaaataccatt

SEQ ID NO: 126774 - DNA, 17 bp, Homo sapiens
ttaaaaaatattttaag

SEQ ID NO: 126775 - DNA, 19 bp, Homo sapiens
ttaaaaaatattttaagaa

SEQ ID NO: 126776 - DNA, 23 bp, Homo sapiens
ttaaaactgagtccatgaaaata

SEQ ID NO: 126777 - DNA, 16 bp, Homo sapiens
ttaaaataaaataatt

SEQ ID NO: 126778 - DNA, 23 bp, Homo sapiens
ttaaaatatatgttctgcaagaa

SEQ ID NO: 126779 - DNA, 21 bp, Homo sapiens
ttaaaatattatttgatatct

SEQ ID NO: 126780 - DNA, 12 bp, Homo sapiens
ttaaaatgcaat

SEQ ID NO: 126781 - DNA, 23 bp, Homo sapiens
ttaaaatgcaatatttgtaaggc

SEQ ID NO: 126782 - DNA, 13 bp, Homo sapiens
ttaaagaagacat

SEQ ID NO: 126783 - DNA, 20 bp, Homo sapiens
ttaaataacctctggccctt

SEQ ID NO: 126784 - DNA, 14 bp, Homo sapiens
ttaacaaaaaatgt

SEQ ID NO: 126785 - DNA, 21 bp, Homo sapiens
ttgtacattttgtaaaatatt

SEQ ID NO: 126786 - DNA, 18 bp, Homo sapiens
ttgtacgttatatattgt

SEQ ID NO: 126787 - DNA, 22 bp, Homo sapiens
gtgatcttggcttactgcagcc

SEQ ID NO: 126788 - DNA, 19 bp, Homo sapiens
gtgattgattcagtatctt

SEQ ID NO: 126789 - DNA, 13 bp, Homo sapiens
gtgcccctgccaa

SEQ ID NO: 126790 - DNA, 20 bp, Homo sapiens
gtgcccttaaggatcacccc

SEQ ID NO: 126791 - DNA, 22 bp, Homo sapiens
gtgcccttaaggatcaccccag

SEQ ID NO: 126792 - DNA, 14 bp, Homo sapiens
gtgctgagcctgcc

SEQ ID NO: 126793 - DNA, 15 bp, Homo sapiens
gtgctgagcctgccc

SEQ ID NO: 126794 - DNA, 16 bp, Homo sapiens
gtgctgagcctgccca

SEQ ID NO: 126795 - DNA, 18 bp, Homo sapiens
gtggccctcccaggctgg

SEQ ID NO: 126796 - DNA, 20 bp, Homo sapiens
gtggcttcttttctttgtat

SEQ ID NO: 126797 - DNA, 20 bp, Homo sapiens
gtgggtgggaatgcaagtga

SEQ ID NO: 126798 - DNA, 17 bp, Homo sapiens
gtggttctataataagt

SEQ ID NO: 126799 - DNA, 12 bp, Homo sapiens
gtgtatcattaa

SEQ ID NO: 126800 - DNA, 14 bp, Homo sapiens
gtgtatcattaaaa

SEQ ID NO: 126801 - DNA, 22 bp, Homo sapiens
gtgtatcattaaaatatatgtt

SEQ ID NO: 126802 - DNA, 17 bp, Homo sapiens
gtgtcctggaccctggc

SEQ ID NO: 126803 - DNA, 19 bp, Homo sapiens
gtgtcctggaccctggcct

SEQ ID NO: 126804 - DNA, 20 bp, Homo sapiens
gtgtgtttggcttggccttg

SEQ ID NO: 126805 - DNA, 21 bp, Homo sapiens
gtgttccccccatagagacca

SEQ ID NO: 126806 - DNA, 18 bp, Homo sapiens
gtgttgatttgagaaatt

SEQ ID NO: 126807 - DNA, 23 bp, Homo sapiens
gtgttgtatctacagtaatgaaa

SEQ ID NO: 126808 - DNA, 22 bp, Homo sapiens
gttaagaaaggatataaaagga

SEQ ID NO: 126809 - DNA, 19 bp, Homo sapiens
gttaattgattaaaatctg

SEQ ID NO: 126810 - DNA, 12 bp, Homo sapiens
gttacaagtttg

SEQ ID NO: 126811 - DNA, 23 bp, Homo sapiens
gttacaagtttgctaaaagaaga

SEQ ID NO: 126812 - DNA, 14 bp, Homo sapiens
gttataattttcct

SEQ ID NO: 126813 - DNA, 16 bp, Homo sapiens
gttatatattgtatta

SEQ ID NO: 126814 - DNA, 16 bp, Homo sapiens
gttcgccgcgtggaat

SEQ ID NO: 126815 - DNA, 14 bp, Homo sapiens
gttcgggattccct

SEQ ID NO: 126816 - DNA, 15 bp, Homo sapiens
gttcgggattccctg

SEQ ID NO: 126817 - DNA, 18 bp, Homo sapiens
gttctataataagttttg

SEQ ID NO: 126818 - DNA, 18 bp, Homo sapiens
gttctgcaagaattaaaa

SEQ ID NO: 126819 - DNA, 22 bp, Homo sapiens
gttctgcaagaattaaaactga

SEQ ID NO: 126820 - DNA, 16 bp, Homo sapiens
gttcttgaattgttat

SEQ ID NO: 126821 - DNA, 22 bp, Homo sapiens
gttcttgaattgttatgaaaat

SEQ ID NO: 126822 - DNA, 18 bp, Homo sapiens
gttgaatgggttctcagt

SEQ ID NO: 126823 - DNA, 22 bp, Homo sapiens
gttgcagatctttttgtgaaat

SEQ ID NO: 126824 - DNA, 20 bp, Homo sapiens
gttgcccgccctccacccac

SEQ ID NO: 126825 - DNA, 13 bp, Homo sapiens
gttggaggagact

SEQ ID NO: 126826 - DNA, 14 bp, Homo sapiens
gttggcacttatag

SEQ ID NO: 126827 - DNA, 15 bp, Homo sapiens
gttgggtcccttgct

SEQ ID NO: 126828 - DNA, 13 bp, Homo sapiens
gttggtagtttct

SEQ ID NO: 126829 - DNA, 16 bp, Homo sapiens
gttggtcggtgggttg

SEQ ID NO: 126830 - DNA, 21 bp, Homo sapiens
gttgtatctacagtaatgaaa

SEQ ID NO: 126831 - DNA, 17 bp, Homo sapiens
gtttaaaaaaagtatat

SEQ ID NO: 126832 - DNA, 20 bp, Homo sapiens
gtttaaaaaaagtatatatt

SEQ ID NO: 126833 - DNA, 22 bp, Homo sapiens
gtttaaaaaaagtatatattct

SEQ ID NO: 126834 - DNA, 15 bp, Homo sapiens
gtttaagagttttcc

SEQ ID NO: 126835 - DNA, 14 bp, Homo sapiens
gtttaatagaaaat

SEQ ID NO: 126836 - DNA, 17 bp, Homo sapiens
gtttaatagaaaattaa

SEQ ID NO: 126837 - DNA, 21 bp, Homo sapiens
gtttaatagaaaattaaaata

SEQ ID NO: 126838 - DNA, 22 bp, Homo sapiens
gtttaatagaaaattaaaataa

SEQ ID NO: 126839 - DNA, 15 bp, Homo sapiens
gtttagttttacact

SEQ ID NO: 126840 - DNA, 16 bp, Homo sapiens
gtttagttttacacta

SEQ ID NO: 126841 - DNA, 13 bp, Homo sapiens
gtttattctgtgg

SEQ ID NO: 126842 - DNA, 13 bp, Homo sapiens
gtttcagaataaa

SEQ ID NO: 126843 - DNA, 18 bp, Homo sapiens
gtttcccagtgagcctct

SEQ ID NO: 126844 - DNA, 23 bp, Homo sapiens
gtttctcggcaccagtgcctcag

SEQ ID NO: 126845 - DNA, 16 bp, Homo sapiens
gtttgctaaaagaaga

SEQ ID NO: 126846 - DNA, 18 bp, Homo sapiens
gtttgctaaaagaagaga

SEQ ID NO: 126847 - DNA, 20 bp, Homo sapiens
gtttgctaaaagaagagagg

SEQ ID NO: 126848 - DNA, 14 bp, Homo sapiens
gtttgtatatttgc

SEQ ID NO: 126849 - DNA, 15 bp, Homo sapiens
gtttgtatatttgca

SEQ ID NO: 126850 - DNA, 21 bp, Homo sapiens
gtttgtgttttaaaaaaactg

SEQ ID NO: 126851 - DNA, 22 bp, Homo sapiens
gtttgtgttttaaaaaaactga

SEQ ID NO: 126852 - DNA, 14 bp, Homo sapiens
gtttgtttgcttaa

SEQ ID NO: 126853 - DNA, 14 bp, Homo sapiens
gtttttaactctac

SEQ ID NO: 126854 - DNA, 13 bp, Homo sapiens
gtttttaatagaa

SEQ ID NO: 126855 - DNA, 18 bp, Homo sapiens
taaaaaaaaaaagattgt

SEQ ID NO: 126856 - DNA, 11 bp, Homo sapiens
taaaaaaactg

SEQ ID NO: 126857 - DNA, 13 bp, Homo sapiens
taaaaaaactgaa

SEQ ID NO: 126858 - DNA, 19 bp, Homo sapiens
taaaaaaactgaaggtttt

SEQ ID NO: 126859 - DNA, 14 bp, Homo sapiens
taaaaaaagtatat

SEQ ID NO: 126860 - DNA, 18 bp, Homo sapiens
taaaaaaagtatatattc

SEQ ID NO: 126861 - DNA, 12 bp, Homo sapiens
taaaaaatacca

SEQ ID NO: 126862 - DNA, 18 bp, Homo sapiens
taaaaaataccattgaaa

SEQ ID NO: 126863 - DNA, 20 bp, Homo sapiens
taaaaaataccattgaaatc

SEQ ID NO: 126864 - DNA, 19 bp, Homo sapiens
taaaaaatattttaagaaa

SEQ ID NO: 126865 - DNA, 20 bp, Homo sapiens
taaaaaatgtgtgtattctt

SEQ ID NO: 126866 - DNA, 22 bp, Homo sapiens
taaaaacaaaaacatcccaaga

SEQ ID NO: 126867 - DNA, 11 bp, Homo sapiens
taaaaactgtg

SEQ ID NO: 126868 - DNA, 12 bp, Homo sapiens
taaaaactgtgt

SEQ ID NO: 126869 - DNA, 12 bp, Homo sapiens
taaaaagattat

SEQ ID NO: 126870 - DNA, 20 bp, Homo sapiens
taaaaatataaattgtacat

SEQ ID NO: 126871 - DNA, 17 bp, Homo sapiens
taaaaattttgcatttc

SEQ ID NO: 126872 - DNA, 19 bp, Homo sapiens
taaaactttaaaaggcaac

SEQ ID NO: 126873 - DNA, 12 bp, Homo sapiens
taaaagaagaga

SEQ ID NO: 126874 - DNA, 21 bp, Homo sapiens
taaaagaagagaggggaagaa

SEQ ID NO: 126875 - DNA, 21 bp, Homo sapiens
taaaaggaaatctcaccccat

SEQ ID NO: 126876 - DNA, 12 bp, Homo sapiens
taaaaggatgtt

SEQ ID NO: 126877 - DNA, 15 bp, Homo sapiens
taaaaggatgttaca

SEQ ID NO: 126878 - DNA, 15 bp, Homo sapiens
taaaagtgcatttaa

SEQ ID NO: 126879 - DNA, 17 bp, Homo sapiens
taaaagtgcatttaagg

SEQ ID NO: 126880 - DNA, 13 bp, Homo sapiens
taaaataaaaata

SEQ ID NO: 126881 - DNA, 14 bp, Homo sapiens
taaaataatgcttt

SEQ ID NO: 126882 - DNA, 15 bp, Homo sapiens
taaaatatatgttct

SEQ ID NO: 126883 - DNA, 19 bp, Homo sapiens
taaaatctggcaaagttat

SEQ ID NO: 126884 - DNA, 21 bp, Homo sapiens
taaaatgcttcactgtacgta

SEQ ID NO: 126885 - DNA, 21 bp, Homo sapiens
taaaattaggaacagtaaaat

SEQ ID NO: 126886 - DNA, 12 bp, Homo sapiens
ttctgttttctg

SEQ ID NO: 126887 - DNA, 14 bp, Homo sapiens
ttcttaaaaactgt

SEQ ID NO: 126888 - DNA, 15 bp, Homo sapiens
ttcttaaaaactgtg

SEQ ID NO: 126889 - DNA, 16 bp, Homo sapiens
ttcttaaaaactgtgt

SEQ ID NO: 126890 - DNA, 19 bp, Homo sapiens
ttgtacttttctggttcca

SEQ ID NO: 126891 - DNA, 22 bp, Homo sapiens
ttgtacttttctggttccaaac

SEQ ID NO: 126892 - DNA, 15 bp, Homo sapiens
ttgtataaaaaggaa

SEQ ID NO: 126893 - DNA, 16 bp, Homo sapiens
ttgtataaaaaggaaa

SEQ ID NO: 126894 - DNA, 21 bp, Homo sapiens
ttgtataaaaaggaaattagt

SEQ ID NO: 126895 - DNA, 20 bp, Homo sapiens
ttgtatctacagtaatgaaa

SEQ ID NO: 126896 - DNA, 15 bp, Homo sapiens
ttgtattataattgt

SEQ ID NO: 126897 - DNA, 18 bp, Homo sapiens
ttgtattcaattaaagaa

SEQ ID NO: 126898 - DNA, 21 bp, Homo sapiens
ttgtattcaattaaagaaata

SEQ ID NO: 126899 - DNA, 15 bp, Homo sapiens
ttgtattgctgtcct

SEQ ID NO: 126900 - DNA, 21 bp, Homo sapiens
ttgtcatatcactaaataaac

SEQ ID NO: 126901 - DNA, 11 bp, Homo sapiens
ttgtcctgtgt

SEQ ID NO: 126902 - DNA, 14 bp, Homo sapiens
ttgtcctgtgtcta

SEQ ID NO: 126903 - DNA, 14 bp, Homo sapiens
ttgtggtaaaaaga

SEQ ID NO: 126904 - DNA, 15 bp, Homo sapiens
ttgtgtgttatattc

SEQ ID NO: 126905 - DNA, 22 bp, Homo sapiens
ttgtgttttaaaaaaactgaag

SEQ ID NO: 126906 - DNA, 23 bp, Homo sapiens
ttgttaaaaaaaaaaagattgta

SEQ ID NO: 126907 - DNA, 22 bp, Homo sapiens
ttgttatgaaaatcctatatct

SEQ ID NO: 126908 - DNA, 16 bp, Homo sapiens
ttgttccaatgccaca

SEQ ID NO: 126909 - DNA, 12 bp, Homo sapiens
ttgttgatattt

SEQ ID NO: 126910 - DNA, 17 bp, Homo sapiens
tttaaaaaaactgaagg

SEQ ID NO: 126911 - DNA, 21 bp, Homo sapiens
tttaaaaaaactgaaggtttt

SEQ ID NO: 126912 - DNA, 18 bp, Homo sapiens
tttaaaaaaagtatatat

SEQ ID NO: 126913 - DNA, 23 bp, Homo sapiens
tttaaaaaataccattgaaatca

SEQ ID NO: 126914 - DNA, 18 bp, Homo sapiens
tttaaaaaatattttaag

SEQ ID NO: 126915 - DNA, 14 bp, Homo sapiens
tttaaaagagacaa

SEQ ID NO: 126916 - DNA, 13 bp, Homo sapiens
tttaaaaggcaac

SEQ ID NO: 126917 - DNA, 14 bp, Homo sapiens
tttaaaataaaaat

SEQ ID NO: 126918 - DNA, 21 bp, Homo sapiens
tttaaaataaaaatattttta

SEQ ID NO: 126919 - DNA, 20 bp, Homo sapiens
tttaaagtatttataaaaat

SEQ ID NO: 126920 - DNA, 17 bp, Homo sapiens
tttaaataacctctggc

SEQ ID NO: 126921 - DNA, 20 bp, Homo sapiens
tttaactatgaactgaaggc

SEQ ID NO: 126922 - DNA, 21 bp, Homo sapiens
tttaactctactgtgtaatat

SEQ ID NO: 126923 - DNA, 21 bp, Homo sapiens
tttaagacgtgaatgtctcag

SEQ ID NO: 126924 - DNA, 17 bp, Homo sapiens
tttaagtgcaacatttc

SEQ ID NO: 126925 - DNA, 20 bp, Homo sapiens
tttaagtgcaacatttctgt

SEQ ID NO: 126926 - DNA, 13 bp, Homo sapiens
tttaatagaaaat

SEQ ID NO: 126927 - DNA, 17 bp, Homo sapiens
tttaatagaaccatgtt

SEQ ID NO: 126928 - DNA, 24 bp, Homo sapiens
tttaatattacctaatgaaagtga

SEQ ID NO: 126929 - DNA, 17 bp, Homo sapiens
tttaattatctgcattt

SEQ ID NO: 126930 - DNA, 21 bp, Homo sapiens
tttacaatcagccacattcta

SEQ ID NO: 126931 - DNA, 17 bp, Homo sapiens
tttacagaatgcattaa

SEQ ID NO: 126932 - DNA, 15 bp, Homo sapiens
tttagttttacacta

SEQ ID NO: 126933 - DNA, 19 bp, Homo sapiens
tttataaaaatataaattg

SEQ ID NO: 126934 - DNA, 16 bp, Homo sapiens
tttatatctggaatga

SEQ ID NO: 126935 - DNA, 19 bp, Homo sapiens
tttatattagttgctttgt

SEQ ID NO: 126936 - DNA, 20 bp, Homo sapiens
tttatattagttgctttgtt

SEQ ID NO: 126937 - DNA, 18 bp, Homo sapiens
tttatttccacataaagg

SEQ ID NO: 126938 - DNA, 15 bp, Homo sapiens
tttcagaataaaatt

SEQ ID NO: 126939 - DNA, 23 bp, Homo sapiens
tttcagaattgaaggagaaaatg

SEQ ID NO: 126940 - DNA, 19 bp, Homo sapiens
tttcattgtacaagtatta

SEQ ID NO: 126941 - DNA, 17 bp, Homo sapiens
tttcccagtgagcctct

SEQ ID NO: 126942 - DNA, 19 bp, Homo sapiens
tttccctttttaaaaaata

SEQ ID NO: 126943 - DNA, 22 bp, Homo sapiens
tttcctgtggttttattacaaa

SEQ ID NO: 126944 - DNA, 19 bp, Homo sapiens
tttccttctgttaagaaag

SEQ ID NO: 126945 - DNA, 21 bp, Homo sapiens
tttccttctgttaagaaagga

SEQ ID NO: 126946 - DNA, 22 bp, Homo sapiens
tttctaaagctctgaacaaaag

SEQ ID NO: 126947 - DNA, 19 bp, Homo sapiens
tttctataaatttaagaaa

SEQ ID NO: 126948 - DNA, 23 bp, Homo sapiens
tttctataaatttaagaaaacaa

SEQ ID NO: 126949 - DNA, 22 bp, Homo sapiens
tttctctaacttcaaggcccat

SEQ ID NO: 126950 - DNA, 11 bp, Homo sapiens
tttctgcccag

SEQ ID NO: 126951 - DNA, 13 bp, Homo sapiens
tttcttaaaattc

SEQ ID NO: 126952 - DNA, 22 bp, Homo sapiens
tttcttcccaaatcaaaataaa

SEQ ID NO: 126953 - DNA, 14 bp, Homo sapiens
tttctttttttggt

SEQ ID NO: 126954 - DNA, 13 bp, Homo sapiens
tttgaaaaatatt

SEQ ID NO: 126955 - DNA, 16 bp, Homo sapiens
tttgaaaaatattgct

SEQ ID NO: 126956 - DNA, 19 bp, Homo sapiens
tttgaaaaatattgctaaa

SEQ ID NO: 126957 - DNA, 22 bp, Homo sapiens
tttgaaaaatattgctaaaagt

SEQ ID NO: 126958 - DNA, 21 bp, Homo sapiens
tttgaaggaatacaatatata

SEQ ID NO: 126959 - DNA, 19 bp, Homo sapiens
tttgaataaaaagtgaact

SEQ ID NO: 126960 - DNA, 21 bp, Homo sapiens
tttgaataaaaagtgaacttt

SEQ ID NO: 126961 - DNA, 15 bp, Homo sapiens
tttgatataatcttg

SEQ ID NO: 126962 - DNA, 23 bp, Homo sapiens
tttgcaaaccctttgtattataa

SEQ ID NO: 126963 - DNA, 13 bp, Homo sapiens
tttgctaaaagaa

SEQ ID NO: 126964 - DNA, 14 bp, Homo sapiens
tttgctaaaagaag

SEQ ID NO: 126965 - DNA, 13 bp, Homo sapiens
tttgcttaatttc

SEQ ID NO: 126966 - DNA, 14 bp, Homo sapiens
tttgctttcagatg

SEQ ID NO: 126967 - DNA, 19 bp, Homo sapiens
tttggaattattgtagaca

SEQ ID NO: 126968 - DNA, 16 bp, Homo sapiens
tttggtaaatttttga

SEQ ID NO: 126969 - DNA, 21 bp, Homo sapiens
tttggtaaatttttgaaaaat

SEQ ID NO: 126970 - DNA, 18 bp, Homo sapiens
tttggtcgagtctttgtg

SEQ ID NO: 126971 - DNA, 11 bp, Homo sapiens
tttgtaacttc

SEQ ID NO: 126972 - DNA, 15 bp, Homo sapiens
tttgtaacttcaaat

SEQ ID NO: 126973 - DNA, 14 bp, Homo sapiens
tttgtataaaaagg

SEQ ID NO: 126974 - DNA, 15 bp, Homo sapiens
tttgtatatttgcaa

SEQ ID NO: 126975 - DNA, 22 bp, Homo sapiens
tttgtattcaattaaagaaata

SEQ ID NO: 126976 - DNA, 15 bp, Homo sapiens
tttgttgctgtcaag

SEQ ID NO: 126977 - DNA, 12 bp, Homo sapiens
tttgttttgctt

SEQ ID NO: 126978 - DNA, 15 bp, Homo sapiens
ttttaaaaaaactga

SEQ ID NO: 126979 - DNA, 14 bp, Homo sapiens
ttttaaaagagaca

SEQ ID NO: 126980 - DNA, 21 bp, Homo sapiens
ttttaaaagcaattatattgt

SEQ ID NO: 126981 - DNA, 22 bp, Homo sapiens
ttttaaataacctctggccctt

SEQ ID NO: 126982 - DNA, 23 bp, Homo sapiens
ttttaagaaagagaatgaactgt

SEQ ID NO: 126983 - DNA, 16 bp, Homo sapiens
ttttaagtgcaacatt

SEQ ID NO: 126984 - DNA, 16 bp, Homo sapiens
ttttaattaagcagaa

SEQ ID NO: 126985 - DNA, 15 bp, Homo sapiens
ttttactgacagaaa

SEQ ID NO: 126986 - DNA, 12 bp, Homo sapiens
ttttaggaaagg

SEQ ID NO: 126987 - DNA, 19 bp, Homo sapiens
tttctgtatactgtaaaag

SEQ ID NO: 126988 - DNA, 14 bp, Homo sapiens
tttcttaaaattca

SEQ ID NO: 126989 - DNA, 20 bp, Homo sapiens
tttcttcccaaatcaaaata

SEQ ID NO: 126990 - DNA, 14 bp, Homo sapiens
tttgaataaaaagt

SEQ ID NO: 126991 - DNA, 22 bp, Homo sapiens
tttgaataaaaagtgaactttt

SEQ ID NO: 126992 - DNA, 18 bp, Homo sapiens
ttttcatgtaagtttaat

SEQ ID NO: 126993 - DNA, 14 bp, Homo sapiens
ttttccctttttaa

SEQ ID NO: 126994 - DNA, 19 bp, Homo sapiens
ttttccctttttaaaaaat

SEQ ID NO: 126995 - DNA, 22 bp, Homo sapiens
ttttccttgggagaactaagta

SEQ ID NO: 126996 - DNA, 16 bp, Homo sapiens
ttttcctttttcatgt

SEQ ID NO: 126997 - DNA, 14 bp, Homo sapiens
ttttctggttccaa

SEQ ID NO: 126998 - DNA, 16 bp, Homo sapiens
ttttctggttccaaac

SEQ ID NO: 126999 - DNA, 20 bp, Homo sapiens
ttttctggttccaaaccagt

SEQ ID NO: 127000 - DNA, 13 bp, Homo sapiens
ttttcttcccaaa

SEQ ID NO: 127001 - DNA, 15 bp, Homo sapiens
ttttctttgtatcat

SEQ ID NO: 127002 - DNA, 18 bp, Homo sapiens
ttttctttttttggtaaa

SEQ ID NO: 127003 - DNA, 16 bp, Homo sapiens
ttttgaataaaaagtg

SEQ ID NO: 127004 - DNA, 20 bp, Homo sapiens
ttttgaataaaaagtgaact

SEQ ID NO: 127005 - DNA, 10 bp, Homo sapiens
ttttgatata

SEQ ID NO: 127006 - DNA, 11 bp, Homo sapiens
ttttgcatttc

SEQ ID NO: 127007 - DNA, 15 bp, Homo sapiens
ttttgcatttcatgc

SEQ ID NO: 127008 - DNA, 17 bp, Homo sapiens
ttttgtaacttcaaata

SEQ ID NO: 127009 - DNA, 15 bp, Homo sapiens
ttttgtataaaaagg

SEQ ID NO: 127010 - DNA, 16 bp, Homo sapiens
ttttgtataaaaagga

SEQ ID NO: 127011 - DNA, 18 bp, Homo sapiens
tttttaaaataaaaatat

SEQ ID NO: 127012 - DNA, 22 bp, Homo sapiens
tttttaactctactgtgtaata

SEQ ID NO: 127013 - DNA, 16 bp, Homo sapiens
tttttaagtgcaacat

SEQ ID NO: 127014 - DNA, 18 bp, Homo sapiens
tttttaagtgcaacattt

SEQ ID NO: 127015 - DNA, 20 bp, Homo sapiens
tttttaagtgcaacatttct

SEQ ID NO: 127016 - DNA, 18 bp, Homo sapiens
tttttatattagttgctt

SEQ ID NO: 127017 - DNA, 16 bp, Homo sapiens
tttttcatgtaagttt

SEQ ID NO: 127018 - DNA, 12 bp, Homo sapiens
tttttctccccg

SEQ ID NO: 127019 - DNA, 12 bp, Homo sapiens
tttttgtataaa

SEQ ID NO: 127020 - DNA, 20 bp, Homo sapiens
tttttgtataaaaaggaaat

SEQ ID NO: 127021 - DNA, 14 bp, Homo sapiens
tttttgtgaaattc

SEQ ID NO: 127022 - DNA, 13 bp, Homo sapiens
ttttttatttcca

SEQ ID NO: 127023 - DNA, 13 bp, Homo sapiens
ttttttttccaaa

SEQ ID NO: 127024 - DNA, 13 bp, Homo sapiens
tttttttttccaa

SEQ ID NO: 127025 - DNA, 18 bp, Homo sapiens
taaactttctccatttaa

SEQ ID NO: 127026 - DNA, 20 bp, Homo sapiens
taaagaggaaaagtgcaatg

SEQ ID NO: 127027 - DNA, 15 bp, Homo sapiens
taaagtaattttgtg

SEQ ID NO: 127028 - DNA, 13 bp, Homo sapiens
taaagtatttata

SEQ ID NO: 127029 - DNA, 22 bp, Homo sapiens
taaataaatgaagtatttctca

SEQ ID NO: 127030 - DNA, 15 bp, Homo sapiens
taaataacctctggc

SEQ ID NO: 127031 - DNA, 23 bp, Homo sapiens
taaataattttaaataacctctg

SEQ ID NO: 127032 - DNA, 12 bp, Homo sapiens
taaatcatttta

SEQ ID NO: 127033 - DNA, 17 bp, Homo sapiens
taaatcattttaggaaa

SEQ ID NO: 127034 - DNA, 22 bp, Homo sapiens
taaatcccaagtgtctcttgac

SEQ ID NO: 127035 - DNA, 14 bp, Homo sapiens
taaatttaagaaaa

SEQ ID NO: 127036 - DNA, 12 bp, Homo sapiens
taaatttttgaa

SEQ ID NO: 127037 - DNA, 12 bp, Homo sapiens
taacactgttgg

SEQ ID NO: 127038 - DNA, 14 bp, Homo sapiens
taacctctggccct

SEQ ID NO: 127039 - DNA, 16 bp, Homo sapiens
taacctctggcccttg

SEQ ID NO: 127040 - DNA, 17 bp, Homo sapiens
taacctctggcccttgg

SEQ ID NO: 127041 - DNA, 13 bp, Homo sapiens
taactgaactgtt

SEQ ID NO: 127042 - DNA, 14 bp, Homo sapiens
taactgaactgttt

SEQ ID NO: 127043 - DNA, 17 bp, Homo sapiens
taactgatgagtaaact

SEQ ID NO: 127044 - DNA, 12 bp, Homo sapiens
taactgtaaact

SEQ ID NO: 127045 - DNA, 14 bp, Homo sapiens
taactgtaaacttg

SEQ ID NO: 127046 - DNA, 17 bp, Homo sapiens
taacttcaaatatagag

SEQ ID NO: 127047 - DNA, 18 bp, Homo sapiens
taacttcaaatatagaga

SEQ ID NO: 127048 - DNA, 23 bp, Homo sapiens
taagaaaagtaatgaagaatcac

SEQ ID NO: 127049 - DNA, 21 bp, Homo sapiens
taagaaagagaatgaactgtg

SEQ ID NO: 127050 - DNA, 21 bp, Homo sapiens
taagaagggggagtgaaacag

SEQ ID NO: 127051 - DNA, 22 bp, Homo sapiens
taagaagggggagtgaaacaga

SEQ ID NO: 127052 - DNA, 23 bp, Homo sapiens
taagaagggggagtgaaacagag

SEQ ID NO: 127053 - DNA, 14 bp, Homo sapiens
taagacgtgaatgt

SEQ ID NO: 127054 - DNA, 19 bp, Homo sapiens
taagacgtgaatgtctcag

SEQ ID NO: 127055 - DNA, 20 bp, Homo sapiens
taagctcaggatatggctta

SEQ ID NO: 127056 - DNA, 20 bp, Homo sapiens
taaggatcaccccagccccc

SEQ ID NO: 127057 - DNA, 14 bp, Homo sapiens
taagtacccttggg

SEQ ID NO: 127058 - DNA, 22 bp, Homo sapiens
taagtcttttttttttccaaat

SEQ ID NO: 127059 - DNA, 19 bp, Homo sapiens
taagtgcaacatttctgta

SEQ ID NO: 127060 - DNA, 21 bp, Homo sapiens
taagtgcaacatttctgtata

SEQ ID NO: 127061 - DNA, 19 bp, Homo sapiens
taagtggactggtgtcata

SEQ ID NO: 127062 - DNA, 19 bp, Homo sapiens
taatagaaaattaaaataa

SEQ ID NO: 127063 - DNA, 20 bp, Homo sapiens
taatataaaagatcttgcag

SEQ ID NO: 127064 - DNA, 22 bp, Homo sapiens
taatattacctaatgaaagtga

SEQ ID NO: 127065 - DNA, 23 bp, Homo sapiens
taatcaatttctcaatagttctt

SEQ ID NO: 127066 - DNA, 19 bp, Homo sapiens
taatcagctctcctggctc

SEQ ID NO: 127067 - DNA, 23 bp, Homo sapiens
taatcttggcttcttaaaaactg

SEQ ID NO: 127068 - DNA, 16 bp, Homo sapiens
taatgacatgcctata

SEQ ID NO: 127069 - DNA, 16 bp, Homo sapiens
taattaagcagaaaca

SEQ ID NO: 127070 - DNA, 14 bp, Homo sapiens
taattatgaaaact

SEQ ID NO: 127071 - DNA, 19 bp, Homo sapiens
taattgaacaataaagttt

SEQ ID NO: 127072 - DNA, 21 bp, Homo sapiens
taattgtcctgtgtctatgta

SEQ ID NO: 127073 - DNA, 13 bp, Homo sapiens
taattgttgatat

SEQ ID NO: 127074 - DNA, 16 bp, Homo sapiens
taattgttgatatttt

SEQ ID NO: 127075 - DNA, 21 bp, Homo sapiens
taatttataaaagaataaaat

SEQ ID NO: 127076 - DNA, 15 bp, Homo sapiens
taatttccttctgtt

SEQ ID NO: 127077 - DNA, 15 bp, Homo sapiens
taattttaaataacc

SEQ ID NO: 127078 - DNA, 15 bp, Homo sapiens
taattttattccaga

SEQ ID NO: 127079 - DNA, 18 bp, Homo sapiens
tacaaagcatgggaaaaa

SEQ ID NO: 127080 - DNA, 24 bp, Homo sapiens
tacaaagcatgggaaaaagagact

SEQ ID NO: 127081 - DNA, 20 bp, Homo sapiens
tacaaggtaggctgcaaaat

SEQ ID NO: 127082 - DNA, 16 bp, Homo sapiens
tacaagtcagtttcta

SEQ ID NO: 127083 - DNA, 21 bp, Homo sapiens
tacaataaaactttgctgcca

SEQ ID NO: 127084 - DNA, 15 bp, Homo sapiens
tacaatcgacatcct

SEQ ID NO: 127085 - DNA, 22 bp, Homo sapiens
tacaatcgagactgcaatgtga

SEQ ID NO: 127086 - DNA, 15 bp, Homo sapiens
tacacatatatgtat

SEQ ID NO: 127087 - DNA, 17 bp, Homo sapiens
tacactaggaaacgtgt

SEQ ID NO: 127088 - DNA, 14 bp, Homo sapiens
tacagaatgcatta

SEQ ID NO: 127089 - DNA, 15 bp, Homo sapiens
tacagaatgcattaa

SEQ ID NO: 127090 - DNA, 13 bp, Homo sapiens
tacagtaatgaaa

SEQ ID NO: 127091 - DNA, 15 bp, Homo sapiens
tacagtttgtgtttt

SEQ ID NO: 127092 - DNA, 17 bp, Homo sapiens
tacagtttgtgttttaa

SEQ ID NO: 127093 - DNA, 20 bp, Homo sapiens
tacagtttgtgttttaaaaa

SEQ ID NO: 127094 - DNA, 13 bp, Homo sapiens
tacatacagaggt

SEQ ID NO: 127095 - DNA, 21 bp, Homo sapiens
tacatacagaggtaactatca

SEQ ID NO: 127096 - DNA, 12 bp, Homo sapiens
tacatgctgcta

SEQ ID NO: 127097 - DNA, 20 bp, Homo sapiens
tacatgtatctggtttgtca

SEQ ID NO: 127098 - DNA, 20 bp, Homo sapiens
tacattttattgtcagaatt

SEQ ID NO: 127099 - DNA, 14 bp, Homo sapiens
tacattttgtaaaa

SEQ ID NO: 127100 - DNA, 16 bp, Homo sapiens
taccccacctgacctc

SEQ ID NO: 127101 - DNA, 12 bp, Homo sapiens
taccctgcagct

SEQ ID NO: 127102 - DNA, 23 bp, Homo sapiens
taccctgcccctccccaaaagaa

SEQ ID NO: 127103 - DNA, 20 bp, Homo sapiens
tacccttggggtggtgctgg

SEQ ID NO: 127104 - DNA, 12 bp, Homo sapiens
tacctcaggaaa

SEQ ID NO: 127105 - DNA, 22 bp, Homo sapiens
tactaagtggactggtgtcata

SEQ ID NO: 127106 - DNA, 21 bp, Homo sapiens
tactaatgttatttcttaaaa

SEQ ID NO: 127107 - DNA, 20 bp, Homo sapiens
tactgcagcctttgcctccc

SEQ ID NO: 127108 - DNA, 17 bp, Homo sapiens
tactgtaaaagttataa

SEQ ID NO: 127109 - DNA, 20 bp, Homo sapiens
tactgtaaaagttataataa

SEQ ID NO: 127110 - DNA, 22 bp, Homo sapiens
tactgtaaaagttataataact

SEQ ID NO: 127111 - DNA, 23 bp, Homo sapiens
tactgtaaaagttataataactg

SEQ ID NO: 127112 - DNA, 18 bp, Homo sapiens
tacttctgagccccagcc

SEQ ID NO: 127113 - DNA, 21 bp, Homo sapiens
tactttgtagactgtttcaca

SEQ ID NO: 127114 - DNA, 12 bp, Homo sapiens
tagaaagaaagt

SEQ ID NO: 127115 - DNA, 21 bp, Homo sapiens
tagaaccatgttggttgcact

SEQ ID NO: 127116 - DNA, 23 bp, Homo sapiens
tagaaccatgttggttgcacttt

SEQ ID NO: 127117 - DNA, 12 bp, Homo sapiens
accccagccccc

SEQ ID NO: 127118 - DNA, 13 bp, Homo sapiens
accccagccccca

SEQ ID NO: 127119 - DNA, 18 bp, Homo sapiens
accccagcccccacagcc

SEQ ID NO: 127120 - DNA, 15 bp, Homo sapiens
accccatcccacacc

SEQ ID NO: 127121 - DNA, 20 bp, Homo sapiens
acccccacttcatgcccact

SEQ ID NO: 127122 - DNA, 13 bp, Homo sapiens
acccctgcctcct

SEQ ID NO: 127123 - DNA, 17 bp, Homo sapiens
acccctgcctcctgcct

SEQ ID NO: 127124 - DNA, 20 bp, Homo sapiens
acccctgcctcctgcctccc

SEQ ID NO: 127125 - DNA, 23 bp, Homo sapiens
acccgccccgccccctccctgct

SEQ ID NO: 127126 - DNA, 11 bp, Homo sapiens
accctgtctca

SEQ ID NO: 127127 - DNA, 20 bp, Homo sapiens
accctttgtattataattgt

SEQ ID NO: 127128 - DNA, 15 bp, Homo sapiens
accgaggagccccag

SEQ ID NO: 127129 - DNA, 13 bp, Homo sapiens
accgctggctccg

SEQ ID NO: 127130 - DNA, 14 bp, Homo sapiens
accggcccctggca

SEQ ID NO: 127131 - DNA, 21 bp, Homo sapiens
acctaaaaggaaatctcaccc

SEQ ID NO: 127132 - DNA, 22 bp, Homo sapiens
acctaaaaggaaatctcacccc

SEQ ID NO: 127133 - DNA, 14 bp, Homo sapiens
acctagcttttaaa

SEQ ID NO: 127134 - DNA, 17 bp, Homo sapiens
acctagcttttaaaaaa

SEQ ID NO: 127135 - DNA, 20 bp, Homo sapiens
acctagcttttaaaaaatat

SEQ ID NO: 127136 - DNA, 22 bp, Homo sapiens
acctatggcccagccactgcag

SEQ ID NO: 127137 - DNA, 22 bp, Homo sapiens
acctcccctccccgccccctga

SEQ ID NO: 127138 - DNA, 9 bp, Homo sapiens
acctctggc

SEQ ID NO: 127139 - DNA, 16 bp, Homo sapiens
acctctggcccttgga

SEQ ID NO: 127140 - DNA, 14 bp, Homo sapiens
acctgacctctgca

SEQ ID NO: 127141 - DNA, 16 bp, Homo sapiens
acctgggccaaggact

SEQ ID NO: 127142 - DNA, 15 bp, Homo sapiens
acctgtccataaagt

SEQ ID NO: 127143 - DNA, 16 bp, Homo sapiens
acctgtccataaagta

SEQ ID NO: 127144 - DNA, 12 bp, Homo sapiens
acctgtgtctta

SEQ ID NO: 127145 - DNA, 11 bp, Homo sapiens
accttctccct

SEQ ID NO: 127146 - DNA, 14 bp, Homo sapiens
acggtttctccccg

SEQ ID NO: 127147 - DNA, 12 bp, Homo sapiens
acgtcccttgga

SEQ ID NO: 127148 - DNA, 14 bp, Homo sapiens
acgtgaatgtctca

SEQ ID NO: 127149 - DNA, 18 bp, Homo sapiens
acgtgattgattcagtat

SEQ ID NO: 127150 - DNA, 15 bp, Homo sapiens
actaaacagaaaact

SEQ ID NO: 127151 - DNA, 16 bp, Homo sapiens
actaagtaagaaacac

SEQ ID NO: 127152 - DNA, 19 bp, Homo sapiens
actaagtacccttggggtg

SEQ ID NO: 127153 - DNA, 13 bp, Homo sapiens
actaggagactgg

SEQ ID NO: 127154 - DNA, 14 bp, Homo sapiens
actaggagactggt

SEQ ID NO: 127155 - DNA, 17 bp, Homo sapiens
actagtgcaattccaag

SEQ ID NO: 127156 - DNA, 17 bp, Homo sapiens
actatcaatatttaagt

SEQ ID NO: 127157 - DNA, 18 bp, Homo sapiens
actatcaatatttaagtt

SEQ ID NO: 127158 - DNA, 22 bp, Homo sapiens
actatgaactgaaggcagcatg

SEQ ID NO: 127159 - DNA, 13 bp, Homo sapiens
actattacttgaa

SEQ ID NO: 127160 - DNA, 16 bp, Homo sapiens
actattacttgaactt

SEQ ID NO: 127161 - DNA, 15 bp, Homo sapiens
actcaagaagcacac

SEQ ID NO: 127162 - DNA, 13 bp, Homo sapiens
actcctctgggcc

SEQ ID NO: 127163 - DNA, 19 bp, Homo sapiens
actcctctgggcctggggt

SEQ ID NO: 127164 - DNA, 18 bp, Homo sapiens
actccttgaaatgtgtgt

SEQ ID NO: 127165 - DNA, 13 bp, Homo sapiens
actcctttccaat

SEQ ID NO: 127166 - DNA, 21 bp, Homo sapiens
actctaattagagaactggag

SEQ ID NO: 127167 - DNA, 14 bp, Homo sapiens
actctactgtgtaa

SEQ ID NO: 127168 - DNA, 22 bp, Homo sapiens
actctgcagatagtgcctctgc

SEQ ID NO: 127169 - DNA, 14 bp, Homo sapiens
actgaactgtttgg

SEQ ID NO: 127170 - DNA, 23 bp, Homo sapiens
actgaaggcagcatgtatagttg

SEQ ID NO: 127171 - DNA, 15 bp, Homo sapiens
actgagtccatgaaa

SEQ ID NO: 127172 - DNA, 21 bp, Homo sapiens
actgagtccatgaaaatacca

SEQ ID NO: 127173 - DNA, 17 bp, Homo sapiens
actgattccctctccca

SEQ ID NO: 127174 - DNA, 19 bp, Homo sapiens
actgattccctctcccacc

SEQ ID NO: 127175 - DNA, 20 bp, Homo sapiens
actggcacttgcctgctgct

SEQ ID NO: 127176 - DNA, 19 bp, Homo sapiens
actgggcacccctgcctcc

SEQ ID NO: 127177 - DNA, 20 bp, Homo sapiens
actgggcacccctgcctcct

SEQ ID NO: 127178 - DNA, 21 bp, Homo sapiens
actgggcacccctgcctcctg

SEQ ID NO: 127179 - DNA, 17 bp, Homo sapiens
actgggggcgggactgg

SEQ ID NO: 127180 - DNA, 22 bp, Homo sapiens
aattagtgagattaaaaatcta

SEQ ID NO: 127181 - DNA, 23 bp, Homo sapiens
aattatggtctggggtaaaattg

SEQ ID NO: 127182 - DNA, 22 bp, Homo sapiens
aattattaattgtcctgtgtct

SEQ ID NO: 127183 - DNA, 16 bp, Homo sapiens
aattattgtagacatg

SEQ ID NO: 127184 - DNA, 18 bp, Homo sapiens
aattccaagaaaatatca

SEQ ID NO: 127185 - DNA, 17 bp, Homo sapiens
aattgaaagtattcaga

SEQ ID NO: 127186 - DNA, 18 bp, Homo sapiens
aattgaaagtattcagaa

SEQ ID NO: 127187 - DNA, 22 bp, Homo sapiens
aattgaacaataaagtttgctt

SEQ ID NO: 127188 - DNA, 17 bp, Homo sapiens
aattgaaggagaaaatg

SEQ ID NO: 127189 - DNA, 23 bp, Homo sapiens
aattgattattctgattccactt

SEQ ID NO: 127190 - DNA, 15 bp, Homo sapiens
aattgttatgaaaat

SEQ ID NO: 127191 - DNA, 13 bp, Homo sapiens
aattgttgatatt

SEQ ID NO: 127192 - DNA, 15 bp, Homo sapiens
aattgttgatatttt

SEQ ID NO: 127193 - DNA, 15 bp, Homo sapiens
aatttaagaaaacaa

SEQ ID NO: 127194 - DNA, 21 bp, Homo sapiens
aatttaagaaaacaagtatat

SEQ ID NO: 127195 - DNA, 20 bp, Homo sapiens
aatttaatggactgtgaatt

SEQ ID NO: 127196 - DNA, 17 bp, Homo sapiens
aatttactttgtagact

SEQ ID NO: 127197 - DNA, 19 bp, Homo sapiens
aatttataacgttctcagt

SEQ ID NO: 127198 - DNA, 20 bp, Homo sapiens
aatttccttctgttaagaaa

SEQ ID NO: 127199 - DNA, 21 bp, Homo sapiens
aattttactgacagaaatgca

SEQ ID NO: 127200 - DNA, 21 bp, Homo sapiens
aattttcctttttcatgtaag

SEQ ID NO: 127201 - DNA, 15 bp, Homo sapiens
aattttgagaaaaat

SEQ ID NO: 127202 - DNA, 13 bp, Homo sapiens
aatttttgaaaaa

SEQ ID NO: 127203 - DNA, 16 bp, Homo sapiens
aatttttgaaaaatat

SEQ ID NO: 127204 - DNA, 23 bp, Homo sapiens
acaaaaaaatacctcaggaaaga

SEQ ID NO: 127205 - DNA, 15 bp, Homo sapiens
acaaacaaaaaaaag

SEQ ID NO: 127206 - DNA, 13 bp, Homo sapiens
acaaagactcctc

SEQ ID NO: 127207 - DNA, 21 bp, Homo sapiens
acaaagactcctctgggcctg

SEQ ID NO: 127208 - DNA, 17 bp, Homo sapiens
acaaagcatgggaaaaa

SEQ ID NO: 127209 - DNA, 20 bp, Homo sapiens
acaacgctctaccctgcagc

SEQ ID NO: 127210 - DNA, 23 bp, Homo sapiens
acaacgctctaccctgcagcttg

SEQ ID NO: 127211 - DNA, 21 bp, Homo sapiens
acaacttgctacttatcattt

SEQ ID NO: 127212 - DNA, 22 bp, Homo sapiens
acaaggtaggctgcaaaattaa

SEQ ID NO: 127213 - DNA, 15 bp, Homo sapiens
acaagtatataattt

SEQ ID NO: 127214 - DNA, 16 bp, Homo sapiens
acaagtggtgaccaaa

SEQ ID NO: 127215 - DNA, 23 bp, Homo sapiens
acaagtggtgaccaaaattttta

SEQ ID NO: 127216 - DNA, 14 bp, Homo sapiens
acaagtttgctaaa

SEQ ID NO: 127217 - DNA, 16 bp, Homo sapiens
acaagtttgctaaaag

SEQ ID NO: 127218 - DNA, 17 bp, Homo sapiens
agccaaggaatgtgtcc

SEQ ID NO: 127219 - DNA, 22 bp, Homo sapiens
agccacagggaagcatgtactg

SEQ ID NO: 127220 - DNA, 12 bp, Homo sapiens
agccactgcagc

SEQ ID NO: 127221 - DNA, 14 bp, Homo sapiens
agccactgcagcac

SEQ ID NO: 127222 - DNA, 15 bp, Homo sapiens
agccccacccagagg

SEQ ID NO: 127223 - DNA, 13 bp, Homo sapiens
agccccagccccg

SEQ ID NO: 127224 - DNA, 15 bp, Homo sapiens
agccccagccccgtc

SEQ ID NO: 127225 - DNA, 12 bp, Homo sapiens
agcccccacagc

SEQ ID NO: 127226 - DNA, 14 bp, Homo sapiens
agcccccacagccc

SEQ ID NO: 127227 - DNA, 15 bp, Homo sapiens
agcccccacagccct

SEQ ID NO: 127228 - DNA, 18 bp, Homo sapiens
agcccccacagccctgga

SEQ ID NO: 127229 - DNA, 11 bp, Homo sapiens
agcccccaggc

SEQ ID NO: 127230 - DNA, 17 bp, Homo sapiens
agccccgtcccagaggc

SEQ ID NO: 127231 - DNA, 23 bp, Homo sapiens
agccccgtcccagaggccgctgc

SEQ ID NO: 127232 - DNA, 18 bp, Homo sapiens
agccctcagacatttata

SEQ ID NO: 127233 - DNA, 18 bp, Homo sapiens
agcctagatatgaatata

SEQ ID NO: 127234 - DNA, 23 bp, Homo sapiens
agcctccggagtagctgggacca

SEQ ID NO: 127235 - DNA, 22 bp, Homo sapiens
agcctgcccagttggaggagac

SEQ ID NO: 127236 - DNA, 20 bp, Homo sapiens
agcgctgttgatcccctctc

SEQ ID NO: 127237 - DNA, 20 bp, Homo sapiens
agcgctgttgcccgccctcc

SEQ ID NO: 127238 - DNA, 16 bp, Homo sapiens
agcgggccaggcaggc

SEQ ID NO: 127239 - DNA, 15 bp, Homo sapiens
agctattagcaactg

SEQ ID NO: 127240 - DNA, 18 bp, Homo sapiens
agctattagcaactgtgc

SEQ ID NO: 127241 - DNA, 13 bp, Homo sapiens
agctcagctgggc

SEQ ID NO: 127242 - DNA, 21 bp, Homo sapiens
agctcagctgggccactcctc

SEQ ID NO: 127243 - DNA, 22 bp, Homo sapiens
agctcagctgggccactcctct

SEQ ID NO: 127244 - DNA, 23 bp, Homo sapiens
agctcagctgggccactcctctt

SEQ ID NO: 127245 - DNA, 13 bp, Homo sapiens
agctcccattcta

SEQ ID NO: 127246 - DNA, 12 bp, Homo sapiens
agctctcctggc

SEQ ID NO: 127247 - DNA, 13 bp, Homo sapiens
agctctcctggct

SEQ ID NO: 127248 - DNA, 17 bp, Homo sapiens
agctgacggtttctccc

SEQ ID NO: 127249 - DNA, 21 bp, Homo sapiens
agctgacggtttctccccgga

SEQ ID NO: 127250 - DNA, 17 bp, Homo sapiens
agctggccctcagctcc

SEQ ID NO: 127251 - DNA, 13 bp, Homo sapiens
agctgggcccagc

SEQ ID NO: 127252 - DNA, 20 bp, Homo sapiens
agctgggcccagcccctcca

SEQ ID NO: 127253 - DNA, 22 bp, Homo sapiens
agcttgtgctgagcctgcccag

SEQ ID NO: 127254 - DNA, 12 bp, Homo sapiens
agcttttaaaaa

SEQ ID NO: 127255 - DNA, 15 bp, Homo sapiens
agcttttaaaaaata

SEQ ID NO: 127256 - DNA, 21 bp, Homo sapiens
agcttttaaaaaatattttaa

SEQ ID NO: 127257 - DNA, 19 bp, Homo sapiens
aggaaaagtgcaatgcgtg

SEQ ID NO: 127258 - DNA, 13 bp, Homo sapiens
aggaaaattgaaa

SEQ ID NO: 127259 - DNA, 12 bp, Homo sapiens
aggaaagaatag

SEQ ID NO: 127260 - DNA, 16 bp, Homo sapiens
aggaaatctcacccca

SEQ ID NO: 127261 - DNA, 16 bp, Homo sapiens
aggaaattagtctttt

SEQ ID NO: 127262 - DNA, 18 bp, Homo sapiens
aggaagacataaaacttt

SEQ ID NO: 127263 - DNA, 15 bp, Homo sapiens
aggaaggcccagggg

SEQ ID NO: 127264 - DNA, 17 bp, Homo sapiens
aggaatataagaaaagt

SEQ ID NO: 127265 - DNA, 15 bp, Homo sapiens
aggaatgtgtccaag

SEQ ID NO: 127266 - DNA, 18 bp, Homo sapiens
aggaatgtgtccaagaca

SEQ ID NO: 127267 - DNA, 20 bp, Homo sapiens
aggacactaggagactggtt

SEQ ID NO: 127268 - DNA, 14 bp, Homo sapiens
aggactgaagctgg

SEQ ID NO: 127269 - DNA, 15 bp, Homo sapiens
aggactgaagctggg

SEQ ID NO: 127270 - DNA, 19 bp, Homo sapiens
aggagactgggcacccctg

SEQ ID NO: 127271 - DNA, 16 bp, Homo sapiens
aggagccccagccccg

SEQ ID NO: 127272 - DNA, 17 bp, Homo sapiens
aggagccccagccccgt

SEQ ID NO: 127273 - DNA, 16 bp, Homo sapiens
aggaggctccgtgagc

SEQ ID NO: 127274 - DNA, 21 bp, Homo sapiens
aggaggttcgggattccctgg

SEQ ID NO: 127275 - DNA, 15 bp, Homo sapiens
aggatgttacaagtt

SEQ ID NO: 127276 - DNA, 19 bp, Homo sapiens
aggatgttacaagtttgct

SEQ ID NO: 127277 - DNA, 13 bp, Homo sapiens
aggcaaaagactg

SEQ ID NO: 127278 - DNA, 16 bp, Homo sapiens
aggcaaaagactggtt

SEQ ID NO: 127279 - DNA, 16 bp, Homo sapiens
aggcaactcaaagatg

SEQ ID NO: 127280 - DNA, 19 bp, Homo sapiens
aggcccaggggtggggccc

SEQ ID NO: 127281 - DNA, 22 bp, Homo sapiens
aggcccagtgacaaagactcct

SEQ ID NO: 127282 - DNA, 18 bp, Homo sapiens
accatgacaaacctagct

SEQ ID NO: 127283 - DNA, 16 bp, Homo sapiens
accattgaaatcagca

SEQ ID NO: 127284 - DNA, 22 bp, Homo sapiens
accattgaaatcagcatgacaa

SEQ ID NO: 127285 - DNA, 12 bp, Homo sapiens
acccaaggagaa

SEQ ID NO: 127286 - DNA, 14 bp, Homo sapiens
acccaaggagaacg

SEQ ID NO: 127287 - DNA, 12 bp, Homo sapiens
acccacagccct

SEQ ID NO: 127288 - DNA, 15 bp, Homo sapiens
acccacagccctgaa

SEQ ID NO: 127289 - DNA, 21 bp, Homo sapiens
acccaccccacagactccggc

SEQ ID NO: 127290 - DNA, 22 bp, Homo sapiens
acccacctgggccaaggactcc

SEQ ID NO: 127291 - DNA, 18 bp, Homo sapiens
acccactaggtgaacagc

SEQ ID NO: 127292 - DNA, 22 bp, Homo sapiens
acccagaggtggccctcccagg

SEQ ID NO: 127293 - DNA, 11 bp, Homo sapiens
acccatgaagc

SEQ ID NO: 127294 - DNA, 14 bp, Homo sapiens
acccatgaagctgg

SEQ ID NO: 127295 - DNA, 17 bp, Homo sapiens
acccatgaagctggccc

SEQ ID NO: 127296 - DNA, 19 bp, Homo sapiens
acccatgaagctggccctc

SEQ ID NO: 127297 - DNA, 19 bp, Homo sapiens
accccacctgacctctgca

SEQ ID NO: 127298 - DNA, 17 bp, Homo sapiens
accccagcccccacagc

SEQ ID NO: 127299 - DNA, 21 bp, Homo sapiens
accccatggagacaataaaca

SEQ ID NO: 127300 - DNA, 10 bp, Homo sapiens
acccctgcct

SEQ ID NO: 127301 - DNA, 12 bp, Homo sapiens
acccctgcctcc

SEQ ID NO: 127302 - DNA, 16 bp, Homo sapiens
acccctgcctcctgcc

SEQ ID NO: 127303 - DNA, 15 bp, Homo sapiens
acccgccccgccccc

SEQ ID NO: 127304 - DNA, 13 bp, Homo sapiens
accctcctggcac

SEQ ID NO: 127305 - DNA, 13 bp, Homo sapiens
accctgcagcttg

SEQ ID NO: 127306 - DNA, 23 bp, Homo sapiens
accctgcccctccccaaaagaaa

SEQ ID NO: 127307 - DNA, 14 bp, Homo sapiens
accgctggctccgc

SEQ ID NO: 127308 - DNA, 21 bp, Homo sapiens
acctaatgaaagtgatgacat

SEQ ID NO: 127309 - DNA, 16 bp, Homo sapiens
acctcaggaaagaata

SEQ ID NO: 127310 - DNA, 21 bp, Homo sapiens
acctcccctccccgccccctg

SEQ ID NO: 127311 - DNA, 23 bp, Homo sapiens
acctcccctccccgccccctgaa

SEQ ID NO: 127312 - DNA, 18 bp, Homo sapiens
acctctgcaagagggggc

SEQ ID NO: 127313 - DNA, 13 bp, Homo sapiens
acctctggccctt

SEQ ID NO: 127314 - DNA, 15 bp, Homo sapiens
acctctggcccttgg

SEQ ID NO: 127315 - DNA, 17 bp, Homo sapiens
acctgggccaaggactc

SEQ ID NO: 127316 - DNA, 18 bp, Homo sapiens
accttctccctagccctt

SEQ ID NO: 127317 - DNA, 19 bp, Homo sapiens
accttctccctagcccttc

SEQ ID NO: 127318 - DNA, 21 bp, Homo sapiens
acctttatatctgtcttttat

SEQ ID NO: 127319 - DNA, 14 bp, Homo sapiens
acgagaagtgccct

SEQ ID NO: 127320 - DNA, 14 bp, Homo sapiens
aggaattttaaaaa

SEQ ID NO: 127321 - DNA, 22 bp, Homo sapiens
aggacaaaaagaccttctccct

SEQ ID NO: 127322 - DNA, 14 bp, Homo sapiens
aggacactaggaga

SEQ ID NO: 127323 - DNA, 18 bp, Homo sapiens
aggacactaggagactgg

SEQ ID NO: 127324 - DNA, 13 bp, Homo sapiens
aggacccacctgg

SEQ ID NO: 127325 - DNA, 14 bp, Homo sapiens
aggactctgcagat

SEQ ID NO: 127326 - DNA, 14 bp, Homo sapiens
aggagaaaatgcat

SEQ ID NO: 127327 - DNA, 13 bp, Homo sapiens
aggagaaactgag

SEQ ID NO: 127328 - DNA, 14 bp, Homo sapiens
aggagactgggcac

SEQ ID NO: 127329 - DNA, 22 bp, Homo sapiens
aggagactgggcacccctgcct

SEQ ID NO: 127330 - DNA, 18 bp, Homo sapiens
aggaggctccgtgagccc

SEQ ID NO: 127331 - DNA, 22 bp, Homo sapiens
aggaggttcgggattccctggt

SEQ ID NO: 127332 - DNA, 18 bp, Homo sapiens
aggagtgactaggtgggt

SEQ ID NO: 127333 - DNA, 13 bp, Homo sapiens
aggataaaataat

SEQ ID NO: 127334 - DNA, 14 bp, Homo sapiens
aggatcaccccagc

SEQ ID NO: 127335 - DNA, 16 bp, Homo sapiens
aggatcaccccagccc

SEQ ID NO: 127336 - DNA, 13 bp, Homo sapiens
aggatgccctgtt

SEQ ID NO: 127337 - DNA, 15 bp, Homo sapiens
aggatgccctgttgg

SEQ ID NO: 127338 - DNA, 20 bp, Homo sapiens
aggatgttacaagtttgcta

SEQ ID NO: 127339 - DNA, 18 bp, Homo sapiens
aggcaactcaaagatgat

SEQ ID NO: 127340 - DNA, 16 bp, Homo sapiens
aggcagcatgtatagt

SEQ ID NO: 127341 - DNA, 21 bp, Homo sapiens
aggcaggctgggtgggaggga

SEQ ID NO: 127342 - DNA, 21 bp, Homo sapiens
aggcatcactgattccctctc

SEQ ID NO: 127343 - DNA, 22 bp, Homo sapiens
aggcatcactgattccctctcc

SEQ ID NO: 127344 - DNA, 15 bp, Homo sapiens
aggccgctgcccctg

SEQ ID NO: 127345 - DNA, 17 bp, Homo sapiens
aggccggagacccacag

SEQ ID NO: 127346 - DNA, 23 bp, Homo sapiens
aggccggagacccacagccctga

SEQ ID NO: 127347 - DNA, 17 bp, Homo sapiens
aggcctcggctgtctcc

SEQ ID NO: 127348 - DNA, 21 bp, Homo sapiens
aggcctcggctgtctcctgtc

SEQ ID NO: 127349 - DNA, 15 bp, Homo sapiens
aggctccgtgagccc

SEQ ID NO: 127350 - DNA, 14 bp, Homo sapiens
aggctgcaaaatta

SEQ ID NO: 127351 - DNA, 15 bp, Homo sapiens
aggctgggcagggcc

SEQ ID NO: 127352 - DNA, 21 bp, Homo sapiens
aggctgggcagggcctggcgg

SEQ ID NO: 127353 - DNA, 14 bp, Homo sapiens
agggccgagacagg

SEQ ID NO: 127354 - DNA, 17 bp, Homo sapiens
aggggctattgggccct

SEQ ID NO: 127355 - DNA, 15 bp, Homo sapiens
agggtgaagcaccag

SEQ ID NO: 127356 - DNA, 22 bp, Homo sapiens
aggtaactatcaatatttaagt

SEQ ID NO: 127357 - DNA, 16 bp, Homo sapiens
aggtccaccggcccct

SEQ ID NO: 127358 - DNA, 18 bp, Homo sapiens
aggtccaccggcccctgg

SEQ ID NO: 127359 - DNA, 22 bp, Homo sapiens
aggtccaccggcccctggcagc

SEQ ID NO: 127360 - DNA, 17 bp, Homo sapiens
aggtgcaagtgccccag

SEQ ID NO: 127361 - DNA, 16 bp, Homo sapiens
aggtggccctcccagg

SEQ ID NO: 127362 - DNA, 21 bp, Homo sapiens
aggttcatgccaccatggcca

SEQ ID NO: 127363 - DNA, 21 bp, Homo sapiens
aggttcgggattccctggtgg

SEQ ID NO: 127364 - DNA, 18 bp, Homo sapiens
aggtttcccagtgagcct

SEQ ID NO: 127365 - DNA, 20 bp, Homo sapiens
aggtttcccagtgagcctct

SEQ ID NO: 127366 - DNA, 24 bp, Homo sapiens
aggttttgaataaaaagtgaactt

SEQ ID NO: 127367 - DNA, 14 bp, Homo sapiens
aggtttttctcccc

SEQ ID NO: 127368 - DNA, 20 bp, Homo sapiens
aggttttttttttaagtgca

SEQ ID NO: 127369 - DNA, 14 bp, Homo sapiens
agtaaaatccaaag

SEQ ID NO: 127370 - DNA, 20 bp, Homo sapiens
agtaaaatccaaagaactat

SEQ ID NO: 127371 - DNA, 15 bp, Homo sapiens
agtaaactgaggccc

SEQ ID NO: 127372 - DNA, 15 bp, Homo sapiens
agtaatgaagaatca

SEQ ID NO: 127373 - DNA, 23 bp, Homo sapiens
agtacctcccctccccgccccct

SEQ ID NO: 127374 - DNA, 22 bp, Homo sapiens
agtagtgtcttcctagtatatt

SEQ ID NO: 127375 - DNA, 18 bp, Homo sapiens
agtattcagaaattaaaa

SEQ ID NO: 127376 - DNA, 22 bp, Homo sapiens
agtattcagaaattaaaatatt

SEQ ID NO: 127377 - DNA, 23 bp, Homo sapiens
agtattcagaaattaaaatatta

SEQ ID NO: 127378 - DNA, 16 bp, Homo sapiens
agtatttataaaaata

SEQ ID NO: 127379 - DNA, 17 bp, Homo sapiens
agtatttataaaaatat

SEQ ID NO: 127380 - DNA, 14 bp, Homo sapiens
agtattttcttccc

SEQ ID NO: 127381 - DNA, 16 bp, Homo sapiens
agtatttttgtattca

SEQ ID NO: 127382 - DNA, 14 bp, Homo sapiens
agtcatgtgggcca

SEQ ID NO: 127383 - DNA, 13 bp, Homo sapiens
agtccatgaaaat

SEQ ID NO: 127384 - DNA, 13 bp, Homo sapiens
agtcgagcactct

SEQ ID NO: 127385 - DNA, 11 bp, Homo sapiens
agtctcctggg

SEQ ID NO: 127386 - DNA, 13 bp, Homo sapiens
ataaaaatataaa

SEQ ID NO: 127387 - DNA, 14 bp, Homo sapiens
ataaaaatataaat

SEQ ID NO: 127388 - DNA, 13 bp, Homo sapiens
ataaaactttaaa

SEQ ID NO: 127389 - DNA, 14 bp, Homo sapiens
ataaaactttaaaa

SEQ ID NO: 127390 - DNA, 15 bp, Homo sapiens
ataaaactttaaaag

SEQ ID NO: 127391 - DNA, 12 bp, Homo sapiens
ataaacagctga

SEQ ID NO: 127392 - DNA, 13 bp, Homo sapiens
ataaaggtattta

SEQ ID NO: 127393 - DNA, 23 bp, Homo sapiens
ataaattgtacattttgtaaaat

SEQ ID NO: 127394 - DNA, 15 bp, Homo sapiens
ataaatttaagaaaa

SEQ ID NO: 127395 - DNA, 18 bp, Homo sapiens
ataaatttaagaaaacaa

SEQ ID NO: 127396 - DNA, 20 bp, Homo sapiens
ataaatttaagaaaacaagt

SEQ ID NO: 127397 - DNA, 21 bp, Homo sapiens
ataacactgttggcacttata

SEQ ID NO: 127398 - DNA, 14 bp, Homo sapiens
ataacacttaactt

SEQ ID NO: 127399 - DNA, 12 bp, Homo sapiens
ataacctctggc

SEQ ID NO: 127400 - DNA, 16 bp, Homo sapiens
ataacctctggccctt

SEQ ID NO: 127401 - DNA, 17 bp, Homo sapiens
ataacctctggcccttg

SEQ ID NO: 127402 - DNA, 19 bp, Homo sapiens
ataacctctggcccttgga

SEQ ID NO: 127403 - DNA, 14 bp, Homo sapiens
ataacgttctcagt

SEQ ID NO: 127404 - DNA, 13 bp, Homo sapiens
ataagaaaagtaa

SEQ ID NO: 127405 - DNA, 16 bp, Homo sapiens
ataagttttgatataa

SEQ ID NO: 127406 - DNA, 13 bp, Homo sapiens
ataataactgaac

SEQ ID NO: 127407 - DNA, 15 bp, Homo sapiens
ataataactgaactg

SEQ ID NO: 127408 - DNA, 15 bp, Homo sapiens
ataataagttttgat

SEQ ID NO: 127409 - DNA, 16 bp, Homo sapiens
ataataagttttgata

SEQ ID NO: 127410 - DNA, 20 bp, Homo sapiens
ataataagttttgatataat

SEQ ID NO: 127411 - DNA, 14 bp, Homo sapiens
ataatctcatttca

SEQ ID NO: 127412 - DNA, 23 bp, Homo sapiens
ataatcttggcttcttaaaaact

SEQ ID NO: 127413 - DNA, 12 bp, Homo sapiens
ataattgttgat

SEQ ID NO: 127414 - DNA, 14 bp, Homo sapiens
ataattgttgatat

SEQ ID NO: 127415 - DNA, 15 bp, Homo sapiens
ataattgttgatatt

SEQ ID NO: 127416 - DNA, 16 bp, Homo sapiens
ataattttaaataacc

SEQ ID NO: 127417 - DNA, 22 bp, Homo sapiens
ataattttaaataacctctggc

SEQ ID NO: 127418 - DNA, 13 bp, Homo sapiens
ataattttccttt

SEQ ID NO: 127419 - DNA, 19 bp, Homo sapiens
atacaatccgagctacaaa

SEQ ID NO: 127420 - DNA, 16 bp, Homo sapiens
atacatacatgtatct

SEQ ID NO: 127421 - DNA, 16 bp, Homo sapiens
ataccataggaagaca

SEQ ID NO: 127422 - DNA, 21 bp, Homo sapiens
atattccaaggaaaattgaaa

SEQ ID NO: 127423 - DNA, 12 bp, Homo sapiens
atattgctaaaa

SEQ ID NO: 127424 - DNA, 15 bp, Homo sapiens
atattgctaaaagtg

SEQ ID NO: 127425 - DNA, 18 bp, Homo sapiens
atattgctaaaagtgcat

SEQ ID NO: 127426 - DNA, 14 bp, Homo sapiens
atatttaagtttgt

SEQ ID NO: 127427 - DNA, 19 bp, Homo sapiens
atatttgcaaaccctttgt

SEQ ID NO: 127428 - DNA, 15 bp, Homo sapiens
atatttgtaaggctt

SEQ ID NO: 127429 - DNA, 15 bp, Homo sapiens
atcaccccagccccc

SEQ ID NO: 127430 - DNA, 16 bp, Homo sapiens
atcaccccagccccca

SEQ ID NO: 127431 - DNA, 18 bp, Homo sapiens
atcaccccagcccccaca

SEQ ID NO: 127432 - DNA, 16 bp, Homo sapiens
atcacgatttcatcct

SEQ ID NO: 127433 - DNA, 17 bp, Homo sapiens
atcactgattccctctc

SEQ ID NO: 127434 - DNA, 18 bp, Homo sapiens
atcactgattccctctcc

SEQ ID NO: 127435 - DNA, 15 bp, Homo sapiens
atcacttaacattcc

SEQ ID NO: 127436 - DNA, 22 bp, Homo sapiens
atcagaggtcatcccttcctcc

SEQ ID NO: 127437 - DNA, 15 bp, Homo sapiens
atcagcatgacaaaa

SEQ ID NO: 127438 - DNA, 21 bp, Homo sapiens
atcagcatgacaaaaataaca

SEQ ID NO: 127439 - DNA, 22 bp, Homo sapiens
atcagcatgacaaaaataacac

SEQ ID NO: 127440 - DNA, 11 bp, Homo sapiens
atcataaagta

SEQ ID NO: 127441 - DNA, 19 bp, Homo sapiens
atcatacttaacatttcat

SEQ ID NO: 127442 - DNA, 12 bp, Homo sapiens
atcattcatctt

SEQ ID NO: 127443 - DNA, 20 bp, Homo sapiens
atcatttttgtataaaaagg

SEQ ID NO: 127444 - DNA, 23 bp, Homo sapiens
atcatttttgtataaaaaggaaa

SEQ ID NO: 127445 - DNA, 15 bp, Homo sapiens
atccaaggaaacatg

SEQ ID NO: 127446 - DNA, 21 bp, Homo sapiens
atccacctgtctcagcctccc

SEQ ID NO: 127447 - DNA, 14 bp, Homo sapiens
atccagagaagcgc

SEQ ID NO: 127448 - DNA, 14 bp, Homo sapiens
atcccaagtgtctc

SEQ ID NO: 127449 - DNA, 21 bp, Homo sapiens
atcccaagtgtctcttgactg

SEQ ID NO: 127450 - DNA, 14 bp, Homo sapiens
atcccacaccctgg

SEQ ID NO: 127451 - DNA, 14 bp, Homo sapiens
atcccctctctgtg

SEQ ID NO: 127452 - DNA, 21 bp, Homo sapiens
atcccctctctgtggctccaa

SEQ ID NO: 127453 - DNA, 15 bp, Homo sapiens
atcccttcctcctct

SEQ ID NO: 127454 - DNA, 20 bp, Homo sapiens
atcccttcctcctctcctgg

SEQ ID NO: 127455 - DNA, 23 bp, Homo sapiens
atcccttcctcctctcctggaaa

SEQ ID NO: 127456 - DNA, 19 bp, Homo sapiens
atcctatatctgtttgtat

SEQ ID NO: 127457 - DNA, 18 bp, Homo sapiens
atcctcctcagcccccag

SEQ ID NO: 127458 - DNA, 23 bp, Homo sapiens
atcctcctcagcccccaggccag

SEQ ID NO: 127459 - DNA, 13 bp, Homo sapiens
atccttgaatcct

SEQ ID NO: 127460 - DNA, 17 bp, Homo sapiens
atccttgaatcctatgt

SEQ ID NO: 127461 - DNA, 22 bp, Homo sapiens
atccttgggccataattatgaa

SEQ ID NO: 127462 - DNA, 21 bp, Homo sapiens
atcgacatcctagccccaccc

SEQ ID NO: 127463 - DNA, 21 bp, Homo sapiens
atctaactgatgagtaaactg

SEQ ID NO: 127464 - DNA, 15 bp, Homo sapiens
atctacagtaatgaa

SEQ ID NO: 127465 - DNA, 19 bp, Homo sapiens
atctagacattcttttaat

SEQ ID NO: 127466 - DNA, 14 bp, Homo sapiens
atctcaccccatcc

SEQ ID NO: 127467 - DNA, 23 bp, Homo sapiens
atctcaccccatcccacaccctg

SEQ ID NO: 127468 - DNA, 15 bp, Homo sapiens
atctctaaactgctg

SEQ ID NO: 127469 - DNA, 14 bp, Homo sapiens
atctctccctcccc

SEQ ID NO: 127470 - DNA, 16 bp, Homo sapiens
atctcttattttacaa

SEQ ID NO: 127471 - DNA, 19 bp, Homo sapiens
atctgcattttcaccccac

SEQ ID NO: 127472 - DNA, 18 bp, Homo sapiens
atcttagagtttacagtt

SEQ ID NO: 127473 - DNA, 21 bp, Homo sapiens
atcttagagtttacagtttgt

SEQ ID NO: 127474 - DNA, 22 bp, Homo sapiens
atcttagagtttacagtttgtg

SEQ ID NO: 127475 - DNA, 13 bp, Homo sapiens
atcttggcttctt

SEQ ID NO: 127476 - DNA, 15 bp, Homo sapiens
atcttggcttcttaa

SEQ ID NO: 127477 - DNA, 23 bp, Homo sapiens
atcttggcttcttaaaaactgtg

SEQ ID NO: 127478 - DNA, 13 bp, Homo sapiens
atcttttttccta

SEQ ID NO: 127479 - DNA, 20 bp, Homo sapiens
atcttttttcctagtttttc

SEQ ID NO: 127480 - DNA, 18 bp, Homo sapiens
atgaaaatcctatatctg

SEQ ID NO: 127481 - DNA, 16 bp, Homo sapiens
atgaactgtggaattt

SEQ ID NO: 127482 - DNA, 19 bp, Homo sapiens
atgaactgtggaatttatt

SEQ ID NO: 127483 - DNA, 20 bp, Homo sapiens
atgaactgtggaatttattg

SEQ ID NO: 127484 - DNA, 13 bp, Homo sapiens
atgacatattttt

SEQ ID NO: 127485 - DNA, 13 bp, Homo sapiens
atgatcaagatat

SEQ ID NO: 127486 - DNA, 19 bp, Homo sapiens
atgcaaatttctataaatt

SEQ ID NO: 127487 - DNA, 20 bp, Homo sapiens
atgcaagacttcactgcagc

SEQ ID NO: 127488 - DNA, 11 bp, Homo sapiens
atgcctctgga

SEQ ID NO: 127489 - DNA, 18 bp, Homo sapiens
atgctatcagaaacagta

SEQ ID NO: 127490 - DNA, 23 bp, Homo sapiens
atgctgaggttttgaataaaaag

SEQ ID NO: 127491 - DNA, 11 bp, Homo sapiens
agaagtgccct

SEQ ID NO: 127492 - DNA, 13 bp, Homo sapiens
agaagtgtatata

SEQ ID NO: 127493 - DNA, 20 bp, Homo sapiens
agaatagcctagatatgaat

SEQ ID NO: 127494 - DNA, 19 bp, Homo sapiens
agaatcatacttaacattt

SEQ ID NO: 127495 - DNA, 14 bp, Homo sapiens
agaatgaactgtgg

SEQ ID NO: 127496 - DNA, 21 bp, Homo sapiens
agaatgaactgtggaatttat

SEQ ID NO: 127497 - DNA, 23 bp, Homo sapiens
agaatgaactgtggaatttattg

SEQ ID NO: 127498 - DNA, 14 bp, Homo sapiens
agaatgcattaaaa

SEQ ID NO: 127499 - DNA, 13 bp, Homo sapiens
agaatggagaaag

SEQ ID NO: 127500 - DNA, 17 bp, Homo sapiens
agaatggagaaagtaag

SEQ ID NO: 127501 - DNA, 22 bp, Homo sapiens
agaatggagaaagtaagtcttt

SEQ ID NO: 127502 - DNA, 13 bp, Homo sapiens
agaatggtggctt

SEQ ID NO: 127503 - DNA, 16 bp, Homo sapiens
agaattaaaactgagt

SEQ ID NO: 127504 - DNA, 23 bp, Homo sapiens
agaattaaaactgagtccatgaa

SEQ ID NO: 127505 - DNA, 23 bp, Homo sapiens
agaatttaatggactgtgaattt

SEQ ID NO: 127506 - DNA, 12 bp, Homo sapiens
agacaaagcaaa

SEQ ID NO: 127507 - DNA, 18 bp, Homo sapiens
agacacatgctgaggttt

SEQ ID NO: 127508 - DNA, 15 bp, Homo sapiens
agacagggagaagtt

SEQ ID NO: 127509 - DNA, 12 bp, Homo sapiens
agacataaaact

SEQ ID NO: 127510 - DNA, 13 bp, Homo sapiens
agacataaaactt

SEQ ID NO: 127511 - DNA, 21 bp, Homo sapiens
agacataaaactttaaaaggc

SEQ ID NO: 127512 - DNA, 16 bp, Homo sapiens
agacatgcccaaaact

SEQ ID NO: 127513 - DNA, 17 bp, Homo sapiens
agacatgcccaaaactt

SEQ ID NO: 127514 - DNA, 14 bp, Homo sapiens
agacattcttttaa

SEQ ID NO: 127515 - DNA, 16 bp, Homo sapiens
agaccaggagggagag

SEQ ID NO: 127516 - DNA, 15 bp, Homo sapiens
agacccacagccctg

SEQ ID NO: 127517 - DNA, 17 bp, Homo sapiens
agacccacagccctgaa

SEQ ID NO: 127518 - DNA, 12 bp, Homo sapiens
agacgtgaatgt

SEQ ID NO: 127519 - DNA, 18 bp, Homo sapiens
agacgtgaatgtctcagc

SEQ ID NO: 127520 - DNA, 14 bp, Homo sapiens
agactcagaggacc

SEQ ID NO: 127521 - DNA, 14 bp, Homo sapiens
agactccggcctgt

SEQ ID NO: 127522 - DNA, 21 bp, Homo sapiens
agactgcaatgtgatctatgt

SEQ ID NO: 127523 - DNA, 15 bp, Homo sapiens
caaagactcctctgg

SEQ ID NO: 127524 - DNA, 16 bp, Homo sapiens
caaagactcctctggg

SEQ ID NO: 127525 - DNA, 17 bp, Homo sapiens
caaagactcctctgggc

SEQ ID NO: 127526 - DNA, 23 bp, Homo sapiens
caaagcatgggaaaaagagactc

SEQ ID NO: 127527 - DNA, 20 bp, Homo sapiens
caaagggcagtaaagttttc

SEQ ID NO: 127528 - DNA, 22 bp, Homo sapiens
caaatagcgtgggatagatttg

SEQ ID NO: 127529 - DNA, 14 bp, Homo sapiens
caaatcaaaataaa

SEQ ID NO: 127530 - DNA, 17 bp, Homo sapiens
caaatgaacttttacag

SEQ ID NO: 127531 - DNA, 21 bp, Homo sapiens
caaatgaacttttacagaatg

SEQ ID NO: 127532 - DNA, 23 bp, Homo sapiens
caaatgaacttttacagaatgca

SEQ ID NO: 127533 - DNA, 16 bp, Homo sapiens
caaatgagcattagct

SEQ ID NO: 127534 - DNA, 20 bp, Homo sapiens
caaatgagcattagctactt

SEQ ID NO: 127535 - DNA, 19 bp, Homo sapiens
caaatttctctgttccata

SEQ ID NO: 127536 - DNA, 13 bp, Homo sapiens
caacatttctgta

SEQ ID NO: 127537 - DNA, 14 bp, Homo sapiens
caacatttctgtat

SEQ ID NO: 127538 - DNA, 18 bp, Homo sapiens
caacgctctaccctgcag

SEQ ID NO: 127539 - DNA, 23 bp, Homo sapiens
caacgctctaccctgcagcttgg

SEQ ID NO: 127540 - DNA, 16 bp, Homo sapiens
caactaggggaggaga

SEQ ID NO: 127541 - DNA, 18 bp, Homo sapiens
caactaggggaggagaga

SEQ ID NO: 127542 - DNA, 15 bp, Homo sapiens
caagaatggtggctt

SEQ ID NO: 127543 - DNA, 20 bp, Homo sapiens
caagaatggtggcttctttt

SEQ ID NO: 127544 - DNA, 20 bp, Homo sapiens
caagaggtttttctccccgc

SEQ ID NO: 127545 - DNA, 19 bp, Homo sapiens
caagattttttttgtaact

SEQ ID NO: 127546 - DNA, 20 bp, Homo sapiens
caagcacatctgcattttca

SEQ ID NO: 127547 - DNA, 18 bp, Homo sapiens
caagcctcactattactt

SEQ ID NO: 127548 - DNA, 17 bp, Homo sapiens
caaggaaaattgaaagt

SEQ ID NO: 127549 - DNA, 18 bp, Homo sapiens
caaggaaaattgaaagta

SEQ ID NO: 127550 - DNA, 22 bp, Homo sapiens
caaggaaaattgaaagtattca

SEQ ID NO: 127551 - DNA, 18 bp, Homo sapiens
caagtcctgctcctttct

SEQ ID NO: 127552 - DNA, 19 bp, Homo sapiens
caagtcctgctcctttctg

SEQ ID NO: 127553 - DNA, 15 bp, Homo sapiens
caagtggtgaccaaa

SEQ ID NO: 127554 - DNA, 21 bp, Homo sapiens
caagttttttaattaagcaga

SEQ ID NO: 127555 - DNA, 18 bp, Homo sapiens
caataaaattatttgcag

SEQ ID NO: 127556 - DNA, 15 bp, Homo sapiens
caatacatgctgcta

SEQ ID NO: 127557 - DNA, 16 bp, Homo sapiens
caatagaaagaaacta

SEQ ID NO: 127558 - DNA, 20 bp, Homo sapiens
caatagtgtcctatgcaata

SEQ ID NO: 127559 - DNA, 22 bp, Homo sapiens
caatagtgtcctatgcaataaa

SEQ ID NO: 127560 - DNA, 18 bp, Homo sapiens
caatagttcttaaaatta

SEQ ID NO: 127561 - DNA, 23 bp, Homo sapiens
caatcgacatcctagccccaccc

SEQ ID NO: 127562 - DNA, 14 bp, Homo sapiens
caatgcgtgttgta

SEQ ID NO: 127563 - DNA, 15 bp, Homo sapiens
caatgtcagaaactc

SEQ ID NO: 127564 - DNA, 13 bp, Homo sapiens
caattatattgtc

SEQ ID NO: 127565 - DNA, 18 bp, Homo sapiens
caattccaagaaaatatc

SEQ ID NO: 127566 - DNA, 21 bp, Homo sapiens
caattccaagaaaatatcact

SEQ ID NO: 127567 - DNA, 15 bp, Homo sapiens
cacaaatttctctgt

SEQ ID NO: 127568 - DNA, 14 bp, Homo sapiens
cacacattttatga

SEQ ID NO: 127569 - DNA, 15 bp, Homo sapiens
cacacattttatgag

SEQ ID NO: 127570 - DNA, 18 bp, Homo sapiens
cacacccccaagccacag

SEQ ID NO: 127571 - DNA, 16 bp, Homo sapiens
cacaccgctggctccg

SEQ ID NO: 127572 - DNA, 18 bp, Homo sapiens
cacagactccggcctgta

SEQ ID NO: 127573 - DNA, 22 bp, Homo sapiens
cacagactccggcctgtaatca

SEQ ID NO: 127574 - DNA, 14 bp, Homo sapiens
cacagcccagggcc

SEQ ID NO: 127575 - DNA, 17 bp, Homo sapiens
cacagcccagggcctgc

SEQ ID NO: 127576 - DNA, 10 bp, Homo sapiens
cacataaagg

SEQ ID NO: 127577 - DNA, 20 bp, Homo sapiens
cacataaaggtatttagaat

SEQ ID NO: 127578 - DNA, 14 bp, Homo sapiens
cacatataacactt

SEQ ID NO: 127579 - DNA, 15 bp, Homo sapiens
cacatataacactta

SEQ ID NO: 127580 - DNA, 12 bp, Homo sapiens
cacatatatgta

SEQ ID NO: 127581 - DNA, 19 bp, Homo sapiens
cacatgctgaggttttgaa

SEQ ID NO: 127582 - DNA, 15 bp, Homo sapiens
cacattttatgagag

SEQ ID NO: 127583 - DNA, 19 bp, Homo sapiens
cacattttgtacaaagata

SEQ ID NO: 127584 - DNA, 15 bp, Homo sapiens
caccacgtccagctg

SEQ ID NO: 127585 - DNA, 17 bp, Homo sapiens
caccagggagaggcctc

SEQ ID NO: 127586 - DNA, 14 bp, Homo sapiens
caccagtgcctcag

SEQ ID NO: 127587 - DNA, 22 bp, Homo sapiens
caccagtgcctcagtgctgcaa

SEQ ID NO: 127588 - DNA, 18 bp, Homo sapiens
caccatcattaagaataa

SEQ ID NO: 127589 - DNA, 16 bp, Homo sapiens
cacccaccccacagac

SEQ ID NO: 127590 - DNA, 15 bp, Homo sapiens
cacccaccccatgga

SEQ ID NO: 127591 - DNA, 19 bp, Homo sapiens
cacccagaggtggccctcc

SEQ ID NO: 127592 - DNA, 22 bp, Homo sapiens
cacccagaggtggccctcccag

SEQ ID NO: 127593 - DNA, 13 bp, Homo sapiens
caccccagccccc

SEQ ID NO: 127594 - DNA, 16 bp, Homo sapiens
cacccccaagccacag

SEQ ID NO: 127595 - DNA, 11 bp, Homo sapiens
cacccctgcct

SEQ ID NO: 127596 - DNA, 20 bp, Homo sapiens
agcccttctaccccacctga

SEQ ID NO: 127597 - DNA, 23 bp, Homo sapiens
agccgtgctcgcccacaaactga

SEQ ID NO: 127598 - DNA, 19 bp, Homo sapiens
agcctagatatgaatatat

SEQ ID NO: 127599 - DNA, 18 bp, Homo sapiens
agcctcactattacttga

SEQ ID NO: 127600 - DNA, 22 bp, Homo sapiens
agcctcactattacttgaactt

SEQ ID NO: 127601 - DNA, 21 bp, Homo sapiens
agcctctgcgcctctccactg

SEQ ID NO: 127602 - DNA, 19 bp, Homo sapiens
agcctgatggtatactact

SEQ ID NO: 127603 - DNA, 20 bp, Homo sapiens
agcctgcaggtccggggagg

SEQ ID NO: 127604 - DNA, 22 bp, Homo sapiens
agcctgcaggtccggggaggag

SEQ ID NO: 127605 - DNA, 21 bp, Homo sapiens
agcctgcccagttggaggaga

SEQ ID NO: 127606 - DNA, 22 bp, Homo sapiens
agcctgttgggatcgcattgca

SEQ ID NO: 127607 - DNA, 12 bp, Homo sapiens
agccttgctcag

SEQ ID NO: 127608 - DNA, 15 bp, Homo sapiens
agcctttgcctcccc

SEQ ID NO: 127609 - DNA, 16 bp, Homo sapiens
agcctttgcctccccg

SEQ ID NO: 127610 - DNA, 15 bp, Homo sapiens
agcgaacaaccacag

SEQ ID NO: 127611 - DNA, 19 bp, Homo sapiens
agcgctgttgatcccctct

SEQ ID NO: 127612 - DNA, 21 bp, Homo sapiens
agcgctgttgcccgccctcca

SEQ ID NO: 127613 - DNA, 22 bp, Homo sapiens
agctacaaagcatgggaaaaag

SEQ ID NO: 127614 - DNA, 16 bp, Homo sapiens
agctcaggatatggct

SEQ ID NO: 127615 - DNA, 18 bp, Homo sapiens
agctccctgaccccctgt

SEQ ID NO: 127616 - DNA, 20 bp, Homo sapiens
agctctattaagatttccaa

SEQ ID NO: 127617 - DNA, 22 bp, Homo sapiens
agctctattaagatttccaagt

SEQ ID NO: 127618 - DNA, 23 bp, Homo sapiens
agctgacggtttctccccggaca

SEQ ID NO: 127619 - DNA, 14 bp, Homo sapiens
agctgctgaggccc

SEQ ID NO: 127620 - DNA, 14 bp, Homo sapiens
agctggccctcagc

SEQ ID NO: 127621 - DNA, 23 bp, Homo sapiens
agctggccctcagctccctgacc

SEQ ID NO: 127622 - DNA, 14 bp, Homo sapiens
agctgggccactcc

SEQ ID NO: 127623 - DNA, 19 bp, Homo sapiens
agctgggccactcctcttc

SEQ ID NO: 127624 - DNA, 12 bp, Homo sapiens
cagacagggaga

SEQ ID NO: 127625 - DNA, 16 bp, Homo sapiens
cagacagggagaagtt

SEQ ID NO: 127626 - DNA, 16 bp, Homo sapiens
cagactccggcctgta

SEQ ID NO: 127627 - DNA, 20 bp, Homo sapiens
cagactccggcctgtaatca

SEQ ID NO: 127628 - DNA, 9 bp, Homo sapiens
cagagaaag

SEQ ID NO: 127629 - DNA, 23 bp, Homo sapiens
cagagaaagaaaaggcaaaagac

SEQ ID NO: 127630 - DNA, 22 bp, Homo sapiens
cagagaagcgctgttgcccgcc

SEQ ID NO: 127631 - DNA, 19 bp, Homo sapiens
cagaggccgctgcccctga

SEQ ID NO: 127632 - DNA, 23 bp, Homo sapiens
cagaggccgctgcccctgagttc

SEQ ID NO: 127633 - DNA, 16 bp, Homo sapiens
cagaggtggccctccc

SEQ ID NO: 127634 - DNA, 19 bp, Homo sapiens
cagaggtggccctcccagg

SEQ ID NO: 127635 - DNA, 15 bp, Homo sapiens
cagatagtgcctctg

SEQ ID NO: 127636 - DNA, 16 bp, Homo sapiens
cagatctttttgtgaa

SEQ ID NO: 127637 - DNA, 15 bp, Homo sapiens
cagatgcagttttca

SEQ ID NO: 127638 - DNA, 18 bp, Homo sapiens
cagatgcagttttcaaat

SEQ ID NO: 127639 - DNA, 21 bp, Homo sapiens
cagatttgaggactgaagctg

SEQ ID NO: 127640 - DNA, 22 bp, Homo sapiens
cagatttttatattagttgctt

SEQ ID NO: 127641 - DNA, 23 bp, Homo sapiens
cagatttttatattagttgcttt

SEQ ID NO: 127642 - DNA, 14 bp, Homo sapiens
cagcacagcccagg

SEQ ID NO: 127643 - DNA, 18 bp, Homo sapiens
cagcacagcccagggcct

SEQ ID NO: 127644 - DNA, 15 bp, Homo sapiens
cagcaggatgccctg

SEQ ID NO: 127645 - DNA, 15 bp, Homo sapiens
cagcagtacaataaa

SEQ ID NO: 127646 - DNA, 15 bp, Homo sapiens
cagcatgacaaaaat

SEQ ID NO: 127647 - DNA, 18 bp, Homo sapiens
cagcatgtatagttgctt

SEQ ID NO: 127648 - DNA, 19 bp, Homo sapiens
cagcatgtatagttgcttt

SEQ ID NO: 127649 - DNA, 13 bp, Homo sapiens
cagccaaggaatg

SEQ ID NO: 127650 - DNA, 16 bp, Homo sapiens
cagccacaccgctggc

SEQ ID NO: 127651 - DNA, 17 bp, Homo sapiens
cagccacaccgctggct

SEQ ID NO: 127652 - DNA, 16 bp, Homo sapiens
cagccactgcagcaca

SEQ ID NO: 127653 - DNA, 14 bp, Homo sapiens
cagcccagggcctg

SEQ ID NO: 127654 - DNA, 17 bp, Homo sapiens
cagccccaatccagaga

SEQ ID NO: 127655 - DNA, 21 bp, Homo sapiens
cagccccaatccagagaagcg

SEQ ID NO: 127656 - DNA, 13 bp, Homo sapiens
cagcccccaggcc

SEQ ID NO: 127657 - DNA, 14 bp, Homo sapiens
cagcccccaggcca

SEQ ID NO: 127658 - DNA, 16 bp, Homo sapiens
cagcccccaggccagg

SEQ ID NO: 127659 - DNA, 15 bp, Homo sapiens
cagccccgtcccaga

SEQ ID NO: 127660 - DNA, 19 bp, Homo sapiens
cagccccgtcccagaggcc

SEQ ID NO: 127661 - DNA, 13 bp, Homo sapiens
cagccctgaaacg

SEQ ID NO: 127662 - DNA, 23 bp, Homo sapiens
cagccctgaaacgagaagtgccc

SEQ ID NO: 127663 - DNA, 17 bp, Homo sapiens
cagcctgctcagcaggt

SEQ ID NO: 127664 - DNA, 12 bp, Homo sapiens
cagctcagctgg

SEQ ID NO: 127665 - DNA, 14 bp, Homo sapiens
cagctcagctgggc

SEQ ID NO: 127666 - DNA, 15 bp, Homo sapiens
cagctccctgacccc

SEQ ID NO: 127667 - DNA, 19 bp, Homo sapiens
cagctccctgaccccctgt

SEQ ID NO: 127668 - DNA, 13 bp, Homo sapiens
cagctctcctggc

SEQ ID NO: 127669 - DNA, 14 bp, Homo sapiens
cagctctcctggct

SEQ ID NO: 127670 - DNA, 13 bp, Homo sapiens
cagctctctctcc

SEQ ID NO: 127671 - DNA, 18 bp, Homo sapiens
cagctctctctcctggag

SEQ ID NO: 127672 - DNA, 22 bp, Homo sapiens
cagctgacggtttctccccgga

SEQ ID NO: 127673 - DNA, 16 bp, Homo sapiens
cagcttgtgctgagcc

SEQ ID NO: 127674 - DNA, 23 bp, Homo sapiens
cagcttgtgctgagcctgcccag

SEQ ID NO: 127675 - DNA, 13 bp, Homo sapiens
caggactctgcag

SEQ ID NO: 127676 - DNA, 14 bp, Homo sapiens
caggactctgcaga

SEQ ID NO: 127677 - DNA, 21 bp, Homo sapiens
caggaggctccgtgagccctt

SEQ ID NO: 127678 - DNA, 19 bp, Homo sapiens
caggcatcactgattccct

SEQ ID NO: 127679 - DNA, 14 bp, Homo sapiens
caggcccagtgaca

SEQ ID NO: 127680 - DNA, 16 bp, Homo sapiens
caggcgatccacctgt

SEQ ID NO: 127681 - DNA, 19 bp, Homo sapiens
caggcttatttttaaaata

SEQ ID NO: 127682 - DNA, 12 bp, Homo sapiens
cagggagaagtt

SEQ ID NO: 127683 - DNA, 20 bp, Homo sapiens
cagggagaagttgagcaggt

SEQ ID NO: 127684 - DNA, 17 bp, Homo sapiens
cagggagaggcctcggc

SEQ ID NO: 127685 - DNA, 23 bp, Homo sapiens
cagggagaggcctcggctgtctc

SEQ ID NO: 127686 - DNA, 11 bp, Homo sapiens
cagggcctggc

SEQ ID NO: 127687 - DNA, 15 bp, Homo sapiens
caggggtctgagcca

SEQ ID NO: 127688 - DNA, 23 bp, Homo sapiens
cagggtgaagcaccagggagagg

SEQ ID NO: 127689 - DNA, 17 bp, Homo sapiens
caggtccggggaggagg

SEQ ID NO: 127690 - DNA, 12 bp, Homo sapiens
caggtctctgtg

SEQ ID NO: 127691 - DNA, 21 bp, Homo sapiens
caggttgaatgggttctcagt

SEQ ID NO: 127692 - DNA, 16 bp, Homo sapiens
cagtatcttagagttt

SEQ ID NO: 127693 - DNA, 18 bp, Homo sapiens
cagtatcttagagtttac

SEQ ID NO: 127694 - DNA, 21 bp, Homo sapiens
cagtgacaaagactcctctgg

SEQ ID NO: 127695 - DNA, 18 bp, Homo sapiens
cagtgagcctctgcgcct

SEQ ID NO: 127696 - DNA, 18 bp, Homo sapiens
cagtgcctcagtgctgca

SEQ ID NO: 127697 - DNA, 22 bp, Homo sapiens
cagtgtattagtcataaaacac

SEQ ID NO: 127698 - DNA, 15 bp, Homo sapiens
cagtttaagagtttt

SEQ ID NO: 127699 - DNA, 12 bp, Homo sapiens
attttgcatttc

SEQ ID NO: 127700 - DNA, 16 bp, Homo sapiens
attttgccatttagcg

SEQ ID NO: 127701 - DNA, 13 bp, Homo sapiens
attttgtaaaata

SEQ ID NO: 127702 - DNA, 16 bp, Homo sapiens
atttttgaaaaatatt

SEQ ID NO: 127703 - DNA, 22 bp, Homo sapiens
atttttgaaaaatattgctaaa

SEQ ID NO: 127704 - DNA, 20 bp, Homo sapiens
atttttgtacgttatatatt

SEQ ID NO: 127705 - DNA, 22 bp, Homo sapiens
atttttgtacgttatatattgt

SEQ ID NO: 127706 - DNA, 17 bp, Homo sapiens
atttttgtataaaaagg

SEQ ID NO: 127707 - DNA, 18 bp, Homo sapiens
atttttgtataaaaagga

SEQ ID NO: 127708 - DNA, 21 bp, Homo sapiens
atttttgtataaaaaggaaat

SEQ ID NO: 127709 - DNA, 15 bp, Homo sapiens
attttttaaaagaga

SEQ ID NO: 127710 - DNA, 21 bp, Homo sapiens
attttttcatttcaaaatgct

SEQ ID NO: 127711 - DNA, 20 bp, Homo sapiens
caaaaaaaaaaaaaaagact

SEQ ID NO: 127712 - DNA, 23 bp, Homo sapiens
caaaaaaaaaaaaaaagactgtc

SEQ ID NO: 127713 - DNA, 21 bp, Homo sapiens
caaaaaagcttttgttttgct

SEQ ID NO: 127714 - DNA, 16 bp, Homo sapiens
caaaaagaccttctcc

SEQ ID NO: 127715 - DNA, 23 bp, Homo sapiens
caaaaataacactgttggcactt

SEQ ID NO: 127716 - DNA, 11 bp, Homo sapiens
caaaacaatgc

SEQ ID NO: 127717 - DNA, 16 bp, Homo sapiens
caaaagaaaccatgac

SEQ ID NO: 127718 - DNA, 17 bp, Homo sapiens
caaaagaaaccatgaca

SEQ ID NO: 127719 - DNA, 19 bp, Homo sapiens
caaaagaaaccatgacaaa

SEQ ID NO: 127720 - DNA, 20 bp, Homo sapiens
caaaagactggtttgtttgc

SEQ ID NO: 127721 - DNA, 23 bp, Homo sapiens
caaaagactggtttgtttgctta

SEQ ID NO: 127722 - DNA, 18 bp, Homo sapiens
caaaagagtgtaaaatat

SEQ ID NO: 127723 - DNA, 16 bp, Homo sapiens
caaaataaaagaaata

SEQ ID NO: 127724 - DNA, 16 bp, Homo sapiens
caaaattaaatctaga

SEQ ID NO: 127725 - DNA, 15 bp, Homo sapiens
caaaaataacactgt

SEQ ID NO: 127726 - DNA, 16 bp, Homo sapiens
caaaaataacactgtt

SEQ ID NO: 127727 - DNA, 12 bp, Homo sapiens
caaaacaaacaa

SEQ ID NO: 127728 - DNA, 16 bp, Homo sapiens
caaaagactggtttgt

SEQ ID NO: 127729 - DNA, 16 bp, Homo sapiens
caaaagagtgtaaaat

SEQ ID NO: 127730 - DNA, 20 bp, Homo sapiens
caaaagagtgtaaaatattt

SEQ ID NO: 127731 - DNA, 14 bp, Homo sapiens
caaaatcaacatga

SEQ ID NO: 127732 - DNA, 16 bp, Homo sapiens
caaaatcaacatgact

SEQ ID NO: 127733 - DNA, 16 bp, Homo sapiens
caaaccagtttattct

SEQ ID NO: 127734 - DNA, 18 bp, Homo sapiens
caaaccagtttattctgt

SEQ ID NO: 127735 - DNA, 23 bp, Homo sapiens
caaaccagtttattctgtggttc

SEQ ID NO: 127736 - DNA, 16 bp, Homo sapiens
caaactacatgtaatc

SEQ ID NO: 127737 - DNA, 19 bp, Homo sapiens
caaagactcctctgggcct

SEQ ID NO: 127738 - DNA, 20 bp, Homo sapiens
caaagactcctctgggcctg

SEQ ID NO: 127739 - DNA, 22 bp, Homo sapiens
caaagagagtttttaatagaac

SEQ ID NO: 127740 - DNA, 15 bp, Homo sapiens
caaagatgatggaaa

SEQ ID NO: 127741 - DNA, 17 bp, Homo sapiens
caaagcatgggaaaaag

SEQ ID NO: 127742 - DNA, 18 bp, Homo sapiens
caaagcatgggaaaaaga

SEQ ID NO: 127743 - DNA, 18 bp, Homo sapiens
caaaggaatataagaaaa

SEQ ID NO: 127744 - DNA, 16 bp, Homo sapiens
caaagggcagtaaagt

SEQ ID NO: 127745 - DNA, 13 bp, Homo sapiens
caaatcaaaataa

SEQ ID NO: 127746 - DNA, 15 bp, Homo sapiens
caaatcaaaataaaa

SEQ ID NO: 127747 - DNA, 18 bp, Homo sapiens
caaatcaaaataaaagaa

SEQ ID NO: 127748 - DNA, 18 bp, Homo sapiens
caaatccaaggaaacatg

SEQ ID NO: 127749 - DNA, 16 bp, Homo sapiens
caaatgaacttttaca

SEQ ID NO: 127750 - DNA, 18 bp, Homo sapiens
caaatgaacttttacaga

SEQ ID NO: 127751 - DNA, 23 bp, Homo sapiens
caaatgcaaatttctataaattt

SEQ ID NO: 127752 - DNA, 22 bp, Homo sapiens
caaattattaattgtcctgtgt

SEQ ID NO: 127753 - DNA, 17 bp, Homo sapiens
caaatttctataaattt

SEQ ID NO: 127754 - DNA, 23 bp, Homo sapiens
caaatttctataaatttaagaaa

SEQ ID NO: 127755 - DNA, 18 bp, Homo sapiens
caacatttctgtatactg

SEQ ID NO: 127756 - DNA, 20 bp, Homo sapiens
caacatttctgtatactgta

SEQ ID NO: 127757 - DNA, 22 bp, Homo sapiens
caacatttctgtatactgtaaa

SEQ ID NO: 127758 - DNA, 21 bp, Homo sapiens
caacccgttgggtcccttgct

SEQ ID NO: 127759 - DNA, 23 bp, Homo sapiens
caacccgttgggtcccttgctgc

SEQ ID NO: 127760 - DNA, 14 bp, Homo sapiens
caacctgtgtctta

SEQ ID NO: 127761 - DNA, 19 bp, Homo sapiens
caacgctctaccctgcagc

SEQ ID NO: 127762 - DNA, 20 bp, Homo sapiens
caacgctctaccctgcagct

SEQ ID NO: 127763 - DNA, 15 bp, Homo sapiens
caactcaaagatgat

SEQ ID NO: 127764 - DNA, 20 bp, Homo sapiens
caacttgctacttatcattt

SEQ ID NO: 127765 - DNA, 15 bp, Homo sapiens
caagaattaaaactg

SEQ ID NO: 127766 - DNA, 18 bp, Homo sapiens
caagaattaaaactgagt

SEQ ID NO: 127767 - DNA, 22 bp, Homo sapiens
caagaattaaaactgagtccat

SEQ ID NO: 127768 - DNA, 17 bp, Homo sapiens
caagacaaagcaaagcc

SEQ ID NO: 127769 - DNA, 21 bp, Homo sapiens
caagattttttttgtaacttc

SEQ ID NO: 127770 - DNA, 14 bp, Homo sapiens
caaggaaaattgaa

SEQ ID NO: 127771 - DNA, 19 bp, Homo sapiens
caaggaaaattgaaagtat

SEQ ID NO: 127772 - DNA, 15 bp, Homo sapiens
caaggaggtggctgt

SEQ ID NO: 127773 - DNA, 23 bp, Homo sapiens
caaggccggagacccacagccct

SEQ ID NO: 127774 - DNA, 20 bp, Homo sapiens
caaggtaggctgcaaaatta

SEQ ID NO: 127775 - DNA, 22 bp, Homo sapiens
caaggtttcccagtgagcctct

SEQ ID NO: 127776 - DNA, 17 bp, Homo sapiens
caagtagtagtgtcttc

SEQ ID NO: 127777 - DNA, 17 bp, Homo sapiens
caagtatataatttact

SEQ ID NO: 127778 - DNA, 13 bp, Homo sapiens
caagtcagtttct

SEQ ID NO: 127779 - DNA, 16 bp, Homo sapiens
caagtcagtttctaca

SEQ ID NO: 127780 - DNA, 18 bp, Homo sapiens
caagtctctgctggccca

SEQ ID NO: 127781 - DNA, 22 bp, Homo sapiens
caagtctctgctggcccagcca

SEQ ID NO: 127782 - DNA, 15 bp, Homo sapiens
caagtgtcctggacc

SEQ ID NO: 127783 - DNA, 22 bp, Homo sapiens
caagtgtctcttgactggctca

SEQ ID NO: 127784 - DNA, 11 bp, Homo sapiens
caagtttgcta

SEQ ID NO: 127785 - DNA, 20 bp, Homo sapiens
caagtttgctaaaagaagag

SEQ ID NO: 127786 - DNA, 17 bp, Homo sapiens
caataaaattatttgca

SEQ ID NO: 127787 - DNA, 17 bp, Homo sapiens
caataaagtttgctttc

SEQ ID NO: 127788 - DNA, 16 bp, Homo sapiens
caatagttcttaaaat

SEQ ID NO: 127789 - DNA, 15 bp, Homo sapiens
caatgccacatactt

SEQ ID NO: 127790 - DNA, 17 bp, Homo sapiens
caattaaagaaataatt

SEQ ID NO: 127791 - DNA, 18 bp, Homo sapiens
caattaaagaaataattt

SEQ ID NO: 127792 - DNA, 15 bp, Homo sapiens
caattagcagaatgg

SEQ ID NO: 127793 - DNA, 14 bp, Homo sapiens
caattccaagaaaa

SEQ ID NO: 127794 - DNA, 13 bp, Homo sapiens
caattgccacatt

SEQ ID NO: 127795 - DNA, 21 bp, Homo sapiens
caattgtgagccaccacgtcc

SEQ ID NO: 127796 - DNA, 19 bp, Homo sapiens
cacaacgctctaccctgca

SEQ ID NO: 127797 - DNA, 22 bp, Homo sapiens
cacaacgctctaccctgcagct

SEQ ID NO: 127798 - DNA, 16 bp, Homo sapiens
cacagaagggctcttt

SEQ ID NO: 127799 - DNA, 11 bp, Homo sapiens
cacagactccg

SEQ ID NO: 127800 - DNA, 15 bp, Homo sapiens
cacagactccggcct

SEQ ID NO: 127801 - DNA, 15 bp, Homo sapiens
cacagcccagggcct

SEQ ID NO: 127802 - DNA, 13 bp, Homo sapiens
cacagccctgaaa

SEQ ID NO: 127803 - DNA, 13 bp, Homo sapiens
cacagccctggaa

SEQ ID NO: 127804 - DNA, 20 bp, Homo sapiens
caggcttatttttaaaataa

SEQ ID NO: 127805 - DNA, 15 bp, Homo sapiens
cagggagaggcctcg

SEQ ID NO: 127806 - DNA, 13 bp, Homo sapiens
cagggcgcaagcc

SEQ ID NO: 127807 - DNA, 14 bp, Homo sapiens
caggggtctgagcc

SEQ ID NO: 127808 - DNA, 17 bp, Homo sapiens
caggggtggggcccatg

SEQ ID NO: 127809 - DNA, 19 bp, Homo sapiens
caggggtggggcccatggg

SEQ ID NO: 127810 - DNA, 17 bp, Homo sapiens
cagggtgaagcaccagg

SEQ ID NO: 127811 - DNA, 20 bp, Homo sapiens
cagggtgaagcaccagggag

SEQ ID NO: 127812 - DNA, 21 bp, Homo sapiens
caggtagcatagctctgtaca

SEQ ID NO: 127813 - DNA, 15 bp, Homo sapiens
caggtccggggagga

SEQ ID NO: 127814 - DNA, 16 bp, Homo sapiens
caggtccggggaggag

SEQ ID NO: 127815 - DNA, 16 bp, Homo sapiens
cagtagtcgtcaagtt

SEQ ID NO: 127816 - DNA, 16 bp, Homo sapiens
cagtattttcttccca

SEQ ID NO: 127817 - DNA, 17 bp, Homo sapiens
cagtcctgcctcagcct

SEQ ID NO: 127818 - DNA, 19 bp, Homo sapiens
cagtgaagtctagaatcat

SEQ ID NO: 127819 - DNA, 22 bp, Homo sapiens
cagtgacaaagactcctctggg

SEQ ID NO: 127820 - DNA, 12 bp, Homo sapiens
cagtgagcctct

SEQ ID NO: 127821 - DNA, 19 bp, Homo sapiens
cagtgagcctctgcgcctc

SEQ ID NO: 127822 - DNA, 19 bp, Homo sapiens
cagtgagtgtaaataattt

SEQ ID NO: 127823 - DNA, 20 bp, Homo sapiens
cagtgagtgtaaataatttt

SEQ ID NO: 127824 - DNA, 12 bp, Homo sapiens
cagtgcctcagt

SEQ ID NO: 127825 - DNA, 13 bp, Homo sapiens
cagtgttcccccc

SEQ ID NO: 127826 - DNA, 14 bp, Homo sapiens
ccactgcagcacag

SEQ ID NO: 127827 - DNA, 16 bp, Homo sapiens
ccactgccgatgccca

SEQ ID NO: 127828 - DNA, 22 bp, Homo sapiens
ccactggcacttgcctgctgct

SEQ ID NO: 127829 - DNA, 17 bp, Homo sapiens
ccacttcatgcccactg

SEQ ID NO: 127830 - DNA, 22 bp, Homo sapiens
ccacttcatgcccactgccgat

SEQ ID NO: 127831 - DNA, 17 bp, Homo sapiens
ccagaggccgctgcccc

SEQ ID NO: 127832 - DNA, 19 bp, Homo sapiens
ccagaggccgctgcccctg

SEQ ID NO: 127833 - DNA, 21 bp, Homo sapiens
ccagaggccgctgcccctgag

SEQ ID NO: 127834 - DNA, 15 bp, Homo sapiens
ccagaggtggccctc

SEQ ID NO: 127835 - DNA, 20 bp, Homo sapiens
ccagaggtggccctcccagg

SEQ ID NO: 127836 - DNA, 17 bp, Homo sapiens
ccagcagtacaataaaa

SEQ ID NO: 127837 - DNA, 17 bp, Homo sapiens
ccagccaaaccctgtct

SEQ ID NO: 127838 - DNA, 19 bp, Homo sapiens
ccagccaaaccctgtctga

SEQ ID NO: 127839 - DNA, 13 bp, Homo sapiens
ccagccactgcag

SEQ ID NO: 127840 - DNA, 21 bp, Homo sapiens
ccagccccaatccagagaagc

SEQ ID NO: 127841 - DNA, 19 bp, Homo sapiens
ccagcccccacagccctgg

SEQ ID NO: 127842 - DNA, 17 bp, Homo sapiens
ccagctctctctcctgg

SEQ ID NO: 127843 - DNA, 18 bp, Homo sapiens
ccagctctctctcctgga

SEQ ID NO: 127844 - DNA, 16 bp, Homo sapiens
ccaggagggagagcct

SEQ ID NO: 127845 - DNA, 22 bp, Homo sapiens
ccaggagggagagcctctgttt

SEQ ID NO: 127846 - DNA, 18 bp, Homo sapiens
ccaggcatcactgattcc

SEQ ID NO: 127847 - DNA, 18 bp, Homo sapiens
ccaggccaggtgaggtcc

SEQ ID NO: 127848 - DNA, 13 bp, Homo sapiens
ccagggagaggcc

SEQ ID NO: 127849 - DNA, 14 bp, Homo sapiens
ccagggagaggcct

SEQ ID NO: 127850 - DNA, 15 bp, Homo sapiens
ccagggagaggcctc

SEQ ID NO: 127851 - DNA, 21 bp, Homo sapiens
ccagggagaggcctcggctgt

SEQ ID NO: 127852 - DNA, 19 bp, Homo sapiens
ccaggggtggggcccatgg

SEQ ID NO: 127853 - DNA, 13 bp, Homo sapiens
ccagtgagcctct

SEQ ID NO: 127854 - DNA, 14 bp, Homo sapiens
ccagtgagcctctg

SEQ ID NO: 127855 - DNA, 12 bp, Homo sapiens
ccagtgagtgta

SEQ ID NO: 127856 - DNA, 19 bp, Homo sapiens
ccagtgcctcagtgctgca

SEQ ID NO: 127857 - DNA, 20 bp, Homo sapiens
ccataattatgaaaactcat

SEQ ID NO: 127858 - DNA, 17 bp, Homo sapiens
ccatagagaccaggagg

SEQ ID NO: 127859 - DNA, 23 bp, Homo sapiens
ccataggaagacataaaacttta

SEQ ID NO: 127860 - DNA, 19 bp, Homo sapiens
ccatagttaaagaagacat

SEQ ID NO: 127861 - DNA, 11 bp, Homo sapiens
ccatgaaaata

SEQ ID NO: 127862 - DNA, 16 bp, Homo sapiens
ccatgaagctggccct

SEQ ID NO: 127863 - DNA, 18 bp, Homo sapiens
ccatgacaaacctagctt

SEQ ID NO: 127864 - DNA, 13 bp, Homo sapiens
ccatgcctctgga

SEQ ID NO: 127865 - DNA, 22 bp, Homo sapiens
ccatgcctctggaggcctctgg

SEQ ID NO: 127866 - DNA, 21 bp, Homo sapiens
ccatggagacaataaacagct

SEQ ID NO: 127867 - DNA, 23 bp, Homo sapiens
ccatggggtctctgcatcttcag

SEQ ID NO: 127868 - DNA, 17 bp, Homo sapiens
ccatgtgcacctatggc

SEQ ID NO: 127869 - DNA, 20 bp, Homo sapiens
ccatgtgcacctatggccca

SEQ ID NO: 127870 - DNA, 23 bp, Homo sapiens
ccatgtgcacctatggcccagcc

SEQ ID NO: 127871 - DNA, 10 bp, Homo sapiens
ccattgaaat

SEQ ID NO: 127872 - DNA, 14 bp, Homo sapiens
cccaaacaccctcc

SEQ ID NO: 127873 - DNA, 19 bp, Homo sapiens
cccaagtagtagtgtcttc

SEQ ID NO: 127874 - DNA, 22 bp, Homo sapiens
cccaagtagtagtgtcttccta

SEQ ID NO: 127875 - DNA, 15 bp, Homo sapiens
cccacagactccggc

SEQ ID NO: 127876 - DNA, 13 bp, Homo sapiens
cccacagccctga

SEQ ID NO: 127877 - DNA, 12 bp, Homo sapiens
cccacccaagga

SEQ ID NO: 127878 - DNA, 13 bp, Homo sapiens
cccacccagaggt

SEQ ID NO: 127879 - DNA, 16 bp, Homo sapiens
cccacccagaggtggc

SEQ ID NO: 127880 - DNA, 22 bp, Homo sapiens
cccacccagaggtggccctccc

SEQ ID NO: 127881 - DNA, 13 bp, Homo sapiens
cccaccccatgga

SEQ ID NO: 127882 - DNA, 14 bp, Homo sapiens
cccaccccatggag

SEQ ID NO: 127883 - DNA, 12 bp, Homo sapiens
cccacccccatc

SEQ ID NO: 127884 - DNA, 18 bp, Homo sapiens
cccaccgaggagccccag

SEQ ID NO: 127885 - DNA, 15 bp, Homo sapiens
cccacctgacctctg

SEQ ID NO: 127886 - DNA, 22 bp, Homo sapiens
cccagaggccgctgcccctgag

SEQ ID NO: 127887 - DNA, 18 bp, Homo sapiens
cccagaggtggccctccc

SEQ ID NO: 127888 - DNA, 18 bp, Homo sapiens
cccagcccccacagccct

SEQ ID NO: 127889 - DNA, 19 bp, Homo sapiens
cccagcccccacagccctg

SEQ ID NO: 127890 - DNA, 16 bp, Homo sapiens
cccagccccgtcccag

SEQ ID NO: 127891 - DNA, 20 bp, Homo sapiens
cccagccccgtcccagaggc

SEQ ID NO: 127892 - DNA, 22 bp, Homo sapiens
cccagccccgtcccagaggccg

SEQ ID NO: 127893 - DNA, 21 bp, Homo sapiens
cccagctctctctcctggagt

SEQ ID NO: 127894 - DNA, 13 bp, Homo sapiens
cccaggccaggtg

SEQ ID NO: 127895 - DNA, 20 bp, Homo sapiens
cccagtgacaaagactcctc

SEQ ID NO: 127896 - DNA, 12 bp, Homo sapiens
cccagtgagcct

SEQ ID NO: 127897 - DNA, 13 bp, Homo sapiens
cccagtgagcctc

SEQ ID NO: 127898 - DNA, 15 bp, Homo sapiens
cccagttggaggaga

SEQ ID NO: 127899 - DNA, 17 bp, Homo sapiens
cccagttggaggagact

SEQ ID NO: 127900 - DNA, 17 bp, Homo sapiens
cccatagagaccaggag

SEQ ID NO: 127901 - DNA, 18 bp, Homo sapiens
cccatagagaccaggagg

SEQ ID NO: 127902 - DNA, 18 bp, Homo sapiens
cccatctctccctcccct

SEQ ID NO: 127903 - DNA, 14 bp, Homo sapiens
cccatgaagctggc

SEQ ID NO: 127904 - DNA, 15 bp, Homo sapiens
cccatgaagctggcc

SEQ ID NO: 127905 - DNA, 19 bp, Homo sapiens
cccatgaagctggccctca

SEQ ID NO: 127906 - DNA, 23 bp, Homo sapiens
cccatgaagctggccctcagctc

SEQ ID NO: 127907 - DNA, 21 bp, Homo sapiens
ccccaagtgtcctggaccctg

SEQ ID NO: 127908 - DNA, 21 bp, Homo sapiens
ccccacagactccggcctgta

SEQ ID NO: 127909 - DNA, 17 bp, Homo sapiens
ccccacagccctggaat

SEQ ID NO: 127910 - DNA, 13 bp, Homo sapiens
ccccacctgacct

SEQ ID NO: 127911 - DNA, 15 bp, Homo sapiens
ccccactgacagcct

SEQ ID NO: 127912 - DNA, 17 bp, Homo sapiens
ccccagcccccacagcc

SEQ ID NO: 127913 - DNA, 19 bp, Homo sapiens
ccccagccccgtcccagag

SEQ ID NO: 127914 - DNA, 20 bp, Homo sapiens
ccccagccccgtcccagagg

SEQ ID NO: 127915 - DNA, 14 bp, Homo sapiens
ccccaggccaggtg

SEQ ID NO: 127916 - DNA, 23 bp, Homo sapiens
ccccagggggcggggtgcagaag

SEQ ID NO: 127917 - DNA, 18 bp, Homo sapiens
ccccatagagaccaggag

SEQ ID NO: 127918 - DNA, 22 bp, Homo sapiens
ccccatggagacaataaacagc

SEQ ID NO: 127919 - DNA, 22 bp, Homo sapiens
cccccaagtgtcctggaccctg

SEQ ID NO: 127920 - DNA, 15 bp, Homo sapiens
cccccacagccctgg

SEQ ID NO: 127921 - DNA, 22 bp, Homo sapiens
cccccacttcatgcccactgcc

SEQ ID NO: 127922 - DNA, 23 bp, Homo sapiens
ccccctgaaacatgtgcccctgc

SEQ ID NO: 127923 - DNA, 23 bp, Homo sapiens
ccccgccccctccctgctcccag

SEQ ID NO: 127924 - DNA, 16 bp, Homo sapiens
cccctccctgctccca

SEQ ID NO: 127925 - DNA, 18 bp, Homo sapiens
cccctccctgctcccagc

SEQ ID NO: 127926 - DNA, 18 bp, Homo sapiens
cccctgaaacatgtgccc

SEQ ID NO: 127927 - DNA, 19 bp, Homo sapiens
cagtttttaactctactgt

SEQ ID NO: 127928 - DNA, 14 bp, Homo sapiens
cataaaactttaaa

SEQ ID NO: 127929 - DNA, 16 bp, Homo sapiens
cataaaactttaaaag

SEQ ID NO: 127930 - DNA, 19 bp, Homo sapiens
cataaaactttaaaaggca

SEQ ID NO: 127931 - DNA, 20 bp, Homo sapiens
cataaagtatgccttcctgt

SEQ ID NO: 127932 - DNA, 14 bp, Homo sapiens
cataattatgaaaa

SEQ ID NO: 127933 - DNA, 21 bp, Homo sapiens
cataattatgaaaactcatga

SEQ ID NO: 127934 - DNA, 16 bp, Homo sapiens
catacagaggtaacta

SEQ ID NO: 127935 - DNA, 22 bp, Homo sapiens
catacatgtatctggtttgtca

SEQ ID NO: 127936 - DNA, 16 bp, Homo sapiens
catacttaacatttca

SEQ ID NO: 127937 - DNA, 19 bp, Homo sapiens
catacttaacatttcattg

SEQ ID NO: 127938 - DNA, 16 bp, Homo sapiens
catagctctgtacatc

SEQ ID NO: 127939 - DNA, 17 bp, Homo sapiens
cataggaagacataaaa

SEQ ID NO: 127940 - DNA, 20 bp, Homo sapiens
catagttaaagaagacattt

SEQ ID NO: 127941 - DNA, 18 bp, Homo sapiens
catatatgtatatgtata

SEQ ID NO: 127942 - DNA, 19 bp, Homo sapiens
catatgaggacctttatat

SEQ ID NO: 127943 - DNA, 23 bp, Homo sapiens
catatgaggacctttatatctgt

SEQ ID NO: 127944 - DNA, 17 bp, Homo sapiens
catcaaaggaatataag

SEQ ID NO: 127945 - DNA, 20 bp, Homo sapiens
catcactgattccctctccc

SEQ ID NO: 127946 - DNA, 18 bp, Homo sapiens
catcattaagaataattg

SEQ ID NO: 127947 - DNA, 14 bp, Homo sapiens
catcccttcctcct

SEQ ID NO: 127948 - DNA, 23 bp, Homo sapiens
catcccttcctcctctcctggaa

SEQ ID NO: 127949 - DNA, 13 bp, Homo sapiens
catcctagcccca

SEQ ID NO: 127950 - DNA, 14 bp, Homo sapiens
catcctagccccac

SEQ ID NO: 127951 - DNA, 16 bp, Homo sapiens
catcctagccccaccc

SEQ ID NO: 127952 - DNA, 21 bp, Homo sapiens
catcctagccccacccagagg

SEQ ID NO: 127953 - DNA, 17 bp, Homo sapiens
catcctcctcagccccc

SEQ ID NO: 127954 - DNA, 22 bp, Homo sapiens
catctaactgatgagtaaactg

SEQ ID NO: 127955 - DNA, 23 bp, Homo sapiens
catctctccctcccctgccattt

SEQ ID NO: 127956 - DNA, 19 bp, Homo sapiens
catcttcagtcgtctgtcc

SEQ ID NO: 127957 - DNA, 20 bp, Homo sapiens
catcttcagtcgtctgtccc

SEQ ID NO: 127958 - DNA, 14 bp, Homo sapiens
catgaaaataccat

SEQ ID NO: 127959 - DNA, 19 bp, Homo sapiens
catgaaagagaaagactga

SEQ ID NO: 127960 - DNA, 15 bp, Homo sapiens
catgaagctggccct

SEQ ID NO: 127961 - DNA, 16 bp, Homo sapiens
catgaagctggccctc

SEQ ID NO: 127962 - DNA, 21 bp, Homo sapiens
catgaaggacactctgcaggg

SEQ ID NO: 127963 - DNA, 14 bp, Homo sapiens
catgacaaaaataa

SEQ ID NO: 127964 - DNA, 19 bp, Homo sapiens
catgagggaagaataaaga

SEQ ID NO: 127965 - DNA, 17 bp, Homo sapiens
catgggcgcaggcccag

SEQ ID NO: 127966 - DNA, 22 bp, Homo sapiens
catgggggcaccgggctccatg

SEQ ID NO: 127967 - DNA, 22 bp, Homo sapiens
catggggtctctgcatcttcag

SEQ ID NO: 127968 - DNA, 20 bp, Homo sapiens
catggttcattttctgatgc

SEQ ID NO: 127969 - DNA, 15 bp, Homo sapiens
catgtatagttgctt

SEQ ID NO: 127970 - DNA, 20 bp, Homo sapiens
catgtgcacctatggcccag

SEQ ID NO: 127971 - DNA, 20 bp, Homo sapiens
catgttggttgcactttgta

SEQ ID NO: 127972 - DNA, 22 bp, Homo sapiens
catgttggttgcactttgtagt

SEQ ID NO: 127973 - DNA, 22 bp, Homo sapiens
cattaaaaaaaaaaaaaaactc

SEQ ID NO: 127974 - DNA, 19 bp, Homo sapiens
cattaaaatatatgttctg

SEQ ID NO: 127975 - DNA, 17 bp, Homo sapiens
cattaatcaatttctca

SEQ ID NO: 127976 - DNA, 23 bp, Homo sapiens
cattacaatcgagactgcaatgt

SEQ ID NO: 127977 - DNA, 14 bp, Homo sapiens
cattgaaatcagca

SEQ ID NO: 127978 - DNA, 19 bp, Homo sapiens
cattgaaatcagcatgaca

SEQ ID NO: 127979 - DNA, 16 bp, Homo sapiens
catttaaatatctgaa

SEQ ID NO: 127980 - DNA, 15 bp, Homo sapiens
catttatatattgga

SEQ ID NO: 127981 - DNA, 14 bp, Homo sapiens
catttcaaaatgct

SEQ ID NO: 127982 - DNA, 13 bp, Homo sapiens
catttctgtatac

SEQ ID NO: 127983 - DNA, 16 bp, Homo sapiens
catttctgtatactgt

SEQ ID NO: 127984 - DNA, 20 bp, Homo sapiens
catttctgtatactgtaaaa

SEQ ID NO: 127985 - DNA, 23 bp, Homo sapiens
cattttaaaagcaattatattgt

SEQ ID NO: 127986 - DNA, 19 bp, Homo sapiens
cattttgtaaaatattatg

SEQ ID NO: 127987 - DNA, 14 bp, Homo sapiens
catttttgtataaa

SEQ ID NO: 127988 - DNA, 18 bp, Homo sapiens
ccaaaagaaaccatgaca

SEQ ID NO: 127989 - DNA, 18 bp, Homo sapiens
ccaaaccagtttattctg

SEQ ID NO: 127990 - DNA, 23 bp, Homo sapiens
ccaaaccagtttattctgtggtt

SEQ ID NO: 127991 - DNA, 14 bp, Homo sapiens
ccaaaccctgtctg

SEQ ID NO: 127992 - DNA, 12 bp, Homo sapiens
ccaaagaactat

SEQ ID NO: 127993 - DNA, 14 bp, Homo sapiens
ccaaatcaaaataa

SEQ ID NO: 127994 - DNA, 18 bp, Homo sapiens
ccaaattattaattgtcc

SEQ ID NO: 127995 - DNA, 18 bp, Homo sapiens
ccaaggccggagacccac

SEQ ID NO: 127996 - DNA, 22 bp, Homo sapiens
ccaaggccggagacccacagcc

SEQ ID NO: 127997 - DNA, 23 bp, Homo sapiens
ccaaggccggagacccacagccc

SEQ ID NO: 127998 - DNA, 15 bp, Homo sapiens
ccaaggtttcccagt

SEQ ID NO: 127999 - DNA, 21 bp, Homo sapiens
ccaaggtttcccagtgagcct

SEQ ID NO: 128000 - DNA, 14 bp, Homo sapiens
ccaagtcctgctcc

SEQ ID NO: 128001 - DNA, 19 bp, Homo sapiens
ccaagtgtcctggaccctg

SEQ ID NO: 128002 - DNA, 12 bp, Homo sapiens
ccaatccagaga

SEQ ID NO: 128003 - DNA, 20 bp, Homo sapiens
ccaatccagagaagcgctgt

SEQ ID NO: 128004 - DNA, 21 bp, Homo sapiens
ccaatccagagaagcgctgtt

SEQ ID NO: 128005 - DNA, 12 bp, Homo sapiens
ccaatccaggcc

SEQ ID NO: 128006 - DNA, 17 bp, Homo sapiens
ccaatcctgtttttcct

SEQ ID NO: 128007 - DNA, 15 bp, Homo sapiens
ccacaccgctggctc

SEQ ID NO: 128008 - DNA, 19 bp, Homo sapiens
ccacagactccggcctgta

SEQ ID NO: 128009 - DNA, 13 bp, Homo sapiens
ccacagccctgaa

SEQ ID NO: 128010 - DNA, 14 bp, Homo sapiens
ccacagccctgaaa

SEQ ID NO: 128011 - DNA, 15 bp, Homo sapiens
ccacagccctgaaac

SEQ ID NO: 128012 - DNA, 14 bp, Homo sapiens
ccacagccctggaa

SEQ ID NO: 128013 - DNA, 11 bp, Homo sapiens
ccacataaagg

SEQ ID NO: 128014 - DNA, 23 bp, Homo sapiens
ccacatgggaggaaggcccaggg

SEQ ID NO: 128015 - DNA, 13 bp, Homo sapiens
ccacccaaggaga

SEQ ID NO: 128016 - DNA, 13 bp, Homo sapiens
ccacccaccccac

SEQ ID NO: 128017 - DNA, 22 bp, Homo sapiens
ccacccagaggtggccctccca

SEQ ID NO: 128018 - DNA, 14 bp, Homo sapiens
ccaccccatggaga

SEQ ID NO: 128019 - DNA, 18 bp, Homo sapiens
ccacccgccccgccccct

SEQ ID NO: 128020 - DNA, 11 bp, Homo sapiens
ccaccctgtct

SEQ ID NO: 128021 - DNA, 14 bp, Homo sapiens
ccacccttcccctc

SEQ ID NO: 128022 - DNA, 14 bp, Homo sapiens
ccaccgaggagccc

SEQ ID NO: 128023 - DNA, 15 bp, Homo sapiens
ccaccgaggagcccc

SEQ ID NO: 128024 - DNA, 16 bp, Homo sapiens
ccaccgaggagcccca

SEQ ID NO: 128025 - DNA, 18 bp, Homo sapiens
ccaccgaggagccccagc

SEQ ID NO: 128026 - DNA, 22 bp, Homo sapiens
ccaccgaggagccccagccccg

SEQ ID NO: 128027 - DNA, 22 bp, Homo sapiens
ccaccggcccctggcagcacag

SEQ ID NO: 128028 - DNA, 15 bp, Homo sapiens
taggaagacataaaa

SEQ ID NO: 128029 - DNA, 18 bp, Homo sapiens
taggaagacataaaactt

SEQ ID NO: 128030 - DNA, 21 bp, Homo sapiens
taggacaaaaagaccttctcc

SEQ ID NO: 128031 - DNA, 12 bp, Homo sapiens
taggagactggt

SEQ ID NO: 128032 - DNA, 13 bp, Homo sapiens
taggataaaataa

SEQ ID NO: 128033 - DNA, 14 bp, Homo sapiens
taggataaaataat

SEQ ID NO: 128034 - DNA, 13 bp, Homo sapiens
taggggaggagag

SEQ ID NO: 128035 - DNA, 13 bp, Homo sapiens
tagtagtgtcttc

SEQ ID NO: 128036 - DNA, 20 bp, Homo sapiens
tagtatattagtttgattta

SEQ ID NO: 128037 - DNA, 13 bp, Homo sapiens
tagtctcctgggt

SEQ ID NO: 128038 - DNA, 23 bp, Homo sapiens
tagtgagattaaaaatctaaaaa

SEQ ID NO: 128039 - DNA, 21 bp, Homo sapiens
tagtgcaattccaagaaaata

SEQ ID NO: 128040 - DNA, 23 bp, Homo sapiens
tagtgcaattccaagaaaatatc

SEQ ID NO: 128041 - DNA, 14 bp, Homo sapiens
tagtgtcctatgca

SEQ ID NO: 128042 - DNA, 20 bp, Homo sapiens
tagtgtcttcctagtatatt

SEQ ID NO: 128043 - DNA, 14 bp, Homo sapiens
tagttgctttgtta

SEQ ID NO: 128044 - DNA, 13 bp, Homo sapiens
tagttttacacta

SEQ ID NO: 128045 - DNA, 14 bp, Homo sapiens
tataaaaaggaaat

SEQ ID NO: 128046 - DNA, 21 bp, Homo sapiens
tataaaaaggaaattagtctt

SEQ ID NO: 128047 - DNA, 21 bp, Homo sapiens
tataaattgtacattttgtaa

SEQ ID NO: 128048 - DNA, 15 bp, Homo sapiens
tataataagttttga

SEQ ID NO: 128049 - DNA, 20 bp, Homo sapiens
tataataagttttgatataa

SEQ ID NO: 128050 - DNA, 19 bp, Homo sapiens
tataatcttggcttcttaa

SEQ ID NO: 128051 - DNA, 18 bp, Homo sapiens
tataatttactttgtaga

SEQ ID NO: 128052 - DNA, 13 bp, Homo sapiens
tatacatacatgt

SEQ ID NO: 128053 - DNA, 14 bp, Homo sapiens
tatacatacatgta

SEQ ID NO: 128054 - DNA, 15 bp, Homo sapiens
tatacatacatgtat

SEQ ID NO: 128055 - DNA, 18 bp, Homo sapiens
tatacatacatgtatctg

SEQ ID NO: 128056 - DNA, 16 bp, Homo sapiens
tatactgtaaaagtta

SEQ ID NO: 128057 - DNA, 19 bp, Homo sapiens
tatagagatatttttgtac

SEQ ID NO: 128058 - DNA, 21 bp, Homo sapiens
tatagagatatttttgtacgt

SEQ ID NO: 128059 - DNA, 18 bp, Homo sapiens
tatagctggcaagaatgg

SEQ ID NO: 128060 - DNA, 13 bp, Homo sapiens
tataggataaaat

SEQ ID NO: 128061 - DNA, 14 bp, Homo sapiens
tataggataaaata

SEQ ID NO: 128062 - DNA, 15 bp, Homo sapiens
tataggataaaataa

SEQ ID NO: 128063 - DNA, 13 bp, Homo sapiens
tatagttgctttt

SEQ ID NO: 128064 - DNA, 18 bp, Homo sapiens
tatataatttactttgta

SEQ ID NO: 128065 - DNA, 18 bp, Homo sapiens
tatatagctggcaagaat

SEQ ID NO: 128066 - DNA, 12 bp, Homo sapiens
tatatattgtat

SEQ ID NO: 128067 - DNA, 16 bp, Homo sapiens
tatatattgtattaag

SEQ ID NO: 128068 - DNA, 13 bp, Homo sapiens
tatatcataaagt

SEQ ID NO: 128069 - DNA, 15 bp, Homo sapiens
tatatctgtttgtat

SEQ ID NO: 128070 - DNA, 18 bp, Homo sapiens
tatatctgtttgtatatt

SEQ ID NO: 128071 - DNA, 15 bp, Homo sapiens
tatatgagaagaata

SEQ ID NO: 128072 - DNA, 13 bp, Homo sapiens
tatatgtatatct

SEQ ID NO: 128073 - DNA, 14 bp, Homo sapiens
tatatgtatatcta

SEQ ID NO: 128074 - DNA, 18 bp, Homo sapiens
tatatgttctgcaagaat

SEQ ID NO: 128075 - DNA, 14 bp, Homo sapiens
tatattagttgctt

SEQ ID NO: 128076 - DNA, 18 bp, Homo sapiens
tatattagttgctttgtt

SEQ ID NO: 128077 - DNA, 16 bp, Homo sapiens
tatattccaaggaaaa

SEQ ID NO: 128078 - DNA, 15 bp, Homo sapiens
tatattgtattaagg

SEQ ID NO: 128079 - DNA, 12 bp, Homo sapiens
tatcattaaaat

SEQ ID NO: 128080 - DNA, 13 bp, Homo sapiens
tatcattaaaata

SEQ ID NO: 128081 - DNA, 19 bp, Homo sapiens
tatcattcatcttcttctt

SEQ ID NO: 128082 - DNA, 13 bp, Homo sapiens
tatcatttttgta

SEQ ID NO: 128083 - DNA, 19 bp, Homo sapiens
tatcatttttgtataaaaa

SEQ ID NO: 128084 - DNA, 21 bp, Homo sapiens
tatcatttttgtataaaaagg

SEQ ID NO: 128085 - DNA, 13 bp, Homo sapiens
tatctaatgacat

SEQ ID NO: 128086 - DNA, 16 bp, Homo sapiens
tatctacagtaatgaa

SEQ ID NO: 128087 - DNA, 14 bp, Homo sapiens
tatctatatctcta

SEQ ID NO: 128088 - DNA, 17 bp, Homo sapiens
tatctatatctctaaac

SEQ ID NO: 128089 - DNA, 23 bp, Homo sapiens
tatctatatctctaaactgctgt

SEQ ID NO: 128090 - DNA, 19 bp, Homo sapiens
tatctgaacatttactaca

SEQ ID NO: 128091 - DNA, 22 bp, Homo sapiens
tatctgcatttatcttttttcc

SEQ ID NO: 128092 - DNA, 19 bp, Homo sapiens
tatctgtgaaatgctggca

SEQ ID NO: 128093 - DNA, 17 bp, Homo sapiens
tatctgtttgtatattt

SEQ ID NO: 128094 - DNA, 20 bp, Homo sapiens
ttgcatacaactgtgcatta

SEQ ID NO: 128095 - DNA, 16 bp, Homo sapiens
ttgccaggcttaagga

SEQ ID NO: 128096 - DNA, 18 bp, Homo sapiens
ttgcccgccctccaccca

SEQ ID NO: 128097 - DNA, 23 bp, Homo sapiens
ttgcccgccctccacccactagg

SEQ ID NO: 128098 - DNA, 12 bp, Homo sapiens
ttgctaaaagaa

SEQ ID NO: 128099 - DNA, 14 bp, Homo sapiens
ttgctaaaagaaga

SEQ ID NO: 128100 - DNA, 19 bp, Homo sapiens
ttgctcaggtgcaagtgcc

SEQ ID NO: 128101 - DNA, 11 bp, Homo sapiens
ttgctccaggc

SEQ ID NO: 128102 - DNA, 15 bp, Homo sapiens
ttgctccaggcatca

SEQ ID NO: 128103 - DNA, 23 bp, Homo sapiens
ttgcttaatttccttctgttaag

SEQ ID NO: 128104 - DNA, 13 bp, Homo sapiens
ttgcttacatcct

SEQ ID NO: 128105 - DNA, 23 bp, Homo sapiens
ttgctttgttaaaaaaaaaaaga

SEQ ID NO: 128106 - DNA, 18 bp, Homo sapiens
ttgcttttgaaggaatac

SEQ ID NO: 128107 - DNA, 21 bp, Homo sapiens
ttgcttttgaaggaatacaat

SEQ ID NO: 128108 - DNA, 15 bp, Homo sapiens
ttggaggagactggg

SEQ ID NO: 128109 - DNA, 18 bp, Homo sapiens
ttggagtgccccaaggag

SEQ ID NO: 128110 - DNA, 16 bp, Homo sapiens
ttggcagccaaggaat

SEQ ID NO: 128111 - DNA, 21 bp, Homo sapiens
ttggcatgggcgcaggcccag

SEQ ID NO: 128112 - DNA, 14 bp, Homo sapiens
ttgggccataatta

SEQ ID NO: 128113 - DNA, 21 bp, Homo sapiens
ttgggccataattatgaaaac

SEQ ID NO: 128114 - DNA, 22 bp, Homo sapiens
ttggtcgagtctttgtgtgtta

SEQ ID NO: 128115 - DNA, 23 bp, Homo sapiens
ttggtcgagtctttgtgtgttat

SEQ ID NO: 128116 - DNA, 16 bp, Homo sapiens
ttgtaacttcaaatat

SEQ ID NO: 128117 - DNA, 17 bp, Homo sapiens
ttgtaatttgaattggg

SEQ ID NO: 128118 - DNA, 15 bp, Homo sapiens
ttgtacaaagatatg

SEQ ID NO: 128119 - DNA, 22 bp, Homo sapiens
ttgtacatacagaggtaactat

SEQ ID NO: 128120 - DNA, 20 bp, Homo sapiens
ttgtacgttatatattgtat

SEQ ID NO: 128121 - DNA, 19 bp, Homo sapiens
ttgtataaaaaggaaatta

SEQ ID NO: 128122 - DNA, 15 bp, Homo sapiens
ttgtatatttgcaaa

SEQ ID NO: 128123 - DNA, 16 bp, Homo sapiens
ttgtattataattgtt

SEQ ID NO: 128124 - DNA, 20 bp, Homo sapiens
ttgtcaagtctctgctggcc

SEQ ID NO: 128125 - DNA, 19 bp, Homo sapiens
ttgtcctgtgtctatgtac

SEQ ID NO: 128126 - DNA, 13 bp, Homo sapiens
ttgtgaaagaagg

SEQ ID NO: 128127 - DNA, 20 bp, Homo sapiens
ttgtgaaattcaacctgtgt

SEQ ID NO: 128128 - DNA, 18 bp, Homo sapiens
ttgtgagccaccacgtcc

SEQ ID NO: 128129 - DNA, 18 bp, Homo sapiens
ttgtgctgagcctgccca

SEQ ID NO: 128130 - DNA, 15 bp, Homo sapiens
ttgtgttttaaaaaa

SEQ ID NO: 128131 - DNA, 20 bp, Homo sapiens
ttgtgttttaaaaaaactga

SEQ ID NO: 128132 - DNA, 21 bp, Homo sapiens
ttgtgttttaaaaaaactgaa

SEQ ID NO: 128133 - DNA, 16 bp, Homo sapiens
ttgttatgaaaatcct

SEQ ID NO: 128134 - DNA, 14 bp, Homo sapiens
ttgttccctctccc

SEQ ID NO: 128135 - DNA, 22 bp, Homo sapiens
ttgttcgccgcgtggaatgtga

SEQ ID NO: 128136 - DNA, 23 bp, Homo sapiens
ttgttgatattttccctttttaa

SEQ ID NO: 128137 - DNA, 20 bp, Homo sapiens
ttgtttattctttttaaagt

SEQ ID NO: 128138 - DNA, 11 bp, Homo sapiens
ttttgaataaa

SEQ ID NO: 128139 - DNA, 14 bp, Homo sapiens
ttttgaataaaaag

SEQ ID NO: 128140 - DNA, 17 bp, Homo sapiens
ttttgatataatcttgg

SEQ ID NO: 128141 - DNA, 22 bp, Homo sapiens
ttttggtaaatttttgaaaaat

SEQ ID NO: 128142 - DNA, 12 bp, Homo sapiens
ttttgtaaaata

SEQ ID NO: 128143 - DNA, 11 bp, Homo sapiens
ttttgtaactt

SEQ ID NO: 128144 - DNA, 15 bp, Homo sapiens
ttttgtaacttcaaa

SEQ ID NO: 128145 - DNA, 20 bp, Homo sapiens
ttttgtacgttatatattgt

SEQ ID NO: 128146 - DNA, 14 bp, Homo sapiens
ttttgtataaaaag

SEQ ID NO: 128147 - DNA, 21 bp, Homo sapiens
ttttgttgtgcactagtgcaa

SEQ ID NO: 128148 - DNA, 23 bp, Homo sapiens
tttttaaaaaataccattgaaat

SEQ ID NO: 128149 - DNA, 20 bp, Homo sapiens
tttttaaaagagacaaactg

SEQ ID NO: 128150 - DNA, 13 bp, Homo sapiens
tttttaagtgcaa

SEQ ID NO: 128151 - DNA, 17 bp, Homo sapiens
tttttatattagttgct

SEQ ID NO: 128152 - DNA, 15 bp, Homo sapiens
tttttatttccacat

SEQ ID NO: 128153 - DNA, 15 bp, Homo sapiens
tttttgaaaaatatt

SEQ ID NO: 128154 - DNA, 18 bp, Homo sapiens
tttttgtaacttcaaata

SEQ ID NO: 128155 - DNA, 21 bp, Homo sapiens
tttttgtacgttatatattgt

SEQ ID NO: 128156 - DNA, 11 bp, Homo sapiens
tttttgtattc

SEQ ID NO: 128157 - DNA, 13 bp, Homo sapiens
ttttttggtaaat

SEQ ID NO: 128158 - DNA, 12 bp, Homo sapiens
tttttttccaaa

SEQ ID NO: 128159 - DNA, 13 bp, Homo sapiens
tttttttccaaat

SEQ ID NO: 128160 - DNA, 14 bp, Homo sapiens
tttttttgtaactt

SEQ ID NO: 128161 - DNA, 23 bp, Homo sapiens
tttgaataaaaagtgaacttttg

SEQ ID NO: 128162 - DNA, 18 bp, Homo sapiens
tttgcaaaccctttgtat

SEQ ID NO: 128163 - DNA, 20 bp, Homo sapiens
tttgcaaaccctttgtatta

SEQ ID NO: 128164 - DNA, 22 bp, Homo sapiens
tttgcaggtctttaaatcattt

SEQ ID NO: 128165 - DNA, 14 bp, Homo sapiens
tttgcatttcatgc

SEQ ID NO: 128166 - DNA, 12 bp, Homo sapiens
tttgctaaaaga

SEQ ID NO: 128167 - DNA, 17 bp, Homo sapiens
tttgctaaaagaagaga

SEQ ID NO: 128168 - DNA, 21 bp, Homo sapiens
tttgcttaatttccttctgtt

SEQ ID NO: 128169 - DNA, 22 bp, Homo sapiens
tttgcttaatttccttctgtta

SEQ ID NO: 128170 - DNA, 19 bp, Homo sapiens
tttggctacttttgaaaat

SEQ ID NO: 128171 - DNA, 15 bp, Homo sapiens
tttggtaaatttttg

SEQ ID NO: 128172 - DNA, 18 bp, Homo sapiens
tttgtaaaatattatgtt

SEQ ID NO: 128173 - DNA, 17 bp, Homo sapiens
tttgtaaggcttgttcc

SEQ ID NO: 128174 - DNA, 13 bp, Homo sapiens
tttgtaatttgaa

SEQ ID NO: 128175 - DNA, 17 bp, Homo sapiens
tttgtaatttgaattgg

SEQ ID NO: 128176 - DNA, 18 bp, Homo sapiens
tttgtacttttctggttc

SEQ ID NO: 128177 - DNA, 18 bp, Homo sapiens
tttgtataaaaaggaaat

SEQ ID NO: 128178 - DNA, 14 bp, Homo sapiens
tttgtatatttgca

SEQ ID NO: 128179 - DNA, 15 bp, Homo sapiens
tttgtattataattg

SEQ ID NO: 128180 - DNA, 23 bp, Homo sapiens
tttgtattataattgttgatatt

SEQ ID NO: 128181 - DNA, 17 bp, Homo sapiens
tttgttataattttcct

SEQ ID NO: 128182 - DNA, 11 bp, Homo sapiens
tttgtttgctt

SEQ ID NO: 128183 - DNA, 20 bp, Homo sapiens
tttgtttgcttaatttcctt

SEQ ID NO: 128184 - DNA, 14 bp, Homo sapiens
ttttaaaaaaactg

SEQ ID NO: 128185 - DNA, 18 bp, Homo sapiens
ttttaaaaaataccattg

SEQ ID NO: 128186 - DNA, 19 bp, Homo sapiens
ttttaaaaaataccattga

SEQ ID NO: 128187 - DNA, 22 bp, Homo sapiens
ttttaaaaaataccattgaaat

SEQ ID NO: 128188 - DNA, 14 bp, Homo sapiens
ttttaaaaaatatt

SEQ ID NO: 128189 - DNA, 22 bp, Homo sapiens
ttttaaaagagacaaactgtaa

SEQ ID NO: 128190 - DNA, 23 bp, Homo sapiens
ttttaaaagagacaaactgtaaa

SEQ ID NO: 128191 - DNA, 18 bp, Homo sapiens
ttttaaaagcaattatat

SEQ ID NO: 128192 - DNA, 13 bp, Homo sapiens
ttttaaaataaaa

SEQ ID NO: 128193 - DNA, 22 bp, Homo sapiens
ttttaaagtatgttattgcata

SEQ ID NO: 128194 - DNA, 13 bp, Homo sapiens
ttttaaagtattt

SEQ ID NO: 128195 - DNA, 20 bp, Homo sapiens
ttttaaagtatttataaaaa

SEQ ID NO: 128196 - DNA, 17 bp, Homo sapiens
ttttaaataacctctgg

SEQ ID NO: 128197 - DNA, 14 bp, Homo sapiens
ttttaagaaagaga

SEQ ID NO: 128198 - DNA, 21 bp, Homo sapiens
ttttaagaaagagaatgaact

SEQ ID NO: 128199 - DNA, 22 bp, Homo sapiens
ttttaagacgtgaatgtctcag

SEQ ID NO: 128200 - DNA, 21 bp, Homo sapiens
ttttaagtgcaacatttctgt

SEQ ID NO: 128201 - DNA, 18 bp, Homo sapiens
ttttactgacagaaatgc

SEQ ID NO: 128202 - DNA, 24 bp, Homo sapiens
ttttcagaattgaaggagaaaatg

SEQ ID NO: 128203 - DNA, 17 bp, Homo sapiens
ttttccctttttaaaaa

SEQ ID NO: 128204 - DNA, 21 bp, Homo sapiens
ttttcctaatgtgatcatatg

SEQ ID NO: 128205 - DNA, 21 bp, Homo sapiens
ttttctaatactaatgttatt

SEQ ID NO: 128206 - DNA, 13 bp, Homo sapiens
ttttctccccgct

SEQ ID NO: 128207 - DNA, 15 bp, Homo sapiens
ttttctggttccaaa

SEQ ID NO: 128208 - DNA, 20 bp, Homo sapiens
ttttgaaaaatattgctaaa

SEQ ID NO: 128209 - DNA, 14 bp, Homo sapiens
ttttgaaaatcaag

SEQ ID NO: 128210 - DNA, 19 bp, Homo sapiens
attctgtggttctataata

SEQ ID NO: 128211 - DNA, 18 bp, Homo sapiens
attcttaaaatgcaatat

SEQ ID NO: 128212 - DNA, 22 bp, Homo sapiens
attgaaagtattcagaaattaa

SEQ ID NO: 128213 - DNA, 23 bp, Homo sapiens
attgaaagtattcagaaattaaa

SEQ ID NO: 128214 - DNA, 17 bp, Homo sapiens
attgaacaataaagttt

SEQ ID NO: 128215 - DNA, 22 bp, Homo sapiens
attgaacaataaagtttgcttt

SEQ ID NO: 128216 - DNA, 22 bp, Homo sapiens
attgactcctttccaatagaaa

SEQ ID NO: 128217 - DNA, 16 bp, Homo sapiens
attgagtttcagaata

SEQ ID NO: 128218 - DNA, 18 bp, Homo sapiens
attgagtttcagaataaa

SEQ ID NO: 128219 - DNA, 22 bp, Homo sapiens
attgattattctgattccactt

SEQ ID NO: 128220 - DNA, 15 bp, Homo sapiens
attgctaaaagtgca

SEQ ID NO: 128221 - DNA, 19 bp, Homo sapiens
attggcagccaaggaatgt

SEQ ID NO: 128222 - DNA, 20 bp, Homo sapiens
attggcagccaaggaatgtg

SEQ ID NO: 128223 - DNA, 15 bp, Homo sapiens
attgggagacaatta

SEQ ID NO: 128224 - DNA, 12 bp, Homo sapiens
attgtcctgtgt

SEQ ID NO: 128225 - DNA, 16 bp, Homo sapiens
attgtgagccaccacg

SEQ ID NO: 128226 - DNA, 17 bp, Homo sapiens
attgttatgaaaatcct

SEQ ID NO: 128227 - DNA, 20 bp, Homo sapiens
atttaaatatctgaacattt

SEQ ID NO: 128228 - DNA, 17 bp, Homo sapiens
atttaacaaaaaatgta

SEQ ID NO: 128229 - DNA, 18 bp, Homo sapiens
atttaacaaaaaatgtaa

SEQ ID NO: 128230 - DNA, 12 bp, Homo sapiens
atttaagtttgt

SEQ ID NO: 128231 - DNA, 16 bp, Homo sapiens
atttaatggactgtga

SEQ ID NO: 128232 - DNA, 16 bp, Homo sapiens
atttactttgtagact

SEQ ID NO: 128233 - DNA, 13 bp, Homo sapiens
atttagaatatat

SEQ ID NO: 128234 - DNA, 20 bp, Homo sapiens
atttagaatatattaaatcg

SEQ ID NO: 128235 - DNA, 16 bp, Homo sapiens
atttataaaaatataa

SEQ ID NO: 128236 - DNA, 23 bp, Homo sapiens
atttattggcagccaaggaatgt

SEQ ID NO: 128237 - DNA, 14 bp, Homo sapiens
atttcaaaaaaaaa

SEQ ID NO: 128238 - DNA, 17 bp, Homo sapiens
atttcatccttgaatcc

SEQ ID NO: 128239 - DNA, 21 bp, Homo sapiens
atttcatgctatcagaaacag

SEQ ID NO: 128240 - DNA, 13 bp, Homo sapiens
ttgtataaaaagg

SEQ ID NO: 128241 - DNA, 13 bp, Homo sapiens
ttgtattcaatta

SEQ ID NO: 128242 - DNA, 19 bp, Homo sapiens
ttgtgaaattcaacctgtg

SEQ ID NO: 128243 - DNA, 18 bp, Homo sapiens
ttgtgttttaaaaaaact

SEQ ID NO: 128244 - DNA, 22 bp, Homo sapiens
ttgttaaaaaaaaaaagattgt

SEQ ID NO: 128245 - DNA, 22 bp, Homo sapiens
ttgttgatattttcccttttta

SEQ ID NO: 128246 - DNA, 21 bp, Homo sapiens
ttgtttctcggcaccagtgcc

SEQ ID NO: 128247 - DNA, 14 bp, Homo sapiens
tttaaaaaaactga

SEQ ID NO: 128248 - DNA, 16 bp, Homo sapiens
tttaaaaaaactgaag

SEQ ID NO: 128249 - DNA, 19 bp, Homo sapiens
tttaaaaaaactgaaggtt

SEQ ID NO: 128250 - DNA, 13 bp, Homo sapiens
tttaaaaaatatt

SEQ ID NO: 128251 - DNA, 15 bp, Homo sapiens
tttaaaaaatatttt

SEQ ID NO: 128252 - DNA, 20 bp, Homo sapiens
tttaaaaaatattttaagaa

SEQ ID NO: 128253 - DNA, 21 bp, Homo sapiens
tttaaaaaatattttaagaaa

SEQ ID NO: 128254 - DNA, 22 bp, Homo sapiens
tttaaaaaatattttaagaaag

SEQ ID NO: 128255 - DNA, 11 bp, Homo sapiens
tttaaaaggca

SEQ ID NO: 128256 - DNA, 23 bp, Homo sapiens
tttaaaaggcaactcaaagatga

SEQ ID NO: 128257 - DNA, 13 bp, Homo sapiens
tttaaaataaact

SEQ ID NO: 128258 - DNA, 20 bp, Homo sapiens
tttaaataacctctggccct

SEQ ID NO: 128259 - DNA, 23 bp, Homo sapiens
tttaaatatctgaacatttacta

SEQ ID NO: 128260 - DNA, 16 bp, Homo sapiens
tttaactatgaactga

SEQ ID NO: 128261 - DNA, 17 bp, Homo sapiens
tttaactctactgtgta

SEQ ID NO: 128262 - DNA, 15 bp, Homo sapiens
aaacaagtatataat

SEQ ID NO: 128263 - DNA, 21 bp, Homo sapiens
aaacagagaaagaaaaggcaa

SEQ ID NO: 128264 - DNA, 23 bp, Homo sapiens
aaacagagaaagaaaaggcaaaa

SEQ ID NO: 128265 - DNA, 14 bp, Homo sapiens
aaacagctgaacca

SEQ ID NO: 128266 - DNA, 22 bp, Homo sapiens
aaacatgcagctcttcaacatg

SEQ ID NO: 128267 - DNA, 16 bp, Homo sapiens
aaacatgtgcccctgc

SEQ ID NO: 128268 - DNA, 17 bp, Homo sapiens
aaacatgtgcccctgcc

SEQ ID NO: 128269 - DNA, 18 bp, Homo sapiens
aaaccagtttattctgtg

SEQ ID NO: 128270 - DNA, 13 bp, Homo sapiens
aaaccatgacaaa

SEQ ID NO: 128271 - DNA, 19 bp, Homo sapiens
aaacctagcttttaaaaaa

SEQ ID NO: 128272 - DNA, 22 bp, Homo sapiens
aaacctagcttttaaaaaatat

SEQ ID NO: 128273 - DNA, 18 bp, Homo sapiens
aaacctgtccataaagta

SEQ ID NO: 128274 - DNA, 16 bp, Homo sapiens
aaacgcacttacaagt

SEQ ID NO: 128275 - DNA, 19 bp, Homo sapiens
aaacgcacttacaagtggt

SEQ ID NO: 128276 - DNA, 21 bp, Homo sapiens
aaactcatgatcaagatatat

SEQ ID NO: 128277 - DNA, 17 bp, Homo sapiens
aaactcccaatacaaag

SEQ ID NO: 128278 - DNA, 12 bp, Homo sapiens
aaactcctgtgt

SEQ ID NO: 128279 - DNA, 12 bp, Homo sapiens
aaactgaaggtt

SEQ ID NO: 128280 - DNA, 13 bp, Homo sapiens
aaactgatttctc

SEQ ID NO: 128281 - DNA, 21 bp, Homo sapiens
aaactgtaaaaaatgtgtgta

SEQ ID NO: 128282 - DNA, 18 bp, Homo sapiens
aaactgtgtatcattaaa

SEQ ID NO: 128283 - DNA, 19 bp, Homo sapiens
aaactgtgtatcattaaaa

SEQ ID NO: 128284 - DNA, 21 bp, Homo sapiens
aaactgtgtatcattaaaata

SEQ ID NO: 128285 - DNA, 23 bp, Homo sapiens
aaactgtgtatcattaaaatata

SEQ ID NO: 128286 - DNA, 16 bp, Homo sapiens
aaacttggaatcaagg

SEQ ID NO: 128287 - DNA, 13 bp, Homo sapiens
aaagaaaaggcaa

SEQ ID NO: 128288 - DNA, 13 bp, Homo sapiens
aaagaaaccatga

SEQ ID NO: 128289 - DNA, 16 bp, Homo sapiens
aaagaagagaggggaa

SEQ ID NO: 128290 - DNA, 21 bp, Homo sapiens
aaagaagagaggggaagaatt

SEQ ID NO: 128291 - DNA, 20 bp, Homo sapiens
aaagactggtttgtttgctt

SEQ ID NO: 128292 - DNA, 19 bp, Homo sapiens
aaagactgtcaaatgaact

SEQ ID NO: 128293 - DNA, 21 bp, Homo sapiens
aaagactgtcaaatgaacttt

SEQ ID NO: 128294 - DNA, 22 bp, Homo sapiens
aaagagaatgaactgtggaatt

SEQ ID NO: 128295 - DNA, 16 bp, Homo sapiens
aaagagtgtaaaatat

SEQ ID NO: 128296 - DNA, 13 bp, Homo sapiens
aaagatgatggaa

SEQ ID NO: 128297 - DNA, 20 bp, Homo sapiens
aaagatgatggaaacgcact

SEQ ID NO: 128298 - DNA, 15 bp, Homo sapiens
aaagattatatatca

SEQ ID NO: 128299 - DNA, 16 bp, Homo sapiens
aaagcaattatattgt

SEQ ID NO: 128300 - DNA, 21 bp, Homo sapiens
aaagcatgggaaaaagagact

SEQ ID NO: 128301 - DNA, 18 bp, Homo sapiens
aaagctctgaacaaaagc

SEQ ID NO: 128302 - DNA, 17 bp, Homo sapiens
aaaggatataaaaggat

SEQ ID NO: 128303 - DNA, 14 bp, Homo sapiens
aaaggatgttacaa

SEQ ID NO: 128304 - DNA, 16 bp, Homo sapiens
aaaggatgttacaagt

SEQ ID NO: 128305 - DNA, 17 bp, Homo sapiens
aaaggatgttacaagtt

SEQ ID NO: 128306 - DNA, 16 bp, Homo sapiens
aaaggcaaaagactgg

SEQ ID NO: 128307 - DNA, 14 bp, Homo sapiens
aaagtaaaccacaa

SEQ ID NO: 128308 - DNA, 21 bp, Homo sapiens
aaagtaatgaagaatcacgat

SEQ ID NO: 128309 - DNA, 21 bp, Homo sapiens
aaagtatgccttcctgtttaa

SEQ ID NO: 128310 - DNA, 20 bp, Homo sapiens
aaagtcacatataaaagtta

SEQ ID NO: 128311 - DNA, 16 bp, Homo sapiens
aaagtctatctaatga

SEQ ID NO: 128312 - DNA, 13 bp, Homo sapiens
aaagtgaactttt

SEQ ID NO: 128313 - DNA, 16 bp, Homo sapiens
aaagtgaacttttgta

SEQ ID NO: 128314 - DNA, 15 bp, Homo sapiens
aaagtgcatttaagg

SEQ ID NO: 128315 - DNA, 14 bp, Homo sapiens
aaagttataataac

SEQ ID NO: 128316 - DNA, 19 bp, Homo sapiens
aaagttataataactgaac

SEQ ID NO: 128317 - DNA, 21 bp, Homo sapiens
aaagttataataactgaactg

SEQ ID NO: 128318 - DNA, 14 bp, Homo sapiens
aaataaaagaaata

SEQ ID NO: 128319 - DNA, 15 bp, Homo sapiens
aaataaacacgattt

SEQ ID NO: 128320 - DNA, 15 bp, Homo sapiens
aaataactttttctg

SEQ ID NO: 128321 - DNA, 21 bp, Homo sapiens
aaataagaagggggagtgaaa

SEQ ID NO: 128322 - DNA, 22 bp, Homo sapiens
aaataagaagggggagtgaaac

SEQ ID NO: 128323 - DNA, 12 bp, Homo sapiens
aaataattttaa

SEQ ID NO: 128324 - DNA, 23 bp, Homo sapiens
aaataattttaaataacctctgg

SEQ ID NO: 128325 - DNA, 18 bp, Homo sapiens
aaataccataggaagaca

SEQ ID NO: 128326 - DNA, 21 bp, Homo sapiens
aaataccataggaagacataa

SEQ ID NO: 128327 - DNA, 15 bp, Homo sapiens
aaataccattgaaat

SEQ ID NO: 128328 - DNA, 18 bp, Homo sapiens
aaatacctcaggaaagaa

SEQ ID NO: 128329 - DNA, 18 bp, Homo sapiens
aaatagagcaaaatcaac

SEQ ID NO: 128330 - DNA, 20 bp, Homo sapiens
aaatataaattgtacatttt

SEQ ID NO: 128331 - DNA, 18 bp, Homo sapiens
aaatatatgttctgcaag

SEQ ID NO: 128332 - DNA, 20 bp, Homo sapiens
aaatatatgttctgcaagaa

SEQ ID NO: 128333 - DNA, 22 bp, Homo sapiens
aaatatatgttctgcaagaatt

SEQ ID NO: 128334 - DNA, 15 bp, Homo sapiens
aaatattatttgata

SEQ ID NO: 128335 - DNA, 12 bp, Homo sapiens
aaatattgctaa

SEQ ID NO: 128336 - DNA, 18 bp, Homo sapiens
aaatattttaagaaagag

SEQ ID NO: 128337 - DNA, 22 bp, Homo sapiens
aaatattttaagaaagagaatg

SEQ ID NO: 128338 - DNA, 16 bp, Homo sapiens
aaatcagcatgacaaa

SEQ ID NO: 128339 - DNA, 17 bp, Homo sapiens
aaatcagcatgacaaaa

SEQ ID NO: 128340 - DNA, 20 bp, Homo sapiens
aaatcagcatgacaaaaata

SEQ ID NO: 128341 - DNA, 22 bp, Homo sapiens
aaatcagcatgacaaaaataac

SEQ ID NO: 128342 - DNA, 22 bp, Homo sapiens
aaatcccaagtgtctcttgact

SEQ ID NO: 128343 - DNA, 17 bp, Homo sapiens
aaatcctatatctgttt

SEQ ID NO: 128344 - DNA, 21 bp, Homo sapiens
aaatctagacattcttttaat

SEQ ID NO: 128345 - DNA, 23 bp, Homo sapiens
aaatctagacattcttttaatgc

SEQ ID NO: 128346 - DNA, 17 bp, Homo sapiens
aaatgaacttttacaga

SEQ ID NO: 128347 - DNA, 22 bp, Homo sapiens
aaatgaacttttacagaatgca

SEQ ID NO: 128348 - DNA, 15 bp, Homo sapiens
aaatgagcattagct

SEQ ID NO: 128349 - DNA, 18 bp, Homo sapiens
aaatgcttcactgtacgt

SEQ ID NO: 128350 - DNA, 12 bp, Homo sapiens
aaattaaatcta

SEQ ID NO: 128351 - DNA, 21 bp, Homo sapiens
aaattaggaacagtaaaatcc

SEQ ID NO: 128352 - DNA, 14 bp, Homo sapiens
aaattagtcttttt

SEQ ID NO: 128353 - DNA, 21 bp, Homo sapiens
aaattagtgagattaaaaatc

SEQ ID NO: 128354 - DNA, 15 bp, Homo sapiens
aaattattaattgtc

SEQ ID NO: 128355 - DNA, 19 bp, Homo sapiens
aaattcaacctgtgtctta

SEQ ID NO: 128356 - DNA, 16 bp, Homo sapiens
aaatttaagaaaacaa

SEQ ID NO: 128357 - DNA, 10 bp, Homo sapiens
aaatttttga

SEQ ID NO: 128358 - DNA, 13 bp, Homo sapiens
aaatttttgaaaa

SEQ ID NO: 128359 - DNA, 17 bp, Homo sapiens
aaatttttgaaaaatat

SEQ ID NO: 128360 - DNA, 21 bp, Homo sapiens
aaatttttgaaaaatattgct

SEQ ID NO: 128361 - DNA, 14 bp, Homo sapiens
aagtagtagtgtct

SEQ ID NO: 128362 - DNA, 14 bp, Homo sapiens
aagtatatattcta

SEQ ID NO: 128363 - DNA, 23 bp, Homo sapiens
aagtatatattctacacatatat

SEQ ID NO: 128364 - DNA, 13 bp, Homo sapiens
aagtattcagaaa

SEQ ID NO: 128365 - DNA, 19 bp, Homo sapiens
aagtattcagaaattaaaa

SEQ ID NO: 128366 - DNA, 23 bp, Homo sapiens
aagtattcagaaattaaaatatt

SEQ ID NO: 128367 - DNA, 14 bp, Homo sapiens
aagtatttataaaa

SEQ ID NO: 128368 - DNA, 15 bp, Homo sapiens
aagtcctgctccttt

SEQ ID NO: 128369 - DNA, 23 bp, Homo sapiens
aagtcctgctcctttctgcccag

SEQ ID NO: 128370 - DNA, 16 bp, Homo sapiens
aagtcgagcactctaa

SEQ ID NO: 128371 - DNA, 22 bp, Homo sapiens
aagtctatctaatgacatgcct

SEQ ID NO: 128372 - DNA, 15 bp, Homo sapiens
aagtctctgctggcc

SEQ ID NO: 128373 - DNA, 19 bp, Homo sapiens
aagtcttttttttttccaa

SEQ ID NO: 128374 - DNA, 12 bp, Homo sapiens
aagtgaactttt

SEQ ID NO: 128375 - DNA, 16 bp, Homo sapiens
aagtgaacttttgtaa

SEQ ID NO: 128376 - DNA, 16 bp, Homo sapiens
aagtgcaacatttctg

SEQ ID NO: 128377 - DNA, 13 bp, Homo sapiens
aagtgcatttaag

SEQ ID NO: 128378 - DNA, 14 bp, Homo sapiens
aagtgcatttaagg

SEQ ID NO: 128379 - DNA, 18 bp, Homo sapiens
aagtgcatttaaggagat

SEQ ID NO: 128380 - DNA, 23 bp, Homo sapiens
aagtggtgaccaaaatttttagg

SEQ ID NO: 128381 - DNA, 20 bp, Homo sapiens
aagtgtctcttgactggctc

SEQ ID NO: 128382 - DNA, 18 bp, Homo sapiens
aagttataataactgaac

SEQ ID NO: 128383 - DNA, 14 bp, Homo sapiens
aagttctgttttct

SEQ ID NO: 128384 - DNA, 12 bp, Homo sapiens
aagtttgctaaa

SEQ ID NO: 128385 - DNA, 13 bp, Homo sapiens
aagtttgctaaaa

SEQ ID NO: 128386 - DNA, 11 bp, Homo sapiens
aataaaaagtg

SEQ ID NO: 128387 - DNA, 16 bp, Homo sapiens
aataaaattatttgca

SEQ ID NO: 128388 - DNA, 15 bp, Homo sapiens
aataaaattgcactt

SEQ ID NO: 128389 - DNA, 20 bp, Homo sapiens
aataaagttctgttttctgt

SEQ ID NO: 128390 - DNA, 20 bp, Homo sapiens
aattgaaggagaaaatgcat

SEQ ID NO: 128391 - DNA, 14 bp, Homo sapiens
aattgagtttcaga

SEQ ID NO: 128392 - DNA, 14 bp, Homo sapiens
aattgcacttttaa

SEQ ID NO: 128393 - DNA, 14 bp, Homo sapiens
aattgttatgaaaa

SEQ ID NO: 128394 - DNA, 16 bp, Homo sapiens
aattgttatgaaaatc

SEQ ID NO: 128395 - DNA, 13 bp, Homo sapiens
accccacccttcc

SEQ ID NO: 128396 - DNA, 14 bp, Homo sapiens
accccacctgacct

SEQ ID NO: 128397 - DNA, 19 bp, Homo sapiens
accccagcccccacagccc

SEQ ID NO: 128398 - DNA, 20 bp, Homo sapiens
accccagcccccacagccct

SEQ ID NO: 128399 - DNA, 22 bp, Homo sapiens
accccagcccccacagccctgg

SEQ ID NO: 128400 - DNA, 14 bp, Homo sapiens
acccctgcctcctg

SEQ ID NO: 128401 - DNA, 15 bp, Homo sapiens
acccctgcctcctgc

SEQ ID NO: 128402 - DNA, 18 bp, Homo sapiens
acccctgcctcctgcctc

SEQ ID NO: 128403 - DNA, 16 bp, Homo sapiens
acccgccccgccccct

SEQ ID NO: 128404 - DNA, 18 bp, Homo sapiens
acccgttgggtcccttgc

SEQ ID NO: 128405 - DNA, 22 bp, Homo sapiens
accctgcccctccccaaaagaa

SEQ ID NO: 128406 - DNA, 20 bp, Homo sapiens
accctgtctcagtacctccc

SEQ ID NO: 128407 - DNA, 19 bp, Homo sapiens
acccttggggtggtgctgg

SEQ ID NO: 128408 - DNA, 12 bp, Homo sapiens
accctttgtatt

SEQ ID NO: 128409 - DNA, 12 bp, Homo sapiens
accgaggagccc

SEQ ID NO: 128410 - DNA, 18 bp, Homo sapiens
accgaggagccccagccc

SEQ ID NO: 128411 - DNA, 17 bp, Homo sapiens
accgagtctctgtataa

SEQ ID NO: 128412 - DNA, 21 bp, Homo sapiens
accgggctccatgcctctgga

SEQ ID NO: 128413 - DNA, 18 bp, Homo sapiens
acctagcttttaaaaaat

SEQ ID NO: 128414 - DNA, 19 bp, Homo sapiens
acctagcttttaaaaaata

SEQ ID NO: 128415 - DNA, 21 bp, Homo sapiens
acctatggcccagccactgca

SEQ ID NO: 128416 - DNA, 12 bp, Homo sapiens
acctcaggaaag

SEQ ID NO: 128417 - DNA, 23 bp, Homo sapiens
acctcaggaaagaatagaaagaa

SEQ ID NO: 128418 - DNA, 20 bp, Homo sapiens
acctcccctccccgccccct

SEQ ID NO: 128419 - DNA, 16 bp, Homo sapiens
acctctagctgttctt

SEQ ID NO: 128420 - DNA, 17 bp, Homo sapiens
acctctggcccttggaa

SEQ ID NO: 128421 - DNA, 16 bp, Homo sapiens
acctgacctctgcaag

SEQ ID NO: 128422 - DNA, 18 bp, Homo sapiens
acctttatatctgtcttt

SEQ ID NO: 128423 - DNA, 14 bp, Homo sapiens
accttttattacat

SEQ ID NO: 128424 - DNA, 17 bp, Homo sapiens
acgctctaccctgcagc

SEQ ID NO: 128425 - DNA, 15 bp, Homo sapiens
acgtgaatgtctcag

SEQ ID NO: 128426 - DNA, 19 bp, Homo sapiens
acgtgattgattcagtatc

SEQ ID NO: 128427 - DNA, 20 bp, Homo sapiens
acgtgattgattcagtatct

SEQ ID NO: 128428 - DNA, 14 bp, Homo sapiens
acgtgttgtatcta

SEQ ID NO: 128429 - DNA, 11 bp, Homo sapiens
actaaacagaa

SEQ ID NO: 128430 - DNA, 16 bp, Homo sapiens
actaaataaacacgat

SEQ ID NO: 128431 - DNA, 23 bp, Homo sapiens
actaaccagggaagctgtccctc

SEQ ID NO: 128432 - DNA, 18 bp, Homo sapiens
actaagtaagaaacacaa

SEQ ID NO: 128433 - DNA, 19 bp, Homo sapiens
actaatgttatttcttaaa

SEQ ID NO: 128434 - DNA, 19 bp, Homo sapiens
actacacacccccaagcca

SEQ ID NO: 128435 - DNA, 13 bp, Homo sapiens
actaggggaggag

SEQ ID NO: 128436 - DNA, 19 bp, Homo sapiens
actaggggaggagagaggg

SEQ ID NO: 128437 - DNA, 18 bp, Homo sapiens
actaggtgaacagcagga

SEQ ID NO: 128438 - DNA, 20 bp, Homo sapiens
actatgtaaacaaaaaagct

SEQ ID NO: 128439 - DNA, 13 bp, Homo sapiens
actattacttttc

SEQ ID NO: 128440 - DNA, 15 bp, Homo sapiens
actcaaagatgatgg

SEQ ID NO: 128441 - DNA, 16 bp, Homo sapiens
actccgctggatgggg

SEQ ID NO: 128442 - DNA, 21 bp, Homo sapiens
actcctctgggcctggggtgc

SEQ ID NO: 128443 - DNA, 10 bp, Homo sapiens
actcctgtgt

SEQ ID NO: 128444 - DNA, 20 bp, Homo sapiens
actcctttccaatagaaaga

SEQ ID NO: 128445 - DNA, 15 bp, Homo sapiens
actcgatgaatgtgt

SEQ ID NO: 128446 - DNA, 23 bp, Homo sapiens
actgaactgtttggtcgagtctt

SEQ ID NO: 128447 - DNA, 17 bp, Homo sapiens
actgaagctggggcttg

SEQ ID NO: 128448 - DNA, 20 bp, Homo sapiens
actgaagctggggcttgggg

SEQ ID NO: 128449 - DNA, 21 bp, Homo sapiens
actgaaggttttttttttaag

SEQ ID NO: 128450 - DNA, 18 bp, Homo sapiens
actgagtccatgaaaata

SEQ ID NO: 128451 - DNA, 20 bp, Homo sapiens
actgagtccatgaaaatacc

SEQ ID NO: 128452 - DNA, 16 bp, Homo sapiens
actgccaaaacaatgc

SEQ ID NO: 128453 - DNA, 19 bp, Homo sapiens
actggcacttgcctgctgc

SEQ ID NO: 128454 - DNA, 15 bp, Homo sapiens
actgggcacccctgc

SEQ ID NO: 128455 - DNA, 19 bp, Homo sapiens
actgggggcggggcctggg

SEQ ID NO: 128456 - DNA, 22 bp, Homo sapiens
actgggggcggggcctgggcgg

SEQ ID NO: 128457 - DNA, 22 bp, Homo sapiens
actgtaaaagttataataactg

SEQ ID NO: 128458 - DNA, 19 bp, Homo sapiens
actgtcaaatgaactttta

SEQ ID NO: 128459 - DNA, 12 bp, Homo sapiens
actgtgaatttc

SEQ ID NO: 128460 - DNA, 14 bp, Homo sapiens
actgtgaatttcaa

SEQ ID NO: 128461 - DNA, 15 bp, Homo sapiens
actgtgaatttcaaa

SEQ ID NO: 128462 - DNA, 18 bp, Homo sapiens
actgtggaatttattggc

SEQ ID NO: 128463 - DNA, 14 bp, Homo sapiens
actgtgtatcatta

SEQ ID NO: 128464 - DNA, 19 bp, Homo sapiens
actgtgtatcattaaaata

SEQ ID NO: 128465 - DNA, 20 bp, Homo sapiens
actgtgtatcattaaaatat

SEQ ID NO: 128466 - DNA, 20 bp, Homo sapiens
acttacaagtggtgaccaaa

SEQ ID NO: 128467 - DNA, 15 bp, Homo sapiens
acttatcatttttgt

SEQ ID NO: 128468 - DNA, 18 bp, Homo sapiens
acttatcatttttgtata

SEQ ID NO: 128469 - DNA, 19 bp, Homo sapiens
acttatcatttttgtataa

SEQ ID NO: 128470 - DNA, 17 bp, Homo sapiens
acttcaaatatagagat

SEQ ID NO: 128471 - DNA, 16 bp, Homo sapiens
acttcactaccaaatg

SEQ ID NO: 128472 - DNA, 18 bp, Homo sapiens
acttcatgcccactgccg

SEQ ID NO: 128473 - DNA, 18 bp, Homo sapiens
acttcccaattgccacat

SEQ ID NO: 128474 - DNA, 15 bp, Homo sapiens
acttctgagccccag

SEQ ID NO: 128475 - DNA, 12 bp, Homo sapiens
acttgcctgctg

SEQ ID NO: 128476 - DNA, 14 bp, Homo sapiens
acttgcctgctgct

SEQ ID NO: 128477 - DNA, 22 bp, Homo sapiens
acttggaatcaaggtaagctca

SEQ ID NO: 128478 - DNA, 20 bp, Homo sapiens
actttaaaaggcaactcaaa

SEQ ID NO: 128479 - DNA, 14 bp, Homo sapiens
actttccaaaacct

SEQ ID NO: 128480 - DNA, 15 bp, Homo sapiens
actttcctgtggttt

SEQ ID NO: 128481 - DNA, 21 bp, Homo sapiens
actttctccatttaagacaca

SEQ ID NO: 128482 - DNA, 13 bp, Homo sapiens
actttgctccagg

SEQ ID NO: 128483 - DNA, 12 bp, Homo sapiens
actttgtagtgt

SEQ ID NO: 128484 - DNA, 15 bp, Homo sapiens
actttgtagtgtttg

SEQ ID NO: 128485 - DNA, 19 bp, Homo sapiens
acttttacagaatgcatta

SEQ ID NO: 128486 - DNA, 21 bp, Homo sapiens
acttttacagaatgcattaaa

SEQ ID NO: 128487 - DNA, 15 bp, Homo sapiens
acttttctaaagctc

SEQ ID NO: 128488 - DNA, 16 bp, Homo sapiens
acttttctggttccaa

SEQ ID NO: 128489 - DNA, 17 bp, Homo sapiens
acttttctggttccaaa

SEQ ID NO: 128490 - DNA, 14 bp, Homo sapiens
acttttctgtttag

SEQ ID NO: 128491 - DNA, 18 bp, Homo sapiens
ataaaaaggaaattagtc

SEQ ID NO: 128492 - DNA, 16 bp, Homo sapiens
ataaaaagtgaacttt

SEQ ID NO: 128493 - DNA, 17 bp, Homo sapiens
ataaaaagtgaactttt

SEQ ID NO: 128494 - DNA, 17 bp, Homo sapiens
ataaaaatataaattgt

SEQ ID NO: 128495 - DNA, 16 bp, Homo sapiens
ataaaactttaaaagg

SEQ ID NO: 128496 - DNA, 16 bp, Homo sapiens
ataaaaggatgttaca

SEQ ID NO: 128497 - DNA, 17 bp, Homo sapiens
ataaaaggatgttacaa

SEQ ID NO: 128498 - DNA, 16 bp, Homo sapiens
ataaaataatgctttg

SEQ ID NO: 128499 - DNA, 16 bp, Homo sapiens
ataaaattatttgcag

SEQ ID NO: 128500 - DNA, 16 bp, Homo sapiens
ataaacacgattttat

SEQ ID NO: 128501 - DNA, 21 bp, Homo sapiens
ataaaggtatttagaatatat

SEQ ID NO: 128502 - DNA, 17 bp, Homo sapiens
ataaattgtacattttg

SEQ ID NO: 128503 - DNA, 17 bp, Homo sapiens
ataaatttaagaaaaca

SEQ ID NO: 128504 - DNA, 20 bp, Homo sapiens
ataacactgttggcacttat

SEQ ID NO: 128505 - DNA, 14 bp, Homo sapiens
ataacctctggccc

SEQ ID NO: 128506 - DNA, 15 bp, Homo sapiens
ataacctctggccct

SEQ ID NO: 128507 - DNA, 18 bp, Homo sapiens
ataacctctggcccttgg

SEQ ID NO: 128508 - DNA, 20 bp, Homo sapiens
ataacctctggcccttggaa

SEQ ID NO: 128509 - DNA, 12 bp, Homo sapiens
ataactgaactg

SEQ ID NO: 128510 - DNA, 14 bp, Homo sapiens
ataactgaactgtt

SEQ ID NO: 128511 - DNA, 18 bp, Homo sapiens
ataagttttgatataatc

SEQ ID NO: 128512 - DNA, 21 bp, Homo sapiens
ataagttttgatataatcttg

SEQ ID NO: 128513 - DNA, 16 bp, Homo sapiens
ataataactgaactgt

SEQ ID NO: 128514 - DNA, 12 bp, Homo sapiens
ataataagtttt

SEQ ID NO: 128515 - DNA, 13 bp, Homo sapiens
ataatctcatttc

SEQ ID NO: 128516 - DNA, 18 bp, Homo sapiens
ataatgcatccagcagta

SEQ ID NO: 128517 - DNA, 19 bp, Homo sapiens
ataatggtgttactaaagt

SEQ ID NO: 128518 - DNA, 12 bp, Homo sapiens
ataattatgaaa

SEQ ID NO: 128519 - DNA, 22 bp, Homo sapiens
atctgtttgtatatttgcaaac

SEQ ID NO: 128520 - DNA, 16 bp, Homo sapiens
atcttagagtttacag

SEQ ID NO: 128521 - DNA, 18 bp, Homo sapiens
atcttggcttcttaaaaa

SEQ ID NO: 128522 - DNA, 23 bp, Homo sapiens
atcttttttcctagtttttctaa

SEQ ID NO: 128523 - DNA, 20 bp, Homo sapiens
atgaaaactcatgatcaaga

SEQ ID NO: 128524 - DNA, 22 bp, Homo sapiens
atgaaaatcctatatctgtttg

SEQ ID NO: 128525 - DNA, 13 bp, Homo sapiens
atgaactgtggaa

SEQ ID NO: 128526 - DNA, 20 bp, Homo sapiens
atgaacttttacagaatgca

SEQ ID NO: 128527 - DNA, 15 bp, Homo sapiens
atgaagaatcacgat

SEQ ID NO: 128528 - DNA, 17 bp, Homo sapiens
atgaagctggccctcag

SEQ ID NO: 128529 - DNA, 13 bp, Homo sapiens
atgaatatatggc

SEQ ID NO: 128530 - DNA, 20 bp, Homo sapiens
atgaatatatggcatttgca

SEQ ID NO: 128531 - DNA, 17 bp, Homo sapiens
atgacaaaaataacact

SEQ ID NO: 128532 - DNA, 19 bp, Homo sapiens
atgacaaaaataacactgt

SEQ ID NO: 128533 - DNA, 16 bp, Homo sapiens
atgacaaacctagctt

SEQ ID NO: 128534 - DNA, 19 bp, Homo sapiens
atgacaaacctagctttta

SEQ ID NO: 128535 - DNA, 17 bp, Homo sapiens
atgactattacttttct

SEQ ID NO: 128536 - DNA, 23 bp, Homo sapiens
atgactattacttttctgtttag

SEQ ID NO: 128537 - DNA, 15 bp, Homo sapiens
atgatcaaaaataat

SEQ ID NO: 128538 - DNA, 22 bp, Homo sapiens
atgatggaaacgcacttacaag

SEQ ID NO: 128539 - DNA, 15 bp, Homo sapiens
atgcaataaaattat

SEQ ID NO: 128540 - DNA, 18 bp, Homo sapiens
atgcaataaaattatttg

SEQ ID NO: 128541 - DNA, 20 bp, Homo sapiens
atgcaataaaattatttgca

SEQ ID NO: 128542 - DNA, 21 bp, Homo sapiens
atgcaataaaattatttgcag

SEQ ID NO: 128543 - DNA, 13 bp, Homo sapiens
atgcaatatttgt

SEQ ID NO: 128544 - DNA, 14 bp, Homo sapiens
atgcaatatttgta

SEQ ID NO: 128545 - DNA, 20 bp, Homo sapiens
atgcagctcttcaacatgac

SEQ ID NO: 128546 - DNA, 21 bp, Homo sapiens
atgcagctcttcaacatgaca

SEQ ID NO: 128547 - DNA, 22 bp, Homo sapiens
atgcagctcttcaacatgacat

SEQ ID NO: 128548 - DNA, 14 bp, Homo sapiens
atgcccaaaactta

SEQ ID NO: 128549 - DNA, 22 bp, Homo sapiens
atgcccaccgaggagccccagc

SEQ ID NO: 128550 - DNA, 23 bp, Homo sapiens
atgcccaccgaggagccccagcc

SEQ ID NO: 128551 - DNA, 20 bp, Homo sapiens
atgcctctggaggcctctgg

SEQ ID NO: 128552 - DNA, 17 bp, Homo sapiens
atgctgaggttttgaat

SEQ ID NO: 128553 - DNA, 21 bp, Homo sapiens
atgctgaggttttgaataaaa

SEQ ID NO: 128554 - DNA, 20 bp, Homo sapiens
atggaaacgcacttacaagt

SEQ ID NO: 128555 - DNA, 21 bp, Homo sapiens
atggaaacgcacttacaagtg

SEQ ID NO: 128556 - DNA, 22 bp, Homo sapiens
atggagaaagtaagtctttttt

SEQ ID NO: 128557 - DNA, 19 bp, Homo sapiens
atggagacaataaacagct

SEQ ID NO: 128558 - DNA, 14 bp, Homo sapiens
atggcccagccact

SEQ ID NO: 128559 - DNA, 16 bp, Homo sapiens
atgggaaaaagagact

SEQ ID NO: 128560 - DNA, 20 bp, Homo sapiens
atgggaggaaggcccagggg

SEQ ID NO: 128561 - DNA, 23 bp, Homo sapiens
atgggaggaaggcccaggggtgg

SEQ ID NO: 128562 - DNA, 15 bp, Homo sapiens
atgggcgcaggccca

SEQ ID NO: 128563 - DNA, 18 bp, Homo sapiens
atgggcgcaggcccagtg

SEQ ID NO: 128564 - DNA, 12 bp, Homo sapiens
atgtaagtttaa

SEQ ID NO: 128565 - DNA, 15 bp, Homo sapiens
atgtatagttgcttt

SEQ ID NO: 128566 - DNA, 20 bp, Homo sapiens
atgtatatctatatctctaa

SEQ ID NO: 128567 - DNA, 14 bp, Homo sapiens
atgtatatgtatat

SEQ ID NO: 128568 - DNA, 17 bp, Homo sapiens
atgtatatgtatatcta

SEQ ID NO: 128569 - DNA, 20 bp, Homo sapiens
atgtattttcctaatgtgat

SEQ ID NO: 128570 - DNA, 15 bp, Homo sapiens
atgtcattaatcaat

SEQ ID NO: 128571 - DNA, 14 bp, Homo sapiens
atgtgatcatatga

SEQ ID NO: 128572 - DNA, 21 bp, Homo sapiens
atgtgatctatgtttcatctt

SEQ ID NO: 128573 - DNA, 18 bp, Homo sapiens
atgtgcacctatggccca

SEQ ID NO: 128574 - DNA, 16 bp, Homo sapiens
atgtgtatacatacat

SEQ ID NO: 128575 - DNA, 20 bp, Homo sapiens
atgtgtatacatacatgtat

SEQ ID NO: 128576 - DNA, 15 bp, Homo sapiens
atcagccacattcta

SEQ ID NO: 128577 - DNA, 12 bp, Homo sapiens
atcataaagtat

SEQ ID NO: 128578 - DNA, 15 bp, Homo sapiens
atcatacttaacatt

SEQ ID NO: 128579 - DNA, 12 bp, Homo sapiens
atcattaaaata

SEQ ID NO: 128580 - DNA, 13 bp, Homo sapiens
atcattaaaatat

SEQ ID NO: 128581 - DNA, 19 bp, Homo sapiens
atcatttttgtataaaaag

SEQ ID NO: 128582 - DNA, 14 bp, Homo sapiens
atccaaggaaacat

SEQ ID NO: 128583 - DNA, 18 bp, Homo sapiens
atccagcagtacaataaa

SEQ ID NO: 128584 - DNA, 13 bp, Homo sapiens
atcccttcctcct

SEQ ID NO: 128585 - DNA, 21 bp, Homo sapiens
atcccttcctcctctcctgga

SEQ ID NO: 128586 - DNA, 22 bp, Homo sapiens
atccgagtgtttgccaggctta

SEQ ID NO: 128587 - DNA, 16 bp, Homo sapiens
atcctagccccaccca

SEQ ID NO: 128588 - DNA, 20 bp, Homo sapiens
atcctagccccacccagagg

SEQ ID NO: 128589 - DNA, 13 bp, Homo sapiens
atcctatatctgt

SEQ ID NO: 128590 - DNA, 15 bp, Homo sapiens
atcctatatctgttt

SEQ ID NO: 128591 - DNA, 23 bp, Homo sapiens
atcctatatctgtttgtatattt

SEQ ID NO: 128592 - DNA, 16 bp, Homo sapiens
atcctcctcagccccc

SEQ ID NO: 128593 - DNA, 22 bp, Homo sapiens
atcctcctcagcccccaggcca

SEQ ID NO: 128594 - DNA, 21 bp, Homo sapiens
atccttgggccataattatga

SEQ ID NO: 128595 - DNA, 23 bp, Homo sapiens
atccttgggccataattatgaaa

SEQ ID NO: 128596 - DNA, 22 bp, Homo sapiens
atctaaaaattttgcatttcat

SEQ ID NO: 128597 - DNA, 16 bp, Homo sapiens
atctacagtaatgaaa

SEQ ID NO: 128598 - DNA, 18 bp, Homo sapiens
atctacagtaatgaaatg

SEQ ID NO: 128599 - DNA, 21 bp, Homo sapiens
atctatatctctaaactgctg

SEQ ID NO: 128600 - DNA, 16 bp, Homo sapiens
atctatgtttcatctt

SEQ ID NO: 128601 - DNA, 20 bp, Homo sapiens
atctatgtttcatcttgttt

SEQ ID NO: 128602 - DNA, 12 bp, Homo sapiens
atctatttacat

SEQ ID NO: 128603 - DNA, 15 bp, Homo sapiens
atctatttacataaa

SEQ ID NO: 128604 - DNA, 13 bp, Homo sapiens
atctcaccccatc

SEQ ID NO: 128605 - DNA, 15 bp, Homo sapiens
atctctccctcccct

SEQ ID NO: 128606 - DNA, 23 bp, Homo sapiens
atctctccctcccctgccatttt

SEQ ID NO: 128607 - DNA, 19 bp, Homo sapiens
atctcttattttacaataa

SEQ ID NO: 128608 - DNA, 17 bp, Homo sapiens
atctgagaagtgtatat

SEQ ID NO: 128609 - DNA, 11 bp, Homo sapiens
atctgcattta

SEQ ID NO: 128610 - DNA, 12 bp, Homo sapiens
atctgtttgtat

SEQ ID NO: 128611 - DNA, 12 bp, Homo sapiens
cctctccactgt

SEQ ID NO: 128612 - DNA, 13 bp, Homo sapiens
cctctccctgttg

SEQ ID NO: 128613 - DNA, 13 bp, Homo sapiens
cctctctgtggct

SEQ ID NO: 128614 - DNA, 16 bp, Homo sapiens
cctctctgtggctcca

SEQ ID NO: 128615 - DNA, 20 bp, Homo sapiens
cctctgatagctgtttcaaa

SEQ ID NO: 128616 - DNA, 20 bp, Homo sapiens
cctctggaggcctctggccc

SEQ ID NO: 128617 - DNA, 21 bp, Homo sapiens
cctctggccctcggtggctgc

SEQ ID NO: 128618 - DNA, 19 bp, Homo sapiens
cctctggcccttggaataa

SEQ ID NO: 128619 - DNA, 11 bp, Homo sapiens
cctctgggcct

SEQ ID NO: 128620 - DNA, 20 bp, Homo sapiens
cctgaaacgagaagtgccct

SEQ ID NO: 128621 - DNA, 13 bp, Homo sapiens
cctgaccccctgt

SEQ ID NO: 128622 - DNA, 14 bp, Homo sapiens
cctgaccccctgtc

SEQ ID NO: 128623 - DNA, 22 bp, Homo sapiens
cctgacctctgcaagagggggc

SEQ ID NO: 128624 - DNA, 18 bp, Homo sapiens
cctgcagccacatgggag

SEQ ID NO: 128625 - DNA, 12 bp, Homo sapiens
cctgccaaggcc

SEQ ID NO: 128626 - DNA, 20 bp, Homo sapiens
cctgcccctccccaaaagaa

SEQ ID NO: 128627 - DNA, 21 bp, Homo sapiens
cctgcccctccccaaaagaaa

SEQ ID NO: 128628 - DNA, 13 bp, Homo sapiens
cctgctcccagct

SEQ ID NO: 128629 - DNA, 19 bp, Homo sapiens
cctgctcctttctgcccag

SEQ ID NO: 128630 - DNA, 14 bp, Homo sapiens
cctgctgcttggag

SEQ ID NO: 128631 - DNA, 16 bp, Homo sapiens
cctggaggatttcatc

SEQ ID NO: 128632 - DNA, 16 bp, Homo sapiens
cctggagtctgaagcc

SEQ ID NO: 128633 - DNA, 19 bp, Homo sapiens
cctggagtctgaagcctgc

SEQ ID NO: 128634 - DNA, 24 bp, Homo sapiens
cctggagtctgaagcctgcaggtc

SEQ ID NO: 128635 - DNA, 14 bp, Homo sapiens
cctggcagcacagc

SEQ ID NO: 128636 - DNA, 16 bp, Homo sapiens
cctggcagcacagccc

SEQ ID NO: 128637 - DNA, 18 bp, Homo sapiens
cctggcagcacagcccag

SEQ ID NO: 128638 - DNA, 18 bp, Homo sapiens
cctggctccctcccgtag

SEQ ID NO: 128639 - DNA, 15 bp, Homo sapiens
cctgggccaaggact

SEQ ID NO: 128640 - DNA, 17 bp, Homo sapiens
cctgggccaaggactcc

SEQ ID NO: 128641 - DNA, 18 bp, Homo sapiens
cctgggcggggccgcagc

SEQ ID NO: 128642 - DNA, 13 bp, Homo sapiens
cctggtgggcctc

SEQ ID NO: 128643 - DNA, 23 bp, Homo sapiens
cctgtaatcagctctcctggctc

SEQ ID NO: 128644 - DNA, 14 bp, Homo sapiens
cctgtccataaagt

SEQ ID NO: 128645 - DNA, 16 bp, Homo sapiens
cctgttgggggcttca

SEQ ID NO: 128646 - DNA, 17 bp, Homo sapiens
cctgtttaaaaaaagta

SEQ ID NO: 128647 - DNA, 20 bp, Homo sapiens
ccttcctcctctcctggaaa

SEQ ID NO: 128648 - DNA, 17 bp, Homo sapiens
ccttctaccccacctga

SEQ ID NO: 128649 - DNA, 13 bp, Homo sapiens
ccttctccctagc

SEQ ID NO: 128650 - DNA, 14 bp, Homo sapiens
ccttctccctagcc

SEQ ID NO: 128651 - DNA, 16 bp, Homo sapiens
ccttctccctagccct

SEQ ID NO: 128652 - DNA, 19 bp, Homo sapiens
ccttctgttaagaaaggat

SEQ ID NO: 128653 - DNA, 20 bp, Homo sapiens
ccttgggcgcttcccacctg

SEQ ID NO: 128654 - DNA, 15 bp, Homo sapiens
cctttccaatagaaa

SEQ ID NO: 128655 - DNA, 13 bp, Homo sapiens
cctttctgcccag

SEQ ID NO: 128656 - DNA, 20 bp, Homo sapiens
cctttctgcccagcctgctc

SEQ ID NO: 128657 - DNA, 17 bp, Homo sapiens
cctttgtattataattg

SEQ ID NO: 128658 - DNA, 21 bp, Homo sapiens
cctttgtattataattgttga

SEQ ID NO: 128659 - DNA, 15 bp, Homo sapiens
cctttttaaaaaata

SEQ ID NO: 128660 - DNA, 21 bp, Homo sapiens
cctttttaaaaaataccattg

SEQ ID NO: 128661 - DNA, 21 bp, Homo sapiens
cgaagaacaatgtcagaaact

SEQ ID NO: 128662 - DNA, 13 bp, Homo sapiens
cgagaagtgccct

SEQ ID NO: 128663 - DNA, 15 bp, Homo sapiens
cgatccacctgtctc

SEQ ID NO: 128664 - DNA, 17 bp, Homo sapiens
ctgagtccatgaaaata

SEQ ID NO: 128665 - DNA, 19 bp, Homo sapiens
ctgagtccatgaaaatacc

SEQ ID NO: 128666 - DNA, 21 bp, Homo sapiens
ctgagtccatgaaaataccat

SEQ ID NO: 128667 - DNA, 21 bp, Homo sapiens
ctgatgagtaaactgaggccc

SEQ ID NO: 128668 - DNA, 21 bp, Homo sapiens
ctgcaaacccatgaagctggc

SEQ ID NO: 128669 - DNA, 16 bp, Homo sapiens
ctgcaagaattaaaac

SEQ ID NO: 128670 - DNA, 18 bp, Homo sapiens
ctgcaagaattaaaactg

SEQ ID NO: 128671 - DNA, 20 bp, Homo sapiens
ctgcaagcacatctgcattt

SEQ ID NO: 128672 - DNA, 15 bp, Homo sapiens
ctgcaattgagggct

SEQ ID NO: 128673 - DNA, 15 bp, Homo sapiens
ctgcagccacatggg

SEQ ID NO: 128674 - DNA, 16 bp, Homo sapiens
ctgcagccacatggga

SEQ ID NO: 128675 - DNA, 16 bp, Homo sapiens
ctgcaggtccggggag

SEQ ID NO: 128676 - DNA, 20 bp, Homo sapiens
ctgcatttatcttttttcct

SEQ ID NO: 128677 - DNA, 23 bp, Homo sapiens
ctgccaaggccggagacccacag

SEQ ID NO: 128678 - DNA, 21 bp, Homo sapiens
ctgccccacccaccccacaga

SEQ ID NO: 128679 - DNA, 22 bp, Homo sapiens
ctgcccctgagttctgacactg

SEQ ID NO: 128680 - DNA, 11 bp, Homo sapiens
ctgctcccagc

SEQ ID NO: 128681 - DNA, 12 bp, Homo sapiens
ctgctcccagct

SEQ ID NO: 128682 - DNA, 21 bp, Homo sapiens
ctgctcccagctctctctcct

SEQ ID NO: 128683 - DNA, 14 bp, Homo sapiens
ctgctcgaagaaca

SEQ ID NO: 128684 - DNA, 17 bp, Homo sapiens
ctgctcgaagaacaatg

SEQ ID NO: 128685 - DNA, 17 bp, Homo sapiens
ctgctgagctgggccca

SEQ ID NO: 128686 - DNA, 20 bp, Homo sapiens
ctgctgagctgggcccagcc

SEQ ID NO: 128687 - DNA, 19 bp, Homo sapiens
ctgctgcttggagtgcccc

SEQ ID NO: 128688 - DNA, 16 bp, Homo sapiens
ctgctggcccagccaa

SEQ ID NO: 128689 - DNA, 15 bp, Homo sapiens
ctgcttggagtgccc

SEQ ID NO: 128690 - DNA, 17 bp, Homo sapiens
ctgcttggagtgcccca

SEQ ID NO: 128691 - DNA, 19 bp, Homo sapiens
ctgcttggagtgccccaag

SEQ ID NO: 128692 - DNA, 15 bp, Homo sapiens
ctggaggcctctggc

SEQ ID NO: 128693 - DNA, 16 bp, Homo sapiens
ctggaggcctctggcc

SEQ ID NO: 128694 - DNA, 18 bp, Homo sapiens
ctggaggcctctggccct

SEQ ID NO: 128695 - DNA, 15 bp, Homo sapiens
ctggagtctgaagcc

SEQ ID NO: 128696 - DNA, 17 bp, Homo sapiens
ctggagtctgaagcctg

SEQ ID NO: 128697 - DNA, 16 bp, Homo sapiens
ctggcacttgcctgct

SEQ ID NO: 128698 - DNA, 16 bp, Homo sapiens
ctggcagcacagccca

SEQ ID NO: 128699 - DNA, 18 bp, Homo sapiens
ctggcagcacagcccagg

SEQ ID NO: 128700 - DNA, 20 bp, Homo sapiens
ctggcagcacagcccagggc

SEQ ID NO: 128701 - DNA, 13 bp, Homo sapiens
ctggccctcagct

SEQ ID NO: 128702 - DNA, 16 bp, Homo sapiens
ctggccctcagctccc

SEQ ID NO: 128703 - DNA, 21 bp, Homo sapiens
ctggccctcagctccctgacc

SEQ ID NO: 128704 - DNA, 18 bp, Homo sapiens
ctggccctcggtggctgc

SEQ ID NO: 128705 - DNA, 23 bp, Homo sapiens
ctggccctcggtggctgcacaga

SEQ ID NO: 128706 - DNA, 17 bp, Homo sapiens
cttataggtaacgtgat

SEQ ID NO: 128707 - DNA, 21 bp, Homo sapiens
cttataggtaacgtgattgat

SEQ ID NO: 128708 - DNA, 14 bp, Homo sapiens
cttatcatttttgt

SEQ ID NO: 128709 - DNA, 19 bp, Homo sapiens
cttatcatttttgtataaa

SEQ ID NO: 128710 - DNA, 16 bp, Homo sapiens
cttattgaaaaatcag

SEQ ID NO: 128711 - DNA, 20 bp, Homo sapiens
cttatttttaaaataaaaat

SEQ ID NO: 128712 - DNA, 21 bp, Homo sapiens
cttcaaattttttaaaagaga

SEQ ID NO: 128713 - DNA, 18 bp, Homo sapiens
cttcacccaccccatgga

SEQ ID NO: 128714 - DNA, 14 bp, Homo sapiens
cttcactgcagcct

SEQ ID NO: 128715 - DNA, 17 bp, Homo sapiens
cttcactgcagcctttc

SEQ ID NO: 128716 - DNA, 18 bp, Homo sapiens
cttcccaaatcaaaataa

SEQ ID NO: 128717 - DNA, 17 bp, Homo sapiens
cttcccaattgccacat

SEQ ID NO: 128718 - DNA, 17 bp, Homo sapiens
cttctaccttaaaatgt

SEQ ID NO: 128719 - DNA, 20 bp, Homo sapiens
cttctagacactccttgaaa

SEQ ID NO: 128720 - DNA, 13 bp, Homo sapiens
cttctgagcccca

SEQ ID NO: 128721 - DNA, 18 bp, Homo sapiens
cttcttaaaaactgtgta

SEQ ID NO: 128722 - DNA, 14 bp, Homo sapiens
cttgaactttccaa

SEQ ID NO: 128723 - DNA, 23 bp, Homo sapiens
cttgaatgccatagtcaaagaga

SEQ ID NO: 128724 - DNA, 15 bp, Homo sapiens
cttgaattgttatga

SEQ ID NO: 128725 - DNA, 19 bp, Homo sapiens
cttgaattgttatgaaaat

SEQ ID NO: 128726 - DNA, 22 bp, Homo sapiens
cttgcacgcgccctttctacca

SEQ ID NO: 128727 - DNA, 16 bp, Homo sapiens
cttgctacttatcatt

SEQ ID NO: 128728 - DNA, 21 bp, Homo sapiens
cttgctacttatcatttttgt

SEQ ID NO: 128729 - DNA, 16 bp, Homo sapiens
cttgctcaggtgcaag

SEQ ID NO: 128730 - DNA, 18 bp, Homo sapiens
cttggagtgccccaagga

SEQ ID NO: 128731 - DNA, 19 bp, Homo sapiens
cttggagtgccccaaggag

SEQ ID NO: 128732 - DNA, 20 bp, Homo sapiens
cttggcatgggcgcaggccc

SEQ ID NO: 128733 - DNA, 21 bp, Homo sapiens
cttggcatgggcgcaggccca

SEQ ID NO: 128734 - DNA, 22 bp, Homo sapiens
cttggcatgggcgcaggcccag

SEQ ID NO: 128735 - DNA, 15 bp, Homo sapiens
cttggcttcttaaaa

SEQ ID NO: 128736 - DNA, 22 bp, Homo sapiens
cttggcttcttaaaaactgtgt

SEQ ID NO: 128737 - DNA, 16 bp, Homo sapiens
cttgtgctgagcctgc

SEQ ID NO: 128738 - DNA, 19 bp, Homo sapiens
cttgtgctgagcctgccca

SEQ ID NO: 128739 - DNA, 23 bp, Homo sapiens
cttgtttttataataaaaagctt

SEQ ID NO: 128740 - DNA, 13 bp, Homo sapiens
ctttaaaaggcaa

SEQ ID NO: 128741 - DNA, 14 bp, Homo sapiens
ctttaaaaggcaac

SEQ ID NO: 128742 - DNA, 15 bp, Homo sapiens
ctttaaaataaaata

SEQ ID NO: 128743 - DNA, 14 bp, Homo sapiens
ctttcacaggactc

SEQ ID NO: 128744 - DNA, 17 bp, Homo sapiens
ctttcacaggactctgc

SEQ ID NO: 128745 - DNA, 15 bp, Homo sapiens
ctttccaatagaaag

SEQ ID NO: 128746 - DNA, 16 bp, Homo sapiens
gcttttaaaaaatatt

SEQ ID NO: 128747 - DNA, 19 bp, Homo sapiens
ggaaaaaactttgctccag

SEQ ID NO: 128748 - DNA, 14 bp, Homo sapiens
ggaaaaagagactc

SEQ ID NO: 128749 - DNA, 14 bp, Homo sapiens
ggaaaattgaaagt

SEQ ID NO: 128750 - DNA, 17 bp, Homo sapiens
ggaaacagacagggaga

SEQ ID NO: 128751 - DNA, 17 bp, Homo sapiens
ggaaacgcacttacaag

SEQ ID NO: 128752 - DNA, 21 bp, Homo sapiens
ggaagaatttaatggactgtg

SEQ ID NO: 128753 - DNA, 19 bp, Homo sapiens
ggaaggtgggtgaggctgg

SEQ ID NO: 128754 - DNA, 21 bp, Homo sapiens
ggaaggtgggtgaggctgggc

SEQ ID NO: 128755 - DNA, 19 bp, Homo sapiens
ggaatgtgtccaagacaca

SEQ ID NO: 128756 - DNA, 17 bp, Homo sapiens
ggaattttgagaaaaat

SEQ ID NO: 128757 - DNA, 21 bp, Homo sapiens
ggacaaaaagaccttctccct

SEQ ID NO: 128758 - DNA, 17 bp, Homo sapiens
ggacagatttgaggact

SEQ ID NO: 128759 - DNA, 12 bp, Homo sapiens
ggacccacctgg

SEQ ID NO: 128760 - DNA, 22 bp, Homo sapiens
ggaccccctcaggattgtttct

SEQ ID NO: 128761 - DNA, 11 bp, Homo sapiens
ggaccctggcc

SEQ ID NO: 128762 - DNA, 17 bp, Homo sapiens
ggagaaagtaagtcttt

SEQ ID NO: 128763 - DNA, 19 bp, Homo sapiens
ggagaactccgctggatgg

SEQ ID NO: 128764 - DNA, 14 bp, Homo sapiens
ggagacccacagcc

SEQ ID NO: 128765 - DNA, 21 bp, Homo sapiens
ggagacccacagccctgaaac

SEQ ID NO: 128766 - DNA, 19 bp, Homo sapiens
ggagactgggcacccctgc

SEQ ID NO: 128767 - DNA, 21 bp, Homo sapiens
ggagactgggcacccctgcct

SEQ ID NO: 128768 - DNA, 15 bp, Homo sapiens
ggagagagggtctcc

SEQ ID NO: 128769 - DNA, 17 bp, Homo sapiens
tgctcctttctgcccag

SEQ ID NO: 128770 - DNA, 19 bp, Homo sapiens
tgctcgcccacaaactgat

SEQ ID NO: 128771 - DNA, 21 bp, Homo sapiens
tgctgagctgggcccagcccc

SEQ ID NO: 128772 - DNA, 17 bp, Homo sapiens
tgctgaggttttgaata

SEQ ID NO: 128773 - DNA, 20 bp, Homo sapiens
tgctgaggttttgaataaaa

SEQ ID NO: 128774 - DNA, 17 bp, Homo sapiens
tgctgcaaacccatgaa

SEQ ID NO: 128775 - DNA, 19 bp, Homo sapiens
tgcttgttccctctccctg

SEQ ID NO: 128776 - DNA, 14 bp, Homo sapiens
tggaaacgcactta

SEQ ID NO: 128777 - DNA, 18 bp, Homo sapiens
tggaagctgctgaggccc

SEQ ID NO: 128778 - DNA, 12 bp, Homo sapiens
ctttctgcccag

SEQ ID NO: 128779 - DNA, 22 bp, Homo sapiens
ctttctgcccagcctgctcagc

SEQ ID NO: 128780 - DNA, 12 bp, Homo sapiens
ctttgtattata

SEQ ID NO: 128781 - DNA, 17 bp, Homo sapiens
ctttgtgtgttatattc

SEQ ID NO: 128782 - DNA, 14 bp, Homo sapiens
ctttgttaaaaaaa

SEQ ID NO: 128783 - DNA, 17 bp, Homo sapiens
cttttctggttccaaac

SEQ ID NO: 128784 - DNA, 12 bp, Homo sapiens
cttttctttgta

SEQ ID NO: 128785 - DNA, 18 bp, Homo sapiens
cttttgcaacaagacaaa

SEQ ID NO: 128786 - DNA, 11 bp, Homo sapiens
cttttgtaatt

SEQ ID NO: 128787 - DNA, 15 bp, Homo sapiens
cttttgtaatttgaa

SEQ ID NO: 128788 - DNA, 19 bp, Homo sapiens
cttttgtaatttgaattgg

SEQ ID NO: 128789 - DNA, 14 bp, Homo sapiens
ctttttaaaaaata

SEQ ID NO: 128790 - DNA, 15 bp, Homo sapiens
ctttttaaaaaatac

SEQ ID NO: 128791 - DNA, 20 bp, Homo sapiens
ctttttaaaaaataccattg

SEQ ID NO: 128792 - DNA, 19 bp, Homo sapiens
cttttttgtacttttctgg

SEQ ID NO: 128793 - DNA, 21 bp, Homo sapiens
cttttttttttccaaattatt

SEQ ID NO: 128794 - DNA, 23 bp, Homo sapiens
cttttttttttccaaattattaa

SEQ ID NO: 128795 - DNA, 13 bp, Homo sapiens
gaaaaagagactc

SEQ ID NO: 128796 - DNA, 16 bp, Homo sapiens
gaaaaatattgctaaa

SEQ ID NO: 128797 - DNA, 22 bp, Homo sapiens
gaaaactcatgatcaagatata

SEQ ID NO: 128798 - DNA, 14 bp, Homo sapiens
gaaaagtgcaatgc

SEQ ID NO: 128799 - DNA, 15 bp, Homo sapiens
gaaaatgcattatgt

SEQ ID NO: 128800 - DNA, 16 bp, Homo sapiens
gaaaattgaaagtatt

SEQ ID NO: 128801 - DNA, 16 bp, Homo sapiens
gaaacagacagggaga

SEQ ID NO: 128802 - DNA, 18 bp, Homo sapiens
gaaacagacagggagaag

SEQ ID NO: 128803 - DNA, 16 bp, Homo sapiens
gaaacagcatattagc

SEQ ID NO: 128804 - DNA, 22 bp, Homo sapiens
gaaacagtattttcttcccaaa

SEQ ID NO: 128805 - DNA, 14 bp, Homo sapiens
gaaaccatgacaaa

SEQ ID NO: 128806 - DNA, 15 bp, Homo sapiens
gaaaccatgacaaac

SEQ ID NO: 128807 - DNA, 19 bp, Homo sapiens
gaaacctgtccataaagta

SEQ ID NO: 128808 - DNA, 17 bp, Homo sapiens
gaaacgagaagtgccct

SEQ ID NO: 128809 - DNA, 19 bp, Homo sapiens
gaaacgagaagtgccctta

SEQ ID NO: 128810 - DNA, 18 bp, Homo sapiens
gaaacgcacttacaagtg

SEQ ID NO: 128811 - DNA, 18 bp, Homo sapiens
gaaactaaacagaaaact

SEQ ID NO: 128812 - DNA, 19 bp, Homo sapiens
gaaactaaacagaaaactc

SEQ ID NO: 128813 - DNA, 21 bp, Homo sapiens
gaaagaaaaggcaaaagactg

SEQ ID NO: 128814 - DNA, 15 bp, Homo sapiens
gaaagagaatgaact

SEQ ID NO: 128815 - DNA, 18 bp, Homo sapiens
gaaaggatataaaaggat

SEQ ID NO: 128816 - DNA, 18 bp, Homo sapiens
gaaagtattcagaaatta

SEQ ID NO: 128817 - DNA, 14 bp, Homo sapiens
gaaagtgatgacat

SEQ ID NO: 128818 - DNA, 15 bp, Homo sapiens
gaaagtgatgacata

SEQ ID NO: 128819 - DNA, 19 bp, Homo sapiens
gaaataatgtacatctggc

SEQ ID NO: 128820 - DNA, 17 bp, Homo sapiens
gaaatcagcatgacaaa

SEQ ID NO: 128821 - DNA, 20 bp, Homo sapiens
gaaatcagcatgacaaaaat

SEQ ID NO: 128822 - DNA, 22 bp, Homo sapiens
gaaatcagcatgacaaaaataa

SEQ ID NO: 128823 - DNA, 23 bp, Homo sapiens
gaaatcagcatgacaaaaataac

SEQ ID NO: 128824 - DNA, 12 bp, Homo sapiens
gaaatctcaccc

SEQ ID NO: 128825 - DNA, 23 bp, Homo sapiens
gaaattaaaatattatttgatat

SEQ ID NO: 128826 - DNA, 13 bp, Homo sapiens
gaaattagtcttt

SEQ ID NO: 128827 - DNA, 21 bp, Homo sapiens
gaaattcaacctgtgtcttat

SEQ ID NO: 128828 - DNA, 20 bp, Homo sapiens
gaacagcaggatgccctgtt

SEQ ID NO: 128829 - DNA, 18 bp, Homo sapiens
gaactaagtaagaaacac

SEQ ID NO: 128830 - DNA, 15 bp, Homo sapiens
gaactgtggaattta

SEQ ID NO: 128831 - DNA, 17 bp, Homo sapiens
gaactttccaaaaccta

SEQ ID NO: 128832 - DNA, 18 bp, Homo sapiens
gaacttttacagaatgca

SEQ ID NO: 128833 - DNA, 19 bp, Homo sapiens
gaacttttacagaatgcat

SEQ ID NO: 128834 - DNA, 23 bp, Homo sapiens
gaacttttacagaatgcattaaa

SEQ ID NO: 128835 - DNA, 15 bp, Homo sapiens
gaagaatcacgattt

SEQ ID NO: 128836 - DNA, 17 bp, Homo sapiens
gaagaatttaatggact

SEQ ID NO: 128837 - DNA, 16 bp, Homo sapiens
gaagacataaaacttt

SEQ ID NO: 128838 - DNA, 19 bp, Homo sapiens
gaagacataaaactttaaa

SEQ ID NO: 128839 - DNA, 16 bp, Homo sapiens
gaagatggctgttagc

SEQ ID NO: 128840 - DNA, 18 bp, Homo sapiens
gaagattctctattggct

SEQ ID NO: 128841 - DNA, 17 bp, Homo sapiens
gaagctgctgaggcccc

SEQ ID NO: 128842 - DNA, 16 bp, Homo sapiens
gatattttcccttttt

SEQ ID NO: 128843 - DNA, 21 bp, Homo sapiens
gatattttccctttttaaaaa

SEQ ID NO: 128844 - DNA, 22 bp, Homo sapiens
gatattttccctttttaaaaaa

SEQ ID NO: 128845 - DNA, 12 bp, Homo sapiens
gatatttttgta

SEQ ID NO: 128846 - DNA, 17 bp, Homo sapiens
gatcaccccagccccca

SEQ ID NO: 128847 - DNA, 22 bp, Homo sapiens
gatcagaggtcatcccttcctc

SEQ ID NO: 128848 - DNA, 14 bp, Homo sapiens
gatccacctgtctc

SEQ ID NO: 128849 - DNA, 12 bp, Homo sapiens
gatcccctctct

SEQ ID NO: 128850 - DNA, 15 bp, Homo sapiens
gatcttgcagaagtt

SEQ ID NO: 128851 - DNA, 19 bp, Homo sapiens
gatgagtaaactgaggccc

SEQ ID NO: 128852 - DNA, 18 bp, Homo sapiens
gatgcagttttcaaatta

SEQ ID NO: 128853 - DNA, 18 bp, Homo sapiens
gatgcccaatccaggccc

SEQ ID NO: 128854 - DNA, 19 bp, Homo sapiens
gatgcccaccgaggagccc

SEQ ID NO: 128855 - DNA, 19 bp, Homo sapiens
gatggaaacgcacttacaa

SEQ ID NO: 128856 - DNA, 19 bp, Homo sapiens
gatggcttatttgtataat

SEQ ID NO: 128857 - DNA, 19 bp, Homo sapiens
gatgttacaagtttgctaa

SEQ ID NO: 128858 - DNA, 15 bp, Homo sapiens
gattatatatcataa

SEQ ID NO: 128859 - DNA, 18 bp, Homo sapiens
gattatatatcataaagt

SEQ ID NO: 128860 - DNA, 20 bp, Homo sapiens
gattatatatcataaagtat

SEQ ID NO: 128861 - DNA, 22 bp, Homo sapiens
gattatatatcataaagtatgc

SEQ ID NO: 128862 - DNA, 12 bp, Homo sapiens
gattccctctcc

SEQ ID NO: 128863 - DNA, 13 bp, Homo sapiens
gattgtattgctg

SEQ ID NO: 128864 - DNA, 21 bp, Homo sapiens
gattgttctgtccagtttcca

SEQ ID NO: 128865 - DNA, 22 bp, Homo sapiens
gcaaaagactggtttgtttgct

SEQ ID NO: 128866 - DNA, 21 bp, Homo sapiens
gcaaaagagtgtaaaatattt

SEQ ID NO: 128867 - DNA, 16 bp, Homo sapiens
gcaaaatcaacatgac

SEQ ID NO: 128868 - DNA, 14 bp, Homo sapiens
gcaaaattaaatct

SEQ ID NO: 128869 - DNA, 14 bp, Homo sapiens
gcaaacccatgaag

SEQ ID NO: 128870 - DNA, 13 bp, Homo sapiens
gcaaagttatatt

SEQ ID NO: 128871 - DNA, 21 bp, Homo sapiens
gcaaatttctataaatttaag

SEQ ID NO: 128872 - DNA, 22 bp, Homo sapiens
gcaaatttctataaatttaaga

SEQ ID NO: 128873 - DNA, 15 bp, Homo sapiens
gcaacatttctgtat

SEQ ID NO: 128874 - DNA, 20 bp, Homo sapiens
gcaacatttctgtatactgt

SEQ ID NO: 128875 - DNA, 20 bp, Homo sapiens
gcaagaatggtggcttcttt

SEQ ID NO: 128876 - DNA, 15 bp, Homo sapiens
gcaagaattaaaact

SEQ ID NO: 128877 - DNA, 16 bp, Homo sapiens
gcaagaattaaaactg

SEQ ID NO: 128878 - DNA, 21 bp, Homo sapiens
gcaagaattaaaactgagtcc

SEQ ID NO: 128879 - DNA, 19 bp, Homo sapiens
gcaagacttcactgcagcc

SEQ ID NO: 128880 - DNA, 13 bp, Homo sapiens
gcaagagaacatt

SEQ ID NO: 128881 - DNA, 18 bp, Homo sapiens
gcaataaaattatttgca

SEQ ID NO: 128882 - DNA, 16 bp, Homo sapiens
gcaattatattgtcct

SEQ ID NO: 128883 - DNA, 18 bp, Homo sapiens
gcaattccaagaaaatat

SEQ ID NO: 128884 - DNA, 19 bp, Homo sapiens
gcaattccaagaaaatatc

SEQ ID NO: 128885 - DNA, 12 bp, Homo sapiens
gcacagcccagg

SEQ ID NO: 128886 - DNA, 15 bp, Homo sapiens
gcacaggaggctccg

SEQ ID NO: 128887 - DNA, 23 bp, Homo sapiens
gcaccgggctccatgcctctgga

SEQ ID NO: 128888 - DNA, 19 bp, Homo sapiens
gcacctatggcccagccac

SEQ ID NO: 128889 - DNA, 18 bp, Homo sapiens
gcacgcgccctttctacc

SEQ ID NO: 128890 - DNA, 13 bp, Homo sapiens
gcacttgcctgct

SEQ ID NO: 128891 - DNA, 15 bp, Homo sapiens
gcacttgcctgctgc

SEQ ID NO: 128892 - DNA, 14 bp, Homo sapiens
gcagaatggagaaa

SEQ ID NO: 128893 - DNA, 16 bp, Homo sapiens
gcagaatggagaaagt

SEQ ID NO: 128894 - DNA, 16 bp, Homo sapiens
gcagatagtgcctctg

SEQ ID NO: 128895 - DNA, 18 bp, Homo sapiens
gcagatagtgcctctgca

SEQ ID NO: 128896 - DNA, 15 bp, Homo sapiens
gcagcacagcccagg

SEQ ID NO: 128897 - DNA, 19 bp, Homo sapiens
gcagcacagcccagggcct

SEQ ID NO: 128898 - DNA, 17 bp, Homo sapiens
gcagccaaggaatgtgt

SEQ ID NO: 128899 - DNA, 18 bp, Homo sapiens
gcagccacaccgctggct

SEQ ID NO: 128900 - DNA, 19 bp, Homo sapiens
gcagcttgtgctgagcctg

SEQ ID NO: 128901 - DNA, 17 bp, Homo sapiens
gcaggatgccctgttgg

SEQ ID NO: 128902 - DNA, 18 bp, Homo sapiens
gcagggcctggcggaggt

SEQ ID NO: 128903 - DNA, 14 bp, Homo sapiens
gcaggggtctgagc

SEQ ID NO: 128904 - DNA, 16 bp, Homo sapiens
gcaggggtctgagcca

SEQ ID NO: 128905 - DNA, 21 bp, Homo sapiens
gcaggtctttaaatcatttta

SEQ ID NO: 128906 - DNA, 16 bp, Homo sapiens
gcagtacaataaaagt

SEQ ID NO: 128907 - DNA, 18 bp, Homo sapiens
gcagtcctgcctcagcct

SEQ ID NO: 128908 - DNA, 13 bp, Homo sapiens
gcagttcaccatg

SEQ ID NO: 128909 - DNA, 22 bp, Homo sapiens
gcatcactgattccctctccca

SEQ ID NO: 128910 - DNA, 16 bp, Homo sapiens
gcatcctcctcagccc

SEQ ID NO: 128911 - DNA, 18 bp, Homo sapiens
gcatcctcctcagccccc

SEQ ID NO: 128912 - DNA, 21 bp, Homo sapiens
gcatcctcctcagcccccagg

SEQ ID NO: 128913 - DNA, 11 bp, Homo sapiens
gcatcttcagt

SEQ ID NO: 128914 - DNA, 23 bp, Homo sapiens
gcatcttcagtcgtctgtcccaa

SEQ ID NO: 128915 - DNA, 15 bp, Homo sapiens
gcatgggcgcaggcc

SEQ ID NO: 128916 - DNA, 17 bp, Homo sapiens
gcatgggcgcaggccca

SEQ ID NO: 128917 - DNA, 19 bp, Homo sapiens
gcatgggcgcaggcccagt

SEQ ID NO: 128918 - DNA, 16 bp, Homo sapiens
gcatgtatagttgctt

SEQ ID NO: 128919 - DNA, 15 bp, Homo sapiens
gcattttaaaagcaa

SEQ ID NO: 128920 - DNA, 15 bp, Homo sapiens
gccaaaccctgtctg

SEQ ID NO: 128921 - DNA, 14 bp, Homo sapiens
gccaaggccggaga

SEQ ID NO: 128922 - DNA, 16 bp, Homo sapiens
gccaccacgtccagct

SEQ ID NO: 128923 - DNA, 12 bp, Homo sapiens
gccactcctctt

SEQ ID NO: 128924 - DNA, 15 bp, Homo sapiens
gccactcctcttcac

SEQ ID NO: 128925 - DNA, 15 bp, Homo sapiens
gccactgcagcacag

SEQ ID NO: 128926 - DNA, 23 bp, Homo sapiens
gccactggcacttgcctgctgct

SEQ ID NO: 128927 - DNA, 17 bp, Homo sapiens
gccaggtgaggtccacc

SEQ ID NO: 128928 - DNA, 20 bp, Homo sapiens
gccaggtgaggtccaccggc

SEQ ID NO: 128929 - DNA, 13 bp, Homo sapiens
gccataattatga

SEQ ID NO: 128930 - DNA, 16 bp, Homo sapiens
gccataattatgaaaa

SEQ ID NO: 128931 - DNA, 17 bp, Homo sapiens
gccatagtcaaagagag

SEQ ID NO: 128932 - DNA, 21 bp, Homo sapiens
gccatgtgcacctatggccca

SEQ ID NO: 128933 - DNA, 15 bp, Homo sapiens
gcccaatccaggccc

SEQ ID NO: 128934 - DNA, 14 bp, Homo sapiens
gcccacaaactgat

SEQ ID NO: 128935 - DNA, 19 bp, Homo sapiens
gcccaccgaggagccccag

SEQ ID NO: 128936 - DNA, 20 bp, Homo sapiens
gcccaccgaggagccccagc

SEQ ID NO: 128937 - DNA, 21 bp, Homo sapiens
gcccaccgaggagccccagcc

SEQ ID NO: 128938 - DNA, 23 bp, Homo sapiens
gcccaccgaggagccccagcccc

SEQ ID NO: 128939 - DNA, 16 bp, Homo sapiens
gcccagccactgcagc

SEQ ID NO: 128940 - DNA, 16 bp, Homo sapiens
gcccagcccctccacg

SEQ ID NO: 128941 - DNA, 14 bp, Homo sapiens
gcccagcctgctca

SEQ ID NO: 128942 - DNA, 17 bp, Homo sapiens
gcccagcctgctcagca

SEQ ID NO: 128943 - DNA, 19 bp, Homo sapiens
gcccagcctgctcagcagg

SEQ ID NO: 128944 - DNA, 20 bp, Homo sapiens
gcccaggggtggggcccatg

SEQ ID NO: 128945 - DNA, 22 bp, Homo sapiens
ttcaaaaaaaaaaaaaaagact

SEQ ID NO: 128946 - DNA, 21 bp, Homo sapiens
ttcaaattttttaaaagagac

SEQ ID NO: 128947 - DNA, 13 bp, Homo sapiens
ttcaccccaccct

SEQ ID NO: 128948 - DNA, 12 bp, Homo sapiens
ttcactgtacgt

SEQ ID NO: 128949 - DNA, 13 bp, Homo sapiens
ttcagaaattaaa

SEQ ID NO: 128950 - DNA, 15 bp, Homo sapiens
ttcagaaattaaaat

SEQ ID NO: 128951 - DNA, 21 bp, Homo sapiens
ttcagaaattaaaatattatt

SEQ ID NO: 128952 - DNA, 15 bp, Homo sapiens
ttcagaataaaatta

SEQ ID NO: 128953 - DNA, 18 bp, Homo sapiens
ttcagctattagcaactg

SEQ ID NO: 128954 - DNA, 12 bp, Homo sapiens
ttcagtatctta

SEQ ID NO: 128955 - DNA, 17 bp, Homo sapiens
ttcagtatcttagagtt

SEQ ID NO: 128956 - DNA, 20 bp, Homo sapiens
ttcataatggcctgagactt

SEQ ID NO: 128957 - DNA, 15 bp, Homo sapiens
ttcatgctatcagaa

SEQ ID NO: 128958 - DNA, 12 bp, Homo sapiens
ttcattgtacaa

SEQ ID NO: 128959 - DNA, 20 bp, Homo sapiens
ttcatttgagttattttaat

SEQ ID NO: 128960 - DNA, 17 bp, Homo sapiens
ttccaaaccagtttatt

SEQ ID NO: 128961 - DNA, 19 bp, Homo sapiens
tagaggacactaggagact

SEQ ID NO: 128962 - DNA, 21 bp, Homo sapiens
tagagtttacagtttgtgttt

SEQ ID NO: 128963 - DNA, 20 bp, Homo sapiens
aaactgtgtatcattaaaat

SEQ ID NO: 128964 - DNA, 22 bp, Homo sapiens
aaactgtgtatcattaaaatat

SEQ ID NO: 128965 - DNA, 16 bp, Homo sapiens
aaactttaaaaggcaa

SEQ ID NO: 128966 - DNA, 15 bp, Homo sapiens
aaactttctccattt

SEQ ID NO: 128967 - DNA, 15 bp, Homo sapiens
aaactttcttaatat

SEQ ID NO: 128968 - DNA, 16 bp, Homo sapiens
aaactttgctccaggc

SEQ ID NO: 128969 - DNA, 17 bp, Homo sapiens
aaagaaaccatgacaaa

SEQ ID NO: 128970 - DNA, 20 bp, Homo sapiens
aaagaagagaggggaagaat

SEQ ID NO: 128971 - DNA, 23 bp, Homo sapiens
aaagaagagaggggaagaattta

SEQ ID NO: 128972 - DNA, 12 bp, Homo sapiens
aaagaatagaaa

SEQ ID NO: 128973 - DNA, 13 bp, Homo sapiens
aaagaccttctcc

SEQ ID NO: 128974 - DNA, 16 bp, Homo sapiens
aaagaccttctcccta

SEQ ID NO: 128975 - DNA, 22 bp, Homo sapiens
aaagaccttctccctagccctt

SEQ ID NO: 128976 - DNA, 14 bp, Homo sapiens
aaagactcctctgg

SEQ ID NO: 128977 - DNA, 16 bp, Homo sapiens
aaagactcctctgggc

SEQ ID NO: 128978 - DNA, 12 bp, Homo sapiens
aaagactggttt

SEQ ID NO: 128979 - DNA, 22 bp, Homo sapiens
aaagactggtttgtttgcttaa

SEQ ID NO: 128980 - DNA, 23 bp, Homo sapiens
aaagactgtcaaatgaactttta

SEQ ID NO: 128981 - DNA, 15 bp, Homo sapiens
aaagagaatgaactg

SEQ ID NO: 128982 - DNA, 18 bp, Homo sapiens
aaagagaatgaactgtgg

SEQ ID NO: 128983 - DNA, 22 bp, Homo sapiens
aaagagacaaactgtaaaaaat

SEQ ID NO: 128984 - DNA, 12 bp, Homo sapiens
aaagattatata

SEQ ID NO: 128985 - DNA, 17 bp, Homo sapiens
aaagattatatatcata

SEQ ID NO: 128986 - DNA, 15 bp, Homo sapiens
aaagattgtattgct

SEQ ID NO: 128987 - DNA, 13 bp, Homo sapiens
aaagccacatttt

SEQ ID NO: 128988 - DNA, 15 bp, Homo sapiens
aaagccacattttgc

SEQ ID NO: 128989 - DNA, 17 bp, Homo sapiens
aaaggaaatctcacccc

SEQ ID NO: 128990 - DNA, 16 bp, Homo sapiens
aaaggatataaaagga

SEQ ID NO: 128991 - DNA, 18 bp, Homo sapiens
aaatttaagaaaacaagt

SEQ ID NO: 128992 - DNA, 21 bp, Homo sapiens
aaatttaagaaaacaagtata

SEQ ID NO: 128993 - DNA, 12 bp, Homo sapiens
aaatttctctgt

SEQ ID NO: 128994 - DNA, 14 bp, Homo sapiens
aaatttttgaaaaa

SEQ ID NO: 128995 - DNA, 16 bp, Homo sapiens
aaatttttgaaaaata

SEQ ID NO: 128996 - DNA, 22 bp, Homo sapiens
aaatttttgaaaaatattgcta

SEQ ID NO: 128997 - DNA, 20 bp, Homo sapiens
aacaacttgctacttatcat

SEQ ID NO: 128998 - DNA, 11 bp, Homo sapiens
aacaataaagt

SEQ ID NO: 128999 - DNA, 22 bp, Homo sapiens
aacactgttggcacttataggt

SEQ ID NO: 129000 - DNA, 15 bp, Homo sapiens
aacagagaaagaaaa

SEQ ID NO: 129001 - DNA, 20 bp, Homo sapiens
aacagagaaagaaaaggcaa

SEQ ID NO: 129002 - DNA, 12 bp, Homo sapiens
aacagtaaaatc

SEQ ID NO: 129003 - DNA, 15 bp, Homo sapiens
aacatcccaagattt

SEQ ID NO: 129004 - DNA, 14 bp, Homo sapiens
aacatgggtttcct

SEQ ID NO: 129005 - DNA, 15 bp, Homo sapiens
aacatgggtttcctt

SEQ ID NO: 129006 - DNA, 14 bp, Homo sapiens
aacatgtgcccctg

SEQ ID NO: 129007 - DNA, 17 bp, Homo sapiens
aacatttctgtatactg

SEQ ID NO: 129008 - DNA, 19 bp, Homo sapiens
aaccagggaagctgtccct

SEQ ID NO: 129009 - DNA, 12 bp, Homo sapiens
aaccatgacaaa

SEQ ID NO: 129010 - DNA, 13 bp, Homo sapiens
aaccatgacaaac

SEQ ID NO: 129011 - DNA, 20 bp, Homo sapiens
aacctagcttttaaaaaata

SEQ ID NO: 129012 - DNA, 22 bp, Homo sapiens
aacctagcttttaaaaaatatt

SEQ ID NO: 129013 - DNA, 23 bp, Homo sapiens
aacctagcttttaaaaaatattt

SEQ ID NO: 129014 - DNA, 13 bp, Homo sapiens
aacctctggccct

SEQ ID NO: 129015 - DNA, 16 bp, Homo sapiens
aacctctggcccttgg

SEQ ID NO: 129016 - DNA, 21 bp, Homo sapiens
aacctctggcccttggaataa

SEQ ID NO: 129017 - DNA, 23 bp, Homo sapiens
aacctctggcccttggaataaag

SEQ ID NO: 129018 - DNA, 18 bp, Homo sapiens
aacgtgattgattcagta

SEQ ID NO: 129019 - DNA, 23 bp, Homo sapiens
aactacacacccccaagccacag

SEQ ID NO: 129020 - DNA, 17 bp, Homo sapiens
aactatcaatatttaag

SEQ ID NO: 129021 - DNA, 22 bp, Homo sapiens
aactatcaatatttaagtttgt

SEQ ID NO: 129022 - DNA, 11 bp, Homo sapiens
aactcctgtgt

SEQ ID NO: 129023 - DNA, 13 bp, Homo sapiens
aactcctgtgtcg

SEQ ID NO: 129024 - DNA, 15 bp, Homo sapiens
aactctactgtgtaa

SEQ ID NO: 129025 - DNA, 22 bp, Homo sapiens
aactgaaggttttttttttaag

SEQ ID NO: 129026 - DNA, 23 bp, Homo sapiens
aactgaaggttttttttttaagt

SEQ ID NO: 129027 - DNA, 18 bp, Homo sapiens
aactgagaaatgaatgct

SEQ ID NO: 129028 - DNA, 16 bp, Homo sapiens
aactgagtccatgaaa

SEQ ID NO: 129029 - DNA, 17 bp, Homo sapiens
aactgagtccatgaaaa

SEQ ID NO: 129030 - DNA, 22 bp, Homo sapiens
aactgagtccatgaaaatacca

SEQ ID NO: 129031 - DNA, 20 bp, Homo sapiens
aactgtaaaaaatgtgtgta

SEQ ID NO: 129032 - DNA, 22 bp, Homo sapiens
aactgtaaacttggaatcaagg

SEQ ID NO: 129033 - DNA, 16 bp, Homo sapiens
aactgtgcattacaaa

SEQ ID NO: 129034 - DNA, 17 bp, Homo sapiens
aactgtgtatcattaaa

SEQ ID NO: 129035 - DNA, 21 bp, Homo sapiens
aactgtgtatcattaaaatat

SEQ ID NO: 129036 - DNA, 16 bp, Homo sapiens
aacttcaaatatagag

SEQ ID NO: 129037 - DNA, 14 bp, Homo sapiens
aacttggaatcaag

SEQ ID NO: 129038 - DNA, 22 bp, Homo sapiens
aactttctccatttaagacaca

SEQ ID NO: 129039 - DNA, 15 bp, Homo sapiens
aactttgctccaggc

SEQ ID NO: 129040 - DNA, 13 bp, Homo sapiens
aacttttacagaa

SEQ ID NO: 129041 - DNA, 16 bp, Homo sapiens
aacttttacagaatgc

SEQ ID NO: 129042 - DNA, 14 bp, Homo sapiens
aacttttgtaattt

SEQ ID NO: 129043 - DNA, 20 bp, Homo sapiens
aacttttgtaatttgaattg

SEQ ID NO: 129044 - DNA, 20 bp, Homo sapiens
aagaaaaggcaaaagactgg

SEQ ID NO: 129045 - DNA, 11 bp, Homo sapiens
aagaaaatatc

SEQ ID NO: 129046 - DNA, 14 bp, Homo sapiens
aagaaaccatgaca

SEQ ID NO: 129047 - DNA, 17 bp, Homo sapiens
aagaaagagaatgaact

SEQ ID NO: 129048 - DNA, 21 bp, Homo sapiens
aagaaagagaatgaactgtgg

SEQ ID NO: 129049 - DNA, 13 bp, Homo sapiens
aagaatcccaccc

SEQ ID NO: 129050 - DNA, 19 bp, Homo sapiens
aagaatgtttaatagaaaa

SEQ ID NO: 129051 - DNA, 20 bp, Homo sapiens
aagaatgtttaatagaaaat

SEQ ID NO: 129052 - DNA, 21 bp, Homo sapiens
aagaatgtttaatagaaaatt

SEQ ID NO: 129053 - DNA, 17 bp, Homo sapiens
aagaatttaatggactg

SEQ ID NO: 129054 - DNA, 18 bp, Homo sapiens
aagaatttaatggactgt

SEQ ID NO: 129055 - DNA, 20 bp, Homo sapiens
aagaatttaatggactgtga

SEQ ID NO: 129056 - DNA, 18 bp, Homo sapiens
aagacacatgctgaggtt

SEQ ID NO: 129057 - DNA, 13 bp, Homo sapiens
aagactcctctgg

SEQ ID NO: 129058 - DNA, 14 bp, Homo sapiens
aagactcctctggg

SEQ ID NO: 129059 - DNA, 23 bp, Homo sapiens
aagactcctctgggcctggggtg

SEQ ID NO: 129060 - DNA, 17 bp, Homo sapiens
aagactggtttgtttgc

SEQ ID NO: 129061 - DNA, 18 bp, Homo sapiens
aagactggtttgtttgct

SEQ ID NO: 129062 - DNA, 17 bp, Homo sapiens
aagacttcactgcagcc

SEQ ID NO: 129063 - DNA, 18 bp, Homo sapiens
aagacttcactgcagcct

SEQ ID NO: 129064 - DNA, 20 bp, Homo sapiens
aagacttcactgcagccttt

SEQ ID NO: 129065 - DNA, 16 bp, Homo sapiens
aagagaatgaactgtg

SEQ ID NO: 129066 - DNA, 19 bp, Homo sapiens
aagagaatgaactgtggaa

SEQ ID NO: 129067 - DNA, 19 bp, Homo sapiens
aagagagtttttaatagaa

SEQ ID NO: 129068 - DNA, 13 bp, Homo sapiens
aagatcttgcaga

SEQ ID NO: 129069 - DNA, 22 bp, Homo sapiens
aagatgatggaaacgcacttac

SEQ ID NO: 129070 - DNA, 20 bp, Homo sapiens
aagattatatatcataaagt

SEQ ID NO: 129071 - DNA, 17 bp, Homo sapiens
aagatttccaagtgcca

SEQ ID NO: 129072 - DNA, 15 bp, Homo sapiens
aagattttttttgta

SEQ ID NO: 129073 - DNA, 16 bp, Homo sapiens
aagattttttttgtaa

SEQ ID NO: 129074 - DNA, 20 bp, Homo sapiens
aagattttttttgtaacttc

SEQ ID NO: 129075 - DNA, 17 bp, Homo sapiens
aagcaaagccacatttt

SEQ ID NO: 129076 - DNA, 13 bp, Homo sapiens
aagcaattatatt

SEQ ID NO: 129077 - DNA, 16 bp, Homo sapiens
aagcaattatattgtc

SEQ ID NO: 129078 - DNA, 13 bp, Homo sapiens
aagcaccagggag

SEQ ID NO: 129079 - DNA, 15 bp, Homo sapiens
aagcaccagggagag

SEQ ID NO: 129080 - DNA, 15 bp, Homo sapiens
aagcatgggaaaaag

SEQ ID NO: 129081 - DNA, 21 bp, Homo sapiens
aagcatgggaaaaagagactc

SEQ ID NO: 129082 - DNA, 23 bp, Homo sapiens
aagcctgcaggtccggggaggag

SEQ ID NO: 129083 - DNA, 22 bp, Homo sapiens
aagcttctagacactccttgaa

SEQ ID NO: 129084 - DNA, 20 bp, Homo sapiens
aaggaatacaatatatagct

SEQ ID NO: 129085 - DNA, 14 bp, Homo sapiens
aaggaatataagaa

SEQ ID NO: 129086 - DNA, 17 bp, Homo sapiens
aaggaatgtgtccaaga

SEQ ID NO: 129087 - DNA, 15 bp, Homo sapiens
aaggagattgggaga

SEQ ID NO: 129088 - DNA, 16 bp, Homo sapiens
aaggcagcatgtatag

SEQ ID NO: 129089 - DNA, 19 bp, Homo sapiens
aaggccggagacccacagc

SEQ ID NO: 129090 - DNA, 21 bp, Homo sapiens
aaggccggagacccacagccc

SEQ ID NO: 129091 - DNA, 14 bp, Homo sapiens
aagggcattttaaa

SEQ ID NO: 129092 - DNA, 13 bp, Homo sapiens
aaaaactcctgtg

SEQ ID NO: 129093 - DNA, 16 bp, Homo sapiens
aaaaactcctgtgtcg

SEQ ID NO: 129094 - DNA, 11 bp, Homo sapiens
aaaaactgaag

SEQ ID NO: 129095 - DNA, 16 bp, Homo sapiens
aaaaagaccttctccc

SEQ ID NO: 129096 - DNA, 15 bp, Homo sapiens
aaaaagactgtcaaa

SEQ ID NO: 129097 - DNA, 21 bp, Homo sapiens
aaaaagactgtcaaatgaact

SEQ ID NO: 129098 - DNA, 18 bp, Homo sapiens
aaaaagattgtattgctg

SEQ ID NO: 129099 - DNA, 15 bp, Homo sapiens
aaaaaggaaattagt

SEQ ID NO: 129100 - DNA, 14 bp, Homo sapiens
aaaaagtatatatt

SEQ ID NO: 129101 - DNA, 17 bp, Homo sapiens
aaaaagtatatattcta

SEQ ID NO: 129102 - DNA, 16 bp, Homo sapiens
aaaaagtgaacttttg

SEQ ID NO: 129103 - DNA, 22 bp, Homo sapiens
aaaaagtgaacttttgtaattt

SEQ ID NO: 129104 - DNA, 15 bp, Homo sapiens
aaaaataacactgtt

SEQ ID NO: 129105 - DNA, 21 bp, Homo sapiens
aaaaatagagcaaaatcaaca

SEQ ID NO: 129106 - DNA, 12 bp, Homo sapiens
aaaaatattgct

SEQ ID NO: 129107 - DNA, 15 bp, Homo sapiens
aaaaatattgctaaa

SEQ ID NO: 129108 - DNA, 19 bp, Homo sapiens
aaaaattttgcatttcatg

SEQ ID NO: 129109 - DNA, 20 bp, Homo sapiens
aaaactcccaatacaaagat

SEQ ID NO: 129110 - DNA, 22 bp, Homo sapiens
aaaactcccaatacaaagatga

SEQ ID NO: 129111 - DNA, 10 bp, Homo sapiens
aaaactgaag

SEQ ID NO: 129112 - DNA, 23 bp, Homo sapiens
aaaactgaaggttttttttttaa

SEQ ID NO: 129113 - DNA, 14 bp, Homo sapiens
aaaactgagtccat

SEQ ID NO: 129114 - DNA, 20 bp, Homo sapiens
aaaactgtgtatcattaaaa

SEQ ID NO: 129115 - DNA, 21 bp, Homo sapiens
aaaactgtgtatcattaaaat

SEQ ID NO: 129116 - DNA, 20 bp, Homo sapiens
aaaagaagagaggggaagaa

SEQ ID NO: 129117 - DNA, 17 bp, Homo sapiens
aaaagactgtcaaatga

SEQ ID NO: 129118 - DNA, 22 bp, Homo sapiens
aaaagactgtcaaatgaacttt

SEQ ID NO: 129119 - DNA, 11 bp, Homo sapiens
aaaagagactc

SEQ ID NO: 129120 - DNA, 19 bp, Homo sapiens
aaaagagtgtaaaatattt

SEQ ID NO: 129121 - DNA, 15 bp, Homo sapiens
aaaagattgtattgc

SEQ ID NO: 129122 - DNA, 18 bp, Homo sapiens
aaaagcaattatattgtc

SEQ ID NO: 129123 - DNA, 17 bp, Homo sapiens
aaaaggaaattagtctt

SEQ ID NO: 129124 - DNA, 19 bp, Homo sapiens
aaaaggatgttacaagttt

SEQ ID NO: 129125 - DNA, 21 bp, Homo sapiens
aaaaggatgttacaagtttgc

SEQ ID NO: 129126 - DNA, 17 bp, Homo sapiens
aaaagtgaacttttgta

SEQ ID NO: 129127 - DNA, 21 bp, Homo sapiens
aaaagtgaacttttgtaattt

SEQ ID NO: 129128 - DNA, 21 bp, Homo sapiens
aaaagtgcaatgcgtgttgta

SEQ ID NO: 129129 - DNA, 14 bp, Homo sapiens
aaaagtgcatttaa

SEQ ID NO: 129130 - DNA, 15 bp, Homo sapiens
aaaagtgcatttaag

SEQ ID NO: 129131 - DNA, 21 bp, Homo sapiens
aaaagttataataactgaact

SEQ ID NO: 129132 - DNA, 22 bp, Homo sapiens
aaaagttataataactgaactg

SEQ ID NO: 129133 - DNA, 13 bp, Homo sapiens
aaaataacactgt

SEQ ID NO: 129134 - DNA, 13 bp, Homo sapiens
aaaataatgcttt

SEQ ID NO: 129135 - DNA, 20 bp, Homo sapiens
aaaatagagcaaaatcaaca

SEQ ID NO: 129136 - DNA, 16 bp, Homo sapiens
aaaatataaattgtac

SEQ ID NO: 129137 - DNA, 13 bp, Homo sapiens
aaaatattatttg

SEQ ID NO: 129138 - DNA, 14 bp, Homo sapiens
aaaatattatttga

SEQ ID NO: 129139 - DNA, 15 bp, Homo sapiens
aaaatattttaagaa

SEQ ID NO: 129140 - DNA, 15 bp, Homo sapiens
aaaatgcattatgtg

SEQ ID NO: 129141 - DNA, 23 bp, Homo sapiens
aaaatgtgtgtattcttaaaatg

SEQ ID NO: 129142 - DNA, 13 bp, Homo sapiens
aaaattaaaataa

SEQ ID NO: 129143 - DNA, 18 bp, Homo sapiens
aaaattaaatctagacat

SEQ ID NO: 129144 - DNA, 16 bp, Homo sapiens
aaggatgttacaagtt

SEQ ID NO: 129145 - DNA, 23 bp, Homo sapiens
aaggatgttacaagtttgctaaa

SEQ ID NO: 129146 - DNA, 16 bp, Homo sapiens
aaggcccaggggtggg

SEQ ID NO: 129147 - DNA, 16 bp, Homo sapiens
aagggcagtaaagttt

SEQ ID NO: 129148 - DNA, 19 bp, Homo sapiens
aaggtttcccagtgagcct

SEQ ID NO: 129149 - DNA, 17 bp, Homo sapiens
aaggttttttttttaag

SEQ ID NO: 129150 - DNA, 21 bp, Homo sapiens
aaggttttttttttaagtgca

SEQ ID NO: 129151 - DNA, 20 bp, Homo sapiens
aagtaagtcttttttttttc

SEQ ID NO: 129152 - DNA, 16 bp, Homo sapiens
aagtagtagtgtcttc

SEQ ID NO: 129153 - DNA, 15 bp, Homo sapiens
aagtatatttaagga

SEQ ID NO: 129154 - DNA, 17 bp, Homo sapiens
aagtattcagaaattaa

SEQ ID NO: 129155 - DNA, 16 bp, Homo sapiens
aagtatttataaaaat

SEQ ID NO: 129156 - DNA, 14 bp, Homo sapiens
aagtctagaatcat

SEQ ID NO: 129157 - DNA, 21 bp, Homo sapiens
aagtctctgctggcccagcca

SEQ ID NO: 129158 - DNA, 17 bp, Homo sapiens
aagtgaacttgggaggg

SEQ ID NO: 129159 - DNA, 17 bp, Homo sapiens
aagtgaacttttgtaat

SEQ ID NO: 129160 - DNA, 23 bp, Homo sapiens
aagtgaacttttgtaatttgaat

SEQ ID NO: 129161 - DNA, 18 bp, Homo sapiens
aagtgcaacatttctgta

SEQ ID NO: 129162 - DNA, 19 bp, Homo sapiens
aagtgcaacatttctgtat

SEQ ID NO: 129163 - DNA, 20 bp, Homo sapiens
aagtgcaacatttctgtata

SEQ ID NO: 129164 - DNA, 15 bp, Homo sapiens
aagtgcatttaagga

SEQ ID NO: 129165 - DNA, 17 bp, Homo sapiens
aagtgcatttaaggaga

SEQ ID NO: 129166 - DNA, 22 bp, Homo sapiens
aagtgtcctggaccctggccta

SEQ ID NO: 129167 - DNA, 14 bp, Homo sapiens
aagttataataact

SEQ ID NO: 129168 - DNA, 17 bp, Homo sapiens
aagttataataactgaa

SEQ ID NO: 129169 - DNA, 15 bp, Homo sapiens
aagtttgctaaaaga

SEQ ID NO: 129170 - DNA, 20 bp, Homo sapiens
aagtttgctaaaagaagaga

SEQ ID NO: 129171 - DNA, 14 bp, Homo sapiens
aagttttgatataa

SEQ ID NO: 129172 - DNA, 17 bp, Homo sapiens
aataaaattatttgcag

SEQ ID NO: 129173 - DNA, 19 bp, Homo sapiens
aataaaattatttgcaggt

SEQ ID NO: 129174 - DNA, 12 bp, Homo sapiens
aataaactttct

SEQ ID NO: 129175 - DNA, 18 bp, Homo sapiens
aataaagttctgttttct

SEQ ID NO: 129176 - DNA, 11 bp, Homo sapiens
aataacactgt

SEQ ID NO: 129177 - DNA, 22 bp, Homo sapiens
aataacactgttggcacttata

SEQ ID NO: 129178 - DNA, 20 bp, Homo sapiens
aataacctctggcccttgga

SEQ ID NO: 129179 - DNA, 23 bp, Homo sapiens
aataacctctggcccttggaata

SEQ ID NO: 129180 - DNA, 13 bp, Homo sapiens
aataactgaactg

SEQ ID NO: 129181 - DNA, 20 bp, Homo sapiens
aataagaagggggagtgaaa

SEQ ID NO: 129182 - DNA, 13 bp, Homo sapiens
aatacaaagatga

SEQ ID NO: 129183 - DNA, 14 bp, Homo sapiens
aatacaaagatgac

SEQ ID NO: 129184 - DNA, 13 bp, Homo sapiens
aataccattgaaa

SEQ ID NO: 129185 - DNA, 18 bp, Homo sapiens
aataccattgaaatcagc

SEQ ID NO: 129186 - DNA, 18 bp, Homo sapiens
aatactaatgttatttct

SEQ ID NO: 129187 - DNA, 14 bp, Homo sapiens
aatagtgtcctatg

SEQ ID NO: 129188 - DNA, 16 bp, Homo sapiens
aatagttcttaaaatt

SEQ ID NO: 129189 - DNA, 21 bp, Homo sapiens
aatataagaaaagtaatgaag

SEQ ID NO: 129190 - DNA, 16 bp, Homo sapiens
aatatagagatatttt

SEQ ID NO: 129191 - DNA, 13 bp, Homo sapiens
aatatatggcatt

SEQ ID NO: 129192 - DNA, 15 bp, Homo sapiens
aatatatgttctgca

SEQ ID NO: 129193 - DNA, 18 bp, Homo sapiens
aatatctgagaagtgtat

SEQ ID NO: 129194 - DNA, 24 bp, Homo sapiens
aaagttataataactgaactgttt

SEQ ID NO: 129195 - DNA, 15 bp, Homo sapiens
aaataaaagaaatat

SEQ ID NO: 129196 - DNA, 12 bp, Homo sapiens
aaataaaataat

SEQ ID NO: 129197 - DNA, 22 bp, Homo sapiens
aaataacctctggcccttggaa

SEQ ID NO: 129198 - DNA, 19 bp, Homo sapiens
aaataccataggaagacat

SEQ ID NO: 129199 - DNA, 18 bp, Homo sapiens
aaataccattgaaatcag

SEQ ID NO: 129200 - DNA, 15 bp, Homo sapiens
aaatacctcaggaaa

SEQ ID NO: 129201 - DNA, 16 bp, Homo sapiens
aaatagagcaaaatca

SEQ ID NO: 129202 - DNA, 21 bp, Homo sapiens
aaatagagcaaaatcaacatg

SEQ ID NO: 129203 - DNA, 17 bp, Homo sapiens
aaatataaattgtacat

SEQ ID NO: 129204 - DNA, 10 bp, Homo sapiens
aaatatctga

SEQ ID NO: 129205 - DNA, 16 bp, Homo sapiens
aaatatctgaacattt

SEQ ID NO: 129206 - DNA, 13 bp, Homo sapiens
aaatattgctaaa

SEQ ID NO: 129207 - DNA, 13 bp, Homo sapiens
aaatcaaaataaa

SEQ ID NO: 129208 - DNA, 12 bp, Homo sapiens
aaatcaacatga

SEQ ID NO: 129209 - DNA, 16 bp, Homo sapiens
aaatctagacattctt

SEQ ID NO: 129210 - DNA, 15 bp, Homo sapiens
aaatgaacttttaca

SEQ ID NO: 129211 - DNA, 20 bp, Homo sapiens
aaatgaacttttacagaatg

SEQ ID NO: 129212 - DNA, 22 bp, Homo sapiens
aaatgtaattaactgtaaactt

SEQ ID NO: 129213 - DNA, 15 bp, Homo sapiens
aaatgtgcattttgt

SEQ ID NO: 129214 - DNA, 20 bp, Homo sapiens
aaattaaatctagacattct

SEQ ID NO: 129215 - DNA, 20 bp, Homo sapiens
aaattattaattgtcctgtg

SEQ ID NO: 129216 - DNA, 23 bp, Homo sapiens
aaattattaattgtcctgtgtct

SEQ ID NO: 129217 - DNA, 14 bp, Homo sapiens
aaattatttgcagg

SEQ ID NO: 129218 - DNA, 19 bp, Homo sapiens
aaattgaaagtattcagaa

SEQ ID NO: 129219 - DNA, 20 bp, Homo sapiens
aaattgaaagtattcagaaa

SEQ ID NO: 129220 - DNA, 13 bp, Homo sapiens
aaattgtacattt

SEQ ID NO: 129221 - DNA, 13 bp, Homo sapiens
aaatttaagaaaa

SEQ ID NO: 129222 - DNA, 18 bp, Homo sapiens
aaattttgcatttcatgc

SEQ ID NO: 129223 - DNA, 19 bp, Homo sapiens
aaatttttgaaaaatattg

SEQ ID NO: 129224 - DNA, 16 bp, Homo sapiens
aaattttttaaaagag

SEQ ID NO: 129225 - DNA, 18 bp, Homo sapiens
aaattttttaaaagagac

SEQ ID NO: 129226 - DNA, 15 bp, Homo sapiens
aacaaccacaggaat

SEQ ID NO: 129227 - DNA, 21 bp, Homo sapiens
aacaacttgctacttatcatt

SEQ ID NO: 129228 - DNA, 23 bp, Homo sapiens
aacacaggcttatttttaaaata

SEQ ID NO: 129229 - DNA, 18 bp, Homo sapiens
aacaccatcattaagaat

SEQ ID NO: 129230 - DNA, 22 bp, Homo sapiens
aacagtaaaatccaaagaacta

SEQ ID NO: 129231 - DNA, 22 bp, Homo sapiens
aacatgcagctcttcaacatga

SEQ ID NO: 129232 - DNA, 15 bp, Homo sapiens
aacatgtgcccctgc

SEQ ID NO: 129233 - DNA, 17 bp, Homo sapiens
aacatttactacagttt

SEQ ID NO: 129234 - DNA, 15 bp, Homo sapiens
aacatttctgtatac

SEQ ID NO: 129235 - DNA, 16 bp, Homo sapiens
aacatttctgtatact

SEQ ID NO: 129236 - DNA, 19 bp, Homo sapiens
aacatttctgtatactgta

SEQ ID NO: 129237 - DNA, 23 bp, Homo sapiens
aacatttctgtatactgtaaaag

SEQ ID NO: 129238 - DNA, 22 bp, Homo sapiens
aaccacaaaaaaatacctcagg

SEQ ID NO: 129239 - DNA, 15 bp, Homo sapiens
aaccacccgccccgc

SEQ ID NO: 129240 - DNA, 18 bp, Homo sapiens
aaccagggaagctgtccc

SEQ ID NO: 129241 - DNA, 18 bp, Homo sapiens
aaccagtttattctgtgg

SEQ ID NO: 129242 - DNA, 17 bp, Homo sapiens
aacccatgaagctggcc

SEQ ID NO: 129243 - DNA, 22 bp, Homo sapiens
aacccatgaagctggccctcag

SEQ ID NO: 129244 - DNA, 17 bp, Homo sapiens
aaccctttgtattataa

SEQ ID NO: 129245 - DNA, 23 bp, Homo sapiens
aaccctttgtattataattgttg

SEQ ID NO: 129246 - DNA, 12 bp, Homo sapiens
aaccgacttttc

SEQ ID NO: 129247 - DNA, 18 bp, Homo sapiens
aacctaaagaggaaaagt

SEQ ID NO: 129248 - DNA, 19 bp, Homo sapiens
aacctagcttttaaaaaat

SEQ ID NO: 129249 - DNA, 9 bp, Homo sapiens
aacctctgg

SEQ ID NO: 129250 - DNA, 10 bp, Homo sapiens
aacctctggc

SEQ ID NO: 129251 - DNA, 12 bp, Homo sapiens
aacctctggccc

SEQ ID NO: 129252 - DNA, 18 bp, Homo sapiens
aacctctggcccttggaa

SEQ ID NO: 129253 - DNA, 17 bp, Homo sapiens
aacctgtccataaagta

SEQ ID NO: 129254 - DNA, 21 bp, Homo sapiens
aacctgtccataaagtaattt

SEQ ID NO: 129255 - DNA, 19 bp, Homo sapiens
aacgctctaccctgcagct

SEQ ID NO: 129256 - DNA, 19 bp, Homo sapiens
aacgtgattgattcagtat

SEQ ID NO: 129257 - DNA, 14 bp, Homo sapiens
aactatgtaaacaa

SEQ ID NO: 129258 - DNA, 23 bp, Homo sapiens
aactcgatgaatgtgttgatttg

SEQ ID NO: 129259 - DNA, 14 bp, Homo sapiens
aactgatttctcac

SEQ ID NO: 129260 - DNA, 20 bp, Homo sapiens
aactggaggaaccacatata

SEQ ID NO: 129261 - DNA, 15 bp, Homo sapiens
aactgtggaatttat

SEQ ID NO: 129262 - DNA, 23 bp, Homo sapiens
aactgtttggtcgagtctttgtg

SEQ ID NO: 129263 - DNA, 17 bp, Homo sapiens
aacttcaaatatagaga

SEQ ID NO: 129264 - DNA, 13 bp, Homo sapiens
aacttcaaatttt

SEQ ID NO: 129265 - DNA, 19 bp, Homo sapiens
aacttgctacttatcattt

SEQ ID NO: 129266 - DNA, 20 bp, Homo sapiens
aacttgctacttatcatttt

SEQ ID NO: 129267 - DNA, 12 bp, Homo sapiens
aactttaaaagg

SEQ ID NO: 129268 - DNA, 17 bp, Homo sapiens
aactttaaaaggcaact

SEQ ID NO: 129269 - DNA, 15 bp, Homo sapiens
aacttttacagaatg

SEQ ID NO: 129270 - DNA, 17 bp, Homo sapiens
aagaaaaggcaaaagac

SEQ ID NO: 129271 - DNA, 18 bp, Homo sapiens
aagaaaaggcaaaagact

SEQ ID NO: 129272 - DNA, 17 bp, Homo sapiens
aagaaaggatataaaag

SEQ ID NO: 129273 - DNA, 22 bp, Homo sapiens
aagaaagtctatctaatgacat

SEQ ID NO: 129274 - DNA, 23 bp, Homo sapiens
aagaaagtctatctaatgacatg

SEQ ID NO: 129275 - DNA, 21 bp, Homo sapiens
aagaagggggagtgaaacaga

SEQ ID NO: 129276 - DNA, 23 bp, Homo sapiens
aagaagggggagtgaaacagaga

SEQ ID NO: 129277 - DNA, 23 bp, Homo sapiens
aagaataattgaacaataaagtt

SEQ ID NO: 129278 - DNA, 16 bp, Homo sapiens
aagaattaaaactgag

SEQ ID NO: 129279 - DNA, 18 bp, Homo sapiens
aagaattaaaactgagtc

SEQ ID NO: 129280 - DNA, 16 bp, Homo sapiens
aagaatttaatggact

SEQ ID NO: 129281 - DNA, 14 bp, Homo sapiens
aagacataaaactt

SEQ ID NO: 129282 - DNA, 20 bp, Homo sapiens
aagactgtcaaatgaacttt

SEQ ID NO: 129283 - DNA, 21 bp, Homo sapiens
aagactgtcaaatgaactttt

SEQ ID NO: 129284 - DNA, 21 bp, Homo sapiens
aagacttcactgcagcctttc

SEQ ID NO: 129285 - DNA, 12 bp, Homo sapiens
aagacttgtttt

SEQ ID NO: 129286 - DNA, 17 bp, Homo sapiens
aagagaatgaactgtgg

SEQ ID NO: 129287 - DNA, 20 bp, Homo sapiens
aagagaatgaactgtggaat

SEQ ID NO: 129288 - DNA, 11 bp, Homo sapiens
aagagagtttt

SEQ ID NO: 129289 - DNA, 15 bp, Homo sapiens
aagagtgtaaaatat

SEQ ID NO: 129290 - DNA, 17 bp, Homo sapiens
aagagtgtaaaatattt

SEQ ID NO: 129291 - DNA, 14 bp, Homo sapiens
aagatatatgtgta

SEQ ID NO: 129292 - DNA, 23 bp, Homo sapiens
aagattatatatcataaagtatg

SEQ ID NO: 129293 - DNA, 14 bp, Homo sapiens
aagattttttttgt

SEQ ID NO: 129294 - DNA, 19 bp, Homo sapiens
aagattttttttgtaactt

SEQ ID NO: 129295 - DNA, 13 bp, Homo sapiens
aattaaagaaata

SEQ ID NO: 129296 - DNA, 15 bp, Homo sapiens
aattaactgtaaact

SEQ ID NO: 129297 - DNA, 16 bp, Homo sapiens
aattaagcagaaacag

SEQ ID NO: 129298 - DNA, 19 bp, Homo sapiens
aattagcagaatggagaaa

SEQ ID NO: 129299 - DNA, 20 bp, Homo sapiens
aattagtgagattaaaaatc

SEQ ID NO: 129300 - DNA, 20 bp, Homo sapiens
aattataatctcatttcaat

SEQ ID NO: 129301 - DNA, 12 bp, Homo sapiens
aattattaattg

SEQ ID NO: 129302 - DNA, 19 bp, Homo sapiens
aattatttgcaggtcttta

SEQ ID NO: 129303 - DNA, 18 bp, Homo sapiens
aattcaaagctctattaa

SEQ ID NO: 129304 - DNA, 18 bp, Homo sapiens
aattcaacctgtgtctta

SEQ ID NO: 129305 - DNA, 12 bp, Homo sapiens
aattgaaagtat

SEQ ID NO: 129306 - DNA, 13 bp, Homo sapiens
aattgaaagtatt

SEQ ID NO: 129307 - DNA, 19 bp, Homo sapiens
aattgaaagtattcagaaa

SEQ ID NO: 129308 - DNA, 21 bp, Homo sapiens
aattgaacaataaagtttgct

SEQ ID NO: 129309 - DNA, 21 bp, Homo sapiens
aattgagtttcagaataaaat

SEQ ID NO: 129310 - DNA, 18 bp, Homo sapiens
aattgcacttttaaacct

SEQ ID NO: 129311 - DNA, 15 bp, Homo sapiens
aattgtacattttgt

SEQ ID NO: 129312 - DNA, 19 bp, Homo sapiens
aatttaatggactgtgaat

SEQ ID NO: 129313 - DNA, 21 bp, Homo sapiens
aatttaatggactgtgaattt

SEQ ID NO: 129314 - DNA, 23 bp, Homo sapiens
aatttaatggactgtgaatttca

SEQ ID NO: 129315 - DNA, 21 bp, Homo sapiens
aatttattggcagccaaggaa

SEQ ID NO: 129316 - DNA, 18 bp, Homo sapiens
aatttccttctgttaaga

SEQ ID NO: 129317 - DNA, 22 bp, Homo sapiens
aatttccttctgttaagaaagg

SEQ ID NO: 129318 - DNA, 18 bp, Homo sapiens
aatttctataaatttaag

SEQ ID NO: 129319 - DNA, 18 bp, Homo sapiens
aattttcctttttcatgt

SEQ ID NO: 129320 - DNA, 19 bp, Homo sapiens
aattttgagaaaaatagag

SEQ ID NO: 129321 - DNA, 11 bp, Homo sapiens
aatttttgaaa

SEQ ID NO: 129322 - DNA, 17 bp, Homo sapiens
aatttttgaaaaatatt

SEQ ID NO: 129323 - DNA, 17 bp, Homo sapiens
aattttttaaaagagac

SEQ ID NO: 129324 - DNA, 14 bp, Homo sapiens
acaaaaaatgtaat

SEQ ID NO: 129325 - DNA, 15 bp, Homo sapiens
acaaaaaatgtaatt

SEQ ID NO: 129326 - DNA, 14 bp, Homo sapiens
acaaaaataacact

SEQ ID NO: 129327 - DNA, 16 bp, Homo sapiens
acaaaaataacactgt

SEQ ID NO: 129328 - DNA, 21 bp, Homo sapiens
acaaaaatgtaatgatcataa

SEQ ID NO: 129329 - DNA, 10 bp, Homo sapiens
acaaacaaaa

SEQ ID NO: 129330 - DNA, 18 bp, Homo sapiens
acaaactgtaaaaaatgt

SEQ ID NO: 129331 - DNA, 17 bp, Homo sapiens
acaaagactcctctggg

SEQ ID NO: 129332 - DNA, 15 bp, Homo sapiens
acaacttgctactta

SEQ ID NO: 129333 - DNA, 20 bp, Homo sapiens
acaacttgctacttatcatt

SEQ ID NO: 129334 - DNA, 13 bp, Homo sapiens
acaagtatataat

SEQ ID NO: 129335 - DNA, 17 bp, Homo sapiens
acaagtatataatttac

SEQ ID NO: 129336 - DNA, 12 bp, Homo sapiens
acaagtttgcta

SEQ ID NO: 129337 - DNA, 15 bp, Homo sapiens
acaattagcagaatg

SEQ ID NO: 129338 - DNA, 17 bp, Homo sapiens
acacaatgccaacagct

SEQ ID NO: 129339 - DNA, 18 bp, Homo sapiens
acacacccccaagccaca

SEQ ID NO: 129340 - DNA, 20 bp, Homo sapiens
acacacccccaagccacagg

SEQ ID NO: 129341 - DNA, 22 bp, Homo sapiens
acacaggcttatttttaaaata

SEQ ID NO: 129342 - DNA, 23 bp, Homo sapiens
acacatgctgaggttttgaataa

SEQ ID NO: 129343 - DNA, 12 bp, Homo sapiens
acacattttatg

SEQ ID NO: 129344 - DNA, 16 bp, Homo sapiens
acaccctcctggcaca

SEQ ID NO: 129345 - DNA, 14 bp, Homo sapiens
acacgattttattg

SEQ ID NO: 129346 - DNA, 18 bp, Homo sapiens
acactgttggcacttata

SEQ ID NO: 129347 - DNA, 14 bp, Homo sapiens
acagaagggctctt

SEQ ID NO: 129348 - DNA, 13 bp, Homo sapiens
aaataaaaatatt

SEQ ID NO: 129349 - DNA, 19 bp, Homo sapiens
aaataacactgttggcact

SEQ ID NO: 129350 - DNA, 19 bp, Homo sapiens
aaataacctctggcccttg

SEQ ID NO: 129351 - DNA, 17 bp, Homo sapiens
aaataccattgaaatca

SEQ ID NO: 129352 - DNA, 20 bp, Homo sapiens
aaataccattgaaatcagca

SEQ ID NO: 129353 - DNA, 15 bp, Homo sapiens
aaatagagcaaaatc

SEQ ID NO: 129354 - DNA, 23 bp, Homo sapiens
aaatagagcaaaatcaacatgac

SEQ ID NO: 129355 - DNA, 21 bp, Homo sapiens
aaatagcgtgggatagatttg

SEQ ID NO: 129356 - DNA, 19 bp, Homo sapiens
aaatataaattgtacattt

SEQ ID NO: 129357 - DNA, 23 bp, Homo sapiens
aaatatatgttctgcaagaatta

SEQ ID NO: 129358 - DNA, 17 bp, Homo sapiens
aaatatctgaacattta

SEQ ID NO: 129359 - DNA, 14 bp, Homo sapiens
aaatattgctaaaa

SEQ ID NO: 129360 - DNA, 14 bp, Homo sapiens
aaatattttaagaa

SEQ ID NO: 129361 - DNA, 15 bp, Homo sapiens
aaatattttaagaaa

SEQ ID NO: 129362 - DNA, 17 bp, Homo sapiens
aaatattttaagaaaga

SEQ ID NO: 129363 - DNA, 21 bp, Homo sapiens
aaatcaaaataaaagaaatat

SEQ ID NO: 129364 - DNA, 13 bp, Homo sapiens
aaatcaacatgac

SEQ ID NO: 129365 - DNA, 15 bp, Homo sapiens
aaatcagcatgacaa

SEQ ID NO: 129366 - DNA, 18 bp, Homo sapiens
aaatcattttaggaaagg

SEQ ID NO: 129367 - DNA, 16 bp, Homo sapiens
aaatccaaggaaacat

SEQ ID NO: 129368 - DNA, 13 bp, Homo sapiens
aaatcccaagtgt

SEQ ID NO: 129369 - DNA, 14 bp, Homo sapiens
aaatcctatatctg

SEQ ID NO: 129370 - DNA, 15 bp, Homo sapiens
aaatctagacattct

SEQ ID NO: 129371 - DNA, 17 bp, Homo sapiens
aaatctcaccccatccc

SEQ ID NO: 129372 - DNA, 22 bp, Homo sapiens
aaatctggcaaagttatattta

SEQ ID NO: 129373 - DNA, 15 bp, Homo sapiens
aaatgcaatatttgt

SEQ ID NO: 129374 - DNA, 18 bp, Homo sapiens
aaatgtgtgtattcttaa

SEQ ID NO: 129375 - DNA, 13 bp, Homo sapiens
aaattaaaatatt

SEQ ID NO: 129376 - DNA, 14 bp, Homo sapiens
aaattaaaatatta

SEQ ID NO: 129377 - DNA, 17 bp, Homo sapiens
aaattaaaatattattt

SEQ ID NO: 129378 - DNA, 20 bp, Homo sapiens
aaattaaaatattatttgat

SEQ ID NO: 129379 - DNA, 20 bp, Homo sapiens
aaattaggaacagtaaaatc

SEQ ID NO: 129380 - DNA, 17 bp, Homo sapiens
aaattagtctttttctt

SEQ ID NO: 129381 - DNA, 21 bp, Homo sapiens
aaattattaattgtcctgtgt

SEQ ID NO: 129382 - DNA, 13 bp, Homo sapiens
aaattgaaagtat

SEQ ID NO: 129383 - DNA, 15 bp, Homo sapiens
aaattgaaagtattc

SEQ ID NO: 129384 - DNA, 17 bp, Homo sapiens
aaattgaaagtattcag

SEQ ID NO: 129385 - DNA, 15 bp, Homo sapiens
aaattgtacattttg

SEQ ID NO: 129386 - DNA, 21 bp, Homo sapiens
aaatttctataaatttaagaa

SEQ ID NO: 129387 - DNA, 18 bp, Homo sapiens
aaattttactgacagaaa

SEQ ID NO: 129388 - DNA, 19 bp, Homo sapiens
aaattttactgacagaaat

SEQ ID NO: 129389 - DNA, 15 bp, Homo sapiens
aaatttttgaaaaat

SEQ ID NO: 129390 - DNA, 18 bp, Homo sapiens
aaatttttgaaaaatatt

SEQ ID NO: 129391 - DNA, 15 bp, Homo sapiens
aacaacttgctactt

SEQ ID NO: 129392 - DNA, 16 bp, Homo sapiens
aacaatgtcagaaact

SEQ ID NO: 129393 - DNA, 13 bp, Homo sapiens
aacaccatcatta

SEQ ID NO: 129394 - DNA, 22 bp, Homo sapiens
aacagaaaactcccaatacaaa

SEQ ID NO: 129395 - DNA, 13 bp, Homo sapiens
aacagagaaagaa

SEQ ID NO: 129396 - DNA, 15 bp, Homo sapiens
agaatggagaaagta

SEQ ID NO: 129397 - DNA, 19 bp, Homo sapiens
agaatggagaaagtaagtc

SEQ ID NO: 129398 - DNA, 15 bp, Homo sapiens
agaattaaaactgag

SEQ ID NO: 129399 - DNA, 15 bp, Homo sapiens
agaatttaatggact

SEQ ID NO: 129400 - DNA, 21 bp, Homo sapiens
agacaaactgtaaaaaatgtg

SEQ ID NO: 129401 - DNA, 15 bp, Homo sapiens
agacaattagcagaa

SEQ ID NO: 129402 - DNA, 18 bp, Homo sapiens
agacaattagcagaatgg

SEQ ID NO: 129403 - DNA, 22 bp, Homo sapiens
agacacattgactcctttccaa

SEQ ID NO: 129404 - DNA, 15 bp, Homo sapiens
agacagtcacaaatt

SEQ ID NO: 129405 - DNA, 14 bp, Homo sapiens
agacataaaacttt

SEQ ID NO: 129406 - DNA, 22 bp, Homo sapiens
agacataaaactttaaaaggca

SEQ ID NO: 129407 - DNA, 13 bp, Homo sapiens
agacatttatata

SEQ ID NO: 129408 - DNA, 16 bp, Homo sapiens
agacccacagccctga

SEQ ID NO: 129409 - DNA, 19 bp, Homo sapiens
agacccacagccctgaaac

SEQ ID NO: 129410 - DNA, 18 bp, Homo sapiens
agaccttctccctagccc

SEQ ID NO: 129411 - DNA, 20 bp, Homo sapiens
agaccttctccctagccctt

SEQ ID NO: 129412 - DNA, 21 bp, Homo sapiens
agactcagaggacccacctgg

SEQ ID NO: 129413 - DNA, 12 bp, Homo sapiens
agactcctctgg

SEQ ID NO: 129414 - DNA, 16 bp, Homo sapiens
agactgggcacccctg

SEQ ID NO: 129415 - DNA, 17 bp, Homo sapiens
agactgggcacccctgc

SEQ ID NO: 129416 - DNA, 18 bp, Homo sapiens
agactgggcacccctgcc

SEQ ID NO: 129417 - DNA, 23 bp, Homo sapiens
agactgggcacccctgcctcctg

SEQ ID NO: 129418 - DNA, 18 bp, Homo sapiens
agactggtttgtttgctt

SEQ ID NO: 129419 - DNA, 20 bp, Homo sapiens
agactggtttgtttgcttaa

SEQ ID NO: 129420 - DNA, 21 bp, Homo sapiens
agactgtcaaatgaactttta

SEQ ID NO: 129421 - DNA, 12 bp, Homo sapiens
agagaaagaaaa

SEQ ID NO: 129422 - DNA, 16 bp, Homo sapiens
agagaaagaaaaggca

SEQ ID NO: 129423 - DNA, 20 bp, Homo sapiens
agagaactggaggaaccaca

SEQ ID NO: 129424 - DNA, 15 bp, Homo sapiens
agagaccaggaggga

SEQ ID NO: 129425 - DNA, 15 bp, Homo sapiens
agagcacctgtagct

SEQ ID NO: 129426 - DNA, 14 bp, Homo sapiens
agaggacccacctg

SEQ ID NO: 129427 - DNA, 19 bp, Homo sapiens
agaggggctattgggccct

SEQ ID NO: 129428 - DNA, 20 bp, Homo sapiens
agaggtggccctcccaggct

SEQ ID NO: 129429 - DNA, 18 bp, Homo sapiens
agagtgcattgtgagggt

SEQ ID NO: 129430 - DNA, 19 bp, Homo sapiens
agagtttggaattattgta

SEQ ID NO: 129431 - DNA, 17 bp, Homo sapiens
agagtttttaatagaac

SEQ ID NO: 129432 - DNA, 18 bp, Homo sapiens
agatatatgtgtatacat

SEQ ID NO: 129433 - DNA, 12 bp, Homo sapiens
agatatttttgt

SEQ ID NO: 129434 - DNA, 23 bp, Homo sapiens
agatatttttgtacgttatatat

SEQ ID NO: 129435 - DNA, 21 bp, Homo sapiens
agatcagggatagcgctgttg

SEQ ID NO: 129436 - DNA, 20 bp, Homo sapiens
agatctttttgtgaaattca

SEQ ID NO: 129437 - DNA, 13 bp, Homo sapiens
agatgatggaaac

SEQ ID NO: 129438 - DNA, 20 bp, Homo sapiens
agattgggagacaattagca

SEQ ID NO: 129439 - DNA, 15 bp, Homo sapiens
agattgtattgctgt

SEQ ID NO: 129440 - DNA, 13 bp, Homo sapiens
agcaaaatcaaca

SEQ ID NO: 129441 - DNA, 19 bp, Homo sapiens
agcaaagccacattttgca

SEQ ID NO: 129442 - DNA, 15 bp, Homo sapiens
agcaattatattgtc

SEQ ID NO: 129443 - DNA, 14 bp, Homo sapiens
agcacagcccaggg

SEQ ID NO: 129444 - DNA, 15 bp, Homo sapiens
agcacatctgcattt

SEQ ID NO: 129445 - DNA, 24 bp, Homo sapiens
agcaccagggagaggcctcggctg

SEQ ID NO: 129446 - DNA, 20 bp, Homo sapiens
agcacgttggcgaggaaaaa

SEQ ID NO: 129447 - DNA, 16 bp, Homo sapiens
agcactctaattagag

SEQ ID NO: 129448 - DNA, 17 bp, Homo sapiens
agcactctaattagaga

SEQ ID NO: 129449 - DNA, 21 bp, Homo sapiens
agcacttgcttacatcctctg

SEQ ID NO: 129450 - DNA, 11 bp, Homo sapiens
agcagaaacag

SEQ ID NO: 129451 - DNA, 20 bp, Homo sapiens
agcagaatggagaaagtaag

SEQ ID NO: 129452 - DNA, 13 bp, Homo sapiens
agcaggatgccct

SEQ ID NO: 129453 - DNA, 15 bp, Homo sapiens
agcaggggtctgagc

SEQ ID NO: 129454 - DNA, 20 bp, Homo sapiens
agcatgggaaaaagagactc

SEQ ID NO: 129455 - DNA, 18 bp, Homo sapiens
agcatgtatagttgcttt

SEQ ID NO: 129456 - DNA, 15 bp, Homo sapiens
agccaacttttgcat

SEQ ID NO: 129457 - DNA, 19 bp, Homo sapiens
agccacaccgctggctccg

SEQ ID NO: 129458 - DNA, 13 bp, Homo sapiens
agcccagggcctg

SEQ ID NO: 129459 - DNA, 14 bp, Homo sapiens
agcccagggcctgc

SEQ ID NO: 129460 - DNA, 15 bp, Homo sapiens
agcccagggcctgca

SEQ ID NO: 129461 - DNA, 16 bp, Homo sapiens
aggcccggtgaggcca

SEQ ID NO: 129462 - DNA, 16 bp, Homo sapiens
aggcctcggctgtctc

SEQ ID NO: 129463 - DNA, 20 bp, Homo sapiens
aggcctcggctgtctcctgt

SEQ ID NO: 129464 - DNA, 12 bp, Homo sapiens
aggcctctggcc

SEQ ID NO: 129465 - DNA, 14 bp, Homo sapiens
aggcctctggccct

SEQ ID NO: 129466 - DNA, 16 bp, Homo sapiens
aggctccgtgagccct

SEQ ID NO: 129467 - DNA, 17 bp, Homo sapiens
aggctgcaaaattaaat

SEQ ID NO: 129468 - DNA, 23 bp, Homo sapiens
aggcttaaggagaggagaaactg

SEQ ID NO: 129469 - DNA, 21 bp, Homo sapiens
aggcttgttccaatgccacat

SEQ ID NO: 129470 - DNA, 19 bp, Homo sapiens
agggaagaataaagagctg

SEQ ID NO: 129471 - DNA, 12 bp, Homo sapiens
agggagaggcct

SEQ ID NO: 129472 - DNA, 15 bp, Homo sapiens
agggccgagacagga

SEQ ID NO: 129473 - DNA, 18 bp, Homo sapiens
agggctctttctctctgc

SEQ ID NO: 129474 - DNA, 14 bp, Homo sapiens
aggggaagaattta

SEQ ID NO: 129475 - DNA, 19 bp, Homo sapiens
aggggaggagagagggtct

SEQ ID NO: 129476 - DNA, 16 bp, Homo sapiens
agggggagtgaaacag

SEQ ID NO: 129477 - DNA, 16 bp, Homo sapiens
agggggcacgggcctg

SEQ ID NO: 129478 - DNA, 19 bp, Homo sapiens
aggggtggggcccatgggg

SEQ ID NO: 129479 - DNA, 20 bp, Homo sapiens
agggtcaacatcttttacat

SEQ ID NO: 129480 - DNA, 15 bp, Homo sapiens
aggtaacgtgattga

SEQ ID NO: 129481 - DNA, 22 bp, Homo sapiens
aggtaacgtgattgattcagta

SEQ ID NO: 129482 - DNA, 20 bp, Homo sapiens
aggtaactatcaatatttaa

SEQ ID NO: 129483 - DNA, 22 bp, Homo sapiens
aggtatcaactaggggaggaga

SEQ ID NO: 129484 - DNA, 19 bp, Homo sapiens
aggtcatcccttcctcctc

SEQ ID NO: 129485 - DNA, 12 bp, Homo sapiens
aggtcatgaagg

SEQ ID NO: 129486 - DNA, 17 bp, Homo sapiens
aggtgaacagcaggatg

SEQ ID NO: 129487 - DNA, 21 bp, Homo sapiens
aggtgaagtcgagcactctaa

SEQ ID NO: 129488 - DNA, 14 bp, Homo sapiens
aggtggccctccca

SEQ ID NO: 129489 - DNA, 15 bp, Homo sapiens
aggtggccctcccag

SEQ ID NO: 129490 - DNA, 17 bp, Homo sapiens
aggtgggtgaggctggg

SEQ ID NO: 129491 - DNA, 14 bp, Homo sapiens
aggtgtaaagttgt

SEQ ID NO: 129492 - DNA, 17 bp, Homo sapiens
aggttcgggattccctg

SEQ ID NO: 129493 - DNA, 16 bp, Homo sapiens
aggtttcccagtgagc

SEQ ID NO: 129494 - DNA, 21 bp, Homo sapiens
aggtttcccagtgagcctctg

SEQ ID NO: 129495 - DNA, 16 bp, Homo sapiens
aggttttgaataaaaa

SEQ ID NO: 129496 - DNA, 17 bp, Homo sapiens
aggttttgaataaaaag

SEQ ID NO: 129497 - DNA, 20 bp, Homo sapiens
agttcttgaattgttatgaa

SEQ ID NO: 129498 - DNA, 17 bp, Homo sapiens
agttggaggagactggg

SEQ ID NO: 129499 - DNA, 20 bp, Homo sapiens
agttggaggagactgggcac

SEQ ID NO: 129500 - DNA, 21 bp, Homo sapiens
agttgttcgccgcgtggaatg

SEQ ID NO: 129501 - DNA, 20 bp, Homo sapiens
agtttaattatctgcattta

SEQ ID NO: 129502 - DNA, 16 bp, Homo sapiens
agtttattctgtggtt

SEQ ID NO: 129503 - DNA, 13 bp, Homo sapiens
agtttcagaataa

SEQ ID NO: 129504 - DNA, 22 bp, Homo sapiens
agtttccaaagggcagtaaagt

SEQ ID NO: 129505 - DNA, 21 bp, Homo sapiens
agtttgctaaaagaagagagg

SEQ ID NO: 129506 - DNA, 22 bp, Homo sapiens
agtttgctaaaagaagagaggg

SEQ ID NO: 129507 - DNA, 23 bp, Homo sapiens
agtttgctaaattgagaggggct

SEQ ID NO: 129508 - DNA, 17 bp, Homo sapiens
agtttgtggtaaaaaga

SEQ ID NO: 129509 - DNA, 18 bp, Homo sapiens
agtttgtgttttaaaaaa

SEQ ID NO: 129510 - DNA, 21 bp, Homo sapiens
agttttccttgggagaactaa

SEQ ID NO: 129511 - DNA, 11 bp, Homo sapiens
agttttgatat

SEQ ID NO: 129512 - DNA, 21 bp, Homo sapiens
agttttgatataatcttggct

SEQ ID NO: 129513 - DNA, 23 bp, Homo sapiens
agttttttaattaagcagaaaca

SEQ ID NO: 129514 - DNA, 11 bp, Homo sapiens
ataaaaaggaa

SEQ ID NO: 129515 - DNA, 18 bp, Homo sapiens
ataaaaagtgaacttttg

SEQ ID NO: 129516 - DNA, 19 bp, Homo sapiens
ataaaaatataaattgtac

SEQ ID NO: 129517 - DNA, 18 bp, Homo sapiens
ataaaactttaaaaggca

SEQ ID NO: 129518 - DNA, 20 bp, Homo sapiens
ataaaactttaaaaggcaac

SEQ ID NO: 129519 - DNA, 17 bp, Homo sapiens
ataaaactttgctgcca

SEQ ID NO: 129520 - DNA, 19 bp, Homo sapiens
ataaaaggatgttacaagt

SEQ ID NO: 129521 - DNA, 22 bp, Homo sapiens
ataaaaggatgttacaagtttg

SEQ ID NO: 129522 - DNA, 15 bp, Homo sapiens
ataaaataagaaggg

SEQ ID NO: 129523 - DNA, 23 bp, Homo sapiens
ataaaataagaagggggagtgaa

SEQ ID NO: 129524 - DNA, 14 bp, Homo sapiens
ataaaataatttta

SEQ ID NO: 129525 - DNA, 16 bp, Homo sapiens
ataaaataattttatt

SEQ ID NO: 129526 - DNA, 15 bp, Homo sapiens
ataaaattatttgca

SEQ ID NO: 129527 - DNA, 15 bp, Homo sapiens
ataaagtatgccttc

SEQ ID NO: 129528 - DNA, 13 bp, Homo sapiens
ataaattgtacat

SEQ ID NO: 129529 - DNA, 16 bp, Homo sapiens
ataaattgtacatttt

SEQ ID NO: 129530 - DNA, 11 bp, Homo sapiens
ataacctctgg

SEQ ID NO: 129531 - DNA, 15 bp, Homo sapiens
ataactgaactgttt

SEQ ID NO: 129532 - DNA, 16 bp, Homo sapiens
ataactgaactgtttg

SEQ ID NO: 129533 - DNA, 13 bp, Homo sapiens
ataacttcaaatt

SEQ ID NO: 129534 - DNA, 14 bp, Homo sapiens
ataagaaaagtaat

SEQ ID NO: 129535 - DNA, 22 bp, Homo sapiens
ataagaagggggagtgaaacag

SEQ ID NO: 129536 - DNA, 14 bp, Homo sapiens
ataagtctaaataa

SEQ ID NO: 129537 - DNA, 14 bp, Homo sapiens
ataagttttgatat

SEQ ID NO: 129538 - DNA, 15 bp, Homo sapiens
ataagttttgatata

SEQ ID NO: 129539 - DNA, 14 bp, Homo sapiens
ataataactgaact

SEQ ID NO: 129540 - DNA, 17 bp, Homo sapiens
ataataactgaactgtt

SEQ ID NO: 129541 - DNA, 18 bp, Homo sapiens
ataataactgaactgttt

SEQ ID NO: 129542 - DNA, 13 bp, Homo sapiens
ataataagttttg

SEQ ID NO: 129543 - DNA, 17 bp, Homo sapiens
ataataagttttgatat

SEQ ID NO: 129544 - DNA, 19 bp, Homo sapiens
ataataagttttgatataa

SEQ ID NO: 129545 - DNA, 22 bp, Homo sapiens
ataataagttttgatataatct

SEQ ID NO: 129546 - DNA, 15 bp, Homo sapiens
ataatctatttacat

SEQ ID NO: 129547 - DNA, 20 bp, Homo sapiens
ataatcttggcttcttaaaa

SEQ ID NO: 129548 - DNA, 21 bp, Homo sapiens
ataatcttggcttcttaaaaa

SEQ ID NO: 129549 - DNA, 14 bp, Homo sapiens
ataattatgaaaac

SEQ ID NO: 129550 - DNA, 15 bp, Homo sapiens
ataattatgaaaact

SEQ ID NO: 129551 - DNA, 18 bp, Homo sapiens
ataattgaacaataaagt

SEQ ID NO: 129552 - DNA, 17 bp, Homo sapiens
ataattttaaataacct

SEQ ID NO: 129553 - DNA, 19 bp, Homo sapiens
ataattttcctttttcatg

SEQ ID NO: 129554 - DNA, 20 bp, Homo sapiens
ataattttcctttttcatgt

SEQ ID NO: 129555 - DNA, 14 bp, Homo sapiens
atacaatatatagc

SEQ ID NO: 129556 - DNA, 16 bp, Homo sapiens
atacaatatatagctg

SEQ ID NO: 129557 - DNA, 15 bp, Homo sapiens
atacagaggtaacta

SEQ ID NO: 129558 - DNA, 14 bp, Homo sapiens
ataccattgaaatc

SEQ ID NO: 129559 - DNA, 14 bp, Homo sapiens
atactgtaaaagtt

SEQ ID NO: 129560 - DNA, 20 bp, Homo sapiens
atactgtaaaagttataata

SEQ ID NO: 129561 - DNA, 21 bp, Homo sapiens
atactgtaaaagttataataa

SEQ ID NO: 129562 - DNA, 15 bp, Homo sapiens
atagaaaattaaaat

SEQ ID NO: 129563 - DNA, 20 bp, Homo sapiens
atagagaccaggagggagag

SEQ ID NO: 129564 - DNA, 18 bp, Homo sapiens
atagagcaaaatcaacat

SEQ ID NO: 129565 - DNA, 17 bp, Homo sapiens
acctatggcccagccac

SEQ ID NO: 129566 - DNA, 18 bp, Homo sapiens
acctatggcccagccact

SEQ ID NO: 129567 - DNA, 19 bp, Homo sapiens
acctatggcccagccactg

SEQ ID NO: 129568 - DNA, 17 bp, Homo sapiens
acctcaggaaagaatag

SEQ ID NO: 129569 - DNA, 22 bp, Homo sapiens
acctctgcaagagggggcattg

SEQ ID NO: 129570 - DNA, 12 bp, Homo sapiens
acctctggccct

SEQ ID NO: 129571 - DNA, 14 bp, Homo sapiens
acctctggcccttg

SEQ ID NO: 129572 - DNA, 20 bp, Homo sapiens
acctctggcccttggaataa

SEQ ID NO: 129573 - DNA, 19 bp, Homo sapiens
acctggtactgcacatttt

SEQ ID NO: 129574 - DNA, 14 bp, Homo sapiens
acctgtctcagcct

SEQ ID NO: 129575 - DNA, 16 bp, Homo sapiens
accttcctcagctcag

SEQ ID NO: 129576 - DNA, 18 bp, Homo sapiens
acgctctaccctgcagct

SEQ ID NO: 129577 - DNA, 18 bp, Homo sapiens
acgtgatttccagtgagt

SEQ ID NO: 129578 - DNA, 15 bp, Homo sapiens
acgttatatattgta

SEQ ID NO: 129579 - DNA, 16 bp, Homo sapiens
acgttatatattgtat

SEQ ID NO: 129580 - DNA, 17 bp, Homo sapiens
acgttatatattgtatt

SEQ ID NO: 129581 - DNA, 18 bp, Homo sapiens
acgttggcgaggaaaaac

SEQ ID NO: 129582 - DNA, 22 bp, Homo sapiens
acgttggcgaggaaaaacaaaa

SEQ ID NO: 129583 - DNA, 12 bp, Homo sapiens
actaaacagaaa

SEQ ID NO: 129584 - DNA, 21 bp, Homo sapiens
actaatgttatttcttaaaat

SEQ ID NO: 129585 - DNA, 23 bp, Homo sapiens
actagtgcaattccaagaaaata

SEQ ID NO: 129586 - DNA, 14 bp, Homo sapiens
actatgtaaacaaa

SEQ ID NO: 129587 - DNA, 15 bp, Homo sapiens
actattacttgaact

SEQ ID NO: 129588 - DNA, 19 bp, Homo sapiens
actcagaggacccacctgg

SEQ ID NO: 129589 - DNA, 18 bp, Homo sapiens
actcatgatcaagatata

SEQ ID NO: 129590 - DNA, 16 bp, Homo sapiens
actcccaatacaaaga

SEQ ID NO: 129591 - DNA, 17 bp, Homo sapiens
actccggcctgtaatca

SEQ ID NO: 129592 - DNA, 15 bp, Homo sapiens
actcctctgggcctg

SEQ ID NO: 129593 - DNA, 17 bp, Homo sapiens
actcctctgggcctggg

SEQ ID NO: 129594 - DNA, 23 bp, Homo sapiens
actcctttccaatagaaagaaac

SEQ ID NO: 129595 - DNA, 22 bp, Homo sapiens
actcgcctactaagtacccttg

SEQ ID NO: 129596 - DNA, 13 bp, Homo sapiens
actctaattagag

SEQ ID NO: 129597 - DNA, 15 bp, Homo sapiens
actctaattagagaa

SEQ ID NO: 129598 - DNA, 22 bp, Homo sapiens
atctgcattttcaccccaccct

SEQ ID NO: 129599 - DNA, 23 bp, Homo sapiens
atctgcattttcaccccaccctt

SEQ ID NO: 129600 - DNA, 13 bp, Homo sapiens
atctgtcttttat

SEQ ID NO: 129601 - DNA, 21 bp, Homo sapiens
atctgtcttttatttaacaaa

SEQ ID NO: 129602 - DNA, 15 bp, Homo sapiens
atctgtttgtatatt

SEQ ID NO: 129603 - DNA, 17 bp, Homo sapiens
atctgtttgtatatttg

SEQ ID NO: 129604 - DNA, 18 bp, Homo sapiens
atctgtttgtatatttgc

SEQ ID NO: 129605 - DNA, 19 bp, Homo sapiens
atctgtttgtatatttgca

SEQ ID NO: 129606 - DNA, 17 bp, Homo sapiens
atcttagagtttacagt

SEQ ID NO: 129607 - DNA, 22 bp, Homo sapiens
atcttgcagaagttcttagtgt

SEQ ID NO: 129608 - DNA, 16 bp, Homo sapiens
atcttggcttcttaaa

SEQ ID NO: 129609 - DNA, 21 bp, Homo sapiens
atcttggcttcttaaaaactg

SEQ ID NO: 129610 - DNA, 11 bp, Homo sapiens
atcttttacat

SEQ ID NO: 129611 - DNA, 21 bp, Homo sapiens
atgaaaactcatgatcaagat

SEQ ID NO: 129612 - DNA, 18 bp, Homo sapiens
atgaaaataccataggaa

SEQ ID NO: 129613 - DNA, 20 bp, Homo sapiens
atgaaaataccataggaaga

SEQ ID NO: 129614 - DNA, 23 bp, Homo sapiens
atgaaaataccataggaagacat

SEQ ID NO: 129615 - DNA, 19 bp, Homo sapiens
atgaaaatcctatatctgt

SEQ ID NO: 129616 - DNA, 12 bp, Homo sapiens
atgaactgtgga

SEQ ID NO: 129617 - DNA, 15 bp, Homo sapiens
atgaactgtggaatt

SEQ ID NO: 129618 - DNA, 17 bp, Homo sapiens
atgaactgtggaattta

SEQ ID NO: 129619 - DNA, 19 bp, Homo sapiens
atgaagaatcacgatttca

SEQ ID NO: 129620 - DNA, 15 bp, Homo sapiens
atgaagctggccctc

SEQ ID NO: 129621 - DNA, 14 bp, Homo sapiens
atgacaaaaataac

SEQ ID NO: 129622 - DNA, 15 bp, Homo sapiens
atgacaaaaataaca

SEQ ID NO: 129623 - DNA, 21 bp, Homo sapiens
atgacaaacctagcttttaaa

SEQ ID NO: 129624 - DNA, 13 bp, Homo sapiens
atgagaagaatag

SEQ ID NO: 129625 - DNA, 18 bp, Homo sapiens
atgagtaaactgaggccc

SEQ ID NO: 129626 - DNA, 13 bp, Homo sapiens
atgatcaaaaata

SEQ ID NO: 129627 - DNA, 21 bp, Homo sapiens
atgatggaaacgcacttacaa

SEQ ID NO: 129628 - DNA, 22 bp, Homo sapiens
atgcaagacttcactgcagcct

SEQ ID NO: 129629 - DNA, 23 bp, Homo sapiens
atgcaagacttcactgcagcctt

SEQ ID NO: 129630 - DNA, 19 bp, Homo sapiens
atgcaataaaattatttgc

SEQ ID NO: 129631 - DNA, 22 bp, Homo sapiens
atgcaataaaattatttgcagg

SEQ ID NO: 129632 - DNA, 15 bp, Homo sapiens
atgcaatatttgtaa

SEQ ID NO: 129633 - DNA, 14 bp, Homo sapiens
atgcattaaaaaaa

SEQ ID NO: 129634 - DNA, 21 bp, Homo sapiens
atgcccaccgaggagccccag

SEQ ID NO: 129635 - DNA, 21 bp, Homo sapiens
atgccctgttgggggcttcag

SEQ ID NO: 129636 - DNA, 21 bp, Homo sapiens
atgcctctggaggcctctggc

SEQ ID NO: 129637 - DNA, 15 bp, Homo sapiens
atgctgaggttttga

SEQ ID NO: 129638 - DNA, 18 bp, Homo sapiens
atgctgaggttttgaata

SEQ ID NO: 129639 - DNA, 17 bp, Homo sapiens
atggagacaataaacag

SEQ ID NO: 129640 - DNA, 17 bp, Homo sapiens
atggcatttgcagattt

SEQ ID NO: 129641 - DNA, 15 bp, Homo sapiens
atggcccagccactg

SEQ ID NO: 129642 - DNA, 17 bp, Homo sapiens
atggcccagccactgca

SEQ ID NO: 129643 - DNA, 19 bp, Homo sapiens
atggcttatttgtataatg

SEQ ID NO: 129644 - DNA, 19 bp, Homo sapiens
atgggaggaaggcccaggg

SEQ ID NO: 129645 - DNA, 16 bp, Homo sapiens
atgggcgcaggcccag

SEQ ID NO: 129646 - DNA, 15 bp, Homo sapiens
atgggttctcagtgg

SEQ ID NO: 129647 - DNA, 18 bp, Homo sapiens
atggtctggggtaaaatt

SEQ ID NO: 129648 - DNA, 23 bp, Homo sapiens
atggtggcttcttttctttgtat

SEQ ID NO: 129649 - DNA, 12 bp, Homo sapiens
atgtaaacaaaa

SEQ ID NO: 129650 - DNA, 23 bp, Homo sapiens
atgtaagtttaattatctgcatt

SEQ ID NO: 129651 - DNA, 17 bp, Homo sapiens
atgtactgtacttccca

SEQ ID NO: 129652 - DNA, 13 bp, Homo sapiens
atgtatatctata

SEQ ID NO: 129653 - DNA, 19 bp, Homo sapiens
atgtattttcctaatgtga

SEQ ID NO: 129654 - DNA, 21 bp, Homo sapiens
atgtcagaaactcgatgaatg

SEQ ID NO: 129655 - DNA, 14 bp, Homo sapiens
atgtgcccctgcca

SEQ ID NO: 129656 - DNA, 15 bp, Homo sapiens
atgtgtatacataca

SEQ ID NO: 129657 - DNA, 14 bp, Homo sapiens
atgtgtccaagaca

SEQ ID NO: 129658 - DNA, 16 bp, Homo sapiens
atgtgtccaagacaca

SEQ ID NO: 129659 - DNA, 15 bp, Homo sapiens
atgttacaagtttgc

SEQ ID NO: 129660 - DNA, 16 bp, Homo sapiens
atgttacaagtttgct

SEQ ID NO: 129661 - DNA, 17 bp, Homo sapiens
atgttacaagtttgcta

SEQ ID NO: 129662 - DNA, 18 bp, Homo sapiens
atgttacaagtttgctaa

SEQ ID NO: 129663 - DNA, 15 bp, Homo sapiens
atgttctgcaagaat

SEQ ID NO: 129664 - DNA, 18 bp, Homo sapiens
atgttggttgcactttgt

SEQ ID NO: 129665 - DNA, 16 bp, Homo sapiens
atgtttaatagaaaat

SEQ ID NO: 129666 - DNA, 12 bp, Homo sapiens
attaaaactgag

SEQ ID NO: 129667 - DNA, 17 bp, Homo sapiens
attaaaactgagtccat

SEQ ID NO: 129668 - DNA, 21 bp, Homo sapiens
attaaaatatatgttctgcaa

SEQ ID NO: 129669 - DNA, 19 bp, Homo sapiens
atgctgctaattcaaagct

SEQ ID NO: 129670 - DNA, 23 bp, Homo sapiens
atgctggcatttgcacctacctc

SEQ ID NO: 129671 - DNA, 13 bp, Homo sapiens
atggcatttgcag

SEQ ID NO: 129672 - DNA, 14 bp, Homo sapiens
atggcatttgcaga

SEQ ID NO: 129673 - DNA, 19 bp, Homo sapiens
atggcccagccactgcagc

SEQ ID NO: 129674 - DNA, 19 bp, Homo sapiens
atggcctgcagccacatgg

SEQ ID NO: 129675 - DNA, 21 bp, Homo sapiens
atggcctgcagccacatggga

SEQ ID NO: 129676 - DNA, 13 bp, Homo sapiens
atggcttaggaat

SEQ ID NO: 129677 - DNA, 19 bp, Homo sapiens
atggtctggggtaaaattg

SEQ ID NO: 129678 - DNA, 21 bp, Homo sapiens
atgtaaacaaaaaagcttttg

SEQ ID NO: 129679 - DNA, 13 bp, Homo sapiens
atgtaagtttaat

SEQ ID NO: 129680 - DNA, 20 bp, Homo sapiens
atgtacctctagctgttctt

SEQ ID NO: 129681 - DNA, 15 bp, Homo sapiens
atgtatatctatatc

SEQ ID NO: 129682 - DNA, 19 bp, Homo sapiens
atgtgcacctatggcccag

SEQ ID NO: 129683 - DNA, 12 bp, Homo sapiens
atgtgcccctgc

SEQ ID NO: 129684 - DNA, 13 bp, Homo sapiens
atgtgcccctgcc

SEQ ID NO: 129685 - DNA, 17 bp, Homo sapiens
atgtgcccctgccaagg

SEQ ID NO: 129686 - DNA, 19 bp, Homo sapiens
atgttacaagtttgctaaa

SEQ ID NO: 129687 - DNA, 21 bp, Homo sapiens
atgttacaagtttgctaaaag

SEQ ID NO: 129688 - DNA, 23 bp, Homo sapiens
atgttacaagtttgctaaaagaa

SEQ ID NO: 129689 - DNA, 20 bp, Homo sapiens
atgttctgcaagaattaaaa

SEQ ID NO: 129690 - DNA, 21 bp, Homo sapiens
atgttctgcaagaattaaaac

SEQ ID NO: 129691 - DNA, 19 bp, Homo sapiens
attaaaaaaaaaaaaaaac

SEQ ID NO: 129692 - DNA, 21 bp, Homo sapiens
attaaaaaaaaaaaaaaactc

SEQ ID NO: 129693 - DNA, 15 bp, Homo sapiens
attaaaaatctaaaa

SEQ ID NO: 129694 - DNA, 21 bp, Homo sapiens
attaaaactgagtccatgaaa

SEQ ID NO: 129695 - DNA, 15 bp, Homo sapiens
attaaaatatatgtt

SEQ ID NO: 129696 - DNA, 16 bp, Homo sapiens
attaaaatatatgttc

SEQ ID NO: 129697 - DNA, 17 bp, Homo sapiens
attaaaatatatgttct

SEQ ID NO: 129698 - DNA, 16 bp, Homo sapiens
attaaatctagacatt

SEQ ID NO: 129699 - DNA, 20 bp, Homo sapiens
agtgtttggtgctcatttaa

SEQ ID NO: 129700 - DNA, 16 bp, Homo sapiens
agttataataactgaa

SEQ ID NO: 129701 - DNA, 21 bp, Homo sapiens
agttataataactgaactgtt

SEQ ID NO: 129702 - DNA, 13 bp, Homo sapiens
agttcttaaaatt

SEQ ID NO: 129703 - DNA, 15 bp, Homo sapiens
agttcttgaattgtt

SEQ ID NO: 129704 - DNA, 19 bp, Homo sapiens
agttcttgaattgttatga

SEQ ID NO: 129705 - DNA, 14 bp, Homo sapiens
agtttacagtttgt

SEQ ID NO: 129706 - DNA, 12 bp, Homo sapiens
agtttattctgt

SEQ ID NO: 129707 - DNA, 13 bp, Homo sapiens
agtttattctgtg

SEQ ID NO: 129708 - DNA, 15 bp, Homo sapiens
agtttattctgtggt

SEQ ID NO: 129709 - DNA, 17 bp, Homo sapiens
agtttattctgtggttc

SEQ ID NO: 129710 - DNA, 17 bp, Homo sapiens
agtttcagaataaaatt

SEQ ID NO: 129711 - DNA, 19 bp, Homo sapiens
agtttcagaataaaattag

SEQ ID NO: 129712 - DNA, 11 bp, Homo sapiens
agtttgctaaa

SEQ ID NO: 129713 - DNA, 17 bp, Homo sapiens
agtttgctaaaagaaga

SEQ ID NO: 129714 - DNA, 22 bp, Homo sapiens
agtttgctaaattgagaggggc

SEQ ID NO: 129715 - DNA, 17 bp, Homo sapiens
agtttgtgttttaaaaa

SEQ ID NO: 129716 - DNA, 21 bp, Homo sapiens
agtttgtgttttaaaaaaact

SEQ ID NO: 129717 - DNA, 18 bp, Homo sapiens
agtttttctaatactaat

SEQ ID NO: 129718 - DNA, 15 bp, Homo sapiens
ataaaaagtgaactt

SEQ ID NO: 129719 - DNA, 20 bp, Homo sapiens
ataaaaagtgaacttttgta

SEQ ID NO: 129720 - DNA, 19 bp, Homo sapiens
ataaaactttaaaaggcaa

SEQ ID NO: 129721 - DNA, 15 bp, Homo sapiens
ataaaataatgcttt

SEQ ID NO: 129722 - DNA, 14 bp, Homo sapiens
ataaaggtatttag

SEQ ID NO: 129723 - DNA, 18 bp, Homo sapiens
ataaagtttgctttcaga

SEQ ID NO: 129724 - DNA, 14 bp, Homo sapiens
ataaattgtacatt

SEQ ID NO: 129725 - DNA, 18 bp, Homo sapiens
ataaattgtacattttgt

SEQ ID NO: 129726 - DNA, 19 bp, Homo sapiens
ataaatttaagaaaacaag

SEQ ID NO: 129727 - DNA, 13 bp, Homo sapiens
ataactgaactgt

SEQ ID NO: 129728 - DNA, 16 bp, Homo sapiens
ataacttcaaattttt

SEQ ID NO: 129729 - DNA, 19 bp, Homo sapiens
ataagaagggggagtgaaa

SEQ ID NO: 129730 - DNA, 24 bp, Homo sapiens
ataagaagggggagtgaaacagag

SEQ ID NO: 129731 - DNA, 19 bp, Homo sapiens
ataagttttgatataatct

SEQ ID NO: 129732 - DNA, 20 bp, Homo sapiens
ataataactgaactgtttgg

SEQ ID NO: 129733 - DNA, 14 bp, Homo sapiens
ataataagttttga

SEQ ID NO: 129734 - DNA, 14 bp, Homo sapiens
ataatctatttaca

SEQ ID NO: 129735 - DNA, 18 bp, Homo sapiens
ataatcttggcttcttaa

SEQ ID NO: 129736 - DNA, 19 bp, Homo sapiens
ataatcttggcttcttaaa

SEQ ID NO: 129737 - DNA, 22 bp, Homo sapiens
ataatcttggcttcttaaaaac

SEQ ID NO: 129738 - DNA, 21 bp, Homo sapiens
ataatggtgttactaaagtca

SEQ ID NO: 129739 - DNA, 13 bp, Homo sapiens
ataattatgaaaa

SEQ ID NO: 129740 - DNA, 19 bp, Homo sapiens
ataattgaacaataaagtt

SEQ ID NO: 129741 - DNA, 13 bp, Homo sapiens
ataattgttgata

SEQ ID NO: 129742 - DNA, 16 bp, Homo sapiens
ataattgttgatattt

SEQ ID NO: 129743 - DNA, 17 bp, Homo sapiens
atacaaagatgactggt

SEQ ID NO: 129744 - DNA, 23 bp, Homo sapiens
atacaatccgagctacaaagcat

SEQ ID NO: 129745 - DNA, 18 bp, Homo sapiens
atacagaggtaactatca

SEQ ID NO: 129746 - DNA, 18 bp, Homo sapiens
ataccagcttagatttta

SEQ ID NO: 129747 - DNA, 21 bp, Homo sapiens
atacctcaggaaagaatagaa

SEQ ID NO: 129748 - DNA, 21 bp, Homo sapiens
atactaatgttatttcttaaa

SEQ ID NO: 129749 - DNA, 23 bp, Homo sapiens
atactgtaaaagttataataact

SEQ ID NO: 129750 - DNA, 22 bp, Homo sapiens
atacttaacatttcattgtaca

SEQ ID NO: 129751 - DNA, 23 bp, Homo sapiens
atagaaagaaactaaacagaaaa

SEQ ID NO: 129752 - DNA, 13 bp, Homo sapiens
atagagcaaaatc

SEQ ID NO: 129753 - DNA, 19 bp, Homo sapiens
atagctgtttcaaatgtgc

SEQ ID NO: 129754 - DNA, 20 bp, Homo sapiens
atagctgtttcaaatgtgca

SEQ ID NO: 129755 - DNA, 15 bp, Homo sapiens
ataggaagacataaa

SEQ ID NO: 129756 - DNA, 20 bp, Homo sapiens
ataggaagacataaaacttt

SEQ ID NO: 129757 - DNA, 13 bp, Homo sapiens
ataggtaacgtga

SEQ ID NO: 129758 - DNA, 16 bp, Homo sapiens
atagttcttaaaatta

SEQ ID NO: 129759 - DNA, 12 bp, Homo sapiens
atagttgctttt

SEQ ID NO: 129760 - DNA, 21 bp, Homo sapiens
atagttgcttttgaaggaata

SEQ ID NO: 129761 - DNA, 19 bp, Homo sapiens
atataaaagatcttgcaga

SEQ ID NO: 129762 - DNA, 12 bp, Homo sapiens
atataaattgta

SEQ ID NO: 129763 - DNA, 19 bp, Homo sapiens
atataaattgtacattttg

SEQ ID NO: 129764 - DNA, 11 bp, Homo sapiens
atataagaaaa

SEQ ID NO: 129765 - DNA, 21 bp, Homo sapiens
atataagaaaagtaatgaaga

SEQ ID NO: 129766 - DNA, 20 bp, Homo sapiens
atataatcttggcttcttaa

SEQ ID NO: 129767 - DNA, 23 bp, Homo sapiens
atataatcttggcttcttaaaaa

SEQ ID NO: 129768 - DNA, 18 bp, Homo sapiens
atataatttactttgtag

SEQ ID NO: 129769 - DNA, 17 bp, Homo sapiens
atataggataaaataat

SEQ ID NO: 129770 - DNA, 15 bp, Homo sapiens
atatatggcatttgc

SEQ ID NO: 129771 - DNA, 17 bp, Homo sapiens
atatatggcatttgcag

SEQ ID NO: 129772 - DNA, 12 bp, Homo sapiens
atatatgtatat

SEQ ID NO: 129773 - DNA, 23 bp, Homo sapiens
atatatgtatatgtatatctata

SEQ ID NO: 129774 - DNA, 15 bp, Homo sapiens
atatatgtgtataca

SEQ ID NO: 129775 - DNA, 15 bp, Homo sapiens
atatatgttctgcaa

SEQ ID NO: 129776 - DNA, 20 bp, Homo sapiens
atatatgttctgcaagaatt

SEQ ID NO: 129777 - DNA, 15 bp, Homo sapiens
atatcactaaataaa

SEQ ID NO: 129778 - DNA, 12 bp, Homo sapiens
atatcataaagt

SEQ ID NO: 129779 - DNA, 19 bp, Homo sapiens
atatctgagaagtgtatat

SEQ ID NO: 129780 - DNA, 13 bp, Homo sapiens
atatgagaagaat

SEQ ID NO: 129781 - DNA, 15 bp, Homo sapiens
atatgagaagaatag

SEQ ID NO: 129782 - DNA, 20 bp, Homo sapiens
atatgtgtatacatacatgt

SEQ ID NO: 129783 - DNA, 23 bp, Homo sapiens
atatgttctgcaagaattaaaac

SEQ ID NO: 129784 - DNA, 22 bp, Homo sapiens
atattagtttgatttaatatct

SEQ ID NO: 129785 - DNA, 13 bp, Homo sapiens
atattatttgata

SEQ ID NO: 129786 - DNA, 14 bp, Homo sapiens
atattatttgatat

SEQ ID NO: 129787 - DNA, 15 bp, Homo sapiens
atattccaaggaaaa

SEQ ID NO: 129788 - DNA, 19 bp, Homo sapiens
atattccaaggaaaattga

SEQ ID NO: 129789 - DNA, 20 bp, Homo sapiens
atattccaaggaaaattgaa

SEQ ID NO: 129790 - DNA, 22 bp, Homo sapiens
atattctacacatatatgtata

SEQ ID NO: 129791 - DNA, 11 bp, Homo sapiens
atattgctaaa

SEQ ID NO: 129792 - DNA, 16 bp, Homo sapiens
atattgctaaaagtgc

SEQ ID NO: 129793 - DNA, 22 bp, Homo sapiens
atattgtcagagttctgctcta

SEQ ID NO: 129794 - DNA, 15 bp, Homo sapiens
atatttaagtttgtt

SEQ ID NO: 129795 - DNA, 13 bp, Homo sapiens
atatttactttaa

SEQ ID NO: 129796 - DNA, 14 bp, Homo sapiens
atatttactttaaa

SEQ ID NO: 129797 - DNA, 15 bp, Homo sapiens
atatttctgatataa

SEQ ID NO: 129798 - DNA, 11 bp, Homo sapiens
atatttgcaaa

SEQ ID NO: 129799 - DNA, 21 bp, Homo sapiens
atatttgcaaaccctttgtat

SEQ ID NO: 129800 - DNA, 20 bp, Homo sapiens
catcctcctcagcccccagg

SEQ ID NO: 129801 - DNA, 21 bp, Homo sapiens
catcctctgatagctgtttca

SEQ ID NO: 129802 - DNA, 12 bp, Homo sapiens
catctctccctc

SEQ ID NO: 129803 - DNA, 15 bp, Homo sapiens
catctctccctcccc

SEQ ID NO: 129804 - DNA, 20 bp, Homo sapiens
catctctccctcccctgcca

SEQ ID NO: 129805 - DNA, 23 bp, Homo sapiens
catgaagctggccctcagctccc

SEQ ID NO: 129806 - DNA, 16 bp, Homo sapiens
catgaaggacactctg

SEQ ID NO: 129807 - DNA, 17 bp, Homo sapiens
catgaaggacactctgc

SEQ ID NO: 129808 - DNA, 19 bp, Homo sapiens
catgacaaaaataacactg

SEQ ID NO: 129809 - DNA, 23 bp, Homo sapiens
catgacaaaaataacactgttgg

SEQ ID NO: 129810 - DNA, 14 bp, Homo sapiens
catgacaaacctag

SEQ ID NO: 129811 - DNA, 16 bp, Homo sapiens
catgacaaacctagct

SEQ ID NO: 129812 - DNA, 20 bp, Homo sapiens
catgagcccaaacaccctcc

SEQ ID NO: 129813 - DNA, 14 bp, Homo sapiens
catgatcaagatat

SEQ ID NO: 129814 - DNA, 16 bp, Homo sapiens
catgcctctggaggcc

SEQ ID NO: 129815 - DNA, 19 bp, Homo sapiens
catgctatcagaaacagta

SEQ ID NO: 129816 - DNA, 18 bp, Homo sapiens
catgctgaggttttgaat

SEQ ID NO: 129817 - DNA, 21 bp, Homo sapiens
catgctgaggttttgaataaa

SEQ ID NO: 129818 - DNA, 21 bp, Homo sapiens
catgggaggaaggcccagggg

SEQ ID NO: 129819 - DNA, 19 bp, Homo sapiens
catgtgcacctatggccca

SEQ ID NO: 129820 - DNA, 15 bp, Homo sapiens
catgtgcccctgcca

SEQ ID NO: 129821 - DNA, 17 bp, Homo sapiens
catgtgcccctgccaag

SEQ ID NO: 129822 - DNA, 21 bp, Homo sapiens
cattaaaatatatgttctgca

SEQ ID NO: 129823 - DNA, 13 bp, Homo sapiens
cattaagaataat

SEQ ID NO: 129824 - DNA, 18 bp, Homo sapiens
cattgactcctttccaat

SEQ ID NO: 129825 - DNA, 23 bp, Homo sapiens
cattgactcctttccaatagaaa

SEQ ID NO: 129826 - DNA, 14 bp, Homo sapiens
cattgtacaagtat

SEQ ID NO: 129827 - DNA, 13 bp, Homo sapiens
catttaaggagat

SEQ ID NO: 129828 - DNA, 14 bp, Homo sapiens
catttcaatttata

SEQ ID NO: 129829 - DNA, 10 bp, Homo sapiens
catttcatgc

SEQ ID NO: 129830 - DNA, 18 bp, Homo sapiens
catttctgtatactgtaa

SEQ ID NO: 129831 - DNA, 22 bp, Homo sapiens
cattttaaaagcaattatattg

SEQ ID NO: 129832 - DNA, 19 bp, Homo sapiens
cattttattgtcagaattt

SEQ ID NO: 129833 - DNA, 16 bp, Homo sapiens
cattttcaccccaccc

SEQ ID NO: 129834 - DNA, 13 bp, Homo sapiens
cattttgtaaaat

SEQ ID NO: 129835 - DNA, 23 bp, Homo sapiens
cattttgtacaaagatatgctaa

SEQ ID NO: 129836 - DNA, 19 bp, Homo sapiens
cattttgtggaattttgag

SEQ ID NO: 129837 - DNA, 12 bp, Homo sapiens
catttttgtata

SEQ ID NO: 129838 - DNA, 13 bp, Homo sapiens
catttttgtataa

SEQ ID NO: 129839 - DNA, 22 bp, Homo sapiens
catttttgtataaaaaggaaat

SEQ ID NO: 129840 - DNA, 12 bp, Homo sapiens
ccaaaattttta

SEQ ID NO: 129841 - DNA, 14 bp, Homo sapiens
ccaaaccagtttat

SEQ ID NO: 129842 - DNA, 13 bp, Homo sapiens
ccaaatcaaaata

SEQ ID NO: 129843 - DNA, 17 bp, Homo sapiens
ccaaattattaattgtc

SEQ ID NO: 129844 - DNA, 23 bp, Homo sapiens
ccaactacacacccccaagccac

SEQ ID NO: 129845 - DNA, 13 bp, Homo sapiens
ccaagaaaatatc

SEQ ID NO: 129846 - DNA, 14 bp, Homo sapiens
ccaagacacatgct

SEQ ID NO: 129847 - DNA, 21 bp, Homo sapiens
ccaaggaatgtgtccaagaca

SEQ ID NO: 129848 - DNA, 16 bp, Homo sapiens
ccaaggccggagaccc

SEQ ID NO: 129849 - DNA, 21 bp, Homo sapiens
ccaaggccggagacccacagc

SEQ ID NO: 129850 - DNA, 23 bp, Homo sapiens
ccaaggtttcccagtgagcctct

SEQ ID NO: 129851 - DNA, 16 bp, Homo sapiens
ccaagtgtctcttgac

SEQ ID NO: 129852 - DNA, 22 bp, Homo sapiens
ccaatccagagaagcgctgttg

SEQ ID NO: 129853 - DNA, 23 bp, Homo sapiens
ccaatccaggcccggtgaggcca

SEQ ID NO: 129854 - DNA, 12 bp, Homo sapiens
ccacacatttta

SEQ ID NO: 129855 - DNA, 14 bp, Homo sapiens
ccacatataacact

SEQ ID NO: 129856 - DNA, 17 bp, Homo sapiens
ccaccaagacttgtttt

SEQ ID NO: 129857 - DNA, 16 bp, Homo sapiens
ccaccatggccagcca

SEQ ID NO: 129858 - DNA, 17 bp, Homo sapiens
ccaccatggccagccaa

SEQ ID NO: 129859 - DNA, 14 bp, Homo sapiens
ccacccaaggagaa

SEQ ID NO: 129860 - DNA, 12 bp, Homo sapiens
ccaccgaggagc

SEQ ID NO: 129861 - DNA, 17 bp, Homo sapiens
ccaccgaggagccccag

SEQ ID NO: 129862 - DNA, 23 bp, Homo sapiens
ccaccgaggagccccagccccgt

SEQ ID NO: 129863 - DNA, 13 bp, Homo sapiens
ccaccggcccctg

SEQ ID NO: 129864 - DNA, 17 bp, Homo sapiens
ccactaagtacagctga

SEQ ID NO: 129865 - DNA, 11 bp, Homo sapiens
ccactcctctt

SEQ ID NO: 129866 - DNA, 14 bp, Homo sapiens
ccactcctcttcac

SEQ ID NO: 129867 - DNA, 15 bp, Homo sapiens
ccactgacagcctcc

SEQ ID NO: 129868 - DNA, 19 bp, Homo sapiens
ccactgacagcctcccacc

SEQ ID NO: 129869 - DNA, 16 bp, Homo sapiens
ccactgtttcatgagc

SEQ ID NO: 129870 - DNA, 18 bp, Homo sapiens
ccactgtttcatgagccc

SEQ ID NO: 129871 - DNA, 20 bp, Homo sapiens
ccactgtttcatgagcccaa

SEQ ID NO: 129872 - DNA, 19 bp, Homo sapiens
ccacttcatgcccactgcc

SEQ ID NO: 129873 - DNA, 16 bp, Homo sapiens
ccacttttattcattt

SEQ ID NO: 129874 - DNA, 17 bp, Homo sapiens
ccagaagaagatggctg

SEQ ID NO: 129875 - DNA, 23 bp, Homo sapiens
ccagagatgactattacttttct

SEQ ID NO: 129876 - DNA, 15 bp, Homo sapiens
ccagaggccgctgcc

SEQ ID NO: 129877 - DNA, 16 bp, Homo sapiens
ccagaggccgctgccc

SEQ ID NO: 129878 - DNA, 20 bp, Homo sapiens
cacattttgtacaaagatat

SEQ ID NO: 129879 - DNA, 22 bp, Homo sapiens
caccaagacttgttttatgctc

SEQ ID NO: 129880 - DNA, 15 bp, Homo sapiens
caccagggagaggcc

SEQ ID NO: 129881 - DNA, 21 bp, Homo sapiens
caccagggagaggcctcggct

SEQ ID NO: 129882 - DNA, 13 bp, Homo sapiens
caccagtgcctca

SEQ ID NO: 129883 - DNA, 17 bp, Homo sapiens
caccagtgcctcagtgc

SEQ ID NO: 129884 - DNA, 19 bp, Homo sapiens
caccagtgcctcagtgctg

SEQ ID NO: 129885 - DNA, 20 bp, Homo sapiens
caccagtgcctcagtgctgc

SEQ ID NO: 129886 - DNA, 13 bp, Homo sapiens
cacccaaggagaa

SEQ ID NO: 129887 - DNA, 21 bp, Homo sapiens
cacccagaagaagatggctgt

SEQ ID NO: 129888 - DNA, 17 bp, Homo sapiens
cacccagaggtggccct

SEQ ID NO: 129889 - DNA, 23 bp, Homo sapiens
caccccacagactccggcctgta

SEQ ID NO: 129890 - DNA, 17 bp, Homo sapiens
caccccagcccccacag

SEQ ID NO: 129891 - DNA, 22 bp, Homo sapiens
caccccagcccccacagccctg

SEQ ID NO: 129892 - DNA, 12 bp, Homo sapiens
cacccccaagcc

SEQ ID NO: 129893 - DNA, 23 bp, Homo sapiens
cacccccacttcatgcccactgc

SEQ ID NO: 129894 - DNA, 13 bp, Homo sapiens
cacccctgcctcc

SEQ ID NO: 129895 - DNA, 14 bp, Homo sapiens
cacccctgcctcct

SEQ ID NO: 129896 - DNA, 18 bp, Homo sapiens
cacccctgcctcctgcct

SEQ ID NO: 129897 - DNA, 17 bp, Homo sapiens
cacccgccccgccccct

SEQ ID NO: 129898 - DNA, 15 bp, Homo sapiens
caccctcctggcaca

SEQ ID NO: 129899 - DNA, 13 bp, Homo sapiens
cacccttcccctc

SEQ ID NO: 129900 - DNA, 22 bp, Homo sapiens
cacccttcccctccttctccct

SEQ ID NO: 129901 - DNA, 22 bp, Homo sapiens
ccatcaaaggaatataagaaaa

SEQ ID NO: 129902 - DNA, 12 bp, Homo sapiens
ccatcccacacc

SEQ ID NO: 129903 - DNA, 17 bp, Homo sapiens
ccatctctccctcccct

SEQ ID NO: 129904 - DNA, 23 bp, Homo sapiens
ccatgaaaataccataggaagac

SEQ ID NO: 129905 - DNA, 21 bp, Homo sapiens
ccatgaagctggccctcagct

SEQ ID NO: 129906 - DNA, 22 bp, Homo sapiens
ccatgaagctggccctcagctc

SEQ ID NO: 129907 - DNA, 22 bp, Homo sapiens
ccatgttggttgcactttgtag

SEQ ID NO: 129908 - DNA, 18 bp, Homo sapiens
cccaaatcaaaataaaag

SEQ ID NO: 129909 - DNA, 12 bp, Homo sapiens
cccaagccacag

SEQ ID NO: 129910 - DNA, 13 bp, Homo sapiens
cccaaggaggtgg

SEQ ID NO: 129911 - DNA, 16 bp, Homo sapiens
cccaatacaaagatga

SEQ ID NO: 129912 - DNA, 15 bp, Homo sapiens
cccaatccagagaag

SEQ ID NO: 129913 - DNA, 20 bp, Homo sapiens
cccacagactccggcctgta

SEQ ID NO: 129914 - DNA, 11 bp, Homo sapiens
cccacagccct

SEQ ID NO: 129915 - DNA, 16 bp, Homo sapiens
cccacagccctgaaac

SEQ ID NO: 129916 - DNA, 14 bp, Homo sapiens
cccaccgaggagcc

SEQ ID NO: 129917 - DNA, 15 bp, Homo sapiens
cccaccgaggagccc

SEQ ID NO: 129918 - DNA, 20 bp, Homo sapiens
cccaccgaggagccccagcc

SEQ ID NO: 129919 - DNA, 13 bp, Homo sapiens
cccacctgacctc

SEQ ID NO: 129920 - DNA, 17 bp, Homo sapiens
cccacctgggccaagga

SEQ ID NO: 129921 - DNA, 20 bp, Homo sapiens
cccacctgggccaaggactc

SEQ ID NO: 129922 - DNA, 19 bp, Homo sapiens
cccacttcatgcccactgc

SEQ ID NO: 129923 - DNA, 21 bp, Homo sapiens
cccacttcatgcccactgccg

SEQ ID NO: 129924 - DNA, 13 bp, Homo sapiens
cccagaggtggcc

SEQ ID NO: 129925 - DNA, 21 bp, Homo sapiens
cccagaggtggccctcccagg

SEQ ID NO: 129926 - DNA, 12 bp, Homo sapiens
cccagccactgc

SEQ ID NO: 129927 - DNA, 19 bp, Homo sapiens
cccagccccaatccagaga

SEQ ID NO: 129928 - DNA, 21 bp, Homo sapiens
cccagcccccacagccctgga

SEQ ID NO: 129929 - DNA, 18 bp, Homo sapiens
cccagccccgtcccagag

SEQ ID NO: 129930 - DNA, 22 bp, Homo sapiens
cccagcctgctcagcaggttga

SEQ ID NO: 129931 - DNA, 18 bp, Homo sapiens
cccagctctctctcctgg

SEQ ID NO: 129932 - DNA, 16 bp, Homo sapiens
cccaggctggtctcaa

SEQ ID NO: 129933 - DNA, 17 bp, Homo sapiens
cccaggggtggggccca

SEQ ID NO: 129934 - DNA, 15 bp, Homo sapiens
cccagtgagcctctg

SEQ ID NO: 129935 - DNA, 17 bp, Homo sapiens
cccagtgagcctctgcg

SEQ ID NO: 129936 - DNA, 21 bp, Homo sapiens
cccagttggaggagactgggc

SEQ ID NO: 129937 - DNA, 23 bp, Homo sapiens
cccagttggaggagactgggcac

SEQ ID NO: 129938 - DNA, 15 bp, Homo sapiens
cccatcccacaccct

SEQ ID NO: 129939 - DNA, 23 bp, Homo sapiens
cccatctctccctcccctgccat

SEQ ID NO: 129940 - DNA, 17 bp, Homo sapiens
cccatgaagctggccct

SEQ ID NO: 129941 - DNA, 18 bp, Homo sapiens
cccatgaagctggccctc

SEQ ID NO: 129942 - DNA, 21 bp, Homo sapiens
cccatgaagctggccctcagc

SEQ ID NO: 129943 - DNA, 22 bp, Homo sapiens
cccatgaagctggccctcagct

SEQ ID NO: 129944 - DNA, 19 bp, Homo sapiens
cccatggagacaataaaca

SEQ ID NO: 129945 - DNA, 20 bp, Homo sapiens
cccatggagacaataaacag

SEQ ID NO: 129946 - DNA, 20 bp, Homo sapiens
cccatttttatatcgatctc

SEQ ID NO: 129947 - DNA, 13 bp, Homo sapiens
ccccaagccacag

SEQ ID NO: 129948 - DNA, 13 bp, Homo sapiens
ccccagcccccac

SEQ ID NO: 129949 - DNA, 21 bp, Homo sapiens
ccccagccccgtcccagaggc

SEQ ID NO: 129950 - DNA, 19 bp, Homo sapiens
ccccatctctccctcccct

SEQ ID NO: 129951 - DNA, 14 bp, Homo sapiens
cccccaagccacag

SEQ ID NO: 129952 - DNA, 12 bp, Homo sapiens
cccccaggccag

SEQ ID NO: 129953 - DNA, 13 bp, Homo sapiens
ccccctagagact

SEQ ID NO: 129954 - DNA, 15 bp, Homo sapiens
ccccctccctgctcc

SEQ ID NO: 129955 - DNA, 14 bp, Homo sapiens
ccccgccccctgaa

SEQ ID NO: 129956 - DNA, 15 bp, Homo sapiens
ccccgccccctgaaa

SEQ ID NO: 129957 - DNA, 20 bp, Homo sapiens
ccccggcggggtgcctgctg

SEQ ID NO: 129958 - DNA, 21 bp, Homo sapiens
ccccgtcccagaggccgctgc

SEQ ID NO: 129959 - DNA, 15 bp, Homo sapiens
cccctccccgccccc

SEQ ID NO: 129960 - DNA, 14 bp, Homo sapiens
cccctccctgctcc

SEQ ID NO: 129961 - DNA, 21 bp, Homo sapiens
cccctgaaacatgtgcccctg

SEQ ID NO: 129962 - DNA, 14 bp, Homo sapiens
cccctgcctcctgc

SEQ ID NO: 129963 - DNA, 13 bp, Homo sapiens
cccgccaccctgt

SEQ ID NO: 129964 - DNA, 13 bp, Homo sapiens
cccgccccctgaa

SEQ ID NO: 129965 - DNA, 16 bp, Homo sapiens
cccgccctccacccac

SEQ ID NO: 129966 - DNA, 14 bp, Homo sapiens
cccgcttagttctt

SEQ ID NO: 129967 - DNA, 15 bp, Homo sapiens
cccgcttagttcttg

SEQ ID NO: 129968 - DNA, 21 bp, Homo sapiens
cccgcttagttcttgaattgt

SEQ ID NO: 129969 - DNA, 13 bp, Homo sapiens
cccggacactcgc

SEQ ID NO: 129970 - DNA, 20 bp, Homo sapiens
cccggcggggtgcctgctgt

SEQ ID NO: 129971 - DNA, 14 bp, Homo sapiens
cccgtagtctcctg

SEQ ID NO: 129972 - DNA, 17 bp, Homo sapiens
cccgtagtctcctgggt

SEQ ID NO: 129973 - DNA, 13 bp, Homo sapiens
cccgtcccagagg

SEQ ID NO: 129974 - DNA, 21 bp, Homo sapiens
ccctagcccttctaccccacc

SEQ ID NO: 129975 - DNA, 15 bp, Homo sapiens
ccctcagctccctga

SEQ ID NO: 129976 - DNA, 16 bp, Homo sapiens
ccctcagctccctgac

SEQ ID NO: 129977 - DNA, 22 bp, Homo sapiens
ccctcaggattgtttctcggca

SEQ ID NO: 129978 - DNA, 11 bp, Homo sapiens
ccctcccaggc

SEQ ID NO: 129979 - DNA, 12 bp, Homo sapiens
ccctcccaggct

SEQ ID NO: 129980 - DNA, 15 bp, Homo sapiens
ccctccccgccccct

SEQ ID NO: 129981 - DNA, 19 bp, Homo sapiens
ccctccccgccccctgaaa

SEQ ID NO: 129982 - DNA, 17 bp, Homo sapiens
cacaggactctgcagat

SEQ ID NO: 129983 - DNA, 13 bp, Homo sapiens
cacaggaggctcc

SEQ ID NO: 129984 - DNA, 22 bp, Homo sapiens
cacaggaggctccgtgagccct

SEQ ID NO: 129985 - DNA, 19 bp, Homo sapiens
cacaggttcatgccaccat

SEQ ID NO: 129986 - DNA, 14 bp, Homo sapiens
cacagtgttgccca

SEQ ID NO: 129987 - DNA, 13 bp, Homo sapiens
cacatctgcattt

SEQ ID NO: 129988 - DNA, 21 bp, Homo sapiens
cacatctgcattttcacccca

SEQ ID NO: 129989 - DNA, 21 bp, Homo sapiens
cacatgctgaggttttgaata

SEQ ID NO: 129990 - DNA, 22 bp, Homo sapiens
cacatgggaggaaggcccaggg

SEQ ID NO: 129991 - DNA, 12 bp, Homo sapiens
caccatggccag

SEQ ID NO: 129992 - DNA, 16 bp, Homo sapiens
caccatggccagccaa

SEQ ID NO: 129993 - DNA, 18 bp, Homo sapiens
cacccagaggtggccctc

SEQ ID NO: 129994 - DNA, 13 bp, Homo sapiens
caccccaccaggg

SEQ ID NO: 129995 - DNA, 14 bp, Homo sapiens
caccccacccttcc

SEQ ID NO: 129996 - DNA, 21 bp, Homo sapiens
caccccagcccccacagccct

SEQ ID NO: 129997 - DNA, 23 bp, Homo sapiens
caccccagcccccacagccctgg

SEQ ID NO: 129998 - DNA, 12 bp, Homo sapiens
caccccatccca

SEQ ID NO: 129999 - DNA, 21 bp, Homo sapiens
caccccatcccacaccctgga

SEQ ID NO: 130000 - DNA, 17 bp, Homo sapiens
cacccccatctctccct

SEQ ID NO: 130001 - DNA, 15 bp, Homo sapiens
cacccctgcctcctg

SEQ ID NO: 130002 - DNA, 19 bp, Homo sapiens
cacccgccccgccccctcc

SEQ ID NO: 130003 - DNA, 13 bp, Homo sapiens
cctgctcagcagg

SEQ ID NO: 130004 - DNA, 11 bp, Homo sapiens
cctgctcccag

SEQ ID NO: 130005 - DNA, 12 bp, Homo sapiens
cctgctcccagc

SEQ ID NO: 130006 - DNA, 16 bp, Homo sapiens
cctgctcccagctctc

SEQ ID NO: 130007 - DNA, 16 bp, Homo sapiens
cctgctgcttggagtg

SEQ ID NO: 130008 - DNA, 23 bp, Homo sapiens
cctgctgcttggagtgccccaag

SEQ ID NO: 130009 - DNA, 17 bp, Homo sapiens
cctgctgtccgtcccgc

SEQ ID NO: 130010 - DNA, 22 bp, Homo sapiens
cctggagtctgaagcctgcagg

SEQ ID NO: 130011 - DNA, 13 bp, Homo sapiens
cctggcagcacag

SEQ ID NO: 130012 - DNA, 15 bp, Homo sapiens
cctggcagcacagcc

SEQ ID NO: 130013 - DNA, 18 bp, Homo sapiens
cctggcggaggtggagtg

SEQ ID NO: 130014 - DNA, 20 bp, Homo sapiens
cctggcggaggtggagtggc

SEQ ID NO: 130015 - DNA, 21 bp, Homo sapiens
cctggcggaggtggagtggcc

SEQ ID NO: 130016 - DNA, 14 bp, Homo sapiens
cctgggccaaggac

SEQ ID NO: 130017 - DNA, 21 bp, Homo sapiens
cctggggtgcatcctcctcag

SEQ ID NO: 130018 - DNA, 22 bp, Homo sapiens
cctggggtgcatcctcctcagc

SEQ ID NO: 130019 - DNA, 18 bp, Homo sapiens
cctggtactgcacatttt

SEQ ID NO: 130020 - DNA, 22 bp, Homo sapiens
cctgtagatcagggatagcgct

SEQ ID NO: 130021 - DNA, 14 bp, Homo sapiens
cctgtctcagcctc

SEQ ID NO: 130022 - DNA, 15 bp, Homo sapiens
cctgtctcagcctcc

SEQ ID NO: 130023 - DNA, 16 bp, Homo sapiens
cctgtctcagcctccc

SEQ ID NO: 130024 - DNA, 21 bp, Homo sapiens
ccttcctcagctcagctgggc

SEQ ID NO: 130025 - DNA, 23 bp, Homo sapiens
ccttcctcagctcagctgggcca

SEQ ID NO: 130026 - DNA, 17 bp, Homo sapiens
ccttcctcctctcctgg

SEQ ID NO: 130027 - DNA, 17 bp, Homo sapiens
ccttggcatgggcgcag

SEQ ID NO: 130028 - DNA, 23 bp, Homo sapiens
ccttggcatgggcgcaggcccag

SEQ ID NO: 130029 - DNA, 19 bp, Homo sapiens
ccttggggtggtgctgggt

SEQ ID NO: 130030 - DNA, 15 bp, Homo sapiens
ccttggttcctcccc

SEQ ID NO: 130031 - DNA, 17 bp, Homo sapiens
cctttttaaaaaatacc

SEQ ID NO: 130032 - DNA, 19 bp, Homo sapiens
cctttttaaaaaataccat

SEQ ID NO: 130033 - DNA, 18 bp, Homo sapiens
cgacatcctagccccacc

SEQ ID NO: 130034 - DNA, 20 bp, Homo sapiens
cgacatcctagccccaccca

SEQ ID NO: 130035 - DNA, 18 bp, Homo sapiens
cgagacaggagcagccca

SEQ ID NO: 130036 - DNA, 15 bp, Homo sapiens
cgagcagtcctgcct

SEQ ID NO: 130037 - DNA, 17 bp, Homo sapiens
cgagcagtcctgcctca

SEQ ID NO: 130038 - DNA, 18 bp, Homo sapiens
cgaggagccccagccccg

SEQ ID NO: 130039 - DNA, 19 bp, Homo sapiens
cgaggagccccagccccgt

SEQ ID NO: 130040 - DNA, 22 bp, Homo sapiens
cgagtctttgtgtgttatattc

SEQ ID NO: 130041 - DNA, 20 bp, Homo sapiens
cgatccacctgtctcagcct

SEQ ID NO: 130042 - DNA, 20 bp, Homo sapiens
cgcagccacaccgctggctc

SEQ ID NO: 130043 - DNA, 18 bp, Homo sapiens
cgccccctccctgctccc

SEQ ID NO: 130044 - DNA, 12 bp, Homo sapiens
cgccccctgaaa

SEQ ID NO: 130045 - DNA, 21 bp, Homo sapiens
cgcctactaagtacccttggg

SEQ ID NO: 130046 - DNA, 20 bp, Homo sapiens
cgcctcccgccaccctgtct

SEQ ID NO: 130047 - DNA, 21 bp, Homo sapiens
cgctgttgatcccctctctgt

SEQ ID NO: 130048 - DNA, 22 bp, Homo sapiens
cgctgttgcccgccctccaccc

SEQ ID NO: 130049 - DNA, 19 bp, Homo sapiens
cgcttagttcttgaattgt

SEQ ID NO: 130050 - DNA, 13 bp, Homo sapiens
cgcttcccacctg

SEQ ID NO: 130051 - DNA, 16 bp, Homo sapiens
cggagacccacagccc

SEQ ID NO: 130052 - DNA, 15 bp, Homo sapiens
cggagaccctgagtc

SEQ ID NO: 130053 - DNA, 16 bp, Homo sapiens
cggcaccagtgcctca

SEQ ID NO: 130054 - DNA, 13 bp, Homo sapiens
cggcccctggcag

SEQ ID NO: 130055 - DNA, 15 bp, Homo sapiens
cggctgtctcctgtc

SEQ ID NO: 130056 - DNA, 19 bp, Homo sapiens
cgggaagtgcagcgggcca

SEQ ID NO: 130057 - DNA, 22 bp, Homo sapiens
cgggactgggggcgggactggg

SEQ ID NO: 130058 - DNA, 17 bp, Homo sapiens
cgggactgggggcgggg

SEQ ID NO: 130059 - DNA, 19 bp, Homo sapiens
cgggctccatgcctctgga

SEQ ID NO: 130060 - DNA, 19 bp, Homo sapiens
cgtaagatggcttatttgt

SEQ ID NO: 130061 - DNA, 14 bp, Homo sapiens
cgtagtctcctggg

SEQ ID NO: 130062 - DNA, 15 bp, Homo sapiens
cgtagtctcctgggt

SEQ ID NO: 130063 - DNA, 18 bp, Homo sapiens
cgtccccctagagactca

SEQ ID NO: 130064 - DNA, 21 bp, Homo sapiens
cgtcccttggatcagaggtca

SEQ ID NO: 130065 - DNA, 21 bp, Homo sapiens
cgtctgtcccaagtcctgctc

SEQ ID NO: 130066 - DNA, 15 bp, Homo sapiens
cgtgaatgtctcagc

SEQ ID NO: 130067 - DNA, 16 bp, Homo sapiens
cgtgaatgtctcagcg

SEQ ID NO: 130068 - DNA, 18 bp, Homo sapiens
ctaaaaattttgcatttc

SEQ ID NO: 130069 - DNA, 19 bp, Homo sapiens
ctaaaagtgcatttaagga

SEQ ID NO: 130070 - DNA, 15 bp, Homo sapiens
ctaagtaagaaacac

SEQ ID NO: 130071 - DNA, 15 bp, Homo sapiens
ctaagtacccttggg

SEQ ID NO: 130072 - DNA, 23 bp, Homo sapiens
ctaatgacatgcctatatgagaa

SEQ ID NO: 130073 - DNA, 17 bp, Homo sapiens
ctaatgtgatcatatga

SEQ ID NO: 130074 - DNA, 23 bp, Homo sapiens
ctaatgttatttcttaaaattca

SEQ ID NO: 130075 - DNA, 15 bp, Homo sapiens
ctaattagagaactg

SEQ ID NO: 130076 - DNA, 18 bp, Homo sapiens
ctaattagagaactggag

SEQ ID NO: 130077 - DNA, 12 bp, Homo sapiens
ctacacatatat

SEQ ID NO: 130078 - DNA, 14 bp, Homo sapiens
ctacagtaatgaaa

SEQ ID NO: 130079 - DNA, 12 bp, Homo sapiens
ctaccccacctg

SEQ ID NO: 130080 - DNA, 15 bp, Homo sapiens
ctaccccacctgacc

SEQ ID NO: 130081 - DNA, 12 bp, Homo sapiens
ctaccctgcagc

SEQ ID NO: 130082 - DNA, 19 bp, Homo sapiens
ctaccttaaaatgtaaaac

SEQ ID NO: 130083 - DNA, 13 bp, Homo sapiens
ctacttttcagaa

SEQ ID NO: 130084 - DNA, 20 bp, Homo sapiens
ctagaggacactaggagact

SEQ ID NO: 130085 - DNA, 23 bp, Homo sapiens
ctagaggacactaggagactggt

SEQ ID NO: 130086 - DNA, 14 bp, Homo sapiens
caggtatcaactag

SEQ ID NO: 130087 - DNA, 18 bp, Homo sapiens
caggtccggggaggaggt

SEQ ID NO: 130088 - DNA, 13 bp, Homo sapiens
caggtctctgtgg

SEQ ID NO: 130089 - DNA, 16 bp, Homo sapiens
cagtacctcccctccc

SEQ ID NO: 130090 - DNA, 23 bp, Homo sapiens
cagtacctcccctccccgccccc

SEQ ID NO: 130091 - DNA, 19 bp, Homo sapiens
cagtatcttagagtttaca

SEQ ID NO: 130092 - DNA, 22 bp, Homo sapiens
cagtattttcttcccaaatcaa

SEQ ID NO: 130093 - DNA, 16 bp, Homo sapiens
cagtcacaaatttctc

SEQ ID NO: 130094 - DNA, 19 bp, Homo sapiens
cagtcctgcctcagcctcc

SEQ ID NO: 130095 - DNA, 20 bp, Homo sapiens
cagtgaagtctagaatcata

SEQ ID NO: 130096 - DNA, 22 bp, Homo sapiens
cagtgagatataggataaaata

SEQ ID NO: 130097 - DNA, 13 bp, Homo sapiens
cagtgagcctctg

SEQ ID NO: 130098 - DNA, 17 bp, Homo sapiens
cagtgagcctctgcgcc

SEQ ID NO: 130099 - DNA, 23 bp, Homo sapiens
cagtgagcctctgcgcctctcca

SEQ ID NO: 130100 - DNA, 19 bp, Homo sapiens
cagtggtcaccttcctcag

SEQ ID NO: 130101 - DNA, 18 bp, Homo sapiens
cagtgttccccccataga

SEQ ID NO: 130102 - DNA, 13 bp, Homo sapiens
cagtttattctgt

SEQ ID NO: 130103 - DNA, 21 bp, Homo sapiens
cagtttgtgttttaaaaaaac

SEQ ID NO: 130104 - DNA, 15 bp, Homo sapiens
ccacctgacctctgc

SEQ ID NO: 130105 - DNA, 15 bp, Homo sapiens
ccacctgtctcagcc

SEQ ID NO: 130106 - DNA, 18 bp, Homo sapiens
ccactcctcttcacccac

SEQ ID NO: 130107 - DNA, 18 bp, Homo sapiens
ccactggcacttgcctgc

SEQ ID NO: 130108 - DNA, 19 bp, Homo sapiens
ccactggcacttgcctgct

SEQ ID NO: 130109 - DNA, 20 bp, Homo sapiens
ccactggcacttgcctgctg

SEQ ID NO: 130110 - DNA, 21 bp, Homo sapiens
ccactggcacttgcctgctgc

SEQ ID NO: 130111 - DNA, 17 bp, Homo sapiens
ccactgtttcatgagcc

SEQ ID NO: 130112 - DNA, 16 bp, Homo sapiens
ccacttcatgcccact

SEQ ID NO: 130113 - DNA, 19 bp, Homo sapiens
ccacttcttgttccccact

SEQ ID NO: 130114 - DNA, 16 bp, Homo sapiens
ccagagaagcgctgtt

SEQ ID NO: 130115 - DNA, 20 bp, Homo sapiens
ccagaggccgctgcccctga

SEQ ID NO: 130116 - DNA, 19 bp, Homo sapiens
ccagattgttctgtccagt

SEQ ID NO: 130117 - DNA, 21 bp, Homo sapiens
ccagcagtacaataaaagtaa

SEQ ID NO: 130118 - DNA, 17 bp, Homo sapiens
ccagccccaatccagag

SEQ ID NO: 130119 - DNA, 14 bp, Homo sapiens
ccagcccccacagc

SEQ ID NO: 130120 - DNA, 16 bp, Homo sapiens
ccagccccgtcccaga

SEQ ID NO: 130121 - DNA, 18 bp, Homo sapiens
ccagccccgtcccagagg

SEQ ID NO: 130122 - DNA, 20 bp, Homo sapiens
ccagccccgtcccagaggcc

SEQ ID NO: 130123 - DNA, 15 bp, Homo sapiens
ccagctctctctcct

SEQ ID NO: 130124 - DNA, 16 bp, Homo sapiens
ccagctctctctcctg

SEQ ID NO: 130125 - DNA, 19 bp, Homo sapiens
ccaggagggagagcctctg

SEQ ID NO: 130126 - DNA, 20 bp, Homo sapiens
ccaggagggagagcctctgt

SEQ ID NO: 130127 - DNA, 20 bp, Homo sapiens
ccaggcatcactgattccct

SEQ ID NO: 130128 - DNA, 20 bp, Homo sapiens
ccaggggtggggcccatggg

SEQ ID NO: 130129 - DNA, 21 bp, Homo sapiens
ccaggggtggggcccatgggg

SEQ ID NO: 130130 - DNA, 13 bp, Homo sapiens
ccagtgagtgtaa

SEQ ID NO: 130131 - DNA, 12 bp, Homo sapiens
ccagtgcctcag

SEQ ID NO: 130132 - DNA, 19 bp, Homo sapiens
ccagttggaggagactggg

SEQ ID NO: 130133 - DNA, 17 bp, Homo sapiens
ccagtttattctgtggt

SEQ ID NO: 130134 - DNA, 14 bp, Homo sapiens
ccataattatgaaa

SEQ ID NO: 130135 - DNA, 20 bp, Homo sapiens
ccataggaagacataaaact

SEQ ID NO: 130136 - DNA, 14 bp, Homo sapiens
ccatcccacaccct

SEQ ID NO: 130137 - DNA, 23 bp, Homo sapiens
ccatctctccctcccctgccatt

SEQ ID NO: 130138 - DNA, 17 bp, Homo sapiens
ccatgacaaacctagct

SEQ ID NO: 130139 - DNA, 19 bp, Homo sapiens
ccatggagacaataaacag

SEQ ID NO: 130140 - DNA, 16 bp, Homo sapiens
ccatggggtctctgca

SEQ ID NO: 130141 - DNA, 12 bp, Homo sapiens
ccattctatgtg

SEQ ID NO: 130142 - DNA, 19 bp, Homo sapiens
ccattgaaatcagcatgac

SEQ ID NO: 130143 - DNA, 12 bp, Homo sapiens
cccaaggagaac

SEQ ID NO: 130144 - DNA, 15 bp, Homo sapiens
cccaaggaggtggct

SEQ ID NO: 130145 - DNA, 13 bp, Homo sapiens
cccacaaactgat

SEQ ID NO: 130146 - DNA, 12 bp, Homo sapiens
cccacaccctgg

SEQ ID NO: 130147 - DNA, 18 bp, Homo sapiens
cccacagactccggcctg

SEQ ID NO: 130148 - DNA, 12 bp, Homo sapiens
cccacccagagg

SEQ ID NO: 130149 - DNA, 13 bp, Homo sapiens
cccacccagcaga

SEQ ID NO: 130150 - DNA, 18 bp, Homo sapiens
cccaccccacagactccg

SEQ ID NO: 130151 - DNA, 18 bp, Homo sapiens
cccacccccacttcatgc

SEQ ID NO: 130152 - DNA, 16 bp, Homo sapiens
cccactgacagcctcc

SEQ ID NO: 130153 - DNA, 18 bp, Homo sapiens
cccagaggccgctgcccc

SEQ ID NO: 130154 - DNA, 21 bp, Homo sapiens
cccagaggccgctgcccctga

SEQ ID NO: 130155 - DNA, 14 bp, Homo sapiens
cccagaggtggccc

SEQ ID NO: 130156 - DNA, 16 bp, Homo sapiens
cccagaggtggccctc

SEQ ID NO: 130157 - DNA, 20 bp, Homo sapiens
cccagaggtggccctcccag

SEQ ID NO: 130158 - DNA, 14 bp, Homo sapiens
cccagccactgcag

SEQ ID NO: 130159 - DNA, 16 bp, Homo sapiens
cccagccactgcagca

SEQ ID NO: 130160 - DNA, 20 bp, Homo sapiens
cccagccccaatccagagaa

SEQ ID NO: 130161 - DNA, 14 bp, Homo sapiens
cccagcccccacag

SEQ ID NO: 130162 - DNA, 15 bp, Homo sapiens
cccagcccccacagc

SEQ ID NO: 130163 - DNA, 16 bp, Homo sapiens
cccagcccccacagcc

SEQ ID NO: 130164 - DNA, 14 bp, Homo sapiens
cccagcccctccac

SEQ ID NO: 130165 - DNA, 15 bp, Homo sapiens
cccagcccctccacg

SEQ ID NO: 130166 - DNA, 20 bp, Homo sapiens
cccaggccaggtgaggtcca

SEQ ID NO: 130167 - DNA, 21 bp, Homo sapiens
cccaggggtggggcccatggg

SEQ ID NO: 130168 - DNA, 22 bp, Homo sapiens
cccaggggtggggcccatgggg

SEQ ID NO: 130169 - DNA, 23 bp, Homo sapiens
cccagtgacaaagactcctctgg

SEQ ID NO: 130170 - DNA, 14 bp, Homo sapiens
cccagtgagcctct

SEQ ID NO: 130171 - DNA, 19 bp, Homo sapiens
cccagtgagcctctgcgcc

SEQ ID NO: 130172 - DNA, 22 bp, Homo sapiens
cccatggagacaataaacagct

SEQ ID NO: 130173 - DNA, 20 bp, Homo sapiens
ccccaatccagagaagcgct

SEQ ID NO: 130174 - DNA, 14 bp, Homo sapiens
ccccacctgacctc

SEQ ID NO: 130175 - DNA, 17 bp, Homo sapiens
ccccacctgacctctgc

SEQ ID NO: 130176 - DNA, 21 bp, Homo sapiens
ccccacttcatgcccactgcc

SEQ ID NO: 130177 - DNA, 14 bp, Homo sapiens
ccccagcccccaca

SEQ ID NO: 130178 - DNA, 19 bp, Homo sapiens
ccccagcccccacagccct

SEQ ID NO: 130179 - DNA, 18 bp, Homo sapiens
ccccagccccgtcccaga

SEQ ID NO: 130180 - DNA, 12 bp, Homo sapiens
ccccatctctcc

SEQ ID NO: 130181 - DNA, 16 bp, Homo sapiens
ccccatctctccctcc

SEQ ID NO: 130182 - DNA, 21 bp, Homo sapiens
ccccgccccctccctgctccc

SEQ ID NO: 130183 - DNA, 15 bp, Homo sapiens
ccccgtcccagaggc

SEQ ID NO: 130184 - DNA, 19 bp, Homo sapiens
ccccgtccccctagagact

SEQ ID NO: 130185 - DNA, 18 bp, Homo sapiens
cccctccccaaaagaaac

SEQ ID NO: 130186 - DNA, 20 bp, Homo sapiens
cccctccccgccccctgaaa

SEQ ID NO: 130187 - DNA, 18 bp, Homo sapiens
cccctctctgtggctcca

SEQ ID NO: 130188 - DNA, 14 bp, Homo sapiens
ctagatatgaatat

SEQ ID NO: 130189 - DNA, 21 bp, Homo sapiens
ctagccccacccagaggtggc

SEQ ID NO: 130190 - DNA, 23 bp, Homo sapiens
ctagcccttctaccccacctgac

SEQ ID NO: 130191 - DNA, 16 bp, Homo sapiens
ctagcttttaaaaaat

SEQ ID NO: 130192 - DNA, 12 bp, Homo sapiens
ctaggggaggag

SEQ ID NO: 130193 - DNA, 17 bp, Homo sapiens
ctataaatttaagaaaa

SEQ ID NO: 130194 - DNA, 20 bp, Homo sapiens
ctataaatttaagaaaacaa

SEQ ID NO: 130195 - DNA, 13 bp, Homo sapiens
ctataataagttt

SEQ ID NO: 130196 - DNA, 13 bp, Homo sapiens
ctatatctgtttg

SEQ ID NO: 130197 - DNA, 19 bp, Homo sapiens
ctatatctgtttgtatatt

SEQ ID NO: 130198 - DNA, 17 bp, Homo sapiens
ctatatgagaagaatag

SEQ ID NO: 130199 - DNA, 13 bp, Homo sapiens
ctatcaatattta

SEQ ID NO: 130200 - DNA, 18 bp, Homo sapiens
ctatcaatatttaagttt

SEQ ID NO: 130201 - DNA, 13 bp, Homo sapiens
ctatctaatgaca

SEQ ID NO: 130202 - DNA, 16 bp, Homo sapiens
ctatgaactgaaggca

SEQ ID NO: 130203 - DNA, 18 bp, Homo sapiens
ctatggcccagccactgc

SEQ ID NO: 130204 - DNA, 21 bp, Homo sapiens
ctatggcccagccactgcagc

SEQ ID NO: 130205 - DNA, 22 bp, Homo sapiens
ctatggcccagccactgcagca

SEQ ID NO: 130206 - DNA, 16 bp, Homo sapiens
ctgagtccgggaggca

SEQ ID NO: 130207 - DNA, 20 bp, Homo sapiens
ctgatgagtaaactgaggcc

SEQ ID NO: 130208 - DNA, 21 bp, Homo sapiens
ctgatgcccaccgaggagccc

SEQ ID NO: 130209 - DNA, 15 bp, Homo sapiens
ctgcaaaattaaatc

SEQ ID NO: 130210 - DNA, 14 bp, Homo sapiens
ctgcaagaattaaa

SEQ ID NO: 130211 - DNA, 15 bp, Homo sapiens
ctgcaagaattaaaa

SEQ ID NO: 130212 - DNA, 19 bp, Homo sapiens
ctgcaagaattaaaactga

SEQ ID NO: 130213 - DNA, 22 bp, Homo sapiens
ctgcaagaattaaaactgagtc

SEQ ID NO: 130214 - DNA, 13 bp, Homo sapiens
ctgcacagaaggg

SEQ ID NO: 130215 - DNA, 17 bp, Homo sapiens
ctgcacagaagggctct

SEQ ID NO: 130216 - DNA, 17 bp, Homo sapiens
ctgcagcacaggaggct

SEQ ID NO: 130217 - DNA, 23 bp, Homo sapiens
ctgcagggtgaagcaccagggag

SEQ ID NO: 130218 - DNA, 18 bp, Homo sapiens
ctgcaggtccggggagga

SEQ ID NO: 130219 - DNA, 17 bp, Homo sapiens
ctgcattttcaccccac

SEQ ID NO: 130220 - DNA, 18 bp, Homo sapiens
ctgcattttcaccccacc

SEQ ID NO: 130221 - DNA, 21 bp, Homo sapiens
ctgccaaggccggagacccac

SEQ ID NO: 130222 - DNA, 22 bp, Homo sapiens
ctgccaaggccggagacccaca

SEQ ID NO: 130223 - DNA, 19 bp, Homo sapiens
ctgcccagcctgctcagca

SEQ ID NO: 130224 - DNA, 19 bp, Homo sapiens
ctgcccctccccaaaagaa

SEQ ID NO: 130225 - DNA, 21 bp, Homo sapiens
ctgcccctgagttctgacact

SEQ ID NO: 130226 - DNA, 22 bp, Homo sapiens
ctgccgatgcccaatccaggcc

SEQ ID NO: 130227 - DNA, 12 bp, Homo sapiens
ctgcctcagcct

SEQ ID NO: 130228 - DNA, 14 bp, Homo sapiens
ctgcctcctgcctc

SEQ ID NO: 130229 - DNA, 22 bp, Homo sapiens
ctgcctgccccacccaccccac

SEQ ID NO: 130230 - DNA, 14 bp, Homo sapiens
ctgctcagcaggtt

SEQ ID NO: 130231 - DNA, 15 bp, Homo sapiens
ctgctcccagctctc

SEQ ID NO: 130232 - DNA, 24 bp, Homo sapiens
ctgctcccagctctctctcctgga

SEQ ID NO: 130233 - DNA, 19 bp, Homo sapiens
ctgctcctttctgcccagc

SEQ ID NO: 130234 - DNA, 14 bp, Homo sapiens
ctgctgagctgggc

SEQ ID NO: 130235 - DNA, 16 bp, Homo sapiens
ctgctgagctgggccc

SEQ ID NO: 130236 - DNA, 23 bp, Homo sapiens
ctgctgttaattgattaaaatct

SEQ ID NO: 130237 - DNA, 16 bp, Homo sapiens
ctgcttggagtgcccc

SEQ ID NO: 130238 - DNA, 23 bp, Homo sapiens
ctggaaacagacagggagaagtt

SEQ ID NO: 130239 - DNA, 13 bp, Homo sapiens
ctggaccctggcc

SEQ ID NO: 130240 - DNA, 14 bp, Homo sapiens
ctggaggcctctgg

SEQ ID NO: 130241 - DNA, 17 bp, Homo sapiens
ctggaggcctctggccc

SEQ ID NO: 130242 - DNA, 19 bp, Homo sapiens
ctggaggcctctggccctc

SEQ ID NO: 130243 - DNA, 17 bp, Homo sapiens
ctggatggggagtctca

SEQ ID NO: 130244 - DNA, 17 bp, Homo sapiens
ctggcacttgcctgctg

SEQ ID NO: 130245 - DNA, 14 bp, Homo sapiens
ctggcagcacagcc

SEQ ID NO: 130246 - DNA, 13 bp, Homo sapiens
ctggcccagccaa

SEQ ID NO: 130247 - DNA, 19 bp, Homo sapiens
ctggccctcagctccctga

SEQ ID NO: 130248 - DNA, 23 bp, Homo sapiens
ctggccctcagctccctgacccc

SEQ ID NO: 130249 - DNA, 13 bp, Homo sapiens
ctggcccttggaa

SEQ ID NO: 130250 - DNA, 13 bp, Homo sapiens
ctggcggaggtgg

SEQ ID NO: 130251 - DNA, 21 bp, Homo sapiens
ctggctcaagaattagggccc

SEQ ID NO: 130252 - DNA, 21 bp, Homo sapiens
ctgggcacccctgcctcctgc

SEQ ID NO: 130253 - DNA, 14 bp, Homo sapiens
ctgggcagggcctg

SEQ ID NO: 130254 - DNA, 23 bp, Homo sapiens
ctgggccaaggactccaaagccg

SEQ ID NO: 130255 - DNA, 18 bp, Homo sapiens
ctgggcggggccgcagcc

SEQ ID NO: 130256 - DNA, 23 bp, Homo sapiens
ctgggggcttcgcttccttagcc

SEQ ID NO: 130257 - DNA, 22 bp, Homo sapiens
ctgggtctcgctttgttgccca

SEQ ID NO: 130258 - DNA, 20 bp, Homo sapiens
ctggtttgtttgcttaattt

SEQ ID NO: 130259 - DNA, 19 bp, Homo sapiens
ctgtaaaagttataataac

SEQ ID NO: 130260 - DNA, 20 bp, Homo sapiens
ctgtaaaagttataataact

SEQ ID NO: 130261 - DNA, 20 bp, Homo sapiens
ctgtaatcagctctcctggc

SEQ ID NO: 130262 - DNA, 22 bp, Homo sapiens
ctgtaatcagctctcctggctc

SEQ ID NO: 130263 - DNA, 19 bp, Homo sapiens
ctgtaatgagtcagtgaag

SEQ ID NO: 130264 - DNA, 19 bp, Homo sapiens
ctgtataatctatttacat

SEQ ID NO: 130265 - DNA, 18 bp, Homo sapiens
ctgtatactgtaaaagtt

SEQ ID NO: 130266 - DNA, 16 bp, Homo sapiens
ctgtccagtttccaaa

SEQ ID NO: 130267 - DNA, 23 bp, Homo sapiens
ctgtccataaagtaattttgtga

SEQ ID NO: 130268 - DNA, 15 bp, Homo sapiens
ctgtctcagcctccc

SEQ ID NO: 130269 - DNA, 17 bp, Homo sapiens
ctgtctcagcctcccag

SEQ ID NO: 130270 - DNA, 16 bp, Homo sapiens
ctgtgaatttcaaaaa

SEQ ID NO: 130271 - DNA, 13 bp, Homo sapiens
ctgtggaatttat

SEQ ID NO: 130272 - DNA, 11 bp, Homo sapiens
ctgtggctcca

SEQ ID NO: 130273 - DNA, 19 bp, Homo sapiens
ctgtggttctataataagt

SEQ ID NO: 130274 - DNA, 19 bp, Homo sapiens
ctgtggttttattacaaat

SEQ ID NO: 130275 - DNA, 19 bp, Homo sapiens
ctgtgtatcattaaaatat

SEQ ID NO: 130276 - DNA, 20 bp, Homo sapiens
ctgtgtatcattaaaatata

SEQ ID NO: 130277 - DNA, 20 bp, Homo sapiens
ctgttaaccacccgccccgc

SEQ ID NO: 130278 - DNA, 14 bp, Homo sapiens
ctgttaagaaagga

SEQ ID NO: 130279 - DNA, 22 bp, Homo sapiens
ctgttaagaaaggatataaaag

SEQ ID NO: 130280 - DNA, 23 bp, Homo sapiens
ctgttaagaaaggatataaaagg

SEQ ID NO: 130281 - DNA, 19 bp, Homo sapiens
ctgttgatcccctctctgt

SEQ ID NO: 130282 - DNA, 19 bp, Homo sapiens
ctgttgcccgccctccacc

SEQ ID NO: 130283 - DNA, 23 bp, Homo sapiens
ctgttgcccgccctccacccact

SEQ ID NO: 130284 - DNA, 19 bp, Homo sapiens
ctgtttaaaaaaagtatat

SEQ ID NO: 130285 - DNA, 22 bp, Homo sapiens
ctgtttaaaaaaagtatatatt

SEQ ID NO: 130286 - DNA, 13 bp, Homo sapiens
ctgtttcaaatgt

SEQ ID NO: 130287 - DNA, 17 bp, Homo sapiens
ctgtttcatgagcccaa

SEQ ID NO: 130288 - DNA, 15 bp, Homo sapiens
ctgtttgtatatttg

SEQ ID NO: 130289 - DNA, 11 bp, Homo sapiens
cttaaaaactg

SEQ ID NO: 130290 - DNA, 14 bp, Homo sapiens
cttaaaaactgtgt

SEQ ID NO: 130291 - DNA, 16 bp, Homo sapiens
cttaaaaactgtgtat

SEQ ID NO: 130292 - DNA, 19 bp, Homo sapiens
cttaaaaactgtgtatcat

SEQ ID NO: 130293 - DNA, 14 bp, Homo sapiens
cttaaaatgcaata

SEQ ID NO: 130294 - DNA, 16 bp, Homo sapiens
cttaatatttttacat

SEQ ID NO: 130295 - DNA, 22 bp, Homo sapiens
cttaatttccttctgttaagaa

SEQ ID NO: 130296 - DNA, 16 bp, Homo sapiens
cttagagtttacagtt

SEQ ID NO: 130297 - DNA, 14 bp, Homo sapiens
cttataggtttcca

SEQ ID NO: 130298 - DNA, 22 bp, Homo sapiens
cttatcatttttgtataaaaag

SEQ ID NO: 130299 - DNA, 22 bp, Homo sapiens
cttatccttgggccataattat

SEQ ID NO: 130300 - DNA, 18 bp, Homo sapiens
cttattgaaaaatcagtg

SEQ ID NO: 130301 - DNA, 15 bp, Homo sapiens
cttcactgcagcctt

SEQ ID NO: 130302 - DNA, 15 bp, Homo sapiens
cttcataatggcctg

SEQ ID NO: 130303 - DNA, 12 bp, Homo sapiens
cttcatgcccac

SEQ ID NO: 130304 - DNA, 20 bp, Homo sapiens
cttcatgtcattaatcaatt

SEQ ID NO: 130305 - DNA, 15 bp, Homo sapiens
cttcccaaatcaaaa

SEQ ID NO: 130306 - DNA, 20 bp, Homo sapiens
cttcctcagctcagctgggc

SEQ ID NO: 130307 - DNA, 21 bp, Homo sapiens
ctcagctgggccactcctctt

SEQ ID NO: 130308 - DNA, 20 bp, Homo sapiens
ctcaggcgatccacctgtct

SEQ ID NO: 130309 - DNA, 18 bp, Homo sapiens
ctcagtcctttgttataa

SEQ ID NO: 130310 - DNA, 16 bp, Homo sapiens
ctcatgatcaagatat

SEQ ID NO: 130311 - DNA, 22 bp, Homo sapiens
ctcatgatcaagatatatgtgt

SEQ ID NO: 130312 - DNA, 22 bp, Homo sapiens
ctcatgcaagacttcactgcag

SEQ ID NO: 130313 - DNA, 23 bp, Homo sapiens
ctccaacccgttgggtcccttgc

SEQ ID NO: 130314 - DNA, 14 bp, Homo sapiens
ctccacccactagg

SEQ ID NO: 130315 - DNA, 21 bp, Homo sapiens
ctccacttcttgttccccact

SEQ ID NO: 130316 - DNA, 16 bp, Homo sapiens
ctccatttaagacaca

SEQ ID NO: 130317 - DNA, 20 bp, Homo sapiens
ctcccacccccatctctccc

SEQ ID NO: 130318 - DNA, 22 bp, Homo sapiens
ctcccacccccatctctccctc

SEQ ID NO: 130319 - DNA, 22 bp, Homo sapiens
ctccccaaaagaaaccatgaca

SEQ ID NO: 130320 - DNA, 18 bp, Homo sapiens
ctccccgccccctgaaac

SEQ ID NO: 130321 - DNA, 14 bp, Homo sapiens
ctccccggctcgag

SEQ ID NO: 130322 - DNA, 22 bp, Homo sapiens
ctcccctccccgccccctgaaa

SEQ ID NO: 130323 - DNA, 13 bp, Homo sapiens
ctcccgccaccct

SEQ ID NO: 130324 - DNA, 15 bp, Homo sapiens
ctcccgccaccctgt

SEQ ID NO: 130325 - DNA, 19 bp, Homo sapiens
ctcccgccaccctgtctca

SEQ ID NO: 130326 - DNA, 17 bp, Homo sapiens
ctcccgtagtctcctgg

SEQ ID NO: 130327 - DNA, 21 bp, Homo sapiens
ctccctcccgtagtctcctgg

SEQ ID NO: 130328 - DNA, 15 bp, Homo sapiens
ctccctgaccccctg

SEQ ID NO: 130329 - DNA, 16 bp, Homo sapiens
ctccctgaccccctgt

SEQ ID NO: 130330 - DNA, 13 bp, Homo sapiens
ctccctgctccca

SEQ ID NO: 130331 - DNA, 14 bp, Homo sapiens
ctccgtgagccctt

SEQ ID NO: 130332 - DNA, 15 bp, Homo sapiens
ctccgtgagcccttg

SEQ ID NO: 130333 - DNA, 13 bp, Homo sapiens
ctcctcagccccc

SEQ ID NO: 130334 - DNA, 19 bp, Homo sapiens
ctcctcagcccccaggcca

SEQ ID NO: 130335 - DNA, 21 bp, Homo sapiens
ctcctcagcccccaggccagg

SEQ ID NO: 130336 - DNA, 15 bp, Homo sapiens
ctcctctcctggaaa

SEQ ID NO: 130337 - DNA, 18 bp, Homo sapiens
ctcctctgggcctggggt

SEQ ID NO: 130338 - DNA, 22 bp, Homo sapiens
ctcctctgggcctggggtgcat

SEQ ID NO: 130339 - DNA, 13 bp, Homo sapiens
ctcctcttcaccc

SEQ ID NO: 130340 - DNA, 20 bp, Homo sapiens
ctcctggaaacagacaggga

SEQ ID NO: 130341 - DNA, 22 bp, Homo sapiens
ctcctggaaacagacagggaga

SEQ ID NO: 130342 - DNA, 23 bp, Homo sapiens
ctcctggagtctgaagcctgcag

SEQ ID NO: 130343 - DNA, 24 bp, Homo sapiens
ctcctggcacaacgctctaccctg

SEQ ID NO: 130344 - DNA, 14 bp, Homo sapiens
ctcctggctccctc

SEQ ID NO: 130345 - DNA, 13 bp, Homo sapiens
ctcctgggctcag

SEQ ID NO: 130346 - DNA, 14 bp, Homo sapiens
ctcctgtccccggc

SEQ ID NO: 130347 - DNA, 22 bp, Homo sapiens
ctcctgtgtcggtcagaacaac

SEQ ID NO: 130348 - DNA, 15 bp, Homo sapiens
ctcgaagaacaatgt

SEQ ID NO: 130349 - DNA, 15 bp, Homo sapiens
ctcgacgtcccttgg

SEQ ID NO: 130350 - DNA, 17 bp, Homo sapiens
ctcgacgtcccttggat

SEQ ID NO: 130351 - DNA, 17 bp, Homo sapiens
ctcgagcagtcctgcct

SEQ ID NO: 130352 - DNA, 19 bp, Homo sapiens
ctcgcctactaagtaccct

SEQ ID NO: 130353 - DNA, 14 bp, Homo sapiens
ctctaattagagaa

SEQ ID NO: 130354 - DNA, 13 bp, Homo sapiens
ctctactgtgtaa

SEQ ID NO: 130355 - DNA, 14 bp, Homo sapiens
ctctactgtgtaat

SEQ ID NO: 130356 - DNA, 20 bp, Homo sapiens
ctctattaagatttccaagt

SEQ ID NO: 130357 - DNA, 12 bp, Homo sapiens
ctctccctgttg

SEQ ID NO: 130358 - DNA, 20 bp, Homo sapiens
ctctcctggagtctgaagcc

SEQ ID NO: 130359 - DNA, 13 bp, Homo sapiens
ctctctcctggag

SEQ ID NO: 130360 - DNA, 13 bp, Homo sapiens
ctctctctcctgg

SEQ ID NO: 130361 - DNA, 15 bp, Homo sapiens
ctctctgctgagctg

SEQ ID NO: 130362 - DNA, 20 bp, Homo sapiens
ctctctgctgagctgggccc

SEQ ID NO: 130363 - DNA, 22 bp, Homo sapiens
ctctgcagggtgaagcaccagg

SEQ ID NO: 130364 - DNA, 22 bp, Homo sapiens
ctctgcatcttcagtcgtctgt

SEQ ID NO: 130365 - DNA, 18 bp, Homo sapiens
ctctgcgcctctccactg

SEQ ID NO: 130366 - DNA, 16 bp, Homo sapiens
ctctgctgagctgggc

SEQ ID NO: 130367 - DNA, 20 bp, Homo sapiens
ctctggaggcctctggccct

SEQ ID NO: 130368 - DNA, 10 bp, Homo sapiens
ctctggccct

SEQ ID NO: 130369 - DNA, 11 bp, Homo sapiens
ctctggccctt

SEQ ID NO: 130370 - DNA, 12 bp, Homo sapiens
ctctggcccttg

SEQ ID NO: 130371 - DNA, 14 bp, Homo sapiens
ctctggcccttgga

SEQ ID NO: 130372 - DNA, 14 bp, Homo sapiens
ctctgggcctgggg

SEQ ID NO: 130373 - DNA, 22 bp, Homo sapiens
ctctgtataatctatttacata

SEQ ID NO: 130374 - DNA, 20 bp, Homo sapiens
ctcttcacccaccccatgga

SEQ ID NO: 130375 - DNA, 16 bp, Homo sapiens
ctcttgactggctcaa

SEQ ID NO: 130376 - DNA, 15 bp, Homo sapiens
ctcttttaaagtatt

SEQ ID NO: 130377 - DNA, 16 bp, Homo sapiens
ctgaaacgagaagtgc

SEQ ID NO: 130378 - DNA, 13 bp, Homo sapiens
ctgaacaaaagct

SEQ ID NO: 130379 - DNA, 21 bp, Homo sapiens
ctgaacatttactacagtttt

SEQ ID NO: 130380 - DNA, 18 bp, Homo sapiens
ctgaagattcagtttaag

SEQ ID NO: 130381 - DNA, 13 bp, Homo sapiens
ctgacagaaatgc

SEQ ID NO: 130382 - DNA, 15 bp, Homo sapiens
ctgacctctgcaaga

SEQ ID NO: 130383 - DNA, 19 bp, Homo sapiens
ctgacggtttctccccgga

SEQ ID NO: 130384 - DNA, 17 bp, Homo sapiens
ctgagaagtgtatatag

SEQ ID NO: 130385 - DNA, 19 bp, Homo sapiens
ctgagactttctttctgta

SEQ ID NO: 130386 - DNA, 14 bp, Homo sapiens
ctgagccccagccc

SEQ ID NO: 130387 - DNA, 16 bp, Homo sapiens
ctgagccccagcccca

SEQ ID NO: 130388 - DNA, 10 bp, Homo sapiens
ctgagctggg

SEQ ID NO: 130389 - DNA, 16 bp, Homo sapiens
ctgagctgggcccagc

SEQ ID NO: 130390 - DNA, 17 bp, Homo sapiens
ctgaggttttgaataaa

SEQ ID NO: 130391 - DNA, 18 bp, Homo sapiens
ctgagtccatgaaaatac

SEQ ID NO: 130392 - DNA, 19 bp, Homo sapiens
ctgatagctgtttcaaatg

SEQ ID NO: 130393 - DNA, 20 bp, Homo sapiens
ctgatgcccaccgaggagcc

SEQ ID NO: 130394 - DNA, 17 bp, Homo sapiens
ctagccccacccagagg

SEQ ID NO: 130395 - DNA, 18 bp, Homo sapiens
ctagccccacccagaggt

SEQ ID NO: 130396 - DNA, 19 bp, Homo sapiens
ctagccccacccagaggtg

SEQ ID NO: 130397 - DNA, 17 bp, Homo sapiens
ctagcccttctacccca

SEQ ID NO: 130398 - DNA, 20 bp, Homo sapiens
ctagcccttctaccccacct

SEQ ID NO: 130399 - DNA, 12 bp, Homo sapiens
ctaggagactgg

SEQ ID NO: 130400 - DNA, 15 bp, Homo sapiens
ctaggggaggagaga

SEQ ID NO: 130401 - DNA, 23 bp, Homo sapiens
ctaggtcatgaaggacactctgc

SEQ ID NO: 130402 - DNA, 11 bp, Homo sapiens
ctagtatatta

SEQ ID NO: 130403 - DNA, 14 bp, Homo sapiens
ctataataagtttt

SEQ ID NO: 130404 - DNA, 16 bp, Homo sapiens
ctataataagttttga

SEQ ID NO: 130405 - DNA, 18 bp, Homo sapiens
ctataataagttttgata

SEQ ID NO: 130406 - DNA, 16 bp, Homo sapiens
ctatatctgtttgtat

SEQ ID NO: 130407 - DNA, 18 bp, Homo sapiens
ctatatctgtttgtatat

SEQ ID NO: 130408 - DNA, 14 bp, Homo sapiens
ctatggcccagcca

SEQ ID NO: 130409 - DNA, 15 bp, Homo sapiens
gaagtctagaatcat

SEQ ID NO: 130410 - DNA, 18 bp, Homo sapiens
gaataaaaagtgaacttt

SEQ ID NO: 130411 - DNA, 19 bp, Homo sapiens
gaataaaaagtgaactttt

SEQ ID NO: 130412 - DNA, 23 bp, Homo sapiens
gaataaaaagtgaacttttgtaa

SEQ ID NO: 130413 - DNA, 20 bp, Homo sapiens
gaataaagttctgttttctg

SEQ ID NO: 130414 - DNA, 13 bp, Homo sapiens
gaatagaaagaaa

SEQ ID NO: 130415 - DNA, 15 bp, Homo sapiens
gaatagaaagaaagt

SEQ ID NO: 130416 - DNA, 17 bp, Homo sapiens
gaatagcctagatatga

SEQ ID NO: 130417 - DNA, 22 bp, Homo sapiens
gaatataagaaaagtaatgaag

SEQ ID NO: 130418 - DNA, 14 bp, Homo sapiens
gaatatatggcatt

SEQ ID NO: 130419 - DNA, 19 bp, Homo sapiens
gaatatatggcatttgcag

SEQ ID NO: 130420 - DNA, 23 bp, Homo sapiens
gaatatatggcatttgcagattt

SEQ ID NO: 130421 - DNA, 20 bp, Homo sapiens
gaatcatacttaacatttca

SEQ ID NO: 130422 - DNA, 14 bp, Homo sapiens
gaatgcattaaaaa

SEQ ID NO: 130423 - DNA, 16 bp, Homo sapiens
gaatgcattaaaaaaa

SEQ ID NO: 130424 - DNA, 22 bp, Homo sapiens
gaatgtgagtgtgtttgtgtgc

SEQ ID NO: 130425 - DNA, 15 bp, Homo sapiens
gaattaaaactgagt

SEQ ID NO: 130426 - DNA, 13 bp, Homo sapiens
gaattgttatgaa

SEQ ID NO: 130427 - DNA, 16 bp, Homo sapiens
gaattgttatgaaaat

SEQ ID NO: 130428 - DNA, 15 bp, Homo sapiens
gaatttaatggactg

SEQ ID NO: 130429 - DNA, 20 bp, Homo sapiens
gaatttaatggactgtgaat

SEQ ID NO: 130430 - DNA, 13 bp, Homo sapiens
gaatttattggca

SEQ ID NO: 130431 - DNA, 22 bp, Homo sapiens
gaatttattggcagccaaggaa

SEQ ID NO: 130432 - DNA, 12 bp, Homo sapiens
gacaaaaataac

SEQ ID NO: 130433 - DNA, 13 bp, Homo sapiens
gacaaaaataaca

SEQ ID NO: 130434 - DNA, 23 bp, Homo sapiens
gacaaacctagcttttaaaaaat

SEQ ID NO: 130435 - DNA, 17 bp, Homo sapiens
gacaaagactcctctgg

SEQ ID NO: 130436 - DNA, 14 bp, Homo sapiens
gacaattagcagaa

SEQ ID NO: 130437 - DNA, 16 bp, Homo sapiens
gacacattgactcctt

SEQ ID NO: 130438 - DNA, 15 bp, Homo sapiens
gacactaggagactg

SEQ ID NO: 130439 - DNA, 17 bp, Homo sapiens
gacactaggagactggt

SEQ ID NO: 130440 - DNA, 18 bp, Homo sapiens
gacagaaatgcaatctcc

SEQ ID NO: 130441 - DNA, 18 bp, Homo sapiens
gacagccctgcggagacc

SEQ ID NO: 130442 - DNA, 11 bp, Homo sapiens
gacagcctccc

SEQ ID NO: 130443 - DNA, 12 bp, Homo sapiens
gacataaaactt

SEQ ID NO: 130444 - DNA, 14 bp, Homo sapiens
gacataaaacttta

SEQ ID NO: 130445 - DNA, 18 bp, Homo sapiens
gacataaaactttaaaag

SEQ ID NO: 130446 - DNA, 17 bp, Homo sapiens
gacatgcccaaaactta

SEQ ID NO: 130447 - DNA, 16 bp, Homo sapiens
gacattcttttaatgc

SEQ ID NO: 130448 - DNA, 11 bp, Homo sapiens
gaccaggaggg

SEQ ID NO: 130449 - DNA, 19 bp, Homo sapiens
gaccaggagggagagcctc

SEQ ID NO: 130450 - DNA, 21 bp, Homo sapiens
gaccaggagggagagcctctg

SEQ ID NO: 130451 - DNA, 14 bp, Homo sapiens
gacccacagccctg

SEQ ID NO: 130452 - DNA, 10 bp, Homo sapiens
gaccccctca

SEQ ID NO: 130453 - DNA, 20 bp, Homo sapiens
gaccctgagtccgggaggca

SEQ ID NO: 130454 - DNA, 18 bp, Homo sapiens
gacctctgcaagaggggg

SEQ ID NO: 130455 - DNA, 19 bp, Homo sapiens
gacgtgaatgtctcagcga

SEQ ID NO: 130456 - DNA, 12 bp, Homo sapiens
gactcctctggg

SEQ ID NO: 130457 - DNA, 16 bp, Homo sapiens
gactcctctgggcctg

SEQ ID NO: 130458 - DNA, 21 bp, Homo sapiens
gactctgcagatagtgcctct

SEQ ID NO: 130459 - DNA, 23 bp, Homo sapiens
gactctgcagatagtgcctctgc

SEQ ID NO: 130460 - DNA, 13 bp, Homo sapiens
gactggctcaaga

SEQ ID NO: 130461 - DNA, 17 bp, Homo sapiens
gactgggcacccctgcc

SEQ ID NO: 130462 - DNA, 23 bp, Homo sapiens
gactgggcacccctgcctcctgc

SEQ ID NO: 130463 - DNA, 17 bp, Homo sapiens
gactggtttgtttgctt

SEQ ID NO: 130464 - DNA, 15 bp, Homo sapiens
gactgtcaaatgaac

SEQ ID NO: 130465 - DNA, 17 bp, Homo sapiens
gactgtcaaatgaactt

SEQ ID NO: 130466 - DNA, 18 bp, Homo sapiens
gactgtcaaatgaacttt

SEQ ID NO: 130467 - DNA, 14 bp, Homo sapiens
gactgtgaatttca

SEQ ID NO: 130468 - DNA, 18 bp, Homo sapiens
gactgtgaatttcaaaaa

SEQ ID NO: 130469 - DNA, 19 bp, Homo sapiens
gactgtgaatttcaaaaaa

SEQ ID NO: 130470 - DNA, 15 bp, Homo sapiens
gactgtttcacattg

SEQ ID NO: 130471 - DNA, 16 bp, Homo sapiens
gacttcactgcagcct

SEQ ID NO: 130472 - DNA, 19 bp, Homo sapiens
gacttcactgcagcctttc

SEQ ID NO: 130473 - DNA, 11 bp, Homo sapiens
gagaaactgag

SEQ ID NO: 130474 - DNA, 18 bp, Homo sapiens
gagaaagaaaaggcaaaa

SEQ ID NO: 130475 - DNA, 19 bp, Homo sapiens
gagaaagaaaaggcaaaag

SEQ ID NO: 130476 - DNA, 23 bp, Homo sapiens
gagaagaatagcctagatatgaa

SEQ ID NO: 130477 - DNA, 14 bp, Homo sapiens
gagaatgaactgtg

SEQ ID NO: 130478 - DNA, 14 bp, Homo sapiens
gagacaataaacag

SEQ ID NO: 130479 - DNA, 18 bp, Homo sapiens
gagacaattagcagaatg

SEQ ID NO: 130480 - DNA, 15 bp, Homo sapiens
gagacccacagccct

SEQ ID NO: 130481 - DNA, 17 bp, Homo sapiens
gagacccacagccctga

SEQ ID NO: 130482 - DNA, 20 bp, Homo sapiens
gagacccacagccctgaaac

SEQ ID NO: 130483 - DNA, 21 bp, Homo sapiens
gagactcagaggacccacctg

SEQ ID NO: 130484 - DNA, 18 bp, Homo sapiens
gagactgggcacccctgc

SEQ ID NO: 130485 - DNA, 19 bp, Homo sapiens
gagactgggcacccctgcc

SEQ ID NO: 130486 - DNA, 20 bp, Homo sapiens
gagactttctttctgtaggt

SEQ ID NO: 130487 - DNA, 16 bp, Homo sapiens
gagagaccacacattt

SEQ ID NO: 130488 - DNA, 14 bp, Homo sapiens
gagagcctctgttt

SEQ ID NO: 130489 - DNA, 19 bp, Homo sapiens
gagaggagaaactgagaaa

SEQ ID NO: 130490 - DNA, 15 bp, Homo sapiens
gagaggcctcggctg

SEQ ID NO: 130491 - DNA, 21 bp, Homo sapiens
gagagggtctccagtgttccc

SEQ ID NO: 130492 - DNA, 18 bp, Homo sapiens
gagattgggagacaatta

SEQ ID NO: 130493 - DNA, 20 bp, Homo sapiens
gagcaaaatcaacatgactg

SEQ ID NO: 130494 - DNA, 15 bp, Homo sapiens
gagcaagagaacatt

SEQ ID NO: 130495 - DNA, 19 bp, Homo sapiens
gagcagcccacccagcaga

SEQ ID NO: 130496 - DNA, 17 bp, Homo sapiens
gagcaggggtctgagcc

SEQ ID NO: 130497 - DNA, 17 bp, Homo sapiens
ctgattccctctcccac

SEQ ID NO: 130498 - DNA, 19 bp, Homo sapiens
ctgattccctctcccaccc

SEQ ID NO: 130499 - DNA, 12 bp, Homo sapiens
ctgatttctcac

SEQ ID NO: 130500 - DNA, 13 bp, Homo sapiens
ctgcaaaattaaa

SEQ ID NO: 130501 - DNA, 19 bp, Homo sapiens
ctgcaaaattaaatctaga

SEQ ID NO: 130502 - DNA, 19 bp, Homo sapiens
ctgcaaacccatgaagctg

SEQ ID NO: 130503 - DNA, 22 bp, Homo sapiens
ctgcaaacccatgaagctggcc

SEQ ID NO: 130504 - DNA, 17 bp, Homo sapiens
ctgcaagaattaaaact

SEQ ID NO: 130505 - DNA, 18 bp, Homo sapiens
ctgcacagaagggctctt

SEQ ID NO: 130506 - DNA, 20 bp, Homo sapiens
ctgcagcctttgcctccccg

SEQ ID NO: 130507 - DNA, 14 bp, Homo sapiens
ctgcagcttggaga

SEQ ID NO: 130508 - DNA, 16 bp, Homo sapiens
ctgcagggtgaagcac

SEQ ID NO: 130509 - DNA, 21 bp, Homo sapiens
ctgcaggtccggggaggaggt

SEQ ID NO: 130510 - DNA, 12 bp, Homo sapiens
ctgcatcttcag

SEQ ID NO: 130511 - DNA, 17 bp, Homo sapiens
gaggactgaagctgggg

SEQ ID NO: 130512 - DNA, 21 bp, Homo sapiens
gaggactgaagctggggcttg

SEQ ID NO: 130513 - DNA, 13 bp, Homo sapiens
gaggagactgggc

SEQ ID NO: 130514 - DNA, 17 bp, Homo sapiens
gaggccgctgcccctga

SEQ ID NO: 130515 - DNA, 18 bp, Homo sapiens
gaggctccgtgagccctt

SEQ ID NO: 130516 - DNA, 21 bp, Homo sapiens
gaggctccgtgagcccttggt

SEQ ID NO: 130517 - DNA, 16 bp, Homo sapiens
gagggagagcctctgt

SEQ ID NO: 130518 - DNA, 22 bp, Homo sapiens
gagggccgagacaggagcagcc

SEQ ID NO: 130519 - DNA, 18 bp, Homo sapiens
gaggtaactatcaatatt

SEQ ID NO: 130520 - DNA, 15 bp, Homo sapiens
gaggtggagtggcca

SEQ ID NO: 130521 - DNA, 21 bp, Homo sapiens
gaggtggccctcccaggctgg

SEQ ID NO: 130522 - DNA, 13 bp, Homo sapiens
gagtatttttgta

SEQ ID NO: 130523 - DNA, 13 bp, Homo sapiens
gagtccatgaaaa

SEQ ID NO: 130524 - DNA, 15 bp, Homo sapiens
gagtccatgaaaata

SEQ ID NO: 130525 - DNA, 17 bp, Homo sapiens
gagtccatgaaaatacc

SEQ ID NO: 130526 - DNA, 18 bp, Homo sapiens
gagtctttgtgtgttata

SEQ ID NO: 130527 - DNA, 13 bp, Homo sapiens
gagtgaaacagag

SEQ ID NO: 130528 - DNA, 15 bp, Homo sapiens
gagtgtaaataattt

SEQ ID NO: 130529 - DNA, 19 bp, Homo sapiens
gagtgtaaataattttaaa

SEQ ID NO: 130530 - DNA, 17 bp, Homo sapiens
gagtttacagtttgtgt

SEQ ID NO: 130531 - DNA, 16 bp, Homo sapiens
gagtttttaatagaac

SEQ ID NO: 130532 - DNA, 23 bp, Homo sapiens
gatactccgctgtcggcacattc

SEQ ID NO: 130533 - DNA, 17 bp, Homo sapiens
gatataatcttggcttc

SEQ ID NO: 130534 - DNA, 16 bp, Homo sapiens
gatataggataaaata

SEQ ID NO: 130535 - DNA, 16 bp, Homo sapiens
gatatatgtgtataca

SEQ ID NO: 130536 - DNA, 21 bp, Homo sapiens
gatatggcttaggaatgactt

SEQ ID NO: 130537 - DNA, 22 bp, Homo sapiens
gatcaccccagcccccacagcc

SEQ ID NO: 130538 - DNA, 18 bp, Homo sapiens
gatccacctgtctcagcc

SEQ ID NO: 130539 - DNA, 22 bp, Homo sapiens
gatcccccaagtgtcctggacc

SEQ ID NO: 130540 - DNA, 23 bp, Homo sapiens
gatcccccaagtgtcctggaccc

SEQ ID NO: 130541 - DNA, 20 bp, Homo sapiens
gatcccctctctgtggctcc

SEQ ID NO: 130542 - DNA, 21 bp, Homo sapiens
gatcccctctctgtggctcca

SEQ ID NO: 130543 - DNA, 19 bp, Homo sapiens
gatcttggcttactgcagc

SEQ ID NO: 130544 - DNA, 15 bp, Homo sapiens
gatgatggaaacgca

SEQ ID NO: 130545 - DNA, 22 bp, Homo sapiens
gatgcccaccgaggagccccag

SEQ ID NO: 130546 - DNA, 16 bp, Homo sapiens
gatggaaacgcactta

SEQ ID NO: 130547 - DNA, 21 bp, Homo sapiens
gatggccgcagggctgtgcac

SEQ ID NO: 130548 - DNA, 20 bp, Homo sapiens
gattacctcctgtgtggaag

SEQ ID NO: 130549 - DNA, 21 bp, Homo sapiens
gattatatatcataaagtatg

SEQ ID NO: 130550 - DNA, 19 bp, Homo sapiens
gattattctgattccactt

SEQ ID NO: 130551 - DNA, 17 bp, Homo sapiens
gattgattcagtatctt

SEQ ID NO: 130552 - DNA, 16 bp, Homo sapiens
gatttcatccttgaat

SEQ ID NO: 130553 - DNA, 21 bp, Homo sapiens
gattttttttgtaacttcaaa

SEQ ID NO: 130554 - DNA, 10 bp, Homo sapiens
gcaaaagact

SEQ ID NO: 130555 - DNA, 12 bp, Homo sapiens
gcaaaattaaat

SEQ ID NO: 130556 - DNA, 15 bp, Homo sapiens
gcaaaattaaatcta

SEQ ID NO: 130557 - DNA, 20 bp, Homo sapiens
gcaaacccatgaagctggcc

SEQ ID NO: 130558 - DNA, 14 bp, Homo sapiens
gcaaaccctttgta

SEQ ID NO: 130559 - DNA, 14 bp, Homo sapiens
gcaaagttatattt

SEQ ID NO: 130560 - DNA, 17 bp, Homo sapiens
gcaaatttctataaatt

SEQ ID NO: 130561 - DNA, 18 bp, Homo sapiens
gcaaatttctataaattt

SEQ ID NO: 130562 - DNA, 13 bp, Homo sapiens
gcaagaattaaaa

SEQ ID NO: 130563 - DNA, 18 bp, Homo sapiens
gcaagacttcactgcagc

SEQ ID NO: 130564 - DNA, 20 bp, Homo sapiens
gcaagacttcactgcagcct

SEQ ID NO: 130565 - DNA, 23 bp, Homo sapiens
gcaagacttcactgcagcctttc

SEQ ID NO: 130566 - DNA, 21 bp, Homo sapiens
gcaaggttgtagtcaagaggt

SEQ ID NO: 130567 - DNA, 22 bp, Homo sapiens
gcacaacgctctaccctgcagc

SEQ ID NO: 130568 - DNA, 23 bp, Homo sapiens
gcacaacgctctaccctgcagct

SEQ ID NO: 130569 - DNA, 11 bp, Homo sapiens
gcacagcccag

SEQ ID NO: 130570 - DNA, 13 bp, Homo sapiens
gcacatctgcatt

SEQ ID NO: 130571 - DNA, 13 bp, Homo sapiens
gcaccagggagag

SEQ ID NO: 130572 - DNA, 14 bp, Homo sapiens
gcaccagggagagg

SEQ ID NO: 130573 - DNA, 18 bp, Homo sapiens
gcaccagggagaggcctc

SEQ ID NO: 130574 - DNA, 14 bp, Homo sapiens
gcacccctgcctcc

SEQ ID NO: 130575 - DNA, 14 bp, Homo sapiens
gcacctatggccca

SEQ ID NO: 130576 - DNA, 18 bp, Homo sapiens
gcacctatggcccagcca

SEQ ID NO: 130577 - DNA, 20 bp, Homo sapiens
gcacctatggcccagccact

SEQ ID NO: 130578 - DNA, 23 bp, Homo sapiens
gcacctatggcccagccactgca

SEQ ID NO: 130579 - DNA, 20 bp, Homo sapiens
gcacgcgccctttctaccat

SEQ ID NO: 130580 - DNA, 17 bp, Homo sapiens
gcactctaattagagaa

SEQ ID NO: 130581 - DNA, 23 bp, Homo sapiens
gcactctaattagagaactggag

SEQ ID NO: 130582 - DNA, 12 bp, Homo sapiens
gcacttacaagt

SEQ ID NO: 130583 - DNA, 17 bp, Homo sapiens
gcactttgtagtgtttg

SEQ ID NO: 130584 - DNA, 18 bp, Homo sapiens
gcagaatggagaaagtaa

SEQ ID NO: 130585 - DNA, 15 bp, Homo sapiens
gcagatctttttgtg

SEQ ID NO: 130586 - DNA, 23 bp, Homo sapiens
gcagatttttatattagttgctt

SEQ ID NO: 130587 - DNA, 14 bp, Homo sapiens
gcagcacagcccag

SEQ ID NO: 130588 - DNA, 16 bp, Homo sapiens
gcagcacagcccaggg

SEQ ID NO: 130589 - DNA, 13 bp, Homo sapiens
gcagcacaggagg

SEQ ID NO: 130590 - DNA, 18 bp, Homo sapiens
gcagcacaggaggctccg

SEQ ID NO: 130591 - DNA, 12 bp, Homo sapiens
gcagccaaggaa

SEQ ID NO: 130592 - DNA, 16 bp, Homo sapiens
gcagccacaccgctgg

SEQ ID NO: 130593 - DNA, 20 bp, Homo sapiens
gcagccacaccgctggctcc

SEQ ID NO: 130594 - DNA, 21 bp, Homo sapiens
gcagcttggagaactccgctg

SEQ ID NO: 130595 - DNA, 14 bp, Homo sapiens
gcaggcccagtgac

SEQ ID NO: 130596 - DNA, 13 bp, Homo sapiens
gcagggcctggcg

SEQ ID NO: 130597 - DNA, 14 bp, Homo sapiens
gcaggtctttaaat

SEQ ID NO: 130598 - DNA, 19 bp, Homo sapiens
gcaggttgaatgggttctc

SEQ ID NO: 130599 - DNA, 22 bp, Homo sapiens
gcatcttcagtcgtctgtccca

SEQ ID NO: 130600 - DNA, 17 bp, Homo sapiens
gaaacatgtgcccctgc

SEQ ID NO: 130601 - DNA, 19 bp, Homo sapiens
gaaacgtgttgtatctaca

SEQ ID NO: 130602 - DNA, 14 bp, Homo sapiens
gaaactaaacagaa

SEQ ID NO: 130603 - DNA, 13 bp, Homo sapiens
gaaagaaaaggca

SEQ ID NO: 130604 - DNA, 14 bp, Homo sapiens
gaaagaaaaggcaa

SEQ ID NO: 130605 - DNA, 15 bp, Homo sapiens
gaaagaaaaggcaaa

SEQ ID NO: 130606 - DNA, 14 bp, Homo sapiens
gaaagaatagaaag

SEQ ID NO: 130607 - DNA, 17 bp, Homo sapiens
gaaagagaatgaactgt

SEQ ID NO: 130608 - DNA, 21 bp, Homo sapiens
gaaagagaatgaactgtggaa

SEQ ID NO: 130609 - DNA, 16 bp, Homo sapiens
gaaagtattcagaaat

SEQ ID NO: 130610 - DNA, 20 bp, Homo sapiens
gaaagtattcagaaattaaa

SEQ ID NO: 130611 - DNA, 18 bp, Homo sapiens
gaaatcagcatgacaaaa

SEQ ID NO: 130612 - DNA, 18 bp, Homo sapiens
gcatttcatgctatcaga

SEQ ID NO: 130613 - DNA, 23 bp, Homo sapiens
gcatttcatgctatcagaaacag

SEQ ID NO: 130614 - DNA, 21 bp, Homo sapiens
gccaaaacaatgcccgtaaga

SEQ ID NO: 130615 - DNA, 21 bp, Homo sapiens
gccaacaggtagcatagctct

SEQ ID NO: 130616 - DNA, 23 bp, Homo sapiens
gccaaggtttcccagtgagcctc

SEQ ID NO: 130617 - DNA, 17 bp, Homo sapiens
gccacatacttgcagct

SEQ ID NO: 130618 - DNA, 23 bp, Homo sapiens
gccacatgggaggaaggcccagg

SEQ ID NO: 130619 - DNA, 11 bp, Homo sapiens
gccacattttg

SEQ ID NO: 130620 - DNA, 21 bp, Homo sapiens
gccactggcacttgcctgctg

SEQ ID NO: 130621 - DNA, 15 bp, Homo sapiens
gccaggtgaggtcca

SEQ ID NO: 130622 - DNA, 16 bp, Homo sapiens
gccaggtgaggtccac

SEQ ID NO: 130623 - DNA, 19 bp, Homo sapiens
gccataattatgaaaactc

SEQ ID NO: 130624 - DNA, 22 bp, Homo sapiens
gccatgtgcacctatggcccag

SEQ ID NO: 130625 - DNA, 19 bp, Homo sapiens
gcccaaacaccctcctggc

SEQ ID NO: 130626 - DNA, 20 bp, Homo sapiens
gcccaaacaccctcctggca

SEQ ID NO: 130627 - DNA, 21 bp, Homo sapiens
gcccacaaactgatttctcac

SEQ ID NO: 130628 - DNA, 13 bp, Homo sapiens
gcccaccgaggag

SEQ ID NO: 130629 - DNA, 15 bp, Homo sapiens
gcccaccgaggagcc

SEQ ID NO: 130630 - DNA, 16 bp, Homo sapiens
gcccaccgaggagccc

SEQ ID NO: 130631 - DNA, 17 bp, Homo sapiens
gcccaccgaggagcccc

SEQ ID NO: 130632 - DNA, 22 bp, Homo sapiens
gcccaccgaggagccccagccc

SEQ ID NO: 130633 - DNA, 17 bp, Homo sapiens
gcccagccaaaccctgt

SEQ ID NO: 130634 - DNA, 20 bp, Homo sapiens
gcccagccaaaccctgtctg

SEQ ID NO: 130635 - DNA, 17 bp, Homo sapiens
gcccagccactgcagca

SEQ ID NO: 130636 - DNA, 15 bp, Homo sapiens
gcccagcctgctcag

SEQ ID NO: 130637 - DNA, 17 bp, Homo sapiens
gcccagttggaggagac

SEQ ID NO: 130638 - DNA, 13 bp, Homo sapiens
gccccacccagag

SEQ ID NO: 130639 - DNA, 14 bp, Homo sapiens
gccccacccagagg

SEQ ID NO: 130640 - DNA, 22 bp, Homo sapiens
gccccagccccaatccagagaa

SEQ ID NO: 130641 - DNA, 15 bp, Homo sapiens
gcccccacagccctg

SEQ ID NO: 130642 - DNA, 13 bp, Homo sapiens
gcccccaggccag

SEQ ID NO: 130643 - DNA, 13 bp, Homo sapiens
gccccctccctgc

SEQ ID NO: 130644 - DNA, 20 bp, Homo sapiens
gccccctccctgctcccagc

SEQ ID NO: 130645 - DNA, 15 bp, Homo sapiens
gccccgtcccagagg

SEQ ID NO: 130646 - DNA, 15 bp, Homo sapiens
gcccctccacgtgat

SEQ ID NO: 130647 - DNA, 19 bp, Homo sapiens
gcccctccccaaaagaaac

SEQ ID NO: 130648 - DNA, 13 bp, Homo sapiens
gccctccacccac

SEQ ID NO: 130649 - DNA, 14 bp, Homo sapiens
gccctccacccact

SEQ ID NO: 130650 - DNA, 17 bp, Homo sapiens
gccctccacccactagg

SEQ ID NO: 130651 - DNA, 19 bp, Homo sapiens
gccctcggtggctgcacag

SEQ ID NO: 130652 - DNA, 19 bp, Homo sapiens
gccctgttgggggcttcag

SEQ ID NO: 130653 - DNA, 23 bp, Homo sapiens
gcccttaaggatcaccccagccc

SEQ ID NO: 130654 - DNA, 17 bp, Homo sapiens
gcccttctaccccacct

SEQ ID NO: 130655 - DNA, 18 bp, Homo sapiens
gcccttctaccccacctg

SEQ ID NO: 130656 - DNA, 22 bp, Homo sapiens
gcccttctaccccacctgacct

SEQ ID NO: 130657 - DNA, 14 bp, Homo sapiens
gccgctgcccctga

SEQ ID NO: 130658 - DNA, 15 bp, Homo sapiens
gccgctgcccctgag

SEQ ID NO: 130659 - DNA, 21 bp, Homo sapiens
gccggagacccacagccctga

SEQ ID NO: 130660 - DNA, 12 bp, Homo sapiens
gcctcccacccc

SEQ ID NO: 130661 - DNA, 17 bp, Homo sapiens
gcctcccacccccatct

SEQ ID NO: 130662 - DNA, 19 bp, Homo sapiens
gcctcccgccaccctgtct

SEQ ID NO: 130663 - DNA, 21 bp, Homo sapiens
gcctcccgccaccctgtctca

SEQ ID NO: 130664 - DNA, 18 bp, Homo sapiens
gcctcgacgtcccttgga

SEQ ID NO: 130665 - DNA, 22 bp, Homo sapiens
gcctctgcgcctctccactgtt

SEQ ID NO: 130666 - DNA, 14 bp, Homo sapiens
gcctctggaggcct

SEQ ID NO: 130667 - DNA, 17 bp, Homo sapiens
gcctctggaggcctctg

SEQ ID NO: 130668 - DNA, 20 bp, Homo sapiens
gcctctggaggcctctggcc

SEQ ID NO: 130669 - DNA, 22 bp, Homo sapiens
gcctctgttttgtaaactaagg

SEQ ID NO: 130670 - DNA, 20 bp, Homo sapiens
gcctgcccagttggaggaga

SEQ ID NO: 130671 - DNA, 22 bp, Homo sapiens
gcctgccccacccaccccacag

SEQ ID NO: 130672 - DNA, 23 bp, Homo sapiens
gcctgccccacccaccccacaga

SEQ ID NO: 130673 - DNA, 17 bp, Homo sapiens
gcctggcggaggtggag

SEQ ID NO: 130674 - DNA, 17 bp, Homo sapiens
gccttggcatgggcgca

SEQ ID NO: 130675 - DNA, 19 bp, Homo sapiens
gccttggcatgggcgcagg

SEQ ID NO: 130676 - DNA, 24 bp, Homo sapiens
gccttggcatgggcgcaggcccag

SEQ ID NO: 130677 - DNA, 22 bp, Homo sapiens
gcctttcacaggactctgcaga

SEQ ID NO: 130678 - DNA, 16 bp, Homo sapiens
gcgatccacctgtctc

SEQ ID NO: 130679 - DNA, 17 bp, Homo sapiens
gcgatccacctgtctca

SEQ ID NO: 130680 - DNA, 15 bp, Homo sapiens
gcgcaggcccagtga

SEQ ID NO: 130681 - DNA, 16 bp, Homo sapiens
gcgcctctccactgtt

SEQ ID NO: 130682 - DNA, 16 bp, Homo sapiens
gcgctgttgatcccct

SEQ ID NO: 130683 - DNA, 18 bp, Homo sapiens
gcgctgttgcccgccctc

SEQ ID NO: 130684 - DNA, 14 bp, Homo sapiens
gcgggccaggcagg

SEQ ID NO: 130685 - DNA, 15 bp, Homo sapiens
gcgggccaggcaggc

SEQ ID NO: 130686 - DNA, 12 bp, Homo sapiens
gctaaaagaaga

SEQ ID NO: 130687 - DNA, 18 bp, Homo sapiens
gctaaaagtgcatttaag

SEQ ID NO: 130688 - DNA, 22 bp, Homo sapiens
gctaaaagtgcatttaaggaga

SEQ ID NO: 130689 - DNA, 18 bp, Homo sapiens
gctacaaggtaggctgca

SEQ ID NO: 130690 - DNA, 20 bp, Homo sapiens
gctacttatcatttttgtat

SEQ ID NO: 130691 - DNA, 14 bp, Homo sapiens
gctatcagaaacag

SEQ ID NO: 130692 - DNA, 22 bp, Homo sapiens
gctcaggcgatccacctgtctc

SEQ ID NO: 130693 - DNA, 24 bp, Homo sapiens
gctcaggcgatccacctgtctcag

SEQ ID NO: 130694 - DNA, 15 bp, Homo sapiens
gctcaggtgcaagtg

SEQ ID NO: 130695 - DNA, 20 bp, Homo sapiens
gctccaggcatcactgattc

SEQ ID NO: 130696 - DNA, 15 bp, Homo sapiens
gctccatgcctctgg

SEQ ID NO: 130697 - DNA, 15 bp, Homo sapiens
gctcccagctctctc

SEQ ID NO: 130698 - DNA, 14 bp, Homo sapiens
gctccctgaccccc

SEQ ID NO: 130699 - DNA, 16 bp, Homo sapiens
gctccctgaccccctg

SEQ ID NO: 130700 - DNA, 19 bp, Homo sapiens
gctccctgaccccctgtcc

SEQ ID NO: 130701 - DNA, 17 bp, Homo sapiens
gctccgtgagcccttgg

SEQ ID NO: 130702 - DNA, 20 bp, Homo sapiens
gctgacggtttctccccgga

SEQ ID NO: 130703 - DNA, 17 bp, Homo sapiens
gctgagctgggcccagc

SEQ ID NO: 130704 - DNA, 21 bp, Homo sapiens
gctgcaaacccatgaagctgg

SEQ ID NO: 130705 - DNA, 23 bp, Homo sapiens
gctgcaaacccatgaagctggcc

SEQ ID NO: 130706 - DNA, 20 bp, Homo sapiens
gctgcacagaagggctcttt

SEQ ID NO: 130707 - DNA, 19 bp, Homo sapiens
gctgcttggagtgccccaa

SEQ ID NO: 130708 - DNA, 13 bp, Homo sapiens
gctggaagggtca

SEQ ID NO: 130709 - DNA, 14 bp, Homo sapiens
gctggcccagccaa

SEQ ID NO: 130710 - DNA, 21 bp, Homo sapiens
gctggccctcagctccctgac

SEQ ID NO: 130711 - DNA, 15 bp, Homo sapiens
gctgggcagggcctg

SEQ ID NO: 130712 - DNA, 12 bp, Homo sapiens
gctgggcccagc

SEQ ID NO: 130713 - DNA, 15 bp, Homo sapiens
gctgagctgggccca

SEQ ID NO: 130714 - DNA, 14 bp, Homo sapiens
gctgcaaaattaaa

SEQ ID NO: 130715 - DNA, 15 bp, Homo sapiens
gctgcccctgagttc

SEQ ID NO: 130716 - DNA, 13 bp, Homo sapiens
gctggccctcagc

SEQ ID NO: 130717 - DNA, 14 bp, Homo sapiens
gctggccctcagct

SEQ ID NO: 130718 - DNA, 16 bp, Homo sapiens
gctggccctcagctcc

SEQ ID NO: 130719 - DNA, 20 bp, Homo sapiens
gctggccctcagctccctga

SEQ ID NO: 130720 - DNA, 17 bp, Homo sapiens
gctgggcccagcccctc

SEQ ID NO: 130721 - DNA, 13 bp, Homo sapiens
gctgtccctcact

SEQ ID NO: 130722 - DNA, 18 bp, Homo sapiens
gctgtccttgaatgccat

SEQ ID NO: 130723 - DNA, 12 bp, Homo sapiens
gctgtctcctgt

SEQ ID NO: 130724 - DNA, 21 bp, Homo sapiens
gctgttaaccacccgccccgc

SEQ ID NO: 130725 - DNA, 22 bp, Homo sapiens
gctgttgatcccctctctgtgg

SEQ ID NO: 130726 - DNA, 21 bp, Homo sapiens
gcttaaggagaggagaaactg

SEQ ID NO: 130727 - DNA, 23 bp, Homo sapiens
gcttaaggagaggagaaactgag

SEQ ID NO: 130728 - DNA, 16 bp, Homo sapiens
gcttctctcttttaaa

SEQ ID NO: 130729 - DNA, 19 bp, Homo sapiens
gcttctctcttttaaagta

SEQ ID NO: 130730 - DNA, 16 bp, Homo sapiens
gcttcttaaaaactgt

SEQ ID NO: 130731 - DNA, 20 bp, Homo sapiens
gcttcttaaaaactgtgtat

SEQ ID NO: 130732 - DNA, 21 bp, Homo sapiens
gcttcttaaaaactgtgtatc

SEQ ID NO: 130733 - DNA, 18 bp, Homo sapiens
gcttgttccaatgccaca

SEQ ID NO: 130734 - DNA, 19 bp, Homo sapiens
gctttcagatgcagttttc

SEQ ID NO: 130735 - DNA, 21 bp, Homo sapiens
gctttcagatgcagttttcaa

SEQ ID NO: 130736 - DNA, 14 bp, Homo sapiens
gctttgagaagaat

SEQ ID NO: 130737 - DNA, 15 bp, Homo sapiens
gcttttaaaaaatat

SEQ ID NO: 130738 - DNA, 22 bp, Homo sapiens
gcttttaaaaaatattttaaga

SEQ ID NO: 130739 - DNA, 14 bp, Homo sapiens
ggaaaagtgcaatg

SEQ ID NO: 130740 - DNA, 16 bp, Homo sapiens
ggaaaattgaaagtat

SEQ ID NO: 130741 - DNA, 14 bp, Homo sapiens
ggaaacgcacttac

SEQ ID NO: 130742 - DNA, 21 bp, Homo sapiens
ggaaaggatgatcaaaaataa

SEQ ID NO: 130743 - DNA, 15 bp, Homo sapiens
ggaagacataaaact

SEQ ID NO: 130744 - DNA, 23 bp, Homo sapiens
ggaagacataaaactttaaaagg

SEQ ID NO: 130745 - DNA, 23 bp, Homo sapiens
ggaagctgctgaggcccccaagt

SEQ ID NO: 130746 - DNA, 22 bp, Homo sapiens
ggaatataagaaaagtaatgaa

SEQ ID NO: 130747 - DNA, 14 bp, Homo sapiens
ggacactaggagac

SEQ ID NO: 130748 - DNA, 15 bp, Homo sapiens
ggacactaggagact

SEQ ID NO: 130749 - DNA, 16 bp, Homo sapiens
ggacactaggagactg

SEQ ID NO: 130750 - DNA, 17 bp, Homo sapiens
ggaccccctcaggattg

SEQ ID NO: 130751 - DNA, 22 bp, Homo sapiens
ggactctgcagatagtgcctct

SEQ ID NO: 130752 - DNA, 24 bp, Homo sapiens
ggactctgcagatagtgcctctgc

SEQ ID NO: 130753 - DNA, 18 bp, Homo sapiens
ggactgggggcgggactg

SEQ ID NO: 130754 - DNA, 18 bp, Homo sapiens
ggagacccacagccctga

SEQ ID NO: 130755 - DNA, 21 bp, Homo sapiens
ggagagagggtctccagtgtt

SEQ ID NO: 130756 - DNA, 20 bp, Homo sapiens
ggagcagcccacccagcaga

SEQ ID NO: 130757 - DNA, 15 bp, Homo sapiens
ggaggaaggcccagg

SEQ ID NO: 130758 - DNA, 18 bp, Homo sapiens
ggaggaaggcccaggggt

SEQ ID NO: 130759 - DNA, 24 bp, Homo sapiens
ggaggagggccgagacaggagcag

SEQ ID NO: 130760 - DNA, 16 bp, Homo sapiens
ggaggcctctggccct

SEQ ID NO: 130761 - DNA, 17 bp, Homo sapiens
ggaggcctctggccctc

SEQ ID NO: 130762 - DNA, 17 bp, Homo sapiens
ggaggctccgtgagccc

SEQ ID NO: 130763 - DNA, 19 bp, Homo sapiens
ggaggctccgtgagccctt

SEQ ID NO: 130764 - DNA, 13 bp, Homo sapiens
ggagggagagcct

SEQ ID NO: 130765 - DNA, 14 bp, Homo sapiens
ggagggaggagggc

SEQ ID NO: 130766 - DNA, 15 bp, Homo sapiens
ggagggccgagacag

SEQ ID NO: 130767 - DNA, 22 bp, Homo sapiens
ggagtgaaacagagaaagaaaa

SEQ ID NO: 130768 - DNA, 18 bp, Homo sapiens
ggagtgccccaaggaggt

SEQ ID NO: 130769 - DNA, 20 bp, Homo sapiens
ggatggccgcagggctgtgc

SEQ ID NO: 130770 - DNA, 20 bp, Homo sapiens
ggatggcctgcagccacatg

SEQ ID NO: 130771 - DNA, 16 bp, Homo sapiens
ggcaactcaaagatga

SEQ ID NO: 130772 - DNA, 21 bp, Homo sapiens
ggcacaacgctctaccctgca

SEQ ID NO: 130773 - DNA, 14 bp, Homo sapiens
ggcaccgggctcca

SEQ ID NO: 130774 - DNA, 15 bp, Homo sapiens
ggcagcacagcccag

SEQ ID NO: 130775 - DNA, 16 bp, Homo sapiens
ggcagcacagcccagg

SEQ ID NO: 130776 - DNA, 18 bp, Homo sapiens
ggcagcacagcccagggc

SEQ ID NO: 130777 - DNA, 20 bp, Homo sapiens
ggcagcacagcccagggcct

SEQ ID NO: 130778 - DNA, 15 bp, Homo sapiens
ggcagccaaggaatg

SEQ ID NO: 130779 - DNA, 16 bp, Homo sapiens
ggcatgggcgcaggcc

SEQ ID NO: 130780 - DNA, 19 bp, Homo sapiens
ggcatgggcgcaggcccag

SEQ ID NO: 130781 - DNA, 17 bp, Homo sapiens
ggccacacaagtgcagt

SEQ ID NO: 130782 - DNA, 14 bp, Homo sapiens
ggccactcctcttc

SEQ ID NO: 130783 - DNA, 16 bp, Homo sapiens
ggccactcctcttcac

SEQ ID NO: 130784 - DNA, 19 bp, Homo sapiens
ggccactggcacttgcctg

SEQ ID NO: 130785 - DNA, 17 bp, Homo sapiens
ggcccatggggtctctg

SEQ ID NO: 130786 - DNA, 13 bp, Homo sapiens
ggccctagaggac

SEQ ID NO: 130787 - DNA, 14 bp, Homo sapiens
ggccctcccaggct

SEQ ID NO: 130788 - DNA, 15 bp, Homo sapiens
ggcccttggaataaa

SEQ ID NO: 130789 - DNA, 17 bp, Homo sapiens
ggcccttggaataaagt

SEQ ID NO: 130790 - DNA, 14 bp, Homo sapiens
ggccgctgcccctg

SEQ ID NO: 130791 - DNA, 19 bp, Homo sapiens
ggccgggggcggggccggg

SEQ ID NO: 130792 - DNA, 21 bp, Homo sapiens
ggcctcggctgtctcctgtcc

SEQ ID NO: 130793 - DNA, 14 bp, Homo sapiens
ggcctctggccctc

SEQ ID NO: 130794 - DNA, 15 bp, Homo sapiens
ggcctctggccctcg

SEQ ID NO: 130795 - DNA, 18 bp, Homo sapiens
ggcctgcagccacatggg

SEQ ID NO: 130796 - DNA, 24 bp, Homo sapiens
ggcctggggtgcatcctcctcagc

SEQ ID NO: 130797 - DNA, 22 bp, Homo sapiens
ggcctgtaatcagctctcctgg

SEQ ID NO: 130798 - DNA, 23 bp, Homo sapiens
ggcctgtaatcagctctcctggc

SEQ ID NO: 130799 - DNA, 18 bp, Homo sapiens
ggcgatccacctgtctca

SEQ ID NO: 130800 - DNA, 17 bp, Homo sapiens
ggcgcaggcccagtgac

SEQ ID NO: 130801 - DNA, 16 bp, Homo sapiens
ggcgcttcccacctgc

SEQ ID NO: 130802 - DNA, 13 bp, Homo sapiens
ggcggggccggga

SEQ ID NO: 130803 - DNA, 19 bp, Homo sapiens
ggctcaagaattagggccc

SEQ ID NO: 130804 - DNA, 23 bp, Homo sapiens
ggctccaacccgttgggtccctt

SEQ ID NO: 130805 - DNA, 14 bp, Homo sapiens
ggcgcaggcccagt

SEQ ID NO: 130806 - DNA, 22 bp, Homo sapiens
ggctccctcccgtagtctcctg

SEQ ID NO: 130807 - DNA, 15 bp, Homo sapiens
ggctccgtgagccct

SEQ ID NO: 130808 - DNA, 19 bp, Homo sapiens
ggctggagtggagtggcgt

SEQ ID NO: 130809 - DNA, 12 bp, Homo sapiens
ggctgggcaggg

SEQ ID NO: 130810 - DNA, 13 bp, Homo sapiens
ggctgtctcctgt

SEQ ID NO: 130811 - DNA, 19 bp, Homo sapiens
ggctgtctcctgtccccgg

SEQ ID NO: 130812 - DNA, 18 bp, Homo sapiens
ggcttatttttaaaataa

SEQ ID NO: 130813 - DNA, 21 bp, Homo sapiens
ggcttatttttaaaataaaaa

SEQ ID NO: 130814 - DNA, 21 bp, Homo sapiens
gaaggttttttttttaagtgc

SEQ ID NO: 130815 - DNA, 23 bp, Homo sapiens
gaaggttttttttttaagtgcaa

SEQ ID NO: 130816 - DNA, 22 bp, Homo sapiens
gaagtgcagcgggccaggcagg

SEQ ID NO: 130817 - DNA, 11 bp, Homo sapiens
gaataaaatta

SEQ ID NO: 130818 - DNA, 21 bp, Homo sapiens
gaataaagttctgttttctgt

SEQ ID NO: 130819 - DNA, 16 bp, Homo sapiens
gaatagaaagaaagtc

SEQ ID NO: 130820 - DNA, 11 bp, Homo sapiens
gaatataagaa

SEQ ID NO: 130821 - DNA, 15 bp, Homo sapiens
gaatataagaaaagt

SEQ ID NO: 130822 - DNA, 18 bp, Homo sapiens
gaatcaaggtaagctcag

SEQ ID NO: 130823 - DNA, 16 bp, Homo sapiens
gaatgaactgtggaat

SEQ ID NO: 130824 - DNA, 21 bp, Homo sapiens
gaatgaactgtggaatttatt

SEQ ID NO: 130825 - DNA, 17 bp, Homo sapiens
gaatggagaaagtaagt

SEQ ID NO: 130826 - DNA, 12 bp, Homo sapiens
gaatgtctcagc

SEQ ID NO: 130827 - DNA, 21 bp, Homo sapiens
gaatgtttaatagaaaattaa

SEQ ID NO: 130828 - DNA, 19 bp, Homo sapiens
gaattgaaggagaaaatgc

SEQ ID NO: 130829 - DNA, 12 bp, Homo sapiens
gaattgggtccc

SEQ ID NO: 130830 - DNA, 23 bp, Homo sapiens
gaatttaatggactgtgaatttc

SEQ ID NO: 130831 - DNA, 15 bp, Homo sapiens
gacaaaaataacact

SEQ ID NO: 130832 - DNA, 13 bp, Homo sapiens
gacaaacctagct

SEQ ID NO: 130833 - DNA, 14 bp, Homo sapiens
gacaaactgtaaaa

SEQ ID NO: 130834 - DNA, 19 bp, Homo sapiens
gacaaactgtaaaaaatgt

SEQ ID NO: 130835 - DNA, 14 bp, Homo sapiens
gacaaagactcctc

SEQ ID NO: 130836 - DNA, 18 bp, Homo sapiens
gacaaagactcctctggg

SEQ ID NO: 130837 - DNA, 12 bp, Homo sapiens
gacaataaacag

SEQ ID NO: 130838 - DNA, 13 bp, Homo sapiens
gacaataaacagc

SEQ ID NO: 130839 - DNA, 14 bp, Homo sapiens
gacaataaacagct

SEQ ID NO: 130840 - DNA, 18 bp, Homo sapiens
gacacatgctgaggtttt

SEQ ID NO: 130841 - DNA, 23 bp, Homo sapiens
gacactcgcctactaagtaccct

SEQ ID NO: 130842 - DNA, 22 bp, Homo sapiens
gacagatttgaggactgaagct

SEQ ID NO: 130843 - DNA, 21 bp, Homo sapiens
gacagggagaagttgagcagg

SEQ ID NO: 130844 - DNA, 16 bp, Homo sapiens
gacataaaactttaaa

SEQ ID NO: 130845 - DNA, 14 bp, Homo sapiens
gacatcctagcccc

SEQ ID NO: 130846 - DNA, 15 bp, Homo sapiens
gacatcctagcccca

SEQ ID NO: 130847 - DNA, 18 bp, Homo sapiens
gacatcctagccccaccc

SEQ ID NO: 130848 - DNA, 12 bp, Homo sapiens
gacattctttta

SEQ ID NO: 130849 - DNA, 14 bp, Homo sapiens
gacattcttttaat

SEQ ID NO: 130850 - DNA, 13 bp, Homo sapiens
gaccaggagggag

SEQ ID NO: 130851 - DNA, 18 bp, Homo sapiens
gacccacagccctgaaac

SEQ ID NO: 130852 - DNA, 22 bp, Homo sapiens
gacccacctgggccaaggactc

SEQ ID NO: 130853 - DNA, 18 bp, Homo sapiens
gaccccctgtcctaggtc

SEQ ID NO: 130854 - DNA, 12 bp, Homo sapiens
gaccttctccct

SEQ ID NO: 130855 - DNA, 19 bp, Homo sapiens
gaccttctccctagccctt

SEQ ID NO: 130856 - DNA, 12 bp, Homo sapiens
gactccggcctg

SEQ ID NO: 130857 - DNA, 13 bp, Homo sapiens
gactccggcctgt

SEQ ID NO: 130858 - DNA, 13 bp, Homo sapiens
gactcctctgggc

SEQ ID NO: 130859 - DNA, 15 bp, Homo sapiens
gactcctctgggcct

SEQ ID NO: 130860 - DNA, 18 bp, Homo sapiens
gactcctctgggcctggg

SEQ ID NO: 130861 - DNA, 20 bp, Homo sapiens
gactcctctgggcctggggt

SEQ ID NO: 130862 - DNA, 22 bp, Homo sapiens
gactctgcagatagtgcctctg

SEQ ID NO: 130863 - DNA, 13 bp, Homo sapiens
gactgaagctggg

SEQ ID NO: 130864 - DNA, 18 bp, Homo sapiens
gactgggcacccctgcct

SEQ ID NO: 130865 - DNA, 19 bp, Homo sapiens
gactggtgtcataaacttt

SEQ ID NO: 130866 - DNA, 22 bp, Homo sapiens
gactgtcaaatgaacttttaca

SEQ ID NO: 130867 - DNA, 15 bp, Homo sapiens
gactgtgaatttcaa

SEQ ID NO: 130868 - DNA, 14 bp, Homo sapiens
gacttcactgcagc

SEQ ID NO: 130869 - DNA, 16 bp, Homo sapiens
gacttttctaaagctc

SEQ ID NO: 130870 - DNA, 17 bp, Homo sapiens
gagaaagaaaaggcaaa

SEQ ID NO: 130871 - DNA, 14 bp, Homo sapiens
gagaagaatagcct

SEQ ID NO: 130872 - DNA, 15 bp, Homo sapiens
gagaagttgagcagg

SEQ ID NO: 130873 - DNA, 13 bp, Homo sapiens
gagacaataaaca

SEQ ID NO: 130874 - DNA, 12 bp, Homo sapiens
gagaccaggagg

SEQ ID NO: 130875 - DNA, 16 bp, Homo sapiens
gagacccacagccctg

SEQ ID NO: 130876 - DNA, 23 bp, Homo sapiens
gagactgggcacccctgcctcct

SEQ ID NO: 130877 - DNA, 20 bp, Homo sapiens
gagaggcctcggctgtctcc

SEQ ID NO: 130878 - DNA, 21 bp, Homo sapiens
gagaggcctcggctgtctcct

SEQ ID NO: 130879 - DNA, 20 bp, Homo sapiens
gagatgactattacttttct

SEQ ID NO: 130880 - DNA, 16 bp, Homo sapiens
gagattaaaaatctaa

SEQ ID NO: 130881 - DNA, 16 bp, Homo sapiens
gagcagcccacccagc

SEQ ID NO: 130882 - DNA, 21 bp, Homo sapiens
gagcagcccacccagcagaaa

SEQ ID NO: 130883 - DNA, 15 bp, Homo sapiens
gagccccagccccaa

SEQ ID NO: 130884 - DNA, 22 bp, Homo sapiens
gagccccagccccaatccagag

SEQ ID NO: 130885 - DNA, 23 bp, Homo sapiens
gagccccagccccaatccagaga

SEQ ID NO: 130886 - DNA, 15 bp, Homo sapiens
gagccccagccccgt

SEQ ID NO: 130887 - DNA, 22 bp, Homo sapiens
gagccccagccccgtcccagag

SEQ ID NO: 130888 - DNA, 16 bp, Homo sapiens
gagcctctgcgcctct

SEQ ID NO: 130889 - DNA, 18 bp, Homo sapiens
gagcctctgcgcctctcc

SEQ ID NO: 130890 - DNA, 19 bp, Homo sapiens
gagcctctgcgcctctcca

SEQ ID NO: 130891 - DNA, 21 bp, Homo sapiens
gagcctgcccagttggaggag

SEQ ID NO: 130892 - DNA, 14 bp, Homo sapiens
gagctacaaagcat

SEQ ID NO: 130893 - DNA, 15 bp, Homo sapiens
gagctgggcccagcc

SEQ ID NO: 130894 - DNA, 16 bp, Homo sapiens
gagctgggcccagccc

SEQ ID NO: 130895 - DNA, 14 bp, Homo sapiens
gaggaaaagtgcaa

SEQ ID NO: 130896 - DNA, 23 bp, Homo sapiens
gaggaaggcccaggggtggggcc

SEQ ID NO: 130897 - DNA, 17 bp, Homo sapiens
gaggacactaggagact

SEQ ID NO: 130898 - DNA, 23 bp, Homo sapiens
gaggagactgggcacccctgcct

SEQ ID NO: 130899 - DNA, 18 bp, Homo sapiens
gaggagccccagccccgt

SEQ ID NO: 130900 - DNA, 21 bp, Homo sapiens
gaggccaaggtttcccagtga

SEQ ID NO: 130901 - DNA, 15 bp, Homo sapiens
gaggccgctgcccct

SEQ ID NO: 130902 - DNA, 12 bp, Homo sapiens
gaggcctctggc

SEQ ID NO: 130903 - DNA, 13 bp, Homo sapiens
gaggctgggcagg

SEQ ID NO: 130904 - DNA, 12 bp, Homo sapiens
gaggtcatccct

SEQ ID NO: 130905 - DNA, 18 bp, Homo sapiens
gaggtcatcccttcctcc

SEQ ID NO: 130906 - DNA, 20 bp, Homo sapiens
gaggtggccctcccaggctg

SEQ ID NO: 130907 - DNA, 22 bp, Homo sapiens
gaggtggccctcccaggctggt

SEQ ID NO: 130908 - DNA, 20 bp, Homo sapiens
gagtcagtgaagtctagaat

SEQ ID NO: 130909 - DNA, 17 bp, Homo sapiens
gttttgcttacaaagta

SEQ ID NO: 130910 - DNA, 15 bp, Homo sapiens
gttttttttttaagt

SEQ ID NO: 130911 - DNA, 22 bp, Homo sapiens
gttttttttttaagtgcaacat

SEQ ID NO: 130912 - DNA, 19 bp, Homo sapiens
taaaaaaaaaaagattgta

SEQ ID NO: 130913 - DNA, 14 bp, Homo sapiens
taaaaaaactgaag

SEQ ID NO: 130914 - DNA, 13 bp, Homo sapiens
taaaaaatatttt

SEQ ID NO: 130915 - DNA, 18 bp, Homo sapiens
taaaaaatattttaagaa

SEQ ID NO: 130916 - DNA, 21 bp, Homo sapiens
gataactgcaattttaattga

SEQ ID NO: 130917 - DNA, 15 bp, Homo sapiens
gatagatttgtttct

SEQ ID NO: 130918 - DNA, 23 bp, Homo sapiens
gatataatcttggcttcttaaaa

SEQ ID NO: 130919 - DNA, 20 bp, Homo sapiens
gatattttccctttttaaaa

SEQ ID NO: 130920 - DNA, 23 bp, Homo sapiens
gatattttccctttttaaaaaat

SEQ ID NO: 130921 - DNA, 22 bp, Homo sapiens
gatatttttgtacgttatatat

SEQ ID NO: 130922 - DNA, 16 bp, Homo sapiens
gatcaccccagccccc

SEQ ID NO: 130923 - DNA, 15 bp, Homo sapiens
gatcagaggtcatcc

SEQ ID NO: 130924 - DNA, 21 bp, Homo sapiens
gatcccccaagtgtcctggac

SEQ ID NO: 130925 - DNA, 22 bp, Homo sapiens
gatcccctctctgtggctccaa

SEQ ID NO: 130926 - DNA, 19 bp, Homo sapiens
gatctttttgtgaaattca

SEQ ID NO: 130927 - DNA, 19 bp, Homo sapiens
gatgatggaaacgcactta

SEQ ID NO: 130928 - DNA, 16 bp, Homo sapiens
gatgcagttttcaaat

SEQ ID NO: 130929 - DNA, 19 bp, Homo sapiens
gatggtatactactgcttt

SEQ ID NO: 130930 - DNA, 12 bp, Homo sapiens
gatgttacaagt

SEQ ID NO: 130931 - DNA, 18 bp, Homo sapiens
gatgttacaagtttgcta

SEQ ID NO: 130932 - DNA, 17 bp, Homo sapiens
gattccctctcccaccc

SEQ ID NO: 130933 - DNA, 23 bp, Homo sapiens
gattgattcagtatcttagagtt

SEQ ID NO: 130934 - DNA, 22 bp, Homo sapiens
gattgttctgtccagtttccaa

SEQ ID NO: 130935 - DNA, 14 bp, Homo sapiens
gatttgagaaattt

SEQ ID NO: 130936 - DNA, 18 bp, Homo sapiens
gatttgtttcttaatggg

SEQ ID NO: 130937 - DNA, 20 bp, Homo sapiens
gatttttatattagttgctt

SEQ ID NO: 130938 - DNA, 22 bp, Homo sapiens
gatttttatattagttgctttg

SEQ ID NO: 130939 - DNA, 11 bp, Homo sapiens
gcaaaagactg

SEQ ID NO: 130940 - DNA, 23 bp, Homo sapiens
gcaaacccatgaagctggccctc

SEQ ID NO: 130941 - DNA, 15 bp, Homo sapiens
gcaaaccctttgtat

SEQ ID NO: 130942 - DNA, 22 bp, Homo sapiens
gcaacatttctgtatactgtaa

SEQ ID NO: 130943 - DNA, 12 bp, Homo sapiens
gcaagaattaaa

SEQ ID NO: 130944 - DNA, 14 bp, Homo sapiens
gcaagaattaaaac

SEQ ID NO: 130945 - DNA, 18 bp, Homo sapiens
gcaagaattaaaactgag

SEQ ID NO: 130946 - DNA, 20 bp, Homo sapiens
gcaagaattaaaactgagtc

SEQ ID NO: 130947 - DNA, 14 bp, Homo sapiens
gcaagcacatctgc

SEQ ID NO: 130948 - DNA, 19 bp, Homo sapiens
gcaataaaattatttgcag

SEQ ID NO: 130949 - DNA, 18 bp, Homo sapiens
gcaatgcgtgttgtacat

SEQ ID NO: 130950 - DNA, 19 bp, Homo sapiens
gcaattttaattgattatt

SEQ ID NO: 130951 - DNA, 23 bp, Homo sapiens
gcacaggaggctccgtgagccct

SEQ ID NO: 130952 - DNA, 17 bp, Homo sapiens
gcaccagggagaggcct

SEQ ID NO: 130953 - DNA, 18 bp, Homo sapiens
gcaccagtgcctcagtgc

SEQ ID NO: 130954 - DNA, 23 bp, Homo sapiens
gcaccagtgcctcagtgctgcaa

SEQ ID NO: 130955 - DNA, 13 bp, Homo sapiens
gcacccctgcctc

SEQ ID NO: 130956 - DNA, 16 bp, Homo sapiens
gcacccctgcctcctg

SEQ ID NO: 130957 - DNA, 17 bp, Homo sapiens
gcacccctgcctcctgc

SEQ ID NO: 130958 - DNA, 18 bp, Homo sapiens
gcacccctgcctcctgcc

SEQ ID NO: 130959 - DNA, 18 bp, Homo sapiens
gcaccgggctccatgcct

SEQ ID NO: 130960 - DNA, 21 bp, Homo sapiens
gcacctatggcccagccactg

SEQ ID NO: 130961 - DNA, 13 bp, Homo sapiens
gcacgggcctgta

SEQ ID NO: 130962 - DNA, 20 bp, Homo sapiens
gcagaatggagaaagtaagt

SEQ ID NO: 130963 - DNA, 13 bp, Homo sapiens
gcagcacagccca

SEQ ID NO: 130964 - DNA, 19 bp, Homo sapiens
gcagccacaccgctggctc

SEQ ID NO: 130965 - DNA, 21 bp, Homo sapiens
gcagccacaccgctggctccg

SEQ ID NO: 130966 - DNA, 16 bp, Homo sapiens
gcagcccacccagcag

SEQ ID NO: 130967 - DNA, 17 bp, Homo sapiens
gcagcctttgcctcccc

SEQ ID NO: 130968 - DNA, 16 bp, Homo sapiens
gcagcgggccaggcag

SEQ ID NO: 130969 - DNA, 15 bp, Homo sapiens
gcagctcccattcta

SEQ ID NO: 130970 - DNA, 14 bp, Homo sapiens
gcaggatgccctgt

SEQ ID NO: 130971 - DNA, 13 bp, Homo sapiens
gcaggcccagtga

SEQ ID NO: 130972 - DNA, 14 bp, Homo sapiens
gcagggctgtgcac

SEQ ID NO: 130973 - DNA, 19 bp, Homo sapiens
gcaggtccggggaggaggt

SEQ ID NO: 130974 - DNA, 17 bp, Homo sapiens
gcagtacaataaaagta

SEQ ID NO: 130975 - DNA, 17 bp, Homo sapiens
gcagtcctgcctcagcc

SEQ ID NO: 130976 - DNA, 20 bp, Homo sapiens
gcatcctcctcagcccccag

SEQ ID NO: 130977 - DNA, 15 bp, Homo sapiens
gcatgacaaaaataa

SEQ ID NO: 130978 - DNA, 17 bp, Homo sapiens
gcatgacaaaaataaca

SEQ ID NO: 130979 - DNA, 18 bp, Homo sapiens
gcatgacaaaaataacac

SEQ ID NO: 130980 - DNA, 15 bp, Homo sapiens
gcatgggaaaaagag

SEQ ID NO: 130981 - DNA, 16 bp, Homo sapiens
gcatgggaaaaagaga

SEQ ID NO: 130982 - DNA, 23 bp, Homo sapiens
gcatgggggcaccgggctccatg

SEQ ID NO: 130983 - DNA, 18 bp, Homo sapiens
gcatttatcttttttcct

SEQ ID NO: 130984 - DNA, 11 bp, Homo sapiens
gcatttcatgc

SEQ ID NO: 130985 - DNA, 16 bp, Homo sapiens
gccaaggaatgtgtcc

SEQ ID NO: 130986 - DNA, 17 bp, Homo sapiens
gccaaggccggagaccc

SEQ ID NO: 130987 - DNA, 16 bp, Homo sapiens
gccacatacttgcagc

SEQ ID NO: 130988 - DNA, 21 bp, Homo sapiens
gccacatgggaggaaggccca

SEQ ID NO: 130989 - DNA, 22 bp, Homo sapiens
gccacatgggaggaaggcccag

SEQ ID NO: 130990 - DNA, 14 bp, Homo sapiens
gccaccacgtccag

SEQ ID NO: 130991 - DNA, 16 bp, Homo sapiens
gccaccatggccagcc

SEQ ID NO: 130992 - DNA, 17 bp, Homo sapiens
gccaccatggccagcca

SEQ ID NO: 130993 - DNA, 12 bp, Homo sapiens
gccactgcagca

SEQ ID NO: 130994 - DNA, 23 bp, Homo sapiens
gccaggtgaggtccaccggcccc

SEQ ID NO: 130995 - DNA, 21 bp, Homo sapiens
gcccagccaaaccctgtctga

SEQ ID NO: 130996 - DNA, 13 bp, Homo sapiens
gcccagccactgc

SEQ ID NO: 130997 - DNA, 14 bp, Homo sapiens
gcccagccactgca

SEQ ID NO: 130998 - DNA, 11 bp, Homo sapiens
gcccagcccct

SEQ ID NO: 130999 - DNA, 14 bp, Homo sapiens
gcccagggcctgca

SEQ ID NO: 131000 - DNA, 23 bp, Homo sapiens
gcccaggggtggggcccatgggg

SEQ ID NO: 131001 - DNA, 18 bp, Homo sapiens
gcccagttggaggagact

SEQ ID NO: 131002 - DNA, 15 bp, Homo sapiens
gcccatggggtctct

SEQ ID NO: 131003 - DNA, 16 bp, Homo sapiens
gccccaatccagagaa

SEQ ID NO: 131004 - DNA, 23 bp, Homo sapiens
gccccaatccagagaagcgctgt

SEQ ID NO: 131005 - DNA, 21 bp, Homo sapiens
gccccacccagaggtggccct

SEQ ID NO: 131006 - DNA, 12 bp, Homo sapiens
gccccagcccca

SEQ ID NO: 131007 - DNA, 21 bp, Homo sapiens
gccccagccccaatccagaga

SEQ ID NO: 131008 - DNA, 21 bp, Homo sapiens
gccccagccccgtcccagagg

SEQ ID NO: 131009 - DNA, 11 bp, Homo sapiens
gcccccacagc

SEQ ID NO: 131010 - DNA, 16 bp, Homo sapiens
gcccccacagccctgg

SEQ ID NO: 131011 - DNA, 12 bp, Homo sapiens
taaaaaggaaat

SEQ ID NO: 131012 - DNA, 14 bp, Homo sapiens
taaaaagtgaactt

SEQ ID NO: 131013 - DNA, 17 bp, Homo sapiens
taaaaagtgaacttttg

SEQ ID NO: 131014 - DNA, 18 bp, Homo sapiens
taaaaagtgaacttttgt

SEQ ID NO: 131015 - DNA, 21 bp, Homo sapiens
taaaaagtgaacttttgtaat

SEQ ID NO: 131016 - DNA, 22 bp, Homo sapiens
taaaaagtgaacttttgtaatt

SEQ ID NO: 131017 - DNA, 23 bp, Homo sapiens
tacctaaaaggaaatctcacccc

SEQ ID NO: 131018 - DNA, 14 bp, Homo sapiens
tacctcaggaaaga

SEQ ID NO: 131019 - DNA, 22 bp, Homo sapiens
tacctcccctccccgccccctg

SEQ ID NO: 131020 - DNA, 18 bp, Homo sapiens
tacctctagctgttcttt

SEQ ID NO: 131021 - DNA, 14 bp, Homo sapiens
tacgttatatattg

SEQ ID NO: 131022 - DNA, 18 bp, Homo sapiens
tactaatgttatttctta

SEQ ID NO: 131023 - DNA, 14 bp, Homo sapiens
tactactgctttgc

SEQ ID NO: 131024 - DNA, 14 bp, Homo sapiens
tactgacagaaatg

SEQ ID NO: 131025 - DNA, 13 bp, Homo sapiens
tactgcacatttt

SEQ ID NO: 131026 - DNA, 15 bp, Homo sapiens
tactgcacattttgt

SEQ ID NO: 131027 - DNA, 21 bp, Homo sapiens
tactgtaaaagttataataac

SEQ ID NO: 131028 - DNA, 16 bp, Homo sapiens
tactgtgtaatataaa

SEQ ID NO: 131029 - DNA, 15 bp, Homo sapiens
tacttaacatttcat

SEQ ID NO: 131030 - DNA, 22 bp, Homo sapiens
tacttaacatttcattgtacaa

SEQ ID NO: 131031 - DNA, 16 bp, Homo sapiens
tacttatcatttttgt

SEQ ID NO: 131032 - DNA, 18 bp, Homo sapiens
tacttatcatttttgtat

SEQ ID NO: 131033 - DNA, 23 bp, Homo sapiens
tacttatcatttttgtataaaaa

SEQ ID NO: 131034 - DNA, 19 bp, Homo sapiens
tacttctgagccccagccc

SEQ ID NO: 131035 - DNA, 16 bp, Homo sapiens
tacttttctggttcca

SEQ ID NO: 131036 - DNA, 19 bp, Homo sapiens
tacttttctggttccaaac

SEQ ID NO: 131037 - DNA, 18 bp, Homo sapiens
tacttttgaaaatcaaga

SEQ ID NO: 131038 - DNA, 14 bp, Homo sapiens
tagaaaattaaaat

SEQ ID NO: 131039 - DNA, 15 bp, Homo sapiens
tagaaaattaaaata

SEQ ID NO: 131040 - DNA, 13 bp, Homo sapiens
tagaaagaaacta

SEQ ID NO: 131041 - DNA, 16 bp, Homo sapiens
tagaaagaaactaaac

SEQ ID NO: 131042 - DNA, 20 bp, Homo sapiens
tagacatgcccaaaacttat

SEQ ID NO: 131043 - DNA, 21 bp, Homo sapiens
tagagaactggaggaaccaca

SEQ ID NO: 131044 - DNA, 17 bp, Homo sapiens
tagagatatttttgtac

SEQ ID NO: 131045 - DNA, 16 bp, Homo sapiens
tagatttgtttcttaa

SEQ ID NO: 131046 - DNA, 12 bp, Homo sapiens
tagcaactgtgc

SEQ ID NO: 131047 - DNA, 17 bp, Homo sapiens
tagccccacccagaggt

SEQ ID NO: 131048 - DNA, 15 bp, Homo sapiens
tagctacttttcaga

SEQ ID NO: 131049 - DNA, 17 bp, Homo sapiens
tagctctgtacatcttt

SEQ ID NO: 131050 - DNA, 18 bp, Homo sapiens
tagctgtttcaaatgtgc

SEQ ID NO: 131051 - DNA, 15 bp, Homo sapiens
tagcttttaaaaaat

SEQ ID NO: 131052 - DNA, 17 bp, Homo sapiens
tagcttttaaaaaatat

SEQ ID NO: 131053 - DNA, 18 bp, Homo sapiens
tagcttttaaaaaatatt

SEQ ID NO: 131054 - DNA, 17 bp, Homo sapiens
taggaacagtaaaatcc

SEQ ID NO: 131055 - DNA, 14 bp, Homo sapiens
taggaagacataaa

SEQ ID NO: 131056 - DNA, 15 bp, Homo sapiens
taggctgcaaaatta

SEQ ID NO: 131057 - DNA, 12 bp, Homo sapiens
taggggaggaga

SEQ ID NO: 131058 - DNA, 21 bp, Homo sapiens
tagtcaagaggtttttctccc

SEQ ID NO: 131059 - DNA, 12 bp, Homo sapiens
tagtctcctggg

SEQ ID NO: 131060 - DNA, 14 bp, Homo sapiens
tagttcttaaaatt

SEQ ID NO: 131061 - DNA, 18 bp, Homo sapiens
tagttcttgaattgttat

SEQ ID NO: 131062 - DNA, 22 bp, Homo sapiens
tagttcttgaattgttatgaaa

SEQ ID NO: 131063 - DNA, 17 bp, Homo sapiens
tagttgcttttgaagga

SEQ ID NO: 131064 - DNA, 12 bp, Homo sapiens
tataaaaaggaa

SEQ ID NO: 131065 - DNA, 21 bp, Homo sapiens
tataaaaggatgttacaagtt

SEQ ID NO: 131066 - DNA, 22 bp, Homo sapiens
tataaaaggatgttacaagttt

SEQ ID NO: 131067 - DNA, 17 bp, Homo sapiens
tataaattgtacatttt

SEQ ID NO: 131068 - DNA, 16 bp, Homo sapiens
tataaatttaagaaaa

SEQ ID NO: 131069 - DNA, 18 bp, Homo sapiens
tataaatttaagaaaaca

SEQ ID NO: 131070 - DNA, 19 bp, Homo sapiens
tataagaaaagtaatgaag

SEQ ID NO: 131071 - DNA, 21 bp, Homo sapiens
tataagaaaagtaatgaagaa

SEQ ID NO: 131072 - DNA, 13 bp, Homo sapiens
tataataactgaa

SEQ ID NO: 131073 - DNA, 17 bp, Homo sapiens
tataataactgaactgt

SEQ ID NO: 131074 - DNA, 18 bp, Homo sapiens
tataataactgaactgtt

SEQ ID NO: 131075 - DNA, 18 bp, Homo sapiens
tataataagttttgatat

SEQ ID NO: 131076 - DNA, 13 bp, Homo sapiens
tataatctattta

SEQ ID NO: 131077 - DNA, 14 bp, Homo sapiens
tataatctatttac

SEQ ID NO: 131078 - DNA, 15 bp, Homo sapiens
tataatctatttaca

SEQ ID NO: 131079 - DNA, 18 bp, Homo sapiens
tataattgttgatatttt

SEQ ID NO: 131080 - DNA, 14 bp, Homo sapiens
tatactgtaaaagt

SEQ ID NO: 131081 - DNA, 20 bp, Homo sapiens
tatactgtaaaagttataat

SEQ ID NO: 131082 - DNA, 14 bp, Homo sapiens
tataggtaacgtga

SEQ ID NO: 131083 - DNA, 14 bp, Homo sapiens
tatataatttactt

SEQ ID NO: 131084 - DNA, 19 bp, Homo sapiens
tatatagctggcaagaatg

SEQ ID NO: 131085 - DNA, 12 bp, Homo sapiens
tatatatcataa

SEQ ID NO: 131086 - DNA, 15 bp, Homo sapiens
tatatatcataaagt

SEQ ID NO: 131087 - DNA, 22 bp, Homo sapiens
tatatattctacacatatatgt

SEQ ID NO: 131088 - DNA, 16 bp, Homo sapiens
tatatccatacatttt

SEQ ID NO: 131089 - DNA, 14 bp, Homo sapiens
tatatctggaatga

SEQ ID NO: 131090 - DNA, 15 bp, Homo sapiens
tatatctgtctttta

SEQ ID NO: 131091 - DNA, 13 bp, Homo sapiens
tatatctgtttgt

SEQ ID NO: 131092 - DNA, 14 bp, Homo sapiens
tatatgagaagaat

SEQ ID NO: 131093 - DNA, 20 bp, Homo sapiens
tatatgagaagaatagccta

SEQ ID NO: 131094 - DNA, 19 bp, Homo sapiens
tatatgtatatctatatct

SEQ ID NO: 131095 - DNA, 15 bp, Homo sapiens
tatatgtatatgtat

SEQ ID NO: 131096 - DNA, 17 bp, Homo sapiens
tatatgttctgcaagaa

SEQ ID NO: 131097 - DNA, 20 bp, Homo sapiens
tatatgttctgcaagaatta

SEQ ID NO: 131098 - DNA, 12 bp, Homo sapiens
tatatttgcaaa

SEQ ID NO: 131099 - DNA, 22 bp, Homo sapiens
tatcagaaacagtattttcttc

SEQ ID NO: 131100 - DNA, 23 bp, Homo sapiens
tatcagaaacagtattttcttcc

SEQ ID NO: 131101 - DNA, 11 bp, Homo sapiens
tatcataaagt

SEQ ID NO: 131102 - DNA, 12 bp, Homo sapiens
tatcataaagta

SEQ ID NO: 131103 - DNA, 14 bp, Homo sapiens
tatcataaagtatg

SEQ ID NO: 131104 - DNA, 21 bp, Homo sapiens
tatcattaaaatatatgttct

SEQ ID NO: 131105 - DNA, 22 bp, Homo sapiens
tatcattaaaatatatgttctg

SEQ ID NO: 131106 - DNA, 14 bp, Homo sapiens
tatcatttttgtat

SEQ ID NO: 131107 - DNA, 17 bp, Homo sapiens
tatcatttttgtataaa

SEQ ID NO: 131108 - DNA, 19 bp, Homo sapiens
tatccttgggccataatta

SEQ ID NO: 131109 - DNA, 12 bp, Homo sapiens
tatctgcattta

SEQ ID NO: 131110 - DNA, 23 bp, Homo sapiens
tatctgtttgtatatttgcaaac

SEQ ID NO: 131111 - DNA, 23 bp, Homo sapiens
tatcttttctattgtttattctt

SEQ ID NO: 131112 - DNA, 19 bp, Homo sapiens
tatgaaaatcctatatctg

SEQ ID NO: 131113 - DNA, 22 bp, Homo sapiens
tatgaaaatcctatatctgttt

SEQ ID NO: 131114 - DNA, 16 bp, Homo sapiens
tctctgcatcttcagt

SEQ ID NO: 131115 - DNA, 14 bp, Homo sapiens
tctctgctgagctg

SEQ ID NO: 131116 - DNA, 21 bp, Homo sapiens
tctctgctgagctgggcccag

SEQ ID NO: 131117 - DNA, 19 bp, Homo sapiens
tctctgctggcccagccaa

SEQ ID NO: 131118 - DNA, 16 bp, Homo sapiens
tctctgtataatctat

SEQ ID NO: 131119 - DNA, 14 bp, Homo sapiens
tgagactttctttc

SEQ ID NO: 131120 - DNA, 16 bp, Homo sapiens
tgagagaccacacatt

SEQ ID NO: 131121 - DNA, 14 bp, Homo sapiens
tgagagttccagat

SEQ ID NO: 131122 - DNA, 23 bp, Homo sapiens
tgagcctgcccagttggaggaga

SEQ ID NO: 131123 - DNA, 16 bp, Homo sapiens
tgaggactgaagctgg

SEQ ID NO: 131124 - DNA, 13 bp, Homo sapiens
tgaggctgggcag

SEQ ID NO: 131125 - DNA, 15 bp, Homo sapiens
tgaggttttgaataa

SEQ ID NO: 131126 - DNA, 16 bp, Homo sapiens
tgaggttttgaataaa

SEQ ID NO: 131127 - DNA, 15 bp, Homo sapiens
tgagtccatgaaaat

SEQ ID NO: 131128 - DNA, 14 bp, Homo sapiens
tgagttattttaat

SEQ ID NO: 131129 - DNA, 17 bp, Homo sapiens
tgagttattttaattat

SEQ ID NO: 131130 - DNA, 22 bp, Homo sapiens
tgatataatcttggcttcttaa

SEQ ID NO: 131131 - DNA, 16 bp, Homo sapiens
tgatcaaaaataatgc

SEQ ID NO: 131132 - DNA, 13 bp, Homo sapiens
tgatcaagatata

SEQ ID NO: 131133 - DNA, 16 bp, Homo sapiens
tgatcaagatatatgt

SEQ ID NO: 131134 - DNA, 16 bp, Homo sapiens
tgatcccctctctgtg

SEQ ID NO: 131135 - DNA, 16 bp, Homo sapiens
tgatgcccaccgagga

SEQ ID NO: 131136 - DNA, 22 bp, Homo sapiens
tgatgcccaccgaggagcccca

SEQ ID NO: 131137 - DNA, 18 bp, Homo sapiens
tgatggaaacgcacttac

SEQ ID NO: 131138 - DNA, 18 bp, Homo sapiens
tgattattctgattccac

SEQ ID NO: 131139 - DNA, 16 bp, Homo sapiens
tgattgattcagtatc

SEQ ID NO: 131140 - DNA, 22 bp, Homo sapiens
tgattgattcagtatcttagag

SEQ ID NO: 131141 - DNA, 13 bp, Homo sapiens
tgatttaatatct

SEQ ID NO: 131142 - DNA, 20 bp, Homo sapiens
tgatttccagtgagtgtaaa

SEQ ID NO: 131143 - DNA, 13 bp, Homo sapiens
tgcaaaattaaat

SEQ ID NO: 131144 - DNA, 14 bp, Homo sapiens
tgcaaatttctata

SEQ ID NO: 131145 - DNA, 16 bp, Homo sapiens
tgcaaatttctataaa

SEQ ID NO: 131146 - DNA, 21 bp, Homo sapiens
tgcaacatttctgtatactgt

SEQ ID NO: 131147 - DNA, 19 bp, Homo sapiens
tgcaagaattaaaactgag

SEQ ID NO: 131148 - DNA, 20 bp, Homo sapiens
tgcaagaattaaaactgagt

SEQ ID NO: 131149 - DNA, 14 bp, Homo sapiens
tgcaatatttgtaa

SEQ ID NO: 131150 - DNA, 18 bp, Homo sapiens
tgcaattccaagaaaata

SEQ ID NO: 131151 - DNA, 14 bp, Homo sapiens
tgcaattgagggct

SEQ ID NO: 131152 - DNA, 11 bp, Homo sapiens
tgcacagaagg

SEQ ID NO: 131153 - DNA, 15 bp, Homo sapiens
tgcacccagaagaag

SEQ ID NO: 131154 - DNA, 18 bp, Homo sapiens
tgcacctatggcccagcc

SEQ ID NO: 131155 - DNA, 19 bp, Homo sapiens
tgcacgcgccctttctacc

SEQ ID NO: 131156 - DNA, 21 bp, Homo sapiens
tgcactagtgcaattccaaga

SEQ ID NO: 131157 - DNA, 14 bp, Homo sapiens
tgcacttcatgtca

SEQ ID NO: 131158 - DNA, 18 bp, Homo sapiens
tgcactttgtagtgtttg

SEQ ID NO: 131159 - DNA, 23 bp, Homo sapiens
tgcagatagtgcctctgcaaact

SEQ ID NO: 131160 - DNA, 12 bp, Homo sapiens
tgcagcacagga

SEQ ID NO: 131161 - DNA, 18 bp, Homo sapiens
tgcagcacaggaggctcc

SEQ ID NO: 131162 - DNA, 22 bp, Homo sapiens
tgcagcctttcacaggactctg

SEQ ID NO: 131163 - DNA, 23 bp, Homo sapiens
tgcagcctttgcctccccggctc

SEQ ID NO: 131164 - DNA, 18 bp, Homo sapiens
tgcagcttgtgctgagcc

SEQ ID NO: 131165 - DNA, 19 bp, Homo sapiens
tgcaggtccggggaggagg

SEQ ID NO: 131166 - DNA, 20 bp, Homo sapiens
tgcaggtccggggaggaggt

SEQ ID NO: 131167 - DNA, 12 bp, Homo sapiens
tgcatcctcctc

SEQ ID NO: 131168 - DNA, 19 bp, Homo sapiens
tgcatcctcctcagccccc

SEQ ID NO: 131169 - DNA, 16 bp, Homo sapiens
tgcatgggggcaccgg

SEQ ID NO: 131170 - DNA, 17 bp, Homo sapiens
tgcccaatccaggcccg

SEQ ID NO: 131171 - DNA, 19 bp, Homo sapiens
tgcccaccgaggagcccca

SEQ ID NO: 131172 - DNA, 14 bp, Homo sapiens
tgcccactgccgat

SEQ ID NO: 131173 - DNA, 15 bp, Homo sapiens
tgcccagcctgctca

SEQ ID NO: 131174 - DNA, 16 bp, Homo sapiens
tgccccaaggaggtgg

SEQ ID NO: 131175 - DNA, 22 bp, Homo sapiens
tgccccgtccccctagagactc

SEQ ID NO: 131176 - DNA, 11 bp, Homo sapiens
tgcccctgcca

SEQ ID NO: 131177 - DNA, 17 bp, Homo sapiens
tgcccgccctccaccca

SEQ ID NO: 131178 - DNA, 20 bp, Homo sapiens
tgccctgttgggggcttcag

SEQ ID NO: 131179 - DNA, 21 bp, Homo sapiens
tgcctatatgagaagaatagc

SEQ ID NO: 131180 - DNA, 14 bp, Homo sapiens
tgcctcagcctccg

SEQ ID NO: 131181 - DNA, 20 bp, Homo sapiens
tgcctctggaggcctctggc

SEQ ID NO: 131182 - DNA, 16 bp, Homo sapiens
tgccttcctgtttaaa

SEQ ID NO: 131183 - DNA, 12 bp, Homo sapiens
tgctaaaagaag

SEQ ID NO: 131184 - DNA, 15 bp, Homo sapiens
tgctaaattgagagg

SEQ ID NO: 131185 - DNA, 22 bp, Homo sapiens
tgctacttatcatttttgtata

SEQ ID NO: 131186 - DNA, 17 bp, Homo sapiens
tgctcaggtgcaagtgc

SEQ ID NO: 131187 - DNA, 17 bp, Homo sapiens
tgctccaggcatcactg

SEQ ID NO: 131188 - DNA, 23 bp, Homo sapiens
tgctcccagctctctctcctgga

SEQ ID NO: 131189 - DNA, 18 bp, Homo sapiens
tgctcctttctgcccagc

SEQ ID NO: 131190 - DNA, 14 bp, Homo sapiens
tgctcgaagaacaa

SEQ ID NO: 131191 - DNA, 21 bp, Homo sapiens
tgctgaagattcagtttaaga

SEQ ID NO: 131192 - DNA, 12 bp, Homo sapiens
tgctgagcctgc

SEQ ID NO: 131193 - DNA, 13 bp, Homo sapiens
tgctgagctgggc

SEQ ID NO: 131194 - DNA, 14 bp, Homo sapiens
tgctgagctgggcc

SEQ ID NO: 131195 - DNA, 15 bp, Homo sapiens
tgctgagctgggccc

SEQ ID NO: 131196 - DNA, 18 bp, Homo sapiens
tgctgagctgggcccagc

SEQ ID NO: 131197 - DNA, 24 bp, Homo sapiens
tgctgagctgggcccagcccctcc

SEQ ID NO: 131198 - DNA, 23 bp, Homo sapiens
tgctgaggttttgaataaaaagt

SEQ ID NO: 131199 - DNA, 22 bp, Homo sapiens
tgctgcaaacccatgaagctgg

SEQ ID NO: 131200 - DNA, 14 bp, Homo sapiens
tgctgtccttgaat

SEQ ID NO: 131201 - DNA, 18 bp, Homo sapiens
tgcttaatttccttctgt

SEQ ID NO: 131202 - DNA, 13 bp, Homo sapiens
tgcttacaaagta

SEQ ID NO: 131203 - DNA, 15 bp, Homo sapiens
tgcttggagtgcccc

SEQ ID NO: 131204 - DNA, 17 bp, Homo sapiens
tgcttggagtgccccaa

SEQ ID NO: 131205 - DNA, 18 bp, Homo sapiens
tgcttggagtgccccaag

SEQ ID NO: 131206 - DNA, 20 bp, Homo sapiens
tgctttcagatgcagttttc

SEQ ID NO: 131207 - DNA, 20 bp, Homo sapiens
tggaatcaaggtaagctcag

SEQ ID NO: 131208 - DNA, 17 bp, Homo sapiens
tggactgtgaatttcaa

SEQ ID NO: 131209 - DNA, 17 bp, Homo sapiens
tggaggaaccacatata

SEQ ID NO: 131210 - DNA, 15 bp, Homo sapiens
tggaggagactgggc

SEQ ID NO: 131211 - DNA, 17 bp, Homo sapiens
tggaggagactgggcac

SEQ ID NO: 131212 - DNA, 13 bp, Homo sapiens
tggaggcctctgg

SEQ ID NO: 131213 - DNA, 14 bp, Homo sapiens
tggagtctgaagcc

SEQ ID NO: 131214 - DNA, 17 bp, Homo sapiens
tggagtctgaagcctgc

SEQ ID NO: 131215 - DNA, 12 bp, Homo sapiens
tggagtgcccca

SEQ ID NO: 131216 - DNA, 14 bp, Homo sapiens
tggagtggccactg

SEQ ID NO: 131217 - DNA, 12 bp, Homo sapiens
tatgcaataaaa

SEQ ID NO: 131218 - DNA, 17 bp, Homo sapiens
tatgccttcctgtttaa

SEQ ID NO: 131219 - DNA, 17 bp, Homo sapiens
tatggcccagccactgc

SEQ ID NO: 131220 - DNA, 20 bp, Homo sapiens
tatggcccagccactgcagc

SEQ ID NO: 131221 - DNA, 17 bp, Homo sapiens
tatgtatatgtatatct

SEQ ID NO: 131222 - DNA, 15 bp, Homo sapiens
tatgtattttcctaa

SEQ ID NO: 131223 - DNA, 14 bp, Homo sapiens
tattacaaatgcaa

SEQ ID NO: 131224 - DNA, 15 bp, Homo sapiens
tattacaaatgcaaa

SEQ ID NO: 131225 - DNA, 19 bp, Homo sapiens
tattacaaatgcaaatttc

SEQ ID NO: 131226 - DNA, 21 bp, Homo sapiens
tattacttgaactttccaaaa

SEQ ID NO: 131227 - DNA, 16 bp, Homo sapiens
tattacttttctgttt

SEQ ID NO: 131228 - DNA, 16 bp, Homo sapiens
tattagtcataaaaca

SEQ ID NO: 131229 - DNA, 13 bp, Homo sapiens
tattagttgcttt

SEQ ID NO: 131230 - DNA, 18 bp, Homo sapiens
tattataattgttgatat

SEQ ID NO: 131231 - DNA, 13 bp, Homo sapiens
tattatttgatat

SEQ ID NO: 131232 - DNA, 12 bp, Homo sapiens
tattcagaaatt

SEQ ID NO: 131233 - DNA, 21 bp, Homo sapiens
tattcagaaattaaaatatta

SEQ ID NO: 131234 - DNA, 14 bp, Homo sapiens
tattctgattccac

SEQ ID NO: 131235 - DNA, 22 bp, Homo sapiens
tattctgtggttctataataag

SEQ ID NO: 131236 - DNA, 19 bp, Homo sapiens
tattcttaaaatgcaatat

SEQ ID NO: 131237 - DNA, 13 bp, Homo sapiens
tattgaaaaatca

SEQ ID NO: 131238 - DNA, 15 bp, Homo sapiens
tattgctaaaagtgc

SEQ ID NO: 131239 - DNA, 17 bp, Homo sapiens
tattgctaaaagtgcat

SEQ ID NO: 131240 - DNA, 19 bp, Homo sapiens
tattgctgtccttgaatgc

SEQ ID NO: 131241 - DNA, 23 bp, Homo sapiens
tattggcagccaaggaatgtgtc

SEQ ID NO: 131242 - DNA, 16 bp, Homo sapiens
tattgtattaagggca

SEQ ID NO: 131243 - DNA, 22 bp, Homo sapiens
tattgtttattctttttaaagt

SEQ ID NO: 131244 - DNA, 24 bp, Homo sapiens
tattgtttattctttttaaagtat

SEQ ID NO: 131245 - DNA, 16 bp, Homo sapiens
tatttccacataaagg

SEQ ID NO: 131246 - DNA, 19 bp, Homo sapiens
tatttccacataaaggtat

SEQ ID NO: 131247 - DNA, 16 bp, Homo sapiens
tattttaaaataaact

SEQ ID NO: 131248 - DNA, 13 bp, Homo sapiens
tattttaagaaag

SEQ ID NO: 131249 - DNA, 19 bp, Homo sapiens
tattttaagaaagagaatg

SEQ ID NO: 131250 - DNA, 17 bp, Homo sapiens
tattttaagacgtgaat

SEQ ID NO: 131251 - DNA, 20 bp, Homo sapiens
tattttccctttttaaaaaa

SEQ ID NO: 131252 - DNA, 16 bp, Homo sapiens
tattttcctaatgtga

SEQ ID NO: 131253 - DNA, 14 bp, Homo sapiens
tatttttgtacgtt

SEQ ID NO: 131254 - DNA, 21 bp, Homo sapiens
tcaaaaaaaaaaaaaaagact

SEQ ID NO: 131255 - DNA, 22 bp, Homo sapiens
tcaaaaaaaaaaaaaaagactg

SEQ ID NO: 131256 - DNA, 15 bp, Homo sapiens
tcaaagatgatggaa

SEQ ID NO: 131257 - DNA, 14 bp, Homo sapiens
tcaaatgaactttt

SEQ ID NO: 131258 - DNA, 20 bp, Homo sapiens
tcaagattttttttgtaact

SEQ ID NO: 131259 - DNA, 13 bp, Homo sapiens
tcaatagtgtcct

SEQ ID NO: 131260 - DNA, 17 bp, Homo sapiens
tcaattaaagaaataat

SEQ ID NO: 131261 - DNA, 19 bp, Homo sapiens
tcacaaatttctctgttcc

SEQ ID NO: 131262 - DNA, 21 bp, Homo sapiens
tcacatataaaagttaaacta

SEQ ID NO: 131263 - DNA, 22 bp, Homo sapiens
tcacatataaaagttaaactac

SEQ ID NO: 131264 - DNA, 16 bp, Homo sapiens
tcacccaccccatgga

SEQ ID NO: 131265 - DNA, 13 bp, Homo sapiens
tcaccccagcccc

SEQ ID NO: 131266 - DNA, 19 bp, Homo sapiens
tcaccccatcccacaccct

SEQ ID NO: 131267 - DNA, 21 bp, Homo sapiens
tcactaaataaacacgatttt

SEQ ID NO: 131268 - DNA, 18 bp, Homo sapiens
tcactattacttgaactt

SEQ ID NO: 131269 - DNA, 13 bp, Homo sapiens
tcactgattccct

SEQ ID NO: 131270 - DNA, 18 bp, Homo sapiens
tcactgattccctctccc

SEQ ID NO: 131271 - DNA, 23 bp, Homo sapiens
tcactgattccctctcccaccca

SEQ ID NO: 131272 - DNA, 12 bp, Homo sapiens
tcactgcagcct

SEQ ID NO: 131273 - DNA, 22 bp, Homo sapiens
tcagaaactcgatgaatgtgtt

SEQ ID NO: 131274 - DNA, 17 bp, Homo sapiens
tcagaaattaaaatatt

SEQ ID NO: 131275 - DNA, 23 bp, Homo sapiens
tcagaaattaaaatattatttga

SEQ ID NO: 131276 - DNA, 12 bp, Homo sapiens
tcagaacaactt

SEQ ID NO: 131277 - DNA, 22 bp, Homo sapiens
tcagaggtcatcccttcctcct

SEQ ID NO: 131278 - DNA, 23 bp, Homo sapiens
tcagaggtcatcccttcctcctc

SEQ ID NO: 131279 - DNA, 13 bp, Homo sapiens
tcagcatgacaaa

SEQ ID NO: 131280 - DNA, 22 bp, Homo sapiens
tcagcatgacaaaaataacact

SEQ ID NO: 131281 - DNA, 15 bp, Homo sapiens
tcagcccccaggcca

SEQ ID NO: 131282 - DNA, 18 bp, Homo sapiens
tcagcccccaggccaggt

SEQ ID NO: 131283 - DNA, 15 bp, Homo sapiens
tcagctcagctgggc

SEQ ID NO: 131284 - DNA, 19 bp, Homo sapiens
tcagctccctgaccccctg

SEQ ID NO: 131285 - DNA, 19 bp, Homo sapiens
tcagctctcctggctccct

SEQ ID NO: 131286 - DNA, 21 bp, Homo sapiens
tcagctgggccactcctcttc

SEQ ID NO: 131287 - DNA, 17 bp, Homo sapiens
tcagtatcttagagttt

SEQ ID NO: 131288 - DNA, 19 bp, Homo sapiens
tcagtatcttagagtttac

SEQ ID NO: 131289 - DNA, 21 bp, Homo sapiens
tcagtatcttagagtttacag

SEQ ID NO: 131290 - DNA, 19 bp, Homo sapiens
tcagtgaagtctagaatca

SEQ ID NO: 131291 - DNA, 20 bp, Homo sapiens
tcagtgaagtctagaatcat

SEQ ID NO: 131292 - DNA, 21 bp, Homo sapiens
tcagtggtcaccttcctcagc

SEQ ID NO: 131293 - DNA, 17 bp, Homo sapiens
tcagtttaagagttttc

SEQ ID NO: 131294 - DNA, 11 bp, Homo sapiens
tcataaacttt

SEQ ID NO: 131295 - DNA, 17 bp, Homo sapiens
tcatatcactaaataaa

SEQ ID NO: 131296 - DNA, 18 bp, Homo sapiens
tcatatcactaaataaac

SEQ ID NO: 131297 - DNA, 11 bp, Homo sapiens
tcatgagccca

SEQ ID NO: 131298 - DNA, 22 bp, Homo sapiens
tcatgcaagacttcactgcagc

SEQ ID NO: 131299 - DNA, 15 bp, Homo sapiens
tcatgcccactgccg

SEQ ID NO: 131300 - DNA, 22 bp, Homo sapiens
tcatgtgggccacacaagtgca

SEQ ID NO: 131301 - DNA, 17 bp, Homo sapiens
tcattaaaatatatgtt

SEQ ID NO: 131302 - DNA, 12 bp, Homo sapiens
tcatttcaattt

SEQ ID NO: 131303 - DNA, 17 bp, Homo sapiens
tcattttctgatgccca

SEQ ID NO: 131304 - DNA, 20 bp, Homo sapiens
tcattttctgatgcccaccg

SEQ ID NO: 131305 - DNA, 12 bp, Homo sapiens
tcatttttgtat

SEQ ID NO: 131306 - DNA, 22 bp, Homo sapiens
tccaaaccagtttattctgtgg

SEQ ID NO: 131307 - DNA, 22 bp, Homo sapiens
tccaaattattaattgtcctgt

SEQ ID NO: 131308 - DNA, 23 bp, Homo sapiens
tccaaattattaattgtcctgtg

SEQ ID NO: 131309 - DNA, 14 bp, Homo sapiens
tccaaggaaaattg

SEQ ID NO: 131310 - DNA, 12 bp, Homo sapiens
tccacataaagg

SEQ ID NO: 131311 - DNA, 14 bp, Homo sapiens
tccacataaaggta

SEQ ID NO: 131312 - DNA, 16 bp, Homo sapiens
tccactgccaaaacaa

SEQ ID NO: 131313 - DNA, 20 bp, Homo sapiens
tccactgtttcatgagccca

SEQ ID NO: 131314 - DNA, 18 bp, Homo sapiens
tccagagaagcgctgttg

SEQ ID NO: 131315 - DNA, 12 bp, Homo sapiens
tccatgaaaata

SEQ ID NO: 131316 - DNA, 15 bp, Homo sapiens
tccatgaaaatacca

SEQ ID NO: 131317 - DNA, 16 bp, Homo sapiens
tccatgaaaataccat

SEQ ID NO: 131318 - DNA, 16 bp, Homo sapiens
tccatttaagacacat

SEQ ID NO: 131319 - DNA, 19 bp, Homo sapiens
ggacagatttgaggactga

SEQ ID NO: 131320 - DNA, 12 bp, Homo sapiens
ggaccctggcct

SEQ ID NO: 131321 - DNA, 13 bp, Homo sapiens
ggaccctggccta

SEQ ID NO: 131322 - DNA, 20 bp, Homo sapiens
tggatcagaggtcatccctt

SEQ ID NO: 131323 - DNA, 14 bp, Homo sapiens
tggcagcacagccc

SEQ ID NO: 131324 - DNA, 18 bp, Homo sapiens
tggcagcacagcccaggg

SEQ ID NO: 131325 - DNA, 16 bp, Homo sapiens
tggcagccaaggaatg

SEQ ID NO: 131326 - DNA, 22 bp, Homo sapiens
tggcagccaaggaatgtgtcca

SEQ ID NO: 131327 - DNA, 20 bp, Homo sapiens
tggcatgggcgcaggcccag

SEQ ID NO: 131328 - DNA, 19 bp, Homo sapiens
tggcatttgcagattttta

SEQ ID NO: 131329 - DNA, 17 bp, Homo sapiens
tggcccagccactgcag

SEQ ID NO: 131330 - DNA, 16 bp, Homo sapiens
tggccctcagctccct

SEQ ID NO: 131331 - DNA, 13 bp, Homo sapiens
tggccctcccagg

SEQ ID NO: 131332 - DNA, 14 bp, Homo sapiens
tggccctcccaggc

SEQ ID NO: 131333 - DNA, 12 bp, Homo sapiens
tggcccttggaa

SEQ ID NO: 131334 - DNA, 15 bp, Homo sapiens
tggcccttggaataa

SEQ ID NO: 131335 - DNA, 19 bp, Homo sapiens
tggcccttggaataaagtt

SEQ ID NO: 131336 - DNA, 22 bp, Homo sapiens
tggcctaaagaatcccaccccc

SEQ ID NO: 131337 - DNA, 18 bp, Homo sapiens
tggccttgaaaccacctt

SEQ ID NO: 131338 - DNA, 20 bp, Homo sapiens
tggccttggcatgggcgcag

SEQ ID NO: 131339 - DNA, 18 bp, Homo sapiens
tggcggaggtggagtggc

SEQ ID NO: 131340 - DNA, 23 bp, Homo sapiens
tggctccaacccgttgggtccct

SEQ ID NO: 131341 - DNA, 17 bp, Homo sapiens
tggctgttaaccacccg

SEQ ID NO: 131342 - DNA, 22 bp, Homo sapiens
tggctgttaaccacccgccccg

SEQ ID NO: 131343 - DNA, 13 bp, Homo sapiens
tggcttcttaaaa

SEQ ID NO: 131344 - DNA, 16 bp, Homo sapiens
tggcttcttaaaaact

SEQ ID NO: 131345 - DNA, 23 bp, Homo sapiens
tggcttcttaaaaactgtgtatc

SEQ ID NO: 131346 - DNA, 19 bp, Homo sapiens
tggcttcttttctttgtat

SEQ ID NO: 131347 - DNA, 22 bp, Homo sapiens
tggcttcttttctttgtatcat

SEQ ID NO: 131348 - DNA, 12 bp, Homo sapiens
tgggaaaaagag

SEQ ID NO: 131349 - DNA, 22 bp, Homo sapiens
tgggaaggtgggtgaggctggg

SEQ ID NO: 131350 - DNA, 21 bp, Homo sapiens
tgggagacaattagcagaatg

SEQ ID NO: 131351 - DNA, 16 bp, Homo sapiens
tgggagggaggagggc

SEQ ID NO: 131352 - DNA, 17 bp, Homo sapiens
tgggcacccctgcctcc

SEQ ID NO: 131353 - DNA, 21 bp, Homo sapiens
tgggcacccctgcctcctgcc

SEQ ID NO: 131354 - DNA, 18 bp, Homo sapiens
tgggccactcctcttcac

SEQ ID NO: 131355 - DNA, 21 bp, Homo sapiens
tgggccgggggcggggccggg

SEQ ID NO: 131356 - DNA, 15 bp, Homo sapiens
tgggcgcaggcccag

SEQ ID NO: 131357 - DNA, 17 bp, Homo sapiens
tgggcgcttcccacctg

SEQ ID NO: 131358 - DNA, 13 bp, Homo sapiens
tggggcccatggg

SEQ ID NO: 131359 - DNA, 15 bp, Homo sapiens
tggggcccatggggt

SEQ ID NO: 131360 - DNA, 22 bp, Homo sapiens
tggggcttggggattgccacta

SEQ ID NO: 131361 - DNA, 23 bp, Homo sapiens
tggggtgcatcctcctcagcccc

SEQ ID NO: 131362 - DNA, 20 bp, Homo sapiens
tgggtcattacttctgagcc

SEQ ID NO: 131363 - DNA, 16 bp, Homo sapiens
tgggtcccttgctgca

SEQ ID NO: 131364 - DNA, 14 bp, Homo sapiens
tgggtgaggctggg

SEQ ID NO: 131365 - DNA, 18 bp, Homo sapiens
tgggtgctgatccttgca

SEQ ID NO: 131366 - DNA, 19 bp, Homo sapiens
tggtaaatttttgaaaaat

SEQ ID NO: 131367 - DNA, 23 bp, Homo sapiens
tggtaaatttttgaaaaatattg

SEQ ID NO: 131368 - DNA, 21 bp, Homo sapiens
tggtgaccaaaatttttaggt

SEQ ID NO: 131369 - DNA, 18 bp, Homo sapiens
tggtgctcatttaaatat

SEQ ID NO: 131370 - DNA, 16 bp, Homo sapiens
tggtttgtttgcttaa

SEQ ID NO: 131371 - DNA, 17 bp, Homo sapiens
tgtaaaaaatgtgtgta

SEQ ID NO: 131372 - DNA, 20 bp, Homo sapiens
tgtaaaagttataataactg

SEQ ID NO: 131373 - DNA, 18 bp, Homo sapiens
tgtaatcagctctcctgg

SEQ ID NO: 131374 - DNA, 14 bp, Homo sapiens
tgtaattaactgta

SEQ ID NO: 131375 - DNA, 19 bp, Homo sapiens
tgtaattaactgtaaactt

SEQ ID NO: 131376 - DNA, 14 bp, Homo sapiens
tgtaatttgaattg

SEQ ID NO: 131377 - DNA, 17 bp, Homo sapiens
tgtacgttatatattgt

SEQ ID NO: 131378 - DNA, 19 bp, Homo sapiens
tgtacttttctggttccaa

SEQ ID NO: 131379 - DNA, 21 bp, Homo sapiens
tgtagacatgcccaaaactta

SEQ ID NO: 131380 - DNA, 19 bp, Homo sapiens
tgtataaaaaggaaattag

SEQ ID NO: 131381 - DNA, 17 bp, Homo sapiens
tgtatactgtaaaagtt

SEQ ID NO: 131382 - DNA, 14 bp, Homo sapiens
tgtatagttgcttt

SEQ ID NO: 131383 - DNA, 17 bp, Homo sapiens
tgtatagttgcttttga

SEQ ID NO: 131384 - DNA, 13 bp, Homo sapiens
tgtatatagtttg

SEQ ID NO: 131385 - DNA, 16 bp, Homo sapiens
tgtatatgtatatcta

SEQ ID NO: 131386 - DNA, 17 bp, Homo sapiens
tgtatatgtatatctat

SEQ ID NO: 131387 - DNA, 13 bp, Homo sapiens
tgtattataattg

SEQ ID NO: 131388 - DNA, 21 bp, Homo sapiens
tgtattataattgttgatatt

SEQ ID NO: 131389 - DNA, 12 bp, Homo sapiens
tgtattgctgtc

SEQ ID NO: 131390 - DNA, 15 bp, Homo sapiens
tgtattttcctaatg

SEQ ID NO: 131391 - DNA, 16 bp, Homo sapiens
tgtcaaatgaactttt

SEQ ID NO: 131392 - DNA, 13 bp, Homo sapiens
tgtcaagattttt

SEQ ID NO: 131393 - DNA, 12 bp, Homo sapiens
tgtcagaaactc

SEQ ID NO: 131394 - DNA, 15 bp, Homo sapiens
tgtcataaactttct

SEQ ID NO: 131395 - DNA, 16 bp, Homo sapiens
tgtcctatgcaataaa

SEQ ID NO: 131396 - DNA, 13 bp, Homo sapiens
tgtcctgtgtcta

SEQ ID NO: 131397 - DNA, 23 bp, Homo sapiens
tgtcctgttattttttatttcca

SEQ ID NO: 131398 - DNA, 15 bp, Homo sapiens
tgtctcagcctccca

SEQ ID NO: 131399 - DNA, 19 bp, Homo sapiens
tgtcttttatttaacaaaa

SEQ ID NO: 131400 - DNA, 14 bp, Homo sapiens
tgtgaatttcaaaa

SEQ ID NO: 131401 - DNA, 22 bp, Homo sapiens
tgtgagtgtgtttgtgtgcatg

SEQ ID NO: 131402 - DNA, 18 bp, Homo sapiens
tgtgcacctatggcccag

SEQ ID NO: 131403 - DNA, 19 bp, Homo sapiens
tgtgcattttgtggaattt

SEQ ID NO: 131404 - DNA, 13 bp, Homo sapiens
tgtgctgagcctg

SEQ ID NO: 131405 - DNA, 17 bp, Homo sapiens
tgtggaatttattggca

SEQ ID NO: 131406 - DNA, 20 bp, Homo sapiens
tgtggaattttgagaaaaat

SEQ ID NO: 131407 - DNA, 15 bp, Homo sapiens
tgtgggcaaaagagt

SEQ ID NO: 131408 - DNA, 12 bp, Homo sapiens
tgtgtatacata

SEQ ID NO: 131409 - DNA, 13 bp, Homo sapiens
tgtgtatcattaa

SEQ ID NO: 131410 - DNA, 20 bp, Homo sapiens
tgtgtattcttaaaatgcaa

SEQ ID NO: 131411 - DNA, 15 bp, Homo sapiens
tgtgtgatggaggga

SEQ ID NO: 131412 - DNA, 15 bp, Homo sapiens
tgtgttatattccaa

SEQ ID NO: 131413 - DNA, 19 bp, Homo sapiens
tgtgttatattccaaggaa

SEQ ID NO: 131414 - DNA, 14 bp, Homo sapiens
tgtgttttaaaaaa

SEQ ID NO: 131415 - DNA, 20 bp, Homo sapiens
tgtgttttaaaaaaactgaa

SEQ ID NO: 131416 - DNA, 16 bp, Homo sapiens
tgttaagaaaggatat

SEQ ID NO: 131417 - DNA, 20 bp, Homo sapiens
tgttaagaaaggatataaaa

SEQ ID NO: 131418 - DNA, 23 bp, Homo sapiens
tgttacaagtttgctaaaagaag

SEQ ID NO: 131419 - DNA, 18 bp, Homo sapiens
tgttatattccaaggaaa

SEQ ID NO: 131420 - DNA, 15 bp, Homo sapiens
tgttccaatgccaca

SEQ ID NO: 131421 - DNA, 20 bp, Homo sapiens
tgttccccccatagagacca

SEQ ID NO: 131422 - DNA, 18 bp, Homo sapiens
tcccaatacaaagatgac

SEQ ID NO: 131423 - DNA, 14 bp, Homo sapiens
tgttctgcaagaat

SEQ ID NO: 131424 - DNA, 21 bp, Homo sapiens
tgttctgcaagaattaaaact

SEQ ID NO: 131425 - DNA, 22 bp, Homo sapiens
tgttctgcaagaattaaaactg

SEQ ID NO: 131426 - DNA, 23 bp, Homo sapiens
tgttctgcaagaattaaaactga

SEQ ID NO: 131427 - DNA, 18 bp, Homo sapiens
tgttctgtccagtttcca

SEQ ID NO: 131428 - DNA, 17 bp, Homo sapiens
tgttgatattttccctt

SEQ ID NO: 131429 - DNA, 16 bp, Homo sapiens
tgttgcccgccctcca

SEQ ID NO: 131430 - DNA, 13 bp, Homo sapiens
tgttgctgtcaag

SEQ ID NO: 131431 - DNA, 14 bp, Homo sapiens
tgttggtttaatat

SEQ ID NO: 131432 - DNA, 16 bp, Homo sapiens
tgtttcaaatgtgcat

SEQ ID NO: 131433 - DNA, 21 bp, Homo sapiens
tgtttcaaatgtgcattttgt

SEQ ID NO: 131434 - DNA, 13 bp, Homo sapiens
tgtttgcttaatt

SEQ ID NO: 131435 - DNA, 17 bp, Homo sapiens
tgtttggcttggccttg

SEQ ID NO: 131436 - DNA, 15 bp, Homo sapiens
tgtttgtatatttgc

SEQ ID NO: 131437 - DNA, 16 bp, Homo sapiens
tgtttgtatatttgca

SEQ ID NO: 131438 - DNA, 14 bp, Homo sapiens
tgtttgtgtgcatg

SEQ ID NO: 131439 - DNA, 16 bp, Homo sapiens
tgtttgtgtgcatgaa

SEQ ID NO: 131440 - DNA, 15 bp, Homo sapiens
tgttttaaaaaaact

SEQ ID NO: 131441 - DNA, 17 bp, Homo sapiens
tgttttaaaaaaactga

SEQ ID NO: 131442 - DNA, 19 bp, Homo sapiens
tgttttaaaaaaactgaag

SEQ ID NO: 131443 - DNA, 12 bp, Homo sapiens
ttaaaaaaactg

SEQ ID NO: 131444 - DNA, 11 bp, Homo sapiens
ttaaaaaatac

SEQ ID NO: 131445 - DNA, 19 bp, Homo sapiens
ttaaaaaataccattgaaa

SEQ ID NO: 131446 - DNA, 14 bp, Homo sapiens
ttaaaaaatatttt

SEQ ID NO: 131447 - DNA, 22 bp, Homo sapiens
ttaaaaaatattttaagaaaga

SEQ ID NO: 131448 - DNA, 15 bp, Homo sapiens
ttaaaaactgtgtat

SEQ ID NO: 131449 - DNA, 22 bp, Homo sapiens
ttaaaaactgtgtatcattaaa

SEQ ID NO: 131450 - DNA, 13 bp, Homo sapiens
ttaaaaggcaact

SEQ ID NO: 131451 - DNA, 13 bp, Homo sapiens
ttaaaataaactt

SEQ ID NO: 131452 - DNA, 16 bp, Homo sapiens
ttaaaataaactttct

SEQ ID NO: 131453 - DNA, 16 bp, Homo sapiens
ttaaaatatatgttct

SEQ ID NO: 131454 - DNA, 20 bp, Homo sapiens
ttaaaatatatgttctgcaa

SEQ ID NO: 131455 - DNA, 22 bp, Homo sapiens
ttaaaatatatgttctgcaaga

SEQ ID NO: 131456 - DNA, 16 bp, Homo sapiens
ttaaaatattatttga

SEQ ID NO: 131457 - DNA, 20 bp, Homo sapiens
ttaaaatgcaatatttgtaa

SEQ ID NO: 131458 - DNA, 23 bp, Homo sapiens
ttaaagtatgttattgcataatt

SEQ ID NO: 131459 - DNA, 16 bp, Homo sapiens
ttaaataacctctggc

SEQ ID NO: 131460 - DNA, 17 bp, Homo sapiens
ttaaatatctgaacatt

SEQ ID NO: 131461 - DNA, 21 bp, Homo sapiens
ttaaatcattttaggaaagga

SEQ ID NO: 131462 - DNA, 15 bp, Homo sapiens
ttaaatctagacatt

SEQ ID NO: 131463 - DNA, 17 bp, Homo sapiens
ttaacatttcattgtac

SEQ ID NO: 131464 - DNA, 22 bp, Homo sapiens
ttaagaaaacaagtatataatt

SEQ ID NO: 131465 - DNA, 11 bp, Homo sapiens
ttaagaaagag

SEQ ID NO: 131466 - DNA, 21 bp, Homo sapiens
ttaagaaagagaatgaactgt

SEQ ID NO: 131467 - DNA, 19 bp, Homo sapiens
ttaagaataattgaacaat

SEQ ID NO: 131468 - DNA, 20 bp, Homo sapiens
ttaagacgtgaatgtctcag

SEQ ID NO: 131469 - DNA, 21 bp, Homo sapiens
ttaaggagaggagaaactgag

SEQ ID NO: 131470 - DNA, 21 bp, Homo sapiens
ttaaggatcaccccagccccc

SEQ ID NO: 131471 - DNA, 16 bp, Homo sapiens
ttaagtgcaacatttc

SEQ ID NO: 131472 - DNA, 19 bp, Homo sapiens
ttaagtgcaacatttctgt

SEQ ID NO: 131473 - DNA, 17 bp, Homo sapiens
ttaatagaaaattaaaa

SEQ ID NO: 131474 - DNA, 22 bp, Homo sapiens
ttaatatctgagaagtgtatat

SEQ ID NO: 131475 - DNA, 19 bp, Homo sapiens
ttaatatttttacatgcag

SEQ ID NO: 131476 - DNA, 15 bp, Homo sapiens
ttaatcacttaacat

SEQ ID NO: 131477 - DNA, 15 bp, Homo sapiens
ttaatggactgtgaa

SEQ ID NO: 131478 - DNA, 16 bp, Homo sapiens
ttaatggactgtgaat

SEQ ID NO: 131479 - DNA, 15 bp, Homo sapiens
ttaatttccttctgt

SEQ ID NO: 131480 - DNA, 16 bp, Homo sapiens
ttaatttccttctgtt

SEQ ID NO: 131481 - DNA, 17 bp, Homo sapiens
ttaatttccttctgtta

SEQ ID NO: 131482 - DNA, 18 bp, Homo sapiens
ttacaagtggtgaccaaa

SEQ ID NO: 131483 - DNA, 19 bp, Homo sapiens
ttacagaatgcattaaaaa

SEQ ID NO: 131484 - DNA, 21 bp, Homo sapiens
ttacagtttgtgttttaaaaa

SEQ ID NO: 131485 - DNA, 22 bp, Homo sapiens
ttacagtttgtgttttaaaaaa

SEQ ID NO: 131486 - DNA, 12 bp, Homo sapiens
ttactaaagtca

SEQ ID NO: 131487 - DNA, 15 bp, Homo sapiens
ttactacagttttta

SEQ ID NO: 131488 - DNA, 17 bp, Homo sapiens
ttacttgaactttccaa

SEQ ID NO: 131489 - DNA, 13 bp, Homo sapiens
ttagcagaatgga

SEQ ID NO: 131490 - DNA, 22 bp, Homo sapiens
ttagcagggattctctcatcta

SEQ ID NO: 131491 - DNA, 14 bp, Homo sapiens
ttagccttgctcag

SEQ ID NO: 131492 - DNA, 18 bp, Homo sapiens
ttaggaaaggatgatcaa

SEQ ID NO: 131493 - DNA, 16 bp, Homo sapiens
ttaggaacagtaaaat

SEQ ID NO: 131494 - DNA, 15 bp, Homo sapiens
ttagtcataaaacac

SEQ ID NO: 131495 - DNA, 11 bp, Homo sapiens
ttagttcttga

SEQ ID NO: 131496 - DNA, 16 bp, Homo sapiens
ttagttcttgaattgt

SEQ ID NO: 131497 - DNA, 14 bp, Homo sapiens
ttataaaaatataa

SEQ ID NO: 131498 - DNA, 14 bp, Homo sapiens
ttataataactgaa

SEQ ID NO: 131499 - DNA, 15 bp, Homo sapiens
ttataataactgaac

SEQ ID NO: 131500 - DNA, 19 bp, Homo sapiens
ttataataactgaactgtt

SEQ ID NO: 131501 - DNA, 16 bp, Homo sapiens
ttatatatcataaagt

SEQ ID NO: 131502 - DNA, 17 bp, Homo sapiens
ttatatatcataaagta

SEQ ID NO: 131503 - DNA, 16 bp, Homo sapiens
ttatattccaaggaaa

SEQ ID NO: 131504 - DNA, 21 bp, Homo sapiens
ttatattccaaggaaaattga

SEQ ID NO: 131505 - DNA, 18 bp, Homo sapiens
ttatcatttttgtataaa

SEQ ID NO: 131506 - DNA, 13 bp, Homo sapiens
ttattaattgtcc

SEQ ID NO: 131507 - DNA, 17 bp, Homo sapiens
ttattctgctgaagatt

SEQ ID NO: 131508 - DNA, 19 bp, Homo sapiens
ttattctgctgaagattca

SEQ ID NO: 131509 - DNA, 16 bp, Homo sapiens
ttattctttttaaagt

SEQ ID NO: 131510 - DNA, 17 bp, Homo sapiens
ttatttccacataaagg

SEQ ID NO: 131511 - DNA, 14 bp, Homo sapiens
ttatttttaaaata

SEQ ID NO: 131512 - DNA, 19 bp, Homo sapiens
ttatttttaaaataaaaat

SEQ ID NO: 131513 - DNA, 11 bp, Homo sapiens
ttcaaatgtgc

SEQ ID NO: 131514 - DNA, 16 bp, Homo sapiens
ttcaacctgtgtctta

SEQ ID NO: 131515 - DNA, 14 bp, Homo sapiens
ttcaattaaagaaa

SEQ ID NO: 131516 - DNA, 16 bp, Homo sapiens
ttcaattaaagaaata

SEQ ID NO: 131517 - DNA, 13 bp, Homo sapiens
ttcagaataaaat

SEQ ID NO: 131518 - DNA, 22 bp, Homo sapiens
ttcagaattgaaggagaaaatg

SEQ ID NO: 131519 - DNA, 11 bp, Homo sapiens
ttcataatggc

SEQ ID NO: 131520 - DNA, 12 bp, Homo sapiens
ttcatgagccca

SEQ ID NO: 131521 - DNA, 13 bp, Homo sapiens
ttcatgagcccaa

SEQ ID NO: 131522 - DNA, 19 bp, Homo sapiens
ttcatgccaccatggccag

SEQ ID NO: 131523 - DNA, 22 bp, Homo sapiens
ttcatgccaccatggccagcca

SEQ ID NO: 131524 - DNA, 14 bp, Homo sapiens
ttcatgcccactgc

SEQ ID NO: 131525 - DNA, 17 bp, Homo sapiens
gtgagcctctgcgcctc

SEQ ID NO: 131526 - DNA, 11 bp, Homo sapiens
tgatttctcac

SEQ ID NO: 131527 - DNA, 17 bp, Homo sapiens
tgcaaacccatgaagct

SEQ ID NO: 131528 - DNA, 16 bp, Homo sapiens
tgcaaaccctttgtat

SEQ ID NO: 131529 - DNA, 18 bp, Homo sapiens
tgcaaatttctataaatt

SEQ ID NO: 131530 - DNA, 14 bp, Homo sapiens
tgcaacatttctgt

SEQ ID NO: 131531 - DNA, 17 bp, Homo sapiens
tgcaacatttctgtata

SEQ ID NO: 131532 - DNA, 16 bp, Homo sapiens
tgcaagaattaaaact

SEQ ID NO: 131533 - DNA, 18 bp, Homo sapiens
tgcaagaattaaaactga

SEQ ID NO: 131534 - DNA, 21 bp, Homo sapiens
tgcaagaattaaaactgagtc

SEQ ID NO: 131535 - DNA, 20 bp, Homo sapiens
tgcaagacttcactgcagcc

SEQ ID NO: 131536 - DNA, 19 bp, Homo sapiens
tgcaagtgaacttgggagg

SEQ ID NO: 131537 - DNA, 13 bp, Homo sapiens
tgcaatatttgta

SEQ ID NO: 131538 - DNA, 20 bp, Homo sapiens
tgcaatatttgtaaggcttg

SEQ ID NO: 131539 - DNA, 17 bp, Homo sapiens
tgcaattccaagaaaat

SEQ ID NO: 131540 - DNA, 18 bp, Homo sapiens
tgcacagaagggctcttt

SEQ ID NO: 131541 - DNA, 16 bp, Homo sapiens
tgcacctatggcccag

SEQ ID NO: 131542 - DNA, 14 bp, Homo sapiens
tgcactagtgcaat

SEQ ID NO: 131543 - DNA, 17 bp, Homo sapiens
tgcactcatcatatttt

SEQ ID NO: 131544 - DNA, 19 bp, Homo sapiens
tgcactggtcccaagtagt

SEQ ID NO: 131545 - DNA, 13 bp, Homo sapiens
tgcactttgtagt

SEQ ID NO: 131546 - DNA, 20 bp, Homo sapiens
tgcagagtatttttgtattc

SEQ ID NO: 131547 - DNA, 16 bp, Homo sapiens
tgcagcacaggaggct

SEQ ID NO: 131548 - DNA, 18 bp, Homo sapiens
tgcagcgggccaggcagg

SEQ ID NO: 131549 - DNA, 13 bp, Homo sapiens
tgcagcttgtgct

SEQ ID NO: 131550 - DNA, 19 bp, Homo sapiens
tgcagcttgtgctgagcct

SEQ ID NO: 131551 - DNA, 21 bp, Homo sapiens
tgcagcttgtgctgagcctgc

SEQ ID NO: 131552 - DNA, 15 bp, Homo sapiens
tgcaggtctttaaat

SEQ ID NO: 131553 - DNA, 22 bp, Homo sapiens
tgcaggtctttaaatcatttta

SEQ ID NO: 131554 - DNA, 21 bp, Homo sapiens
tgcatccagcagtacaataaa

SEQ ID NO: 131555 - DNA, 20 bp, Homo sapiens
tgcatcctcctcagccccca

SEQ ID NO: 131556 - DNA, 11 bp, Homo sapiens
tgcatcttcag

SEQ ID NO: 131557 - DNA, 14 bp, Homo sapiens
tgcatttaaggaga

SEQ ID NO: 131558 - DNA, 20 bp, Homo sapiens
tgccaaggccggagacccac

SEQ ID NO: 131559 - DNA, 11 bp, Homo sapiens
tgccactaagt

SEQ ID NO: 131560 - DNA, 17 bp, Homo sapiens
tgccatagtcaaagaga

SEQ ID NO: 131561 - DNA, 18 bp, Homo sapiens
tgccatagtcaaagagag

SEQ ID NO: 131562 - DNA, 24 bp, Homo sapiens
tgccatagtcaaagagagttttta

SEQ ID NO: 131563 - DNA, 14 bp, Homo sapiens
tgcccaatccaggc

SEQ ID NO: 131564 - DNA, 15 bp, Homo sapiens
tgcccaatccaggcc

SEQ ID NO: 131565 - DNA, 22 bp, Homo sapiens
tgcccaccgaggagccccagcc

SEQ ID NO: 131566 - DNA, 19 bp, Homo sapiens
tgcccactgccgatgccca

SEQ ID NO: 131567 - DNA, 17 bp, Homo sapiens
tgcccaggctggtctca

SEQ ID NO: 131568 - DNA, 18 bp, Homo sapiens
tgccccaaggaggtggct

SEQ ID NO: 131569 - DNA, 15 bp, Homo sapiens
tgcccctgccaaggc

SEQ ID NO: 131570 - DNA, 18 bp, Homo sapiens
tgcccgccctccacccac

SEQ ID NO: 131571 - DNA, 22 bp, Homo sapiens
tgcccttaaggatcaccccagc

SEQ ID NO: 131572 - DNA, 20 bp, Homo sapiens
tgcctatatgagaagaatag

SEQ ID NO: 131573 - DNA, 17 bp, Homo sapiens
tgcctcagtgctgcaat

SEQ ID NO: 131574 - DNA, 18 bp, Homo sapiens
tgcctccccggctcgagc

SEQ ID NO: 131575 - DNA, 18 bp, Homo sapiens
tgcctctggaggcctctg

SEQ ID NO: 131576 - DNA, 23 bp, Homo sapiens
tgcctctggaggcctctggccct

SEQ ID NO: 131577 - DNA, 21 bp, Homo sapiens
tgccttcctgtttaaaaaaag

SEQ ID NO: 131578 - DNA, 17 bp, Homo sapiens
tgctaaaagaagagagg

SEQ ID NO: 131579 - DNA, 12 bp, Homo sapiens
tgctaaaagtgc

SEQ ID NO: 131580 - DNA, 18 bp, Homo sapiens
tgctatcagaaacagtat

SEQ ID NO: 131581 - DNA, 16 bp, Homo sapiens
tgctcagggtcaattt

SEQ ID NO: 131582 - DNA, 14 bp, Homo sapiens
tgctcccagctctc

SEQ ID NO: 131583 - DNA, 22 bp, Homo sapiens
tgctcccagctctctctcctgg

SEQ ID NO: 131584 - DNA, 19 bp, Homo sapiens
tgctgagctgggcccagcc

SEQ ID NO: 131585 - DNA, 22 bp, Homo sapiens
tgctgagctgggcccagcccct

SEQ ID NO: 131586 - DNA, 14 bp, Homo sapiens
tgctgatccttgca

SEQ ID NO: 131587 - DNA, 23 bp, Homo sapiens
tgctgcaaacccatgaagctggc

SEQ ID NO: 131588 - DNA, 16 bp, Homo sapiens
tgcttggagtgcccca

SEQ ID NO: 131589 - DNA, 15 bp, Homo sapiens
tgctttgagaagaat

SEQ ID NO: 131590 - DNA, 22 bp, Homo sapiens
tgctttgttaaaaaaaaaaaga

SEQ ID NO: 131591 - DNA, 18 bp, Homo sapiens
tggaaacagacagggaga

SEQ ID NO: 131592 - DNA, 22 bp, Homo sapiens
tggaaacagacagggagaagtt

SEQ ID NO: 131593 - DNA, 16 bp, Homo sapiens
tggaaacgcacttaca

SEQ ID NO: 131594 - DNA, 17 bp, Homo sapiens
tggaattattgtagaca

SEQ ID NO: 131595 - DNA, 18 bp, Homo sapiens
tggaattttgagaaaaat

SEQ ID NO: 131596 - DNA, 15 bp, Homo sapiens
tggagacaataaaca

SEQ ID NO: 131597 - DNA, 13 bp, Homo sapiens
tggaggagactgg

SEQ ID NO: 131598 - DNA, 14 bp, Homo sapiens
tggaggagactggg

SEQ ID NO: 131599 - DNA, 14 bp, Homo sapiens
tggaggcctctggc

SEQ ID NO: 131600 - DNA, 16 bp, Homo sapiens
tggaggcctctggccc

SEQ ID NO: 131601 - DNA, 18 bp, Homo sapiens
tggagtgccccaaggagg

SEQ ID NO: 131602 - DNA, 21 bp, Homo sapiens
tggcacaacgctctaccctgc

SEQ ID NO: 131603 - DNA, 22 bp, Homo sapiens
tggcacaacgctctaccctgca

SEQ ID NO: 131604 - DNA, 13 bp, Homo sapiens
tggcagcacagcc

SEQ ID NO: 131605 - DNA, 21 bp, Homo sapiens
tggcagcacagcccagggcct

SEQ ID NO: 131606 - DNA, 14 bp, Homo sapiens
tggcagccaaggaa

SEQ ID NO: 131607 - DNA, 19 bp, Homo sapiens
tggcatgggcgcaggccca

SEQ ID NO: 131608 - DNA, 17 bp, Homo sapiens
tggcatttgcagatttt

SEQ ID NO: 131609 - DNA, 10 bp, Homo sapiens
tggccactgg

SEQ ID NO: 131610 - DNA, 21 bp, Homo sapiens
tggccagccaacttttgcatg

SEQ ID NO: 131611 - DNA, 14 bp, Homo sapiens
tggcccagccactg

SEQ ID NO: 131612 - DNA, 18 bp, Homo sapiens
tggcccagccactgcagc

SEQ ID NO: 131613 - DNA, 17 bp, Homo sapiens
tggccctcagctccctg

SEQ ID NO: 131614 - DNA, 19 bp, Homo sapiens
tggccctcagctccctgac

SEQ ID NO: 131615 - DNA, 22 bp, Homo sapiens
tggccctcggtggctgcacaga

SEQ ID NO: 131616 - DNA, 17 bp, Homo sapiens
tggcctaaagaatccca

SEQ ID NO: 131617 - DNA, 20 bp, Homo sapiens
tggctacttttgaaaatcaa

SEQ ID NO: 131618 - DNA, 21 bp, Homo sapiens
tggcttaggaatgacttactt

SEQ ID NO: 131619 - DNA, 15 bp, Homo sapiens
tggcttcttaaaaac

SEQ ID NO: 131620 - DNA, 19 bp, Homo sapiens
tggcttcttaaaaactgtg

SEQ ID NO: 131621 - DNA, 16 bp, Homo sapiens
tggcttggccttggca

SEQ ID NO: 131622 - DNA, 15 bp, Homo sapiens
tgggcaaaagagtgt

SEQ ID NO: 131623 - DNA, 12 bp, Homo sapiens
tgggcagggcct

SEQ ID NO: 131624 - DNA, 13 bp, Homo sapiens
tgggcagggcctg

SEQ ID NO: 131625 - DNA, 15 bp, Homo sapiens
tgggccactcctctt

SEQ ID NO: 131626 - DNA, 16 bp, Homo sapiens
ttaacaaaaaatgtaa

SEQ ID NO: 131627 - DNA, 21 bp, Homo sapiens
ttaacaaaaaatgtaattaac

SEQ ID NO: 131628 - DNA, 19 bp, Homo sapiens
ttcatgctatcagaaacag

SEQ ID NO: 131629 - DNA, 16 bp, Homo sapiens
ttccaaaccagtttat

SEQ ID NO: 131630 - DNA, 21 bp, Homo sapiens
ttccaaaccagtttattctgt

SEQ ID NO: 131631 - DNA, 21 bp, Homo sapiens
ttccaaagggcagtaaagttt

SEQ ID NO: 131632 - DNA, 13 bp, Homo sapiens
ttccaaattatta

SEQ ID NO: 131633 - DNA, 17 bp, Homo sapiens
ttccaagaaaatatcac

SEQ ID NO: 131634 - DNA, 15 bp, Homo sapiens
ttccaatagaaagaa

SEQ ID NO: 131635 - DNA, 14 bp, Homo sapiens
ttccagattgttct

SEQ ID NO: 131636 - DNA, 14 bp, Homo sapiens
ttcccaaatcaaaa

SEQ ID NO: 131637 - DNA, 16 bp, Homo sapiens
ttcccaattgccacat

SEQ ID NO: 131638 - DNA, 15 bp, Homo sapiens
ttcccagtgagcctc

SEQ ID NO: 131639 - DNA, 16 bp, Homo sapiens
ttcccagtgagcctct

SEQ ID NO: 131640 - DNA, 19 bp, Homo sapiens
ttcccagtgagcctctgcg

SEQ ID NO: 131641 - DNA, 23 bp, Homo sapiens
ttccccactgacagcctcccacc

SEQ ID NO: 131642 - DNA, 17 bp, Homo sapiens
ttcccctccttctccct

SEQ ID NO: 131643 - DNA, 18 bp, Homo sapiens
ttcccctccttctccctt

SEQ ID NO: 131644 - DNA, 12 bp, Homo sapiens
ttccctctccca

SEQ ID NO: 131645 - DNA, 15 bp, Homo sapiens
ttccctctcccaccc

SEQ ID NO: 131646 - DNA, 16 bp, Homo sapiens
ttccctctcccaccca

SEQ ID NO: 131647 - DNA, 21 bp, Homo sapiens
ttccctctcccacccaaggag

SEQ ID NO: 131648 - DNA, 14 bp, Homo sapiens
ttcctagtatatta

SEQ ID NO: 131649 - DNA, 21 bp, Homo sapiens
ttcctcagctcagctgggcca

SEQ ID NO: 131650 - DNA, 13 bp, Homo sapiens
ttcctcctctcct

SEQ ID NO: 131651 - DNA, 14 bp, Homo sapiens
ttccttattgaaaa

SEQ ID NO: 131652 - DNA, 17 bp, Homo sapiens
ttccttattgaaaaatc

SEQ ID NO: 131653 - DNA, 14 bp, Homo sapiens
ttccttctgttaag

SEQ ID NO: 131654 - DNA, 23 bp, Homo sapiens
ttccttctgttaagaaaggatat

SEQ ID NO: 131655 - DNA, 20 bp, Homo sapiens
ttccttttgcaacaagacaa

SEQ ID NO: 131656 - DNA, 21 bp, Homo sapiens
ttcgaaacctgtccataaagt

SEQ ID NO: 131657 - DNA, 16 bp, Homo sapiens
ttcgggattccctggt

SEQ ID NO: 131658 - DNA, 13 bp, Homo sapiens
ttctataaattta

SEQ ID NO: 131659 - DNA, 19 bp, Homo sapiens
ttctataaatttaagaaaa

SEQ ID NO: 131660 - DNA, 16 bp, Homo sapiens
ttctataataagtttt

SEQ ID NO: 131661 - DNA, 23 bp, Homo sapiens
ttctataataagttttgatataa

SEQ ID NO: 131662 - DNA, 17 bp, Homo sapiens
ttctccatttaagacac

SEQ ID NO: 131663 - DNA, 12 bp, Homo sapiens
ttctccctagcc

SEQ ID NO: 131664 - DNA, 16 bp, Homo sapiens
ttctccctagcccttc

SEQ ID NO: 131665 - DNA, 22 bp, Homo sapiens
ttctccctagcccttctacccc

SEQ ID NO: 131666 - DNA, 21 bp, Homo sapiens
ttctctaacttcaaggcccat

SEQ ID NO: 131667 - DNA, 19 bp, Homo sapiens
ttctctcttttaaagtatt

SEQ ID NO: 131668 - DNA, 13 bp, Homo sapiens
ttctgagccccag

SEQ ID NO: 131669 - DNA, 12 bp, Homo sapiens
ttctgcaagaat

SEQ ID NO: 131670 - DNA, 23 bp, Homo sapiens
ttctgcaagaattaaaactgagt

SEQ ID NO: 131671 - DNA, 13 bp, Homo sapiens
ttctggttccaaa

SEQ ID NO: 131672 - DNA, 18 bp, Homo sapiens
ttctggttccaaaccagt

SEQ ID NO: 131673 - DNA, 21 bp, Homo sapiens
ttctgtggttctataataagt

SEQ ID NO: 131674 - DNA, 14 bp, Homo sapiens
ttctgttaagaaag

SEQ ID NO: 131675 - DNA, 21 bp, Homo sapiens
ttcttaaaatgcaatatttgt

SEQ ID NO: 131676 - DNA, 22 bp, Homo sapiens
ttcttagtgttggtttaatatt

SEQ ID NO: 131677 - DNA, 19 bp, Homo sapiens
ttcttcccaaatcaaaata

SEQ ID NO: 131678 - DNA, 21 bp, Homo sapiens
ttcttcccaaatcaaaataaa

SEQ ID NO: 131679 - DNA, 14 bp, Homo sapiens
ttcttgaattgtta

SEQ ID NO: 131680 - DNA, 21 bp, Homo sapiens
ttcttgaattgttatgaaaat

SEQ ID NO: 131681 - DNA, 17 bp, Homo sapiens
ttctttgagactgggtc

SEQ ID NO: 131682 - DNA, 15 bp, Homo sapiens
ttcttttctttgtat

SEQ ID NO: 131683 - DNA, 21 bp, Homo sapiens
ttgaaaaatattgctaaaagt

SEQ ID NO: 131684 - DNA, 19 bp, Homo sapiens
ttgaaaccaccttttatta

SEQ ID NO: 131685 - DNA, 13 bp, Homo sapiens
ttgaaagtattca

SEQ ID NO: 131686 - DNA, 17 bp, Homo sapiens
ttgaaagtattcagaaa

SEQ ID NO: 131687 - DNA, 15 bp, Homo sapiens
ttgaaatcagcatga

SEQ ID NO: 131688 - DNA, 15 bp, Homo sapiens
ttgaacaataaagtt

SEQ ID NO: 131689 - DNA, 15 bp, Homo sapiens
ttgaactttccaaaa

SEQ ID NO: 131690 - DNA, 13 bp, Homo sapiens
ttgaataaaaagt

SEQ ID NO: 131691 - DNA, 20 bp, Homo sapiens
ttgaataaaaagtgaacttt

SEQ ID NO: 131692 - DNA, 23 bp, Homo sapiens
ttgaataaaaagtgaacttttgt

SEQ ID NO: 131693 - DNA, 16 bp, Homo sapiens
ttgactcctttccaat

SEQ ID NO: 131694 - DNA, 17 bp, Homo sapiens
ttgactcctttccaata

SEQ ID NO: 131695 - DNA, 14 bp, Homo sapiens
ttgagcaggtatca

SEQ ID NO: 131696 - DNA, 23 bp, Homo sapiens
ttgatcccctctctgtggctcca

SEQ ID NO: 131697 - DNA, 15 bp, Homo sapiens
ttgatttgagaaatt

SEQ ID NO: 131698 - DNA, 13 bp, Homo sapiens
ttgcaaacccttt

SEQ ID NO: 131699 - DNA, 14 bp, Homo sapiens
ttgcaaaccctttg

SEQ ID NO: 131700 - DNA, 17 bp, Homo sapiens
ttgcaaaccctttgtat

SEQ ID NO: 131701 - DNA, 22 bp, Homo sapiens
ttgcagcttgtgctgagcctgc

SEQ ID NO: 131702 - DNA, 13 bp, Homo sapiens
ttgcatttcatgc

SEQ ID NO: 131703 - DNA, 12 bp, Homo sapiens
ttgccactaagt

SEQ ID NO: 131704 - DNA, 13 bp, Homo sapiens
ttgccatttagcg

SEQ ID NO: 131705 - DNA, 18 bp, Homo sapiens
ttgcccaggctggtctca

SEQ ID NO: 131706 - DNA, 11 bp, Homo sapiens
ttgcctgctgc

SEQ ID NO: 131707 - DNA, 17 bp, Homo sapiens
ttgctaaaagaagagag

SEQ ID NO: 131708 - DNA, 15 bp, Homo sapiens
ttgctaaaagtgcat

SEQ ID NO: 131709 - DNA, 23 bp, Homo sapiens
ttgcttttgaaggaatacaatat

SEQ ID NO: 131710 - DNA, 14 bp, Homo sapiens
ttggaatcaaggta

SEQ ID NO: 131711 - DNA, 17 bp, Homo sapiens
ttggaggagactgggca

SEQ ID NO: 131712 - DNA, 12 bp, Homo sapiens
ttggatcagagg

SEQ ID NO: 131713 - DNA, 17 bp, Homo sapiens
ttggcttactgcagcct

SEQ ID NO: 131714 - DNA, 16 bp, Homo sapiens
ttggcttcttaaaaac

SEQ ID NO: 131715 - DNA, 17 bp, Homo sapiens
ttggcttcttaaaaact

SEQ ID NO: 131716 - DNA, 23 bp, Homo sapiens
ttggcttcttaaaaactgtgtat

SEQ ID NO: 131717 - DNA, 22 bp, Homo sapiens
ttgggagacaattagcagaatg

SEQ ID NO: 131718 - DNA, 19 bp, Homo sapiens
ttggggattgccactaagt

SEQ ID NO: 131719 - DNA, 12 bp, Homo sapiens
ttggtaaatttt

SEQ ID NO: 131720 - DNA, 15 bp, Homo sapiens
ttggtaaatttttga

SEQ ID NO: 131721 - DNA, 17 bp, Homo sapiens
ttggtaaatttttgaaa

SEQ ID NO: 131722 - DNA, 14 bp, Homo sapiens
ttggtcgagtcttt

SEQ ID NO: 131723 - DNA, 19 bp, Homo sapiens
ttggtgctcatttaaatat

SEQ ID NO: 131724 - DNA, 18 bp, Homo sapiens
ttgtaaaatattatgttt

SEQ ID NO: 131725 - DNA, 12 bp, Homo sapiens
ttgtaatttgaa

SEQ ID NO: 131726 - DNA, 14 bp, Homo sapiens
ttgtaatttgaatt

SEQ ID NO: 131727 - DNA, 16 bp, Homo sapiens
ttgtacaaagatatgc

SEQ ID NO: 131728 - DNA, 14 bp, Homo sapiens
taaaattatttgca

SEQ ID NO: 131729 - DNA, 15 bp, Homo sapiens
taaaattgagtttca

SEQ ID NO: 131730 - DNA, 20 bp, Homo sapiens
taaaattgagtttcagaata

SEQ ID NO: 131731 - DNA, 24 bp, Homo sapiens
ttaagaaagagaatgaactgtgga

SEQ ID NO: 131732 - DNA, 19 bp, Homo sapiens
ttaagaaaggatataaaag

SEQ ID NO: 131733 - DNA, 21 bp, Homo sapiens
ttaagaaaggatataaaagga

SEQ ID NO: 131734 - DNA, 16 bp, Homo sapiens
ttaagacgtgaatgtc

SEQ ID NO: 131735 - DNA, 16 bp, Homo sapiens
ttaagcttctagacac

SEQ ID NO: 131736 - DNA, 21 bp, Homo sapiens
ttaagtgcaacatttctgtat

SEQ ID NO: 131737 - DNA, 17 bp, Homo sapiens
ttaatatctgagaagtg

SEQ ID NO: 131738 - DNA, 17 bp, Homo sapiens
ttaatggactgtgaatt

SEQ ID NO: 131739 - DNA, 20 bp, Homo sapiens
ttaatggactgtgaatttca

SEQ ID NO: 131740 - DNA, 17 bp, Homo sapiens
ttaattatctgcattta

SEQ ID NO: 131741 - DNA, 17 bp, Homo sapiens
ttacaaatgcaaatttc

SEQ ID NO: 131742 - DNA, 21 bp, Homo sapiens
ttacaaatgcaaatttctata

SEQ ID NO: 131743 - DNA, 17 bp, Homo sapiens
ttacaagtggtgaccaa

SEQ ID NO: 131744 - DNA, 20 bp, Homo sapiens
ttacaagtttgctaaaagaa

SEQ ID NO: 131745 - DNA, 22 bp, Homo sapiens
ttacaagtttgctaaaagaaga

SEQ ID NO: 131746 - DNA, 15 bp, Homo sapiens
ttacagaatgcatta

SEQ ID NO: 131747 - DNA, 14 bp, Homo sapiens
ttactacagttttt

SEQ ID NO: 131748 - DNA, 22 bp, Homo sapiens
ttactacagtttttaactctac

SEQ ID NO: 131749 - DNA, 18 bp, Homo sapiens
ttactgacagaaatgcaa

SEQ ID NO: 131750 - DNA, 22 bp, Homo sapiens
ttactgcagcctttgcctcccc

SEQ ID NO: 131751 - DNA, 15 bp, Homo sapiens
ttacttgaactttcc

SEQ ID NO: 131752 - DNA, 18 bp, Homo sapiens
ttacttgaactttccaaa

SEQ ID NO: 131753 - DNA, 14 bp, Homo sapiens
ttagaatatattaa

SEQ ID NO: 131754 - DNA, 17 bp, Homo sapiens
ttagcagaatggagaaa

SEQ ID NO: 131755 - DNA, 19 bp, Homo sapiens
ttagcagaatggagaaagt

SEQ ID NO: 131756 - DNA, 22 bp, Homo sapiens
ttaggcgcccatggtacaagga

SEQ ID NO: 131757 - DNA, 14 bp, Homo sapiens
ttagtgagattaaa

SEQ ID NO: 131758 - DNA, 14 bp, Homo sapiens
ttagttcttgaatt

SEQ ID NO: 131759 - DNA, 17 bp, Homo sapiens
ttagttcttgaattgtt

SEQ ID NO: 131760 - DNA, 19 bp, Homo sapiens
ttagtttgatttaatatct

SEQ ID NO: 131761 - DNA, 17 bp, Homo sapiens
ttataaaaatataaatt

SEQ ID NO: 131762 - DNA, 18 bp, Homo sapiens
ttataaaaatataaattg

SEQ ID NO: 131763 - DNA, 13 bp, Homo sapiens
ttataataactga

SEQ ID NO: 131764 - DNA, 22 bp, Homo sapiens
ttataattttcctttttcatgt

SEQ ID NO: 131765 - DNA, 15 bp, Homo sapiens
ttataggtaacgtga

SEQ ID NO: 131766 - DNA, 11 bp, Homo sapiens
ttatatattgt

SEQ ID NO: 131767 - DNA, 18 bp, Homo sapiens
ttatatattgtattaagg

SEQ ID NO: 131768 - DNA, 20 bp, Homo sapiens
ttatattagttgctttgtta

SEQ ID NO: 131769 - DNA, 16 bp, Homo sapiens
ttatcatttttgtata

SEQ ID NO: 131770 - DNA, 17 bp, Homo sapiens
ttatcatttttgtataa

SEQ ID NO: 131771 - DNA, 20 bp, Homo sapiens
ttatcatttttgtataaaaa

SEQ ID NO: 131772 - DNA, 14 bp, Homo sapiens
ttattcatttgagt

SEQ ID NO: 131773 - DNA, 16 bp, Homo sapiens
ttattctgtggttcta

SEQ ID NO: 131774 - DNA, 18 bp, Homo sapiens
ttattctgtggttctata

SEQ ID NO: 131775 - DNA, 19 bp, Homo sapiens
ttattggcagccaaggaat

SEQ ID NO: 131776 - DNA, 23 bp, Homo sapiens
ttattggcagccaaggaatgtgt

SEQ ID NO: 131777 - DNA, 16 bp, Homo sapiens
ttatttaacaaaaaat

SEQ ID NO: 131778 - DNA, 12 bp, Homo sapiens
ttatttgatatc

SEQ ID NO: 131779 - DNA, 20 bp, Homo sapiens
ttatttttaaaataaaaata

SEQ ID NO: 131780 - DNA, 15 bp, Homo sapiens
ttcaattaaagaaat

SEQ ID NO: 131781 - DNA, 14 bp, Homo sapiens
ttcaccccaccctt

SEQ ID NO: 131782 - DNA, 12 bp, Homo sapiens
ttcactgcagcc

SEQ ID NO: 131783 - DNA, 14 bp, Homo sapiens
ttcagaaattaaaa

SEQ ID NO: 131784 - DNA, 18 bp, Homo sapiens
ttcagaaattaaaatatt

SEQ ID NO: 131785 - DNA, 14 bp, Homo sapiens
ttcagaataaaatt

SEQ ID NO: 131786 - DNA, 15 bp, Homo sapiens
ttcagtatcttagag

SEQ ID NO: 131787 - DNA, 23 bp, Homo sapiens
ttcagtatcttagagtttacagt

SEQ ID NO: 131788 - DNA, 20 bp, Homo sapiens
ttcattgggaagattctcta

SEQ ID NO: 131789 - DNA, 12 bp, Homo sapiens
ttccaaattatt

SEQ ID NO: 131790 - DNA, 23 bp, Homo sapiens
ttccaaattattaattgtcctgt

SEQ ID NO: 131791 - DNA, 15 bp, Homo sapiens
ttccaagaaaatatc

SEQ ID NO: 131792 - DNA, 15 bp, Homo sapiens
ttccaagctccaaat

SEQ ID NO: 131793 - DNA, 16 bp, Homo sapiens
ttccaaggaaaattga

SEQ ID NO: 131794 - DNA, 18 bp, Homo sapiens
ttccactgccaaaacaat

SEQ ID NO: 131795 - DNA, 19 bp, Homo sapiens
ttccactgccaaaacaatg

SEQ ID NO: 131796 - DNA, 17 bp, Homo sapiens
ttccatagttaaagaag

SEQ ID NO: 131797 - DNA, 17 bp, Homo sapiens
ttcccaaatcaaaataa

SEQ ID NO: 131798 - DNA, 17 bp, Homo sapiens
ttcccagtgagcctctg

SEQ ID NO: 131799 - DNA, 20 bp, Homo sapiens
ttcctcagctcagctgggcc

SEQ ID NO: 131800 - DNA, 14 bp, Homo sapiens
ttcctcctctcctg

SEQ ID NO: 131801 - DNA, 15 bp, Homo sapiens
ttcctcctctcctgg

SEQ ID NO: 131802 - DNA, 19 bp, Homo sapiens
ttccttattgaaaaatcag

SEQ ID NO: 131803 - DNA, 17 bp, Homo sapiens
ttccttctgttaagaaa

SEQ ID NO: 131804 - DNA, 22 bp, Homo sapiens
ttcgaaacctgtccataaagta

SEQ ID NO: 131805 - DNA, 15 bp, Homo sapiens
ttcgggattccctgg

SEQ ID NO: 131806 - DNA, 19 bp, Homo sapiens
ttctacacatatatgtata

SEQ ID NO: 131807 - DNA, 20 bp, Homo sapiens
ttctagacactccttgaaat

SEQ ID NO: 131808 - DNA, 21 bp, Homo sapiens
ttctataaatttaagaaaaca

SEQ ID NO: 131809 - DNA, 22 bp, Homo sapiens
ttctataaatttaagaaaacaa

SEQ ID NO: 131810 - DNA, 12 bp, Homo sapiens
ttctataataag

SEQ ID NO: 131811 - DNA, 21 bp, Homo sapiens
ttctataataagttttgatat

SEQ ID NO: 131812 - DNA, 15 bp, Homo sapiens
ttctcaatagttctt

SEQ ID NO: 131813 - DNA, 19 bp, Homo sapiens
ttctcaatagttcttaaaa

SEQ ID NO: 131814 - DNA, 13 bp, Homo sapiens
ttctcagtccttt

SEQ ID NO: 131815 - DNA, 18 bp, Homo sapiens
ttctccatttaagacaca

SEQ ID NO: 131816 - DNA, 14 bp, Homo sapiens
ttctccccggacac

SEQ ID NO: 131817 - DNA, 11 bp, Homo sapiens
ttctccctagc

SEQ ID NO: 131818 - DNA, 17 bp, Homo sapiens
ttctctcttttaaagta

SEQ ID NO: 131819 - DNA, 14 bp, Homo sapiens
ttctgagccccagc

SEQ ID NO: 131820 - DNA, 16 bp, Homo sapiens
ttctgagccccagccc

SEQ ID NO: 131821 - DNA, 16 bp, Homo sapiens
ttctgcaagaattaaa

SEQ ID NO: 131822 - DNA, 17 bp, Homo sapiens
ttctgcaagaattaaaa

SEQ ID NO: 131823 - DNA, 18 bp, Homo sapiens
ttctgcaagaattaaaac

SEQ ID NO: 131824 - DNA, 19 bp, Homo sapiens
ttctgcaagaattaaaact

SEQ ID NO: 131825 - DNA, 21 bp, Homo sapiens
ttctgcaagaattaaaactga

SEQ ID NO: 131826 - DNA, 18 bp, Homo sapiens
ttctgtccagtttccaaa

SEQ ID NO: 131827 - DNA, 15 bp, Homo sapiens
ttctgttaagaaagg

SEQ ID NO: 131828 - DNA, 11 bp, Homo sapiens
ttctgttttct

SEQ ID NO: 131829 - DNA, 17 bp, Homo sapiens
ttttattacaaatgcaa

SEQ ID NO: 131830 - DNA, 20 bp, Homo sapiens
ttttatttccacataaaggt

SEQ ID NO: 131831 - DNA, 13 bp, Homo sapiens
ttttcaccccacc

SEQ ID NO: 131832 - DNA, 20 bp, Homo sapiens
ttttcaccccacccttcccc

SEQ ID NO: 131833 - DNA, 22 bp, Homo sapiens
ttcttaaaaactgtgtatcatt

SEQ ID NO: 131834 - DNA, 16 bp, Homo sapiens
ttcttgaattgttatg

SEQ ID NO: 131835 - DNA, 20 bp, Homo sapiens
ttcttgaattgttatgaaaa

SEQ ID NO: 131836 - DNA, 12 bp, Homo sapiens
ttctttgtatca

SEQ ID NO: 131837 - DNA, 14 bp, Homo sapiens
ttgaaaaatattgc

SEQ ID NO: 131838 - DNA, 20 bp, Homo sapiens
ttgaaagtattcagaaatta

SEQ ID NO: 131839 - DNA, 21 bp, Homo sapiens
ttgaaagtattcagaaattaa

SEQ ID NO: 131840 - DNA, 16 bp, Homo sapiens
ttgaacaataaagttt

SEQ ID NO: 131841 - DNA, 18 bp, Homo sapiens
ttgaaggagaaaatgcat

SEQ ID NO: 131842 - DNA, 21 bp, Homo sapiens
ttgaataaaaagtgaactttt

SEQ ID NO: 131843 - DNA, 21 bp, Homo sapiens
ttgactcctttccaatagaaa

SEQ ID NO: 131844 - DNA, 22 bp, Homo sapiens
ttgagaaaaatagagcaaaatc

SEQ ID NO: 131845 - DNA, 23 bp, Homo sapiens
ttgagaaaaatagagcaaaatca

SEQ ID NO: 131846 - DNA, 12 bp, Homo sapiens
ttgagtttcaga

SEQ ID NO: 131847 - DNA, 14 bp, Homo sapiens
ttgagtttcagaat

SEQ ID NO: 131848 - DNA, 12 bp, Homo sapiens
ttgatcccctct

SEQ ID NO: 131849 - DNA, 12 bp, Homo sapiens
ttgattattctg

SEQ ID NO: 131850 - DNA, 14 bp, Homo sapiens
ttgattcagtatct

SEQ ID NO: 131851 - DNA, 16 bp, Homo sapiens
ttgattcagtatctta

SEQ ID NO: 131852 - DNA, 18 bp, Homo sapiens
ttgcacgcgccctttcta

SEQ ID NO: 131853 - DNA, 22 bp, Homo sapiens
ttgcagctcccattctatgtgt

SEQ ID NO: 131854 - DNA, 19 bp, Homo sapiens
ttgcagcttgtgctgagcc

SEQ ID NO: 131855 - DNA, 16 bp, Homo sapiens
ttgcccgccctccacc

SEQ ID NO: 131856 - DNA, 24 bp, Homo sapiens
ttgcctgctgcttggagtgcccca

SEQ ID NO: 131857 - DNA, 16 bp, Homo sapiens
ttgctaaaagaagaga

SEQ ID NO: 131858 - DNA, 16 bp, Homo sapiens
ttgcttacaaagtata

SEQ ID NO: 131859 - DNA, 12 bp, Homo sapiens
ttggaagctgct

SEQ ID NO: 131860 - DNA, 13 bp, Homo sapiens
ttggagtgcccca

SEQ ID NO: 131861 - DNA, 22 bp, Homo sapiens
ttggcacttataggtaacgtga

SEQ ID NO: 131862 - DNA, 20 bp, Homo sapiens
ttggcagccaaggaatgtgt

SEQ ID NO: 131863 - DNA, 20 bp, Homo sapiens
ttggcatgggcgcaggccca

SEQ ID NO: 131864 - DNA, 16 bp, Homo sapiens
ttgggaagattctcta

SEQ ID NO: 131865 - DNA, 22 bp, Homo sapiens
ttgggatcgcattgcatacctt

SEQ ID NO: 131866 - DNA, 15 bp, Homo sapiens
ttggggaccccctca

SEQ ID NO: 131867 - DNA, 11 bp, Homo sapiens
ttgggggcttc

SEQ ID NO: 131868 - DNA, 18 bp, Homo sapiens
ttggtcgagtctttgtgt

SEQ ID NO: 131869 - DNA, 13 bp, Homo sapiens
ttgtaacttcaaa

SEQ ID NO: 131870 - DNA, 18 bp, Homo sapiens
ttgtacaaagatatgcta

SEQ ID NO: 131871 - DNA, 13 bp, Homo sapiens
ttgtacaagtatt

SEQ ID NO: 131872 - DNA, 23 bp, Homo sapiens
ttgtataaaaaggaaattagtct

SEQ ID NO: 131873 - DNA, 14 bp, Homo sapiens
ttgtatatttgcaa

SEQ ID NO: 131874 - DNA, 16 bp, Homo sapiens
ttgtatctacagtaat

SEQ ID NO: 131875 - DNA, 19 bp, Homo sapiens
ttgtcctcccctattttaa

SEQ ID NO: 131876 - DNA, 17 bp, Homo sapiens
ttgtgtgttatattcca

SEQ ID NO: 131877 - DNA, 17 bp, Homo sapiens
ttgtgttttaaaaaaac

SEQ ID NO: 131878 - DNA, 11 bp, Homo sapiens
ttgttgatatt

SEQ ID NO: 131879 - DNA, 13 bp, Homo sapiens
tttaaaaaaactg

SEQ ID NO: 131880 - DNA, 15 bp, Homo sapiens
tttaaaaaaactgaa

SEQ ID NO: 131881 - DNA, 14 bp, Homo sapiens
tttaaaaaatattt

SEQ ID NO: 131882 - DNA, 17 bp, Homo sapiens
tttaaaaggcaactcaa

SEQ ID NO: 131883 - DNA, 15 bp, Homo sapiens
tttaaaataaaaata

SEQ ID NO: 131884 - DNA, 12 bp, Homo sapiens
tttaaataacct

SEQ ID NO: 131885 - DNA, 21 bp, Homo sapiens
tttaaataacctctggccctt

SEQ ID NO: 131886 - DNA, 16 bp, Homo sapiens
tttaacaaaaaatgta

SEQ ID NO: 131887 - DNA, 12 bp, Homo sapiens
tttaagaaagag

SEQ ID NO: 131888 - DNA, 13 bp, Homo sapiens
tttaagaaagaga

SEQ ID NO: 131889 - DNA, 23 bp, Homo sapiens
tttaagaaagagaatgaactgtg

SEQ ID NO: 131890 - DNA, 16 bp, Homo sapiens
tttaaggtttttactg

SEQ ID NO: 131891 - DNA, 16 bp, Homo sapiens
tttaagtgcaacattt

SEQ ID NO: 131892 - DNA, 19 bp, Homo sapiens
tttaagtgcaacatttctg

SEQ ID NO: 131893 - DNA, 20 bp, Homo sapiens
tttaagtttgttgctgtcaa

SEQ ID NO: 131894 - DNA, 15 bp, Homo sapiens
tttaatagaaaatta

SEQ ID NO: 131895 - DNA, 15 bp, Homo sapiens
tttaatattacctaa

SEQ ID NO: 131896 - DNA, 12 bp, Homo sapiens
tttaatcactta

SEQ ID NO: 131897 - DNA, 21 bp, Homo sapiens
tttaatcacttaacattccta

SEQ ID NO: 131898 - DNA, 17 bp, Homo sapiens
tttaatggactgtgaat

SEQ ID NO: 131899 - DNA, 21 bp, Homo sapiens
tttaattatctgcatttatct

SEQ ID NO: 131900 - DNA, 14 bp, Homo sapiens
tttaattgattatt

SEQ ID NO: 131901 - DNA, 15 bp, Homo sapiens
tttacagaatgcatt

SEQ ID NO: 131902 - DNA, 19 bp, Homo sapiens
tttacagaatgcattaaaa

SEQ ID NO: 131903 - DNA, 20 bp, Homo sapiens
tttacagaatgcattaaaaa

SEQ ID NO: 131904 - DNA, 13 bp, Homo sapiens
tttacagtttgtg

SEQ ID NO: 131905 - DNA, 17 bp, Homo sapiens
tttatatcccattttta

SEQ ID NO: 131906 - DNA, 14 bp, Homo sapiens
tttatatctggaat

SEQ ID NO: 131907 - DNA, 23 bp, Homo sapiens
tttatatctggaatgagcctgtt

SEQ ID NO: 131908 - DNA, 13 bp, Homo sapiens
tttatatctgtct

SEQ ID NO: 131909 - DNA, 16 bp, Homo sapiens
tttattctttttaaag

SEQ ID NO: 131910 - DNA, 20 bp, Homo sapiens
tttattggcagccaaggaat

SEQ ID NO: 131911 - DNA, 12 bp, Homo sapiens
tttcagaataaa

SEQ ID NO: 131912 - DNA, 13 bp, Homo sapiens
tttcagaataaaa

SEQ ID NO: 131913 - DNA, 23 bp, Homo sapiens
tttcagctattagcaactgtgct

SEQ ID NO: 131914 - DNA, 16 bp, Homo sapiens
tttcatctcttgtata

SEQ ID NO: 131915 - DNA, 21 bp, Homo sapiens
tttcatgctatcagaaacagt

SEQ ID NO: 131916 - DNA, 17 bp, Homo sapiens
tttccaaattattaatt

SEQ ID NO: 131917 - DNA, 13 bp, Homo sapiens
tttccaatagaaa

SEQ ID NO: 131918 - DNA, 15 bp, Homo sapiens
tttccactgccaaaa

SEQ ID NO: 131919 - DNA, 16 bp, Homo sapiens
tttcccagtgagcctc

SEQ ID NO: 131920 - DNA, 18 bp, Homo sapiens
tttcccagtgagcctctg

SEQ ID NO: 131921 - DNA, 16 bp, Homo sapiens
tttccctttttaaaaa

SEQ ID NO: 131922 - DNA, 16 bp, Homo sapiens
tttccttattgaaaaa

SEQ ID NO: 131923 - DNA, 18 bp, Homo sapiens
tttccttattgaaaaatc

SEQ ID NO: 131924 - DNA, 17 bp, Homo sapiens
tttccttctgttaagaa

SEQ ID NO: 131925 - DNA, 12 bp, Homo sapiens
tttctataaatt

SEQ ID NO: 131926 - DNA, 13 bp, Homo sapiens
tttctataaattt

SEQ ID NO: 131927 - DNA, 17 bp, Homo sapiens
tttctcaatagttctta

SEQ ID NO: 131928 - DNA, 23 bp, Homo sapiens
tttctcaatagttcttaaaatta

SEQ ID NO: 131929 - DNA, 14 bp, Homo sapiens
tttctggttccaaa

SEQ ID NO: 131930 - DNA, 15 bp, Homo sapiens
tttctggttccaaac

SEQ ID NO: 131931 - DNA, 21 bp, Homo sapiens
tagactgtttcacattgcact

SEQ ID NO: 131932 - DNA, 16 bp, Homo sapiens
tagagaccaggaggga

SEQ ID NO: 131933 - DNA, 20 bp, Homo sapiens
tagaggacactaggagactg

SEQ ID NO: 131934 - DNA, 13 bp, Homo sapiens
tagagtttacagt

SEQ ID NO: 131935 - DNA, 13 bp, Homo sapiens
tagccccacccag

SEQ ID NO: 131936 - DNA, 15 bp, Homo sapiens
tagccccacccagag

SEQ ID NO: 131937 - DNA, 16 bp, Homo sapiens
tagccccacccagagg

SEQ ID NO: 131938 - DNA, 16 bp, Homo sapiens
tagctggcaagaatgg

SEQ ID NO: 131939 - DNA, 14 bp, Homo sapiens
tagcttttaaaaaa

SEQ ID NO: 131940 - DNA, 13 bp, Homo sapiens
tttgagaaaaata

SEQ ID NO: 131941 - DNA, 14 bp, Homo sapiens
tttgagaaaaatag

SEQ ID NO: 131942 - DNA, 16 bp, Homo sapiens
tttgcattagacagat

SEQ ID NO: 131943 - DNA, 12 bp, Homo sapiens
tttgctccaggc

SEQ ID NO: 131944 - DNA, 10 bp, Homo sapiens
tttgctgcca

SEQ ID NO: 131945 - DNA, 23 bp, Homo sapiens
tttgcttaatttccttctgttaa

SEQ ID NO: 131946 - DNA, 22 bp, Homo sapiens
tttgctttcagatgcagttttc

SEQ ID NO: 131947 - DNA, 20 bp, Homo sapiens
tttggtgctcatttaaatat

SEQ ID NO: 131948 - DNA, 20 bp, Homo sapiens
tttgtaaaatattatgtttg

SEQ ID NO: 131949 - DNA, 13 bp, Homo sapiens
tttgtaacttcaa

SEQ ID NO: 131950 - DNA, 14 bp, Homo sapiens
tttgtaacttcaaa

SEQ ID NO: 131951 - DNA, 18 bp, Homo sapiens
tttgtacgttatatattg

SEQ ID NO: 131952 - DNA, 23 bp, Homo sapiens
tttgtacttttctggttccaaac

SEQ ID NO: 131953 - DNA, 14 bp, Homo sapiens
tttgtagactgttt

SEQ ID NO: 131954 - DNA, 16 bp, Homo sapiens
tttgtataaaaaggaa

SEQ ID NO: 131955 - DNA, 16 bp, Homo sapiens
tttgtattataattgt

SEQ ID NO: 131956 - DNA, 14 bp, Homo sapiens
tttgtgtgttatat

SEQ ID NO: 131957 - DNA, 15 bp, Homo sapiens
tttgtgttttaaaaa

SEQ ID NO: 131958 - DNA, 20 bp, Homo sapiens
tttgtgttttaaaaaaactg

SEQ ID NO: 131959 - DNA, 21 bp, Homo sapiens
tttgtgttttaaaaaaactga

SEQ ID NO: 131960 - DNA, 23 bp, Homo sapiens
tttgtgttttaaaaaaactgaag

SEQ ID NO: 131961 - DNA, 14 bp, Homo sapiens
tttgttgctgtcaa

SEQ ID NO: 131962 - DNA, 14 bp, Homo sapiens
tttgtttgcttaat

SEQ ID NO: 131963 - DNA, 16 bp, Homo sapiens
ttttaaaaaaactgaa

SEQ ID NO: 131964 - DNA, 20 bp, Homo sapiens
ttttaaaaaaactgaaggtt

SEQ ID NO: 131965 - DNA, 23 bp, Homo sapiens
ttttaaaaaataccattgaaatc

SEQ ID NO: 131966 - DNA, 17 bp, Homo sapiens
ttttaaaataaaaatat

SEQ ID NO: 131967 - DNA, 11 bp, Homo sapiens
ttttaagaaag

SEQ ID NO: 131968 - DNA, 12 bp, Homo sapiens
ttttaagaaaga

SEQ ID NO: 131969 - DNA, 13 bp, Homo sapiens
ttttaagacgtga

SEQ ID NO: 131970 - DNA, 23 bp, Homo sapiens
ttttaagtgcaacatttctgtat

SEQ ID NO: 131971 - DNA, 12 bp, Homo sapiens
ttttaatagaac

SEQ ID NO: 131972 - DNA, 15 bp, Homo sapiens
ttttaattgattatt

SEQ ID NO: 131973 - DNA, 22 bp, Homo sapiens
ttttacagaatgcattaaaaaa

SEQ ID NO: 131974 - DNA, 14 bp, Homo sapiens
ttttactgacagaa

SEQ ID NO: 131975 - DNA, 21 bp, Homo sapiens
ttttatatctggaatgagcct

SEQ ID NO: 131976 - DNA, 17 bp, Homo sapiens
ttttatttccacataaa

SEQ ID NO: 131977 - DNA, 20 bp, Homo sapiens
ttttcagctattagcaactg

SEQ ID NO: 131978 - DNA, 13 bp, Homo sapiens
ttttcccttttta

SEQ ID NO: 131979 - DNA, 12 bp, Homo sapiens
ttttctttgtat

SEQ ID NO: 131980 - DNA, 18 bp, Homo sapiens
ttttctttgtatcattca

SEQ ID NO: 131981 - DNA, 13 bp, Homo sapiens
ttttgaaaaatat

SEQ ID NO: 131982 - DNA, 14 bp, Homo sapiens
ttttgaaaaatatt

SEQ ID NO: 131983 - DNA, 19 bp, Homo sapiens
ttttgaaaaatattgctaa

SEQ ID NO: 131984 - DNA, 14 bp, Homo sapiens
ttttgaaggaatac

SEQ ID NO: 131985 - DNA, 17 bp, Homo sapiens
ttttgaataaaaagtga

SEQ ID NO: 131986 - DNA, 21 bp, Homo sapiens
ttttgaataaaaagtgaactt

SEQ ID NO: 131987 - DNA, 15 bp, Homo sapiens
ttttgatataatctt

SEQ ID NO: 131988 - DNA, 16 bp, Homo sapiens
ttttgtaacttcaaat

SEQ ID NO: 131989 - DNA, 15 bp, Homo sapiens
ttttgtaatttgaat

SEQ ID NO: 131990 - DNA, 20 bp, Homo sapiens
ttttgtaatttgaattgggt

SEQ ID NO: 131991 - DNA, 15 bp, Homo sapiens
ttttgtcctgttatt

SEQ ID NO: 131992 - DNA, 12 bp, Homo sapiens
tttttaaaaaat

SEQ ID NO: 131993 - DNA, 17 bp, Homo sapiens
tttttaaaaaataccat

SEQ ID NO: 131994 - DNA, 15 bp, Homo sapiens
tttttaaaagagaca

SEQ ID NO: 131995 - DNA, 16 bp, Homo sapiens
tttttaaaataaaaat

SEQ ID NO: 131996 - DNA, 12 bp, Homo sapiens
tttttaatagaa

SEQ ID NO: 131997 - DNA, 23 bp, Homo sapiens
tttttatatctggaatgagcctg

SEQ ID NO: 131998 - DNA, 14 bp, Homo sapiens
tttttggtaaattt

SEQ ID NO: 131999 - DNA, 16 bp, Homo sapiens
tttttgtaacttcaaa

SEQ ID NO: 132000 - DNA, 12 bp, Homo sapiens
ttttttccaaat

SEQ ID NO: 132001 - DNA, 11 bp, Homo sapiens
ttttttgtaac

SEQ ID NO: 132002 - DNA, 13 bp, Homo sapiens
tttttttttaagt

SEQ ID NO: 132003 - DNA, 18 bp, Homo sapiens
tatctgtttgtatatttg

SEQ ID NO: 132004 - DNA, 20 bp, Homo sapiens
tatctgtttgtatatttgca

SEQ ID NO: 132005 - DNA, 18 bp, Homo sapiens
tatcttagagtttacagt

SEQ ID NO: 132006 - DNA, 22 bp, Homo sapiens
tatcttagagtttacagtttgt

SEQ ID NO: 132007 - DNA, 20 bp, Homo sapiens
tatcttttttcctagttttt

SEQ ID NO: 132008 - DNA, 21 bp, Homo sapiens
tatgaatatatggcatttgca

SEQ ID NO: 132009 - DNA, 18 bp, Homo sapiens
tatgagagtttggaatta

SEQ ID NO: 132010 - DNA, 19 bp, Homo sapiens
tatgtacctctagctgttc

SEQ ID NO: 132011 - DNA, 22 bp, Homo sapiens
tatgtacctctagctgttcttt

SEQ ID NO: 132012 - DNA, 18 bp, Homo sapiens
tatgtatatgtatatcta

SEQ ID NO: 132013 - DNA, 17 bp, Homo sapiens
tattaagatttccaagt

SEQ ID NO: 132014 - DNA, 15 bp, Homo sapiens
tattaagggcatttt

SEQ ID NO: 132015 - DNA, 17 bp, Homo sapiens
tattaattgtcctgtgt

SEQ ID NO: 132016 - DNA, 16 bp, Homo sapiens
tattacaaatgcaaat

SEQ ID NO: 132017 - DNA, 12 bp, Homo sapiens
tattacttgaac

SEQ ID NO: 132018 - DNA, 14 bp, Homo sapiens
tattacttgaactt

SEQ ID NO: 132019 - DNA, 19 bp, Homo sapiens
tattagcagggattctctc

SEQ ID NO: 132020 - DNA, 21 bp, Homo sapiens
tattagtttgatttaatatct

SEQ ID NO: 132021 - DNA, 13 bp, Homo sapiens
tattataattgtt

SEQ ID NO: 132022 - DNA, 17 bp, Homo sapiens
tattataattgttgata

SEQ ID NO: 132023 - DNA, 20 bp, Homo sapiens
tattatgtttgatttctcta

SEQ ID NO: 132024 - DNA, 14 bp, Homo sapiens
tattatttgatatc

SEQ ID NO: 132025 - DNA, 16 bp, Homo sapiens
tattatttgatatctg

SEQ ID NO: 132026 - DNA, 19 bp, Homo sapiens
tattccaaggaaaattgaa

SEQ ID NO: 132027 - DNA, 20 bp, Homo sapiens
tattccaaggaaaattgaaa

SEQ ID NO: 132028 - DNA, 16 bp, Homo sapiens
tattctacacatatat

SEQ ID NO: 132029 - DNA, 18 bp, Homo sapiens
tattctacacatatatgt

SEQ ID NO: 132030 - DNA, 22 bp, Homo sapiens
tattctacacatatatgtatat

SEQ ID NO: 132031 - DNA, 18 bp, Homo sapiens
tattctgctgaagattca

SEQ ID NO: 132032 - DNA, 15 bp, Homo sapiens
tattcttaaaatgca

SEQ ID NO: 132033 - DNA, 18 bp, Homo sapiens
tattcttaaaatgcaata

SEQ ID NO: 132034 - DNA, 11 bp, Homo sapiens
tattgctaaaa

SEQ ID NO: 132035 - DNA, 16 bp, Homo sapiens
tattgctaaaagtgca

SEQ ID NO: 132036 - DNA, 22 bp, Homo sapiens
tattgctaaaagtgcatttaag

SEQ ID NO: 132037 - DNA, 18 bp, Homo sapiens
tattggcagccaaggaat

SEQ ID NO: 132038 - DNA, 21 bp, Homo sapiens
tattggcagccaaggaatgtg

SEQ ID NO: 132039 - DNA, 14 bp, Homo sapiens
tctgtatactgtaa

SEQ ID NO: 132040 - DNA, 15 bp, Homo sapiens
caaggaaaattgaaa

SEQ ID NO: 132041 - DNA, 16 bp, Homo sapiens
caaggaaaattgaaag

SEQ ID NO: 132042 - DNA, 16 bp, Homo sapiens
caaggaatgtgtccaa

SEQ ID NO: 132043 - DNA, 19 bp, Homo sapiens
caaggccggagacccacag

SEQ ID NO: 132044 - DNA, 20 bp, Homo sapiens
caaggccggagacccacagc

SEQ ID NO: 132045 - DNA, 21 bp, Homo sapiens
caaggccggagacccacagcc

SEQ ID NO: 132046 - DNA, 22 bp, Homo sapiens
caaggccggagacccacagccc

SEQ ID NO: 132047 - DNA, 14 bp, Homo sapiens
caaggtaggctgca

SEQ ID NO: 132048 - DNA, 15 bp, Homo sapiens
caagtatataattta

SEQ ID NO: 132049 - DNA, 22 bp, Homo sapiens
caagtatataatttactttgta

SEQ ID NO: 132050 - DNA, 19 bp, Homo sapiens
caagtctctgctggcccag

SEQ ID NO: 132051 - DNA, 15 bp, Homo sapiens
caagtgaacttggga

SEQ ID NO: 132052 - DNA, 17 bp, Homo sapiens
caagtgaacttgggagg

SEQ ID NO: 132053 - DNA, 19 bp, Homo sapiens
caagtggtgaccaaaattt

SEQ ID NO: 132054 - DNA, 12 bp, Homo sapiens
caagtttgctaa

SEQ ID NO: 132055 - DNA, 13 bp, Homo sapiens
caagtttgctaaa

SEQ ID NO: 132056 - DNA, 14 bp, Homo sapiens
caagtttgctaaaa

SEQ ID NO: 132057 - DNA, 18 bp, Homo sapiens
caagtttgctaaaagaag

SEQ ID NO: 132058 - DNA, 19 bp, Homo sapiens
caataaaattatttgcagg

SEQ ID NO: 132059 - DNA, 22 bp, Homo sapiens
caataaaattatttgcaggtct

SEQ ID NO: 132060 - DNA, 12 bp, Homo sapiens
caataaacagct

SEQ ID NO: 132061 - DNA, 16 bp, Homo sapiens
caataaagtttgcttt

SEQ ID NO: 132062 - DNA, 21 bp, Homo sapiens
caatagtgtcctatgcaataa

SEQ ID NO: 132063 - DNA, 22 bp, Homo sapiens
ttccaaggaaaattgaaagtat

SEQ ID NO: 132064 - DNA, 13 bp, Homo sapiens
ttccacataaagg

SEQ ID NO: 132065 - DNA, 22 bp, Homo sapiens
ttcccaaatcaaaataaaagaa

SEQ ID NO: 132066 - DNA, 14 bp, Homo sapiens
ttcccagtgagcct

SEQ ID NO: 132067 - DNA, 13 bp, Homo sapiens
ttccctctcccac

SEQ ID NO: 132068 - DNA, 21 bp, Homo sapiens
ttccctttttaaaaaatacca

SEQ ID NO: 132069 - DNA, 13 bp, Homo sapiens
ttcctaaaatgct

SEQ ID NO: 132070 - DNA, 12 bp, Homo sapiens
ttcctagttttt

SEQ ID NO: 132071 - DNA, 15 bp, Homo sapiens
ttcctagtttttcta

SEQ ID NO: 132072 - DNA, 19 bp, Homo sapiens
ttcctcctctcctggaaac

SEQ ID NO: 132073 - DNA, 22 bp, Homo sapiens
ttcctgtggttttattacaaat

SEQ ID NO: 132074 - DNA, 20 bp, Homo sapiens
ttccttctgttaagaaagga

SEQ ID NO: 132075 - DNA, 23 bp, Homo sapiens
ttctacactgggtgctgatcctt

SEQ ID NO: 132076 - DNA, 14 bp, Homo sapiens
ttctaccccacctg

SEQ ID NO: 132077 - DNA, 19 bp, Homo sapiens
ttctaccccacctgacctc

SEQ ID NO: 132078 - DNA, 17 bp, Homo sapiens
ttctattgtttattctt

SEQ ID NO: 132079 - DNA, 16 bp, Homo sapiens
ttctcaatagttctta

SEQ ID NO: 132080 - DNA, 21 bp, Homo sapiens
ttctcggcaccagtgcctcag

SEQ ID NO: 132081 - DNA, 12 bp, Homo sapiens
ttctctcatcta

SEQ ID NO: 132082 - DNA, 22 bp, Homo sapiens
ttctctcatctaactgatgagt

SEQ ID NO: 132083 - DNA, 15 bp, Homo sapiens
ttctctctgctgagc

SEQ ID NO: 132084 - DNA, 13 bp, Homo sapiens
ttctctcttttaa

SEQ ID NO: 132085 - DNA, 15 bp, Homo sapiens
ttctgatgcccaccg

SEQ ID NO: 132086 - DNA, 12 bp, Homo sapiens
ttctgattccac

SEQ ID NO: 132087 - DNA, 15 bp, Homo sapiens
ttctgcaagaattaa

SEQ ID NO: 132088 - DNA, 20 bp, Homo sapiens
ttctgcaagaattaaaactg

SEQ ID NO: 132089 - DNA, 22 bp, Homo sapiens
ttctgcaagaattaaaactgag

SEQ ID NO: 132090 - DNA, 21 bp, Homo sapiens
ttctgcaagcacatctgcatt

SEQ ID NO: 132091 - DNA, 22 bp, Homo sapiens
ttctgcaagcacatctgcattt

SEQ ID NO: 132092 - DNA, 14 bp, Homo sapiens
ttctggttccaaac

SEQ ID NO: 132093 - DNA, 19 bp, Homo sapiens
ttctgtatactgtaaaagt

SEQ ID NO: 132094 - DNA, 19 bp, Homo sapiens
ttctgtttagttttacact

SEQ ID NO: 132095 - DNA, 13 bp, Homo sapiens
ttcttaaaaactg

SEQ ID NO: 132096 - DNA, 18 bp, Homo sapiens
ttcttaaaaactgtgtat

SEQ ID NO: 132097 - DNA, 16 bp, Homo sapiens
ttcttaaaatgcaata

SEQ ID NO: 132098 - DNA, 22 bp, Homo sapiens
ttcttaaaatgcaatatttgta

SEQ ID NO: 132099 - DNA, 14 bp, Homo sapiens
ttcttaaaattagt

SEQ ID NO: 132100 - DNA, 15 bp, Homo sapiens
ttcttaaaattcagt

SEQ ID NO: 132101 - DNA, 17 bp, Homo sapiens
ttcttcccaaatcaaaa

SEQ ID NO: 132102 - DNA, 22 bp, Homo sapiens
ttcttcccaaatcaaaataaaa

SEQ ID NO: 132103 - DNA, 12 bp, Homo sapiens
ttcttgaattgt

SEQ ID NO: 132104 - DNA, 15 bp, Homo sapiens
ttcttgaattgttat

SEQ ID NO: 132105 - DNA, 14 bp, Homo sapiens
ttcttttctttgta

SEQ ID NO: 132106 - DNA, 15 bp, Homo sapiens
ttgaaaaatattgct

SEQ ID NO: 132107 - DNA, 18 bp, Homo sapiens
ttgaaaaatattgctaaa

SEQ ID NO: 132108 - DNA, 18 bp, Homo sapiens
ttgaactttccaaaacct

SEQ ID NO: 132109 - DNA, 16 bp, Homo sapiens
ttgaaggaatacaata

SEQ ID NO: 132110 - DNA, 18 bp, Homo sapiens
ttgaaggaatacaatata

SEQ ID NO: 132111 - DNA, 12 bp, Homo sapiens
ttgaataaaaag

SEQ ID NO: 132112 - DNA, 15 bp, Homo sapiens
ttgaataaaaagtga

SEQ ID NO: 132113 - DNA, 16 bp, Homo sapiens
ttgaataaaaagtgaa

SEQ ID NO: 132114 - DNA, 17 bp, Homo sapiens
ttgaattgttatgaaaa

SEQ ID NO: 132115 - DNA, 16 bp, Homo sapiens
ttgagtttcagaataa

SEQ ID NO: 132116 - DNA, 17 bp, Homo sapiens
ttgagtttcagaataaa

SEQ ID NO: 132117 - DNA, 18 bp, Homo sapiens
ttgatattttcccttttt

SEQ ID NO: 132118 - DNA, 20 bp, Homo sapiens
ttgatattttccctttttaa

SEQ ID NO: 132119 - DNA, 14 bp, Homo sapiens
ttgatttaatatct

SEQ ID NO: 132120 - DNA, 16 bp, Homo sapiens
ttgcaaaccctttgta

SEQ ID NO: 132121 - DNA, 20 bp, Homo sapiens
ttgcacgcgccctttctacc

SEQ ID NO: 132122 - DNA, 12 bp, Homo sapiens
ttgcactttgta

SEQ ID NO: 132123 - DNA, 14 bp, Homo sapiens
ttgcactttgtagt

SEQ ID NO: 132124 - DNA, 13 bp, Homo sapiens
ttgcagaagttct

SEQ ID NO: 132125 - DNA, 19 bp, Homo sapiens
ttgcagaagttcttagtgt

SEQ ID NO: 132126 - DNA, 23 bp, Homo sapiens
ttgcagctcccattctatgtgtc

SEQ ID NO: 132127 - DNA, 14 bp, Homo sapiens
ttgcatttcatgct

SEQ ID NO: 132128 - DNA, 23 bp, Homo sapiens
ttgcctgctgcttggagtgcccc

SEQ ID NO: 132129 - DNA, 13 bp, Homo sapiens
ttgctaaaagaag

SEQ ID NO: 132130 - DNA, 15 bp, Homo sapiens
ttgctaaaagaagag

SEQ ID NO: 132131 - DNA, 22 bp, Homo sapiens
ttgcttaatttccttctgttaa

SEQ ID NO: 132132 - DNA, 14 bp, Homo sapiens
ttggaggagactgg

SEQ ID NO: 132133 - DNA, 16 bp, Homo sapiens
ttggaggagactgggc

SEQ ID NO: 132134 - DNA, 12 bp, Homo sapiens
ttggagtgcccc

SEQ ID NO: 132135 - DNA, 23 bp, Homo sapiens
ttggcagccaaggaatgtgtcca

SEQ ID NO: 132136 - DNA, 22 bp, Homo sapiens
ttggcatgggcgcaggcccagt

SEQ ID NO: 132137 - DNA, 21 bp, Homo sapiens
ttggcttcttaaaaactgtgt

SEQ ID NO: 132138 - DNA, 22 bp, Homo sapiens
ttggcttcttaaaaactgtgta

SEQ ID NO: 132139 - DNA, 19 bp, Homo sapiens
ttgggagacaattagcaga

SEQ ID NO: 132140 - DNA, 11 bp, Homo sapiens
ttggtaaattt

SEQ ID NO: 132141 - DNA, 12 bp, Homo sapiens
ttggtttaatat

SEQ ID NO: 132142 - DNA, 14 bp, Homo sapiens
ttgtaacttcaaat

SEQ ID NO: 132143 - DNA, 15 bp, Homo sapiens
ttgtaacttcaaata

SEQ ID NO: 132144 - DNA, 16 bp, Homo sapiens
ttgtaatttgaattgg

SEQ ID NO: 132145 - DNA, 18 bp, Homo sapiens
ttgtacattttgtaaaat

SEQ ID NO: 132146 - DNA, 15 bp, Homo sapiens
ttgtacgttatatat

SEQ ID NO: 132147 - DNA, 16 bp, Homo sapiens
ttgtacgttatatatt

SEQ ID NO: 132148 - DNA, 21 bp, Homo sapiens
ttgtacttttctggttccaaa

SEQ ID NO: 132149 - DNA, 12 bp, Homo sapiens
atgttacaagtt

SEQ ID NO: 132150 - DNA, 15 bp, Homo sapiens
atgttattgcataat

SEQ ID NO: 132151 - DNA, 16 bp, Homo sapiens
atgttctgcaagaatt

SEQ ID NO: 132152 - DNA, 17 bp, Homo sapiens
atgttctgcaagaatta

SEQ ID NO: 132153 - DNA, 18 bp, Homo sapiens
atgttctgcaagaattaa

SEQ ID NO: 132154 - DNA, 22 bp, Homo sapiens
atgttctgcaagaattaaaact

SEQ ID NO: 132155 - DNA, 19 bp, Homo sapiens
atgttggttgcactttgta

SEQ ID NO: 132156 - DNA, 14 bp, Homo sapiens
attaaaactgagtc

SEQ ID NO: 132157 - DNA, 20 bp, Homo sapiens
attaaaactgagtccatgaa

SEQ ID NO: 132158 - DNA, 14 bp, Homo sapiens
attaaaatattatt

SEQ ID NO: 132159 - DNA, 16 bp, Homo sapiens
attaaaatattatttg

SEQ ID NO: 132160 - DNA, 22 bp, Homo sapiens
attaaaatattatttgatatct

SEQ ID NO: 132161 - DNA, 21 bp, Homo sapiens
attaaaatctggcaaagttat

SEQ ID NO: 132162 - DNA, 16 bp, Homo sapiens
attaaagaaataattt

SEQ ID NO: 132163 - DNA, 18 bp, Homo sapiens
attaaatctagacattct

SEQ ID NO: 132164 - DNA, 16 bp, Homo sapiens
attaagatttccaagt

SEQ ID NO: 132165 - DNA, 18 bp, Homo sapiens
attaattgtcctgtgtct

SEQ ID NO: 132166 - DNA, 18 bp, Homo sapiens
attacaaatgcaaatttc

SEQ ID NO: 132167 - DNA, 21 bp, Homo sapiens
attacaaatgcaaatttctat

SEQ ID NO: 132168 - DNA, 15 bp, Homo sapiens
attacctaatgaaag

SEQ ID NO: 132169 - DNA, 16 bp, Homo sapiens
attagagaactggagg

SEQ ID NO: 132170 - DNA, 22 bp, Homo sapiens
attagcagaatggagaaagtaa

SEQ ID NO: 132171 - DNA, 22 bp, Homo sapiens
attagctacttttcagaattga

SEQ ID NO: 132172 - DNA, 13 bp, Homo sapiens
attagttgctttg

SEQ ID NO: 132173 - DNA, 14 bp, Homo sapiens
attagttgctttgt

SEQ ID NO: 132174 - DNA, 13 bp, Homo sapiens
attatatatcata

SEQ ID NO: 132175 - DNA, 19 bp, Homo sapiens
attatatatcataaagtat

SEQ ID NO: 132176 - DNA, 18 bp, Homo sapiens
attatctgcatttatctt

SEQ ID NO: 132177 - DNA, 21 bp, Homo sapiens
attatggtctggggtaaaatt

SEQ ID NO: 132178 - DNA, 13 bp, Homo sapiens
attattaattgtc

SEQ ID NO: 132179 - DNA, 16 bp, Homo sapiens
attattaattgtcctg

SEQ ID NO: 132180 - DNA, 16 bp, Homo sapiens
attattgtagacatgc

SEQ ID NO: 132181 - DNA, 17 bp, Homo sapiens
attcaattaaagaaata

SEQ ID NO: 132182 - DNA, 19 bp, Homo sapiens
attcaattaaagaaataat

SEQ ID NO: 132183 - DNA, 17 bp, Homo sapiens
attcagaaattaaaata

SEQ ID NO: 132184 - DNA, 17 bp, Homo sapiens
attcagctgaggttcat

SEQ ID NO: 132185 - DNA, 13 bp, Homo sapiens
attccaaggaaaa

SEQ ID NO: 132186 - DNA, 22 bp, Homo sapiens
attccaaggaaaattgaaagta

SEQ ID NO: 132187 - DNA, 13 bp, Homo sapiens
attccctctccca

SEQ ID NO: 132188 - DNA, 14 bp, Homo sapiens
attccctctcccac

SEQ ID NO: 132189 - DNA, 24 bp, Homo sapiens
attctacacatatatgtatatgta

SEQ ID NO: 132190 - DNA, 14 bp, Homo sapiens
attctatgtgtcat

SEQ ID NO: 132191 - DNA, 23 bp, Homo sapiens
attctatgtgtcatcaatagtgt

SEQ ID NO: 132192 - DNA, 17 bp, Homo sapiens
attctgtggttctataa

SEQ ID NO: 132193 - DNA, 17 bp, Homo sapiens
atttccagtgagtgtaa

SEQ ID NO: 132194 - DNA, 19 bp, Homo sapiens
atttccagtgagtgtaaat

SEQ ID NO: 132195 - DNA, 14 bp, Homo sapiens
atttctataaattt

SEQ ID NO: 132196 - DNA, 21 bp, Homo sapiens
atttctataaatttaagaaaa

SEQ ID NO: 132197 - DNA, 15 bp, Homo sapiens
atttctcaatagttc

SEQ ID NO: 132198 - DNA, 20 bp, Homo sapiens
atttctcaatagttcttaaa

SEQ ID NO: 132199 - DNA, 18 bp, Homo sapiens
atttctctacttgtcata

SEQ ID NO: 132200 - DNA, 15 bp, Homo sapiens
atttctctgttccat

SEQ ID NO: 132201 - DNA, 22 bp, Homo sapiens
atttctgtatactgtaaaagtt

SEQ ID NO: 132202 - DNA, 18 bp, Homo sapiens
atttgcaaaccctttgta

SEQ ID NO: 132203 - DNA, 22 bp, Homo sapiens
atttgcaaaccctttgtattat

SEQ ID NO: 132204 - DNA, 16 bp, Homo sapiens
atttgtaaggcttgtt

SEQ ID NO: 132205 - DNA, 20 bp, Homo sapiens
attttaaaagcaattatatt

SEQ ID NO: 132206 - DNA, 21 bp, Homo sapiens
attttaaaagcaattatattg

SEQ ID NO: 132207 - DNA, 22 bp, Homo sapiens
attttaaaagcaattatattgt

SEQ ID NO: 132208 - DNA, 11 bp, Homo sapiens
attttaaataa

SEQ ID NO: 132209 - DNA, 12 bp, Homo sapiens
attttaagaaag

SEQ ID NO: 132210 - DNA, 17 bp, Homo sapiens
attttaagaaagagaat

SEQ ID NO: 132211 - DNA, 16 bp, Homo sapiens
attttactgacagaaa

SEQ ID NO: 132212 - DNA, 15 bp, Homo sapiens
attttcaccccaccc

SEQ ID NO: 132213 - DNA, 22 bp, Homo sapiens
attttcctttttcatgtaagtt

SEQ ID NO: 132214 - DNA, 20 bp, Homo sapiens
attttcttcccaaatcaaaa

SEQ ID NO: 132215 - DNA, 14 bp, Homo sapiens
attttgagaaaaat

SEQ ID NO: 132216 - DNA, 19 bp, Homo sapiens
attttgggttttgggtctt

SEQ ID NO: 132217 - DNA, 11 bp, Homo sapiens
attttgtaaaa

SEQ ID NO: 132218 - DNA, 21 bp, Homo sapiens
attttgtacaaagatatgcta

SEQ ID NO: 132219 - DNA, 19 bp, Homo sapiens
attttgtgaaagaaggagc

SEQ ID NO: 132220 - DNA, 19 bp, Homo sapiens
atttttatattagttgctt

SEQ ID NO: 132221 - DNA, 17 bp, Homo sapiens
atttttgaaaaatattg

SEQ ID NO: 132222 - DNA, 12 bp, Homo sapiens
atttttgtataa

SEQ ID NO: 132223 - DNA, 13 bp, Homo sapiens
atttttgtataaa

SEQ ID NO: 132224 - DNA, 15 bp, Homo sapiens
attttttttgtaact

SEQ ID NO: 132225 - DNA, 21 bp, Homo sapiens
caaaaaaaaaaaaaaagactg

SEQ ID NO: 132226 - DNA, 17 bp, Homo sapiens
caaaaagaccttctccc

SEQ ID NO: 132227 - DNA, 20 bp, Homo sapiens
caaaaataacactgttggca

SEQ ID NO: 132228 - DNA, 20 bp, Homo sapiens
caaaagaaaccatgacaaac

SEQ ID NO: 132229 - DNA, 22 bp, Homo sapiens
caaaagactggtttgtttgctt

SEQ ID NO: 132230 - DNA, 15 bp, Homo sapiens
caaaagagtgtaaaa

SEQ ID NO: 132231 - DNA, 19 bp, Homo sapiens
caaaagagtgtaaaatatt

SEQ ID NO: 132232 - DNA, 15 bp, Homo sapiens
caaaatcaacatgac

SEQ ID NO: 132233 - DNA, 23 bp, Homo sapiens
caaaatttttaggtgaagtcgag

SEQ ID NO: 132234 - DNA, 16 bp, Homo sapiens
caaacaaaaaaaagaa

SEQ ID NO: 132235 - DNA, 13 bp, Homo sapiens
caaacccatgaag

SEQ ID NO: 132236 - DNA, 14 bp, Homo sapiens
caaagagagttttt

SEQ ID NO: 132237 - DNA, 21 bp, Homo sapiens
caaagagagtttttaatagaa

SEQ ID NO: 132238 - DNA, 21 bp, Homo sapiens
caaagcacttgcttacatcct

SEQ ID NO: 132239 - DNA, 19 bp, Homo sapiens
caaagcatgggaaaaagag

SEQ ID NO: 132240 - DNA, 22 bp, Homo sapiens
caaagcatgggaaaaagagact

SEQ ID NO: 132241 - DNA, 22 bp, Homo sapiens
caaaggaatataagaaaagtaa

SEQ ID NO: 132242 - DNA, 18 bp, Homo sapiens
caaagggcagtaaagttt

SEQ ID NO: 132243 - DNA, 13 bp, Homo sapiens
caaagttatattt

SEQ ID NO: 132244 - DNA, 22 bp, Homo sapiens
caaatatagagatatttttgta

SEQ ID NO: 132245 - DNA, 16 bp, Homo sapiens
caaatccaaggaaaca

SEQ ID NO: 132246 - DNA, 17 bp, Homo sapiens
caaattattaattgtcc

SEQ ID NO: 132247 - DNA, 23 bp, Homo sapiens
caaattattaattgtcctgtgtc

SEQ ID NO: 132248 - DNA, 21 bp, Homo sapiens
caaatttctataaatttaaga

SEQ ID NO: 132249 - DNA, 17 bp, Homo sapiens
caaattttttaaaagag

SEQ ID NO: 132250 - DNA, 19 bp, Homo sapiens
caaattttttaaaagagac

SEQ ID NO: 132251 - DNA, 21 bp, Homo sapiens
caacaggtagcatagctctgt

SEQ ID NO: 132252 - DNA, 21 bp, Homo sapiens
caacatgacatccagagatga

SEQ ID NO: 132253 - DNA, 12 bp, Homo sapiens
caacatttctgt

SEQ ID NO: 132254 - DNA, 19 bp, Homo sapiens
caacatttctgtatactgt

SEQ ID NO: 132255 - DNA, 17 bp, Homo sapiens
caacgctctaccctgca

SEQ ID NO: 132256 - DNA, 12 bp, Homo sapiens
caagaattaaaa

SEQ ID NO: 132257 - DNA, 13 bp, Homo sapiens
caagaattaaaac

SEQ ID NO: 132258 - DNA, 18 bp, Homo sapiens
caagacttcactgcagcc

SEQ ID NO: 132259 - DNA, 19 bp, Homo sapiens
caagacttcactgcagcct

SEQ ID NO: 132260 - DNA, 20 bp, Homo sapiens
caagacttcactgcagcctt

SEQ ID NO: 132261 - DNA, 19 bp, Homo sapiens
caagaggtttttctccccg

SEQ ID NO: 132262 - DNA, 20 bp, Homo sapiens
caagattttttttgtaactt

SEQ ID NO: 132263 - DNA, 17 bp, Homo sapiens
caagcacatctgcattt

SEQ ID NO: 132264 - DNA, 13 bp, Homo sapiens
cccatctctccct

SEQ ID NO: 132265 - DNA, 21 bp, Homo sapiens
cccatctctccctcccctgcc

SEQ ID NO: 132266 - DNA, 20 bp, Homo sapiens
ccccaaaagaaaccatgaca

SEQ ID NO: 132267 - DNA, 15 bp, Homo sapiens
ccccaatccagagaa

SEQ ID NO: 132268 - DNA, 13 bp, Homo sapiens
ccccacagccctg

SEQ ID NO: 132269 - DNA, 14 bp, Homo sapiens
ccccacagccctgg

SEQ ID NO: 132270 - DNA, 13 bp, Homo sapiens
ccccacccagagg

SEQ ID NO: 132271 - DNA, 18 bp, Homo sapiens
ccccacctgacctctgca

SEQ ID NO: 132272 - DNA, 21 bp, Homo sapiens
ccccactgacagcctcccacc

SEQ ID NO: 132273 - DNA, 19 bp, Homo sapiens
ccccagccccaatccagag

SEQ ID NO: 132274 - DNA, 11 bp, Homo sapiens
ccccagccccc

SEQ ID NO: 132275 - DNA, 12 bp, Homo sapiens
ccccagccccca

SEQ ID NO: 132276 - DNA, 15 bp, Homo sapiens
ccccagcccccacag

SEQ ID NO: 132277 - DNA, 18 bp, Homo sapiens
ccccagcccccacagccc

SEQ ID NO: 132278 - DNA, 19 bp, Homo sapiens
ccccatagagaccaggagg

SEQ ID NO: 132279 - DNA, 20 bp, Homo sapiens
ccccatagagaccaggaggg

SEQ ID NO: 132280 - DNA, 16 bp, Homo sapiens
ccccatcccacaccct

SEQ ID NO: 132281 - DNA, 21 bp, Homo sapiens
ccccatggagacaataaacag

SEQ ID NO: 132282 - DNA, 20 bp, Homo sapiens
cccccacttcatgcccactg

SEQ ID NO: 132283 - DNA, 14 bp, Homo sapiens
ccccctagagactc

SEQ ID NO: 132284 - DNA, 20 bp, Homo sapiens
ccccctgaaacatgtgcccc

SEQ ID NO: 132285 - DNA, 22 bp, Homo sapiens
ccccctgaaacatgtgcccctg

SEQ ID NO: 132286 - DNA, 13 bp, Homo sapiens
ccccgccccctga

SEQ ID NO: 132287 - DNA, 19 bp, Homo sapiens
ccccggcggggtgcctgct

SEQ ID NO: 132288 - DNA, 14 bp, Homo sapiens
ccccgtcccagagg

SEQ ID NO: 132289 - DNA, 16 bp, Homo sapiens
cccctagagactcaga

SEQ ID NO: 132290 - DNA, 12 bp, Homo sapiens
cccctccttctc

SEQ ID NO: 132291 - DNA, 10 bp, Homo sapiens
cccctgaaac

SEQ ID NO: 132292 - DNA, 20 bp, Homo sapiens
cccctgaaacatgtgcccct

SEQ ID NO: 132293 - DNA, 13 bp, Homo sapiens
cccctgcctcctg

SEQ ID NO: 132294 - DNA, 19 bp, Homo sapiens
cccctggcagcacagccca

SEQ ID NO: 132295 - DNA, 17 bp, Homo sapiens
cccctgtcctaggtcat

SEQ ID NO: 132296 - DNA, 16 bp, Homo sapiens
cccgccccctccctgc

SEQ ID NO: 132297 - DNA, 14 bp, Homo sapiens
cccgccccctgaaa

SEQ ID NO: 132298 - DNA, 19 bp, Homo sapiens
cccggcggggtgcctgctg

SEQ ID NO: 132299 - DNA, 22 bp, Homo sapiens
cccggctcgagcagtcctgcct

SEQ ID NO: 132300 - DNA, 15 bp, Homo sapiens
cccgtagtctcctgg

SEQ ID NO: 132301 - DNA, 16 bp, Homo sapiens
cccgtagtctcctggg

SEQ ID NO: 132302 - DNA, 13 bp, Homo sapiens
ccctagagactca

SEQ ID NO: 132303 - DNA, 19 bp, Homo sapiens
ccctagaggacactaggag

SEQ ID NO: 132304 - DNA, 12 bp, Homo sapiens
ccctccacccac

SEQ ID NO: 132305 - DNA, 20 bp, Homo sapiens
ccctcccgtagtctcctggg

SEQ ID NO: 132306 - DNA, 21 bp, Homo sapiens
ccctcggtggctgcacagaag

SEQ ID NO: 132307 - DNA, 20 bp, Homo sapiens
ccctctcccacccaaggaga

SEQ ID NO: 132308 - DNA, 21 bp, Homo sapiens
ccctgaaacgagaagtgccct

SEQ ID NO: 132309 - DNA, 17 bp, Homo sapiens
ccctgagttctgacact

SEQ ID NO: 132310 - DNA, 18 bp, Homo sapiens
ccctgccaaggccggaga

SEQ ID NO: 132311 - DNA, 21 bp, Homo sapiens
ccctgcccctccccaaaagaa

SEQ ID NO: 132312 - DNA, 22 bp, Homo sapiens
ccctgcccctccccaaaagaaa

SEQ ID NO: 132313 - DNA, 14 bp, Homo sapiens
ccctgcctcctgcc

SEQ ID NO: 132314 - DNA, 14 bp, Homo sapiens
ccctgctcccagct

SEQ ID NO: 132315 - DNA, 18 bp, Homo sapiens
ccctggcagcacagccca

SEQ ID NO: 132316 - DNA, 19 bp, Homo sapiens
ccctggcagcacagcccag

SEQ ID NO: 132317 - DNA, 13 bp, Homo sapiens
ccctgtcctaggt

SEQ ID NO: 132318 - DNA, 18 bp, Homo sapiens
ccctgttgggggcttcag

SEQ ID NO: 132319 - DNA, 21 bp, Homo sapiens
cccttaaggatcaccccagcc

SEQ ID NO: 132320 - DNA, 13 bp, Homo sapiens
cccttcctcctct

SEQ ID NO: 132321 - DNA, 16 bp, Homo sapiens
cccttctaccccacct

SEQ ID NO: 132322 - DNA, 15 bp, Homo sapiens
ccctttgtattataa

SEQ ID NO: 132323 - DNA, 13 bp, Homo sapiens
ccgaggagcccca

SEQ ID NO: 132324 - DNA, 18 bp, Homo sapiens
ccgaggagccccagcccc

SEQ ID NO: 132325 - DNA, 20 bp, Homo sapiens
ccgaggagccccagccccgt

SEQ ID NO: 132326 - DNA, 13 bp, Homo sapiens
ccgagtttgctaa

SEQ ID NO: 132327 - DNA, 19 bp, Homo sapiens
ccgatgcccaatccaggcc

SEQ ID NO: 132328 - DNA, 14 bp, Homo sapiens
ccgccaccctgtct

SEQ ID NO: 132329 - DNA, 16 bp, Homo sapiens
ccgccaccctgtctca

SEQ ID NO: 132330 - DNA, 13 bp, Homo sapiens
ccgccccctgaaa

SEQ ID NO: 132331 - DNA, 15 bp, Homo sapiens
ccgccctccacccac

SEQ ID NO: 132332 - DNA, 16 bp, Homo sapiens
ccgccctccacccact

SEQ ID NO: 132333 - DNA, 16 bp, Homo sapiens
ccgcctcccgccaccc

SEQ ID NO: 132334 - DNA, 19 bp, Homo sapiens
ccgcctcccgccaccctgt

SEQ ID NO: 132335 - DNA, 23 bp, Homo sapiens
ccgcctcccgccaccctgtctca

SEQ ID NO: 132336 - DNA, 12 bp, Homo sapiens
ccgctgcccctg

SEQ ID NO: 132337 - DNA, 15 bp, Homo sapiens
ccgctgcccctgagt

SEQ ID NO: 132338 - DNA, 22 bp, Homo sapiens
ccgctggctccgcatggttcat

SEQ ID NO: 132339 - DNA, 13 bp, Homo sapiens
ccggagacccaca

SEQ ID NO: 132340 - DNA, 19 bp, Homo sapiens
ccggagcaggggtctgagc

SEQ ID NO: 132341 - DNA, 12 bp, Homo sapiens
ataattttcctt

SEQ ID NO: 132342 - DNA, 14 bp, Homo sapiens
atacaaagatgact

SEQ ID NO: 132343 - DNA, 16 bp, Homo sapiens
atacagaggtaactat

SEQ ID NO: 132344 - DNA, 14 bp, Homo sapiens
atacatacatgtat

SEQ ID NO: 132345 - DNA, 20 bp, Homo sapiens
atacatacatgtatctggtt

SEQ ID NO: 132346 - DNA, 15 bp, Homo sapiens
atacatgctgctaat

SEQ ID NO: 132347 - DNA, 20 bp, Homo sapiens
ataccataggaagacataaa

SEQ ID NO: 132348 - DNA, 15 bp, Homo sapiens
atacctcaggaaaga

SEQ ID NO: 132349 - DNA, 17 bp, Homo sapiens
atacctcaggaaagaat

SEQ ID NO: 132350 - DNA, 18 bp, Homo sapiens
atacctcaggaaagaata

SEQ ID NO: 132351 - DNA, 20 bp, Homo sapiens
ataccttcggggtacaagtc

SEQ ID NO: 132352 - DNA, 16 bp, Homo sapiens
atactgtaaaagttat

SEQ ID NO: 132353 - DNA, 24 bp, Homo sapiens
atactgtaaaagttataataactg

SEQ ID NO: 132354 - DNA, 16 bp, Homo sapiens
atacttaacatttcat

SEQ ID NO: 132355 - DNA, 16 bp, Homo sapiens
atagaaaattaaaata

SEQ ID NO: 132356 - DNA, 13 bp, Homo sapiens
atagaaagaaact

SEQ ID NO: 132357 - DNA, 16 bp, Homo sapiens
atagagaccaggaggg

SEQ ID NO: 132358 - DNA, 16 bp, Homo sapiens
atagatatatatccat

SEQ ID NO: 132359 - DNA, 16 bp, Homo sapiens
ataggaagacataaaa

SEQ ID NO: 132360 - DNA, 17 bp, Homo sapiens
ataggaagacataaaac

SEQ ID NO: 132361 - DNA, 23 bp, Homo sapiens
ataggaagacataaaactttaaa

SEQ ID NO: 132362 - DNA, 15 bp, Homo sapiens
ataggtaacgtgatt

SEQ ID NO: 132363 - DNA, 14 bp, Homo sapiens
atagtcaaagagag

SEQ ID NO: 132364 - DNA, 18 bp, Homo sapiens
atagtgtcctatgcaata

SEQ ID NO: 132365 - DNA, 20 bp, Homo sapiens
atagtgtcctatgcaataaa

SEQ ID NO: 132366 - DNA, 15 bp, Homo sapiens
atagttgcttttgaa

SEQ ID NO: 132367 - DNA, 11 bp, Homo sapiens
atataaaagga

SEQ ID NO: 132368 - DNA, 13 bp, Homo sapiens
atataaattgtac

SEQ ID NO: 132369 - DNA, 14 bp, Homo sapiens
atataaattgtaca

SEQ ID NO: 132370 - DNA, 22 bp, Homo sapiens
atataaattgtacattttgtaa

SEQ ID NO: 132371 - DNA, 14 bp, Homo sapiens
atataacacttaac

SEQ ID NO: 132372 - DNA, 23 bp, Homo sapiens
atataagaaaagtaatgaagaat

SEQ ID NO: 132373 - DNA, 21 bp, Homo sapiens
atataatttactttgtagact

SEQ ID NO: 132374 - DNA, 24 bp, Homo sapiens
atatagtttgtggtaaaaagatta

SEQ ID NO: 132375 - DNA, 20 bp, Homo sapiens
atatatagatatatatccat

SEQ ID NO: 132376 - DNA, 13 bp, Homo sapiens
atatatcataaag

SEQ ID NO: 132377 - DNA, 15 bp, Homo sapiens
atatatcataaagta

SEQ ID NO: 132378 - DNA, 20 bp, Homo sapiens
atatatgtgtatacatacat

SEQ ID NO: 132379 - DNA, 18 bp, Homo sapiens
atatatgttctgcaagaa

SEQ ID NO: 132380 - DNA, 23 bp, Homo sapiens
atatattctacacatatatgtat

SEQ ID NO: 132381 - DNA, 16 bp, Homo sapiens
atatcactaaataaac

SEQ ID NO: 132382 - DNA, 13 bp, Homo sapiens
atatcataaagta

SEQ ID NO: 132383 - DNA, 15 bp, Homo sapiens
atatcataaagtatg

SEQ ID NO: 132384 - DNA, 15 bp, Homo sapiens
atatctgtttgtata

SEQ ID NO: 132385 - DNA, 20 bp, Homo sapiens
atatctgtttgtatatttgc

SEQ ID NO: 132386 - DNA, 21 bp, Homo sapiens
atatctgtttgtatatttgca

SEQ ID NO: 132387 - DNA, 15 bp, Homo sapiens
atatgatcagagctt

SEQ ID NO: 132388 - DNA, 16 bp, Homo sapiens
atatggcatttgcaga

SEQ ID NO: 132389 - DNA, 11 bp, Homo sapiens
atattccaagg

SEQ ID NO: 132390 - DNA, 14 bp, Homo sapiens
atattccaaggaaa

SEQ ID NO: 132391 - DNA, 16 bp, Homo sapiens
atattccaaggaaaat

SEQ ID NO: 132392 - DNA, 22 bp, Homo sapiens
atattggaagctgctgaggccc

SEQ ID NO: 132393 - DNA, 16 bp, Homo sapiens
atattgtattaagggc

SEQ ID NO: 132394 - DNA, 23 bp, Homo sapiens
atatttgcaaaccctttgtatta

SEQ ID NO: 132395 - DNA, 21 bp, Homo sapiens
atatttgtaaggcttgttcca

SEQ ID NO: 132396 - DNA, 18 bp, Homo sapiens
atattttccctttttaaa

SEQ ID NO: 132397 - DNA, 23 bp, Homo sapiens
atatttttgtacgttatatattg

SEQ ID NO: 132398 - DNA, 22 bp, Homo sapiens
atattttttatatctggaatga

SEQ ID NO: 132399 - DNA, 17 bp, Homo sapiens
atcaaaggaatataaga

SEQ ID NO: 132400 - DNA, 13 bp, Homo sapiens
atcaagatatatg

SEQ ID NO: 132401 - DNA, 14 bp, Homo sapiens
atcaagatatatgt

SEQ ID NO: 132402 - DNA, 16 bp, Homo sapiens
atcaagatatatgtgt

SEQ ID NO: 132403 - DNA, 22 bp, Homo sapiens
atcaatagtgtcctatgcaata

SEQ ID NO: 132404 - DNA, 13 bp, Homo sapiens
atcaatttctcaa

SEQ ID NO: 132405 - DNA, 13 bp, Homo sapiens
atcacgatttcat

SEQ ID NO: 132406 - DNA, 20 bp, Homo sapiens
atcagcatgacaaaaataac

SEQ ID NO: 132407 - DNA, 23 bp, Homo sapiens
atcagcatgacaaaaataacact

SEQ ID NO: 132408 - DNA, 14 bp, Homo sapiens
aacaagtatataat

SEQ ID NO: 132409 - DNA, 14 bp, Homo sapiens
aacaatgtcagaaa

SEQ ID NO: 132410 - DNA, 21 bp, Homo sapiens
aacaccatcattaagaataat

SEQ ID NO: 132411 - DNA, 13 bp, Homo sapiens
aacactgttggca

SEQ ID NO: 132412 - DNA, 18 bp, Homo sapiens
aacactgttggcacttat

SEQ ID NO: 132413 - DNA, 12 bp, Homo sapiens
aacagagaaaga

SEQ ID NO: 132414 - DNA, 17 bp, Homo sapiens
aacagagaaagaaaagg

SEQ ID NO: 132415 - DNA, 22 bp, Homo sapiens
aacatcccaagattttttcatt

SEQ ID NO: 132416 - DNA, 13 bp, Homo sapiens
aacatgtgcccct

SEQ ID NO: 132417 - DNA, 16 bp, Homo sapiens
aacatgtgcccctgcc

SEQ ID NO: 132418 - DNA, 17 bp, Homo sapiens
aacatgtgcccctgcca

SEQ ID NO: 132419 - DNA, 18 bp, Homo sapiens
aacattcctaaaatgctt

SEQ ID NO: 132420 - DNA, 13 bp, Homo sapiens
aacatttctgtat

SEQ ID NO: 132421 - DNA, 16 bp, Homo sapiens
aaccagtttattctgt

SEQ ID NO: 132422 - DNA, 21 bp, Homo sapiens
aaccatgacaaacctagcttt

SEQ ID NO: 132423 - DNA, 12 bp, Homo sapiens
aaccctttgtat

SEQ ID NO: 132424 - DNA, 15 bp, Homo sapiens
aacctagcttttaaa

SEQ ID NO: 132425 - DNA, 14 bp, Homo sapiens
aacctctggccctt

SEQ ID NO: 132426 - DNA, 12 bp, Homo sapiens
aacgcacttaca

SEQ ID NO: 132427 - DNA, 14 bp, Homo sapiens
aacgctctaccctg

SEQ ID NO: 132428 - DNA, 23 bp, Homo sapiens
aacgttctcagtcctttgttata

SEQ ID NO: 132429 - DNA, 17 bp, Homo sapiens
aactaagtaagaaacac

SEQ ID NO: 132430 - DNA, 15 bp, Homo sapiens
aactaggggaggaga

SEQ ID NO: 132431 - DNA, 17 bp, Homo sapiens
aactaggggaggagaga

SEQ ID NO: 132432 - DNA, 16 bp, Homo sapiens
aactatcaatatttaa

SEQ ID NO: 132433 - DNA, 18 bp, Homo sapiens
aactatcaatatttaagt

SEQ ID NO: 132434 - DNA, 19 bp, Homo sapiens
aactatcaatatttaagtt

SEQ ID NO: 132435 - DNA, 19 bp, Homo sapiens
aactcaaagatgatggaaa

SEQ ID NO: 132436 - DNA, 20 bp, Homo sapiens
aactcaaagatgatggaaac

SEQ ID NO: 132437 - DNA, 23 bp, Homo sapiens
aactgagtccatgaaaataccat

SEQ ID NO: 132438 - DNA, 12 bp, Homo sapiens
aactgtggaatt

SEQ ID NO: 132439 - DNA, 13 bp, Homo sapiens
aactgtggaattt

SEQ ID NO: 132440 - DNA, 20 bp, Homo sapiens
caggcgatccacctgtctca

SEQ ID NO: 132441 - DNA, 21 bp, Homo sapiens
caggcttatttttaaaataaa

SEQ ID NO: 132442 - DNA, 13 bp, Homo sapiens
cagggagaggcct

SEQ ID NO: 132443 - DNA, 14 bp, Homo sapiens
cagggagaggcctc

SEQ ID NO: 132444 - DNA, 13 bp, Homo sapiens
cagggctgtgcac

SEQ ID NO: 132445 - DNA, 16 bp, Homo sapiens
caggggtggggcccat

SEQ ID NO: 132446 - DNA, 20 bp, Homo sapiens
caggggtggggcccatgggg

SEQ ID NO: 132447 - DNA, 18 bp, Homo sapiens
cagggtgaagcaccaggg

SEQ ID NO: 132448 - DNA, 19 bp, Homo sapiens
cagggtgaagcaccaggga

SEQ ID NO: 132449 - DNA, 11 bp, Homo sapiens
cagtaatgaaa

SEQ ID NO: 132450 - DNA, 15 bp, Homo sapiens
cagtaatgaaatgtt

SEQ ID NO: 132451 - DNA, 21 bp, Homo sapiens
cagtatcttagagtttacagt

SEQ ID NO: 132452 - DNA, 18 bp, Homo sapiens
cagtcctttgttataatt

SEQ ID NO: 132453 - DNA, 20 bp, Homo sapiens
cagtcctttgttataatttt

SEQ ID NO: 132454 - DNA, 16 bp, Homo sapiens
cagtcgtctgtcccaa

SEQ ID NO: 132455 - DNA, 20 bp, Homo sapiens
cagtgacaaagactcctctg

SEQ ID NO: 132456 - DNA, 21 bp, Homo sapiens
cagtgagatataggataaaat

SEQ ID NO: 132457 - DNA, 23 bp, Homo sapiens
cagtgagatataggataaaataa

SEQ ID NO: 132458 - DNA, 14 bp, Homo sapiens
cagtgagcctctgc

SEQ ID NO: 132459 - DNA, 15 bp, Homo sapiens
cagtgagcctctgcg

SEQ ID NO: 132460 - DNA, 20 bp, Homo sapiens
cagtgagcctctgcgcctct

SEQ ID NO: 132461 - DNA, 14 bp, Homo sapiens
cagtgagtgtaaat

SEQ ID NO: 132462 - DNA, 16 bp, Homo sapiens
cagtgagtgtaaataa

SEQ ID NO: 132463 - DNA, 20 bp, Homo sapiens
cagtgctgcaattgagggct

SEQ ID NO: 132464 - DNA, 16 bp, Homo sapiens
cagtggtcaccttcct

SEQ ID NO: 132465 - DNA, 19 bp, Homo sapiens
cagttggaggagactgggc

SEQ ID NO: 132466 - DNA, 15 bp, Homo sapiens
cagtttattctgtgg

SEQ ID NO: 132467 - DNA, 12 bp, Homo sapiens
cataaaacttta

SEQ ID NO: 132468 - DNA, 13 bp, Homo sapiens
cataaaactttaa

SEQ ID NO: 132469 - DNA, 15 bp, Homo sapiens
cataaaactttaaaa

SEQ ID NO: 132470 - DNA, 18 bp, Homo sapiens
cataaaactttaaaaggc

SEQ ID NO: 132471 - DNA, 19 bp, Homo sapiens
cataaaatgggtgatatgc

SEQ ID NO: 132472 - DNA, 22 bp, Homo sapiens
cataaactttctccatttaaga

SEQ ID NO: 132473 - DNA, 23 bp, Homo sapiens
cataaaggtatttagaatatatt

SEQ ID NO: 132474 - DNA, 13 bp, Homo sapiens
cataattatgaaa

SEQ ID NO: 132475 - DNA, 20 bp, Homo sapiens
cataggaagacataaaactt

SEQ ID NO: 132476 - DNA, 14 bp, Homo sapiens
catatatgtatatg

SEQ ID NO: 132477 - DNA, 17 bp, Homo sapiens
catatgaggacctttat

SEQ ID NO: 132478 - DNA, 20 bp, Homo sapiens
catcccttcctcctctcctg

SEQ ID NO: 132479 - DNA, 22 bp, Homo sapiens
catcccttcctcctctcctgga

SEQ ID NO: 132480 - DNA, 19 bp, Homo sapiens
catcctagccccacccaga

SEQ ID NO: 132481 - DNA, 20 bp, Homo sapiens
catcctagccccacccagag

SEQ ID NO: 132482 - DNA, 16 bp, Homo sapiens
catcctcctcagcccc

SEQ ID NO: 132483 - DNA, 18 bp, Homo sapiens
catcctcctcagccccca

SEQ ID NO: 132484 - DNA, 16 bp, Homo sapiens
catctctccctcccct

SEQ ID NO: 132485 - DNA, 19 bp, Homo sapiens
catctgcattttcacccca

SEQ ID NO: 132486 - DNA, 20 bp, Homo sapiens
catctgcattttcaccccac

SEQ ID NO: 132487 - DNA, 13 bp, Homo sapiens
catgaagctggcc

SEQ ID NO: 132488 - DNA, 20 bp, Homo sapiens
catgaagctggccctcagct

SEQ ID NO: 132489 - DNA, 21 bp, Homo sapiens
catgaagctggccctcagctc

SEQ ID NO: 132490 - DNA, 20 bp, Homo sapiens
catgatcaagatatatgtgt

SEQ ID NO: 132491 - DNA, 21 bp, Homo sapiens
catgccaccatggccagccaa

SEQ ID NO: 132492 - DNA, 19 bp, Homo sapiens
catgcccactgccgatgcc

SEQ ID NO: 132493 - DNA, 21 bp, Homo sapiens
catgcctatatgagaagaata

SEQ ID NO: 132494 - DNA, 17 bp, Homo sapiens
catgcctctggaggcct

SEQ ID NO: 132495 - DNA, 19 bp, Homo sapiens
catgcctctggaggcctct

SEQ ID NO: 132496 - DNA, 21 bp, Homo sapiens
catgcctctggaggcctctgg

SEQ ID NO: 132497 - DNA, 22 bp, Homo sapiens
catgcctctggaggcctctggc

SEQ ID NO: 132498 - DNA, 17 bp, Homo sapiens
catgctatcagaaacag

SEQ ID NO: 132499 - DNA, 19 bp, Homo sapiens
catgctgaggttttgaata

SEQ ID NO: 132500 - DNA, 17 bp, Homo sapiens
catggagacaataaaca

SEQ ID NO: 132501 - DNA, 18 bp, Homo sapiens
catggagacaataaacag

SEQ ID NO: 132502 - DNA, 21 bp, Homo sapiens
catggagacaataaacagctg

SEQ ID NO: 132503 - DNA, 14 bp, Homo sapiens
catgggaaaaagag

SEQ ID NO: 132504 - DNA, 18 bp, Homo sapiens
catgggaaaaagagactc

SEQ ID NO: 132505 - DNA, 19 bp, Homo sapiens
catgggaaaaagagactct

SEQ ID NO: 132506 - DNA, 16 bp, Homo sapiens
catgggcgcaggccca

SEQ ID NO: 132507 - DNA, 18 bp, Homo sapiens
catgggcgcaggcccagt

SEQ ID NO: 132508 - DNA, 20 bp, Homo sapiens
catgggcgcaggcccagtga

SEQ ID NO: 132509 - DNA, 23 bp, Homo sapiens
catgggggcaccgggctccatgc

SEQ ID NO: 132510 - DNA, 23 bp, Homo sapiens
catggggtctctgcatcttcagt

SEQ ID NO: 132511 - DNA, 19 bp, Homo sapiens
catgtactgtacttcccaa

SEQ ID NO: 132512 - DNA, 20 bp, Homo sapiens
catgtatagttgcttttgaa

SEQ ID NO: 132513 - DNA, 17 bp, Homo sapiens
gaagctggccctcagct

SEQ ID NO: 132514 - DNA, 13 bp, Homo sapiens
gaaggcccagggg

SEQ ID NO: 132515 - DNA, 18 bp, Homo sapiens
gaagggggagtgaaacag

SEQ ID NO: 132516 - DNA, 22 bp, Homo sapiens
gaaggttttttttttaagtgca

SEQ ID NO: 132517 - DNA, 21 bp, Homo sapiens
gaagtgcagcgggccaggcag

SEQ ID NO: 132518 - DNA, 19 bp, Homo sapiens
gaagtgcccttaaggatca

SEQ ID NO: 132519 - DNA, 12 bp, Homo sapiens
gaatagaaagaa

SEQ ID NO: 132520 - DNA, 22 bp, Homo sapiens
gaatagcctagatatgaatata

SEQ ID NO: 132521 - DNA, 18 bp, Homo sapiens
gaatagtcgcgcaagcat

SEQ ID NO: 132522 - DNA, 18 bp, Homo sapiens
gaatcatacttaacattt

SEQ ID NO: 132523 - DNA, 22 bp, Homo sapiens
gaatcccacccccacttcatgc

SEQ ID NO: 132524 - DNA, 17 bp, Homo sapiens
gaatgaactgtggaatt

SEQ ID NO: 132525 - DNA, 13 bp, Homo sapiens
gaatgacttactt

SEQ ID NO: 132526 - DNA, 15 bp, Homo sapiens
gaatgcattaaaaaa

SEQ ID NO: 132527 - DNA, 21 bp, Homo sapiens
gaatgccatagtcaaagagag

SEQ ID NO: 132528 - DNA, 23 bp, Homo sapiens
gaatgccatagtcaaagagagtt

SEQ ID NO: 132529 - DNA, 13 bp, Homo sapiens
gaatgctgagacc

SEQ ID NO: 132530 - DNA, 21 bp, Homo sapiens
gaatgctgagacccccggagc

SEQ ID NO: 132531 - DNA, 13 bp, Homo sapiens
gaatggagaaagt

SEQ ID NO: 132532 - DNA, 14 bp, Homo sapiens
gaatggagaaagta

SEQ ID NO: 132533 - DNA, 12 bp, Homo sapiens
gaattaaaactg

SEQ ID NO: 132534 - DNA, 22 bp, Homo sapiens
gaattaaaactgagtccatgaa

SEQ ID NO: 132535 - DNA, 20 bp, Homo sapiens
gaattgaaggagaaaatgca

SEQ ID NO: 132536 - DNA, 15 bp, Homo sapiens
gaattgcatacaact

SEQ ID NO: 132537 - DNA, 22 bp, Homo sapiens
gaatttaatggactgtgaattt

SEQ ID NO: 132538 - DNA, 17 bp, Homo sapiens
gacaaaaataacactgt

SEQ ID NO: 132539 - DNA, 22 bp, Homo sapiens
gacaaacctagcttttaaaaaa

SEQ ID NO: 132540 - DNA, 13 bp, Homo sapiens
gacaattagcaga

SEQ ID NO: 132541 - DNA, 21 bp, Homo sapiens
gacacattgactcctttccaa

SEQ ID NO: 132542 - DNA, 15 bp, Homo sapiens
gacactccttgaaat

SEQ ID NO: 132543 - DNA, 14 bp, Homo sapiens
gacagggagaagtt

SEQ ID NO: 132544 - DNA, 15 bp, Homo sapiens
gacataaaactttaa

SEQ ID NO: 132545 - DNA, 17 bp, Homo sapiens
gacataaaactttaaaa

SEQ ID NO: 132546 - DNA, 20 bp, Homo sapiens
gacataaaactttaaaaggc

SEQ ID NO: 132547 - DNA, 16 bp, Homo sapiens
gacatcctagccccac

SEQ ID NO: 132548 - DNA, 23 bp, Homo sapiens
gacatcctagccccacccagagg

SEQ ID NO: 132549 - DNA, 18 bp, Homo sapiens
gacatgcctatatgagaa

SEQ ID NO: 132550 - DNA, 22 bp, Homo sapiens
gacatgcctatatgagaagaat

SEQ ID NO: 132551 - DNA, 21 bp, Homo sapiens
tcctgggtgtgtttggcttgg

SEQ ID NO: 132552 - DNA, 24 bp, Homo sapiens
tcctgttattttttatttccacat

SEQ ID NO: 132553 - DNA, 12 bp, Homo sapiens
tccttctccctt

SEQ ID NO: 132554 - DNA, 17 bp, Homo sapiens
tccttctgttaagaaag

SEQ ID NO: 132555 - DNA, 18 bp, Homo sapiens
tccttctgttaagaaagg

SEQ ID NO: 132556 - DNA, 14 bp, Homo sapiens
tcctttctgcccag

SEQ ID NO: 132557 - DNA, 21 bp, Homo sapiens
tcgaaacctgtccataaagta

SEQ ID NO: 132558 - DNA, 14 bp, Homo sapiens
tcgacatcctagcc

SEQ ID NO: 132559 - DNA, 18 bp, Homo sapiens
tcgacatcctagccccac

SEQ ID NO: 132560 - DNA, 15 bp, Homo sapiens
tcgagtctttgtgtg

SEQ ID NO: 132561 - DNA, 16 bp, Homo sapiens
tcgagtctttgtgtgt

SEQ ID NO: 132562 - DNA, 20 bp, Homo sapiens
tcgatgaatgtgttgatttg

SEQ ID NO: 132563 - DNA, 16 bp, Homo sapiens
tcggctgtctcctgtc

SEQ ID NO: 132564 - DNA, 14 bp, Homo sapiens
tcgggattccctgg

SEQ ID NO: 132565 - DNA, 15 bp, Homo sapiens
tcgggattccctggt

SEQ ID NO: 132566 - DNA, 19 bp, Homo sapiens
tcgggattccctggtgggc

SEQ ID NO: 132567 - DNA, 22 bp, Homo sapiens
tctaactgatgagtaaactgag

SEQ ID NO: 132568 - DNA, 18 bp, Homo sapiens
tctaatactaatgttatt

SEQ ID NO: 132569 - DNA, 21 bp, Homo sapiens
tctaatgacatgcctatatga

SEQ ID NO: 132570 - DNA, 17 bp, Homo sapiens
tctaattagagaactgg

SEQ ID NO: 132571 - DNA, 18 bp, Homo sapiens
tctaattagagaactgga

SEQ ID NO: 132572 - DNA, 19 bp, Homo sapiens
tctacacatatatgtatat

SEQ ID NO: 132573 - DNA, 21 bp, Homo sapiens
tctacacatatatgtatatgt

SEQ ID NO: 132574 - DNA, 15 bp, Homo sapiens
tctacagtaatgaaa

SEQ ID NO: 132575 - DNA, 13 bp, Homo sapiens
tctaccccacctg

SEQ ID NO: 132576 - DNA, 16 bp, Homo sapiens
tctaccctgcagcttg

SEQ ID NO: 132577 - DNA, 18 bp, Homo sapiens
tctagacactccttgaaa

SEQ ID NO: 132578 - DNA, 14 bp, Homo sapiens
tctataataagttt

SEQ ID NO: 132579 - DNA, 20 bp, Homo sapiens
tctataataagttttgatat

SEQ ID NO: 132580 - DNA, 16 bp, Homo sapiens
tctatctaatgacatg

SEQ ID NO: 132581 - DNA, 16 bp, Homo sapiens
tctattgtttattctt

SEQ ID NO: 132582 - DNA, 15 bp, Homo sapiens
tctcagtacctcccc

SEQ ID NO: 132583 - DNA, 18 bp, Homo sapiens
tctcatttcaatttataa

SEQ ID NO: 132584 - DNA, 14 bp, Homo sapiens
tctccactgtttca

SEQ ID NO: 132585 - DNA, 19 bp, Homo sapiens
tctccactgtttcatgagc

SEQ ID NO: 132586 - DNA, 20 bp, Homo sapiens
tctccactgtttcatgagcc

SEQ ID NO: 132587 - DNA, 22 bp, Homo sapiens
tctccactgtttcatgagccca

SEQ ID NO: 132588 - DNA, 14 bp, Homo sapiens
tctcccacccaagg

SEQ ID NO: 132589 - DNA, 15 bp, Homo sapiens
tctcccacccaagga

SEQ ID NO: 132590 - DNA, 14 bp, Homo sapiens
tctccctagccctt

SEQ ID NO: 132591 - DNA, 18 bp, Homo sapiens
tctcctggagtctgaagc

SEQ ID NO: 132592 - DNA, 22 bp, Homo sapiens
tctcctggagtctgaagcctgc

SEQ ID NO: 132593 - DNA, 14 bp, Homo sapiens
tctcctgtccccgg

SEQ ID NO: 132594 - DNA, 17 bp, Homo sapiens
tctcggcaccagtgcct

SEQ ID NO: 132595 - DNA, 22 bp, Homo sapiens
tctctaacttcaaggcccatat

SEQ ID NO: 132596 - DNA, 18 bp, Homo sapiens
tctctattggctcccttt

SEQ ID NO: 132597 - DNA, 17 bp, Homo sapiens
tctctcatctaactgat

SEQ ID NO: 132598 - DNA, 15 bp, Homo sapiens
tctctgctgagctgg

SEQ ID NO: 132599 - DNA, 16 bp, Homo sapiens
tctctgctgagctggg

SEQ ID NO: 132600 - DNA, 19 bp, Homo sapiens
tctctgctgagctgggccc

SEQ ID NO: 132601 - DNA, 22 bp, Homo sapiens
tctctgctgagctgggcccagc

SEQ ID NO: 132602 - DNA, 15 bp, Homo sapiens
tctctgctggcccag

SEQ ID NO: 132603 - DNA, 15 bp, Homo sapiens
tctctgtggctccaa

SEQ ID NO: 132604 - DNA, 14 bp, Homo sapiens
tctctgttccatag

SEQ ID NO: 132605 - DNA, 15 bp, Homo sapiens
tctgaacaaaagctt

SEQ ID NO: 132606 - DNA, 16 bp, Homo sapiens
tctgagccccagcccc

SEQ ID NO: 132607 - DNA, 15 bp, Homo sapiens
tctgcaagaattaaa

SEQ ID NO: 132608 - DNA, 17 bp, Homo sapiens
tctgcaagaattaaaac

SEQ ID NO: 132609 - DNA, 20 bp, Homo sapiens
tctgcaagcacatctgcatt

SEQ ID NO: 132610 - DNA, 19 bp, Homo sapiens
tctgcagatagtgcctctg

SEQ ID NO: 132611 - DNA, 20 bp, Homo sapiens
tctgcagatagtgcctctgc

SEQ ID NO: 132612 - DNA, 21 bp, Homo sapiens
tctgcagggtgaagcaccagg

SEQ ID NO: 132613 - DNA, 14 bp, Homo sapiens
tctgctgagctggg

SEQ ID NO: 132614 - DNA, 19 bp, Homo sapiens
tctgctgagctgggcccag

SEQ ID NO: 132615 - DNA, 22 bp, Homo sapiens
tctggccctcggtggctgcaca

SEQ ID NO: 132616 - DNA, 10 bp, Homo sapiens
tctggccctt

SEQ ID NO: 132617 - DNA, 16 bp, Homo sapiens
tctggcccttggaata

SEQ ID NO: 132618 - DNA, 14 bp, Homo sapiens
tctggggtaaaatt

SEQ ID NO: 132619 - DNA, 19 bp, Homo sapiens
tctgtatactgtaaaagtt

SEQ ID NO: 132620 - DNA, 21 bp, Homo sapiens
tctgtatactgtaaaagttat

SEQ ID NO: 132621 - DNA, 20 bp, Homo sapiens
tctgtgaaatgctggcattt

SEQ ID NO: 132622 - DNA, 18 bp, Homo sapiens
tctgtggttctataataa

SEQ ID NO: 132623 - DNA, 18 bp, Homo sapiens
tctgttaagaaaggatat

SEQ ID NO: 132624 - DNA, 17 bp, Homo sapiens
tctgttccatagttaaa

SEQ ID NO: 132625 - DNA, 13 bp, Homo sapiens
tctgtttgtatat

SEQ ID NO: 132626 - DNA, 19 bp, Homo sapiens
tctgtttgtatatttgcaa

SEQ ID NO: 132627 - DNA, 15 bp, Homo sapiens
tcttaaaaactgtgt

SEQ ID NO: 132628 - DNA, 20 bp, Homo sapiens
tcttaaaaactgtgtatcat

SEQ ID NO: 132629 - DNA, 23 bp, Homo sapiens
tcttaaaaactgtgtatcattaa

SEQ ID NO: 132630 - DNA, 21 bp, Homo sapiens
tcttaaaatgcaatatttgta

SEQ ID NO: 132631 - DNA, 23 bp, Homo sapiens
tcttaaaattagtgagattaaaa

SEQ ID NO: 132632 - DNA, 20 bp, Homo sapiens
tcttagagtttacagtttgt

SEQ ID NO: 132633 - DNA, 13 bp, Homo sapiens
tcttcaacatgac

SEQ ID NO: 132634 - DNA, 19 bp, Homo sapiens
tcttgaattgttatgaaaa

SEQ ID NO: 132635 - DNA, 13 bp, Homo sapiens
tcttggcttctta

SEQ ID NO: 132636 - DNA, 15 bp, Homo sapiens
tcttggcttcttaaa

SEQ ID NO: 132637 - DNA, 17 bp, Homo sapiens
tcttggcttcttaaaaa

SEQ ID NO: 132638 - DNA, 22 bp, Homo sapiens
tcttggcttcttaaaaactgtg

SEQ ID NO: 132639 - DNA, 13 bp, Homo sapiens
tctttgtgtgtta

SEQ ID NO: 132640 - DNA, 20 bp, Homo sapiens
tctttgtgtgttatattcca

SEQ ID NO: 132641 - DNA, 13 bp, Homo sapiens
tcttttctttgta

SEQ ID NO: 132642 - DNA, 17 bp, Homo sapiens
tctttttttggtaaatt

SEQ ID NO: 132643 - DNA, 17 bp, Homo sapiens
tgaaaaatattgctaaa

SEQ ID NO: 132644 - DNA, 19 bp, Homo sapiens
tgaaaaatattgctaaaag

SEQ ID NO: 132645 - DNA, 24 bp, Homo sapiens
tgaaaaatattgctaaaagtgcat

SEQ ID NO: 132646 - DNA, 11 bp, Homo sapiens
tgaaaaatcag

SEQ ID NO: 132647 - DNA, 22 bp, Homo sapiens
tgaaaactcatgatcaagatat

SEQ ID NO: 132648 - DNA, 21 bp, Homo sapiens
tgaaaataccataggaagaca

SEQ ID NO: 132649 - DNA, 18 bp, Homo sapiens
tgaaaatcctatatctgt

SEQ ID NO: 132650 - DNA, 18 bp, Homo sapiens
tgaaagagaaagactgat

SEQ ID NO: 132651 - DNA, 18 bp, Homo sapiens
tggaattattgtagacat

SEQ ID NO: 132652 - DNA, 23 bp, Homo sapiens
tggaatttattggcagccaagga

SEQ ID NO: 132653 - DNA, 17 bp, Homo sapiens
tggaattttgagaaaaa

SEQ ID NO: 132654 - DNA, 13 bp, Homo sapiens
tggaccctggcct

SEQ ID NO: 132655 - DNA, 16 bp, Homo sapiens
tggactgtgaatttca

SEQ ID NO: 132656 - DNA, 18 bp, Homo sapiens
tggactgtgaatttcaaa

SEQ ID NO: 132657 - DNA, 19 bp, Homo sapiens
tggactgtgaatttcaaaa

SEQ ID NO: 132658 - DNA, 20 bp, Homo sapiens
tggactgtgaatttcaaaaa

SEQ ID NO: 132659 - DNA, 18 bp, Homo sapiens
tggagaaagtaagtcttt

SEQ ID NO: 132660 - DNA, 20 bp, Homo sapiens
tggagaactccgctggatgg

SEQ ID NO: 132661 - DNA, 22 bp, Homo sapiens
tggaggaaccacatataacact

SEQ ID NO: 132662 - DNA, 18 bp, Homo sapiens
tggaggcctctggccctc

SEQ ID NO: 132663 - DNA, 17 bp, Homo sapiens
tggagtgccccaaggag

SEQ ID NO: 132664 - DNA, 18 bp, Homo sapiens
tggagtggccactggcac

SEQ ID NO: 132665 - DNA, 16 bp, Homo sapiens
tggcacttgcctgctg

SEQ ID NO: 132666 - DNA, 18 bp, Homo sapiens
tggcacttgcctgctgct

SEQ ID NO: 132667 - DNA, 23 bp, Homo sapiens
tggcacttgcctgctgcttggag

SEQ ID NO: 132668 - DNA, 15 bp, Homo sapiens
tggcagcacagccca

SEQ ID NO: 132669 - DNA, 16 bp, Homo sapiens
tggcagcacagcccag

SEQ ID NO: 132670 - DNA, 17 bp, Homo sapiens
tggcagcacagcccagg

SEQ ID NO: 132671 - DNA, 15 bp, Homo sapiens
tggcagccaaggaat

SEQ ID NO: 132672 - DNA, 18 bp, Homo sapiens
tggccactggcacttgcc

SEQ ID NO: 132673 - DNA, 15 bp, Homo sapiens
tggcccagccactgc

SEQ ID NO: 132674 - DNA, 14 bp, Homo sapiens
tggccctcagctcc

SEQ ID NO: 132675 - DNA, 15 bp, Homo sapiens
tggccctcagctccc

SEQ ID NO: 132676 - DNA, 16 bp, Homo sapiens
tggcccttggaataaa

SEQ ID NO: 132677 - DNA, 20 bp, Homo sapiens
tggcctgcagccacatggga

SEQ ID NO: 132678 - DNA, 13 bp, Homo sapiens
tggccttggcatg

SEQ ID NO: 132679 - DNA, 18 bp, Homo sapiens
tggctacttttgaaaatc

SEQ ID NO: 132680 - DNA, 21 bp, Homo sapiens
tggctacttttgaaaatcaag

SEQ ID NO: 132681 - DNA, 17 bp, Homo sapiens
tggcttcttaaaaactg

SEQ ID NO: 132682 - DNA, 21 bp, Homo sapiens
tggcttcttaaaaactgtgta

SEQ ID NO: 132683 - DNA, 14 bp, Homo sapiens
tggcttggccttgg

SEQ ID NO: 132684 - DNA, 17 bp, Homo sapiens
tgggaaaaagagactct

SEQ ID NO: 132685 - DNA, 22 bp, Homo sapiens
tgggagacaattagcagaatgg

SEQ ID NO: 132686 - DNA, 18 bp, Homo sapiens
tgggaggaaggcccaggg

SEQ ID NO: 132687 - DNA, 16 bp, Homo sapiens
tgggagggggcacggg

SEQ ID NO: 132688 - DNA, 21 bp, Homo sapiens
tgggatagatttgtttcttaa

SEQ ID NO: 132689 - DNA, 13 bp, Homo sapiens
tgggcacccctgc

SEQ ID NO: 132690 - DNA, 14 bp, Homo sapiens
tgggcacccctgcc

SEQ ID NO: 132691 - DNA, 19 bp, Homo sapiens
tgggcacccctgcctcctg

SEQ ID NO: 132692 - DNA, 23 bp, Homo sapiens
tgggcagggcctggcggaggtgg

SEQ ID NO: 132693 - DNA, 12 bp, Homo sapiens
tgggcccagccc

SEQ ID NO: 132694 - DNA, 14 bp, Homo sapiens
tgggccctagagga

SEQ ID NO: 132695 - DNA, 14 bp, Homo sapiens
tgggcgcaggccca

SEQ ID NO: 132696 - DNA, 16 bp, Homo sapiens
tgggcgcaggcccagt

SEQ ID NO: 132697 - DNA, 20 bp, Homo sapiens
tggggaccccctcaggattg

SEQ ID NO: 132698 - DNA, 15 bp, Homo sapiens
tggggattgccacta

SEQ ID NO: 132699 - DNA, 16 bp, Homo sapiens
tggggcccatggggtc

SEQ ID NO: 132700 - DNA, 23 bp, Homo sapiens
tggggtctcacagtgttgcccag

SEQ ID NO: 132701 - DNA, 16 bp, Homo sapiens
tggggtgcatcctcct

SEQ ID NO: 132702 - DNA, 19 bp, Homo sapiens
tggtacaatcgacatccta

SEQ ID NO: 132703 - DNA, 17 bp, Homo sapiens
tggtcgagtctttgtgt

SEQ ID NO: 132704 - DNA, 18 bp, Homo sapiens
tggtcgagtctttgtgtg

SEQ ID NO: 132705 - DNA, 21 bp, Homo sapiens
tggtcgagtctttgtgtgtta

SEQ ID NO: 132706 - DNA, 20 bp, Homo sapiens
tggttccaaaccagtttatt

SEQ ID NO: 132707 - DNA, 16 bp, Homo sapiens
tggttgcactttgtag

SEQ ID NO: 132708 - DNA, 13 bp, Homo sapiens
tggtttgtttgct

SEQ ID NO: 132709 - DNA, 16 bp, Homo sapiens
tgtaaaagttataata

SEQ ID NO: 132710 - DNA, 21 bp, Homo sapiens
tgtaaaagttataataactga

SEQ ID NO: 132711 - DNA, 22 bp, Homo sapiens
tgtaaataattttaaataacct

SEQ ID NO: 132712 - DNA, 16 bp, Homo sapiens
tgtaatcagctctcct

SEQ ID NO: 132713 - DNA, 19 bp, Homo sapiens
tgtaatcagctctcctggc

SEQ ID NO: 132714 - DNA, 20 bp, Homo sapiens
tgtaatcagctctcctggct

SEQ ID NO: 132715 - DNA, 22 bp, Homo sapiens
tgtaatcagctctcctggctcc

SEQ ID NO: 132716 - DNA, 18 bp, Homo sapiens
tgtacaaagatatgctaa

SEQ ID NO: 132717 - DNA, 14 bp, Homo sapiens
tgtacatctggcct

SEQ ID NO: 132718 - DNA, 14 bp, Homo sapiens
tgtacattttgtaa

SEQ ID NO: 132719 - DNA, 21 bp, Homo sapiens
tgtacttttctggttccaaac

SEQ ID NO: 132720 - DNA, 14 bp, Homo sapiens
tgtagactgtttca

SEQ ID NO: 132721 - DNA, 16 bp, Homo sapiens
tgtagactgtttcaca

SEQ ID NO: 132722 - DNA, 23 bp, Homo sapiens
tgtaggtggtctggagctgtccg

SEQ ID NO: 132723 - DNA, 14 bp, Homo sapiens
tgtataaaaaggaa

SEQ ID NO: 132724 - DNA, 16 bp, Homo sapiens
tgtataaaaaggaaat

SEQ ID NO: 132725 - DNA, 18 bp, Homo sapiens
tgtataaaaaggaaatta

SEQ ID NO: 132726 - DNA, 15 bp, Homo sapiens
tgtatacatacatgt

SEQ ID NO: 132727 - DNA, 16 bp, Homo sapiens
tgtatactgtaaaagt

SEQ ID NO: 132728 - DNA, 21 bp, Homo sapiens
tgtatactgtaaaagttataa

SEQ ID NO: 132729 - DNA, 15 bp, Homo sapiens
tgtatagttgctttt

SEQ ID NO: 132730 - DNA, 22 bp, Homo sapiens
tgtatatttgcaaaccctttgt

SEQ ID NO: 132731 - DNA, 12 bp, Homo sapiens
tgtatcattaaa

SEQ ID NO: 132732 - DNA, 21 bp, Homo sapiens
tgtatctacagtaatgaaatg

SEQ ID NO: 132733 - DNA, 18 bp, Homo sapiens
tgtattagtcataaaaca

SEQ ID NO: 132734 - DNA, 15 bp, Homo sapiens
tgtattataattgtt

SEQ ID NO: 132735 - DNA, 20 bp, Homo sapiens
tgtattcttaaaatgcaata

SEQ ID NO: 132736 - DNA, 12 bp, Homo sapiens
tgtcaaatgaac

SEQ ID NO: 132737 - DNA, 17 bp, Homo sapiens
tgtcaagtctctgctgg

SEQ ID NO: 132738 - DNA, 19 bp, Homo sapiens
tgtcaagtctctgctggcc

SEQ ID NO: 132739 - DNA, 16 bp, Homo sapiens
tgtcagagttctgctc

SEQ ID NO: 132740 - DNA, 16 bp, Homo sapiens
tgtcataaactttctc

SEQ ID NO: 132741 - DNA, 23 bp, Homo sapiens
tgtccaagacacatgctgaggtt

SEQ ID NO: 132742 - DNA, 13 bp, Homo sapiens
tgtccagtttcca

SEQ ID NO: 132743 - DNA, 19 bp, Homo sapiens
tagcagaatggagaaagta

SEQ ID NO: 132744 - DNA, 16 bp, Homo sapiens
tagcagggattctctc

SEQ ID NO: 132745 - DNA, 20 bp, Homo sapiens
tagccctcagacatttatat

SEQ ID NO: 132746 - DNA, 17 bp, Homo sapiens
tagcccttctaccccac

SEQ ID NO: 132747 - DNA, 20 bp, Homo sapiens
tagcccttctaccccacctg

SEQ ID NO: 132748 - DNA, 22 bp, Homo sapiens
tagcccttctaccccacctgac

SEQ ID NO: 132749 - DNA, 18 bp, Homo sapiens
tagcctagatatgaatat

SEQ ID NO: 132750 - DNA, 22 bp, Homo sapiens
tagcctagatatgaatatatgg

SEQ ID NO: 132751 - DNA, 14 bp, Homo sapiens
tagctgtttcaaat

SEQ ID NO: 132752 - DNA, 19 bp, Homo sapiens
taggaacagtaaaatccaa

SEQ ID NO: 132753 - DNA, 17 bp, Homo sapiens
taggaagacataaaact

SEQ ID NO: 132754 - DNA, 21 bp, Homo sapiens
taggctgcaaaattaaatcta

SEQ ID NO: 132755 - DNA, 16 bp, Homo sapiens
tagtgtcctatgcaat

SEQ ID NO: 132756 - DNA, 17 bp, Homo sapiens
tagtgtcctatgcaata

SEQ ID NO: 132757 - DNA, 15 bp, Homo sapiens
tagttcttgaattgt

SEQ ID NO: 132758 - DNA, 21 bp, Homo sapiens
tagttgcttttgaaggaatac

SEQ ID NO: 132759 - DNA, 19 bp, Homo sapiens
tagtttttctaatactaat

SEQ ID NO: 132760 - DNA, 16 bp, Homo sapiens
tataaaaatataaatt

SEQ ID NO: 132761 - DNA, 22 bp, Homo sapiens
tataaaaatataaattgtacat

SEQ ID NO: 132762 - DNA, 18 bp, Homo sapiens
tataaaaggatgttacaa

SEQ ID NO: 132763 - DNA, 19 bp, Homo sapiens
tataaatttaagaaaacaa

SEQ ID NO: 132764 - DNA, 20 bp, Homo sapiens
tataacgttctcagtccttt

SEQ ID NO: 132765 - DNA, 13 bp, Homo sapiens
tataagaaaagta

SEQ ID NO: 132766 - DNA, 21 bp, Homo sapiens
tataataactgaactgtttgg

SEQ ID NO: 132767 - DNA, 19 bp, Homo sapiens
tataattgttgatattttc

SEQ ID NO: 132768 - DNA, 16 bp, Homo sapiens
tataggataaaataat

SEQ ID NO: 132769 - DNA, 20 bp, Homo sapiens
tatatagctggcaagaatgg

SEQ ID NO: 132770 - DNA, 14 bp, Homo sapiens
tatatatcataaag

SEQ ID NO: 132771 - DNA, 14 bp, Homo sapiens
tatatcataaagta

SEQ ID NO: 132772 - DNA, 14 bp, Homo sapiens
tatatctgtttgta

SEQ ID NO: 132773 - DNA, 21 bp, Homo sapiens
tatatctgtttgtatatttgc

SEQ ID NO: 132774 - DNA, 16 bp, Homo sapiens
tatatgagaagaatag

SEQ ID NO: 132775 - DNA, 17 bp, Homo sapiens
tatatgagaagaatagc

SEQ ID NO: 132776 - DNA, 14 bp, Homo sapiens
tatatgtgtataca

SEQ ID NO: 132777 - DNA, 15 bp, Homo sapiens
tatatgtgtatacat

SEQ ID NO: 132778 - DNA, 16 bp, Homo sapiens
tatatgtgtatacata

SEQ ID NO: 132779 - DNA, 19 bp, Homo sapiens
tatatgtgtatacatacat

SEQ ID NO: 132780 - DNA, 21 bp, Homo sapiens
tatattgtcctcccctatttt

SEQ ID NO: 132781 - DNA, 12 bp, Homo sapiens
tatcagaaacag

SEQ ID NO: 132782 - DNA, 13 bp, Homo sapiens
tatcattcatctt

SEQ ID NO: 132783 - DNA, 16 bp, Homo sapiens
tatcatttttgtataa

SEQ ID NO: 132784 - DNA, 22 bp, Homo sapiens
tatcatttttgtataaaaagga

SEQ ID NO: 132785 - DNA, 14 bp, Homo sapiens
tatctaatgacatg

SEQ ID NO: 132786 - DNA, 17 bp, Homo sapiens
tatctacagtaatgaaa

SEQ ID NO: 132787 - DNA, 16 bp, Homo sapiens
tatctctaaactgctg

SEQ ID NO: 132788 - DNA, 15 bp, Homo sapiens
tatctgaacatttac

SEQ ID NO: 132789 - DNA, 17 bp, Homo sapiens
tatctgaacatttacta

SEQ ID NO: 132790 - DNA, 18 bp, Homo sapiens
tatctgagaagtgtatat

SEQ ID NO: 132791 - DNA, 22 bp, Homo sapiens
tatctgagaagtgtatatagtt

SEQ ID NO: 132792 - DNA, 16 bp, Homo sapiens
tatctggaatgagcct

SEQ ID NO: 132793 - DNA, 13 bp, Homo sapiens
tatctgtttgtat

SEQ ID NO: 132794 - DNA, 23 bp, Homo sapiens
tatcttttttcctagtttttcta

SEQ ID NO: 132795 - DNA, 14 bp, Homo sapiens
tatgagaagaatag

SEQ ID NO: 132796 - DNA, 21 bp, Homo sapiens
tatggcccagccactgcagca

SEQ ID NO: 132797 - DNA, 16 bp, Homo sapiens
tatgtatatgtatatc

SEQ ID NO: 132798 - DNA, 19 bp, Homo sapiens
tatgtatatgtatatctat

SEQ ID NO: 132799 - DNA, 16 bp, Homo sapiens
tatgtattttcctaat

SEQ ID NO: 132800 - DNA, 22 bp, Homo sapiens
tatgttctgcaagaattaaaac

SEQ ID NO: 132801 - DNA, 18 bp, Homo sapiens
tattaattgtcctgtgtc

SEQ ID NO: 132802 - DNA, 19 bp, Homo sapiens
tattaattgtcctgtgtct

SEQ ID NO: 132803 - DNA, 20 bp, Homo sapiens
tattaattgtcctgtgtcta

SEQ ID NO: 132804 - DNA, 12 bp, Homo sapiens
tattacaaatgc

SEQ ID NO: 132805 - DNA, 17 bp, Homo sapiens
tattacctaatgaaagt

SEQ ID NO: 132806 - DNA, 15 bp, Homo sapiens
tattagcaactgtgc

SEQ ID NO: 132807 - DNA, 14 bp, Homo sapiens
tattataattgttg

SEQ ID NO: 132808 - DNA, 15 bp, Homo sapiens
tattcagaaattaaa

SEQ ID NO: 132809 - DNA, 18 bp, Homo sapiens
tattcagaaattaaaata

SEQ ID NO: 132810 - DNA, 13 bp, Homo sapiens
tattccaaggaaa

SEQ ID NO: 132811 - DNA, 14 bp, Homo sapiens
tattccaaggaaaa

SEQ ID NO: 132812 - DNA, 18 bp, Homo sapiens
tattccaaggaaaattga

SEQ ID NO: 132813 - DNA, 17 bp, Homo sapiens
tattcttaaaatgcaat

SEQ ID NO: 132814 - DNA, 21 bp, Homo sapiens
tattcttaaaatgcaatattt

SEQ ID NO: 132815 - DNA, 12 bp, Homo sapiens
tattgaaaaatc

SEQ ID NO: 132816 - DNA, 13 bp, Homo sapiens
tattgctaaaagt

SEQ ID NO: 132817 - DNA, 19 bp, Homo sapiens
tattggcagccaaggaatg

SEQ ID NO: 132818 - DNA, 22 bp, Homo sapiens
tattggcagccaaggaatgtgt

SEQ ID NO: 132819 - DNA, 17 bp, Homo sapiens
tatttaacaaaaaatgt

SEQ ID NO: 132820 - DNA, 18 bp, Homo sapiens
tatttaacaaaaaatgta

SEQ ID NO: 132821 - DNA, 13 bp, Homo sapiens
tatttataaaaat

SEQ ID NO: 132822 - DNA, 17 bp, Homo sapiens
tatttcttaaaattcag

SEQ ID NO: 132823 - DNA, 22 bp, Homo sapiens
tatttgcaggtctttaaatcat

SEQ ID NO: 132824 - DNA, 23 bp, Homo sapiens
tatttgtaaggcttgttccaatg

SEQ ID NO: 132825 - DNA, 12 bp, Homo sapiens
tattttaagaaa

SEQ ID NO: 132826 - DNA, 14 bp, Homo sapiens
tattttaagaaaga

SEQ ID NO: 132827 - DNA, 13 bp, Homo sapiens
tattttgccattt

SEQ ID NO: 132828 - DNA, 16 bp, Homo sapiens
tattttgccatttagc

SEQ ID NO: 132829 - DNA, 18 bp, Homo sapiens
tatttttaaaataaaaat

SEQ ID NO: 132830 - DNA, 12 bp, Homo sapiens
tatttttaacat

SEQ ID NO: 132831 - DNA, 11 bp, Homo sapiens
tatttttgtac

SEQ ID NO: 132832 - DNA, 16 bp, Homo sapiens
tatttttgtacgttat

SEQ ID NO: 132833 - DNA, 19 bp, Homo sapiens
tattttttatatctggaat

SEQ ID NO: 132834 - DNA, 16 bp, Homo sapiens
tcaaagagagttttta

SEQ ID NO: 132835 - DNA, 15 bp, Homo sapiens
tcaacatcttttaca

SEQ ID NO: 132836 - DNA, 15 bp, Homo sapiens
tcaacctgtgtctta

SEQ ID NO: 132837 - DNA, 19 bp, Homo sapiens
tcaagatatatgtgtatac

SEQ ID NO: 132838 - DNA, 21 bp, Homo sapiens
tcaagatatatgtgtatacat

SEQ ID NO: 132839 - DNA, 14 bp, Homo sapiens
tcaaggtaagctca

SEQ ID NO: 132840 - DNA, 19 bp, Homo sapiens
tcaagtctctgctggccca

SEQ ID NO: 132841 - DNA, 19 bp, Homo sapiens
tcaatagtgtcctatgcaa

SEQ ID NO: 132842 - DNA, 20 bp, Homo sapiens
tcaatagtgtcctatgcaat

SEQ ID NO: 132843 - DNA, 16 bp, Homo sapiens
tcaatagttcttaaaa

SEQ ID NO: 132844 - DNA, 12 bp, Homo sapiens
tcaatatttaag

SEQ ID NO: 132845 - DNA, 13 bp, Homo sapiens
tcaatatttaagt

SEQ ID NO: 132846 - DNA, 17 bp, Homo sapiens
tcaatatttaagtttgt

SEQ ID NO: 132847 - DNA, 19 bp, Homo sapiens
tcaattaaagaaataattt

SEQ ID NO: 132848 - DNA, 17 bp, Homo sapiens
tcacagtgttgcccagg

SEQ ID NO: 132849 - DNA, 19 bp, Homo sapiens
tcaccccagcccccacagc

SEQ ID NO: 132850 - DNA, 23 bp, Homo sapiens
tcaccccagcccccacagccctg

SEQ ID NO: 132851 - DNA, 12 bp, Homo sapiens
tcaccccatccc

SEQ ID NO: 132852 - DNA, 18 bp, Homo sapiens
tcaccttcctcagctcag

SEQ ID NO: 132853 - DNA, 14 bp, Homo sapiens
tcactgcagccttt

SEQ ID NO: 132854 - DNA, 15 bp, Homo sapiens
tcactgcagcctttc

SEQ ID NO: 132855 - DNA, 15 bp, Homo sapiens
tcagaaacagtattt

SEQ ID NO: 132856 - DNA, 16 bp, Homo sapiens
tcagaaattaaaatat

SEQ ID NO: 132857 - DNA, 18 bp, Homo sapiens
tcagaaattaaaatatta

SEQ ID NO: 132858 - DNA, 20 bp, Homo sapiens
tcagaacaacttgctactta

SEQ ID NO: 132859 - DNA, 13 bp, Homo sapiens
tcagaataaaatt

SEQ ID NO: 132860 - DNA, 14 bp, Homo sapiens
tcagacatttatat

SEQ ID NO: 132861 - DNA, 15 bp, Homo sapiens
tcagatgcagttttc

SEQ ID NO: 132862 - DNA, 20 bp, Homo sapiens
tcagatgcagttttcaaatt

SEQ ID NO: 132863 - DNA, 14 bp, Homo sapiens
tcagcatgacaaaa

SEQ ID NO: 132864 - DNA, 16 bp, Homo sapiens
tcagcatgacaaaaat

SEQ ID NO: 132865 - DNA, 20 bp, Homo sapiens
tcagcatgacaaaaataaca

SEQ ID NO: 132866 - DNA, 17 bp, Homo sapiens
tcagcccccaggccagg

SEQ ID NO: 132867 - DNA, 20 bp, Homo sapiens
tcagcctccggagtagctgg

SEQ ID NO: 132868 - DNA, 19 bp, Homo sapiens
tcagctcagctgggccact

SEQ ID NO: 132869 - DNA, 12 bp, Homo sapiens
tcagctccctga

SEQ ID NO: 132870 - DNA, 21 bp, Homo sapiens
tcagctccctgaccccctgtc

SEQ ID NO: 132871 - DNA, 22 bp, Homo sapiens
tcagctccctgaccccctgtcc

SEQ ID NO: 132872 - DNA, 20 bp, Homo sapiens
tcagctctcctggctccctc

SEQ ID NO: 132873 - DNA, 23 bp, Homo sapiens
tcagctgggccactcctcttcac

SEQ ID NO: 132874 - DNA, 12 bp, Homo sapiens
tcaggaaagaat

SEQ ID NO: 132875 - DNA, 14 bp, Homo sapiens
tcaggaaagaatag

SEQ ID NO: 132876 - DNA, 16 bp, Homo sapiens
tcagtacctcccctcc

SEQ ID NO: 132877 - DNA, 13 bp, Homo sapiens
tcataatggcctg

SEQ ID NO: 132878 - DNA, 14 bp, Homo sapiens
tcatacttaacatt

SEQ ID NO: 132879 - DNA, 15 bp, Homo sapiens
tcatattttgttgtg

SEQ ID NO: 132880 - DNA, 16 bp, Homo sapiens
tcatcttcttctttaa

SEQ ID NO: 132881 - DNA, 21 bp, Homo sapiens
tcatgcaagacttcactgcag

SEQ ID NO: 132882 - DNA, 23 bp, Homo sapiens
tcatgcaagacttcactgcagcc

SEQ ID NO: 132883 - DNA, 22 bp, Homo sapiens
tcatgccaccatggccagccaa

SEQ ID NO: 132884 - DNA, 18 bp, Homo sapiens
tcatgctatcagaaacag

SEQ ID NO: 132885 - DNA, 14 bp, Homo sapiens
tcattaaaatatat

SEQ ID NO: 132886 - DNA, 14 bp, Homo sapiens
tcattaatcaattt

SEQ ID NO: 132887 - DNA, 22 bp, Homo sapiens
tcattacttctgagccccagcc

SEQ ID NO: 132888 - DNA, 15 bp, Homo sapiens
tcattttaggaaagg

SEQ ID NO: 132889 - DNA, 14 bp, Homo sapiens
tcatttttgtataa

SEQ ID NO: 132890 - DNA, 19 bp, Homo sapiens
tcatttttgtataaaaagg

SEQ ID NO: 132891 - DNA, 23 bp, Homo sapiens
tcatttttgtataaaaaggaaat

SEQ ID NO: 132892 - DNA, 13 bp, Homo sapiens
tccaaattattaa

SEQ ID NO: 132893 - DNA, 21 bp, Homo sapiens
tccaaattattaattgtcctg

SEQ ID NO: 132894 - DNA, 13 bp, Homo sapiens
tccaagaaaatat

SEQ ID NO: 132895 - DNA, 18 bp, Homo sapiens
tccactgccaaaacaatg

SEQ ID NO: 132896 - DNA, 12 bp, Homo sapiens
tccactgtttca

SEQ ID NO: 132897 - DNA, 19 bp, Homo sapiens
tccactgtttcatgagccc

SEQ ID NO: 132898 - DNA, 15 bp, Homo sapiens
tccagtgagtgtaaa

SEQ ID NO: 132899 - DNA, 20 bp, Homo sapiens
tccagtgagtgtaaataatt

SEQ ID NO: 132900 - DNA, 21 bp, Homo sapiens
tccagtgagtgtaaataattt

SEQ ID NO: 132901 - DNA, 19 bp, Homo sapiens
tccatgcctctggaggcct

SEQ ID NO: 132902 - DNA, 15 bp, Homo sapiens
tcccaaatcaaaata

SEQ ID NO: 132903 - DNA, 12 bp, Homo sapiens
tcccaatacaaa

SEQ ID NO: 132904 - DNA, 20 bp, Homo sapiens
tcccacccccatctctccct

SEQ ID NO: 132905 - DNA, 17 bp, Homo sapiens
tcccagaggccgctgcc

SEQ ID NO: 132906 - DNA, 21 bp, Homo sapiens
tcccagaggccgctgcccctg

SEQ ID NO: 132907 - DNA, 22 bp, Homo sapiens
tcccagaggccgctgcccctga

SEQ ID NO: 132908 - DNA, 18 bp, Homo sapiens
tcccagctctctctcctg

SEQ ID NO: 132909 - DNA, 13 bp, Homo sapiens
tcccagtgagcct

SEQ ID NO: 132910 - DNA, 14 bp, Homo sapiens
tcccattctatgtg

SEQ ID NO: 132911 - DNA, 15 bp, Homo sapiens
tcccattctatgtgt

SEQ ID NO: 132912 - DNA, 14 bp, Homo sapiens
tccccaaaagaaac

SEQ ID NO: 132913 - DNA, 15 bp, Homo sapiens
tccccctagagactc

SEQ ID NO: 132914 - DNA, 13 bp, Homo sapiens
tccccgaaaaccc

SEQ ID NO: 132915 - DNA, 21 bp, Homo sapiens
tccccggcggggtgcctgctg

SEQ ID NO: 132916 - DNA, 13 bp, Homo sapiens
tccccggctcgag

SEQ ID NO: 132917 - DNA, 18 bp, Homo sapiens
tcccctccccgccccctg

SEQ ID NO: 132918 - DNA, 22 bp, Homo sapiens
tcccctccccgccccctgaaac

SEQ ID NO: 132919 - DNA, 18 bp, Homo sapiens
tcccctctctgtggctcc

SEQ ID NO: 132920 - DNA, 17 bp, Homo sapiens
tcccgccaccctgtctc

SEQ ID NO: 132921 - DNA, 18 bp, Homo sapiens
tcccgccaccctgtctca

SEQ ID NO: 132922 - DNA, 14 bp, Homo sapiens
tcccggggctccac

SEQ ID NO: 132923 - DNA, 20 bp, Homo sapiens
tccctcccgtagtctcctgg

SEQ ID NO: 132924 - DNA, 16 bp, Homo sapiens
tccctgaccccctgtc

SEQ ID NO: 132925 - DNA, 19 bp, Homo sapiens
tcccttcctcctctcctgg

SEQ ID NO: 132926 - DNA, 16 bp, Homo sapiens
tcccttggatcagagg

SEQ ID NO: 132927 - DNA, 15 bp, Homo sapiens
tccctttttaaaaaa

SEQ ID NO: 132928 - DNA, 16 bp, Homo sapiens
tccctttttaaaaaat

SEQ ID NO: 132929 - DNA, 20 bp, Homo sapiens
tccctttttatatcccattt

SEQ ID NO: 132930 - DNA, 15 bp, Homo sapiens
tcctagccccaccca

SEQ ID NO: 132931 - DNA, 19 bp, Homo sapiens
tcctagccccacccagagg

SEQ ID NO: 132932 - DNA, 12 bp, Homo sapiens
tcctatatctgt

SEQ ID NO: 132933 - DNA, 18 bp, Homo sapiens
tcctatatctgtttgtat

SEQ ID NO: 132934 - DNA, 13 bp, Homo sapiens
tcctatgcaataa

SEQ ID NO: 132935 - DNA, 17 bp, Homo sapiens
tcctcagcccccaggcc

SEQ ID NO: 132936 - DNA, 15 bp, Homo sapiens
tcctcctcagccccc

SEQ ID NO: 132937 - DNA, 22 bp, Homo sapiens
tcctcctcagcccccaggccag

SEQ ID NO: 132938 - DNA, 23 bp, Homo sapiens
tcctcctcagcccccaggccagg

SEQ ID NO: 132939 - DNA, 14 bp, Homo sapiens
tcctcctctcctgg

SEQ ID NO: 132940 - DNA, 21 bp, Homo sapiens
tcctctgatagctgtttcaaa

SEQ ID NO: 132941 - DNA, 12 bp, Homo sapiens
tcctctgggcct

SEQ ID NO: 132942 - DNA, 13 bp, Homo sapiens
tcctctgggcctg

SEQ ID NO: 132943 - DNA, 14 bp, Homo sapiens
tcctctgggcctgg

SEQ ID NO: 132944 - DNA, 20 bp, Homo sapiens
tcctctgggcctggggtgca

SEQ ID NO: 132945 - DNA, 17 bp, Homo sapiens
tcctgcctcagcctccg

SEQ ID NO: 132946 - DNA, 20 bp, Homo sapiens
tcctgctcctttctgcccag

SEQ ID NO: 132947 - DNA, 19 bp, Homo sapiens
taaaatattatttgatatc

SEQ ID NO: 132948 - DNA, 13 bp, Homo sapiens
taaacagaaaact

SEQ ID NO: 132949 - DNA, 18 bp, Homo sapiens
taaactttcttaatattt

SEQ ID NO: 132950 - DNA, 15 bp, Homo sapiens
taaagtatttataaa

SEQ ID NO: 132951 - DNA, 12 bp, Homo sapiens
aaaaaaaaactc

SEQ ID NO: 132952 - DNA, 11 bp, Homo sapiens
aaaaaaaagaa

SEQ ID NO: 132953 - DNA, 12 bp, Homo sapiens
aaaaaactgaag

SEQ ID NO: 132954 - DNA, 12 bp, Homo sapiens
aaaaaagactgt

SEQ ID NO: 132955 - DNA, 19 bp, Homo sapiens
aaaaaagattgtattgctg

SEQ ID NO: 132956 - DNA, 14 bp, Homo sapiens
aaaaactcctgtgt

SEQ ID NO: 132957 - DNA, 23 bp, Homo sapiens
aaaaactcctgtgtcggtcagaa

SEQ ID NO: 132958 - DNA, 13 bp, Homo sapiens
aaaaactgaaggt

SEQ ID NO: 132959 - DNA, 17 bp, Homo sapiens
aaaaactgaaggttttt

SEQ ID NO: 132960 - DNA, 21 bp, Homo sapiens
aaaaactgtgtatcattaaaa

SEQ ID NO: 132961 - DNA, 22 bp, Homo sapiens
aaaaagactgtcaaatgaactt

SEQ ID NO: 132962 - DNA, 13 bp, Homo sapiens
aaaaagattatat

SEQ ID NO: 132963 - DNA, 18 bp, Homo sapiens
aaaaagattatatatcat

SEQ ID NO: 132964 - DNA, 11 bp, Homo sapiens
aaaaagtatat

SEQ ID NO: 132965 - DNA, 20 bp, Homo sapiens
aaaaagtgaacttttgtaat

SEQ ID NO: 132966 - DNA, 13 bp, Homo sapiens
aaaaataccattg

SEQ ID NO: 132967 - DNA, 22 bp, Homo sapiens
aaaaataccattgaaatcagca

SEQ ID NO: 132968 - DNA, 23 bp, Homo sapiens
aaaaatacctcaggaaagaatag

SEQ ID NO: 132969 - DNA, 22 bp, Homo sapiens
aaaaatgtgtgtattcttaaaa

SEQ ID NO: 132970 - DNA, 17 bp, Homo sapiens
aaaactcatgatcaaga

SEQ ID NO: 132971 - DNA, 13 bp, Homo sapiens
aaaactcctgtgt

SEQ ID NO: 132972 - DNA, 14 bp, Homo sapiens
aaaactcctgtgtc

SEQ ID NO: 132973 - DNA, 14 bp, Homo sapiens
aaaactgaaggttt

SEQ ID NO: 132974 - DNA, 19 bp, Homo sapiens
aaaactgtgtatcattaaa

SEQ ID NO: 132975 - DNA, 23 bp, Homo sapiens
aaaactgtgtatcattaaaatat

SEQ ID NO: 132976 - DNA, 13 bp, Homo sapiens
aaaactttaaaag

SEQ ID NO: 132977 - DNA, 17 bp, Homo sapiens
aaaactttaaaaggcaa

SEQ ID NO: 132978 - DNA, 10 bp, Homo sapiens
aaaagaaacc

SEQ ID NO: 132979 - DNA, 18 bp, Homo sapiens
aaaagaaaccatgacaaa

SEQ ID NO: 132980 - DNA, 21 bp, Homo sapiens
aaaagactggtttgtttgctt

SEQ ID NO: 132981 - DNA, 24 bp, Homo sapiens
aaaagactggtttgtttgcttaat

SEQ ID NO: 132982 - DNA, 14 bp, Homo sapiens
aaaagactgtcaaa

SEQ ID NO: 132983 - DNA, 21 bp, Homo sapiens
aaaagactgtcaaatgaactt

SEQ ID NO: 132984 - DNA, 13 bp, Homo sapiens
aaaagattatata

SEQ ID NO: 132985 - DNA, 17 bp, Homo sapiens
aaaagattatatatcat

SEQ ID NO: 132986 - DNA, 20 bp, Homo sapiens
aaaagattatatatcataaa

SEQ ID NO: 132987 - DNA, 19 bp, Homo sapiens
aaaaggaaattagtctttt

SEQ ID NO: 132988 - DNA, 24 bp, Homo sapiens
aaaagtaatgaagaatcacgattt

SEQ ID NO: 132989 - DNA, 13 bp, Homo sapiens
aaaagtgaacttt

SEQ ID NO: 132990 - DNA, 18 bp, Homo sapiens
aaaagtgaacttttgtaa

SEQ ID NO: 132991 - DNA, 15 bp, Homo sapiens
aaaagttataataac

SEQ ID NO: 132992 - DNA, 17 bp, Homo sapiens
aaaagttataataactg

SEQ ID NO: 132993 - DNA, 20 bp, Homo sapiens
aaaagttataataactgaac

SEQ ID NO: 132994 - DNA, 22 bp, Homo sapiens
aaaataaactttcttaatattt

SEQ ID NO: 132995 - DNA, 14 bp, Homo sapiens
aaaataccattgaa

SEQ ID NO: 132996 - DNA, 15 bp, Homo sapiens
aaaataccattgaaa

SEQ ID NO: 132997 - DNA, 20 bp, Homo sapiens
aaaatacctcaggaaagaat

SEQ ID NO: 132998 - DNA, 24 bp, Homo sapiens
aaaatacctcaggaaagaatagaa

SEQ ID NO: 132999 - DNA, 13 bp, Homo sapiens
aaaatataaattg

SEQ ID NO: 133000 - DNA, 14 bp, Homo sapiens
aaaatattgctaaa

SEQ ID NO: 133001 - DNA, 22 bp, Homo sapiens
aaaatattgctaaaagtgcatt

SEQ ID NO: 133002 - DNA, 18 bp, Homo sapiens
aaaatattttaagaaaga

SEQ ID NO: 133003 - DNA, 14 bp, Homo sapiens
aaaatcaacatgac

SEQ ID NO: 133004 - DNA, 14 bp, Homo sapiens
aaaatcctatatct

SEQ ID NO: 133005 - DNA, 12 bp, Homo sapiens
aaaatgcaatat

SEQ ID NO: 133006 - DNA, 14 bp, Homo sapiens
aaaatgcttcaaag

SEQ ID NO: 133007 - DNA, 23 bp, Homo sapiens
aaaattaggaacagtaaaatcca

SEQ ID NO: 133008 - DNA, 14 bp, Homo sapiens
aaaattgagtttca

SEQ ID NO: 133009 - DNA, 12 bp, Homo sapiens
aaacaaaaacat

SEQ ID NO: 133010 - DNA, 19 bp, Homo sapiens
aaacagagaaagaaaaggc

SEQ ID NO: 133011 - DNA, 15 bp, Homo sapiens
aaaccacaaaaaaat

SEQ ID NO: 133012 - DNA, 17 bp, Homo sapiens
aaaccagtttattctgt

SEQ ID NO: 133013 - DNA, 16 bp, Homo sapiens
aaacctaaagaggaaa

SEQ ID NO: 133014 - DNA, 15 bp, Homo sapiens
aaacctagcttttaa

SEQ ID NO: 133015 - DNA, 16 bp, Homo sapiens
aaacctagcttttaaa

SEQ ID NO: 133016 - DNA, 20 bp, Homo sapiens
aaacctagcttttaaaaaat

SEQ ID NO: 133017 - DNA, 23 bp, Homo sapiens
aaacctagcttttaaaaaatatt

SEQ ID NO: 133018 - DNA, 17 bp, Homo sapiens
aaacctgtccataaagt

SEQ ID NO: 133019 - DNA, 22 bp, Homo sapiens
aaacgtgttgtatctacagtaa

SEQ ID NO: 133020 - DNA, 20 bp, Homo sapiens
aaactgagaaatgaatgctg

SEQ ID NO: 133021 - DNA, 16 bp, Homo sapiens
aaactgagtccatgaa

SEQ ID NO: 133022 - DNA, 18 bp, Homo sapiens
aaactgagtccatgaaaa

SEQ ID NO: 133023 - DNA, 20 bp, Homo sapiens
aaaggatgatcaaaaataat

SEQ ID NO: 133024 - DNA, 18 bp, Homo sapiens
aaaggatgttacaagttt

SEQ ID NO: 133025 - DNA, 21 bp, Homo sapiens
aaaggatgttacaagtttgct

SEQ ID NO: 133026 - DNA, 17 bp, Homo sapiens
aaaggcaaaagactggt

SEQ ID NO: 133027 - DNA, 20 bp, Homo sapiens
aaaggcaactcaaagatgat

SEQ ID NO: 133028 - DNA, 13 bp, Homo sapiens
aaaggtatttaga

SEQ ID NO: 133029 - DNA, 16 bp, Homo sapiens
aaagtaattttgtgaa

SEQ ID NO: 133030 - DNA, 14 bp, Homo sapiens
aaagtatatattct

SEQ ID NO: 133031 - DNA, 15 bp, Homo sapiens
aaagtatatattcta

SEQ ID NO: 133032 - DNA, 21 bp, Homo sapiens
aaagtattcagaaattaaaat

SEQ ID NO: 133033 - DNA, 20 bp, Homo sapiens
aaagtatttataaaaatata

SEQ ID NO: 133034 - DNA, 17 bp, Homo sapiens
aaagtgaacttttgtaa

SEQ ID NO: 133035 - DNA, 20 bp, Homo sapiens
aaagttaaactacttgtaaa

SEQ ID NO: 133036 - DNA, 21 bp, Homo sapiens
aaagttaatatggtaattatg

SEQ ID NO: 133037 - DNA, 15 bp, Homo sapiens
aaagttataataact

SEQ ID NO: 133038 - DNA, 13 bp, Homo sapiens
aaataaacacgat

SEQ ID NO: 133039 - DNA, 13 bp, Homo sapiens
aaataaactttct

SEQ ID NO: 133040 - DNA, 21 bp, Homo sapiens
aaataaactttcttaatattt

SEQ ID NO: 133041 - DNA, 13 bp, Homo sapiens
aaataacctctgg

SEQ ID NO: 133042 - DNA, 17 bp, Homo sapiens
aaataacctctggccct

SEQ ID NO: 133043 - DNA, 18 bp, Homo sapiens
aaataacctctggccctt

SEQ ID NO: 133044 - DNA, 20 bp, Homo sapiens
aaataagaagggggagtgaa

SEQ ID NO: 133045 - DNA, 19 bp, Homo sapiens
aaataattttaaataacct

SEQ ID NO: 133046 - DNA, 18 bp, Homo sapiens
aaataattttattccaga

SEQ ID NO: 133047 - DNA, 14 bp, Homo sapiens
aaataccattgaaa

SEQ ID NO: 133048 - DNA, 14 bp, Homo sapiens
aaatacctcaggaa

SEQ ID NO: 133049 - DNA, 17 bp, Homo sapiens
aaatacctcaggaaaga

SEQ ID NO: 133050 - DNA, 21 bp, Homo sapiens
aaatacctcaggaaagaatag

SEQ ID NO: 133051 - DNA, 18 bp, Homo sapiens
aaatagcgtgggatagat

SEQ ID NO: 133052 - DNA, 16 bp, Homo sapiens
aaatataaattgtaca

SEQ ID NO: 133053 - DNA, 20 bp, Homo sapiens
aaatatagagatatttttgt

SEQ ID NO: 133054 - DNA, 15 bp, Homo sapiens
aaatatatgttctgc

SEQ ID NO: 133055 - DNA, 19 bp, Homo sapiens
aaatatctgaacatttact

SEQ ID NO: 133056 - DNA, 17 bp, Homo sapiens
aaatattatttgatatc

SEQ ID NO: 133057 - DNA, 19 bp, Homo sapiens
aaatattatttgatatctg

SEQ ID NO: 133058 - DNA, 16 bp, Homo sapiens
aaatattgctaaaagt

SEQ ID NO: 133059 - DNA, 18 bp, Homo sapiens
aaatattgctaaaagtgc

SEQ ID NO: 133060 - DNA, 20 bp, Homo sapiens
aaatattgctaaaagtgcat

SEQ ID NO: 133061 - DNA, 21 bp, Homo sapiens
aaatattgctaaaagtgcatt

SEQ ID NO: 133062 - DNA, 15 bp, Homo sapiens
aaatcaagatgagat

SEQ ID NO: 133063 - DNA, 23 bp, Homo sapiens
aaatcagcatgacaaaaataaca

SEQ ID NO: 133064 - DNA, 16 bp, Homo sapiens
aaatcattttaggaaa

SEQ ID NO: 133065 - DNA, 19 bp, Homo sapiens
aaatcattttaggaaagga

SEQ ID NO: 133066 - DNA, 22 bp, Homo sapiens
aaatctaaaaattttgcatttc

SEQ ID NO: 133067 - DNA, 20 bp, Homo sapiens
aaatctagacattcttttaa

SEQ ID NO: 133068 - DNA, 17 bp, Homo sapiens
aaatctggcaaagttat

SEQ ID NO: 133069 - DNA, 12 bp, Homo sapiens
aaatgaactttt

SEQ ID NO: 133070 - DNA, 13 bp, Homo sapiens
aaatgaactttta

SEQ ID NO: 133071 - DNA, 18 bp, Homo sapiens
aaatgaacttttacagaa

SEQ ID NO: 133072 - DNA, 19 bp, Homo sapiens
aaatgaacttttacagaat

SEQ ID NO: 133073 - DNA, 22 bp, Homo sapiens
aaatgagcattagctacttttc

SEQ ID NO: 133074 - DNA, 14 bp, Homo sapiens
aaatgcaaatttct

SEQ ID NO: 133075 - DNA, 21 bp, Homo sapiens
aaatgcaaatttctataaatt

SEQ ID NO: 133076 - DNA, 11 bp, Homo sapiens
aaatgcaatat

SEQ ID NO: 133077 - DNA, 13 bp, Homo sapiens
aaatgcattatgt

SEQ ID NO: 133078 - DNA, 19 bp, Homo sapiens
aaatgcttcactgtacgta

SEQ ID NO: 133079 - DNA, 14 bp, Homo sapiens
aaatgtgcattttg

SEQ ID NO: 133080 - DNA, 13 bp, Homo sapiens
aaattaaaataac

SEQ ID NO: 133081 - DNA, 13 bp, Homo sapiens
aaattaaatctag

SEQ ID NO: 133082 - DNA, 22 bp, Homo sapiens
aaattaaatctagacattcttt

SEQ ID NO: 133083 - DNA, 12 bp, Homo sapiens
aaattagtcttt

SEQ ID NO: 133084 - DNA, 20 bp, Homo sapiens
aaattagtgagattaaaaat

SEQ ID NO: 133085 - DNA, 22 bp, Homo sapiens
aaattattaattgtcctgtgtc

SEQ ID NO: 133086 - DNA, 20 bp, Homo sapiens
aaattcaacctgtgtcttat

SEQ ID NO: 133087 - DNA, 14 bp, Homo sapiens
aaattgaaagtatt

SEQ ID NO: 133088 - DNA, 18 bp, Homo sapiens
aaattgaaagtattcaga

SEQ ID NO: 133089 - DNA, 15 bp, Homo sapiens
aaattgagtttcaga

SEQ ID NO: 133090 - DNA, 16 bp, Homo sapiens
aaattgagtttcagaa

SEQ ID NO: 133091 - DNA, 22 bp, Homo sapiens
aaattgagtttcagaataaaat

SEQ ID NO: 133092 - DNA, 18 bp, Homo sapiens
aaattgtacattttgtaa

SEQ ID NO: 133093 - DNA, 15 bp, Homo sapiens
aaatttaagaaaaca

SEQ ID NO: 133094 - DNA, 20 bp, Homo sapiens
aaggtatttagaatatatta

SEQ ID NO: 133095 - DNA, 19 bp, Homo sapiens
aaggtgggtgaggctgggc

SEQ ID NO: 133096 - DNA, 21 bp, Homo sapiens
aaggtttcccagtgagcctct

SEQ ID NO: 133097 - DNA, 18 bp, Homo sapiens
aaggttttttttttaagt

SEQ ID NO: 133098 - DNA, 14 bp, Homo sapiens
aagtaagtcttttt

SEQ ID NO: 133099 - DNA, 23 bp, Homo sapiens
aagtaagtcttttttttttccaa

SEQ ID NO: 133100 - DNA, 17 bp, Homo sapiens
aagtaatgaagaatcac

SEQ ID NO: 133101 - DNA, 23 bp, Homo sapiens
aagtacagctgacggtttctccc

SEQ ID NO: 133102 - DNA, 23 bp, Homo sapiens
aagtattacaaccatatattgag

SEQ ID NO: 133103 - DNA, 16 bp, Homo sapiens
aagtattcagaaatta

SEQ ID NO: 133104 - DNA, 20 bp, Homo sapiens
aagtattcagaaattaaaat

SEQ ID NO: 133105 - DNA, 21 bp, Homo sapiens
aagtattcagaaattaaaata

SEQ ID NO: 133106 - DNA, 19 bp, Homo sapiens
aagtatttataaaaatata

SEQ ID NO: 133107 - DNA, 22 bp, Homo sapiens
aagtcctgctcctttctgccca

SEQ ID NO: 133108 - DNA, 13 bp, Homo sapiens
aagtctagaatca

SEQ ID NO: 133109 - DNA, 20 bp, Homo sapiens
aagtcttttttttttccaaa

SEQ ID NO: 133110 - DNA, 21 bp, Homo sapiens
aagtcttttttttttccaaat

SEQ ID NO: 133111 - DNA, 22 bp, Homo sapiens
aagtgaacttttgtaatttgaa

SEQ ID NO: 133112 - DNA, 17 bp, Homo sapiens
aagtgcaacatttctgt

SEQ ID NO: 133113 - DNA, 20 bp, Homo sapiens
aagtgcaatgcgtgttgtac

SEQ ID NO: 133114 - DNA, 14 bp, Homo sapiens
aagtggtgaccaaa

SEQ ID NO: 133115 - DNA, 13 bp, Homo sapiens
aagtgtcctggac

SEQ ID NO: 133116 - DNA, 17 bp, Homo sapiens
aagtgtcctggaccctg

SEQ ID NO: 133117 - DNA, 21 bp, Homo sapiens
aagtgtcctggaccctggcct

SEQ ID NO: 133118 - DNA, 21 bp, Homo sapiens
aagtgtctcttgactggctca

SEQ ID NO: 133119 - DNA, 12 bp, Homo sapiens
aagttatattta

SEQ ID NO: 133120 - DNA, 21 bp, Homo sapiens
aagtttaattatctgcattta

SEQ ID NO: 133121 - DNA, 17 bp, Homo sapiens
aagtttgctaaaagaag

SEQ ID NO: 133122 - DNA, 19 bp, Homo sapiens
aataaaaagtgaacttttg

SEQ ID NO: 133123 - DNA, 20 bp, Homo sapiens
aataaaaagtgaacttttgt

SEQ ID NO: 133124 - DNA, 14 bp, Homo sapiens
aataaaagaaatat

SEQ ID NO: 133125 - DNA, 20 bp, Homo sapiens
acaagtttgctaaaagaaga

SEQ ID NO: 133126 - DNA, 11 bp, Homo sapiens
acaataaacag

SEQ ID NO: 133127 - DNA, 16 bp, Homo sapiens
acaatacatgctgcta

SEQ ID NO: 133128 - DNA, 23 bp, Homo sapiens
acaatatatagctggcaagaatg

SEQ ID NO: 133129 - DNA, 19 bp, Homo sapiens
acaatcagccacattctag

SEQ ID NO: 133130 - DNA, 16 bp, Homo sapiens
acaattagcagaatgg

SEQ ID NO: 133131 - DNA, 17 bp, Homo sapiens
acaattagcagaatgga

SEQ ID NO: 133132 - DNA, 19 bp, Homo sapiens
acaattagcagaatggaga

SEQ ID NO: 133133 - DNA, 22 bp, Homo sapiens
acacaagtgcagtagtgcagtt

SEQ ID NO: 133134 - DNA, 16 bp, Homo sapiens
acacatatatgtatat

SEQ ID NO: 133135 - DNA, 16 bp, Homo sapiens
acacatgctgaggttt

SEQ ID NO: 133136 - DNA, 13 bp, Homo sapiens
acacattttatga

SEQ ID NO: 133137 - DNA, 14 bp, Homo sapiens
acactgttggcact

SEQ ID NO: 133138 - DNA, 22 bp, Homo sapiens
acagaaaactcccaatacaaag

SEQ ID NO: 133139 - DNA, 18 bp, Homo sapiens
acagaatgcattaaaaaa

SEQ ID NO: 133140 - DNA, 17 bp, Homo sapiens
acagacagggagaagtt

SEQ ID NO: 133141 - DNA, 15 bp, Homo sapiens
acagagaaagaaaag

SEQ ID NO: 133142 - DNA, 15 bp, Homo sapiens
acagatttgaggact

SEQ ID NO: 133143 - DNA, 20 bp, Homo sapiens
acagcaggatgccctgttgg

SEQ ID NO: 133144 - DNA, 13 bp, Homo sapiens
acagcccagggcc

SEQ ID NO: 133145 - DNA, 21 bp, Homo sapiens
acagccctgaaacgagaagtg

SEQ ID NO: 133146 - DNA, 22 bp, Homo sapiens
acagccctgaaacgagaagtgc

SEQ ID NO: 133147 - DNA, 15 bp, Homo sapiens
acagcctcccacccc

SEQ ID NO: 133148 - DNA, 16 bp, Homo sapiens
acagcctcccaccccc

SEQ ID NO: 133149 - DNA, 21 bp, Homo sapiens
acagctggccagtaattagtg

SEQ ID NO: 133150 - DNA, 21 bp, Homo sapiens
acaggaggctccgtgagccct

SEQ ID NO: 133151 - DNA, 12 bp, Homo sapiens
acagtaatgaaa

SEQ ID NO: 133152 - DNA, 13 bp, Homo sapiens
acagtcacaaatt

SEQ ID NO: 133153 - DNA, 12 bp, Homo sapiens
acagtttgtgtt

SEQ ID NO: 133154 - DNA, 17 bp, Homo sapiens
acagtttgtgttttaaa

SEQ ID NO: 133155 - DNA, 12 bp, Homo sapiens
acataaaacttt

SEQ ID NO: 133156 - DNA, 14 bp, Homo sapiens
acataaaactttaa

SEQ ID NO: 133157 - DNA, 12 bp, Homo sapiens
acataaaggtat

SEQ ID NO: 133158 - DNA, 14 bp, Homo sapiens
acatataaaagtta

SEQ ID NO: 133159 - DNA, 13 bp, Homo sapiens
acatatatgtata

SEQ ID NO: 133160 - DNA, 14 bp, Homo sapiens
acatatatgtatat

SEQ ID NO: 133161 - DNA, 23 bp, Homo sapiens
acatatatgtatatgtatatcta

SEQ ID NO: 133162 - DNA, 15 bp, Homo sapiens
acatattttttatat

SEQ ID NO: 133163 - DNA, 21 bp, Homo sapiens
acatattttttatatctggaa

SEQ ID NO: 133164 - DNA, 18 bp, Homo sapiens
acatccagagatgactat

SEQ ID NO: 133165 - DNA, 15 bp, Homo sapiens
acatgacatccagag

SEQ ID NO: 133166 - DNA, 21 bp, Homo sapiens
acatgacatccagagatgact

SEQ ID NO: 133167 - DNA, 22 bp, Homo sapiens
acatgcctatatgagaagaata

SEQ ID NO: 133168 - DNA, 18 bp, Homo sapiens
acatgctgaggttttgaa

SEQ ID NO: 133169 - DNA, 22 bp, Homo sapiens
acatgctgaggttttgaataaa

SEQ ID NO: 133170 - DNA, 14 bp, Homo sapiens
acatgggaggaagg

SEQ ID NO: 133171 - DNA, 21 bp, Homo sapiens
acattcagctgaggttcatta

SEQ ID NO: 133172 - DNA, 14 bp, Homo sapiens
acattcttttaatg

SEQ ID NO: 133173 - DNA, 18 bp, Homo sapiens
acattgcactcatcatat

SEQ ID NO: 133174 - DNA, 18 bp, Homo sapiens
acatttcattgtacaagt

SEQ ID NO: 133175 - DNA, 21 bp, Homo sapiens
acatttcattgtacaagtatt

SEQ ID NO: 133176 - DNA, 15 bp, Homo sapiens
acatttctgtatact

SEQ ID NO: 133177 - DNA, 21 bp, Homo sapiens
acatttctgtatactgtaaaa

SEQ ID NO: 133178 - DNA, 16 bp, Homo sapiens
acattttatgagagtt

SEQ ID NO: 133179 - DNA, 18 bp, Homo sapiens
acattttattgtcagaat

SEQ ID NO: 133180 - DNA, 14 bp, Homo sapiens
acattttgtaaaat

SEQ ID NO: 133181 - DNA, 20 bp, Homo sapiens
accaaaatttttaggtgaag

SEQ ID NO: 133182 - DNA, 18 bp, Homo sapiens
accacaaaaaaatacctc

SEQ ID NO: 133183 - DNA, 22 bp, Homo sapiens
accacaggaattttaaaaacaa

SEQ ID NO: 133184 - DNA, 16 bp, Homo sapiens
accagcttagatttta

SEQ ID NO: 133185 - DNA, 21 bp, Homo sapiens
accaggagggagagcctctgt

SEQ ID NO: 133186 - DNA, 20 bp, Homo sapiens
accagggagaggcctcggct

SEQ ID NO: 133187 - DNA, 16 bp, Homo sapiens
accataggaagacata

SEQ ID NO: 133188 - DNA, 23 bp, Homo sapiens
actggtgtcataaactttctcca

SEQ ID NO: 133189 - DNA, 12 bp, Homo sapiens
actggtttgttt

SEQ ID NO: 133190 - DNA, 16 bp, Homo sapiens
actggtttgtttgctt

SEQ ID NO: 133191 - DNA, 19 bp, Homo sapiens
actggtttgtttgcttaat

SEQ ID NO: 133192 - DNA, 18 bp, Homo sapiens
actgtaaaaaatgtgtgt

SEQ ID NO: 133193 - DNA, 13 bp, Homo sapiens
actgtaaaagtta

SEQ ID NO: 133194 - DNA, 21 bp, Homo sapiens
actgtaaaagttataataact

SEQ ID NO: 133195 - DNA, 14 bp, Homo sapiens
actgtacttcccaa

SEQ ID NO: 133196 - DNA, 23 bp, Homo sapiens
actgtcaaatgaacttttacaga

SEQ ID NO: 133197 - DNA, 17 bp, Homo sapiens
actgtgaatttcaaaaa

SEQ ID NO: 133198 - DNA, 16 bp, Homo sapiens
actgtggaatttattg

SEQ ID NO: 133199 - DNA, 15 bp, Homo sapiens
actgtgtaatataaa

SEQ ID NO: 133200 - DNA, 17 bp, Homo sapiens
actgtgtatcattaaaa

SEQ ID NO: 133201 - DNA, 14 bp, Homo sapiens
actgttggcactta

SEQ ID NO: 133202 - DNA, 17 bp, Homo sapiens
actgttggcacttatag

SEQ ID NO: 133203 - DNA, 17 bp, Homo sapiens
actgtttcatgagccca

SEQ ID NO: 133204 - DNA, 20 bp, Homo sapiens
acttaacatttcattgtaca

SEQ ID NO: 133205 - DNA, 23 bp, Homo sapiens
acttataggtaacgtgattgatt

SEQ ID NO: 133206 - DNA, 16 bp, Homo sapiens
acttatcatttttgta

SEQ ID NO: 133207 - DNA, 22 bp, Homo sapiens
acttatcatttttgtataaaaa

SEQ ID NO: 133208 - DNA, 23 bp, Homo sapiens
acttatcatttttgtataaaaag

SEQ ID NO: 133209 - DNA, 14 bp, Homo sapiens
acttcactgcagcc

SEQ ID NO: 133210 - DNA, 15 bp, Homo sapiens
acttcatgcccactg

SEQ ID NO: 133211 - DNA, 21 bp, Homo sapiens
acttccaagctccaaatccaa

SEQ ID NO: 133212 - DNA, 19 bp, Homo sapiens
acttctgagccccagcccc

SEQ ID NO: 133213 - DNA, 20 bp, Homo sapiens
acttgaactttccaaaacct

SEQ ID NO: 133214 - DNA, 12 bp, Homo sapiens
acttgctactta

SEQ ID NO: 133215 - DNA, 17 bp, Homo sapiens
acttgctacttatcatt

SEQ ID NO: 133216 - DNA, 17 bp, Homo sapiens
acttgtcatatcactaa

SEQ ID NO: 133217 - DNA, 17 bp, Homo sapiens
acttgttttatgctcag

SEQ ID NO: 133218 - DNA, 15 bp, Homo sapiens
actttaaaataaaat

SEQ ID NO: 133219 - DNA, 16 bp, Homo sapiens
actttctccatttaag

SEQ ID NO: 133220 - DNA, 17 bp, Homo sapiens
actttctttctgtaggt

SEQ ID NO: 133221 - DNA, 14 bp, Homo sapiens
actttgctccaggc

SEQ ID NO: 133222 - DNA, 20 bp, Homo sapiens
actttgtagtgtttggtgct

SEQ ID NO: 133223 - DNA, 16 bp, Homo sapiens
acttttacagaatgca

SEQ ID NO: 133224 - DNA, 20 bp, Homo sapiens
acttttacagaatgcattaa

SEQ ID NO: 133225 - DNA, 22 bp, Homo sapiens
acttttgaaaatcaagatgaga

SEQ ID NO: 133226 - DNA, 14 bp, Homo sapiens
aacagagaaagaaa

SEQ ID NO: 133227 - DNA, 17 bp, Homo sapiens
aacagcaggatgccctg

SEQ ID NO: 133228 - DNA, 18 bp, Homo sapiens
aacagcaggatgccctgt

SEQ ID NO: 133229 - DNA, 23 bp, Homo sapiens
aacatgcagctcttcaacatgac

SEQ ID NO: 133230 - DNA, 16 bp, Homo sapiens
aacatgggtttcctta

SEQ ID NO: 133231 - DNA, 17 bp, Homo sapiens
aacattcctaaaatgct

SEQ ID NO: 133232 - DNA, 13 bp, Homo sapiens
aacatttactaca

SEQ ID NO: 133233 - DNA, 19 bp, Homo sapiens
aacatttactacagttttt

SEQ ID NO: 133234 - DNA, 12 bp, Homo sapiens
aacatttctgta

SEQ ID NO: 133235 - DNA, 21 bp, Homo sapiens
aacatttctgtatactgtaaa

SEQ ID NO: 133236 - DNA, 24 bp, Homo sapiens
aacatttctgtatactgtaaaagt

SEQ ID NO: 133237 - DNA, 18 bp, Homo sapiens
aaccacatataacactta

SEQ ID NO: 133238 - DNA, 20 bp, Homo sapiens
aaccacccgccccgccccct

SEQ ID NO: 133239 - DNA, 20 bp, Homo sapiens
aaccagtttattctgtggtt

SEQ ID NO: 133240 - DNA, 14 bp, Homo sapiens
aacccatgaagctg

SEQ ID NO: 133241 - DNA, 21 bp, Homo sapiens
aacccgttgggtcccttgctg

SEQ ID NO: 133242 - DNA, 17 bp, Homo sapiens
aacctagcttttaaaaa

SEQ ID NO: 133243 - DNA, 21 bp, Homo sapiens
aacctagcttttaaaaaatat

SEQ ID NO: 133244 - DNA, 11 bp, Homo sapiens
aacctctggcc

SEQ ID NO: 133245 - DNA, 15 bp, Homo sapiens
aacctctggcccttg

SEQ ID NO: 133246 - DNA, 16 bp, Homo sapiens
aacctgtccataaagt

SEQ ID NO: 133247 - DNA, 13 bp, Homo sapiens
aacctgtgtctta

SEQ ID NO: 133248 - DNA, 14 bp, Homo sapiens
aacgcacttacaag

SEQ ID NO: 133249 - DNA, 18 bp, Homo sapiens
aacgctctaccctgcagc

SEQ ID NO: 133250 - DNA, 22 bp, Homo sapiens
aacgtgattgattcagtatctt

SEQ ID NO: 133251 - DNA, 21 bp, Homo sapiens
aactaaacagaaaactcccaa

SEQ ID NO: 133252 - DNA, 14 bp, Homo sapiens
aactaggggaggag

SEQ ID NO: 133253 - DNA, 22 bp, Homo sapiens
aactcaaagatgatggaaacgc

SEQ ID NO: 133254 - DNA, 15 bp, Homo sapiens
aactcatgatcaaga

SEQ ID NO: 133255 - DNA, 22 bp, Homo sapiens
aactcctgtgtcggtcagaaca

SEQ ID NO: 133256 - DNA, 11 bp, Homo sapiens
aactgaactgt

SEQ ID NO: 133257 - DNA, 12 bp, Homo sapiens
aactgaactgtt

SEQ ID NO: 133258 - DNA, 17 bp, Homo sapiens
aactgagaaatgaatgc

SEQ ID NO: 133259 - DNA, 18 bp, Homo sapiens
aactgagtccatgaaaat

SEQ ID NO: 133260 - DNA, 23 bp, Homo sapiens
aactgatgagtaaactgaggccc

SEQ ID NO: 133261 - DNA, 20 bp, Homo sapiens
aactgctgttaattgattaa

SEQ ID NO: 133262 - DNA, 16 bp, Homo sapiens
aactgtggaatttatt

SEQ ID NO: 133263 - DNA, 14 bp, Homo sapiens
aactgtgtatcatt

SEQ ID NO: 133264 - DNA, 19 bp, Homo sapiens
aactgtgtatcattaaaat

SEQ ID NO: 133265 - DNA, 20 bp, Homo sapiens
aactgtgtatcattaaaata

SEQ ID NO: 133266 - DNA, 22 bp, Homo sapiens
aactgtgtatcattaaaatata

SEQ ID NO: 133267 - DNA, 16 bp, Homo sapiens
aacttgctacttatca

SEQ ID NO: 133268 - DNA, 16 bp, Homo sapiens
aactttaaaaggcaac

SEQ ID NO: 133269 - DNA, 12 bp, Homo sapiens
aacttttacaga

SEQ ID NO: 133270 - DNA, 19 bp, Homo sapiens
aacttttacagaatgcatt

SEQ ID NO: 133271 - DNA, 20 bp, Homo sapiens
aacttttacagaatgcatta

SEQ ID NO: 133272 - DNA, 16 bp, Homo sapiens
aacttttgtaatttga

SEQ ID NO: 133273 - DNA, 19 bp, Homo sapiens
aacttttgtaatttgaatt

SEQ ID NO: 133274 - DNA, 21 bp, Homo sapiens
aacttttgtaatttgaattgg

SEQ ID NO: 133275 - DNA, 15 bp, Homo sapiens
aagaaaacaagtata

SEQ ID NO: 133276 - DNA, 16 bp, Homo sapiens
aagaaaaggcaaaaga

SEQ ID NO: 133277 - DNA, 22 bp, Homo sapiens
aagcgctgttgcccgccctcca

SEQ ID NO: 133278 - DNA, 17 bp, Homo sapiens
aagcttctagacactcc

SEQ ID NO: 133279 - DNA, 22 bp, Homo sapiens
aaggaaatctcaccccatccca

SEQ ID NO: 133280 - DNA, 21 bp, Homo sapiens
aaggaatagtcgcgcaagcat

SEQ ID NO: 133281 - DNA, 15 bp, Homo sapiens
aaggaatgtgtccaa

SEQ ID NO: 133282 - DNA, 18 bp, Homo sapiens
aaggaatgtgtccaagac

SEQ ID NO: 133283 - DNA, 23 bp, Homo sapiens
aaggcaaaagactggtttgtttg

SEQ ID NO: 133284 - DNA, 12 bp, Homo sapiens
aaggcaactcaa

SEQ ID NO: 133285 - DNA, 21 bp, Homo sapiens
aaggcagcatgtatagttgct

SEQ ID NO: 133286 - DNA, 20 bp, Homo sapiens
aaggccggagacccacagcc

SEQ ID NO: 133287 - DNA, 22 bp, Homo sapiens
aaggccggagacccacagccct

SEQ ID NO: 133288 - DNA, 23 bp, Homo sapiens
aaggccggagacccacagccctg

SEQ ID NO: 133289 - DNA, 16 bp, Homo sapiens
aagggcattttaaaag

SEQ ID NO: 133290 - DNA, 19 bp, Homo sapiens
aagggctctttctctctgc

SEQ ID NO: 133291 - DNA, 15 bp, Homo sapiens
aaggtgggtgaggct

SEQ ID NO: 133292 - DNA, 20 bp, Homo sapiens
aaggtttcccagtgagcctc

SEQ ID NO: 133293 - DNA, 22 bp, Homo sapiens
aaggtttcccagtgagcctctg

SEQ ID NO: 133294 - DNA, 23 bp, Homo sapiens
aaggtttcccagtgagcctctgc

SEQ ID NO: 133295 - DNA, 19 bp, Homo sapiens
aaggttttttttttaagtg

SEQ ID NO: 133296 - DNA, 16 bp, Homo sapiens
aagtaatgaagaatca

SEQ ID NO: 133297 - DNA, 19 bp, Homo sapiens
aagtattacaaccatatat

SEQ ID NO: 133298 - DNA, 15 bp, Homo sapiens
aagtatttataaaaa

SEQ ID NO: 133299 - DNA, 21 bp, Homo sapiens
aagtatttataaaaatataaa

SEQ ID NO: 133300 - DNA, 17 bp, Homo sapiens
aagtcacatataaaagt

SEQ ID NO: 133301 - DNA, 15 bp, Homo sapiens
aagtcagtttctaca

SEQ ID NO: 133302 - DNA, 15 bp, Homo sapiens
aagtcgagcactcta

SEQ ID NO: 133303 - DNA, 16 bp, Homo sapiens
aagtctctgctggccc

SEQ ID NO: 133304 - DNA, 15 bp, Homo sapiens
aagtgaacttttgta

SEQ ID NO: 133305 - DNA, 19 bp, Homo sapiens
aagtgaacttttgtaattt

SEQ ID NO: 133306 - DNA, 13 bp, Homo sapiens
aagtgatgacata

SEQ ID NO: 133307 - DNA, 14 bp, Homo sapiens
aagtgatgacatat

SEQ ID NO: 133308 - DNA, 14 bp, Homo sapiens
aagtgcaacatttc

SEQ ID NO: 133309 - DNA, 23 bp, Homo sapiens
aagtggactggtgtcataaactt

SEQ ID NO: 133310 - DNA, 14 bp, Homo sapiens
aagtgtctcttgac

SEQ ID NO: 133311 - DNA, 11 bp, Homo sapiens
aagttataata

SEQ ID NO: 133312 - DNA, 12 bp, Homo sapiens
aagttataataa

SEQ ID NO: 133313 - DNA, 16 bp, Homo sapiens
aagtttgctaaaagaa

SEQ ID NO: 133314 - DNA, 18 bp, Homo sapiens
aagtttgctaaaagaaga

SEQ ID NO: 133315 - DNA, 15 bp, Homo sapiens
aagtttgctttcaga

SEQ ID NO: 133316 - DNA, 14 bp, Homo sapiens
aataaaaagtgaac

SEQ ID NO: 133317 - DNA, 16 bp, Homo sapiens
aataaaaagtgaactt

SEQ ID NO: 133318 - DNA, 15 bp, Homo sapiens
aataacctctggccc

SEQ ID NO: 133319 - DNA, 19 bp, Homo sapiens
aataacctctggcccttgg

SEQ ID NO: 133320 - DNA, 15 bp, Homo sapiens
aataactgaactgtt

SEQ ID NO: 133321 - DNA, 19 bp, Homo sapiens
aataactgaactgtttggt

SEQ ID NO: 133322 - DNA, 16 bp, Homo sapiens
aataagttttgatata

SEQ ID NO: 133323 - DNA, 18 bp, Homo sapiens
aataagttttgatataat

SEQ ID NO: 133324 - DNA, 21 bp, Homo sapiens
aataagttttgatataatctt

SEQ ID NO: 133325 - DNA, 23 bp, Homo sapiens
aataagttttgatataatcttgg

SEQ ID NO: 133326 - DNA, 23 bp, Homo sapiens
aataatgcatccagcagtacaat

SEQ ID NO: 133327 - DNA, 12 bp, Homo sapiens
aataattttaaa

SEQ ID NO: 133328 - DNA, 22 bp, Homo sapiens
aataccataggaagacataaaa

SEQ ID NO: 133329 - DNA, 23 bp, Homo sapiens
aatactaatgttatttcttaaaa

SEQ ID NO: 133330 - DNA, 17 bp, Homo sapiens
aatagaaaattaaaata

SEQ ID NO: 133331 - DNA, 16 bp, Homo sapiens
aatagagcaaaatcaa

SEQ ID NO: 133332 - DNA, 20 bp, Homo sapiens
aatatagagatatttttgta

SEQ ID NO: 133333 - DNA, 20 bp, Homo sapiens
aatatatagctggcaagaat

SEQ ID NO: 133334 - DNA, 16 bp, Homo sapiens
aatatatggcatttgc

SEQ ID NO: 133335 - DNA, 22 bp, Homo sapiens
aatatatggcatttgcagattt

SEQ ID NO: 133336 - DNA, 13 bp, Homo sapiens
aatatatgttctg

SEQ ID NO: 133337 - DNA, 17 bp, Homo sapiens
aatatatgttctgcaag

SEQ ID NO: 133338 - DNA, 23 bp, Homo sapiens
aatatatgttctgcaagaattaa

SEQ ID NO: 133339 - DNA, 19 bp, Homo sapiens
aatatctgaacatttacta

SEQ ID NO: 133340 - DNA, 20 bp, Homo sapiens
aatatctgagaagtgtatat

SEQ ID NO: 133341 - DNA, 19 bp, Homo sapiens
aatatgatcagagcttgaa

SEQ ID NO: 133342 - DNA, 18 bp, Homo sapiens
aatattacctaatgaaag

SEQ ID NO: 133343 - DNA, 19 bp, Homo sapiens
aatattacctaatgaaagt

SEQ ID NO: 133344 - DNA, 13 bp, Homo sapiens
aatattgctaaaa

SEQ ID NO: 133345 - DNA, 23 bp, Homo sapiens
aatatttaagtttgttgctgtca

SEQ ID NO: 133346 - DNA, 18 bp, Homo sapiens
aatattttaagaaagaga

SEQ ID NO: 133347 - DNA, 19 bp, Homo sapiens
aatcaatttctcaatagtt

SEQ ID NO: 133348 - DNA, 19 bp, Homo sapiens
aatcacttaacattcctaa

SEQ ID NO: 133349 - DNA, 22 bp, Homo sapiens
aatcagcatgacaaaaataaca

SEQ ID NO: 133350 - DNA, 23 bp, Homo sapiens
aatcagcatgacaaaaataacac

SEQ ID NO: 133351 - DNA, 18 bp, Homo sapiens
aatcagctctcctggctc

SEQ ID NO: 133352 - DNA, 19 bp, Homo sapiens
aatcattttaggaaaggat

SEQ ID NO: 133353 - DNA, 14 bp, Homo sapiens
aatcctatatctgt

SEQ ID NO: 133354 - DNA, 15 bp, Homo sapiens
aatcctatatctgtt

SEQ ID NO: 133355 - DNA, 21 bp, Homo sapiens
aatcctatatctgtttgtata

SEQ ID NO: 133356 - DNA, 16 bp, Homo sapiens
aatctagacattcttt

SEQ ID NO: 133357 - DNA, 18 bp, Homo sapiens
aatctggcaaagttatat

SEQ ID NO: 133358 - DNA, 19 bp, Homo sapiens
aatctggcaaagttatatt

SEQ ID NO: 133359 - DNA, 20 bp, Homo sapiens
aatcttggcttcttaaaaac

SEQ ID NO: 133360 - DNA, 17 bp, Homo sapiens
aatgaaagtgatgacat

SEQ ID NO: 133361 - DNA, 23 bp, Homo sapiens
aatgaaatgtttactaagtggac

SEQ ID NO: 133362 - DNA, 18 bp, Homo sapiens
aatgaacttttacagaat

SEQ ID NO: 133363 - DNA, 16 bp, Homo sapiens
aatgaagtatttctca

SEQ ID NO: 133364 - DNA, 13 bp, Homo sapiens
aatgcattaaaaa

SEQ ID NO: 133365 - DNA, 14 bp, Homo sapiens
aatggactgtgaat

SEQ ID NO: 133366 - DNA, 21 bp, Homo sapiens
aatggactgtgaatttcaaaa

SEQ ID NO: 133367 - DNA, 22 bp, Homo sapiens
aatggtggcttcttttctttgt

SEQ ID NO: 133368 - DNA, 23 bp, Homo sapiens
aatggtggcttcttttctttgta

SEQ ID NO: 133369 - DNA, 15 bp, Homo sapiens
aatgtaatgatcata

SEQ ID NO: 133370 - DNA, 21 bp, Homo sapiens
aatgtgatcatatgaggacct

SEQ ID NO: 133371 - DNA, 19 bp, Homo sapiens
aatgtgatctatgtttcat

SEQ ID NO: 133372 - DNA, 17 bp, Homo sapiens
aatgtgttgatttgaga

SEQ ID NO: 133373 - DNA, 19 bp, Homo sapiens
aatgttatttcttaaaatt

SEQ ID NO: 133374 - DNA, 12 bp, Homo sapiens
aattaaaactga

SEQ ID NO: 133375 - DNA, 13 bp, Homo sapiens
aattaaaactgag

SEQ ID NO: 133376 - DNA, 20 bp, Homo sapiens
aattaaaatattatttgata

SEQ ID NO: 133377 - DNA, 13 bp, Homo sapiens
aaaaaaaaaaact

SEQ ID NO: 133378 - DNA, 11 bp, Homo sapiens
aaaaaaaactc

SEQ ID NO: 133379 - DNA, 11 bp, Homo sapiens
aaaaaaactga

SEQ ID NO: 133380 - DNA, 12 bp, Homo sapiens
aaaaaaagactg

SEQ ID NO: 133381 - DNA, 13 bp, Homo sapiens
aaaaaactcctgt

SEQ ID NO: 133382 - DNA, 9 bp, Homo sapiens
aaaaaagaa

SEQ ID NO: 133383 - DNA, 10 bp, Homo sapiens
aaaaaagaac

SEQ ID NO: 133384 - DNA, 17 bp, Homo sapiens
aaaaaataccattgaaa

SEQ ID NO: 133385 - DNA, 10 bp, Homo sapiens
aaaaactgaa

SEQ ID NO: 133386 - DNA, 17 bp, Homo sapiens
aaaaactgtgtatcatt

SEQ ID NO: 133387 - DNA, 14 bp, Homo sapiens
aaaaactttgctcc

SEQ ID NO: 133388 - DNA, 15 bp, Homo sapiens
aaaaagaccttctcc

SEQ ID NO: 133389 - DNA, 11 bp, Homo sapiens
aaaaaggaaat

SEQ ID NO: 133390 - DNA, 12 bp, Homo sapiens
aaaaagtgaact

SEQ ID NO: 133391 - DNA, 17 bp, Homo sapiens
aaaaagtgaacttttgt

SEQ ID NO: 133392 - DNA, 19 bp, Homo sapiens
aaaaagtgaacttttgtaa

SEQ ID NO: 133393 - DNA, 21 bp, Homo sapiens
aaaaagtgaacttttgtaatt

SEQ ID NO: 133394 - DNA, 14 bp, Homo sapiens
aaaaataacactgt

SEQ ID NO: 133395 - DNA, 16 bp, Homo sapiens
aaaaataccattgaaa

SEQ ID NO: 133396 - DNA, 14 bp, Homo sapiens
aaaaatattgctaa

SEQ ID NO: 133397 - DNA, 19 bp, Homo sapiens
aaaaatattgctaaaagtg

SEQ ID NO: 133398 - DNA, 13 bp, Homo sapiens
aaaaatattttaa

SEQ ID NO: 133399 - DNA, 21 bp, Homo sapiens
aaaaatattttaagaaagaga

SEQ ID NO: 133400 - DNA, 23 bp, Homo sapiens
aaaacaccatcattaagaataat

SEQ ID NO: 133401 - DNA, 12 bp, Homo sapiens
aaaactcatgat

SEQ ID NO: 133402 - DNA, 17 bp, Homo sapiens
aaaactcccaatacaaa

SEQ ID NO: 133403 - DNA, 22 bp, Homo sapiens
aaaactcctgtgtcggtcagaa

SEQ ID NO: 133404 - DNA, 12 bp, Homo sapiens
aaaactgaaggt

SEQ ID NO: 133405 - DNA, 20 bp, Homo sapiens
aaaactgagtccatgaaaat

SEQ ID NO: 133406 - DNA, 12 bp, Homo sapiens
aaaactgtgtat

SEQ ID NO: 133407 - DNA, 17 bp, Homo sapiens
aaaactgtgtatcatta

SEQ ID NO: 133408 - DNA, 22 bp, Homo sapiens
aaaactgtgtatcattaaaata

SEQ ID NO: 133409 - DNA, 14 bp, Homo sapiens
aaaactttaaaagg

SEQ ID NO: 133410 - DNA, 18 bp, Homo sapiens
aaaactttaaaaggcaac

SEQ ID NO: 133411 - DNA, 18 bp, Homo sapiens
aaaagactgtcaaatgaa

SEQ ID NO: 133412 - DNA, 14 bp, Homo sapiens
aataaaattatttg

SEQ ID NO: 133413 - DNA, 14 bp, Homo sapiens
aataaaattgcact

SEQ ID NO: 133414 - DNA, 19 bp, Homo sapiens
aataaagttctgttttctg

SEQ ID NO: 133415 - DNA, 20 bp, Homo sapiens
aataaagtttgctttcagat

SEQ ID NO: 133416 - DNA, 20 bp, Homo sapiens
aataacactgttggcactta

SEQ ID NO: 133417 - DNA, 12 bp, Homo sapiens
aataacctctgg

SEQ ID NO: 133418 - DNA, 13 bp, Homo sapiens
aataacctctggc

SEQ ID NO: 133419 - DNA, 11 bp, Homo sapiens
aataactgaac

SEQ ID NO: 133420 - DNA, 16 bp, Homo sapiens
aataactgaactgttt

SEQ ID NO: 133421 - DNA, 22 bp, Homo sapiens
aataagaagggggagtgaaaca

SEQ ID NO: 133422 - DNA, 14 bp, Homo sapiens
aataagttttgata

SEQ ID NO: 133423 - DNA, 15 bp, Homo sapiens
aataagttttgatat

SEQ ID NO: 133424 - DNA, 19 bp, Homo sapiens
aataatgtacatctggcct

SEQ ID NO: 133425 - DNA, 17 bp, Homo sapiens
aataattgaacaataaa

SEQ ID NO: 133426 - DNA, 14 bp, Homo sapiens
aatacatgctgcta

SEQ ID NO: 133427 - DNA, 19 bp, Homo sapiens
aataccattgaaatcagca

SEQ ID NO: 133428 - DNA, 16 bp, Homo sapiens
aatacctcaggaaaga

SEQ ID NO: 133429 - DNA, 19 bp, Homo sapiens
aatactaatgttatttctt

SEQ ID NO: 133430 - DNA, 11 bp, Homo sapiens
aatagaaagaa

SEQ ID NO: 133431 - DNA, 14 bp, Homo sapiens
aatagaaagaaact

SEQ ID NO: 133432 - DNA, 14 bp, Homo sapiens
aatagaaagaaagt

SEQ ID NO: 133433 - DNA, 17 bp, Homo sapiens
aatagcgtgggatagat

SEQ ID NO: 133434 - DNA, 19 bp, Homo sapiens
aatagtgtcctatgcaata

SEQ ID NO: 133435 - DNA, 22 bp, Homo sapiens
aatagtgtcctatgcaataaaa

SEQ ID NO: 133436 - DNA, 17 bp, Homo sapiens
aatataaattgtacatt

SEQ ID NO: 133437 - DNA, 14 bp, Homo sapiens
aatatagagatatt

SEQ ID NO: 133438 - DNA, 14 bp, Homo sapiens
aatatatggcattt

SEQ ID NO: 133439 - DNA, 17 bp, Homo sapiens
aatatatggcatttgca

SEQ ID NO: 133440 - DNA, 16 bp, Homo sapiens
aatatatgttctgcaa

SEQ ID NO: 133441 - DNA, 20 bp, Homo sapiens
aatatatgttctgcaagaat

SEQ ID NO: 133442 - DNA, 17 bp, Homo sapiens
aatatcactgtaatgag

SEQ ID NO: 133443 - DNA, 21 bp, Homo sapiens
aatatctgaacatttactaca

SEQ ID NO: 133444 - DNA, 21 bp, Homo sapiens
aatatctgagaagtgtatata

SEQ ID NO: 133445 - DNA, 14 bp, Homo sapiens
aatattacctaatg

SEQ ID NO: 133446 - DNA, 17 bp, Homo sapiens
aatattatttgatatct

SEQ ID NO: 133447 - DNA, 16 bp, Homo sapiens
aatattgctaaaagtg

SEQ ID NO: 133448 - DNA, 21 bp, Homo sapiens
aatattgctaaaagtgcattt

SEQ ID NO: 133449 - DNA, 15 bp, Homo sapiens
aatattttaagaaag

SEQ ID NO: 133450 - DNA, 19 bp, Homo sapiens
aatattttaagaaagagaa

SEQ ID NO: 133451 - DNA, 22 bp, Homo sapiens
aatattttaagaaagagaatga

SEQ ID NO: 133452 - DNA, 16 bp, Homo sapiens
aatcaacatgactggt

SEQ ID NO: 133453 - DNA, 14 bp, Homo sapiens
aatcaagatgagat

SEQ ID NO: 133454 - DNA, 16 bp, Homo sapiens
aatcagcatgacaaaa

SEQ ID NO: 133455 - DNA, 21 bp, Homo sapiens
aatcagcatgacaaaaataac

SEQ ID NO: 133456 - DNA, 16 bp, Homo sapiens
aatcagctctcctggc

SEQ ID NO: 133457 - DNA, 20 bp, Homo sapiens
aatccagagaagcgctgttg

SEQ ID NO: 133458 - DNA, 18 bp, Homo sapiens
aatcctatatctgtttgt

SEQ ID NO: 133459 - DNA, 16 bp, Homo sapiens
aatcctgtttttccta

SEQ ID NO: 133460 - DNA, 12 bp, Homo sapiens
aatcgacatcct

SEQ ID NO: 133461 - DNA, 21 bp, Homo sapiens
aatctaaaaattttgcatttc

SEQ ID NO: 133462 - DNA, 23 bp, Homo sapiens
aatctatttacataaaatgggtg

SEQ ID NO: 133463 - DNA, 22 bp, Homo sapiens
aatctcaccccatcccacaccc

SEQ ID NO: 133464 - DNA, 16 bp, Homo sapiens
aatctggcaaagttat

SEQ ID NO: 133465 - DNA, 17 bp, Homo sapiens
aatcttggcttcttaaa

SEQ ID NO: 133466 - DNA, 18 bp, Homo sapiens
aatcttggcttcttaaaa

SEQ ID NO: 133467 - DNA, 19 bp, Homo sapiens
aatcttggcttcttaaaaa

SEQ ID NO: 133468 - DNA, 21 bp, Homo sapiens
aatcttggcttcttaaaaact

SEQ ID NO: 133469 - DNA, 21 bp, Homo sapiens
aatgaaataatgtacatctgg

SEQ ID NO: 133470 - DNA, 16 bp, Homo sapiens
aatgaacttttacaga

SEQ ID NO: 133471 - DNA, 17 bp, Homo sapiens
aatgaacttttacagaa

SEQ ID NO: 133472 - DNA, 22 bp, Homo sapiens
aatgaacttttacagaatgcat

SEQ ID NO: 133473 - DNA, 19 bp, Homo sapiens
aatgcaaatttctataaat

SEQ ID NO: 133474 - DNA, 14 bp, Homo sapiens
aatgcaatatttgt

SEQ ID NO: 133475 - DNA, 23 bp, Homo sapiens
aatgcgtgttgtacatacagagg

SEQ ID NO: 133476 - DNA, 12 bp, Homo sapiens
aatggagaaagt

SEQ ID NO: 133477 - DNA, 15 bp, Homo sapiens
aggtttttctccccg

SEQ ID NO: 133478 - DNA, 16 bp, Homo sapiens
aggttttttttttaag

SEQ ID NO: 133479 - DNA, 11 bp, Homo sapiens
agtaaagtttt

SEQ ID NO: 133480 - DNA, 12 bp, Homo sapiens
agtaagaaacac

SEQ ID NO: 133481 - DNA, 22 bp, Homo sapiens
agtaagtcttttttttttccaa

SEQ ID NO: 133482 - DNA, 14 bp, Homo sapiens
agtaatgaaatgtt

SEQ ID NO: 133483 - DNA, 17 bp, Homo sapiens
agtaatgaaatgtttac

SEQ ID NO: 133484 - DNA, 13 bp, Homo sapiens
agtaatgaagaat

SEQ ID NO: 133485 - DNA, 19 bp, Homo sapiens
agtaatgaagaatcacgat

SEQ ID NO: 133486 - DNA, 14 bp, Homo sapiens
agtacaataaaagt

SEQ ID NO: 133487 - DNA, 21 bp, Homo sapiens
agtagtgtcttcctagtatat

SEQ ID NO: 133488 - DNA, 13 bp, Homo sapiens
agtatatattcta

SEQ ID NO: 133489 - DNA, 18 bp, Homo sapiens
agtatcttagagtttaca

SEQ ID NO: 133490 - DNA, 13 bp, Homo sapiens
agtattcagaaat

SEQ ID NO: 133491 - DNA, 14 bp, Homo sapiens
agtattcagaaatt

SEQ ID NO: 133492 - DNA, 22 bp, Homo sapiens
agtatttataaaaatataaatt

SEQ ID NO: 133493 - DNA, 16 bp, Homo sapiens
agtcaaagagagtttt

SEQ ID NO: 133494 - DNA, 14 bp, Homo sapiens
agtcagtttctaca

SEQ ID NO: 133495 - DNA, 16 bp, Homo sapiens
agtccatgaaaatacc

SEQ ID NO: 133496 - DNA, 15 bp, Homo sapiens
agtcctgctcctttc

SEQ ID NO: 133497 - DNA, 22 bp, Homo sapiens
agtctcatgcaagacttcactg

SEQ ID NO: 133498 - DNA, 12 bp, Homo sapiens
agtctcctgggt

SEQ ID NO: 133499 - DNA, 12 bp, Homo sapiens
agtctttgtgtg

SEQ ID NO: 133500 - DNA, 15 bp, Homo sapiens
agtctttgtgtgtta

SEQ ID NO: 133501 - DNA, 19 bp, Homo sapiens
agtctttgtgtgttatatt

SEQ ID NO: 133502 - DNA, 19 bp, Homo sapiens
agtctttttctttttttgg

SEQ ID NO: 133503 - DNA, 22 bp, Homo sapiens
agtctttttctttttttggtaa

SEQ ID NO: 133504 - DNA, 17 bp, Homo sapiens
agtcttttttttttcca

SEQ ID NO: 133505 - DNA, 15 bp, Homo sapiens
agtgaaacagagaaa

SEQ ID NO: 133506 - DNA, 16 bp, Homo sapiens
agtgaaacagagaaag

SEQ ID NO: 133507 - DNA, 17 bp, Homo sapiens
agtgaaacagagaaaga

SEQ ID NO: 133508 - DNA, 18 bp, Homo sapiens
agtgaaacagagaaagaa

SEQ ID NO: 133509 - DNA, 16 bp, Homo sapiens
agtgaacttttgtaat

SEQ ID NO: 133510 - DNA, 17 bp, Homo sapiens
agtgaacttttgtaatt

SEQ ID NO: 133511 - DNA, 19 bp, Homo sapiens
agtgaacttttgtaatttg

SEQ ID NO: 133512 - DNA, 18 bp, Homo sapiens
agtgaagtctagaatcat

SEQ ID NO: 133513 - DNA, 19 bp, Homo sapiens
agtgaagtctagaatcata

SEQ ID NO: 133514 - DNA, 18 bp, Homo sapiens
agtgacaaagactcctct

SEQ ID NO: 133515 - DNA, 22 bp, Homo sapiens
agtgagatataggataaaataa

SEQ ID NO: 133516 - DNA, 23 bp, Homo sapiens
agtgagatataggataaaataat

SEQ ID NO: 133517 - DNA, 18 bp, Homo sapiens
agtgcaacatttctgtat

SEQ ID NO: 133518 - DNA, 23 bp, Homo sapiens
agtgcaacatttctgtatactgt

SEQ ID NO: 133519 - DNA, 18 bp, Homo sapiens
agtgcaattccaagaaaa

SEQ ID NO: 133520 - DNA, 13 bp, Homo sapiens
agtgccccaagga

SEQ ID NO: 133521 - DNA, 19 bp, Homo sapiens
agtgccccaaggaggtggc

SEQ ID NO: 133522 - DNA, 17 bp, Homo sapiens
agtgtaaataattttaa

SEQ ID NO: 133523 - DNA, 19 bp, Homo sapiens
agtgtattagtcataaaac

SEQ ID NO: 133524 - DNA, 16 bp, Homo sapiens
agtgtcctatgcaata

SEQ ID NO: 133525 - DNA, 23 bp, Homo sapiens
agtgtcctatgcaataaaattat

SEQ ID NO: 133526 - DNA, 19 bp, Homo sapiens
agtgtcttcctagtatatt

SEQ ID NO: 133527 - DNA, 15 bp, Homo sapiens
agttataataactga

SEQ ID NO: 133528 - DNA, 19 bp, Homo sapiens
agttatatttactttaaaa

SEQ ID NO: 133529 - DNA, 14 bp, Homo sapiens
agttcttgaattgt

SEQ ID NO: 133530 - DNA, 13 bp, Homo sapiens
agtttaagagttt

SEQ ID NO: 133531 - DNA, 14 bp, Homo sapiens
agtttattctgtgg

SEQ ID NO: 133532 - DNA, 16 bp, Homo sapiens
agtttcagaataaaat

SEQ ID NO: 133533 - DNA, 19 bp, Homo sapiens
agtttgatttaatatctga

SEQ ID NO: 133534 - DNA, 16 bp, Homo sapiens
agtttgctaaaagaag

SEQ ID NO: 133535 - DNA, 18 bp, Homo sapiens
agtttgctaaaagaagag

SEQ ID NO: 133536 - DNA, 22 bp, Homo sapiens
agtttggaattattgtagacat

SEQ ID NO: 133537 - DNA, 19 bp, Homo sapiens
agtttgtggtaaaaagatt

SEQ ID NO: 133538 - DNA, 17 bp, Homo sapiens
agtttgttgctgtcaag

SEQ ID NO: 133539 - DNA, 17 bp, Homo sapiens
agttttgatataatctt

SEQ ID NO: 133540 - DNA, 15 bp, Homo sapiens
ataaaaaggaaatta

SEQ ID NO: 133541 - DNA, 20 bp, Homo sapiens
ataaaaaggaaattagtctt

SEQ ID NO: 133542 - DNA, 21 bp, Homo sapiens
ataaaaagtgaacttttgtaa

SEQ ID NO: 133543 - DNA, 13 bp, Homo sapiens
agccccacccaga

SEQ ID NO: 133544 - DNA, 19 bp, Homo sapiens
agccccacccagaggtggc

SEQ ID NO: 133545 - DNA, 23 bp, Homo sapiens
agccccacccagaggtggccctc

SEQ ID NO: 133546 - DNA, 13 bp, Homo sapiens
agcccccacagcc

SEQ ID NO: 133547 - DNA, 16 bp, Homo sapiens
agcccccacagccctg

SEQ ID NO: 133548 - DNA, 13 bp, Homo sapiens
agcccccaggcca

SEQ ID NO: 133549 - DNA, 19 bp, Homo sapiens
agccccgtcccagaggccg

SEQ ID NO: 133550 - DNA, 18 bp, Homo sapiens
agcccttctaccccacct

SEQ ID NO: 133551 - DNA, 21 bp, Homo sapiens
agccgcggggacaccgggaag

SEQ ID NO: 133552 - DNA, 21 bp, Homo sapiens
agcctgcaggtccggggagga

SEQ ID NO: 133553 - DNA, 16 bp, Homo sapiens
agcgctgttgcccgcc

SEQ ID NO: 133554 - DNA, 14 bp, Homo sapiens
agctcagctgggcc

SEQ ID NO: 133555 - DNA, 19 bp, Homo sapiens
agctccaaatccaaggaaa

SEQ ID NO: 133556 - DNA, 16 bp, Homo sapiens
agctccctgaccccct

SEQ ID NO: 133557 - DNA, 17 bp, Homo sapiens
agctccctgaccccctg

SEQ ID NO: 133558 - DNA, 19 bp, Homo sapiens
agctccctgaccccctgtc

SEQ ID NO: 133559 - DNA, 20 bp, Homo sapiens
agctctcctggctccctccc

SEQ ID NO: 133560 - DNA, 19 bp, Homo sapiens
agctggccagtaattagtg

SEQ ID NO: 133561 - DNA, 13 bp, Homo sapiens
agctggccctcag

SEQ ID NO: 133562 - DNA, 19 bp, Homo sapiens
agctggccctcagctccct

SEQ ID NO: 133563 - DNA, 21 bp, Homo sapiens
agctggccctcagctccctga

SEQ ID NO: 133564 - DNA, 20 bp, Homo sapiens
agctgggccactcctcttca

SEQ ID NO: 133565 - DNA, 15 bp, Homo sapiens
agctgggcccagccc

SEQ ID NO: 133566 - DNA, 21 bp, Homo sapiens
agctgggcccagcccctccac

SEQ ID NO: 133567 - DNA, 16 bp, Homo sapiens
agctgttcttttttgt

SEQ ID NO: 133568 - DNA, 19 bp, Homo sapiens
agctgttcttttttgtact

SEQ ID NO: 133569 - DNA, 19 bp, Homo sapiens
agcttctagacactccttg

SEQ ID NO: 133570 - DNA, 17 bp, Homo sapiens
aggaaaagtgcaatgcg

SEQ ID NO: 133571 - DNA, 18 bp, Homo sapiens
aggaaaattgaaagtatt

SEQ ID NO: 133572 - DNA, 21 bp, Homo sapiens
aggaaccacatataacactta

SEQ ID NO: 133573 - DNA, 24 bp, Homo sapiens
aggaaccacatataacacttaact

SEQ ID NO: 133574 - DNA, 17 bp, Homo sapiens
aggaagacataaaactt

SEQ ID NO: 133575 - DNA, 20 bp, Homo sapiens
aggaagacataaaactttaa

SEQ ID NO: 133576 - DNA, 22 bp, Homo sapiens
aggaagacataaaactttaaaa

SEQ ID NO: 133577 - DNA, 14 bp, Homo sapiens
aggaaggcccaggg

SEQ ID NO: 133578 - DNA, 13 bp, Homo sapiens
acagaatgcatta

SEQ ID NO: 133579 - DNA, 14 bp, Homo sapiens
acagaatgcattaa

SEQ ID NO: 133580 - DNA, 17 bp, Homo sapiens
acagaatgcattaaaaa

SEQ ID NO: 133581 - DNA, 12 bp, Homo sapiens
acagagaaagaa

SEQ ID NO: 133582 - DNA, 16 bp, Homo sapiens
acagagaaagaaaagg

SEQ ID NO: 133583 - DNA, 17 bp, Homo sapiens
acagagaaagaaaaggc

SEQ ID NO: 133584 - DNA, 19 bp, Homo sapiens
acagagaaagaaaaggcaa

SEQ ID NO: 133585 - DNA, 15 bp, Homo sapiens
acagcaggatgccct

SEQ ID NO: 133586 - DNA, 10 bp, Homo sapiens
acagccctgg

SEQ ID NO: 133587 - DNA, 20 bp, Homo sapiens
acagctgacggtttctcccc

SEQ ID NO: 133588 - DNA, 22 bp, Homo sapiens
acaggagcagcccacccagcag

SEQ ID NO: 133589 - DNA, 13 bp, Homo sapiens
acagggagaagtt

SEQ ID NO: 133590 - DNA, 13 bp, Homo sapiens
acagtaatgaaat

SEQ ID NO: 133591 - DNA, 18 bp, Homo sapiens
acagtaatgaaatgttta

SEQ ID NO: 133592 - DNA, 16 bp, Homo sapiens
acataaaactttaaaa

SEQ ID NO: 133593 - DNA, 17 bp, Homo sapiens
acataaaactttaaaag

SEQ ID NO: 133594 - DNA, 18 bp, Homo sapiens
acataaaactttaaaagg

SEQ ID NO: 133595 - DNA, 15 bp, Homo sapiens
acataccagcttaga

SEQ ID NO: 133596 - DNA, 22 bp, Homo sapiens
acatataaaagttaaactactt

SEQ ID NO: 133597 - DNA, 17 bp, Homo sapiens
acatataacacttaact

SEQ ID NO: 133598 - DNA, 19 bp, Homo sapiens
acatattttttatatctgg

SEQ ID NO: 133599 - DNA, 16 bp, Homo sapiens
acatcctagccccacc

SEQ ID NO: 133600 - DNA, 18 bp, Homo sapiens
acatcctagccccaccca

SEQ ID NO: 133601 - DNA, 16 bp, Homo sapiens
acatcctctgatagct

SEQ ID NO: 133602 - DNA, 22 bp, Homo sapiens
acatcctctgatagctgtttca

SEQ ID NO: 133603 - DNA, 20 bp, Homo sapiens
acatgctgaggttttgaata

SEQ ID NO: 133604 - DNA, 21 bp, Homo sapiens
acatgctgaggttttgaataa

SEQ ID NO: 133605 - DNA, 15 bp, Homo sapiens
acattcagctgaggt

SEQ ID NO: 133606 - DNA, 15 bp, Homo sapiens
acattcctctgcagc

SEQ ID NO: 133607 - DNA, 16 bp, Homo sapiens
acatttcattgtacaa

SEQ ID NO: 133608 - DNA, 12 bp, Homo sapiens
acatttctgtat

SEQ ID NO: 133609 - DNA, 13 bp, Homo sapiens
acatttctgtata

SEQ ID NO: 133610 - DNA, 14 bp, Homo sapiens
acatttctgtatac

SEQ ID NO: 133611 - DNA, 16 bp, Homo sapiens
acattttgtaaaatat

SEQ ID NO: 133612 - DNA, 17 bp, Homo sapiens
acattttgtaaaatatt

SEQ ID NO: 133613 - DNA, 20 bp, Homo sapiens
acattttgtacaaagatatg

SEQ ID NO: 133614 - DNA, 18 bp, Homo sapiens
accaatcctgtttttcct

SEQ ID NO: 133615 - DNA, 17 bp, Homo sapiens
accaggagggagagcct

SEQ ID NO: 133616 - DNA, 20 bp, Homo sapiens
accaggagggagagcctctg

SEQ ID NO: 133617 - DNA, 14 bp, Homo sapiens
accagggcgcaagc

SEQ ID NO: 133618 - DNA, 15 bp, Homo sapiens
accagtttattctgt

SEQ ID NO: 133619 - DNA, 19 bp, Homo sapiens
accatcaaaggaatataag

SEQ ID NO: 133620 - DNA, 23 bp, Homo sapiens
accatgttggttgcactttgtag

SEQ ID NO: 133621 - DNA, 13 bp, Homo sapiens
acccacagccctg

SEQ ID NO: 133622 - DNA, 16 bp, Homo sapiens
acccacagccctgaaa

SEQ ID NO: 133623 - DNA, 15 bp, Homo sapiens
acccaccccacagac

SEQ ID NO: 133624 - DNA, 14 bp, Homo sapiens
acccacctgggcca

SEQ ID NO: 133625 - DNA, 18 bp, Homo sapiens
acccagaggtggccctcc

SEQ ID NO: 133626 - DNA, 23 bp, Homo sapiens
acccagaggtggccctcccaggc

SEQ ID NO: 133627 - DNA, 13 bp, Homo sapiens
acccatgaagctg

SEQ ID NO: 133628 - DNA, 22 bp, Homo sapiens
acccatgaagctggccctcagc

SEQ ID NO: 133629 - DNA, 14 bp, Homo sapiens
accccagcccccac

SEQ ID NO: 133630 - DNA, 16 bp, Homo sapiens
accccagcccccacag

SEQ ID NO: 133631 - DNA, 21 bp, Homo sapiens
accccagcccccacagccctg

SEQ ID NO: 133632 - DNA, 22 bp, Homo sapiens
accccatggagacaataaacag

SEQ ID NO: 133633 - DNA, 15 bp, Homo sapiens
acccccaagccacag

SEQ ID NO: 133634 - DNA, 17 bp, Homo sapiens
acccccatctctccctc

SEQ ID NO: 133635 - DNA, 19 bp, Homo sapiens
acccctgcctcctgcctcc

SEQ ID NO: 133636 - DNA, 14 bp, Homo sapiens
accctcctggcaca

SEQ ID NO: 133637 - DNA, 11 bp, Homo sapiens
accctgcagct

SEQ ID NO: 133638 - DNA, 22 bp, Homo sapiens
acccttcccctccttctccctt

SEQ ID NO: 133639 - DNA, 19 bp, Homo sapiens
accctttgtattataattg

SEQ ID NO: 133640 - DNA, 14 bp, Homo sapiens
accgaggagcccca

SEQ ID NO: 133641 - DNA, 15 bp, Homo sapiens
accggcccctggcag

SEQ ID NO: 133642 - DNA, 21 bp, Homo sapiens
accggcccctggcagcacagc

SEQ ID NO: 133643 - DNA, 13 bp, Homo sapiens
acctaatgaaagt

SEQ ID NO: 133644 - DNA, 22 bp, Homo sapiens
acctaatgaaagtgatgacata

SEQ ID NO: 133645 - DNA, 16 bp, Homo sapiens
acctatggcccagcca

SEQ ID NO: 133646 - DNA, 23 bp, Homo sapiens
agtctctgtataatctatttaca

SEQ ID NO: 133647 - DNA, 13 bp, Homo sapiens
agtctgaagcctg

SEQ ID NO: 133648 - DNA, 18 bp, Homo sapiens
agtctgaagcctgcaggt

SEQ ID NO: 133649 - DNA, 16 bp, Homo sapiens
agtctttgtgtgttat

SEQ ID NO: 133650 - DNA, 18 bp, Homo sapiens
agtctttgtgtgttatat

SEQ ID NO: 133651 - DNA, 22 bp, Homo sapiens
agtctttgtgtgttatattcca

SEQ ID NO: 133652 - DNA, 19 bp, Homo sapiens
agtcttttttttttccaaa

SEQ ID NO: 133653 - DNA, 22 bp, Homo sapiens
agtgaaacagagaaagaaaagg

SEQ ID NO: 133654 - DNA, 16 bp, Homo sapiens
agtgaacttgggaggg

SEQ ID NO: 133655 - DNA, 14 bp, Homo sapiens
agtgaacttttgta

SEQ ID NO: 133656 - DNA, 17 bp, Homo sapiens
agtgaagtctagaatca

SEQ ID NO: 133657 - DNA, 22 bp, Homo sapiens
agtgaagtctagaatcatactt

SEQ ID NO: 133658 - DNA, 21 bp, Homo sapiens
agtgagatataggataaaata

SEQ ID NO: 133659 - DNA, 19 bp, Homo sapiens
agtgagcctctgcgcctct

SEQ ID NO: 133660 - DNA, 22 bp, Homo sapiens
agtgagcctctgcgcctctcca

SEQ ID NO: 133661 - DNA, 16 bp, Homo sapiens
agtgagtgtaaataat

SEQ ID NO: 133662 - DNA, 17 bp, Homo sapiens
agtgcaacatttctgta

SEQ ID NO: 133663 - DNA, 19 bp, Homo sapiens
agtgcaacatttctgtata

SEQ ID NO: 133664 - DNA, 19 bp, Homo sapiens
agtgcaattccaagaaaat

SEQ ID NO: 133665 - DNA, 21 bp, Homo sapiens
agtgcaattccaagaaaatat

SEQ ID NO: 133666 - DNA, 14 bp, Homo sapiens
agtgcagcgggcca

SEQ ID NO: 133667 - DNA, 18 bp, Homo sapiens
agtgcagcgggccaggca

SEQ ID NO: 133668 - DNA, 19 bp, Homo sapiens
agtgcagcgggccaggcag

SEQ ID NO: 133669 - DNA, 20 bp, Homo sapiens
agtgccccaaggaggtggct

SEQ ID NO: 133670 - DNA, 21 bp, Homo sapiens
agtgcccttaaggatcacccc

SEQ ID NO: 133671 - DNA, 18 bp, Homo sapiens
agtggtcaccttcctcag

SEQ ID NO: 133672 - DNA, 13 bp, Homo sapiens
agtgtcctggacc

SEQ ID NO: 133673 - DNA, 20 bp, Homo sapiens
agtgtcctggaccctggcct

SEQ ID NO: 133674 - DNA, 22 bp, Homo sapiens
agttataataactgaactgttt

SEQ ID NO: 133675 - DNA, 19 bp, Homo sapiens
agttattttaattatcttt

SEQ ID NO: 133676 - DNA, 17 bp, Homo sapiens
agttcttaaaattagtg

SEQ ID NO: 133677 - DNA, 13 bp, Homo sapiens
agttcttgaattg

SEQ ID NO: 133678 - DNA, 16 bp, Homo sapiens
agttcttgaattgtta

SEQ ID NO: 133679 - DNA, 15 bp, Homo sapiens
actctactgtgtaat

SEQ ID NO: 133680 - DNA, 20 bp, Homo sapiens
actctgcagatagtgcctct

SEQ ID NO: 133681 - DNA, 12 bp, Homo sapiens
actgaagctggg

SEQ ID NO: 133682 - DNA, 13 bp, Homo sapiens
actgaagctgggg

SEQ ID NO: 133683 - DNA, 15 bp, Homo sapiens
actgagaaatgaatg

SEQ ID NO: 133684 - DNA, 16 bp, Homo sapiens
actgagaaatgaatgc

SEQ ID NO: 133685 - DNA, 13 bp, Homo sapiens
actgatttctcac

SEQ ID NO: 133686 - DNA, 12 bp, Homo sapiens
actggctcaaga

SEQ ID NO: 133687 - DNA, 16 bp, Homo sapiens
actgggcacccctgcc

SEQ ID NO: 133688 - DNA, 17 bp, Homo sapiens
actgggcacccctgcct

SEQ ID NO: 133689 - DNA, 18 bp, Homo sapiens
actggtttgtttgcttaa

SEQ ID NO: 133690 - DNA, 12 bp, Homo sapiens
actgtaaaagtt

SEQ ID NO: 133691 - DNA, 15 bp, Homo sapiens
actgtaaaagttata

SEQ ID NO: 133692 - DNA, 21 bp, Homo sapiens
actgtaaacttggaatcaagg

SEQ ID NO: 133693 - DNA, 17 bp, Homo sapiens
actgtcaaatgaacttt

SEQ ID NO: 133694 - DNA, 21 bp, Homo sapiens
actgtcaaatgaacttttaca

SEQ ID NO: 133695 - DNA, 16 bp, Homo sapiens
actgtgcattacaaag

SEQ ID NO: 133696 - DNA, 21 bp, Homo sapiens
actgtgcattacaaagttaat

SEQ ID NO: 133697 - DNA, 15 bp, Homo sapiens
actgttggcacttat

SEQ ID NO: 133698 - DNA, 22 bp, Homo sapiens
actgtttggtcgagtctttgtg

SEQ ID NO: 133699 - DNA, 19 bp, Homo sapiens
acttaacatttcattgtac

SEQ ID NO: 133700 - DNA, 15 bp, Homo sapiens
acttcaaatatagag

SEQ ID NO: 133701 - DNA, 13 bp, Homo sapiens
acttcaaggccca

SEQ ID NO: 133702 - DNA, 16 bp, Homo sapiens
acttcactgcagcctt

SEQ ID NO: 133703 - DNA, 17 bp, Homo sapiens
acttcactgcagccttt

SEQ ID NO: 133704 - DNA, 18 bp, Homo sapiens
acttcactgcagcctttc

SEQ ID NO: 133705 - DNA, 13 bp, Homo sapiens
acttcatgcccac

SEQ ID NO: 133706 - DNA, 14 bp, Homo sapiens
acttcatgcccact

SEQ ID NO: 133707 - DNA, 17 bp, Homo sapiens
acttcatgcccactgcc

SEQ ID NO: 133708 - DNA, 19 bp, Homo sapiens
acttcccaattgccacatt

SEQ ID NO: 133709 - DNA, 20 bp, Homo sapiens
acttctgagccccagcccca

SEQ ID NO: 133710 - DNA, 15 bp, Homo sapiens
acttgaactttccaa

SEQ ID NO: 133711 - DNA, 13 bp, Homo sapiens
acttgcctgctgc

SEQ ID NO: 133712 - DNA, 15 bp, Homo sapiens
actttaaaaggcaac

SEQ ID NO: 133713 - DNA, 16 bp, Homo sapiens
actttaaaaggcaact

SEQ ID NO: 133714 - DNA, 18 bp, Homo sapiens
actttaaaaggcaactca

SEQ ID NO: 133715 - DNA, 18 bp, Homo sapiens
actttgtagactgtttca

SEQ ID NO: 133716 - DNA, 23 bp, Homo sapiens
acttttacagaatgcattaaaaa

SEQ ID NO: 133717 - DNA, 21 bp, Homo sapiens
acttttcagaattgaaggaga

SEQ ID NO: 133718 - DNA, 15 bp, Homo sapiens
acttttctggttcca

SEQ ID NO: 133719 - DNA, 13 bp, Homo sapiens
acttttctgttta

SEQ ID NO: 133720 - DNA, 21 bp, Homo sapiens
agaaaaatagagcaaaatcaa

SEQ ID NO: 133721 - DNA, 17 bp, Homo sapiens
agaaaacaagtatataa

SEQ ID NO: 133722 - DNA, 18 bp, Homo sapiens
agaaaactcccaatacaa

SEQ ID NO: 133723 - DNA, 20 bp, Homo sapiens
agaaaagtaatgaagaatca

SEQ ID NO: 133724 - DNA, 21 bp, Homo sapiens
agaaaagtaatgaagaatcac

SEQ ID NO: 133725 - DNA, 15 bp, Homo sapiens
agaaaatatcactgt

SEQ ID NO: 133726 - DNA, 15 bp, Homo sapiens
agaaaattaaaataa

SEQ ID NO: 133727 - DNA, 18 bp, Homo sapiens
agaaacagtattttcttc

SEQ ID NO: 133728 - DNA, 16 bp, Homo sapiens
agaaactaaacagaaa

SEQ ID NO: 133729 - DNA, 17 bp, Homo sapiens
agaaactaaacagaaaa

SEQ ID NO: 133730 - DNA, 19 bp, Homo sapiens
agaaactcgatgaatgtgt

SEQ ID NO: 133731 - DNA, 20 bp, Homo sapiens
agaaagaaaaggcaaaagac

SEQ ID NO: 133732 - DNA, 23 bp, Homo sapiens
agaaagaaactaaacagaaaact

SEQ ID NO: 133733 - DNA, 13 bp, Homo sapiens
agaaagagaatga

SEQ ID NO: 133734 - DNA, 17 bp, Homo sapiens
agaaagagaatgaactg

SEQ ID NO: 133735 - DNA, 14 bp, Homo sapiens
agaaaggatataaa

SEQ ID NO: 133736 - DNA, 16 bp, Homo sapiens
agaaagtaagtctttt

SEQ ID NO: 133737 - DNA, 22 bp, Homo sapiens
agaaagtctatctaatgacatg

SEQ ID NO: 133738 - DNA, 18 bp, Homo sapiens
agaaatatgatcagagct

SEQ ID NO: 133739 - DNA, 14 bp, Homo sapiens
agaaattaaaatat

SEQ ID NO: 133740 - DNA, 22 bp, Homo sapiens
agaaattaaaatattatttgat

SEQ ID NO: 133741 - DNA, 22 bp, Homo sapiens
agaaattttactgacagaaatg

SEQ ID NO: 133742 - DNA, 11 bp, Homo sapiens
agaacaacttg

SEQ ID NO: 133743 - DNA, 17 bp, Homo sapiens
agaacaatgtcagaaac

SEQ ID NO: 133744 - DNA, 19 bp, Homo sapiens
agaactaagtaagaaacac

SEQ ID NO: 133745 - DNA, 21 bp, Homo sapiens
agaactaagtaagaaacacaa

SEQ ID NO: 133746 - DNA, 17 bp, Homo sapiens
agaactatgtaaacaaa

SEQ ID NO: 133747 - DNA, 19 bp, Homo sapiens
agaagcgctgttgcccgcc

SEQ ID NO: 133748 - DNA, 20 bp, Homo sapiens
atagagcaaaatcaacatga

SEQ ID NO: 133749 - DNA, 22 bp, Homo sapiens
atagagcaaaatcaacatgact

SEQ ID NO: 133750 - DNA, 17 bp, Homo sapiens
atagccctcagacattt

SEQ ID NO: 133751 - DNA, 16 bp, Homo sapiens
atagctggcaagaatg

SEQ ID NO: 133752 - DNA, 20 bp, Homo sapiens
ataggtaacgtgattgattc

SEQ ID NO: 133753 - DNA, 12 bp, Homo sapiens
ataggtttccac

SEQ ID NO: 133754 - DNA, 14 bp, Homo sapiens
atagtgcctctgca

SEQ ID NO: 133755 - DNA, 16 bp, Homo sapiens
atagtgtcctatgcaa

SEQ ID NO: 133756 - DNA, 14 bp, Homo sapiens
atagttcttaaaat

SEQ ID NO: 133757 - DNA, 19 bp, Homo sapiens
atagttcttaaaattagtg

SEQ ID NO: 133758 - DNA, 20 bp, Homo sapiens
atataaaagttaaactactt

SEQ ID NO: 133759 - DNA, 20 bp, Homo sapiens
atatatagctggcaagaatg

SEQ ID NO: 133760 - DNA, 14 bp, Homo sapiens
atatatcataaagt

SEQ ID NO: 133761 - DNA, 14 bp, Homo sapiens
atatatgtatatgt

SEQ ID NO: 133762 - DNA, 15 bp, Homo sapiens
atatatgtatatgta

SEQ ID NO: 133763 - DNA, 16 bp, Homo sapiens
atatatgtatatgtat

SEQ ID NO: 133764 - DNA, 20 bp, Homo sapiens
atatatgtatatgtatatct

SEQ ID NO: 133765 - DNA, 12 bp, Homo sapiens
atatatgtgtat

SEQ ID NO: 133766 - DNA, 16 bp, Homo sapiens
atatatgtgtatacat

SEQ ID NO: 133767 - DNA, 17 bp, Homo sapiens
atatatgtgtatacata

SEQ ID NO: 133768 - DNA, 15 bp, Homo sapiens
atatccatacatttt

SEQ ID NO: 133769 - DNA, 13 bp, Homo sapiens
atatctatatctc

SEQ ID NO: 133770 - DNA, 17 bp, Homo sapiens
atatctgagaagtgtat

SEQ ID NO: 133771 - DNA, 14 bp, Homo sapiens
atatctgtttgtat

SEQ ID NO: 133772 - DNA, 18 bp, Homo sapiens
atatctgtttgtatattt

SEQ ID NO: 133773 - DNA, 19 bp, Homo sapiens
atatctgtttgtatatttg

SEQ ID NO: 133774 - DNA, 22 bp, Homo sapiens
atatctgtttgtatatttgcaa

SEQ ID NO: 133775 - DNA, 12 bp, Homo sapiens
atatgtatatgt

SEQ ID NO: 133776 - DNA, 15 bp, Homo sapiens
atatgtgtatacata

SEQ ID NO: 133777 - DNA, 19 bp, Homo sapiens
atatgttctgcaagaatta

SEQ ID NO: 133778 - DNA, 21 bp, Homo sapiens
atattacctaatgaaagtgat

SEQ ID NO: 133779 - DNA, 18 bp, Homo sapiens
atattagttgctttgtta

SEQ ID NO: 133780 - DNA, 13 bp, Homo sapiens
atattccaaggaa

SEQ ID NO: 133781 - DNA, 19 bp, Homo sapiens
attcagaaattaaaatatt

SEQ ID NO: 133782 - DNA, 20 bp, Homo sapiens
attcagaaattaaaatatta

SEQ ID NO: 133783 - DNA, 21 bp, Homo sapiens
attcagctgaggttcattaca

SEQ ID NO: 133784 - DNA, 14 bp, Homo sapiens
attcagtttaagag

SEQ ID NO: 133785 - DNA, 22 bp, Homo sapiens
attcagtttaagagttttcctt

SEQ ID NO: 133786 - DNA, 23 bp, Homo sapiens
attcagtttaagagttttccttg

SEQ ID NO: 133787 - DNA, 14 bp, Homo sapiens
attccaagaaaata

SEQ ID NO: 133788 - DNA, 16 bp, Homo sapiens
attccaaggaaaattg

SEQ ID NO: 133789 - DNA, 18 bp, Homo sapiens
attccaaggaaaattgaa

SEQ ID NO: 133790 - DNA, 19 bp, Homo sapiens
attccaaggaaaattgaaa

SEQ ID NO: 133791 - DNA, 16 bp, Homo sapiens
attccagacagtcaca

SEQ ID NO: 133792 - DNA, 23 bp, Homo sapiens
attccagacagtcacaaatttct

SEQ ID NO: 133793 - DNA, 15 bp, Homo sapiens
attccctctcccacc

SEQ ID NO: 133794 - DNA, 17 bp, Homo sapiens
attccctctcccaccca

SEQ ID NO: 133795 - DNA, 20 bp, Homo sapiens
attctacacatatatgtata

SEQ ID NO: 133796 - DNA, 20 bp, Homo sapiens
attctgtggttctataataa

SEQ ID NO: 133797 - DNA, 13 bp, Homo sapiens
attcttaaaatgc

SEQ ID NO: 133798 - DNA, 17 bp, Homo sapiens
attcttaaaatgcaata

SEQ ID NO: 133799 - DNA, 16 bp, Homo sapiens
attctttttaaagtat

SEQ ID NO: 133800 - DNA, 14 bp, Homo sapiens
attgaaaaatcagt

SEQ ID NO: 133801 - DNA, 12 bp, Homo sapiens
attgaaagtatt

SEQ ID NO: 133802 - DNA, 14 bp, Homo sapiens
attgaaatcagcat

SEQ ID NO: 133803 - DNA, 16 bp, Homo sapiens
attgaaggagaaaatg

SEQ ID NO: 133804 - DNA, 19 bp, Homo sapiens
attgaaggagaaaatgcat

SEQ ID NO: 133805 - DNA, 13 bp, Homo sapiens
attgattcagtat

SEQ ID NO: 133806 - DNA, 13 bp, Homo sapiens
attgcacttttaa

SEQ ID NO: 133807 - DNA, 18 bp, Homo sapiens
attgctaaaagtgcattt

SEQ ID NO: 133808 - DNA, 21 bp, Homo sapiens
attgctaaaagtgcatttaag

SEQ ID NO: 133809 - DNA, 19 bp, Homo sapiens
attggaagctgctgaggcc

SEQ ID NO: 133810 - DNA, 21 bp, Homo sapiens
attggcagccaaggaatgtgt

SEQ ID NO: 133811 - DNA, 14 bp, Homo sapiens
attgtattgctgtc

SEQ ID NO: 133812 - DNA, 12 bp, Homo sapiens
attgtcagaatt

SEQ ID NO: 133813 - DNA, 14 bp, Homo sapiens
attgtcagaattta

SEQ ID NO: 133814 - DNA, 23 bp, Homo sapiens
attgtcctcccctattttaagac

SEQ ID NO: 133815 - DNA, 23 bp, Homo sapiens
atttaaatatctgaacatttact

SEQ ID NO: 133816 - DNA, 13 bp, Homo sapiens
atttaagacacat

SEQ ID NO: 133817 - DNA, 14 bp, Homo sapiens
atttaagacacatt

SEQ ID NO: 133818 - DNA, 16 bp, Homo sapiens
atttaaggagattggg

SEQ ID NO: 133819 - DNA, 18 bp, Homo sapiens
atttaatggactgtgaat

SEQ ID NO: 133820 - DNA, 19 bp, Homo sapiens
atttaatggactgtgaatt

SEQ ID NO: 133821 - DNA, 20 bp, Homo sapiens
atttaatggactgtgaattt

SEQ ID NO: 133822 - DNA, 19 bp, Homo sapiens
atttattggcagccaagga

SEQ ID NO: 133823 - DNA, 21 bp, Homo sapiens
atttattggcagccaaggaat

SEQ ID NO: 133824 - DNA, 23 bp, Homo sapiens
atttcaaaaaaaaaaaaaaagac

SEQ ID NO: 133825 - DNA, 20 bp, Homo sapiens
atttcattgtacaagtatta

SEQ ID NO: 133826 - DNA, 15 bp, Homo sapiens
atttccacataaagg

SEQ ID NO: 133827 - DNA, 18 bp, Homo sapiens
atttccagtgagtgtaaa

SEQ ID NO: 133828 - DNA, 19 bp, Homo sapiens
atttccttctgttaagaaa

SEQ ID NO: 133829 - DNA, 22 bp, Homo sapiens
atttccttctgttaagaaagga

SEQ ID NO: 133830 - DNA, 15 bp, Homo sapiens
atttctgtatactgt

SEQ ID NO: 133831 - DNA, 16 bp, Homo sapiens
atttctgtatactgta

SEQ ID NO: 133832 - DNA, 18 bp, Homo sapiens
atttctgtatactgtaaa

SEQ ID NO: 133833 - DNA, 23 bp, Homo sapiens
atttctgtatactgtaaaagtta

SEQ ID NO: 133834 - DNA, 14 bp, Homo sapiens
atttcttaaaattc

SEQ ID NO: 133835 - DNA, 11 bp, Homo sapiens
atttgaattgg

SEQ ID NO: 133836 - DNA, 20 bp, Homo sapiens
atttgaggactgaagctggg

SEQ ID NO: 133837 - DNA, 16 bp, Homo sapiens
attttaaaataaactt

SEQ ID NO: 133838 - DNA, 18 bp, Homo sapiens
attttaaataacctctgg

SEQ ID NO: 133839 - DNA, 22 bp, Homo sapiens
attttaaataacctctggccct

SEQ ID NO: 133840 - DNA, 14 bp, Homo sapiens
attttaagaaagag

SEQ ID NO: 133841 - DNA, 19 bp, Homo sapiens
attttaagaaagagaatga

SEQ ID NO: 133842 - DNA, 20 bp, Homo sapiens
attttaagaaagagaatgaa

SEQ ID NO: 133843 - DNA, 23 bp, Homo sapiens
attttaagacgtgaatgtctcag

SEQ ID NO: 133844 - DNA, 18 bp, Homo sapiens
attttaattatcttttct

SEQ ID NO: 133845 - DNA, 18 bp, Homo sapiens
attttactgacagaaatg

SEQ ID NO: 133846 - DNA, 19 bp, Homo sapiens
attttactgacagaaatgc

SEQ ID NO: 133847 - DNA, 19 bp, Homo sapiens
attttatgagagtttggaa

SEQ ID NO: 133848 - DNA, 14 bp, Homo sapiens
attttcccttttta

SEQ ID NO: 133849 - DNA, 18 bp, Homo sapiens
attttccctttttaaaaa

SEQ ID NO: 133850 - DNA, 21 bp, Homo sapiens
attttccctttttaaaaaata

SEQ ID NO: 133851 - DNA, 15 bp, Homo sapiens
attttcctaatgtga

SEQ ID NO: 133852 - DNA, 17 bp, Homo sapiens
attttgtacaaagatat

SEQ ID NO: 133853 - DNA, 20 bp, Homo sapiens
attttgtacaaagatatgct

SEQ ID NO: 133854 - DNA, 13 bp, Homo sapiens
atttttaaaataa

SEQ ID NO: 133855 - DNA, 20 bp, Homo sapiens
atttttaaaataaaaatatt

SEQ ID NO: 133856 - DNA, 18 bp, Homo sapiens
atttttatattagttgct

SEQ ID NO: 133857 - DNA, 20 bp, Homo sapiens
atttttatattagttgcttt

SEQ ID NO: 133858 - DNA, 10 bp, Homo sapiens
atttttgaaa

SEQ ID NO: 133859 - DNA, 14 bp, Homo sapiens
atttttgaaaaata

SEQ ID NO: 133860 - DNA, 15 bp, Homo sapiens
atttttgaaaaatat

SEQ ID NO: 133861 - DNA, 18 bp, Homo sapiens
atttttgaaaaatattgc

SEQ ID NO: 133862 - DNA, 21 bp, Homo sapiens
atttttgaaaaatattgctaa

SEQ ID NO: 133863 - DNA, 16 bp, Homo sapiens
atttttgtataaaaag

SEQ ID NO: 133864 - DNA, 20 bp, Homo sapiens
atttttgtataaaaaggaaa

SEQ ID NO: 133865 - DNA, 22 bp, Homo sapiens
atttttgtataaaaaggaaatt

SEQ ID NO: 133866 - DNA, 18 bp, Homo sapiens
atttttgtattcaattaa

SEQ ID NO: 133867 - DNA, 21 bp, Homo sapiens
attttttaaaagagacaaact

SEQ ID NO: 133868 - DNA, 16 bp, Homo sapiens
attttttatttccaca

SEQ ID NO: 133869 - DNA, 13 bp, Homo sapiens
attttttcatttc

SEQ ID NO: 133870 - DNA, 14 bp, Homo sapiens
attttttcatttca

SEQ ID NO: 133871 - DNA, 16 bp, Homo sapiens
attttttttgtaactt

SEQ ID NO: 133872 - DNA, 22 bp, Homo sapiens
caaaaaaaaaaaaaaagactgt

SEQ ID NO: 133873 - DNA, 12 bp, Homo sapiens
caaaaaaaagaa

SEQ ID NO: 133874 - DNA, 13 bp, Homo sapiens
caaaaaaaagaac

SEQ ID NO: 133875 - DNA, 21 bp, Homo sapiens
caaaacaaacaaaaaaaagaa

SEQ ID NO: 133876 - DNA, 18 bp, Homo sapiens
caaaagaaaccatgacaa

SEQ ID NO: 133877 - DNA, 17 bp, Homo sapiens
caaaagactggtttgtt

SEQ ID NO: 133878 - DNA, 21 bp, Homo sapiens
caaaagactggtttgtttgct

SEQ ID NO: 133879 - DNA, 22 bp, Homo sapiens
caaacccatgaagctggccctc

SEQ ID NO: 133880 - DNA, 12 bp, Homo sapiens
caaactgtaaaa

SEQ ID NO: 133881 - DNA, 21 bp, Homo sapiens
caaactgtaaaaaatgtgtgt

SEQ ID NO: 133882 - DNA, 13 bp, Homo sapiens
atattttaagaaa

SEQ ID NO: 133883 - DNA, 14 bp, Homo sapiens
atattttaagaaag

SEQ ID NO: 133884 - DNA, 16 bp, Homo sapiens
atattttaagaaagag

SEQ ID NO: 133885 - DNA, 17 bp, Homo sapiens
atattttaagaaagaga

SEQ ID NO: 133886 - DNA, 22 bp, Homo sapiens
atatttttgtacgttatatatt

SEQ ID NO: 133887 - DNA, 13 bp, Homo sapiens
atcaaaaataatg

SEQ ID NO: 133888 - DNA, 15 bp, Homo sapiens
atcaaaataaaagaa

SEQ ID NO: 133889 - DNA, 19 bp, Homo sapiens
atcaaaataaaagaaatat

SEQ ID NO: 133890 - DNA, 20 bp, Homo sapiens
atcaaaggaatataagaaaa

SEQ ID NO: 133891 - DNA, 14 bp, Homo sapiens
atcaatttctcaat

SEQ ID NO: 133892 - DNA, 23 bp, Homo sapiens
atcaccccagcccccacagccct

SEQ ID NO: 133893 - DNA, 23 bp, Homo sapiens
atcacttaacattcctaaaatgc

SEQ ID NO: 133894 - DNA, 15 bp, Homo sapiens
atcagaaacagtatt

SEQ ID NO: 133895 - DNA, 23 bp, Homo sapiens
atcagaaacagtattttcttccc

SEQ ID NO: 133896 - DNA, 23 bp, Homo sapiens
atcagaggtcatcccttcctcct

SEQ ID NO: 133897 - DNA, 14 bp, Homo sapiens
atcagcatgacaaa

SEQ ID NO: 133898 - DNA, 15 bp, Homo sapiens
atcagctctcctggc

SEQ ID NO: 133899 - DNA, 18 bp, Homo sapiens
atcagtgtattagtcata

SEQ ID NO: 133900 - DNA, 20 bp, Homo sapiens
atcatattttgttgtgcact

SEQ ID NO: 133901 - DNA, 14 bp, Homo sapiens
atcattaaaatata

SEQ ID NO: 133902 - DNA, 17 bp, Homo sapiens
atcattaaaatatatgt

SEQ ID NO: 133903 - DNA, 21 bp, Homo sapiens
atcattcatcttcttctttaa

SEQ ID NO: 133904 - DNA, 15 bp, Homo sapiens
atcattttaggaaag

SEQ ID NO: 133905 - DNA, 14 bp, Homo sapiens
atcatttttgtata

SEQ ID NO: 133906 - DNA, 15 bp, Homo sapiens
atcatttttgtataa

SEQ ID NO: 133907 - DNA, 17 bp, Homo sapiens
atccaaagaactatgta

SEQ ID NO: 133908 - DNA, 13 bp, Homo sapiens
atccacctgtctc

SEQ ID NO: 133909 - DNA, 18 bp, Homo sapiens
atccacctgtctcagcct

SEQ ID NO: 133910 - DNA, 13 bp, Homo sapiens
atcctagccccac

SEQ ID NO: 133911 - DNA, 21 bp, Homo sapiens
atcctagccccacccagaggt

SEQ ID NO: 133912 - DNA, 18 bp, Homo sapiens
atcctatatctgtttgta

SEQ ID NO: 133913 - DNA, 23 bp, Homo sapiens
atcctgtttttcctatgctctgg

SEQ ID NO: 133914 - DNA, 22 bp, Homo sapiens
atctaactgatgagtaaactga

SEQ ID NO: 133915 - DNA, 21 bp, Homo sapiens
atctacagtaatgaaatgttt

SEQ ID NO: 133916 - DNA, 23 bp, Homo sapiens
atctacagtaatgaaatgtttac

SEQ ID NO: 133917 - DNA, 18 bp, Homo sapiens
atctatatctctaaactg

SEQ ID NO: 133918 - DNA, 16 bp, Homo sapiens
atctcaccccatccca

SEQ ID NO: 133919 - DNA, 22 bp, Homo sapiens
atctcaccccatcccacaccct

SEQ ID NO: 133920 - DNA, 17 bp, Homo sapiens
atctcatttcaatttat

SEQ ID NO: 133921 - DNA, 16 bp, Homo sapiens
atctctaaactgctgt

SEQ ID NO: 133922 - DNA, 11 bp, Homo sapiens
atctctccctc

SEQ ID NO: 133923 - DNA, 18 bp, Homo sapiens
atctgagaagtgtatata

SEQ ID NO: 133924 - DNA, 19 bp, Homo sapiens
atctgagaagtgtatatag

SEQ ID NO: 133925 - DNA, 21 bp, Homo sapiens
atctgtgaaatgctggcattt

SEQ ID NO: 133926 - DNA, 13 bp, Homo sapiens
atctgtttgtata

SEQ ID NO: 133927 - DNA, 14 bp, Homo sapiens
atctgtttgtatat

SEQ ID NO: 133928 - DNA, 20 bp, Homo sapiens
atctgtttgtatatttgcaa

SEQ ID NO: 133929 - DNA, 21 bp, Homo sapiens
atctgtttgtatatttgcaaa

SEQ ID NO: 133930 - DNA, 15 bp, Homo sapiens
atcttagagtttaca

SEQ ID NO: 133931 - DNA, 19 bp, Homo sapiens
atcttggcttcttaaaaac

SEQ ID NO: 133932 - DNA, 20 bp, Homo sapiens
atcttggcttcttaaaaact

SEQ ID NO: 133933 - DNA, 22 bp, Homo sapiens
atcttggcttcttaaaaactgt

SEQ ID NO: 133934 - DNA, 23 bp, Homo sapiens
atgaaaatcctatatctgtttgt

SEQ ID NO: 133935 - DNA, 20 bp, Homo sapiens
atgaaagtgatgacatattt

SEQ ID NO: 133936 - DNA, 13 bp, Homo sapiens
atgaaatgtttac

SEQ ID NO: 133937 - DNA, 15 bp, Homo sapiens
atgaacttttacaga

SEQ ID NO: 133938 - DNA, 18 bp, Homo sapiens
atgaacttttacagaatg

SEQ ID NO: 133939 - DNA, 19 bp, Homo sapiens
atgaacttttacagaatgc

SEQ ID NO: 133940 - DNA, 22 bp, Homo sapiens
atgaatatatggcatttgcaga

SEQ ID NO: 133941 - DNA, 18 bp, Homo sapiens
atgaatgtgttgatttga

SEQ ID NO: 133942 - DNA, 13 bp, Homo sapiens
atgacaaaaataa

SEQ ID NO: 133943 - DNA, 19 bp, Homo sapiens
atgactggtggtgagagac

SEQ ID NO: 133944 - DNA, 18 bp, Homo sapiens
atgagagttccagattgt

SEQ ID NO: 133945 - DNA, 22 bp, Homo sapiens
atgagtcagtgaagtctagaat

SEQ ID NO: 133946 - DNA, 15 bp, Homo sapiens
atgatcaagatatat

SEQ ID NO: 133947 - DNA, 17 bp, Homo sapiens
atgatcaagatatatgt

SEQ ID NO: 133948 - DNA, 19 bp, Homo sapiens
atgatggaaacgcacttac

SEQ ID NO: 133949 - DNA, 21 bp, Homo sapiens
atgcaagacttcactgcagcc

SEQ ID NO: 133950 - DNA, 16 bp, Homo sapiens
atgcaataaaattatt

SEQ ID NO: 133951 - DNA, 16 bp, Homo sapiens
atgcagttttcaaatt

SEQ ID NO: 133952 - DNA, 12 bp, Homo sapiens
atgcattaaaaa

SEQ ID NO: 133953 - DNA, 13 bp, Homo sapiens
atgcattaaaaaa

SEQ ID NO: 133954 - DNA, 16 bp, Homo sapiens
atgcccaatccaggcc

SEQ ID NO: 133955 - DNA, 14 bp, Homo sapiens
atgcccaccgagga

SEQ ID NO: 133956 - DNA, 20 bp, Homo sapiens
cacccctgcctcctgcctcc

SEQ ID NO: 133957 - DNA, 18 bp, Homo sapiens
cacccgccccgccccctc

SEQ ID NO: 133958 - DNA, 14 bp, Homo sapiens
cacccttcccctcc

SEQ ID NO: 133959 - DNA, 23 bp, Homo sapiens
cacccttcccctccttctccctt

SEQ ID NO: 133960 - DNA, 14 bp, Homo sapiens
caccggcccctggc

SEQ ID NO: 133961 - DNA, 16 bp, Homo sapiens
caccggcccctggcag

SEQ ID NO: 133962 - DNA, 22 bp, Homo sapiens
cacctatggcccagccactgca

SEQ ID NO: 133963 - DNA, 12 bp, Homo sapiens
cacctgacctct

SEQ ID NO: 133964 - DNA, 20 bp, Homo sapiens
cacctgggccaaggactcca

SEQ ID NO: 133965 - DNA, 17 bp, Homo sapiens
cacctgtctcagcctcc

SEQ ID NO: 133966 - DNA, 19 bp, Homo sapiens
cacgttggcgaggaaaaac

SEQ ID NO: 133967 - DNA, 23 bp, Homo sapiens
cactaggtgaacagcaggatgcc

SEQ ID NO: 133968 - DNA, 21 bp, Homo sapiens
cactcgcctactaagtaccct

SEQ ID NO: 133969 - DNA, 16 bp, Homo sapiens
cactctaattagagaa

SEQ ID NO: 133970 - DNA, 22 bp, Homo sapiens
cactgattccctctcccaccca

SEQ ID NO: 133971 - DNA, 13 bp, Homo sapiens
cactgcagcacag

SEQ ID NO: 133972 - DNA, 18 bp, Homo sapiens
cactggcacttgcctgct

SEQ ID NO: 133973 - DNA, 19 bp, Homo sapiens
cactggcacttgcctgctg

SEQ ID NO: 133974 - DNA, 21 bp, Homo sapiens
cacttaacattcctaaaatgc

SEQ ID NO: 133975 - DNA, 15 bp, Homo sapiens
cacttacaagtggtg

SEQ ID NO: 133976 - DNA, 15 bp, Homo sapiens
cacttcatgcccact

SEQ ID NO: 133977 - DNA, 20 bp, Homo sapiens
cagaaactcgatgaatgtgt

SEQ ID NO: 133978 - DNA, 16 bp, Homo sapiens
cagaaattaaaatatt

SEQ ID NO: 133979 - DNA, 17 bp, Homo sapiens
cagaaattaaaatatta

SEQ ID NO: 133980 - DNA, 21 bp, Homo sapiens
cagaaattaaaatattatttg

SEQ ID NO: 133981 - DNA, 14 bp, Homo sapiens
cagaatgcattaaa

SEQ ID NO: 133982 - DNA, 16 bp, Homo sapiens
cagaatttagactgaa

SEQ ID NO: 133983 - DNA, 23 bp, Homo sapiens
atgttctgcaagaattaaaactg

SEQ ID NO: 133984 - DNA, 15 bp, Homo sapiens
atgttggttgcactt

SEQ ID NO: 133985 - DNA, 16 bp, Homo sapiens
atgttggttgcacttt

SEQ ID NO: 133986 - DNA, 20 bp, Homo sapiens
atgttggttgcactttgtag

SEQ ID NO: 133987 - DNA, 22 bp, Homo sapiens
attaaaactgagtccatgaaaa

SEQ ID NO: 133988 - DNA, 11 bp, Homo sapiens
attaaaatata

SEQ ID NO: 133989 - DNA, 12 bp, Homo sapiens
attaaaatatta

SEQ ID NO: 133990 - DNA, 18 bp, Homo sapiens
attaaaatattatttgat

SEQ ID NO: 133991 - DNA, 23 bp, Homo sapiens
attaaaatctggcaaagttatat

SEQ ID NO: 133992 - DNA, 19 bp, Homo sapiens
attaaatctagacattctt

SEQ ID NO: 133993 - DNA, 15 bp, Homo sapiens
attaactgtaaactt

SEQ ID NO: 133994 - DNA, 13 bp, Homo sapiens
attaagatttcca

SEQ ID NO: 133995 - DNA, 18 bp, Homo sapiens
attaagcagaaacagcat

SEQ ID NO: 133996 - DNA, 20 bp, Homo sapiens
attaattgtcctgtgtctat

SEQ ID NO: 133997 - DNA, 19 bp, Homo sapiens
attacaaatgcaaatttct

SEQ ID NO: 133998 - DNA, 19 bp, Homo sapiens
attacgatcccccaagtgt

SEQ ID NO: 133999 - DNA, 16 bp, Homo sapiens
attacttgaactttcc

SEQ ID NO: 134000 - DNA, 18 bp, Homo sapiens
attacttgaactttccaa

SEQ ID NO: 134001 - DNA, 14 bp, Homo sapiens
attagcagaatgga

SEQ ID NO: 134002 - DNA, 16 bp, Homo sapiens
attagcagaatggaga

SEQ ID NO: 134003 - DNA, 17 bp, Homo sapiens
attagcagaatggagaa

SEQ ID NO: 134004 - DNA, 22 bp, Homo sapiens
attagtgttgtgcacttcatgt

SEQ ID NO: 134005 - DNA, 21 bp, Homo sapiens
attagtttgatttaatatctg

SEQ ID NO: 134006 - DNA, 17 bp, Homo sapiens
attcaaagctctattaa

SEQ ID NO: 134007 - DNA, 14 bp, Homo sapiens
attcaacctgtgtc

SEQ ID NO: 134008 - DNA, 12 bp, Homo sapiens
attcaattaaag

SEQ ID NO: 134009 - DNA, 21 bp, Homo sapiens
attcagaaattaaaatattat

SEQ ID NO: 134010 - DNA, 19 bp, Homo sapiens
attcagtttaagagttttc

SEQ ID NO: 134011 - DNA, 21 bp, Homo sapiens
attcagtttaagagttttcct

SEQ ID NO: 134012 - DNA, 19 bp, Homo sapiens
attcatttgagttatttta

SEQ ID NO: 134013 - DNA, 15 bp, Homo sapiens
attccaagaaaatat

SEQ ID NO: 134014 - DNA, 21 bp, Homo sapiens
attccaaggaaaattgaaagt

SEQ ID NO: 134015 - DNA, 21 bp, Homo sapiens
attccctctcccacccaagga

SEQ ID NO: 134016 - DNA, 15 bp, Homo sapiens
attctacacatatat

SEQ ID NO: 134017 - DNA, 19 bp, Homo sapiens
attctacacatatatgtat

SEQ ID NO: 134018 - DNA, 13 bp, Homo sapiens
attctgattccac

SEQ ID NO: 134019 - DNA, 21 bp, Homo sapiens
attctgtggttctataataag

SEQ ID NO: 134020 - DNA, 13 bp, Homo sapiens
attgaaaaatcag

SEQ ID NO: 134021 - DNA, 17 bp, Homo sapiens
attgaaagtattcagaa

SEQ ID NO: 134022 - DNA, 20 bp, Homo sapiens
attgaaatcagcatgacaaa

SEQ ID NO: 134023 - DNA, 21 bp, Homo sapiens
attgaaatcagcatgacaaaa

SEQ ID NO: 134024 - DNA, 20 bp, Homo sapiens
attgaacaataaagtttgct

SEQ ID NO: 134025 - DNA, 21 bp, Homo sapiens
attgactcctttccaatagaa

SEQ ID NO: 134026 - DNA, 23 bp, Homo sapiens
attgactcctttccaatagaaag

SEQ ID NO: 134027 - DNA, 14 bp, Homo sapiens
attgattaaaatct

SEQ ID NO: 134028 - DNA, 17 bp, Homo sapiens
attgcactcatcatatt

SEQ ID NO: 134029 - DNA, 11 bp, Homo sapiens
attgctaaaag

SEQ ID NO: 134030 - DNA, 13 bp, Homo sapiens
attgctaaaagtg

SEQ ID NO: 134031 - DNA, 19 bp, Homo sapiens
attgctaaaagtgcattta

SEQ ID NO: 134032 - DNA, 22 bp, Homo sapiens
attgctgtccttgaatgccata

SEQ ID NO: 134033 - DNA, 16 bp, Homo sapiens
attggcagccaaggaa

SEQ ID NO: 134034 - DNA, 23 bp, Homo sapiens
attggcagccaaggaatgtgtcc

SEQ ID NO: 134035 - DNA, 18 bp, Homo sapiens
attgggagacaattagca

SEQ ID NO: 134036 - DNA, 20 bp, Homo sapiens
attgtacattttgtaaaata

SEQ ID NO: 134037 - DNA, 13 bp, Homo sapiens
attgtagacatgc

SEQ ID NO: 134038 - DNA, 19 bp, Homo sapiens
atttaacaaaaaatgtaat

SEQ ID NO: 134039 - DNA, 13 bp, Homo sapiens
atttaatatctga

SEQ ID NO: 134040 - DNA, 16 bp, Homo sapiens
atttaatatctgagaa

SEQ ID NO: 134041 - DNA, 22 bp, Homo sapiens
atttaatatctgagaagtgtat

SEQ ID NO: 134042 - DNA, 15 bp, Homo sapiens
atttaatggactgtg

SEQ ID NO: 134043 - DNA, 14 bp, Homo sapiens
atttactacagttt

SEQ ID NO: 134044 - DNA, 14 bp, Homo sapiens
atttagaatatatt

SEQ ID NO: 134045 - DNA, 16 bp, Homo sapiens
atttagactgaaacta

SEQ ID NO: 134046 - DNA, 19 bp, Homo sapiens
atttataaaaatataaatt

SEQ ID NO: 134047 - DNA, 20 bp, Homo sapiens
atttataaaaatataaattg

SEQ ID NO: 134048 - DNA, 17 bp, Homo sapiens
atttattggcagccaag

SEQ ID NO: 134049 - DNA, 22 bp, Homo sapiens
atttattggcagccaaggaatg

SEQ ID NO: 134050 - DNA, 22 bp, Homo sapiens
atttcaaaaaaaaaaaaaaaga

SEQ ID NO: 134051 - DNA, 17 bp, Homo sapiens
atttccacataaaggta

SEQ ID NO: 134052 - DNA, 15 bp, Homo sapiens
atttccagtgagtgt

SEQ ID NO: 134053 - DNA, 21 bp, Homo sapiens
atttccagtgagtgtaaataa

SEQ ID NO: 134054 - DNA, 18 bp, Homo sapiens
atttccttctgttaagaa

SEQ ID NO: 134055 - DNA, 20 bp, Homo sapiens
atttccttctgttaagaaag

SEQ ID NO: 134056 - DNA, 23 bp, Homo sapiens
atttccttctgttaagaaaggat

SEQ ID NO: 134057 - DNA, 20 bp, Homo sapiens
atttctataaatttaagaaa

SEQ ID NO: 134058 - DNA, 18 bp, Homo sapiens
atttctcaatagttctta

SEQ ID NO: 134059 - DNA, 22 bp, Homo sapiens
cagtttattctgtggttctata

SEQ ID NO: 134060 - DNA, 16 bp, Homo sapiens
cagtttgtgttttaaa

SEQ ID NO: 134061 - DNA, 20 bp, Homo sapiens
cagtttgtgttttaaaaaaa

SEQ ID NO: 134062 - DNA, 23 bp, Homo sapiens
cagtttgtgttttaaaaaaactg

SEQ ID NO: 134063 - DNA, 21 bp, Homo sapiens
cagttttcaaattataatctc

SEQ ID NO: 134064 - DNA, 22 bp, Homo sapiens
cagtttttaactctactgtgta

SEQ ID NO: 134065 - DNA, 20 bp, Homo sapiens
cataaaactttaaaaggcaa

SEQ ID NO: 134066 - DNA, 15 bp, Homo sapiens
cataaactttctcca

SEQ ID NO: 134067 - DNA, 16 bp, Homo sapiens
cataaaggtatttaga

SEQ ID NO: 134068 - DNA, 15 bp, Homo sapiens
cataattatgaaaac

SEQ ID NO: 134069 - DNA, 20 bp, Homo sapiens
catatatgtatatgtatatc

SEQ ID NO: 134070 - DNA, 21 bp, Homo sapiens
catatatgtatatgtatatct

SEQ ID NO: 134071 - DNA, 14 bp, Homo sapiens
catatattgaggtt

SEQ ID NO: 134072 - DNA, 20 bp, Homo sapiens
catatgaggacctttatatc

SEQ ID NO: 134073 - DNA, 19 bp, Homo sapiens
catattttttatatctgga

SEQ ID NO: 134074 - DNA, 18 bp, Homo sapiens
catcaaaggaatataaga

SEQ ID NO: 134075 - DNA, 15 bp, Homo sapiens
catcactgattccct

SEQ ID NO: 134076 - DNA, 21 bp, Homo sapiens
catcactgattccctctccca

SEQ ID NO: 134077 - DNA, 14 bp, Homo sapiens
catcattaagaata

SEQ ID NO: 134078 - DNA, 14 bp, Homo sapiens
catcccacaccctg

SEQ ID NO: 134079 - DNA, 12 bp, Homo sapiens
catcctagcccc

SEQ ID NO: 134080 - DNA, 17 bp, Homo sapiens
catcctagccccaccca

SEQ ID NO: 134081 - DNA, 22 bp, Homo sapiens
catcctagccccacccagaggt

SEQ ID NO: 134082 - DNA, 19 bp, Homo sapiens
catcctcctcagcccccag

SEQ ID NO: 134083 - DNA, 18 bp, Homo sapiens
cagtttattctgtggttc

SEQ ID NO: 134084 - DNA, 22 bp, Homo sapiens
cagtttgtgttttaaaaaaact

SEQ ID NO: 134085 - DNA, 13 bp, Homo sapiens
cagttttcaaatt

SEQ ID NO: 134086 - DNA, 16 bp, Homo sapiens
cataaagtatgccttc

SEQ ID NO: 134087 - DNA, 16 bp, Homo sapiens
cataattatgaaaact

SEQ ID NO: 134088 - DNA, 22 bp, Homo sapiens
cataattatgaaaactcatgat

SEQ ID NO: 134089 - DNA, 17 bp, Homo sapiens
catacagaggtaactat

SEQ ID NO: 134090 - DNA, 21 bp, Homo sapiens
cataggaagacataaaacttt

SEQ ID NO: 134091 - DNA, 13 bp, Homo sapiens
catataacactta

SEQ ID NO: 134092 - DNA, 19 bp, Homo sapiens
catatattgaggttcattg

SEQ ID NO: 134093 - DNA, 21 bp, Homo sapiens
catcaaaggaatataagaaaa

SEQ ID NO: 134094 - DNA, 22 bp, Homo sapiens
catcaaaggaatataagaaaag

SEQ ID NO: 134095 - DNA, 22 bp, Homo sapiens
catcaatagtgtcctatgcaat

SEQ ID NO: 134096 - DNA, 23 bp, Homo sapiens
catcaatagtgtcctatgcaata

SEQ ID NO: 134097 - DNA, 17 bp, Homo sapiens
catcactgattccctct

SEQ ID NO: 134098 - DNA, 16 bp, Homo sapiens
catcattaagaataat

SEQ ID NO: 134099 - DNA, 22 bp, Homo sapiens
catcccgctggtgcctcccggg

SEQ ID NO: 134100 - DNA, 16 bp, Homo sapiens
catcccttcctcctct

SEQ ID NO: 134101 - DNA, 21 bp, Homo sapiens
catcccttcctcctctcctgg

SEQ ID NO: 134102 - DNA, 23 bp, Homo sapiens
catcctagccccacccagaggtg

SEQ ID NO: 134103 - DNA, 21 bp, Homo sapiens
catcctcctcagcccccaggc

SEQ ID NO: 134104 - DNA, 13 bp, Homo sapiens
catcttttacatt

SEQ ID NO: 134105 - DNA, 19 bp, Homo sapiens
catgaaaataccataggaa

SEQ ID NO: 134106 - DNA, 20 bp, Homo sapiens
catgacaaaaataacactgt

SEQ ID NO: 134107 - DNA, 15 bp, Homo sapiens
catgagggaagaata

SEQ ID NO: 134108 - DNA, 19 bp, Homo sapiens
catgatcaagatatatgtg

SEQ ID NO: 134109 - DNA, 18 bp, Homo sapiens
catgcaagacttcactgc

SEQ ID NO: 134110 - DNA, 22 bp, Homo sapiens
catgcaagacttcactgcagcc

SEQ ID NO: 134111 - DNA, 20 bp, Homo sapiens
catgcagctcttcaacatga

SEQ ID NO: 134112 - DNA, 13 bp, Homo sapiens
catgcccactgcc

SEQ ID NO: 134113 - DNA, 20 bp, Homo sapiens
catgctgaggttttgaataa

SEQ ID NO: 134114 - DNA, 16 bp, Homo sapiens
catggagacaataaac

SEQ ID NO: 134115 - DNA, 20 bp, Homo sapiens
catggagacaataaacagct

SEQ ID NO: 134116 - DNA, 17 bp, Homo sapiens
catgggaaaaagagact

SEQ ID NO: 134117 - DNA, 15 bp, Homo sapiens
catgggcgcaggccc

SEQ ID NO: 134118 - DNA, 14 bp, Homo sapiens
catgggggcaccgg

SEQ ID NO: 134119 - DNA, 13 bp, Homo sapiens
catggggtctctg

SEQ ID NO: 134120 - DNA, 23 bp, Homo sapiens
catggttcattttctgatgccca

SEQ ID NO: 134121 - DNA, 17 bp, Homo sapiens
catgtatagttgctttt

SEQ ID NO: 134122 - DNA, 19 bp, Homo sapiens
catgtcattaatcaatttc

SEQ ID NO: 134123 - DNA, 17 bp, Homo sapiens
catgtgcacctatggcc

SEQ ID NO: 134124 - DNA, 13 bp, Homo sapiens
catgtgcccctgc

SEQ ID NO: 134125 - DNA, 14 bp, Homo sapiens
catgtgcccctgcc

SEQ ID NO: 134126 - DNA, 20 bp, Homo sapiens
catgtgcccctgccaaggcc

SEQ ID NO: 134127 - DNA, 16 bp, Homo sapiens
catgttggttgcactt

SEQ ID NO: 134128 - DNA, 19 bp, Homo sapiens
cattacttctgagccccag

SEQ ID NO: 134129 - DNA, 19 bp, Homo sapiens
cattagctacttttcagaa

SEQ ID NO: 134130 - DNA, 21 bp, Homo sapiens
cattcagctgaggttcattac

SEQ ID NO: 134131 - DNA, 14 bp, Homo sapiens
cattcctaaaatgc

SEQ ID NO: 134132 - DNA, 21 bp, Homo sapiens
cattgaaatcagcatgacaaa

SEQ ID NO: 134133 - DNA, 18 bp, Homo sapiens
cattgtacaagtattaca

SEQ ID NO: 134134 - DNA, 15 bp, Homo sapiens
catttcaaaatgctt

SEQ ID NO: 134135 - DNA, 15 bp, Homo sapiens
catttcattgtacaa

SEQ ID NO: 134136 - DNA, 17 bp, Homo sapiens
catttctgtatactgta

SEQ ID NO: 134137 - DNA, 19 bp, Homo sapiens
catttctgtatactgtaaa

SEQ ID NO: 134138 - DNA, 23 bp, Homo sapiens
catttctgtatactgtaaaagtt

SEQ ID NO: 134139 - DNA, 22 bp, Homo sapiens
catttgagttattttaattatc

SEQ ID NO: 134140 - DNA, 14 bp, Homo sapiens
cattttaggaaagg

SEQ ID NO: 134141 - DNA, 21 bp, Homo sapiens
cattttattgtcagaatttag

SEQ ID NO: 134142 - DNA, 23 bp, Homo sapiens
catttttgtataaaaaggaaatt

SEQ ID NO: 134143 - DNA, 19 bp, Homo sapiens
ccaaacaccctcctggcac

SEQ ID NO: 134144 - DNA, 21 bp, Homo sapiens
ccaaaccagtttattctgtgg

SEQ ID NO: 134145 - DNA, 22 bp, Homo sapiens
ccaaaccagtttattctgtggt

SEQ ID NO: 134146 - DNA, 15 bp, Homo sapiens
ccaaatcaaaataaa

SEQ ID NO: 134147 - DNA, 13 bp, Homo sapiens
ccaaattattaat

SEQ ID NO: 134148 - DNA, 20 bp, Homo sapiens
ccaaattattaattgtcctg

SEQ ID NO: 134149 - DNA, 20 bp, Homo sapiens
ccaacaggtagcatagctct

SEQ ID NO: 134150 - DNA, 20 bp, Homo sapiens
ccaacccgttgggtcccttg

SEQ ID NO: 134151 - DNA, 21 bp, Homo sapiens
ccaacccgttgggtcccttgc

SEQ ID NO: 134152 - DNA, 22 bp, Homo sapiens
ccaagctccaaatccaaggaaa

SEQ ID NO: 134153 - DNA, 17 bp, Homo sapiens
ccaaggaaaattgaaag

SEQ ID NO: 134154 - DNA, 22 bp, Homo sapiens
ccaaggaatgtgtccaagacac

SEQ ID NO: 134155 - DNA, 13 bp, Homo sapiens
ccaaggaggtggc

SEQ ID NO: 134156 - DNA, 14 bp, Homo sapiens
ccaaggtttcccag

SEQ ID NO: 134157 - DNA, 18 bp, Homo sapiens
ccaagtcctgctcctttc

SEQ ID NO: 134158 - DNA, 20 bp, Homo sapiens
ccaagtcctgctcctttctg

SEQ ID NO: 134159 - DNA, 18 bp, Homo sapiens
ccaagtgtcctggaccct

SEQ ID NO: 134160 - DNA, 23 bp, Homo sapiens
ccaagtgtctcttgactggctca

SEQ ID NO: 134161 - DNA, 16 bp, Homo sapiens
ccaatagaaagaaact

SEQ ID NO: 134162 - DNA, 14 bp, Homo sapiens
ccagaggtggccct

SEQ ID NO: 134163 - DNA, 16 bp, Homo sapiens
ccagaggtggccctcc

SEQ ID NO: 134164 - DNA, 15 bp, Homo sapiens
ccagcattacgatcc

SEQ ID NO: 134165 - DNA, 18 bp, Homo sapiens
ccagccaaaccctgtctg

SEQ ID NO: 134166 - DNA, 14 bp, Homo sapiens
ccagccactgcagc

SEQ ID NO: 134167 - DNA, 15 bp, Homo sapiens
ccagccactgcagca

SEQ ID NO: 134168 - DNA, 22 bp, Homo sapiens
ccagccccaatccagagaagcg

SEQ ID NO: 134169 - DNA, 15 bp, Homo sapiens
ccagcccccacagcc

SEQ ID NO: 134170 - DNA, 21 bp, Homo sapiens
ccagccccgtcccagaggccg

SEQ ID NO: 134171 - DNA, 23 bp, Homo sapiens
ccaggcaggctgggtgggaggga

SEQ ID NO: 134172 - DNA, 14 bp, Homo sapiens
ccaggctggtctca

SEQ ID NO: 134173 - DNA, 17 bp, Homo sapiens
ccagggaagctgtccct

SEQ ID NO: 134174 - DNA, 16 bp, Homo sapiens
ccagggcctgcatggg

SEQ ID NO: 134175 - DNA, 14 bp, Homo sapiens
ccaggtgaggtcca

SEQ ID NO: 134176 - DNA, 22 bp, Homo sapiens
ccaggtgaggtccaccggcccc

SEQ ID NO: 134177 - DNA, 23 bp, Homo sapiens
ccagtgagcctctgcgcctctcc

SEQ ID NO: 134178 - DNA, 17 bp, Homo sapiens
ccagtgttccccccata

SEQ ID NO: 134179 - DNA, 16 bp, Homo sapiens
ccatagagaccaggag

SEQ ID NO: 134180 - DNA, 22 bp, Homo sapiens
ccataggaagacataaaacttt

SEQ ID NO: 134181 - DNA, 17 bp, Homo sapiens
ccatcaaaggaatataa

SEQ ID NO: 134182 - DNA, 21 bp, Homo sapiens
ccatcaaaggaatataagaaa

SEQ ID NO: 134183 - DNA, 19 bp, Homo sapiens
cccctgaaacatgtgcccc

SEQ ID NO: 134184 - DNA, 19 bp, Homo sapiens
cccctgccaaggccggaga

SEQ ID NO: 134185 - DNA, 11 bp, Homo sapiens
cccctgcctcc

SEQ ID NO: 134186 - DNA, 18 bp, Homo sapiens
cccctgcctcctgcctcc

SEQ ID NO: 134187 - DNA, 20 bp, Homo sapiens
cccctgcctcctgcctcccg

SEQ ID NO: 134188 - DNA, 20 bp, Homo sapiens
cccctggcagcacagcccag

SEQ ID NO: 134189 - DNA, 18 bp, Homo sapiens
cccgccaccctgtctcag

SEQ ID NO: 134190 - DNA, 19 bp, Homo sapiens
cccgccccctccctgctcc

SEQ ID NO: 134191 - DNA, 23 bp, Homo sapiens
cccgcttagttcttgaattgtta

SEQ ID NO: 134192 - DNA, 18 bp, Homo sapiens
cccggagcaggggtctga

SEQ ID NO: 134193 - DNA, 13 bp, Homo sapiens
cccggtgaggcca

SEQ ID NO: 134194 - DNA, 19 bp, Homo sapiens
cccgtccccctagagactc

SEQ ID NO: 134195 - DNA, 21 bp, Homo sapiens
ccctagaggacactaggagac

SEQ ID NO: 134196 - DNA, 12 bp, Homo sapiens
ccctattttaag

SEQ ID NO: 134197 - DNA, 14 bp, Homo sapiens
ccctattttgccat

SEQ ID NO: 134198 - DNA, 14 bp, Homo sapiens
ccctcggtggctgc

SEQ ID NO: 134199 - DNA, 16 bp, Homo sapiens
ccctcggtggctgcac

SEQ ID NO: 134200 - DNA, 18 bp, Homo sapiens
ccctcggtggctgcacag

SEQ ID NO: 134201 - DNA, 11 bp, Homo sapiens
ccctctccctg

SEQ ID NO: 134202 - DNA, 18 bp, Homo sapiens
ccctctctgtggctccaa

SEQ ID NO: 134203 - DNA, 17 bp, Homo sapiens
ccctgaaacatgtgccc

SEQ ID NO: 134204 - DNA, 19 bp, Homo sapiens
ccctgaaacatgtgcccct

SEQ ID NO: 134205 - DNA, 22 bp, Homo sapiens
ccctgaaacatgtgcccctgcc

SEQ ID NO: 134206 - DNA, 20 bp, Homo sapiens
ccctgaaacgagaagtgccc

SEQ ID NO: 134207 - DNA, 13 bp, Homo sapiens
ccctgcctcctgc

SEQ ID NO: 134208 - DNA, 17 bp, Homo sapiens
ccctgcctcctgcctcc

SEQ ID NO: 134209 - DNA, 13 bp, Homo sapiens
ccctgctcccagc

SEQ ID NO: 134210 - DNA, 15 bp, Homo sapiens
ccctggcagcacagc

SEQ ID NO: 134211 - DNA, 16 bp, Homo sapiens
ccctggcagcacagcc

SEQ ID NO: 134212 - DNA, 20 bp, Homo sapiens
ccctggcagcacagcccagg

SEQ ID NO: 134213 - DNA, 21 bp, Homo sapiens
ccctggcagcacagcccaggg

SEQ ID NO: 134214 - DNA, 22 bp, Homo sapiens
ccctggcagcacagcccagggc

SEQ ID NO: 134215 - DNA, 23 bp, Homo sapiens
ccctggtgggcctcgacgtccct

SEQ ID NO: 134216 - DNA, 17 bp, Homo sapiens
cccttcctcctctcctg

SEQ ID NO: 134217 - DNA, 18 bp, Homo sapiens
cccttcctcctctcctgg

SEQ ID NO: 134218 - DNA, 22 bp, Homo sapiens
cccttcctcctctcctggaaac

SEQ ID NO: 134219 - DNA, 22 bp, Homo sapiens
cccttctaccccacctgacctc

SEQ ID NO: 134220 - DNA, 23 bp, Homo sapiens
cccttgctgcaaacccatgaagc

SEQ ID NO: 134221 - DNA, 15 bp, Homo sapiens
cccttggatcagagg

SEQ ID NO: 134222 - DNA, 13 bp, Homo sapiens
ccgacttttctaa

SEQ ID NO: 134223 - DNA, 16 bp, Homo sapiens
ccgaggagccccagcc

SEQ ID NO: 134224 - DNA, 21 bp, Homo sapiens
ccgaggagccccagccccgtc

SEQ ID NO: 134225 - DNA, 21 bp, Homo sapiens
ccgcagccacaccgctggctc

SEQ ID NO: 134226 - DNA, 12 bp, Homo sapiens
ccgctggctccg

SEQ ID NO: 134227 - DNA, 13 bp, Homo sapiens
ccgctggctccgc

SEQ ID NO: 134228 - DNA, 22 bp, Homo sapiens
ccgctggtgcctcccgggacga

SEQ ID NO: 134229 - DNA, 20 bp, Homo sapiens
ccggagacccacagccctga

SEQ ID NO: 134230 - DNA, 13 bp, Homo sapiens
ccgtagtctcctg

SEQ ID NO: 134231 - DNA, 14 bp, Homo sapiens
ccgtagtctcctgg

SEQ ID NO: 134232 - DNA, 12 bp, Homo sapiens
ccgtcccagagg

SEQ ID NO: 134233 - DNA, 20 bp, Homo sapiens
cctaaagaggaaaagtgcaa

SEQ ID NO: 134234 - DNA, 22 bp, Homo sapiens
cctaatgaaagtgatgacatat

SEQ ID NO: 134235 - DNA, 21 bp, Homo sapiens
cctagaggacactaggagact

SEQ ID NO: 134236 - DNA, 14 bp, Homo sapiens
cctagatatgaata

SEQ ID NO: 134237 - DNA, 17 bp, Homo sapiens
cctagccccacccagag

SEQ ID NO: 134238 - DNA, 18 bp, Homo sapiens
cctagccccacccagagg

SEQ ID NO: 134239 - DNA, 18 bp, Homo sapiens
cctagcccttctacccca

SEQ ID NO: 134240 - DNA, 21 bp, Homo sapiens
cctagcccttctaccccacct

SEQ ID NO: 134241 - DNA, 20 bp, Homo sapiens
cctagcttttaaaaaatatt

SEQ ID NO: 134242 - DNA, 16 bp, Homo sapiens
cctatatctgtttgta

SEQ ID NO: 134243 - DNA, 22 bp, Homo sapiens
cctatatgagaagaatagccta

SEQ ID NO: 134244 - DNA, 14 bp, Homo sapiens
cctatgcaataaaa

SEQ ID NO: 134245 - DNA, 20 bp, Homo sapiens
cctatggcccagccactgca

SEQ ID NO: 134246 - DNA, 11 bp, Homo sapiens
cctcagccccc

SEQ ID NO: 134247 - DNA, 12 bp, Homo sapiens
cctcagctccct

SEQ ID NO: 134248 - DNA, 19 bp, Homo sapiens
cctcaggaaagaatagaaa

SEQ ID NO: 134249 - DNA, 17 bp, Homo sapiens
cctcaggattgtttctc

SEQ ID NO: 134250 - DNA, 12 bp, Homo sapiens
cctccacccact

SEQ ID NO: 134251 - DNA, 12 bp, Homo sapiens
cctccacgtgat

SEQ ID NO: 134252 - DNA, 13 bp, Homo sapiens
cctcccaccccca

SEQ ID NO: 134253 - DNA, 23 bp, Homo sapiens
cctccccaaaagaaaccatgaca

SEQ ID NO: 134254 - DNA, 14 bp, Homo sapiens
cctccccgccccct

SEQ ID NO: 134255 - DNA, 18 bp, Homo sapiens
cctccccgccccctgaaa

SEQ ID NO: 134256 - DNA, 18 bp, Homo sapiens
cctcctcagcccccaggc

SEQ ID NO: 134257 - DNA, 14 bp, Homo sapiens
cctcggctgtctcc

SEQ ID NO: 134258 - DNA, 15 bp, Homo sapiens
cctcggctgtctcct

SEQ ID NO: 134259 - DNA, 21 bp, Homo sapiens
cctcggctgtctcctgtcccc

SEQ ID NO: 134260 - DNA, 17 bp, Homo sapiens
cctcggtggctgcacag

SEQ ID NO: 134261 - DNA, 18 bp, Homo sapiens
cctcggtggctgcacaga

SEQ ID NO: 134262 - DNA, 21 bp, Homo sapiens
cctcggtggctgcacagaagg

SEQ ID NO: 134263 - DNA, 22 bp, Homo sapiens
cctctagctgttcttttttgta

SEQ ID NO: 134264 - DNA, 16 bp, Homo sapiens
cctctcccacccaagg

SEQ ID NO: 134265 - DNA, 19 bp, Homo sapiens
ccctcccgtagtctcctgg

SEQ ID NO: 134266 - DNA, 20 bp, Homo sapiens
ccctgaaacatgtgcccctg

SEQ ID NO: 134267 - DNA, 15 bp, Homo sapiens
ccctgaaacgagaag

SEQ ID NO: 134268 - DNA, 23 bp, Homo sapiens
ccctgaaacgagaagtgccctta

SEQ ID NO: 134269 - DNA, 22 bp, Homo sapiens
ccctgcctcctgcctcccgcct

SEQ ID NO: 134270 - DNA, 12 bp, Homo sapiens
ccctgctcccag

SEQ ID NO: 134271 - DNA, 21 bp, Homo sapiens
ccctggaataaatttcgcaat

SEQ ID NO: 134272 - DNA, 23 bp, Homo sapiens
ccctggcagcacagcccagggcc

SEQ ID NO: 134273 - DNA, 19 bp, Homo sapiens
cccttcctcctctcctgga

SEQ ID NO: 134274 - DNA, 15 bp, Homo sapiens
cccttctaccccacc

SEQ ID NO: 134275 - DNA, 17 bp, Homo sapiens
cccttctaccccacctg

SEQ ID NO: 134276 - DNA, 17 bp, Homo sapiens
cccttggatcagaggtc

SEQ ID NO: 134277 - DNA, 20 bp, Homo sapiens
cccttggggtggtgctgggt

SEQ ID NO: 134278 - DNA, 21 bp, Homo sapiens
cccttggggtggtgctgggtc

SEQ ID NO: 134279 - DNA, 18 bp, Homo sapiens
ccctttgtattataattg

SEQ ID NO: 134280 - DNA, 21 bp, Homo sapiens
ccctttgtattataattgttg

SEQ ID NO: 134281 - DNA, 15 bp, Homo sapiens
ccgaggagccccagc

SEQ ID NO: 134282 - DNA, 19 bp, Homo sapiens
ccgaggagccccagccccg

SEQ ID NO: 134283 - DNA, 22 bp, Homo sapiens
ccgcagccacaccgctggctcc

SEQ ID NO: 134284 - DNA, 14 bp, Homo sapiens
ctatgtttcatctt

SEQ ID NO: 134285 - DNA, 15 bp, Homo sapiens
ctatgtttcatcttg

SEQ ID NO: 134286 - DNA, 16 bp, Homo sapiens
ctattaagatttccaa

SEQ ID NO: 134287 - DNA, 18 bp, Homo sapiens
ctattacttgaactttcc

SEQ ID NO: 134288 - DNA, 17 bp, Homo sapiens
ctattacttttctgttt

SEQ ID NO: 134289 - DNA, 20 bp, Homo sapiens
ctattacttttctgtttagt

SEQ ID NO: 134290 - DNA, 14 bp, Homo sapiens
ctattagcaactgt

SEQ ID NO: 134291 - DNA, 20 bp, Homo sapiens
ctcaatagttcttaaaatta

SEQ ID NO: 134292 - DNA, 22 bp, Homo sapiens
ctcaccccatcccacaccctgg

SEQ ID NO: 134293 - DNA, 21 bp, Homo sapiens
ctcactgttgaattttctcta

SEQ ID NO: 134294 - DNA, 17 bp, Homo sapiens
ctcagaggacccacctg

SEQ ID NO: 134295 - DNA, 20 bp, Homo sapiens
ctcagcctccggagtagctg

SEQ ID NO: 134296 - DNA, 14 bp, Homo sapiens
ctcagcgaggtgta

SEQ ID NO: 134297 - DNA, 17 bp, Homo sapiens
ctcagctcagctgggcc

SEQ ID NO: 134298 - DNA, 21 bp, Homo sapiens
ctcagctccctgaccccctgt

SEQ ID NO: 134299 - DNA, 19 bp, Homo sapiens
ctcagctgggccactcctc

SEQ ID NO: 134300 - DNA, 20 bp, Homo sapiens
ctcaggaaagaatagaaaga

SEQ ID NO: 134301 - DNA, 21 bp, Homo sapiens
ctcaggaaagaatagaaagaa

SEQ ID NO: 134302 - DNA, 21 bp, Homo sapiens
ctcaggcgatccacctgtctc

SEQ ID NO: 134303 - DNA, 14 bp, Homo sapiens
ctcatcatattttg

SEQ ID NO: 134304 - DNA, 18 bp, Homo sapiens
ctcatgcaagacttcact

SEQ ID NO: 134305 - DNA, 23 bp, Homo sapiens
ctcatgcaagacttcactgcagc

SEQ ID NO: 134306 - DNA, 14 bp, Homo sapiens
ctcatttaaatatc

SEQ ID NO: 134307 - DNA, 19 bp, Homo sapiens
ctccaaatccaaggaaaca

SEQ ID NO: 134308 - DNA, 15 bp, Homo sapiens
ctccaggcatcactg

SEQ ID NO: 134309 - DNA, 15 bp, Homo sapiens
ctccatgcctctgga

SEQ ID NO: 134310 - DNA, 20 bp, Homo sapiens
ctccatgcctctggaggcct

SEQ ID NO: 134311 - DNA, 21 bp, Homo sapiens
ctcccagctctctctcctgga

SEQ ID NO: 134312 - DNA, 16 bp, Homo sapiens
ctccccaaaagaaacc

SEQ ID NO: 134313 - DNA, 14 bp, Homo sapiens
ctccccgccccctg

SEQ ID NO: 134314 - DNA, 17 bp, Homo sapiens
ctccccgccccctgaaa

SEQ ID NO: 134315 - DNA, 15 bp, Homo sapiens
ctcccctattttaag

SEQ ID NO: 134316 - DNA, 19 bp, Homo sapiens
ctcccctccccgccccctg

SEQ ID NO: 134317 - DNA, 21 bp, Homo sapiens
ctcccctccccgccccctgaa

SEQ ID NO: 134318 - DNA, 14 bp, Homo sapiens
ctcccgccaccctg

SEQ ID NO: 134319 - DNA, 20 bp, Homo sapiens
ctcccgccaccctgtctcag

SEQ ID NO: 134320 - DNA, 22 bp, Homo sapiens
ctcccgcctcccgccaccctgt

SEQ ID NO: 134321 - DNA, 18 bp, Homo sapiens
ctcccgtagtctcctggg

SEQ ID NO: 134322 - DNA, 14 bp, Homo sapiens
ctccctttttatat

SEQ ID NO: 134323 - DNA, 15 bp, Homo sapiens
ctccctttttgggta

SEQ ID NO: 134324 - DNA, 22 bp, Homo sapiens
ctccgctggatggggagtctca

SEQ ID NO: 134325 - DNA, 16 bp, Homo sapiens
ctccggcctgtaatca

SEQ ID NO: 134326 - DNA, 14 bp, Homo sapiens
ctcctcagccccca

SEQ ID NO: 134327 - DNA, 16 bp, Homo sapiens
ctcctctgggcctggg

SEQ ID NO: 134328 - DNA, 15 bp, Homo sapiens
ctcctcttcacccac

SEQ ID NO: 134329 - DNA, 13 bp, Homo sapiens
ctcctgcctcccg

SEQ ID NO: 134330 - DNA, 18 bp, Homo sapiens
ctcctggagtctgaagcc

SEQ ID NO: 134331 - DNA, 12 bp, Homo sapiens
ctcctggctccc

SEQ ID NO: 134332 - DNA, 15 bp, Homo sapiens
ctcctttctgcccag

SEQ ID NO: 134333 - DNA, 16 bp, Homo sapiens
ctcctttctgcccagc

SEQ ID NO: 134334 - DNA, 23 bp, Homo sapiens
ctcgaagaacaatgtcagaaact

SEQ ID NO: 134335 - DNA, 14 bp, Homo sapiens
ctcgacgtcccttg

SEQ ID NO: 134336 - DNA, 23 bp, Homo sapiens
ctcgagcagtcctgcctcagcct

SEQ ID NO: 134337 - DNA, 16 bp, Homo sapiens
ctcggctgtctcctgt

SEQ ID NO: 134338 - DNA, 21 bp, Homo sapiens
ctcggctgtctcctgtccccg

SEQ ID NO: 134339 - DNA, 14 bp, Homo sapiens
ctctagctgttctt

SEQ ID NO: 134340 - DNA, 13 bp, Homo sapiens
ctctccctcccct

SEQ ID NO: 134341 - DNA, 19 bp, Homo sapiens
ctctcctggagtctgaagc

SEQ ID NO: 134342 - DNA, 17 bp, Homo sapiens
ctctctgctgagctggg

SEQ ID NO: 134343 - DNA, 21 bp, Homo sapiens
ctctctgctgagctgggccca

SEQ ID NO: 134344 - DNA, 17 bp, Homo sapiens
ctctctgtggctccaac

SEQ ID NO: 134345 - DNA, 13 bp, Homo sapiens
ctctgcaagaggg

SEQ ID NO: 134346 - DNA, 17 bp, Homo sapiens
ctctgcaagagggggca

SEQ ID NO: 134347 - DNA, 19 bp, Homo sapiens
ctctgcagatagtgcctct

SEQ ID NO: 134348 - DNA, 18 bp, Homo sapiens
ctctgcagggtgaagcac

SEQ ID NO: 134349 - DNA, 21 bp, Homo sapiens
ctctgcagggtgaagcaccag

SEQ ID NO: 134350 - DNA, 14 bp, Homo sapiens
ctctgcatcttcag

SEQ ID NO: 134351 - DNA, 20 bp, Homo sapiens
ctctgcgcctctccactgtt

SEQ ID NO: 134352 - DNA, 15 bp, Homo sapiens
ctctgctgagctggg

SEQ ID NO: 134353 - DNA, 19 bp, Homo sapiens
ctctgctgagctgggccca

SEQ ID NO: 134354 - DNA, 20 bp, Homo sapiens
ctctgctgagctgggcccag

SEQ ID NO: 134355 - DNA, 18 bp, Homo sapiens
ctctgctggcccagccaa

SEQ ID NO: 134356 - DNA, 16 bp, Homo sapiens
ctctggaggcctctgg

SEQ ID NO: 134357 - DNA, 16 bp, Homo sapiens
ctctggccctcggtgg

SEQ ID NO: 134358 - DNA, 13 bp, Homo sapiens
ctctgggcctggg

SEQ ID NO: 134359 - DNA, 13 bp, Homo sapiens
ctctgtggctcca

SEQ ID NO: 134360 - DNA, 17 bp, Homo sapiens
ctctgtggctccaaccc

SEQ ID NO: 134361 - DNA, 13 bp, Homo sapiens
ctctgttttgtaa

SEQ ID NO: 134362 - DNA, 15 bp, Homo sapiens
ctcttattttacaat

SEQ ID NO: 134363 - DNA, 14 bp, Homo sapiens
ctcttgactggctc

SEQ ID NO: 134364 - DNA, 13 bp, Homo sapiens
ctgaaacatgtgc

SEQ ID NO: 134365 - DNA, 19 bp, Homo sapiens
ctgaaacatgtgcccctgc

SEQ ID NO: 134366 - DNA, 19 bp, Homo sapiens
ctgaaacgagaagtgccct

SEQ ID NO: 134367 - DNA, 21 bp, Homo sapiens
ctgaaacgagaagtgccctta

SEQ ID NO: 134368 - DNA, 15 bp, Homo sapiens
cctgtccataaagta

SEQ ID NO: 134369 - DNA, 16 bp, Homo sapiens
cctgtccataaagtaa

SEQ ID NO: 134370 - DNA, 13 bp, Homo sapiens
cctgtctcagcct

SEQ ID NO: 134371 - DNA, 11 bp, Homo sapiens
cctgtgtctta

SEQ ID NO: 134372 - DNA, 23 bp, Homo sapiens
cctgttattttttatttccacat

SEQ ID NO: 134373 - DNA, 17 bp, Homo sapiens
cctgttgggggcttcag

SEQ ID NO: 134374 - DNA, 23 bp, Homo sapiens
cctgttgggggcttcaggtctct

SEQ ID NO: 134375 - DNA, 22 bp, Homo sapiens
ccttaaggatcaccccagcccc

SEQ ID NO: 134376 - DNA, 23 bp, Homo sapiens
ccttaaggatcaccccagccccc

SEQ ID NO: 134377 - DNA, 17 bp, Homo sapiens
ccttctccctagccctt

SEQ ID NO: 134378 - DNA, 16 bp, Homo sapiens
ccttctgttaagaaag

SEQ ID NO: 134379 - DNA, 21 bp, Homo sapiens
ccttctgttaagaaaggatat

SEQ ID NO: 134380 - DNA, 21 bp, Homo sapiens
ccttgagggtgcttgttccct

SEQ ID NO: 134381 - DNA, 15 bp, Homo sapiens
ccttggaataaagtt

SEQ ID NO: 134382 - DNA, 15 bp, Homo sapiens
ccttggatcagaggt

SEQ ID NO: 134383 - DNA, 19 bp, Homo sapiens
ccttggatcagaggtcatc

SEQ ID NO: 134384 - DNA, 15 bp, Homo sapiens
ccttgggagaactaa

SEQ ID NO: 134385 - DNA, 21 bp, Homo sapiens
ccctgaaacatgtgcccctgc

SEQ ID NO: 134386 - DNA, 18 bp, Homo sapiens
ccctgaaacgagaagtgc

SEQ ID NO: 134387 - DNA, 16 bp, Homo sapiens
ccctgagttctgacac

SEQ ID NO: 134388 - DNA, 21 bp, Homo sapiens
ccctgagttctgacactgtgt

SEQ ID NO: 134389 - DNA, 21 bp, Homo sapiens
ccctgcagcttggagaactcc

SEQ ID NO: 134390 - DNA, 16 bp, Homo sapiens
ccctgcctcctgcctc

SEQ ID NO: 134391 - DNA, 13 bp, Homo sapiens
ccctgcggagacc

SEQ ID NO: 134392 - DNA, 16 bp, Homo sapiens
ccctgttgggggcttc

SEQ ID NO: 134393 - DNA, 19 bp, Homo sapiens
ccctgttgggggcttcagg

SEQ ID NO: 134394 - DNA, 20 bp, Homo sapiens
cccttgctgcaaacccatga

SEQ ID NO: 134395 - DNA, 22 bp, Homo sapiens
cccttgctgcaaacccatgaag

SEQ ID NO: 134396 - DNA, 12 bp, Homo sapiens
cccttggatcag

SEQ ID NO: 134397 - DNA, 16 bp, Homo sapiens
cccttggatcagaggt

SEQ ID NO: 134398 - DNA, 23 bp, Homo sapiens
cccttggggtggtgctgggtcat

SEQ ID NO: 134399 - DNA, 15 bp, Homo sapiens
ccctttttaaaaaat

SEQ ID NO: 134400 - DNA, 17 bp, Homo sapiens
ccctttttaaaaaatac

SEQ ID NO: 134401 - DNA, 22 bp, Homo sapiens
ccctttttaaaaaataccattg

SEQ ID NO: 134402 - DNA, 18 bp, Homo sapiens
ccgagcggtgtggggacc

SEQ ID NO: 134403 - DNA, 14 bp, Homo sapiens
ccgaggagccccag

SEQ ID NO: 134404 - DNA, 20 bp, Homo sapiens
ccgatgcccaatccaggccc

SEQ ID NO: 134405 - DNA, 12 bp, Homo sapiens
ccgcagccacac

SEQ ID NO: 134406 - DNA, 14 bp, Homo sapiens
ccgcagccacaccg

SEQ ID NO: 134407 - DNA, 16 bp, Homo sapiens
ccgcagccacaccgct

SEQ ID NO: 134408 - DNA, 23 bp, Homo sapiens
ccgcagccacaccgctggctccg

SEQ ID NO: 134409 - DNA, 22 bp, Homo sapiens
ccgccccctgaaacatgtgccc

SEQ ID NO: 134410 - DNA, 23 bp, Homo sapiens
ccgccctccacccactaggtgaa

SEQ ID NO: 134411 - DNA, 17 bp, Homo sapiens
ccgcctcccgccaccct

SEQ ID NO: 134412 - DNA, 16 bp, Homo sapiens
ccggagacccacagcc

SEQ ID NO: 134413 - DNA, 23 bp, Homo sapiens
ccggagacccacagccctgaaac

SEQ ID NO: 134414 - DNA, 20 bp, Homo sapiens
ccggagcaggggtctgagcc

SEQ ID NO: 134415 - DNA, 12 bp, Homo sapiens
ccggcccctggc

SEQ ID NO: 134416 - DNA, 19 bp, Homo sapiens
ccggcggggtgcctgctgt

SEQ ID NO: 134417 - DNA, 23 bp, Homo sapiens
ccggctcgagcagtcctgcctca

SEQ ID NO: 134418 - DNA, 12 bp, Homo sapiens
ccgggactgggg

SEQ ID NO: 134419 - DNA, 19 bp, Homo sapiens
ccgggctccatgcctctgg

SEQ ID NO: 134420 - DNA, 12 bp, Homo sapiens
ccgggctctgac

SEQ ID NO: 134421 - DNA, 14 bp, Homo sapiens
ccggtgaggccaag

SEQ ID NO: 134422 - DNA, 18 bp, Homo sapiens
ccgtccccctagagactc

SEQ ID NO: 134423 - DNA, 16 bp, Homo sapiens
ccgttgggtcccttgc

SEQ ID NO: 134424 - DNA, 22 bp, Homo sapiens
cctaaaaggaaatctcacccca

SEQ ID NO: 134425 - DNA, 23 bp, Homo sapiens
cctaaaaggaaatctcaccccat

SEQ ID NO: 134426 - DNA, 12 bp, Homo sapiens
cctagagactca

SEQ ID NO: 134427 - DNA, 23 bp, Homo sapiens
cctagaggacactaggagactgg

SEQ ID NO: 134428 - DNA, 15 bp, Homo sapiens
cctagatatgaatat

SEQ ID NO: 134429 - DNA, 21 bp, Homo sapiens
cctagatatgaatatatggca

SEQ ID NO: 134430 - DNA, 12 bp, Homo sapiens
cctagccccacc

SEQ ID NO: 134431 - DNA, 13 bp, Homo sapiens
cctagccccaccc

SEQ ID NO: 134432 - DNA, 22 bp, Homo sapiens
cctagccccacccagaggtggc

SEQ ID NO: 134433 - DNA, 16 bp, Homo sapiens
cctagcttttaaaaaa

SEQ ID NO: 134434 - DNA, 23 bp, Homo sapiens
cctaggtcatgaaggacactctg

SEQ ID NO: 134435 - DNA, 15 bp, Homo sapiens
cctagtttttctaat

SEQ ID NO: 134436 - DNA, 19 bp, Homo sapiens
cctatatctgtttgtatat

SEQ ID NO: 134437 - DNA, 20 bp, Homo sapiens
cctatatctgtttgtatatt

SEQ ID NO: 134438 - DNA, 16 bp, Homo sapiens
cctatggcccagccac

SEQ ID NO: 134439 - DNA, 20 bp, Homo sapiens
cctcactattacttgaactt

SEQ ID NO: 134440 - DNA, 17 bp, Homo sapiens
cctcagctcagctgggc

SEQ ID NO: 134441 - DNA, 14 bp, Homo sapiens
cctcagctccctga

SEQ ID NO: 134442 - DNA, 17 bp, Homo sapiens
cctcagctccctgaccc

SEQ ID NO: 134443 - DNA, 18 bp, Homo sapiens
cctcaggaaagaatagaa

SEQ ID NO: 134444 - DNA, 21 bp, Homo sapiens
cctcaggaaagaatagaaaga

SEQ ID NO: 134445 - DNA, 15 bp, Homo sapiens
cctcagtgctgcaat

SEQ ID NO: 134446 - DNA, 12 bp, Homo sapiens
cctcccaggctg

SEQ ID NO: 134447 - DNA, 19 bp, Homo sapiens
cctccccgccccctgaaac

SEQ ID NO: 134448 - DNA, 23 bp, Homo sapiens
cctccccggctcgagcagtcctg

SEQ ID NO: 134449 - DNA, 17 bp, Homo sapiens
cctcccgtagtctcctg

SEQ ID NO: 134450 - DNA, 19 bp, Homo sapiens
cctcccgtagtctcctggg

SEQ ID NO: 134451 - DNA, 20 bp, Homo sapiens
cctcccgtagtctcctgggt

SEQ ID NO: 134452 - DNA, 15 bp, Homo sapiens
cctccctgctcccag

SEQ ID NO: 134453 - DNA, 16 bp, Homo sapiens
cctcctcagcccccag

SEQ ID NO: 134454 - DNA, 13 bp, Homo sapiens
cctcctctcctgg

SEQ ID NO: 134455 - DNA, 20 bp, Homo sapiens
cctcctgtgtggaagaagga

SEQ ID NO: 134456 - DNA, 16 bp, Homo sapiens
cctccttctccctttt

SEQ ID NO: 134457 - DNA, 16 bp, Homo sapiens
cctcggctgtctcctg

SEQ ID NO: 134458 - DNA, 18 bp, Homo sapiens
cctcggctgtctcctgtc

SEQ ID NO: 134459 - DNA, 15 bp, Homo sapiens
cctctagctgttctt

SEQ ID NO: 134460 - DNA, 13 bp, Homo sapiens
cctctcccaccca

SEQ ID NO: 134461 - DNA, 14 bp, Homo sapiens
cctctcccacccaa

SEQ ID NO: 134462 - DNA, 10 bp, Homo sapiens
cctctccctg

SEQ ID NO: 134463 - DNA, 18 bp, Homo sapiens
cctctcctggaaacagac

SEQ ID NO: 134464 - DNA, 17 bp, Homo sapiens
cctctggaggcctctgg

SEQ ID NO: 134465 - DNA, 10 bp, Homo sapiens
cctctggccc

SEQ ID NO: 134466 - DNA, 12 bp, Homo sapiens
cctctggccctc

SEQ ID NO: 134467 - DNA, 12 bp, Homo sapiens
cctctggccctt

SEQ ID NO: 134468 - DNA, 14 bp, Homo sapiens
cctctggcccttgg

SEQ ID NO: 134469 - DNA, 20 bp, Homo sapiens
cctctgggcctggggtgcat

SEQ ID NO: 134470 - DNA, 13 bp, Homo sapiens
ctgaactgtttgg

SEQ ID NO: 134471 - DNA, 17 bp, Homo sapiens
ctgaacttccaagctcc

SEQ ID NO: 134472 - DNA, 12 bp, Homo sapiens
ctgaagctgggg

SEQ ID NO: 134473 - DNA, 19 bp, Homo sapiens
ctgaaggttttttttttaa

SEQ ID NO: 134474 - DNA, 21 bp, Homo sapiens
ctgaaggttttttttttaagt

SEQ ID NO: 134475 - DNA, 22 bp, Homo sapiens
ctgaaggttttttttttaagtg

SEQ ID NO: 134476 - DNA, 20 bp, Homo sapiens
ctgacagccctgcggagacc

SEQ ID NO: 134477 - DNA, 12 bp, Homo sapiens
ctgacagcctcc

SEQ ID NO: 134478 - DNA, 13 bp, Homo sapiens
ctgacagcctccc

SEQ ID NO: 134479 - DNA, 17 bp, Homo sapiens
ctgacagcctcccaccc

SEQ ID NO: 134480 - DNA, 17 bp, Homo sapiens
ctgacggtttctccccg

SEQ ID NO: 134481 - DNA, 17 bp, Homo sapiens
ctgagctgggcccagcc

SEQ ID NO: 134482 - DNA, 19 bp, Homo sapiens
ctgagctgggcccagcccc

SEQ ID NO: 134483 - DNA, 20 bp, Homo sapiens
ctgaggttttgaataaaaag

SEQ ID NO: 134484 - DNA, 23 bp, Homo sapiens
ctgaggttttgaataaaaagtga

SEQ ID NO: 134485 - DNA, 16 bp, Homo sapiens
ctgagtccatgaaaat

SEQ ID NO: 134486 - DNA, 16 bp, Homo sapiens
cctgcctcctgcctcc

SEQ ID NO: 134487 - DNA, 20 bp, Homo sapiens
cctgctcctttctgcccagc

SEQ ID NO: 134488 - DNA, 21 bp, Homo sapiens
cctgctgcttggagtgcccca

SEQ ID NO: 134489 - DNA, 22 bp, Homo sapiens
cctggaaacagacagggagaag

SEQ ID NO: 134490 - DNA, 23 bp, Homo sapiens
cctggaaacagacagggagaagt

SEQ ID NO: 134491 - DNA, 14 bp, Homo sapiens
cctggaccctggcc

SEQ ID NO: 134492 - DNA, 23 bp, Homo sapiens
cctggagtctgaagcctgcaggt

SEQ ID NO: 134493 - DNA, 20 bp, Homo sapiens
cctggcagcacagcccaggg

SEQ ID NO: 134494 - DNA, 15 bp, Homo sapiens
cctggcggaggtgga

SEQ ID NO: 134495 - DNA, 16 bp, Homo sapiens
cctgggccaaggactc

SEQ ID NO: 134496 - DNA, 18 bp, Homo sapiens
cctgggccaaggactcca

SEQ ID NO: 134497 - DNA, 19 bp, Homo sapiens
cctgggcggggccgcagcc

SEQ ID NO: 134498 - DNA, 21 bp, Homo sapiens
cctgggcggggccgcagccac

SEQ ID NO: 134499 - DNA, 22 bp, Homo sapiens
cctgggcggggccgcagccaca

SEQ ID NO: 134500 - DNA, 15 bp, Homo sapiens
cctggtgggcctcga

SEQ ID NO: 134501 - DNA, 20 bp, Homo sapiens
cctgtaatcagctctcctgg

SEQ ID NO: 134502 - DNA, 23 bp, Homo sapiens
cctgtccccggcggggtgcctgc

SEQ ID NO: 134503 - DNA, 14 bp, Homo sapiens
cctgtgtctatgta

SEQ ID NO: 134504 - DNA, 21 bp, Homo sapiens
cctgtgtggaagaaggaaaca

SEQ ID NO: 134505 - DNA, 16 bp, Homo sapiens
ccttcccctccttctc

SEQ ID NO: 134506 - DNA, 13 bp, Homo sapiens
ccttctgttaaga

SEQ ID NO: 134507 - DNA, 16 bp, Homo sapiens
ccttggatcagaggtc

SEQ ID NO: 134508 - DNA, 17 bp, Homo sapiens
ccttggatcagaggtca

SEQ ID NO: 134509 - DNA, 16 bp, Homo sapiens
ccttggcatgggcgca

SEQ ID NO: 134510 - DNA, 22 bp, Homo sapiens
ccttggcatgggcgcaggccca

SEQ ID NO: 134511 - DNA, 14 bp, Homo sapiens
cctttctgcccagc

SEQ ID NO: 134512 - DNA, 21 bp, Homo sapiens
cctttctgcccagcctgctca

SEQ ID NO: 134513 - DNA, 11 bp, Homo sapiens
cctttgtatta

SEQ ID NO: 134514 - DNA, 15 bp, Homo sapiens
cctttgtattataat

SEQ ID NO: 134515 - DNA, 23 bp, Homo sapiens
cctttgtattataattgttgata

SEQ ID NO: 134516 - DNA, 12 bp, Homo sapiens
cctttttcatgt

SEQ ID NO: 134517 - DNA, 16 bp, Homo sapiens
cgaaaacccccagcat

SEQ ID NO: 134518 - DNA, 19 bp, Homo sapiens
cgacatcctagccccaccc

SEQ ID NO: 134519 - DNA, 14 bp, Homo sapiens
cgagacaggagcag

SEQ ID NO: 134520 - DNA, 22 bp, Homo sapiens
cgagcactctaattagagaact

SEQ ID NO: 134521 - DNA, 21 bp, Homo sapiens
cgagcagtcctgcctcagcct

SEQ ID NO: 134522 - DNA, 15 bp, Homo sapiens
cgagctacaaagcat

SEQ ID NO: 134523 - DNA, 13 bp, Homo sapiens
cgaggagccccag

SEQ ID NO: 134524 - DNA, 15 bp, Homo sapiens
cgcacttacaagtgg

SEQ ID NO: 134525 - DNA, 11 bp, Homo sapiens
cgcaggcccag

SEQ ID NO: 134526 - DNA, 12 bp, Homo sapiens
cgcaggcccagt

SEQ ID NO: 134527 - DNA, 13 bp, Homo sapiens
cgcaggcccagtg

SEQ ID NO: 134528 - DNA, 18 bp, Homo sapiens
cgccctccacccactagg

SEQ ID NO: 134529 - DNA, 17 bp, Homo sapiens
cgctctaccctgcagct

SEQ ID NO: 134530 - DNA, 21 bp, Homo sapiens
cgctctaccctgcagcttgga

SEQ ID NO: 134531 - DNA, 22 bp, Homo sapiens
cgctgttgatcccctctctgtg

SEQ ID NO: 134532 - DNA, 14 bp, Homo sapiens
cgcttcccacctgc

SEQ ID NO: 134533 - DNA, 21 bp, Homo sapiens
cgcttccttagccttgctcag

SEQ ID NO: 134534 - DNA, 16 bp, Homo sapiens
cgcttctctcttttaa

SEQ ID NO: 134535 - DNA, 17 bp, Homo sapiens
cggaggtggagtggcca

SEQ ID NO: 134536 - DNA, 17 bp, Homo sapiens
cggcaccagtgcctcag

SEQ ID NO: 134537 - DNA, 15 bp, Homo sapiens
cgggctctgacagcc

SEQ ID NO: 134538 - DNA, 13 bp, Homo sapiens
cggggccgcagcc

SEQ ID NO: 134539 - DNA, 16 bp, Homo sapiens
cggggccgcagccaca

SEQ ID NO: 134540 - DNA, 15 bp, Homo sapiens
cggggccgggactgg

SEQ ID NO: 134541 - DNA, 15 bp, Homo sapiens
cggggtgcctgctgt

SEQ ID NO: 134542 - DNA, 11 bp, Homo sapiens
cgtcccagagg

SEQ ID NO: 134543 - DNA, 21 bp, Homo sapiens
cgtcccagaggccgctgcccc

SEQ ID NO: 134544 - DNA, 21 bp, Homo sapiens
cgtgattgattcagtatctta

SEQ ID NO: 134545 - DNA, 18 bp, Homo sapiens
cgtgttccgcttctctct

SEQ ID NO: 134546 - DNA, 15 bp, Homo sapiens
cgtgttgtatctaca

SEQ ID NO: 134547 - DNA, 17 bp, Homo sapiens
cgttagaggagcaacag

SEQ ID NO: 134548 - DNA, 13 bp, Homo sapiens
cgttatatattgt

SEQ ID NO: 134549 - DNA, 14 bp, Homo sapiens
cgttgggtcccttg

SEQ ID NO: 134550 - DNA, 15 bp, Homo sapiens
ctaaaagaagagagg

SEQ ID NO: 134551 - DNA, 14 bp, Homo sapiens
ctaaaagtgcattt

SEQ ID NO: 134552 - DNA, 16 bp, Homo sapiens
ctaaaagtgcatttaa

SEQ ID NO: 134553 - DNA, 17 bp, Homo sapiens
ctaaaagtgcatttaag

SEQ ID NO: 134554 - DNA, 21 bp, Homo sapiens
ctaaaagtgcatttaaggaga

SEQ ID NO: 134555 - DNA, 15 bp, Homo sapiens
ctaaataaacacgat

SEQ ID NO: 134556 - DNA, 20 bp, Homo sapiens
ctaaataaacacgattttat

SEQ ID NO: 134557 - DNA, 21 bp, Homo sapiens
ctaaccagggaagctgtccct

SEQ ID NO: 134558 - DNA, 13 bp, Homo sapiens
ctaatgtgatcat

SEQ ID NO: 134559 - DNA, 21 bp, Homo sapiens
ctacaaagcatgggaaaaaga

SEQ ID NO: 134560 - DNA, 22 bp, Homo sapiens
ctacaaagcatgggaaaaagag

SEQ ID NO: 134561 - DNA, 14 bp, Homo sapiens
ctacactgggtgct

SEQ ID NO: 134562 - DNA, 15 bp, Homo sapiens
ctacagtaatgaaat

SEQ ID NO: 134563 - DNA, 14 bp, Homo sapiens
ctacagtttttcct

SEQ ID NO: 134564 - DNA, 13 bp, Homo sapiens
ctaccccacctga

SEQ ID NO: 134565 - DNA, 15 bp, Homo sapiens
ctaccctgcagcttg

SEQ ID NO: 134566 - DNA, 11 bp, Homo sapiens
ctactgtgtaa

SEQ ID NO: 134567 - DNA, 14 bp, Homo sapiens
ctacttatcatttt

SEQ ID NO: 134568 - DNA, 20 bp, Homo sapiens
ctacttatcatttttgtata

SEQ ID NO: 134569 - DNA, 14 bp, Homo sapiens
ctagaatcatactt

SEQ ID NO: 134570 - DNA, 24 bp, Homo sapiens
ctagatatgaatatatggcatttg

SEQ ID NO: 134571 - DNA, 12 bp, Homo sapiens
ctagccccaccc

SEQ ID NO: 134572 - DNA, 14 bp, Homo sapiens
ctagccccacccag

SEQ ID NO: 134573 - DNA, 15 bp, Homo sapiens
ctattacttgaactt

SEQ ID NO: 134574 - DNA, 20 bp, Homo sapiens
ctattacttgaactttccaa

SEQ ID NO: 134575 - DNA, 21 bp, Homo sapiens
ctattacttgaactttccaaa

SEQ ID NO: 134576 - DNA, 13 bp, Homo sapiens
ctattacttttct

SEQ ID NO: 134577 - DNA, 20 bp, Homo sapiens
ctattgggccctagaggaca

SEQ ID NO: 134578 - DNA, 19 bp, Homo sapiens
ctattttaagacgtgaatg

SEQ ID NO: 134579 - DNA, 18 bp, Homo sapiens
ctcaaagatgatggaaac

SEQ ID NO: 134580 - DNA, 12 bp, Homo sapiens
ctcaccccatcc

SEQ ID NO: 134581 - DNA, 19 bp, Homo sapiens
ctcaccccatcccacaccc

SEQ ID NO: 134582 - DNA, 16 bp, Homo sapiens
ctcagcccccaggcca

SEQ ID NO: 134583 - DNA, 18 bp, Homo sapiens
ctcagcccccaggccagg

SEQ ID NO: 134584 - DNA, 20 bp, Homo sapiens
ctcagcctcccagagtgctg

SEQ ID NO: 134585 - DNA, 16 bp, Homo sapiens
ctcagctcagctgggc

SEQ ID NO: 134586 - DNA, 18 bp, Homo sapiens
ctcagctcagctgggcca

SEQ ID NO: 134587 - DNA, 16 bp, Homo sapiens
ctcagctccctgaccc

SEQ ID NO: 134588 - DNA, 13 bp, Homo sapiens
ctgcagcttggag

SEQ ID NO: 134589 - DNA, 20 bp, Homo sapiens
ctgcaggtccggggaggagg

SEQ ID NO: 134590 - DNA, 20 bp, Homo sapiens
ctgcatgggggcaccgggct

SEQ ID NO: 134591 - DNA, 21 bp, Homo sapiens
ctgcatgggggcaccgggctc

SEQ ID NO: 134592 - DNA, 12 bp, Homo sapiens
ctgccaaaacaa

SEQ ID NO: 134593 - DNA, 17 bp, Homo sapiens
ctgcccagcctgctcag

SEQ ID NO: 134594 - DNA, 24 bp, Homo sapiens
ctgccccgtccccctagagactca

SEQ ID NO: 134595 - DNA, 14 bp, Homo sapiens
ctgcccctgagttc

SEQ ID NO: 134596 - DNA, 19 bp, Homo sapiens
ctgcctgccccacccaccc

SEQ ID NO: 134597 - DNA, 21 bp, Homo sapiens
ctgcctgccccacccacccca

SEQ ID NO: 134598 - DNA, 18 bp, Homo sapiens
ctgcggagaccctgagtc

SEQ ID NO: 134599 - DNA, 20 bp, Homo sapiens
ctgctcccagctctctctcc

SEQ ID NO: 134600 - DNA, 22 bp, Homo sapiens
ctgctcccagctctctctcctg

SEQ ID NO: 134601 - DNA, 23 bp, Homo sapiens
ctgctcccagctctctctcctgg

SEQ ID NO: 134602 - DNA, 18 bp, Homo sapiens
ctgctcctttctgcccag

SEQ ID NO: 134603 - DNA, 23 bp, Homo sapiens
ctgctcctttctgcccagcctgc

SEQ ID NO: 134604 - DNA, 19 bp, Homo sapiens
ctgctgagctgggcccagc

SEQ ID NO: 134605 - DNA, 18 bp, Homo sapiens
ctgcttggagtgccccaa

SEQ ID NO: 134606 - DNA, 20 bp, Homo sapiens
ctgcttggagtgccccaagg

SEQ ID NO: 134607 - DNA, 23 bp, Homo sapiens
ctgcttggagtgccccaaggagg

SEQ ID NO: 134608 - DNA, 16 bp, Homo sapiens
ctggaaacagacaggg

SEQ ID NO: 134609 - DNA, 19 bp, Homo sapiens
ctggcaaagttatatttac

SEQ ID NO: 134610 - DNA, 14 bp, Homo sapiens
ctggcacttgcctg

SEQ ID NO: 134611 - DNA, 19 bp, Homo sapiens
ctggcacttgcctgctgct

SEQ ID NO: 134612 - DNA, 17 bp, Homo sapiens
ctggcagcacagcccag

SEQ ID NO: 134613 - DNA, 17 bp, Homo sapiens
ctggcccagccaaaccc

SEQ ID NO: 134614 - DNA, 20 bp, Homo sapiens
ctggcccagccaaaccctgt

SEQ ID NO: 134615 - DNA, 23 bp, Homo sapiens
ctggcccagccaaaccctgtctg

SEQ ID NO: 134616 - DNA, 14 bp, Homo sapiens
ctggccctcagctc

SEQ ID NO: 134617 - DNA, 17 bp, Homo sapiens
ctggccctcagctccct

SEQ ID NO: 134618 - DNA, 19 bp, Homo sapiens
ctggcccttggaataaagt

SEQ ID NO: 134619 - DNA, 19 bp, Homo sapiens
ctggccttgaaaccacctt

SEQ ID NO: 134620 - DNA, 22 bp, Homo sapiens
ctgggaccacaggttcatgcca

SEQ ID NO: 134621 - DNA, 16 bp, Homo sapiens
ctgggcacccctgcct

SEQ ID NO: 134622 - DNA, 18 bp, Homo sapiens
ctgggcacccctgcctcc

SEQ ID NO: 134623 - DNA, 20 bp, Homo sapiens
ctgggcccagcccctccacg

SEQ ID NO: 134624 - DNA, 14 bp, Homo sapiens
ctgggcctggggtg

SEQ ID NO: 134625 - DNA, 16 bp, Homo sapiens
ctgggcggggccgcag

SEQ ID NO: 134626 - DNA, 22 bp, Homo sapiens
ctgggcggggccgcagccacac

SEQ ID NO: 134627 - DNA, 15 bp, Homo sapiens
ctgggggcggggcct

SEQ ID NO: 134628 - DNA, 20 bp, Homo sapiens
ctgggtcattacttctgagc

SEQ ID NO: 134629 - DNA, 21 bp, Homo sapiens
ctgggtcattacttctgagcc

SEQ ID NO: 134630 - DNA, 22 bp, Homo sapiens
ctgggtgtgtttggcttggcct

SEQ ID NO: 134631 - DNA, 18 bp, Homo sapiens
ctggtatttatctgcaag

SEQ ID NO: 134632 - DNA, 19 bp, Homo sapiens
ctggttaggacaaaaagac

SEQ ID NO: 134633 - DNA, 16 bp, Homo sapiens
ctggtttgtttgctta

SEQ ID NO: 134634 - DNA, 23 bp, Homo sapiens
ctggtttgtttgcttaatttcct

SEQ ID NO: 134635 - DNA, 16 bp, Homo sapiens
ctgtaaaagttataat

SEQ ID NO: 134636 - DNA, 18 bp, Homo sapiens
ctgtaaaagttataataa

SEQ ID NO: 134637 - DNA, 21 bp, Homo sapiens
ctgtaaaagttataataactg

SEQ ID NO: 134638 - DNA, 13 bp, Homo sapiens
ctgtacttcccaa

SEQ ID NO: 134639 - DNA, 14 bp, Homo sapiens
ctgtataatctatt

SEQ ID NO: 134640 - DNA, 20 bp, Homo sapiens
ctgtcccaagtcctgctcct

SEQ ID NO: 134641 - DNA, 23 bp, Homo sapiens
ctgtccccggcggggtgcctgct

SEQ ID NO: 134642 - DNA, 13 bp, Homo sapiens
ctgtccctcactg

SEQ ID NO: 134643 - DNA, 22 bp, Homo sapiens
ctgtcctaggtcatgaaggaca

SEQ ID NO: 134644 - DNA, 16 bp, Homo sapiens
ctgtctcagcctccca

SEQ ID NO: 134645 - DNA, 20 bp, Homo sapiens
ctgtctcagtacctcccctc

SEQ ID NO: 134646 - DNA, 11 bp, Homo sapiens
ctgtctcctgt

SEQ ID NO: 134647 - DNA, 12 bp, Homo sapiens
ctgtctcctgtc

SEQ ID NO: 134648 - DNA, 20 bp, Homo sapiens
ctgtctgacaacctcttggt

SEQ ID NO: 134649 - DNA, 12 bp, Homo sapiens
ctgtgaatttca

SEQ ID NO: 134650 - DNA, 15 bp, Homo sapiens
ctgtgcattacaaag

SEQ ID NO: 134651 - DNA, 13 bp, Homo sapiens
ctgtggctccaac

SEQ ID NO: 134652 - DNA, 18 bp, Homo sapiens
ctgtgggcaaaagagtgt

SEQ ID NO: 134653 - DNA, 17 bp, Homo sapiens
ctgtggttctataataa

SEQ ID NO: 134654 - DNA, 22 bp, Homo sapiens
ctgtggttttattacaaatgca

SEQ ID NO: 134655 - DNA, 13 bp, Homo sapiens
ctgtgtatcatta

SEQ ID NO: 134656 - DNA, 13 bp, Homo sapiens
ctgttaagaaagg

SEQ ID NO: 134657 - DNA, 15 bp, Homo sapiens
ctgttaagaaaggat

SEQ ID NO: 134658 - DNA, 21 bp, Homo sapiens
ctgttattttttatttccaca

SEQ ID NO: 134659 - DNA, 14 bp, Homo sapiens
ctgttgatcccctc

SEQ ID NO: 134660 - DNA, 15 bp, Homo sapiens
ctgttgatcccctct

SEQ ID NO: 134661 - DNA, 22 bp, Homo sapiens
ctgttgatcccctctctgtggc

SEQ ID NO: 134662 - DNA, 15 bp, Homo sapiens
ctgttgcccgccctc

SEQ ID NO: 134663 - DNA, 13 bp, Homo sapiens
ctgttggcactta

SEQ ID NO: 134664 - DNA, 16 bp, Homo sapiens
ctgttgggggcttcag

SEQ ID NO: 134665 - DNA, 22 bp, Homo sapiens
ctgttgggggcttcaggtctct

SEQ ID NO: 134666 - DNA, 18 bp, Homo sapiens
ctgtttaaaaaaagtata

SEQ ID NO: 134667 - DNA, 21 bp, Homo sapiens
ctgtttaaaaaaagtatatat

SEQ ID NO: 134668 - DNA, 16 bp, Homo sapiens
ctgtttcatgagccca

SEQ ID NO: 134669 - DNA, 22 bp, Homo sapiens
ctgtttggtcgagtctttgtgt

SEQ ID NO: 134670 - DNA, 12 bp, Homo sapiens
cttaaaaactgt

SEQ ID NO: 134671 - DNA, 13 bp, Homo sapiens
cttaaaaactgtg

SEQ ID NO: 134672 - DNA, 15 bp, Homo sapiens
cttaaaaactgtgta

SEQ ID NO: 134673 - DNA, 20 bp, Homo sapiens
cttaaaaactgtgtatcatt

SEQ ID NO: 134674 - DNA, 21 bp, Homo sapiens
cttaaaaactgtgtatcatta

SEQ ID NO: 134675 - DNA, 13 bp, Homo sapiens
gaacttgggaggg

SEQ ID NO: 134676 - DNA, 13 bp, Homo sapiens
gaacttttgtaat

SEQ ID NO: 134677 - DNA, 15 bp, Homo sapiens
gaacttttgtaattt

SEQ ID NO: 134678 - DNA, 17 bp, Homo sapiens
gaacttttgtaatttga

SEQ ID NO: 134679 - DNA, 14 bp, Homo sapiens
gaagaatttaatgg

SEQ ID NO: 134680 - DNA, 13 bp, Homo sapiens
gaagacataaaac

SEQ ID NO: 134681 - DNA, 14 bp, Homo sapiens
gaagacataaaact

SEQ ID NO: 134682 - DNA, 18 bp, Homo sapiens
gaagagaggggaagaatt

SEQ ID NO: 134683 - DNA, 22 bp, Homo sapiens
gaagagaggggaagaatttaat

SEQ ID NO: 134684 - DNA, 13 bp, Homo sapiens
gaagatggctgtt

SEQ ID NO: 134685 - DNA, 16 bp, Homo sapiens
gaagctggccctcagc

SEQ ID NO: 134686 - DNA, 21 bp, Homo sapiens
gaagctggccctcagctccct

SEQ ID NO: 134687 - DNA, 22 bp, Homo sapiens
gaagctggccctcagctccctg

SEQ ID NO: 134688 - DNA, 12 bp, Homo sapiens
gaaggcccaggg

SEQ ID NO: 134689 - DNA, 13 bp, Homo sapiens
ctgcatcttcagt

SEQ ID NO: 134690 - DNA, 19 bp, Homo sapiens
ctgcatgggggcaccgggc

SEQ ID NO: 134691 - DNA, 23 bp, Homo sapiens
ctgcccagttggaggagactggg

SEQ ID NO: 134692 - DNA, 16 bp, Homo sapiens
ctgccccacccacccc

SEQ ID NO: 134693 - DNA, 17 bp, Homo sapiens
ctgccccacccacccca

SEQ ID NO: 134694 - DNA, 23 bp, Homo sapiens
ctgccccgtccccctagagactc

SEQ ID NO: 134695 - DNA, 13 bp, Homo sapiens
ctgccgatgccca

SEQ ID NO: 134696 - DNA, 14 bp, Homo sapiens
ctgccgatgcccaa

SEQ ID NO: 134697 - DNA, 15 bp, Homo sapiens
ctgccgatgcccaat

SEQ ID NO: 134698 - DNA, 15 bp, Homo sapiens
ctgcgccacccacca

SEQ ID NO: 134699 - DNA, 17 bp, Homo sapiens
ctgcgcctctccactgt

SEQ ID NO: 134700 - DNA, 17 bp, Homo sapiens
ctgctcctttctgccca

SEQ ID NO: 134701 - DNA, 22 bp, Homo sapiens
ctgctcctttctgcccagcctg

SEQ ID NO: 134702 - DNA, 16 bp, Homo sapiens
ctgctcgaagaacaat

SEQ ID NO: 134703 - DNA, 22 bp, Homo sapiens
ctgctgaagattcagtttaaga

SEQ ID NO: 134704 - DNA, 13 bp, Homo sapiens
ctgctgagctggg

SEQ ID NO: 134705 - DNA, 18 bp, Homo sapiens
ctgctgagctgggcccag

SEQ ID NO: 134706 - DNA, 12 bp, Homo sapiens
ctgctgaggccc

SEQ ID NO: 134707 - DNA, 14 bp, Homo sapiens
ctgctgcttggagt

SEQ ID NO: 134708 - DNA, 15 bp, Homo sapiens
ctgctggcccagcca

SEQ ID NO: 134709 - DNA, 22 bp, Homo sapiens
ctgctggcccagccaaaccctg

SEQ ID NO: 134710 - DNA, 18 bp, Homo sapiens
ctggaaacagacagggag

SEQ ID NO: 134711 - DNA, 14 bp, Homo sapiens
ctggaccctggcct

SEQ ID NO: 134712 - DNA, 18 bp, Homo sapiens
ctggaggaaccacatata

SEQ ID NO: 134713 - DNA, 13 bp, Homo sapiens
ctggaggcctctg

SEQ ID NO: 134714 - DNA, 13 bp, Homo sapiens
ctggcaagaatgg

SEQ ID NO: 134715 - DNA, 22 bp, Homo sapiens
ctggcacaacgctctaccctgc

SEQ ID NO: 134716 - DNA, 18 bp, Homo sapiens
ctggcacttgcctgctgc

SEQ ID NO: 134717 - DNA, 19 bp, Homo sapiens
ctggcagcacagcccaggg

SEQ ID NO: 134718 - DNA, 23 bp, Homo sapiens
ctggcagcacagcccagggcctg

SEQ ID NO: 134719 - DNA, 20 bp, Homo sapiens
ctggccctcagctccctgac

SEQ ID NO: 134720 - DNA, 22 bp, Homo sapiens
ctggccctcggtggctgcacag

SEQ ID NO: 134721 - DNA, 12 bp, Homo sapiens
ctggcccttgga

SEQ ID NO: 134722 - DNA, 13 bp, Homo sapiens
ctggcctaaagaa

SEQ ID NO: 134723 - DNA, 20 bp, Homo sapiens
ctggcggaggtggagtggcc

SEQ ID NO: 134724 - DNA, 21 bp, Homo sapiens
ctggcggaggtggagtggcca

SEQ ID NO: 134725 - DNA, 20 bp, Homo sapiens
ctgggcacccctgcctcctg

SEQ ID NO: 134726 - DNA, 15 bp, Homo sapiens
ctgggccaaggactc

SEQ ID NO: 134727 - DNA, 16 bp, Homo sapiens
ctgggccactcctctt

SEQ ID NO: 134728 - DNA, 16 bp, Homo sapiens
ctgggggcggggcctg

SEQ ID NO: 134729 - DNA, 22 bp, Homo sapiens
ctggggtaaaattgagtttcag

SEQ ID NO: 134730 - DNA, 13 bp, Homo sapiens
ctggggtgcatcc

SEQ ID NO: 134731 - DNA, 17 bp, Homo sapiens
ctggggtgcatcctcct

SEQ ID NO: 134732 - DNA, 13 bp, Homo sapiens
ctggtgggcctcg

SEQ ID NO: 134733 - DNA, 20 bp, Homo sapiens
ctggttccaaaccagtttat

SEQ ID NO: 134734 - DNA, 22 bp, Homo sapiens
ctggttccaaaccagtttattc

SEQ ID NO: 134735 - DNA, 14 bp, Homo sapiens
ctgtaaaagttata

SEQ ID NO: 134736 - DNA, 22 bp, Homo sapiens
ctgtaaaagttataataactga

SEQ ID NO: 134737 - DNA, 20 bp, Homo sapiens
ctgtaaacttggaatcaagg

SEQ ID NO: 134738 - DNA, 18 bp, Homo sapiens
ctgtaatcagctctcctg

SEQ ID NO: 134739 - DNA, 22 bp, Homo sapiens
ctgtacttcccaattgccacat

SEQ ID NO: 134740 - DNA, 18 bp, Homo sapiens
ctgtataatctatttaca

SEQ ID NO: 134741 - DNA, 16 bp, Homo sapiens
ctgtatactgtaaaag

SEQ ID NO: 134742 - DNA, 17 bp, Homo sapiens
ctgtatactgtaaaagt

SEQ ID NO: 134743 - DNA, 13 bp, Homo sapiens
ctgtcaaatgaac

SEQ ID NO: 134744 - DNA, 14 bp, Homo sapiens
ctgtcaaatgaact

SEQ ID NO: 134745 - DNA, 16 bp, Homo sapiens
ctgtcaaatgaacttt

SEQ ID NO: 134746 - DNA, 23 bp, Homo sapiens
ctgtcaaatgaacttttacagaa

SEQ ID NO: 134747 - DNA, 14 bp, Homo sapiens
ctgtccagtttcca

SEQ ID NO: 134748 - DNA, 22 bp, Homo sapiens
ctgtccccggcggggtgcctgc

SEQ ID NO: 134749 - DNA, 13 bp, Homo sapiens
ctgtccgtcccgc

SEQ ID NO: 134750 - DNA, 15 bp, Homo sapiens
ctgtctcctgtcccc

SEQ ID NO: 134751 - DNA, 15 bp, Homo sapiens
ctgtgaatttcaaaa

SEQ ID NO: 134752 - DNA, 19 bp, Homo sapiens
ctgtgcacccagaagaaga

SEQ ID NO: 134753 - DNA, 16 bp, Homo sapiens
ctgtggttttattaca

SEQ ID NO: 134754 - DNA, 20 bp, Homo sapiens
ctgtggttttattacaaatg

SEQ ID NO: 134755 - DNA, 15 bp, Homo sapiens
ctgtgtatcattaaa

SEQ ID NO: 134756 - DNA, 16 bp, Homo sapiens
ctgtgtatcattaaaa

SEQ ID NO: 134757 - DNA, 23 bp, Homo sapiens
ctgtgtatcattaaaatatatgt

SEQ ID NO: 134758 - DNA, 17 bp, Homo sapiens
ctgtgtcggtcagaaca

SEQ ID NO: 134759 - DNA, 15 bp, Homo sapiens
ctgttcttttttgta

SEQ ID NO: 134760 - DNA, 18 bp, Homo sapiens
ctgttgatcccctctctg

SEQ ID NO: 134761 - DNA, 14 bp, Homo sapiens
ctgttgggggcttc

SEQ ID NO: 134762 - DNA, 23 bp, Homo sapiens
ctgtttaaaaaaagtatatattc

SEQ ID NO: 134763 - DNA, 15 bp, Homo sapiens
ctgtttagttttaca

SEQ ID NO: 134764 - DNA, 18 bp, Homo sapiens
ctgtttggtcgagtcttt

SEQ ID NO: 134765 - DNA, 14 bp, Homo sapiens
ctgtttgtatattt

SEQ ID NO: 134766 - DNA, 17 bp, Homo sapiens
ctgtttgtatatttgca

SEQ ID NO: 134767 - DNA, 18 bp, Homo sapiens
ctgtttgtatatttgcaa

SEQ ID NO: 134768 - DNA, 21 bp, Homo sapiens
cttaaaatgcaatatttgtaa

SEQ ID NO: 134769 - DNA, 15 bp, Homo sapiens
cttaatatttttaca

SEQ ID NO: 134770 - DNA, 15 bp, Homo sapiens
cttagagtttacagt

SEQ ID NO: 134771 - DNA, 21 bp, Homo sapiens
cttagagtttacagtttgtgt

SEQ ID NO: 134772 - DNA, 12 bp, Homo sapiens
cttagttcttga

SEQ ID NO: 134773 - DNA, 15 bp, Homo sapiens
cttagttcttgaatt

SEQ ID NO: 134774 - DNA, 19 bp, Homo sapiens
cttagttcttgaattgtta

SEQ ID NO: 134775 - DNA, 15 bp, Homo sapiens
cttatcatttttgta

SEQ ID NO: 134776 - DNA, 16 bp, Homo sapiens
cttatttttaaaataa

SEQ ID NO: 134777 - DNA, 15 bp, Homo sapiens
cttaaaatgcaatat

SEQ ID NO: 134778 - DNA, 19 bp, Homo sapiens
cttaaaatgcaatatttgt

SEQ ID NO: 134779 - DNA, 23 bp, Homo sapiens
cttaaggatcaccccagccccca

SEQ ID NO: 134780 - DNA, 18 bp, Homo sapiens
cttaatttccttctgtta

SEQ ID NO: 134781 - DNA, 21 bp, Homo sapiens
cttaatttccttctgttaaga

SEQ ID NO: 134782 - DNA, 22 bp, Homo sapiens
cttacaagtggtgaccaaaatt

SEQ ID NO: 134783 - DNA, 19 bp, Homo sapiens
cttagagtttacagtttgt

SEQ ID NO: 134784 - DNA, 22 bp, Homo sapiens
cttagagtttacagtttgtgtt

SEQ ID NO: 134785 - DNA, 13 bp, Homo sapiens
cttagttcttgaa

SEQ ID NO: 134786 - DNA, 14 bp, Homo sapiens
cttagttcttgaat

SEQ ID NO: 134787 - DNA, 16 bp, Homo sapiens
cttagttcttgaattg

SEQ ID NO: 134788 - DNA, 18 bp, Homo sapiens
cttagttcttgaattgtt

SEQ ID NO: 134789 - DNA, 20 bp, Homo sapiens
cttagttcttgaattgttat

SEQ ID NO: 134790 - DNA, 12 bp, Homo sapiens
gaggactgaagc

SEQ ID NO: 134791 - DNA, 16 bp, Homo sapiens
gaggactgaagctggg

SEQ ID NO: 134792 - DNA, 18 bp, Homo sapiens
gaggactgaagctggggc

SEQ ID NO: 134793 - DNA, 12 bp, Homo sapiens
gaggagactggg

SEQ ID NO: 134794 - DNA, 17 bp, Homo sapiens
gaggagccccagccccg

SEQ ID NO: 134795 - DNA, 21 bp, Homo sapiens
gaggagggccgagacaggagc

SEQ ID NO: 134796 - DNA, 23 bp, Homo sapiens
gaggaggttcgggattccctggt

SEQ ID NO: 134797 - DNA, 14 bp, Homo sapiens
gaggcctctggccc

SEQ ID NO: 134798 - DNA, 16 bp, Homo sapiens
gaggcctctggccctc

SEQ ID NO: 134799 - DNA, 17 bp, Homo sapiens
gaggcctctggccctcg

SEQ ID NO: 134800 - DNA, 18 bp, Homo sapiens
gaggcctctggccctcgg

SEQ ID NO: 134801 - DNA, 16 bp, Homo sapiens
gaggctccgtgagccc

SEQ ID NO: 134802 - DNA, 18 bp, Homo sapiens
gagggccgagacaggagc

SEQ ID NO: 134803 - DNA, 20 bp, Homo sapiens
gaggggaagaatttaatgga

SEQ ID NO: 134804 - DNA, 23 bp, Homo sapiens
gaggtccaccggcccctggcagc

SEQ ID NO: 134805 - DNA, 18 bp, Homo sapiens
gaggtggagtggccactg

SEQ ID NO: 134806 - DNA, 17 bp, Homo sapiens
gaggttcgggattccct

SEQ ID NO: 134807 - DNA, 21 bp, Homo sapiens
gaggttttgaataaaaagtga

SEQ ID NO: 134808 - DNA, 16 bp, Homo sapiens
gagtaaactgaggccc

SEQ ID NO: 134809 - DNA, 14 bp, Homo sapiens
gagtccatgaaaat

SEQ ID NO: 134810 - DNA, 14 bp, Homo sapiens
gagtctttgtgtgt

SEQ ID NO: 134811 - DNA, 20 bp, Homo sapiens
gagtgaaacagagaaagaaa

SEQ ID NO: 134812 - DNA, 13 bp, Homo sapiens
gagtggccactgg

SEQ ID NO: 134813 - DNA, 22 bp, Homo sapiens
gagtgtgtttgtgtgcatgaaa

SEQ ID NO: 134814 - DNA, 11 bp, Homo sapiens
gagtttacagt

SEQ ID NO: 134815 - DNA, 23 bp, Homo sapiens
gagtttacagtttgtgttttaaa

SEQ ID NO: 134816 - DNA, 12 bp, Homo sapiens
gagtttgctaaa

SEQ ID NO: 134817 - DNA, 18 bp, Homo sapiens
gataaaataatgctttga

SEQ ID NO: 134818 - DNA, 18 bp, Homo sapiens
gataactgcaattttaat

SEQ ID NO: 134819 - DNA, 14 bp, Homo sapiens
gatagtgcctctgc

SEQ ID NO: 134820 - DNA, 21 bp, Homo sapiens
gatataaaaggatgttacaag

SEQ ID NO: 134821 - DNA, 23 bp, Homo sapiens
gatataaaaggatgttacaagtt

SEQ ID NO: 134822 - DNA, 22 bp, Homo sapiens
gatataatcttggcttcttaaa

SEQ ID NO: 134823 - DNA, 21 bp, Homo sapiens
gatatatgtgtatacatacat

SEQ ID NO: 134824 - DNA, 14 bp, Homo sapiens
gatatgaatatatg

SEQ ID NO: 134825 - DNA, 17 bp, Homo sapiens
gatatgaatatatggca

SEQ ID NO: 134826 - DNA, 22 bp, Homo sapiens
gatattgtcagagttctgctct

SEQ ID NO: 134827 - DNA, 19 bp, Homo sapiens
gatccacctgtctcagcct

SEQ ID NO: 134828 - DNA, 15 bp, Homo sapiens
gatcccctctctgtg

SEQ ID NO: 134829 - DNA, 15 bp, Homo sapiens
gatctatgtttcatc

SEQ ID NO: 134830 - DNA, 11 bp, Homo sapiens
gatgactggtc

SEQ ID NO: 134831 - DNA, 20 bp, Homo sapiens
gatgcccaccgaggagcccc

SEQ ID NO: 134832 - DNA, 23 bp, Homo sapiens
gatgcccaccgaggagccccagc

SEQ ID NO: 134833 - DNA, 23 bp, Homo sapiens
gatggggtctcacagtgttgccc

SEQ ID NO: 134834 - DNA, 17 bp, Homo sapiens
gatgttacaagtttgct

SEQ ID NO: 134835 - DNA, 20 bp, Homo sapiens
gatgttacaagtttgctaaa

SEQ ID NO: 134836 - DNA, 22 bp, Homo sapiens
gatgttacaagtttgctaaaag

SEQ ID NO: 134837 - DNA, 13 bp, Homo sapiens
gattatatatcat

SEQ ID NO: 134838 - DNA, 19 bp, Homo sapiens
gattatatatcataaagta

SEQ ID NO: 134839 - DNA, 17 bp, Homo sapiens
gattattctgattccac

SEQ ID NO: 134840 - DNA, 20 bp, Homo sapiens
gattcagtttaagagttttc

SEQ ID NO: 134841 - DNA, 13 bp, Homo sapiens
gattccctctccc

SEQ ID NO: 134842 - DNA, 23 bp, Homo sapiens
gattccctctcccacccaaggag

SEQ ID NO: 134843 - DNA, 11 bp, Homo sapiens
gattccctggt

SEQ ID NO: 134844 - DNA, 15 bp, Homo sapiens
gattctctattggct

SEQ ID NO: 134845 - DNA, 22 bp, Homo sapiens
gattgattcagtatcttagagt

SEQ ID NO: 134846 - DNA, 15 bp, Homo sapiens
gattgtattgctgtc

SEQ ID NO: 134847 - DNA, 19 bp, Homo sapiens
gatttccagtgagtgtaaa

SEQ ID NO: 134848 - DNA, 12 bp, Homo sapiens
gcaaaagagtgt

SEQ ID NO: 134849 - DNA, 21 bp, Homo sapiens
gcaaaatcaacatgactggtg

SEQ ID NO: 134850 - DNA, 17 bp, Homo sapiens
gcaaacccatgaagctg

SEQ ID NO: 134851 - DNA, 19 bp, Homo sapiens
gcaaacccatgaagctggc

SEQ ID NO: 134852 - DNA, 21 bp, Homo sapiens
gcaaatagcgtgggatagatt

SEQ ID NO: 134853 - DNA, 22 bp, Homo sapiens
gcaacaatacatgctgctaatt

SEQ ID NO: 134854 - DNA, 21 bp, Homo sapiens
gcaagaatggtggcttctttt

SEQ ID NO: 134855 - DNA, 17 bp, Homo sapiens
gcaagaattaaaactga

SEQ ID NO: 134856 - DNA, 21 bp, Homo sapiens
gcaagacttcactgcagcctt

SEQ ID NO: 134857 - DNA, 22 bp, Homo sapiens
gcaagacttcactgcagccttt

SEQ ID NO: 134858 - DNA, 16 bp, Homo sapiens
gcaataaaattatttg

SEQ ID NO: 134859 - DNA, 14 bp, Homo sapiens
gcaattatattgtc

SEQ ID NO: 134860 - DNA, 16 bp, Homo sapiens
gcacagaagggctctt

SEQ ID NO: 134861 - DNA, 14 bp, Homo sapiens
gcacagcccagggc

SEQ ID NO: 134862 - DNA, 21 bp, Homo sapiens
gcacatctgcattttcacccc

SEQ ID NO: 134863 - DNA, 16 bp, Homo sapiens
gcaccagggagaggcc

SEQ ID NO: 134864 - DNA, 15 bp, Homo sapiens
gcaccagtgcctcag

SEQ ID NO: 134865 - DNA, 22 bp, Homo sapiens
gcaccagtgcctcagtgctgca

SEQ ID NO: 134866 - DNA, 12 bp, Homo sapiens
gcacccctgcct

SEQ ID NO: 134867 - DNA, 15 bp, Homo sapiens
gcacccctgcctcct

SEQ ID NO: 134868 - DNA, 16 bp, Homo sapiens
gcaccgggctccatgc

SEQ ID NO: 134869 - DNA, 22 bp, Homo sapiens
gcaccgggctccatgcctctgg

SEQ ID NO: 134870 - DNA, 22 bp, Homo sapiens
gcacctatggcccagccactgc

SEQ ID NO: 134871 - DNA, 21 bp, Homo sapiens
gcacttataggtaacgtgatt

SEQ ID NO: 134872 - DNA, 11 bp, Homo sapiens
gcactttgtag

SEQ ID NO: 134873 - DNA, 15 bp, Homo sapiens
gcagatagtgcctct

SEQ ID NO: 134874 - DNA, 23 bp, Homo sapiens
gcagatctttttgtgaaattcaa

SEQ ID NO: 134875 - DNA, 17 bp, Homo sapiens
gcagcacagcccagggc

SEQ ID NO: 134876 - DNA, 20 bp, Homo sapiens
gcagcacagcccagggcctg

SEQ ID NO: 134877 - DNA, 15 bp, Homo sapiens
gcagcacaggaggct

SEQ ID NO: 134878 - DNA, 13 bp, Homo sapiens
gcagcatgtatag

SEQ ID NO: 134879 - DNA, 20 bp, Homo sapiens
gcagccaaggaatgtgtcca

SEQ ID NO: 134880 - DNA, 16 bp, Homo sapiens
gcagcctttcacagga

SEQ ID NO: 134881 - DNA, 18 bp, Homo sapiens
gcagcctttgcctccccg

SEQ ID NO: 134882 - DNA, 15 bp, Homo sapiens
gcaggggtctgagcc

SEQ ID NO: 134883 - DNA, 17 bp, Homo sapiens
gcaggggtctgagccac

SEQ ID NO: 134884 - DNA, 21 bp, Homo sapiens
gcatgacaaaaataacactgt

SEQ ID NO: 134885 - DNA, 20 bp, Homo sapiens
gcatgggcgcaggcccagtg

SEQ ID NO: 134886 - DNA, 21 bp, Homo sapiens
gcatgggggcaccgggctcca

SEQ ID NO: 134887 - DNA, 22 bp, Homo sapiens
gcatggttcattttctgatgcc

SEQ ID NO: 134888 - DNA, 23 bp, Homo sapiens
gcattaaaaaaaaaaaaaaactc

SEQ ID NO: 134889 - DNA, 15 bp, Homo sapiens
gcatttaaggagatt

SEQ ID NO: 134890 - DNA, 16 bp, Homo sapiens
gcatttaaggagattg

SEQ ID NO: 134891 - DNA, 17 bp, Homo sapiens
gtctcagtacctcccct

SEQ ID NO: 134892 - DNA, 17 bp, Homo sapiens
gtctcgctttgttgccc

SEQ ID NO: 134893 - DNA, 13 bp, Homo sapiens
gtctctgctggcc

SEQ ID NO: 134894 - DNA, 16 bp, Homo sapiens
gtctctgctggcccag

SEQ ID NO: 134895 - DNA, 17 bp, Homo sapiens
gtctcttgactggctca

SEQ ID NO: 134896 - DNA, 16 bp, Homo sapiens
gtctgaagcctgcagg

SEQ ID NO: 134897 - DNA, 13 bp, Homo sapiens
gtctttaaatcat

SEQ ID NO: 134898 - DNA, 18 bp, Homo sapiens
gtctttgtgtgttatatt

SEQ ID NO: 134899 - DNA, 20 bp, Homo sapiens
gtctttgtgtgttatattcc

SEQ ID NO: 134900 - DNA, 21 bp, Homo sapiens
gtctttttctttttttggtaa

SEQ ID NO: 134901 - DNA, 17 bp, Homo sapiens
gtgaaacagagaaagaa

SEQ ID NO: 134902 - DNA, 19 bp, Homo sapiens
gtgaaacagagaaagaaaa

SEQ ID NO: 134903 - DNA, 23 bp, Homo sapiens
gtgaaacagagaaagaaaaggca

SEQ ID NO: 134904 - DNA, 18 bp, Homo sapiens
gtgaacttgggagggggc

SEQ ID NO: 134905 - DNA, 20 bp, Homo sapiens
gtgaacttttgtaatttgaa

SEQ ID NO: 134906 - DNA, 23 bp, Homo sapiens
gtgacaaagactcctctgggcct

SEQ ID NO: 134907 - DNA, 21 bp, Homo sapiens
gtgagatataggataaaataa

SEQ ID NO: 134908 - DNA, 19 bp, Homo sapiens
gtgaggctgggcagggcct

SEQ ID NO: 134909 - DNA, 12 bp, Homo sapiens
gtgagtgtaaat

SEQ ID NO: 134910 - DNA, 14 bp, Homo sapiens
gtgcaacatttctg

SEQ ID NO: 134911 - DNA, 23 bp, Homo sapiens
gtgcaacatttctgtatactgta

SEQ ID NO: 134912 - DNA, 18 bp, Homo sapiens
gtgcaattccaagaaaat

SEQ ID NO: 134913 - DNA, 19 bp, Homo sapiens
gtgcaattccaagaaaata

SEQ ID NO: 134914 - DNA, 17 bp, Homo sapiens
gtgcacctatggcccag

SEQ ID NO: 134915 - DNA, 23 bp, Homo sapiens
gtgcacctatggcccagccactg

SEQ ID NO: 134916 - DNA, 16 bp, Homo sapiens
gtgcagcgggccaggc

SEQ ID NO: 134917 - DNA, 19 bp, Homo sapiens
gtgcagcgggccaggcagg

SEQ ID NO: 134918 - DNA, 13 bp, Homo sapiens
gtgcagtagtgca

SEQ ID NO: 134919 - DNA, 23 bp, Homo sapiens
gtgcatcctcctcagcccccagg

SEQ ID NO: 134920 - DNA, 14 bp, Homo sapiens
gtgccccaaggagg

SEQ ID NO: 134921 - DNA, 14 bp, Homo sapiens
gtgcctcagtgctg

SEQ ID NO: 134922 - DNA, 18 bp, Homo sapiens
gtgctgcaattgagggct

SEQ ID NO: 134923 - DNA, 22 bp, Homo sapiens
gtgctgggtcattacttctgag

SEQ ID NO: 134924 - DNA, 19 bp, Homo sapiens
gtggaattttgagaaaaat

SEQ ID NO: 134925 - DNA, 23 bp, Homo sapiens
gtggactgaaccgacttttctaa

SEQ ID NO: 134926 - DNA, 23 bp, Homo sapiens
gtggccactggcacttgcctgct

SEQ ID NO: 134927 - DNA, 16 bp, Homo sapiens
gtgggcaaaagagtgt

SEQ ID NO: 134928 - DNA, 21 bp, Homo sapiens
gtgggcctcgacgtcccttgg

SEQ ID NO: 134929 - DNA, 13 bp, Homo sapiens
gtgggtgaggctg

SEQ ID NO: 134930 - DNA, 14 bp, Homo sapiens
gtgggtgaggctgg

SEQ ID NO: 134931 - DNA, 14 bp, Homo sapiens
gtgggtgggaatgc

SEQ ID NO: 134932 - DNA, 13 bp, Homo sapiens
gtgtatcattaaa

SEQ ID NO: 134933 - DNA, 22 bp, Homo sapiens
gtgtgtattcttaaaatgcaat

SEQ ID NO: 134934 - DNA, 19 bp, Homo sapiens
gtgtgttatattccaagga

SEQ ID NO: 134935 - DNA, 20 bp, Homo sapiens
gtgtgttatattccaaggaa

SEQ ID NO: 134936 - DNA, 19 bp, Homo sapiens
gtgttatattccaaggaaa

SEQ ID NO: 134937 - DNA, 20 bp, Homo sapiens
gtgttccccccatagagacc

SEQ ID NO: 134938 - DNA, 20 bp, Homo sapiens
gtgttgcccaggctggtctc

SEQ ID NO: 134939 - DNA, 15 bp, Homo sapiens
gtgtttggcttggcc

SEQ ID NO: 134940 - DNA, 19 bp, Homo sapiens
gtgttttaaaaaaactgaa

SEQ ID NO: 134941 - DNA, 20 bp, Homo sapiens
gtgttttaaaaaaactgaag

SEQ ID NO: 134942 - DNA, 18 bp, Homo sapiens
gttaaccacccgccccgc

SEQ ID NO: 134943 - DNA, 15 bp, Homo sapiens
gttactgttgcagct

SEQ ID NO: 134944 - DNA, 19 bp, Homo sapiens
gttataataactgaactgt

SEQ ID NO: 134945 - DNA, 22 bp, Homo sapiens
gttataattttcctttttcatg

SEQ ID NO: 134946 - DNA, 17 bp, Homo sapiens
gttatattccaaggaaa

SEQ ID NO: 134947 - DNA, 23 bp, Homo sapiens
gttatattccaaggaaaattgaa

SEQ ID NO: 134948 - DNA, 12 bp, Homo sapiens
gttatgaaaatc

SEQ ID NO: 134949 - DNA, 16 bp, Homo sapiens
gttatttcttaaaatt

SEQ ID NO: 134950 - DNA, 16 bp, Homo sapiens
gttcatgccaccatgg

SEQ ID NO: 134951 - DNA, 22 bp, Homo sapiens
gttccgcttctctcttttaaag

SEQ ID NO: 134952 - DNA, 18 bp, Homo sapiens
gttcgggattccctggtg

SEQ ID NO: 134953 - DNA, 21 bp, Homo sapiens
gttctcagtggtcaccttcct

SEQ ID NO: 134954 - DNA, 15 bp, Homo sapiens
gttctgcaagaatta

SEQ ID NO: 134955 - DNA, 21 bp, Homo sapiens
gttctgcaagaattaaaactg

SEQ ID NO: 134956 - DNA, 12 bp, Homo sapiens
gttcttaaaatt

SEQ ID NO: 134957 - DNA, 13 bp, Homo sapiens
gttcttgaattgt

SEQ ID NO: 134958 - DNA, 16 bp, Homo sapiens
gttgatcccctctctg

SEQ ID NO: 134959 - DNA, 16 bp, Homo sapiens
gttgcccgccctccac

SEQ ID NO: 134960 - DNA, 12 bp, Homo sapiens
gttggcacttat

SEQ ID NO: 134961 - DNA, 22 bp, Homo sapiens
gttgtcaagtctctgctggccc

SEQ ID NO: 134962 - DNA, 12 bp, Homo sapiens
gtttaatagaaa

SEQ ID NO: 134963 - DNA, 16 bp, Homo sapiens
gtttaatagaaaatta

SEQ ID NO: 134964 - DNA, 14 bp, Homo sapiens
gtttacagtttgtg

SEQ ID NO: 134965 - DNA, 21 bp, Homo sapiens
gtttattctgtggttctataa

SEQ ID NO: 134966 - DNA, 17 bp, Homo sapiens
gtttcagaataaaatta

SEQ ID NO: 134967 - DNA, 21 bp, Homo sapiens
gtttccaaagggcagtaaagt

SEQ ID NO: 134968 - DNA, 20 bp, Homo sapiens
gtttcccagtgagcctctgc

SEQ ID NO: 134969 - DNA, 20 bp, Homo sapiens
gtttccttattgaaaaatca

SEQ ID NO: 134970 - DNA, 22 bp, Homo sapiens
gtttcggccttcataatggcct

SEQ ID NO: 134971 - DNA, 22 bp, Homo sapiens
gtttctcggcaccagtgcctca

SEQ ID NO: 134972 - DNA, 17 bp, Homo sapiens
gtttgctaaaagaagag

SEQ ID NO: 134973 - DNA, 17 bp, Homo sapiens
gtttgcttaatttcctt

SEQ ID NO: 134974 - DNA, 17 bp, Homo sapiens
gtttggcttggccttgg

SEQ ID NO: 134975 - DNA, 14 bp, Homo sapiens
gtttgtgtgcatga

SEQ ID NO: 134976 - DNA, 15 bp, Homo sapiens
gtttgtgttttaaaa

SEQ ID NO: 134977 - DNA, 12 bp, Homo sapiens
gtttgtttgctt

SEQ ID NO: 134978 - DNA, 16 bp, Homo sapiens
gttttaaaaaaactga

SEQ ID NO: 134979 - DNA, 18 bp, Homo sapiens
gttttaaaaaaactgaag

SEQ ID NO: 134980 - DNA, 19 bp, Homo sapiens
gttttaaaaaaactgaagg

SEQ ID NO: 134981 - DNA, 23 bp, Homo sapiens
gttttaaaaaaactgaaggtttt

SEQ ID NO: 134982 - DNA, 17 bp, Homo sapiens
gttttgaataaaaagtg

SEQ ID NO: 134983 - DNA, 15 bp, Homo sapiens
gttttgatataatct

SEQ ID NO: 134984 - DNA, 21 bp, Homo sapiens
ggctccatgcctctggaggcc

SEQ ID NO: 134985 - DNA, 17 bp, Homo sapiens
ggctccgtgagcccttg

SEQ ID NO: 134986 - DNA, 21 bp, Homo sapiens
ggctcgagcagtcctgcctca

SEQ ID NO: 134987 - DNA, 18 bp, Homo sapiens
ggctgggtgggagggagg

SEQ ID NO: 134988 - DNA, 12 bp, Homo sapiens
ggctgtctcctg

SEQ ID NO: 134989 - DNA, 15 bp, Homo sapiens
ggctgtctcctgtcc

SEQ ID NO: 134990 - DNA, 17 bp, Homo sapiens
ggctgttaaccacccgc

SEQ ID NO: 134991 - DNA, 15 bp, Homo sapiens
ggcttaaggagagga

SEQ ID NO: 134992 - DNA, 21 bp, Homo sapiens
gtcctgctcctttctgcccag

SEQ ID NO: 134993 - DNA, 22 bp, Homo sapiens
gtcctgctcctttctgcccagc

SEQ ID NO: 134994 - DNA, 20 bp, Homo sapiens
gtcgagcactctaattagag

SEQ ID NO: 134995 - DNA, 23 bp, Homo sapiens
gtctccagtgttccccccataga

SEQ ID NO: 134996 - DNA, 16 bp, Homo sapiens
gtctcgctttgttgcc

SEQ ID NO: 134997 - DNA, 14 bp, Homo sapiens
gtctttgtgtgtta

SEQ ID NO: 134998 - DNA, 19 bp, Homo sapiens
gtctttgtgtgttatattc

SEQ ID NO: 134999 - DNA, 18 bp, Homo sapiens
gtcttttttttttccaaa

SEQ ID NO: 135000 - DNA, 22 bp, Homo sapiens
gtgaaattcaacctgtgtctta

SEQ ID NO: 135001 - DNA, 21 bp, Homo sapiens
gtgaacagcaggatgccctgt

SEQ ID NO: 135002 - DNA, 16 bp, Homo sapiens
gtgaacttttgtaatt

SEQ ID NO: 135003 - DNA, 19 bp, Homo sapiens
gtgaacttttgtaatttga

SEQ ID NO: 135004 - DNA, 22 bp, Homo sapiens
gtgaagcaccagggagaggcct

SEQ ID NO: 135005 - DNA, 20 bp, Homo sapiens
gtgagcacgttggcgaggaa

SEQ ID NO: 135006 - DNA, 12 bp, Homo sapiens
gtgaggctgggc

SEQ ID NO: 135007 - DNA, 15 bp, Homo sapiens
gtgaggctgggcagg

SEQ ID NO: 135008 - DNA, 15 bp, Homo sapiens
gtgatggagggaagg

SEQ ID NO: 135009 - DNA, 21 bp, Homo sapiens
gtgcaatgcgtgttgtacata

SEQ ID NO: 135010 - DNA, 20 bp, Homo sapiens
gtgcaattccaagaaaatat

SEQ ID NO: 135011 - DNA, 13 bp, Homo sapiens
gtgcatcctcctc

SEQ ID NO: 135012 - DNA, 20 bp, Homo sapiens
gtgcatcctcctcagccccc

SEQ ID NO: 135013 - DNA, 21 bp, Homo sapiens
gtgcatcctcctcagccccca

SEQ ID NO: 135014 - DNA, 15 bp, Homo sapiens
gtgcatgaaagagaa

SEQ ID NO: 135015 - DNA, 13 bp, Homo sapiens
gtgcatttaagga

SEQ ID NO: 135016 - DNA, 15 bp, Homo sapiens
gtgcatttaaggaga

SEQ ID NO: 135017 - DNA, 11 bp, Homo sapiens
gtgcccctgcc

SEQ ID NO: 135018 - DNA, 12 bp, Homo sapiens
gtgcccctgcca

SEQ ID NO: 135019 - DNA, 18 bp, Homo sapiens
gtgcctcagtgctgcaat

SEQ ID NO: 135020 - DNA, 11 bp, Homo sapiens
gtgcctgctgt

SEQ ID NO: 135021 - DNA, 20 bp, Homo sapiens
gtggaattttgagaaaaata

SEQ ID NO: 135022 - DNA, 14 bp, Homo sapiens
gtggccctcccagg

SEQ ID NO: 135023 - DNA, 15 bp, Homo sapiens
gtggccctcccaggc

SEQ ID NO: 135024 - DNA, 19 bp, Homo sapiens
gtggctgttaaccacccgc

SEQ ID NO: 135025 - DNA, 15 bp, Homo sapiens
gtgtatcattaaaat

SEQ ID NO: 135026 - DNA, 21 bp, Homo sapiens
gtgtatcattaaaatatatgt

SEQ ID NO: 135027 - DNA, 21 bp, Homo sapiens
gtgtattcttaaaatgcaata

SEQ ID NO: 135028 - DNA, 15 bp, Homo sapiens
gtgtgatggagggaa

SEQ ID NO: 135029 - DNA, 14 bp, Homo sapiens
gtgtgtattcttaa

SEQ ID NO: 135030 - DNA, 18 bp, Homo sapiens
gtgtgttatattccaagg

SEQ ID NO: 135031 - DNA, 13 bp, Homo sapiens
gtgttatattcca

SEQ ID NO: 135032 - DNA, 12 bp, Homo sapiens
gtgttcccccca

SEQ ID NO: 135033 - DNA, 12 bp, Homo sapiens
gttaagaaagga

SEQ ID NO: 135034 - DNA, 14 bp, Homo sapiens
gttaagaaaggata

SEQ ID NO: 135035 - DNA, 20 bp, Homo sapiens
gttacaagtttgctaaaaga

SEQ ID NO: 135036 - DNA, 22 bp, Homo sapiens
gttagcgtttcggccttcataa

SEQ ID NO: 135037 - DNA, 16 bp, Homo sapiens
gttataataactgaac

SEQ ID NO: 135038 - DNA, 17 bp, Homo sapiens
gttataataactgaact

SEQ ID NO: 135039 - DNA, 18 bp, Homo sapiens
gttataataactgaactg

SEQ ID NO: 135040 - DNA, 23 bp, Homo sapiens
gttataattttcctttttcatgt

SEQ ID NO: 135041 - DNA, 14 bp, Homo sapiens
gttatatattgtat

SEQ ID NO: 135042 - DNA, 21 bp, Homo sapiens
gttatatattgtattaagggc

SEQ ID NO: 135043 - DNA, 23 bp, Homo sapiens
gttatatattgtattaagggcat

SEQ ID NO: 135044 - DNA, 16 bp, Homo sapiens
gttatattccaaggaa

SEQ ID NO: 135045 - DNA, 21 bp, Homo sapiens
gttatattccaaggaaaattg

SEQ ID NO: 135046 - DNA, 22 bp, Homo sapiens
gttatgaaaatcctatatctgt

SEQ ID NO: 135047 - DNA, 22 bp, Homo sapiens
gttccaaaccagtttattctgt

SEQ ID NO: 135048 - DNA, 17 bp, Homo sapiens
gttccctctccctgttg

SEQ ID NO: 135049 - DNA, 17 bp, Homo sapiens
gttctgcaagaattaaa

SEQ ID NO: 135050 - DNA, 19 bp, Homo sapiens
gttctgcaagaattaaaac

SEQ ID NO: 135051 - DNA, 20 bp, Homo sapiens
gttctgcaagaattaaaact

SEQ ID NO: 135052 - DNA, 15 bp, Homo sapiens
gttcttgaattgtta

SEQ ID NO: 135053 - DNA, 18 bp, Homo sapiens
gttcttgaattgttatga

SEQ ID NO: 135054 - DNA, 15 bp, Homo sapiens
gttcttttttgtact

SEQ ID NO: 135055 - DNA, 17 bp, Homo sapiens
gttgcccgccctccacc

SEQ ID NO: 135056 - DNA, 11 bp, Homo sapiens
gttgctttgtt

SEQ ID NO: 135057 - DNA, 21 bp, Homo sapiens
gttgcttttgaaggaatacaa

SEQ ID NO: 135058 - DNA, 17 bp, Homo sapiens
gttggaggagactgggc

SEQ ID NO: 135059 - DNA, 16 bp, Homo sapiens
gttgggtcccttgctg

SEQ ID NO: 135060 - DNA, 17 bp, Homo sapiens
gttgtcaagtctctgct

SEQ ID NO: 135061 - DNA, 16 bp, Homo sapiens
gttgtgcacttcatgt

SEQ ID NO: 135062 - DNA, 14 bp, Homo sapiens
gtttaaaaaaagta

SEQ ID NO: 135063 - DNA, 18 bp, Homo sapiens
gtttaaaaaaagtatata

SEQ ID NO: 135064 - DNA, 19 bp, Homo sapiens
gtttaaaaaaagtatatat

SEQ ID NO: 135065 - DNA, 23 bp, Homo sapiens
gtttaaaaaaagtatatattcta

SEQ ID NO: 135066 - DNA, 14 bp, Homo sapiens
gtttaagagttttc

SEQ ID NO: 135067 - DNA, 21 bp, Homo sapiens
gtttaatattacctaatgaaa

SEQ ID NO: 135068 - DNA, 13 bp, Homo sapiens
gtttcaaatgtgc

SEQ ID NO: 135069 - DNA, 16 bp, Homo sapiens
gtttcagaataaaatt

SEQ ID NO: 135070 - DNA, 14 bp, Homo sapiens
gtttcatgagccca

SEQ ID NO: 135071 - DNA, 12 bp, Homo sapiens
gtttcccagtga

SEQ ID NO: 135072 - DNA, 19 bp, Homo sapiens
gtttgctaaattgagaggg

SEQ ID NO: 135073 - DNA, 15 bp, Homo sapiens
gttttaaaaaaactg

SEQ ID NO: 135074 - DNA, 17 bp, Homo sapiens
gttttaaaaaaactgaa

SEQ ID NO: 135075 - DNA, 17 bp, Homo sapiens
gttttacactaggaaac

SEQ ID NO: 135076 - DNA, 13 bp, Homo sapiens
gttttcaaattat

SEQ ID NO: 135077 - DNA, 15 bp, Homo sapiens
gtttttataataaaa

SEQ ID NO: 135078 - DNA, 12 bp, Homo sapiens
taaaaaaactga

SEQ ID NO: 135079 - DNA, 17 bp, Homo sapiens
taaaaaataccattgaa

SEQ ID NO: 135080 - DNA, 15 bp, Homo sapiens
taaaaaatgtgtgta

SEQ ID NO: 135081 - DNA, 14 bp, Homo sapiens
taaaaactgtgtat

SEQ ID NO: 135082 - DNA, 15 bp, Homo sapiens
taaaaactgtgtatc

SEQ ID NO: 135083 - DNA, 20 bp, Homo sapiens
taaaaactgtgtatcattaa

SEQ ID NO: 135084 - DNA, 21 bp, Homo sapiens
taaaaactgtgtatcattaaa

SEQ ID NO: 135085 - DNA, 23 bp, Homo sapiens
taaaaactgtgtatcattaaaat

SEQ ID NO: 135086 - DNA, 14 bp, Homo sapiens
taaaaagattatat

SEQ ID NO: 135087 - DNA, 16 bp, Homo sapiens
taatttccttctgtta

SEQ ID NO: 135088 - DNA, 19 bp, Homo sapiens
taattttcctttttcatgt

SEQ ID NO: 135089 - DNA, 18 bp, Homo sapiens
tacaagtcagtttctaca

SEQ ID NO: 135090 - DNA, 19 bp, Homo sapiens
tacaagtggtgaccaaaat

SEQ ID NO: 135091 - DNA, 17 bp, Homo sapiens
tacacacccccaagcca

SEQ ID NO: 135092 - DNA, 17 bp, Homo sapiens
tacacatatatgtatat

SEQ ID NO: 135093 - DNA, 23 bp, Homo sapiens
taaaaagtgaacttttgtaattt

SEQ ID NO: 135094 - DNA, 12 bp, Homo sapiens
taaaaatataaa

SEQ ID NO: 135095 - DNA, 15 bp, Homo sapiens
taaaaatataaattg

SEQ ID NO: 135096 - DNA, 18 bp, Homo sapiens
taaaaatataaattgtac

SEQ ID NO: 135097 - DNA, 10 bp, Homo sapiens
taaaaatatt

SEQ ID NO: 135098 - DNA, 18 bp, Homo sapiens
taaaaatatttttaacat

SEQ ID NO: 135099 - DNA, 18 bp, Homo sapiens
taaaactgagtccatgaa

SEQ ID NO: 135100 - DNA, 13 bp, Homo sapiens
taaaactttaaaa

SEQ ID NO: 135101 - DNA, 17 bp, Homo sapiens
taaaactttaaaaggca

SEQ ID NO: 135102 - DNA, 20 bp, Homo sapiens
taaaactttaaaaggcaact

SEQ ID NO: 135103 - DNA, 14 bp, Homo sapiens
taaaactttgctgc

SEQ ID NO: 135104 - DNA, 16 bp, Homo sapiens
taaaactttgctgcca

SEQ ID NO: 135105 - DNA, 18 bp, Homo sapiens
taaaagaagagaggggaa

SEQ ID NO: 135106 - DNA, 19 bp, Homo sapiens
taaaagcaattatattgtc

SEQ ID NO: 135107 - DNA, 19 bp, Homo sapiens
taaaaggatgttacaagtt

SEQ ID NO: 135108 - DNA, 20 bp, Homo sapiens
taaaaggatgttacaagttt

SEQ ID NO: 135109 - DNA, 15 bp, Homo sapiens
taaaaggcaactcaa

SEQ ID NO: 135110 - DNA, 18 bp, Homo sapiens
taaaagtgcatttaagga

SEQ ID NO: 135111 - DNA, 20 bp, Homo sapiens
taaaagtgcatttaaggaga

SEQ ID NO: 135112 - DNA, 21 bp, Homo sapiens
taaaagtgcatttaaggagat

SEQ ID NO: 135113 - DNA, 22 bp, Homo sapiens
taaaagttaaactacttgtaaa

SEQ ID NO: 135114 - DNA, 16 bp, Homo sapiens
taaaagttataataac

SEQ ID NO: 135115 - DNA, 16 bp, Homo sapiens
taaaataaactttctt

SEQ ID NO: 135116 - DNA, 12 bp, Homo sapiens
taaaatattatt

SEQ ID NO: 135117 - DNA, 20 bp, Homo sapiens
taaaatattatttgatatct

SEQ ID NO: 135118 - DNA, 21 bp, Homo sapiens
taaaatattatttgatatctg

SEQ ID NO: 135119 - DNA, 20 bp, Homo sapiens
taaaatctggcaaagttata

SEQ ID NO: 135120 - DNA, 21 bp, Homo sapiens
taaaatctggcaaagttatat

SEQ ID NO: 135121 - DNA, 12 bp, Homo sapiens
taaaatgcaata

SEQ ID NO: 135122 - DNA, 23 bp, Homo sapiens
taaaattagtgagattaaaaatc

SEQ ID NO: 135123 - DNA, 13 bp, Homo sapiens
taaactgaggccc

SEQ ID NO: 135124 - DNA, 13 bp, Homo sapiens
taaactttctcca

SEQ ID NO: 135125 - DNA, 14 bp, Homo sapiens
taaactttctccat

SEQ ID NO: 135126 - DNA, 10 bp, Homo sapiens
taaagtattt

SEQ ID NO: 135127 - DNA, 20 bp, Homo sapiens
taaagtatttataaaaatat

SEQ ID NO: 135128 - DNA, 22 bp, Homo sapiens
taaagttgttcgccgcgtggaa

SEQ ID NO: 135129 - DNA, 18 bp, Homo sapiens
taaataacctctggccct

SEQ ID NO: 135130 - DNA, 19 bp, Homo sapiens
taaataattttaaataacc

SEQ ID NO: 135131 - DNA, 16 bp, Homo sapiens
taaatctagacattct

SEQ ID NO: 135132 - DNA, 13 bp, Homo sapiens
taaattgtacatt

SEQ ID NO: 135133 - DNA, 13 bp, Homo sapiens
taaatttaagaaa

SEQ ID NO: 135134 - DNA, 13 bp, Homo sapiens
taaatttttgaaa

SEQ ID NO: 135135 - DNA, 20 bp, Homo sapiens
taacaaactacatgtaatcc

SEQ ID NO: 135136 - DNA, 13 bp, Homo sapiens
taacattcctaaa

SEQ ID NO: 135137 - DNA, 20 bp, Homo sapiens
taacattcctaaaatgcttc

SEQ ID NO: 135138 - DNA, 17 bp, Homo sapiens
taaccacccgccccgcc

SEQ ID NO: 135139 - DNA, 21 bp, Homo sapiens
taacctctggcccttggaata

SEQ ID NO: 135140 - DNA, 12 bp, Homo sapiens
taactgcaattt

SEQ ID NO: 135141 - DNA, 21 bp, Homo sapiens
taactgtaaacttggaatcaa

SEQ ID NO: 135142 - DNA, 16 bp, Homo sapiens
taagaaaagtaatgaa

SEQ ID NO: 135143 - DNA, 22 bp, Homo sapiens
taagaaagagaatgaactgtgg

SEQ ID NO: 135144 - DNA, 21 bp, Homo sapiens
taagaaaggatataaaaggat

SEQ ID NO: 135145 - DNA, 20 bp, Homo sapiens
taagacgtgaatgtctcagc

SEQ ID NO: 135146 - DNA, 20 bp, Homo sapiens
taaggagaggagaaactgag

SEQ ID NO: 135147 - DNA, 18 bp, Homo sapiens
taaggatcaccccagccc

SEQ ID NO: 135148 - DNA, 14 bp, Homo sapiens
taagttttgatata

SEQ ID NO: 135149 - DNA, 16 bp, Homo sapiens
taataagttttgatat

SEQ ID NO: 135150 - DNA, 20 bp, Homo sapiens
taataagttttgatataatc

SEQ ID NO: 135151 - DNA, 16 bp, Homo sapiens
taatataaaagatctt

SEQ ID NO: 135152 - DNA, 17 bp, Homo sapiens
taatatctgagaagtgt

SEQ ID NO: 135153 - DNA, 21 bp, Homo sapiens
taatatctgagaagtgtatat

SEQ ID NO: 135154 - DNA, 22 bp, Homo sapiens
taatatctgagaagtgtatata

SEQ ID NO: 135155 - DNA, 19 bp, Homo sapiens
taatattacctaatgaaag

SEQ ID NO: 135156 - DNA, 19 bp, Homo sapiens
taatcacttaacattccta

SEQ ID NO: 135157 - DNA, 23 bp, Homo sapiens
taatcagctctcctggctccctc

SEQ ID NO: 135158 - DNA, 12 bp, Homo sapiens
taatctcatttc

SEQ ID NO: 135159 - DNA, 18 bp, Homo sapiens
taatcttggcttcttaaa

SEQ ID NO: 135160 - DNA, 22 bp, Homo sapiens
taatgaaagtgatgacatattt

SEQ ID NO: 135161 - DNA, 23 bp, Homo sapiens
taatggactgtgaatttcaaaaa

SEQ ID NO: 135162 - DNA, 19 bp, Homo sapiens
taatggtgttactaaagtc

SEQ ID NO: 135163 - DNA, 15 bp, Homo sapiens
taatgtacatctggc

SEQ ID NO: 135164 - DNA, 16 bp, Homo sapiens
taattaactgtaaact

SEQ ID NO: 135165 - DNA, 19 bp, Homo sapiens
taattaagcagaaacagca

SEQ ID NO: 135166 - DNA, 20 bp, Homo sapiens
taattagagaactggaggaa

SEQ ID NO: 135167 - DNA, 22 bp, Homo sapiens
taattcaaagctctattaagat

SEQ ID NO: 135168 - DNA, 15 bp, Homo sapiens
taattgaacaataaa

SEQ ID NO: 135169 - DNA, 18 bp, Homo sapiens
taattgaacaataaagtt

SEQ ID NO: 135170 - DNA, 14 bp, Homo sapiens
taattgtcctgtgt

SEQ ID NO: 135171 - DNA, 22 bp, Homo sapiens
taatttccttctgttaagaaag

SEQ ID NO: 135172 - DNA, 24 bp, Homo sapiens
taatttccttctgttaagaaagga

SEQ ID NO: 135173 - DNA, 13 bp, Homo sapiens
taatttgaattgg

SEQ ID NO: 135174 - DNA, 13 bp, Homo sapiens
taattttaaataa

SEQ ID NO: 135175 - DNA, 21 bp, Homo sapiens
taattttaaataacctctggc

SEQ ID NO: 135176 - DNA, 13 bp, Homo sapiens
tacaaagatgact

SEQ ID NO: 135177 - DNA, 21 bp, Homo sapiens
tacaaagcatgggaaaaagag

SEQ ID NO: 135178 - DNA, 14 bp, Homo sapiens
tacaaccatatatt

SEQ ID NO: 135179 - DNA, 17 bp, Homo sapiens
tacaagtggtgaccaaa

SEQ ID NO: 135180 - DNA, 15 bp, Homo sapiens
tacaagtttgctaaa

SEQ ID NO: 135181 - DNA, 17 bp, Homo sapiens
tacaagtttgctaaaag

SEQ ID NO: 135182 - DNA, 23 bp, Homo sapiens
tacaatcgacatcctagccccac

SEQ ID NO: 135183 - DNA, 18 bp, Homo sapiens
tacagaatgcattaaaaa

SEQ ID NO: 135184 - DNA, 19 bp, Homo sapiens
tacagaatgcattaaaaaa

SEQ ID NO: 135185 - DNA, 17 bp, Homo sapiens
tacagtaatgaaatgtt

SEQ ID NO: 135186 - DNA, 19 bp, Homo sapiens
tacagtttgtgttttaaaa

SEQ ID NO: 135187 - DNA, 18 bp, Homo sapiens
tacatacagaggtaacta

SEQ ID NO: 135188 - DNA, 21 bp, Homo sapiens
tatctctaaactgctgttaat

SEQ ID NO: 135189 - DNA, 14 bp, Homo sapiens
tatctgaacattta

SEQ ID NO: 135190 - DNA, 16 bp, Homo sapiens
tatctgagaagtgtat

SEQ ID NO: 135191 - DNA, 19 bp, Homo sapiens
tatctgagaagtgtatata

SEQ ID NO: 135192 - DNA, 15 bp, Homo sapiens
tatctgtttgtatat

SEQ ID NO: 135193 - DNA, 20 bp, Homo sapiens
tatcttagagtttacagttt

SEQ ID NO: 135194 - DNA, 16 bp, Homo sapiens
tccacccactaggtga

SEQ ID NO: 135195 - DNA, 16 bp, Homo sapiens
tccacctgtctcagcc

SEQ ID NO: 135196 - DNA, 17 bp, Homo sapiens
tccacctgtctcagcct

SEQ ID NO: 135197 - DNA, 19 bp, Homo sapiens
tccaggcccggtgaggcca

SEQ ID NO: 135198 - DNA, 13 bp, Homo sapiens
tccagtttccaaa

SEQ ID NO: 135199 - DNA, 14 bp, Homo sapiens
tccagtttccaaag

SEQ ID NO: 135200 - DNA, 12 bp, Homo sapiens
tccataaagtaa

SEQ ID NO: 135201 - DNA, 21 bp, Homo sapiens
tccataaagtaattttgtgaa

SEQ ID NO: 135202 - DNA, 13 bp, Homo sapiens
tccatgaaaatac

SEQ ID NO: 135203 - DNA, 18 bp, Homo sapiens
tccatgcctctggaggcc

SEQ ID NO: 135204 - DNA, 14 bp, Homo sapiens
tccatttaagacac

SEQ ID NO: 135205 - DNA, 17 bp, Homo sapiens
tcccaaatcaaaataaa

SEQ ID NO: 135206 - DNA, 14 bp, Homo sapiens
tcccaagatttttt

SEQ ID NO: 135207 - DNA, 20 bp, Homo sapiens
tcccaagtagtagtgtcttc

SEQ ID NO: 135208 - DNA, 13 bp, Homo sapiens
tcccaagtgtctc

SEQ ID NO: 135209 - DNA, 14 bp, Homo sapiens
tcccaatacaaaga

SEQ ID NO: 135210 - DNA, 22 bp, Homo sapiens
tcccacccccacttcatgccca

SEQ ID NO: 135211 - DNA, 11 bp, Homo sapiens
tcccagaggcc

SEQ ID NO: 135212 - DNA, 13 bp, Homo sapiens
tcccagctctctc

SEQ ID NO: 135213 - DNA, 16 bp, Homo sapiens
tcccagctctctctcc

SEQ ID NO: 135214 - DNA, 19 bp, Homo sapiens
tcccagctctctctcctgg

SEQ ID NO: 135215 - DNA, 14 bp, Homo sapiens
tcccagtgagcctc

SEQ ID NO: 135216 - DNA, 20 bp, Homo sapiens
tcccagtgagcctctgcgcc

SEQ ID NO: 135217 - DNA, 19 bp, Homo sapiens
tccccactgacagcctccc

SEQ ID NO: 135218 - DNA, 21 bp, Homo sapiens
tccccccatagagaccaggag

SEQ ID NO: 135219 - DNA, 23 bp, Homo sapiens
tccccccatagagaccaggaggg

SEQ ID NO: 135220 - DNA, 13 bp, Homo sapiens
tccccgccccctg

SEQ ID NO: 135221 - DNA, 15 bp, Homo sapiens
tccccgccccctgaa

SEQ ID NO: 135222 - DNA, 20 bp, Homo sapiens
tccccggcggggtgcctgct

SEQ ID NO: 135223 - DNA, 20 bp, Homo sapiens
tcccctccccgccccctgaa

SEQ ID NO: 135224 - DNA, 21 bp, Homo sapiens
tcccctccccgccccctgaaa

SEQ ID NO: 135225 - DNA, 14 bp, Homo sapiens
tcccctccttctcc

SEQ ID NO: 135226 - DNA, 18 bp, Homo sapiens
tcccctccttctcccttt

SEQ ID NO: 135227 - DNA, 16 bp, Homo sapiens
tccctctcccacccaa

SEQ ID NO: 135228 - DNA, 18 bp, Homo sapiens
tccctctcccacccaagg

SEQ ID NO: 135229 - DNA, 14 bp, Homo sapiens
tccctgaccccctg

SEQ ID NO: 135230 - DNA, 12 bp, Homo sapiens
tccctgctccca

SEQ ID NO: 135231 - DNA, 14 bp, Homo sapiens
tccctgctcccagc

SEQ ID NO: 135232 - DNA, 14 bp, Homo sapiens
tccctttttaaaaa

SEQ ID NO: 135233 - DNA, 18 bp, Homo sapiens
tccctttttaaaaaatac

SEQ ID NO: 135234 - DNA, 19 bp, Homo sapiens
tccctttttaaaaaatacc

SEQ ID NO: 135235 - DNA, 15 bp, Homo sapiens
tccggagtagctggg

SEQ ID NO: 135236 - DNA, 15 bp, Homo sapiens
tccggcctgtaatca

SEQ ID NO: 135237 - DNA, 24 bp, Homo sapiens
tccggcctgtaatcagctctcctg

SEQ ID NO: 135238 - DNA, 12 bp, Homo sapiens
tcctagccccac

SEQ ID NO: 135239 - DNA, 14 bp, Homo sapiens
tcctagccccaccc

SEQ ID NO: 135240 - DNA, 13 bp, Homo sapiens
tcctagtatatta

SEQ ID NO: 135241 - DNA, 23 bp, Homo sapiens
tcctagtatattagtttgattta

SEQ ID NO: 135242 - DNA, 13 bp, Homo sapiens
tcctagtttttct

SEQ ID NO: 135243 - DNA, 13 bp, Homo sapiens
tcctcagccccca

SEQ ID NO: 135244 - DNA, 19 bp, Homo sapiens
tcctcagcccccaggccag

SEQ ID NO: 135245 - DNA, 22 bp, Homo sapiens
tcctcagcccccaggccaggtg

SEQ ID NO: 135246 - DNA, 17 bp, Homo sapiens
tcctcagctcagctggg

SEQ ID NO: 135247 - DNA, 18 bp, Homo sapiens
tcctcagctcagctgggc

SEQ ID NO: 135248 - DNA, 19 bp, Homo sapiens
tcctcagctcagctgggcc

SEQ ID NO: 135249 - DNA, 14 bp, Homo sapiens
tcctctcctggaaa

SEQ ID NO: 135250 - DNA, 20 bp, Homo sapiens
tcctctgatagctgtttcaa

SEQ ID NO: 135251 - DNA, 16 bp, Homo sapiens
tcctctgggcctgggg

SEQ ID NO: 135252 - DNA, 14 bp, Homo sapiens
tcctgcctcagcct

SEQ ID NO: 135253 - DNA, 16 bp, Homo sapiens
tcctgcctcagcctcc

SEQ ID NO: 135254 - DNA, 23 bp, Homo sapiens
tcctgcctcccgcctcccgccac

SEQ ID NO: 135255 - DNA, 23 bp, Homo sapiens
tcctggaaacagacagggagaag

SEQ ID NO: 135256 - DNA, 12 bp, Homo sapiens
tcctggaccctg

SEQ ID NO: 135257 - DNA, 22 bp, Homo sapiens
tccttgggccataattatgaaa

SEQ ID NO: 135258 - DNA, 19 bp, Homo sapiens
tcctttccaatagaaagaa

SEQ ID NO: 135259 - DNA, 19 bp, Homo sapiens
tccttttgcaacaagacaa

SEQ ID NO: 135260 - DNA, 13 bp, Homo sapiens
tcctttttcatgt

SEQ ID NO: 135261 - DNA, 14 bp, Homo sapiens
tcgagactgcaatg

SEQ ID NO: 135262 - DNA, 17 bp, Homo sapiens
tcgagcagtcctgcctc

SEQ ID NO: 135263 - DNA, 22 bp, Homo sapiens
tcgagcagtcctgcctcagcct

SEQ ID NO: 135264 - DNA, 21 bp, Homo sapiens
tcggcaccagtgcctcagtgc

SEQ ID NO: 135265 - DNA, 15 bp, Homo sapiens
tcggctgtctcctgt

SEQ ID NO: 135266 - DNA, 18 bp, Homo sapiens
tcgttagaggagcaacag

SEQ ID NO: 135267 - DNA, 23 bp, Homo sapiens
tctaaaaattttgcatttcatgc

SEQ ID NO: 135268 - DNA, 12 bp, Homo sapiens
tctaattagaga

SEQ ID NO: 135269 - DNA, 21 bp, Homo sapiens
tctacactgggtgctgatcct

SEQ ID NO: 135270 - DNA, 22 bp, Homo sapiens
tctaccccacctgacctctgca

SEQ ID NO: 135271 - DNA, 14 bp, Homo sapiens
tctaccctgcagct

SEQ ID NO: 135272 - DNA, 15 bp, Homo sapiens
tctacttgtcatatc

SEQ ID NO: 135273 - DNA, 18 bp, Homo sapiens
tctacttgtcatatcact

SEQ ID NO: 135274 - DNA, 20 bp, Homo sapiens
tctaggtaggggcccacttc

SEQ ID NO: 135275 - DNA, 14 bp, Homo sapiens
tctatctaatgaca

SEQ ID NO: 135276 - DNA, 17 bp, Homo sapiens
tctattaagatttccaa

SEQ ID NO: 135277 - DNA, 18 bp, Homo sapiens
tctattaagatttccaag

SEQ ID NO: 135278 - DNA, 17 bp, Homo sapiens
tctattgtttattcttt

SEQ ID NO: 135279 - DNA, 17 bp, Homo sapiens
tctcaccccatcccaca

SEQ ID NO: 135280 - DNA, 11 bp, Homo sapiens
tctcagcctcc

SEQ ID NO: 135281 - DNA, 12 bp, Homo sapiens
tctcagcctccc

SEQ ID NO: 135282 - DNA, 23 bp, Homo sapiens
tctcatgcaagacttcactgcag

SEQ ID NO: 135283 - DNA, 21 bp, Homo sapiens
tctccactgtttcatgagccc

SEQ ID NO: 135284 - DNA, 22 bp, Homo sapiens
tctccctagcccttctacccca

SEQ ID NO: 135285 - DNA, 19 bp, Homo sapiens
tctcggcaccagtgcctca

SEQ ID NO: 135286 - DNA, 14 bp, Homo sapiens
tctctccctcccct

SEQ ID NO: 135287 - DNA, 12 bp, Homo sapiens
tctctctcctgg

SEQ ID NO: 135288 - DNA, 13 bp, Homo sapiens
tctctctcctgga

SEQ ID NO: 135289 - DNA, 19 bp, Homo sapiens
tctctctgctgagctgggc

SEQ ID NO: 135290 - DNA, 14 bp, Homo sapiens
tctctgcatcttca

SEQ ID NO: 135291 - DNA, 14 bp, Homo sapiens
tacatgctgctaat

SEQ ID NO: 135292 - DNA, 13 bp, Homo sapiens
taccataggaaga

SEQ ID NO: 135293 - DNA, 19 bp, Homo sapiens
taccataggaagacataaa

SEQ ID NO: 135294 - DNA, 22 bp, Homo sapiens
taccataggaagacataaaact

SEQ ID NO: 135295 - DNA, 15 bp, Homo sapiens
taccccacctgacct

SEQ ID NO: 135296 - DNA, 12 bp, Homo sapiens
tattgtattaag

SEQ ID NO: 135297 - DNA, 20 bp, Homo sapiens
tattgtcctcccctatttta

SEQ ID NO: 135298 - DNA, 13 bp, Homo sapiens
tatttgcaaaccc

SEQ ID NO: 135299 - DNA, 20 bp, Homo sapiens
tattttaagaaagagaatga

SEQ ID NO: 135300 - DNA, 15 bp, Homo sapiens
tattttcccttttta

SEQ ID NO: 135301 - DNA, 16 bp, Homo sapiens
tattttgttgtgcact

SEQ ID NO: 135302 - DNA, 20 bp, Homo sapiens
tatttttaaaataaaaatat

SEQ ID NO: 135303 - DNA, 15 bp, Homo sapiens
tattttttatttcca

SEQ ID NO: 135304 - DNA, 18 bp, Homo sapiens
tattttttatttccacat

SEQ ID NO: 135305 - DNA, 17 bp, Homo sapiens
tcaaagatgatggaaac

SEQ ID NO: 135306 - DNA, 15 bp, Homo sapiens
tcaaaggaatataag

SEQ ID NO: 135307 - DNA, 19 bp, Homo sapiens
tcaaaggaatataagaaaa

SEQ ID NO: 135308 - DNA, 23 bp, Homo sapiens
tcaaaggaatataagaaaagtaa

SEQ ID NO: 135309 - DNA, 18 bp, Homo sapiens
tcaaatatagagatattt

SEQ ID NO: 135310 - DNA, 12 bp, Homo sapiens
tcaaatgaactt

SEQ ID NO: 135311 - DNA, 13 bp, Homo sapiens
tcaaatgaacttt

SEQ ID NO: 135312 - DNA, 21 bp, Homo sapiens
tcaaatgaacttttacagaat

SEQ ID NO: 135313 - DNA, 20 bp, Homo sapiens
tcaaattttttaaaagagac

SEQ ID NO: 135314 - DNA, 19 bp, Homo sapiens
tcaagaggtttttctcccc

SEQ ID NO: 135315 - DNA, 18 bp, Homo sapiens
tcaagatatatgtgtata

SEQ ID NO: 135316 - DNA, 20 bp, Homo sapiens
tcaagatatatgtgtataca

SEQ ID NO: 135317 - DNA, 18 bp, Homo sapiens
tcaagattttttttgtaa

SEQ ID NO: 135318 - DNA, 21 bp, Homo sapiens
tcaagattttttttgtaactt

SEQ ID NO: 135319 - DNA, 17 bp, Homo sapiens
tcaagtctctgctggcc

SEQ ID NO: 135320 - DNA, 21 bp, Homo sapiens
tcaatagtgtcctatgcaata

SEQ ID NO: 135321 - DNA, 13 bp, Homo sapiens
tcaatagttctta

SEQ ID NO: 135322 - DNA, 14 bp, Homo sapiens
tcacaaatttctct

SEQ ID NO: 135323 - DNA, 18 bp, Homo sapiens
tcacaaatttctctgttc

SEQ ID NO: 135324 - DNA, 16 bp, Homo sapiens
tcacaggactctgcag

SEQ ID NO: 135325 - DNA, 12 bp, Homo sapiens
tcaccccaccct

SEQ ID NO: 135326 - DNA, 22 bp, Homo sapiens
tcaccttcctcagctcagctgg

SEQ ID NO: 135327 - DNA, 17 bp, Homo sapiens
tcactcaagaagcacac

SEQ ID NO: 135328 - DNA, 14 bp, Homo sapiens
tcactgattccctc

SEQ ID NO: 135329 - DNA, 16 bp, Homo sapiens
tcactgattccctctc

SEQ ID NO: 135330 - DNA, 16 bp, Homo sapiens
tgggaaaaagagactc

SEQ ID NO: 135331 - DNA, 15 bp, Homo sapiens
tgggaagattctcta

SEQ ID NO: 135332 - DNA, 21 bp, Homo sapiens
tgggaaggtgggtgaggctgg

SEQ ID NO: 135333 - DNA, 23 bp, Homo sapiens
tgggagaactaagtaagaaacac

SEQ ID NO: 135334 - DNA, 19 bp, Homo sapiens
tgggaggaaggcccagggg

SEQ ID NO: 135335 - DNA, 15 bp, Homo sapiens
tgggcacccctgcct

SEQ ID NO: 135336 - DNA, 16 bp, Homo sapiens
tgggcagggcctggcg

SEQ ID NO: 135337 - DNA, 14 bp, Homo sapiens
tgggccaaggactc

SEQ ID NO: 135338 - DNA, 18 bp, Homo sapiens
tgggcctcgacgtccctt

SEQ ID NO: 135339 - DNA, 18 bp, Homo sapiens
tgggcgcaggcccagtga

SEQ ID NO: 135340 - DNA, 19 bp, Homo sapiens
tggggagtaggacatacca

SEQ ID NO: 135341 - DNA, 18 bp, Homo sapiens
tgggggcggggcctgggc

SEQ ID NO: 135342 - DNA, 21 bp, Homo sapiens
tggggtctcacagtgttgccc

SEQ ID NO: 135343 - DNA, 15 bp, Homo sapiens
tggggtctctgcatc

SEQ ID NO: 135344 - DNA, 20 bp, Homo sapiens
tggggtctctgcatcttcag

SEQ ID NO: 135345 - DNA, 21 bp, Homo sapiens
tggggtctctgcatcttcagt

SEQ ID NO: 135346 - DNA, 14 bp, Homo sapiens
tgggtcccttgctg

SEQ ID NO: 135347 - DNA, 22 bp, Homo sapiens
tgggtctcgctttgttgcccag

SEQ ID NO: 135348 - DNA, 15 bp, Homo sapiens
tgggtgaggctgggc

SEQ ID NO: 135349 - DNA, 19 bp, Homo sapiens
tgggtgaggctgggcaggg

SEQ ID NO: 135350 - DNA, 20 bp, Homo sapiens
tgggtgaggctgggcagggc

SEQ ID NO: 135351 - DNA, 14 bp, Homo sapiens
tggtaaatttttga

SEQ ID NO: 135352 - DNA, 18 bp, Homo sapiens
tggtactgcacattttgt

SEQ ID NO: 135353 - DNA, 16 bp, Homo sapiens
tggtgttactaaagtc

SEQ ID NO: 135354 - DNA, 14 bp, Homo sapiens
tggttctataataa

SEQ ID NO: 135355 - DNA, 22 bp, Homo sapiens
tggtttgtttgcttaatttcct

SEQ ID NO: 135356 - DNA, 14 bp, Homo sapiens
tgtaaaagttataa

SEQ ID NO: 135357 - DNA, 22 bp, Homo sapiens
tgtaaaagttataataactgaa

SEQ ID NO: 135358 - DNA, 23 bp, Homo sapiens
tgtaaaagttataataactgaac

SEQ ID NO: 135359 - DNA, 17 bp, Homo sapiens
tgtaaacttggaatcaa

SEQ ID NO: 135360 - DNA, 18 bp, Homo sapiens
tgtaaacttggaatcaag

SEQ ID NO: 135361 - DNA, 20 bp, Homo sapiens
tgtaaataattttaaataac

SEQ ID NO: 135362 - DNA, 13 bp, Homo sapiens
tgtaacttcaaat

SEQ ID NO: 135363 - DNA, 14 bp, Homo sapiens
tgtaacttcaaata

SEQ ID NO: 135364 - DNA, 19 bp, Homo sapiens
tgtaagtttaattatctgc

SEQ ID NO: 135365 - DNA, 12 bp, Homo sapiens
tgtaatttgaat

SEQ ID NO: 135366 - DNA, 13 bp, Homo sapiens
tgtaatttgaatt

SEQ ID NO: 135367 - DNA, 15 bp, Homo sapiens
tgtaatttgaattgg

SEQ ID NO: 135368 - DNA, 20 bp, Homo sapiens
tgtacattttgtaaaatatt

SEQ ID NO: 135369 - DNA, 15 bp, Homo sapiens
tgtacgttatatatt

SEQ ID NO: 135370 - DNA, 13 bp, Homo sapiens
tgtagtcaagagg

SEQ ID NO: 135371 - DNA, 13 bp, Homo sapiens
tgtataaaaagga

SEQ ID NO: 135372 - DNA, 14 bp, Homo sapiens
tgtataatctattt

SEQ ID NO: 135373 - DNA, 13 bp, Homo sapiens
tgtatacatacat

SEQ ID NO: 135374 - DNA, 14 bp, Homo sapiens
tgtatacatacatg

SEQ ID NO: 135375 - DNA, 13 bp, Homo sapiens
tgtatactgtaaa

SEQ ID NO: 135376 - DNA, 14 bp, Homo sapiens
tgtatactgtaaaa

SEQ ID NO: 135377 - DNA, 19 bp, Homo sapiens
tgtatatctatatctctaa

SEQ ID NO: 135378 - DNA, 20 bp, Homo sapiens
tgtatcattaaaatatatgt

SEQ ID NO: 135379 - DNA, 19 bp, Homo sapiens
tgtatctacagtaatgaaa

SEQ ID NO: 135380 - DNA, 17 bp, Homo sapiens
tgtattaagggcatttt

SEQ ID NO: 135381 - DNA, 16 bp, Homo sapiens
tgtattagtcataaaa

SEQ ID NO: 135382 - DNA, 14 bp, Homo sapiens
tgtattataattgt

SEQ ID NO: 135383 - DNA, 20 bp, Homo sapiens
tgtattataattgttgatat

SEQ ID NO: 135384 - DNA, 14 bp, Homo sapiens
tgtattcaattaaa

SEQ ID NO: 135385 - DNA, 14 bp, Homo sapiens
tgtattgctgtcct

SEQ ID NO: 135386 - DNA, 13 bp, Homo sapiens
tgtcaaatgaact

SEQ ID NO: 135387 - DNA, 17 bp, Homo sapiens
tgtcaaatgaactttta

SEQ ID NO: 135388 - DNA, 16 bp, Homo sapiens
tgtcaagtctctgctg

SEQ ID NO: 135389 - DNA, 18 bp, Homo sapiens
tgtcaagtctctgctggc

SEQ ID NO: 135390 - DNA, 18 bp, Homo sapiens
tgtcaggctacaaggtag

SEQ ID NO: 135391 - DNA, 22 bp, Homo sapiens
tgtccaagacacatgctgaggt

SEQ ID NO: 135392 - DNA, 13 bp, Homo sapiens
tgtccataaagta

SEQ ID NO: 135393 - DNA, 22 bp, Homo sapiens
tgtcccaagtcctgctcctttc

SEQ ID NO: 135394 - DNA, 23 bp, Homo sapiens
tgtccccggcggggtgcctgctg

SEQ ID NO: 135395 - DNA, 15 bp, Homo sapiens
tgtcctatgcaataa

SEQ ID NO: 135396 - DNA, 17 bp, Homo sapiens
tgtcctgtgtctatgta

SEQ ID NO: 135397 - DNA, 23 bp, Homo sapiens
tgtcctgtgtctatgtacctcta

SEQ ID NO: 135398 - DNA, 17 bp, Homo sapiens
tgtccttgaatgccata

SEQ ID NO: 135399 - DNA, 13 bp, Homo sapiens
tgtctcagcctcc

SEQ ID NO: 135400 - DNA, 20 bp, Homo sapiens
tgtctcagcgaggtgtaaag

SEQ ID NO: 135401 - DNA, 14 bp, Homo sapiens
tgtgaaatgctggc

SEQ ID NO: 135402 - DNA, 12 bp, Homo sapiens
tgtgaatttcaa

SEQ ID NO: 135403 - DNA, 13 bp, Homo sapiens
tgtgatggaggga

SEQ ID NO: 135404 - DNA, 20 bp, Homo sapiens
tgtgcacctatggcccagcc

SEQ ID NO: 135405 - DNA, 14 bp, Homo sapiens
tgtgcccctgccaa

SEQ ID NO: 135406 - DNA, 17 bp, Homo sapiens
tgtgcccctgccaaggc

SEQ ID NO: 135407 - DNA, 18 bp, Homo sapiens
tgtgcccctgccaaggcc

SEQ ID NO: 135408 - DNA, 20 bp, Homo sapiens
ttccctttttaaaaaatacc

SEQ ID NO: 135409 - DNA, 19 bp, Homo sapiens
ttcctcagctcagctgggc

SEQ ID NO: 135410 - DNA, 21 bp, Homo sapiens
ttcctgtggttttattacaaa

SEQ ID NO: 135411 - DNA, 13 bp, Homo sapiens
ttccttctgttaa

SEQ ID NO: 135412 - DNA, 21 bp, Homo sapiens
ttccttctgttaagaaaggat

SEQ ID NO: 135413 - DNA, 14 bp, Homo sapiens
ttcctttttcatgt

SEQ ID NO: 135414 - DNA, 17 bp, Homo sapiens
ttctacacatatatgta

SEQ ID NO: 135415 - DNA, 18 bp, Homo sapiens
ttctacacatatatgtat

SEQ ID NO: 135416 - DNA, 13 bp, Homo sapiens
ttctaccccacct

SEQ ID NO: 135417 - DNA, 14 bp, Homo sapiens
ttctataaatttaa

SEQ ID NO: 135418 - DNA, 18 bp, Homo sapiens
ttctataataagttttga

SEQ ID NO: 135419 - DNA, 22 bp, Homo sapiens
ttctataataagttttgatata

SEQ ID NO: 135420 - DNA, 18 bp, Homo sapiens
ttctcaatagttcttaaa

SEQ ID NO: 135421 - DNA, 17 bp, Homo sapiens
ttctcagtcctttgtta

SEQ ID NO: 135422 - DNA, 19 bp, Homo sapiens
ttctcagtggtcaccttcc

SEQ ID NO: 135423 - DNA, 22 bp, Homo sapiens
ttctcagtggtcaccttcctca

SEQ ID NO: 135424 - DNA, 23 bp, Homo sapiens
ttctcagtggtcaccttcctcag

SEQ ID NO: 135425 - DNA, 19 bp, Homo sapiens
ttctctacttgtcatatca

SEQ ID NO: 135426 - DNA, 20 bp, Homo sapiens
ttctctcttttaaagtattt

SEQ ID NO: 135427 - DNA, 15 bp, Homo sapiens
ttctgagccccagcc

SEQ ID NO: 135428 - DNA, 17 bp, Homo sapiens
ttctgagccccagcccc

SEQ ID NO: 135429 - DNA, 12 bp, Homo sapiens
ttctggttccaa

SEQ ID NO: 135430 - DNA, 13 bp, Homo sapiens
ttctgtatactgt

SEQ ID NO: 135431 - DNA, 14 bp, Homo sapiens
ttctgtatactgta

SEQ ID NO: 135432 - DNA, 16 bp, Homo sapiens
ttctgtccagtttcca

SEQ ID NO: 135433 - DNA, 10 bp, Homo sapiens
ttctgtggtt

SEQ ID NO: 135434 - DNA, 12 bp, Homo sapiens
ttcttaaaaact

SEQ ID NO: 135435 - DNA, 20 bp, Homo sapiens
ttcttaaaaactgtgtatca

SEQ ID NO: 135436 - DNA, 18 bp, Homo sapiens
ttcttaaaatgcaatatt

SEQ ID NO: 135437 - DNA, 23 bp, Homo sapiens
ttcttaaaatgcaatatttgtaa

SEQ ID NO: 135438 - DNA, 13 bp, Homo sapiens
ttcttaaaattca

SEQ ID NO: 135439 - DNA, 12 bp, Homo sapiens
ttcttctttaat

SEQ ID NO: 135440 - DNA, 13 bp, Homo sapiens
ttcttgaattgtt

SEQ ID NO: 135441 - DNA, 22 bp, Homo sapiens
ttcttttttgtacttttctggt

SEQ ID NO: 135442 - DNA, 11 bp, Homo sapiens
ttgaaaatcaa

SEQ ID NO: 135443 - DNA, 16 bp, Homo sapiens
ttgaaagtattcagaa

SEQ ID NO: 135444 - DNA, 23 bp, Homo sapiens
ttgaaagtattcagaaattaaaa

SEQ ID NO: 135445 - DNA, 19 bp, Homo sapiens
ttgaaatcagcatgacaaa

SEQ ID NO: 135446 - DNA, 23 bp, Homo sapiens
ttgaaggaatacaatatatagct

SEQ ID NO: 135447 - DNA, 14 bp, Homo sapiens
ttgaataaaaagtg

SEQ ID NO: 135448 - DNA, 19 bp, Homo sapiens
ttgaataaaaagtgaactt

SEQ ID NO: 135449 - DNA, 23 bp, Homo sapiens
ttgaatgccatagtcaaagagag

SEQ ID NO: 135450 - DNA, 16 bp, Homo sapiens
ttgaattgttatgaaa

SEQ ID NO: 135451 - DNA, 18 bp, Homo sapiens
ttgaattgttatgaaaat

SEQ ID NO: 135452 - DNA, 14 bp, Homo sapiens
ttgagaagaatgtt

SEQ ID NO: 135453 - DNA, 20 bp, Homo sapiens
ttgagaagaatgtttaatag

SEQ ID NO: 135454 - DNA, 14 bp, Homo sapiens
ttgagaggggctat

SEQ ID NO: 135455 - DNA, 23 bp, Homo sapiens
ttgagcaggtatcaactagggga

SEQ ID NO: 135456 - DNA, 15 bp, Homo sapiens
ttgagtttcagaata

SEQ ID NO: 135457 - DNA, 13 bp, Homo sapiens
ttgatataatctt

SEQ ID NO: 135458 - DNA, 16 bp, Homo sapiens
ttgatcccctctctgt

SEQ ID NO: 135459 - DNA, 20 bp, Homo sapiens
ttgattattctgattccact

SEQ ID NO: 135460 - DNA, 19 bp, Homo sapiens
ttgcaaaccctttgtatta

SEQ ID NO: 135461 - DNA, 17 bp, Homo sapiens
ttgcacctacctcacag

SEQ ID NO: 135462 - DNA, 17 bp, Homo sapiens
ttgcactcatcatattt

SEQ ID NO: 135463 - DNA, 13 bp, Homo sapiens
ttgcactttgtag

SEQ ID NO: 135464 - DNA, 17 bp, Homo sapiens
ttgcagctcccattcta

SEQ ID NO: 135465 - DNA, 13 bp, Homo sapiens
aaaaaaaaagact

SEQ ID NO: 135466 - DNA, 12 bp, Homo sapiens
aaaaaaactgaa

SEQ ID NO: 135467 - DNA, 13 bp, Homo sapiens
aaaaaaactgaag

SEQ ID NO: 135468 - DNA, 13 bp, Homo sapiens
aaaaaactgaagg

SEQ ID NO: 135469 - DNA, 11 bp, Homo sapiens
aaaaaagaacc

SEQ ID NO: 135470 - DNA, 15 bp, Homo sapiens
aaaaactgaaggttt

SEQ ID NO: 135471 - DNA, 11 bp, Homo sapiens
aaaaactgtgt

SEQ ID NO: 135472 - DNA, 12 bp, Homo sapiens
aaaaactgtgta

SEQ ID NO: 135473 - DNA, 15 bp, Homo sapiens
aaaaactgtgtatca

SEQ ID NO: 135474 - DNA, 11 bp, Homo sapiens
aaaaagactgt

SEQ ID NO: 135475 - DNA, 23 bp, Homo sapiens
aaaaagactgtcaaatgaacttt

SEQ ID NO: 135476 - DNA, 13 bp, Homo sapiens
aaaaagtatatat

SEQ ID NO: 135477 - DNA, 14 bp, Homo sapiens
aaaaagtgaacttt

SEQ ID NO: 135478 - DNA, 14 bp, Homo sapiens
aaaaataccattga

SEQ ID NO: 135479 - DNA, 18 bp, Homo sapiens
aaaaatattttaagaaag

SEQ ID NO: 135480 - DNA, 23 bp, Homo sapiens
aaaaatattttaagaaagagaat

SEQ ID NO: 135481 - DNA, 13 bp, Homo sapiens
aaaaattttgcat

SEQ ID NO: 135482 - DNA, 16 bp, Homo sapiens
aaaaattttgcatttc

SEQ ID NO: 135483 - DNA, 22 bp, Homo sapiens
aaaacaagtatataatttactt

SEQ ID NO: 135484 - DNA, 15 bp, Homo sapiens
aaaactcatgatcaa

SEQ ID NO: 135485 - DNA, 19 bp, Homo sapiens
aaaactgagtccatgaaaa

SEQ ID NO: 135486 - DNA, 21 bp, Homo sapiens
aaaactgagtccatgaaaata

SEQ ID NO: 135487 - DNA, 12 bp, Homo sapiens
aaaactttaaaa

SEQ ID NO: 135488 - DNA, 17 bp, Homo sapiens
aaaactttgctccaggc

SEQ ID NO: 135489 - DNA, 21 bp, Homo sapiens
aaaagaccttctccctagccc

SEQ ID NO: 135490 - DNA, 19 bp, Homo sapiens
aaaagcttttgttttgctt

SEQ ID NO: 135491 - DNA, 17 bp, Homo sapiens
aaaaggatgttacaagt

SEQ ID NO: 135492 - DNA, 16 bp, Homo sapiens
aaaaggcaaaagactg

SEQ ID NO: 135493 - DNA, 11 bp, Homo sapiens
aaaagtatata

SEQ ID NO: 135494 - DNA, 14 bp, Homo sapiens
aaaagtgcaatgcg

SEQ ID NO: 135495 - DNA, 18 bp, Homo sapiens
aaaagttataataactga

SEQ ID NO: 135496 - DNA, 14 bp, Homo sapiens
aaaataaactttct

SEQ ID NO: 135497 - DNA, 23 bp, Homo sapiens
aaaataccataggaagacataaa

SEQ ID NO: 135498 - DNA, 16 bp, Homo sapiens
aaaataccattgaaat

SEQ ID NO: 135499 - DNA, 17 bp, Homo sapiens
aaaataccattgaaatc

SEQ ID NO: 135500 - DNA, 17 bp, Homo sapiens
aaaatagagcaaaatca

SEQ ID NO: 135501 - DNA, 21 bp, Homo sapiens
aaaatagagcaaaatcaacat

SEQ ID NO: 135502 - DNA, 10 bp, Homo sapiens
aaaatataaa

SEQ ID NO: 135503 - DNA, 20 bp, Homo sapiens
aaaatataaattgtacattt

SEQ ID NO: 135504 - DNA, 14 bp, Homo sapiens
aaaatatatgttct

SEQ ID NO: 135505 - DNA, 16 bp, Homo sapiens
aaaatatatgttctgc

SEQ ID NO: 135506 - DNA, 16 bp, Homo sapiens
aaaatattatttgata

SEQ ID NO: 135507 - DNA, 17 bp, Homo sapiens
aaaatattatttgatat

SEQ ID NO: 135508 - DNA, 13 bp, Homo sapiens
aaaatattgctaa

SEQ ID NO: 135509 - DNA, 21 bp, Homo sapiens
aaaatattgctaaaagtgcat

SEQ ID NO: 135510 - DNA, 19 bp, Homo sapiens
aaaatattttaagaaagag

SEQ ID NO: 135511 - DNA, 23 bp, Homo sapiens
aaaatattttaagaaagagaatg

SEQ ID NO: 135512 - DNA, 18 bp, Homo sapiens
aaaatcctatatctgttt

SEQ ID NO: 135513 - DNA, 22 bp, Homo sapiens
aaaatctaaaaattttgcattt

SEQ ID NO: 135514 - DNA, 11 bp, Homo sapiens
aaaatgcaata

SEQ ID NO: 135515 - DNA, 16 bp, Homo sapiens
aaaatgtgtgtattct

SEQ ID NO: 135516 - DNA, 14 bp, Homo sapiens
aaaattatttgcag

SEQ ID NO: 135517 - DNA, 14 bp, Homo sapiens
aaaattgaaagtat

SEQ ID NO: 135518 - DNA, 19 bp, Homo sapiens
aaaattgagtttcagaata

SEQ ID NO: 135519 - DNA, 16 bp, Homo sapiens
aaaattttgcatttca

SEQ ID NO: 135520 - DNA, 18 bp, Homo sapiens
aaaattttgcatttcatg

SEQ ID NO: 135521 - DNA, 19 bp, Homo sapiens
aaaattttgcatttcatgc

SEQ ID NO: 135522 - DNA, 15 bp, Homo sapiens
aaacaaaaaaaagaa

SEQ ID NO: 135523 - DNA, 16 bp, Homo sapiens
aataacctctggccct

SEQ ID NO: 135524 - DNA, 21 bp, Homo sapiens
aataacctctggcccttggaa

SEQ ID NO: 135525 - DNA, 14 bp, Homo sapiens
aataactgaactgt

SEQ ID NO: 135526 - DNA, 17 bp, Homo sapiens
aataactgaactgtttg

SEQ ID NO: 135527 - DNA, 13 bp, Homo sapiens
aataactttttct

SEQ ID NO: 135528 - DNA, 23 bp, Homo sapiens
aataagaagggggagtgaaacag

SEQ ID NO: 135529 - DNA, 17 bp, Homo sapiens
aataagttttgatataa

SEQ ID NO: 135530 - DNA, 17 bp, Homo sapiens
aataattttaaataacc

SEQ ID NO: 135531 - DNA, 23 bp, Homo sapiens
aatacaatccgagctacaaagca

SEQ ID NO: 135532 - DNA, 15 bp, Homo sapiens
aataccattgaaatc

SEQ ID NO: 135533 - DNA, 16 bp, Homo sapiens
aataccattgaaatca

SEQ ID NO: 135534 - DNA, 13 bp, Homo sapiens
aatagaaaattaa

SEQ ID NO: 135535 - DNA, 20 bp, Homo sapiens
aatagaaccatgttggttgc

SEQ ID NO: 135536 - DNA, 20 bp, Homo sapiens
aatagtgtcctatgcaataa

SEQ ID NO: 135537 - DNA, 21 bp, Homo sapiens
aatagtgtcctatgcaataaa

SEQ ID NO: 135538 - DNA, 23 bp, Homo sapiens
aatagtgtcctatgcaataaaat

SEQ ID NO: 135539 - DNA, 14 bp, Homo sapiens
aatagttcttaaaa

SEQ ID NO: 135540 - DNA, 17 bp, Homo sapiens
aatagttcttaaaatta

SEQ ID NO: 135541 - DNA, 15 bp, Homo sapiens
aatataaattgtaca

SEQ ID NO: 135542 - DNA, 16 bp, Homo sapiens
aatataaattgtacat

SEQ ID NO: 135543 - DNA, 19 bp, Homo sapiens
aatataaattgtacatttt

SEQ ID NO: 135544 - DNA, 12 bp, Homo sapiens
aatataagaaaa

SEQ ID NO: 135545 - DNA, 20 bp, Homo sapiens
aatataagaaaagtaatgaa

SEQ ID NO: 135546 - DNA, 11 bp, Homo sapiens
aatatagagat

SEQ ID NO: 135547 - DNA, 18 bp, Homo sapiens
aatatagagatatttttg

SEQ ID NO: 135548 - DNA, 21 bp, Homo sapiens
aatatagagatatttttgtac

SEQ ID NO: 135549 - DNA, 18 bp, Homo sapiens
aatatatggcatttgcag

SEQ ID NO: 135550 - DNA, 12 bp, Homo sapiens
aatatatgttct

SEQ ID NO: 135551 - DNA, 22 bp, Homo sapiens
aatatatgttctgcaagaatta

SEQ ID NO: 135552 - DNA, 15 bp, Homo sapiens
aatatctgaacattt

SEQ ID NO: 135553 - DNA, 16 bp, Homo sapiens
aatattatttgatatc

SEQ ID NO: 135554 - DNA, 18 bp, Homo sapiens
aatatttaagtttgttgc

SEQ ID NO: 135555 - DNA, 13 bp, Homo sapiens
aatattttaagaa

SEQ ID NO: 135556 - DNA, 14 bp, Homo sapiens
aatattttaagaaa

SEQ ID NO: 135557 - DNA, 17 bp, Homo sapiens
aatattttaagaaagag

SEQ ID NO: 135558 - DNA, 18 bp, Homo sapiens
aatcaagatgagatatat

SEQ ID NO: 135559 - DNA, 15 bp, Homo sapiens
aatcagcatgacaaa

SEQ ID NO: 135560 - DNA, 12 bp, Homo sapiens
aatcagctctcc

SEQ ID NO: 135561 - DNA, 19 bp, Homo sapiens
aatcagctctcctggctcc

SEQ ID NO: 135562 - DNA, 15 bp, Homo sapiens
aatcatacttaacat

SEQ ID NO: 135563 - DNA, 20 bp, Homo sapiens
aatccaaagaactatgtaaa

SEQ ID NO: 135564 - DNA, 16 bp, Homo sapiens
aatccgagtgtttgcc

SEQ ID NO: 135565 - DNA, 19 bp, Homo sapiens
aatcctatatctgtttgta

SEQ ID NO: 135566 - DNA, 17 bp, Homo sapiens
aatcgagactgcaatgt

SEQ ID NO: 135567 - DNA, 15 bp, Homo sapiens
aatgaaatgtttact

SEQ ID NO: 135568 - DNA, 12 bp, Homo sapiens
aatgaactgtgg

SEQ ID NO: 135569 - DNA, 16 bp, Homo sapiens
aatgaactgtggaatt

SEQ ID NO: 135570 - DNA, 18 bp, Homo sapiens
aatgaactgtggaattta

SEQ ID NO: 135571 - DNA, 20 bp, Homo sapiens
aatgaacttttacagaatgc

SEQ ID NO: 135572 - DNA, 14 bp, Homo sapiens
aatgagcattagct

SEQ ID NO: 135573 - DNA, 21 bp, Homo sapiens
aatgcatccagcagtacaata

SEQ ID NO: 135574 - DNA, 17 bp, Homo sapiens
aatgccaccacacgtgt

SEQ ID NO: 135575 - DNA, 18 bp, Homo sapiens
aatgcttcactgtacgta

SEQ ID NO: 135576 - DNA, 15 bp, Homo sapiens
aatggtggcttcttt

SEQ ID NO: 135577 - DNA, 20 bp, Homo sapiens
aatgtaattaactgtaaact

SEQ ID NO: 135578 - DNA, 23 bp, Homo sapiens
aatgtcagaaactcgatgaatgt

SEQ ID NO: 135579 - DNA, 20 bp, Homo sapiens
aatgtctcagcgaggtgtaa

SEQ ID NO: 135580 - DNA, 22 bp, Homo sapiens
aatgtgttgatttgagaaattt

SEQ ID NO: 135581 - DNA, 11 bp, Homo sapiens
aattaaaatat

SEQ ID NO: 135582 - DNA, 23 bp, Homo sapiens
aattaaaatattatttgatatct

SEQ ID NO: 135583 - DNA, 15 bp, Homo sapiens
aattagagaactgga

SEQ ID NO: 135584 - DNA, 14 bp, Homo sapiens
aattagcagaatgg

SEQ ID NO: 135585 - DNA, 13 bp, Homo sapiens
aattagtcttttt

SEQ ID NO: 135586 - DNA, 15 bp, Homo sapiens
aattagtctttttct

SEQ ID NO: 135587 - DNA, 22 bp, Homo sapiens
aattagtgttgtgcacttcatg

SEQ ID NO: 135588 - DNA, 15 bp, Homo sapiens
aattatctgcattta

SEQ ID NO: 135589 - DNA, 14 bp, Homo sapiens
aattattaattgtc

SEQ ID NO: 135590 - DNA, 19 bp, Homo sapiens
aattattaattgtcctgtg

SEQ ID NO: 135591 - DNA, 14 bp, Homo sapiens
aattattgtagaca

SEQ ID NO: 135592 - DNA, 14 bp, Homo sapiens
aattcaaagctcta

SEQ ID NO: 135593 - DNA, 13 bp, Homo sapiens
aattcagtgagat

SEQ ID NO: 135594 - DNA, 14 bp, Homo sapiens
aattgaaagtattc

SEQ ID NO: 135595 - DNA, 20 bp, Homo sapiens
aattgaaagtattcagaaat

SEQ ID NO: 135596 - DNA, 14 bp, Homo sapiens
tgtccagtttccaa

SEQ ID NO: 135597 - DNA, 12 bp, Homo sapiens
tgtccataaagt

SEQ ID NO: 135598 - DNA, 12 bp, Homo sapiens
tgtcctatgcaa

SEQ ID NO: 135599 - DNA, 14 bp, Homo sapiens
tgtcctatgcaata

SEQ ID NO: 135600 - DNA, 19 bp, Homo sapiens
tgtcctggaccctggccta

SEQ ID NO: 135601 - DNA, 16 bp, Homo sapiens
tgtcctgtgtctatgt

SEQ ID NO: 135602 - DNA, 14 bp, Homo sapiens
tgtcggcacattca

SEQ ID NO: 135603 - DNA, 14 bp, Homo sapiens
tgtctcagcctccc

SEQ ID NO: 135604 - DNA, 17 bp, Homo sapiens
tgtctcctgtccccggc

SEQ ID NO: 135605 - DNA, 20 bp, Homo sapiens
tgtcttcctagtatattagt

SEQ ID NO: 135606 - DNA, 15 bp, Homo sapiens
acttttgaaaatcaa

SEQ ID NO: 135607 - DNA, 17 bp, Homo sapiens
acttttgtaatttgaat

SEQ ID NO: 135608 - DNA, 19 bp, Homo sapiens
agaaaactcccaatacaaa

SEQ ID NO: 135609 - DNA, 14 bp, Homo sapiens
agaaaaggcaaaag

SEQ ID NO: 135610 - DNA, 18 bp, Homo sapiens
agaaaaggcaaaagactg

SEQ ID NO: 135611 - DNA, 20 bp, Homo sapiens
agaaaaggcaaaagactggt

SEQ ID NO: 135612 - DNA, 14 bp, Homo sapiens
cccacagccctgaa

SEQ ID NO: 135613 - DNA, 15 bp, Homo sapiens
cccacagccctgaaa

SEQ ID NO: 135614 - DNA, 13 bp, Homo sapiens
cccacagccctgg

SEQ ID NO: 135615 - DNA, 15 bp, Homo sapiens
cccacagccctggaa

SEQ ID NO: 135616 - DNA, 16 bp, Homo sapiens
cccacccaccccacag

SEQ ID NO: 135617 - DNA, 14 bp, Homo sapiens
cccacccccacttc

SEQ ID NO: 135618 - DNA, 18 bp, Homo sapiens
cccacctgggccaaggac

SEQ ID NO: 135619 - DNA, 15 bp, Homo sapiens
cccacttcatgccca

SEQ ID NO: 135620 - DNA, 20 bp, Homo sapiens
cccagaggccgctgcccctg

SEQ ID NO: 135621 - DNA, 17 bp, Homo sapiens
cccagccaaaccctgtc

SEQ ID NO: 135622 - DNA, 13 bp, Homo sapiens
cccagccactgca

SEQ ID NO: 135623 - DNA, 15 bp, Homo sapiens
cccagccactgcagc

SEQ ID NO: 135624 - DNA, 12 bp, Homo sapiens
cccagccccaat

SEQ ID NO: 135625 - DNA, 18 bp, Homo sapiens
cccagccccaatccagag

SEQ ID NO: 135626 - DNA, 17 bp, Homo sapiens
cccagcccccacagccc

SEQ ID NO: 135627 - DNA, 20 bp, Homo sapiens
cccagcccccacagccctgg

SEQ ID NO: 135628 - DNA, 19 bp, Homo sapiens
cccagccccgtcccagagg

SEQ ID NO: 135629 - DNA, 17 bp, Homo sapiens
cccagctctctctcctg

SEQ ID NO: 135630 - DNA, 19 bp, Homo sapiens
cccagctctctctcctgga

SEQ ID NO: 135631 - DNA, 13 bp, Homo sapiens
cccaggctggtat

SEQ ID NO: 135632 - DNA, 20 bp, Homo sapiens
cccaggggtggggcccatgg

SEQ ID NO: 135633 - DNA, 23 bp, Homo sapiens
cccaggggtggggcccatggggt

SEQ ID NO: 135634 - DNA, 19 bp, Homo sapiens
cccagttggaggagactgg

SEQ ID NO: 135635 - DNA, 20 bp, Homo sapiens
cccagttggaggagactggg

SEQ ID NO: 135636 - DNA, 20 bp, Homo sapiens
cccatagagaccaggaggga

SEQ ID NO: 135637 - DNA, 13 bp, Homo sapiens
cccatcccacacc

SEQ ID NO: 135638 - DNA, 21 bp, Homo sapiens
cgcagccacaccgctggctcc

SEQ ID NO: 135639 - DNA, 22 bp, Homo sapiens
cgcagccacaccgctggctccg

SEQ ID NO: 135640 - DNA, 15 bp, Homo sapiens
cgccaccctgtctca

SEQ ID NO: 135641 - DNA, 15 bp, Homo sapiens
cgcccacaaactgat

SEQ ID NO: 135642 - DNA, 14 bp, Homo sapiens
cgccccctgaaaca

SEQ ID NO: 135643 - DNA, 16 bp, Homo sapiens
cgctctaccctgcagc

SEQ ID NO: 135644 - DNA, 21 bp, Homo sapiens
cgctgttgcccgccctccacc

SEQ ID NO: 135645 - DNA, 19 bp, Homo sapiens
cgcttctctcttttaaagt

SEQ ID NO: 135646 - DNA, 13 bp, Homo sapiens
cggacactcgcct

SEQ ID NO: 135647 - DNA, 18 bp, Homo sapiens
cggagacccacagccctg

SEQ ID NO: 135648 - DNA, 19 bp, Homo sapiens
cggagacccacagccctga

SEQ ID NO: 135649 - DNA, 14 bp, Homo sapiens
cggagaccctgagt

SEQ ID NO: 135650 - DNA, 21 bp, Homo sapiens
cggaggtggagtggccactgg

SEQ ID NO: 135651 - DNA, 23 bp, Homo sapiens
cggcccctggcagcacagcccag

SEQ ID NO: 135652 - DNA, 18 bp, Homo sapiens
cggcggggtgcctgctgt

SEQ ID NO: 135653 - DNA, 20 bp, Homo sapiens
cggctcgagcagtcctgcct

SEQ ID NO: 135654 - DNA, 12 bp, Homo sapiens
cggctgtctcct

SEQ ID NO: 135655 - DNA, 22 bp, Homo sapiens
cgggaaaaaactttgctccagg

SEQ ID NO: 135656 - DNA, 23 bp, Homo sapiens
cgggaaaaaactttgctccaggc

SEQ ID NO: 135657 - DNA, 17 bp, Homo sapiens
cgggactgggggcggga

SEQ ID NO: 135658 - DNA, 13 bp, Homo sapiens
cgggattccctgg

SEQ ID NO: 135659 - DNA, 16 bp, Homo sapiens
cgggattccctggtgg

SEQ ID NO: 135660 - DNA, 12 bp, Homo sapiens
cgggccaggcag

SEQ ID NO: 135661 - DNA, 13 bp, Homo sapiens
cgggccaggcagg

SEQ ID NO: 135662 - DNA, 18 bp, Homo sapiens
cgggctccatgcctctgg

SEQ ID NO: 135663 - DNA, 17 bp, Homo sapiens
cggggccgcagccacac

SEQ ID NO: 135664 - DNA, 12 bp, Homo sapiens
cggggtgcagaa

SEQ ID NO: 135665 - DNA, 17 bp, Homo sapiens
cgtaagatggcttattt

SEQ ID NO: 135666 - DNA, 17 bp, Homo sapiens
cgtagtctcctgggtgt

SEQ ID NO: 135667 - DNA, 23 bp, Homo sapiens
cgtcaagttgcagatctttttgt

SEQ ID NO: 135668 - DNA, 13 bp, Homo sapiens
cgtcccagaggcc

SEQ ID NO: 135669 - DNA, 15 bp, Homo sapiens
cgtcccagaggccgc

SEQ ID NO: 135670 - DNA, 23 bp, Homo sapiens
cgtcccagaggccgctgcccctg

SEQ ID NO: 135671 - DNA, 17 bp, Homo sapiens
cgtccccctagagactc

SEQ ID NO: 135672 - DNA, 14 bp, Homo sapiens
cgttatatattgta

SEQ ID NO: 135673 - DNA, 15 bp, Homo sapiens
cgttatatattgtat

SEQ ID NO: 135674 - DNA, 14 bp, Homo sapiens
cgttctcagtcctt

SEQ ID NO: 135675 - DNA, 12 bp, Homo sapiens
ctaaaagaagag

SEQ ID NO: 135676 - DNA, 14 bp, Homo sapiens
ctaaaagaagagag

SEQ ID NO: 135677 - DNA, 16 bp, Homo sapiens
ctaaagtcacatataa

SEQ ID NO: 135678 - DNA, 18 bp, Homo sapiens
ctaactgatgagtaaact

SEQ ID NO: 135679 - DNA, 17 bp, Homo sapiens
ctaagtaagaaacacaa

SEQ ID NO: 135680 - DNA, 16 bp, Homo sapiens
ctaagtacccttgggg

SEQ ID NO: 135681 - DNA, 13 bp, Homo sapiens
ctaatgaaagtga

SEQ ID NO: 135682 - DNA, 16 bp, Homo sapiens
ctaatgttatttctta

SEQ ID NO: 135683 - DNA, 19 bp, Homo sapiens
ctaatgttatttcttaaaa

SEQ ID NO: 135684 - DNA, 22 bp, Homo sapiens
ctacaaggtaggctgcaaaatt

SEQ ID NO: 135685 - DNA, 21 bp, Homo sapiens
ctacacacccccaagccacag

SEQ ID NO: 135686 - DNA, 14 bp, Homo sapiens
ctacacatatatgt

SEQ ID NO: 135687 - DNA, 19 bp, Homo sapiens
ctacacatatatgtatatg

SEQ ID NO: 135688 - DNA, 18 bp, Homo sapiens
ctacagtaatgaaatgtt

SEQ ID NO: 135689 - DNA, 19 bp, Homo sapiens
ctaccccacctgacctctg

SEQ ID NO: 135690 - DNA, 13 bp, Homo sapiens
ctacttatcattt

SEQ ID NO: 135691 - DNA, 15 bp, Homo sapiens
ctacttttgaaaatc

SEQ ID NO: 135692 - DNA, 17 bp, Homo sapiens
ctacttttgaaaatcaa

SEQ ID NO: 135693 - DNA, 18 bp, Homo sapiens
ctagaggacactaggaga

SEQ ID NO: 135694 - DNA, 22 bp, Homo sapiens
ctagccccacccagaggtggcc

SEQ ID NO: 135695 - DNA, 13 bp, Homo sapiens
ctagcttttaaaa

SEQ ID NO: 135696 - DNA, 14 bp, Homo sapiens
ctagcttttaaaaa

SEQ ID NO: 135697 - DNA, 18 bp, Homo sapiens
ctagcttttaaaaaatat

SEQ ID NO: 135698 - DNA, 19 bp, Homo sapiens
ctagcttttaaaaaatatt

SEQ ID NO: 135699 - DNA, 13 bp, Homo sapiens
ctaggagactggt

SEQ ID NO: 135700 - DNA, 17 bp, Homo sapiens
ctaggggaggagagagg

SEQ ID NO: 135701 - DNA, 16 bp, Homo sapiens
ctaggtgaacagcagg

SEQ ID NO: 135702 - DNA, 20 bp, Homo sapiens
ctaggtgaacagcaggatgc

SEQ ID NO: 135703 - DNA, 21 bp, Homo sapiens
ctagtatattagtttgattta

SEQ ID NO: 135704 - DNA, 20 bp, Homo sapiens
ctagtgcaattccaagaaaa

SEQ ID NO: 135705 - DNA, 20 bp, Homo sapiens
ctataataagttttgatata

SEQ ID NO: 135706 - DNA, 14 bp, Homo sapiens
ctatatctctaaac

SEQ ID NO: 135707 - DNA, 15 bp, Homo sapiens
ctatatctctaaact

SEQ ID NO: 135708 - DNA, 21 bp, Homo sapiens
ctatatctgtttgtatatttg

SEQ ID NO: 135709 - DNA, 16 bp, Homo sapiens
ctatatgagaagaata

SEQ ID NO: 135710 - DNA, 18 bp, Homo sapiens
ctatatgagaagaatagc

SEQ ID NO: 135711 - DNA, 14 bp, Homo sapiens
ctatcaatatttaa

SEQ ID NO: 135712 - DNA, 13 bp, Homo sapiens
ctatcagaaacag

SEQ ID NO: 135713 - DNA, 14 bp, Homo sapiens
ctattgtttattct

SEQ ID NO: 135714 - DNA, 22 bp, Homo sapiens
ctattgtttattctttttaaag

SEQ ID NO: 135715 - DNA, 14 bp, Homo sapiens
ctcaatagttctta

SEQ ID NO: 135716 - DNA, 16 bp, Homo sapiens
ctcaatagttcttaaa

SEQ ID NO: 135717 - DNA, 17 bp, Homo sapiens
ctcacagtgttgcccag

SEQ ID NO: 135718 - DNA, 20 bp, Homo sapiens
ctcactattacttgaacttt

SEQ ID NO: 135719 - DNA, 23 bp, Homo sapiens
ctcagaggacccacctgggccaa

SEQ ID NO: 135720 - DNA, 17 bp, Homo sapiens
ctcagcccccaggccag

SEQ ID NO: 135721 - DNA, 13 bp, Homo sapiens
ctcagcctcccag

SEQ ID NO: 135722 - DNA, 13 bp, Homo sapiens
ctcagctccctga

SEQ ID NO: 135723 - DNA, 15 bp, Homo sapiens
ctcaggaaagaatag

SEQ ID NO: 135724 - DNA, 16 bp, Homo sapiens
ctcaggattgtttctc

SEQ ID NO: 135725 - DNA, 20 bp, Homo sapiens
ctcagtacctcccctccccg

SEQ ID NO: 135726 - DNA, 18 bp, Homo sapiens
ctcagtggtcaccttcct

SEQ ID NO: 135727 - DNA, 22 bp, Homo sapiens
ctcagtggtcaccttcctcagc

SEQ ID NO: 135728 - DNA, 15 bp, Homo sapiens
ctcatctaactgatg

SEQ ID NO: 135729 - DNA, 20 bp, Homo sapiens
ctcatgatcaagatatatgt

SEQ ID NO: 135730 - DNA, 12 bp, Homo sapiens
ctccacccacta

SEQ ID NO: 135731 - DNA, 21 bp, Homo sapiens
ctccacgtgatttccagtgag

SEQ ID NO: 135732 - DNA, 14 bp, Homo sapiens
ctccatgcctctgg

SEQ ID NO: 135733 - DNA, 23 bp, Homo sapiens
ctccatgcctctggaggcctctg

SEQ ID NO: 135734 - DNA, 13 bp, Homo sapiens
ctcccacccaagg

SEQ ID NO: 135735 - DNA, 16 bp, Homo sapiens
ctcccacccaaggaga

SEQ ID NO: 135736 - DNA, 17 bp, Homo sapiens
ctcccagctctctctcc

SEQ ID NO: 135737 - DNA, 15 bp, Homo sapiens
ctccccgccccctga

SEQ ID NO: 135738 - DNA, 19 bp, Homo sapiens
ctcccgtagtctcctgggt

SEQ ID NO: 135739 - DNA, 14 bp, Homo sapiens
ctccctcccctgcc

SEQ ID NO: 135740 - DNA, 16 bp, Homo sapiens
ggagccccagccccgt

SEQ ID NO: 135741 - DNA, 15 bp, Homo sapiens
ggaggctccgtgagc

SEQ ID NO: 135742 - DNA, 17 bp, Homo sapiens
ggagggaaggggacaga

SEQ ID NO: 135743 - DNA, 19 bp, Homo sapiens
ggaggttcgggattccctg

SEQ ID NO: 135744 - DNA, 13 bp, Homo sapiens
ggagtgccccaag

SEQ ID NO: 135745 - DNA, 22 bp, Homo sapiens
ggagtgccccaaggaggtggct

SEQ ID NO: 135746 - DNA, 11 bp, Homo sapiens
ggataaaataa

SEQ ID NO: 135747 - DNA, 17 bp, Homo sapiens
ggatataaaaggatgtt

SEQ ID NO: 135748 - DNA, 16 bp, Homo sapiens
ggatcaccccagcccc

SEQ ID NO: 135749 - DNA, 15 bp, Homo sapiens
ggatcagaggtcatc

SEQ ID NO: 135750 - DNA, 16 bp, Homo sapiens
ggatcagaggtcatcc

SEQ ID NO: 135751 - DNA, 15 bp, Homo sapiens
ggatggggagtctca

SEQ ID NO: 135752 - DNA, 15 bp, Homo sapiens
ggatgttacaagttt

SEQ ID NO: 135753 - DNA, 20 bp, Homo sapiens
ggatgttacaagtttgctaa

SEQ ID NO: 135754 - DNA, 23 bp, Homo sapiens
ggcacaacgctctaccctgcagc

SEQ ID NO: 135755 - DNA, 24 bp, Homo sapiens
ggcacaacgctctaccctgcagct

SEQ ID NO: 135756 - DNA, 13 bp, Homo sapiens
ggcacccctgcct

SEQ ID NO: 135757 - DNA, 16 bp, Homo sapiens
ggcacttgcctgctgc

SEQ ID NO: 135758 - DNA, 14 bp, Homo sapiens
ggcagcacagccca

SEQ ID NO: 135759 - DNA, 21 bp, Homo sapiens
ggcagcacagcccagggcctg

SEQ ID NO: 135760 - DNA, 12 bp, Homo sapiens
ggcagccaagga

SEQ ID NO: 135761 - DNA, 13 bp, Homo sapiens
ggcagccaaggaa

SEQ ID NO: 135762 - DNA, 20 bp, Homo sapiens
ggcatgggcgcaggcccagt

SEQ ID NO: 135763 - DNA, 18 bp, Homo sapiens
ggcccagccactgcagca

SEQ ID NO: 135764 - DNA, 24 bp, Homo sapiens
ggcccatatctgtgaaatgctggc

SEQ ID NO: 135765 - DNA, 17 bp, Homo sapiens
ggccccaactacacacc

SEQ ID NO: 135766 - DNA, 20 bp, Homo sapiens
ggcccccaagttttttaatt

SEQ ID NO: 135767 - DNA, 12 bp, Homo sapiens
ggcccctggcag

SEQ ID NO: 135768 - DNA, 16 bp, Homo sapiens
ggcccctggcagcaca

SEQ ID NO: 135769 - DNA, 19 bp, Homo sapiens
ggcccctggcagcacagcc

SEQ ID NO: 135770 - DNA, 12 bp, Homo sapiens
ggccctcccagg

SEQ ID NO: 135771 - DNA, 13 bp, Homo sapiens
ggcccttggaata

SEQ ID NO: 135772 - DNA, 21 bp, Homo sapiens
ggccgcagccacaccgctggc

SEQ ID NO: 135773 - DNA, 16 bp, Homo sapiens
ggccgctgcccctgag

SEQ ID NO: 135774 - DNA, 20 bp, Homo sapiens
ggccggagacccacagccct

SEQ ID NO: 135775 - DNA, 22 bp, Homo sapiens
ggccggagacccacagccctga

SEQ ID NO: 135776 - DNA, 12 bp, Homo sapiens
ggccgggactgg

SEQ ID NO: 135777 - DNA, 19 bp, Homo sapiens
ggcctcgacgtcccttgga

SEQ ID NO: 135778 - DNA, 19 bp, Homo sapiens
ggcctcggctgtctcctgt

SEQ ID NO: 135779 - DNA, 13 bp, Homo sapiens
ggcctctggccct

SEQ ID NO: 135780 - DNA, 20 bp, Homo sapiens
ggcctgggcggggccgcagc

SEQ ID NO: 135781 - DNA, 21 bp, Homo sapiens
ggcctggggtgcatcctcctc

SEQ ID NO: 135782 - DNA, 21 bp, Homo sapiens
ggcctgtaatcagctctcctg

SEQ ID NO: 135783 - DNA, 14 bp, Homo sapiens
ggccttcataatgg

SEQ ID NO: 135784 - DNA, 12 bp, Homo sapiens
ggcgcaggccca

SEQ ID NO: 135785 - DNA, 15 bp, Homo sapiens
ggcgcaggcccagtg

SEQ ID NO: 135786 - DNA, 17 bp, Homo sapiens
ggcggggccgggactgg

SEQ ID NO: 135787 - DNA, 16 bp, Homo sapiens
ggcggggtgcctgctg

SEQ ID NO: 135788 - DNA, 14 bp, Homo sapiens
ggctccgtgagccc

SEQ ID NO: 135789 - DNA, 16 bp, Homo sapiens
ggctctttctctctgc

SEQ ID NO: 135790 - DNA, 18 bp, Homo sapiens
ggctctttctctctgctg

SEQ ID NO: 135791 - DNA, 23 bp, Homo sapiens
ggctctttctctctgctgagctg

SEQ ID NO: 135792 - DNA, 13 bp, Homo sapiens
ggctgcacagaag

SEQ ID NO: 135793 - DNA, 18 bp, Homo sapiens
ggcttcaggtctctgtgg

SEQ ID NO: 135794 - DNA, 13 bp, Homo sapiens
ggcttcttaaaaa

SEQ ID NO: 135795 - DNA, 14 bp, Homo sapiens
ggcttcttaaaaac

SEQ ID NO: 135796 - DNA, 15 bp, Homo sapiens
ggcttcttaaaaact

SEQ ID NO: 135797 - DNA, 17 bp, Homo sapiens
ggcttcttaaaaactgt

SEQ ID NO: 135798 - DNA, 18 bp, Homo sapiens
ggcttcttaaaaactgtg

SEQ ID NO: 135799 - DNA, 18 bp, Homo sapiens
ggcttcttttctttgtat

SEQ ID NO: 135800 - DNA, 18 bp, Homo sapiens
gggacagatttgaggact

SEQ ID NO: 135801 - DNA, 15 bp, Homo sapiens
gggaccccctcagga

SEQ ID NO: 135802 - DNA, 14 bp, Homo sapiens
gggagagcctctgt

SEQ ID NO: 135803 - DNA, 15 bp, Homo sapiens
gggaggaaggcccag

SEQ ID NO: 135804 - DNA, 22 bp, Homo sapiens
gggagttgtcaagtctctgctg

SEQ ID NO: 135805 - DNA, 12 bp, Homo sapiens
gggattccctgg

SEQ ID NO: 135806 - DNA, 13 bp, Homo sapiens
gggcacccctgcc

SEQ ID NO: 135807 - DNA, 13 bp, Homo sapiens
gggcacgggcctg

SEQ ID NO: 135808 - DNA, 15 bp, Homo sapiens
gggccactcctcttc

SEQ ID NO: 135809 - DNA, 13 bp, Homo sapiens
gggcccagcccct

SEQ ID NO: 135810 - DNA, 13 bp, Homo sapiens
gggccgggactgg

SEQ ID NO: 135811 - DNA, 15 bp, Homo sapiens
gggcctggcggaggt

SEQ ID NO: 135812 - DNA, 14 bp, Homo sapiens
gggcgcaggcccag

SEQ ID NO: 135813 - DNA, 18 bp, Homo sapiens
gggctccatgcctctgga

SEQ ID NO: 135814 - DNA, 19 bp, Homo sapiens
gggctccatgcctctggag

SEQ ID NO: 135815 - DNA, 23 bp, Homo sapiens
gggctctgacagccctgcggaga

SEQ ID NO: 135816 - DNA, 22 bp, Homo sapiens
gggctctttctctctgctgagc

SEQ ID NO: 135817 - DNA, 16 bp, Homo sapiens
gggcttcaggtctctg

SEQ ID NO: 135818 - DNA, 17 bp, Homo sapiens
gggcttcaggtctctgt

SEQ ID NO: 135819 - DNA, 15 bp, Homo sapiens
ggggccgggactggg

SEQ ID NO: 135820 - DNA, 17 bp, Homo sapiens
ggggcctgggcggggcc

SEQ ID NO: 135821 - DNA, 12 bp, Homo sapiens
ggggtgcctgct

SEQ ID NO: 135822 - DNA, 14 bp, Homo sapiens
ggggtgcctgctgt

SEQ ID NO: 135823 - DNA, 20 bp, Homo sapiens
gggtgcatcctcctcagccc

SEQ ID NO: 135824 - DNA, 13 bp, Homo sapiens
gggtggtgctggg

SEQ ID NO: 135825 - DNA, 21 bp, Homo sapiens
gggtgtgtttggcttggcctt

SEQ ID NO: 135826 - DNA, 15 bp, Homo sapiens
ggtaaatttttgaaa

SEQ ID NO: 135827 - DNA, 23 bp, Homo sapiens
catgtgggccacacaagtgcagt

SEQ ID NO: 135828 - DNA, 21 bp, Homo sapiens
catgttggttgcactttgtag

SEQ ID NO: 135829 - DNA, 15 bp, Homo sapiens
cattaaaatatatgt

SEQ ID NO: 135830 - DNA, 16 bp, Homo sapiens
cattaatcaatttctc

SEQ ID NO: 135831 - DNA, 16 bp, Homo sapiens
cattcctaaaatgctt

SEQ ID NO: 135832 - DNA, 23 bp, Homo sapiens
cattctaggtaggggcccacttc

SEQ ID NO: 135833 - DNA, 16 bp, Homo sapiens
cattgaaatcagcatg

SEQ ID NO: 135834 - DNA, 21 bp, Homo sapiens
cattgcactcatcatattttg

SEQ ID NO: 135835 - DNA, 12 bp, Homo sapiens
catttaaggaga

SEQ ID NO: 135836 - DNA, 16 bp, Homo sapiens
catttaaggagattgg

SEQ ID NO: 135837 - DNA, 20 bp, Homo sapiens
catttcaatttataacgttc

SEQ ID NO: 135838 - DNA, 19 bp, Homo sapiens
catttcatgctatcagaaa

SEQ ID NO: 135839 - DNA, 14 bp, Homo sapiens
catttcattgtaca

SEQ ID NO: 135840 - DNA, 17 bp, Homo sapiens
catttcattgtacaagt

SEQ ID NO: 135841 - DNA, 20 bp, Homo sapiens
catttcattgtacaagtatt

SEQ ID NO: 135842 - DNA, 16 bp, Homo sapiens
cattttaaaagcaatt

SEQ ID NO: 135843 - DNA, 20 bp, Homo sapiens
cattttaaaagcaattatat

SEQ ID NO: 135844 - DNA, 13 bp, Homo sapiens
cattttaaataaa

SEQ ID NO: 135845 - DNA, 17 bp, Homo sapiens
cattttcaccccaccct

SEQ ID NO: 135846 - DNA, 19 bp, Homo sapiens
cattttctgatgcccaccg

SEQ ID NO: 135847 - DNA, 19 bp, Homo sapiens
cattttgcattagacagat

SEQ ID NO: 135848 - DNA, 15 bp, Homo sapiens
cattttgtaaaatat

SEQ ID NO: 135849 - DNA, 16 bp, Homo sapiens
cattttgtaaaatatt

SEQ ID NO: 135850 - DNA, 17 bp, Homo sapiens
catttttgtataaaaag

SEQ ID NO: 135851 - DNA, 20 bp, Homo sapiens
catttttgtataaaaaggaa

SEQ ID NO: 135852 - DNA, 20 bp, Homo sapiens
ccaaaccagtttattctgtg

SEQ ID NO: 135853 - DNA, 14 bp, Homo sapiens
ccggcccctggcag

SEQ ID NO: 135854 - DNA, 16 bp, Homo sapiens
ccggcccctggcagca

SEQ ID NO: 135855 - DNA, 20 bp, Homo sapiens
ccggcggggtgcctgctgtc

SEQ ID NO: 135856 - DNA, 20 bp, Homo sapiens
ccgggctccatgcctctgga

SEQ ID NO: 135857 - DNA, 15 bp, Homo sapiens
ccgtagtctcctggg

SEQ ID NO: 135858 - DNA, 19 bp, Homo sapiens
ccgtagtctcctgggtgtg

SEQ ID NO: 135859 - DNA, 13 bp, Homo sapiens
ccgtcccagaggc

SEQ ID NO: 135860 - DNA, 19 bp, Homo sapiens
ccgtcccagaggccgctgc

SEQ ID NO: 135861 - DNA, 11 bp, Homo sapiens
ccgtgagccct

SEQ ID NO: 135862 - DNA, 15 bp, Homo sapiens
ccgtgagcccttggt

SEQ ID NO: 135863 - DNA, 22 bp, Homo sapiens
cctaaagaggaaaagtgcaatg

SEQ ID NO: 135864 - DNA, 21 bp, Homo sapiens
cctaatgaaagtgatgacata

SEQ ID NO: 135865 - DNA, 17 bp, Homo sapiens
cctaatgtgatcatatg

SEQ ID NO: 135866 - DNA, 11 bp, Homo sapiens
cctagagactc

SEQ ID NO: 135867 - DNA, 18 bp, Homo sapiens
cctagagactcagaggac

SEQ ID NO: 135868 - DNA, 14 bp, Homo sapiens
cctagccccaccca

SEQ ID NO: 135869 - DNA, 15 bp, Homo sapiens
cctagccccacccag

SEQ ID NO: 135870 - DNA, 16 bp, Homo sapiens
cctagccccacccaga

SEQ ID NO: 135871 - DNA, 19 bp, Homo sapiens
cctagccccacccagaggt

SEQ ID NO: 135872 - DNA, 21 bp, Homo sapiens
cctagccccacccagaggtgg

SEQ ID NO: 135873 - DNA, 22 bp, Homo sapiens
cctagcccttctaccccacctg

SEQ ID NO: 135874 - DNA, 13 bp, Homo sapiens
cctagcttttaaa

SEQ ID NO: 135875 - DNA, 14 bp, Homo sapiens
cctagcttttaaaa

SEQ ID NO: 135876 - DNA, 15 bp, Homo sapiens
cctatatctgtttgt

SEQ ID NO: 135877 - DNA, 15 bp, Homo sapiens
cctatatgagaagaa

SEQ ID NO: 135878 - DNA, 15 bp, Homo sapiens
cctatggcccagcca

SEQ ID NO: 135879 - DNA, 18 bp, Homo sapiens
cctatggcccagccactg

SEQ ID NO: 135880 - DNA, 22 bp, Homo sapiens
cctatggcccagccactgcagc

SEQ ID NO: 135881 - DNA, 17 bp, Homo sapiens
cctatgtattttcctaa

SEQ ID NO: 135882 - DNA, 13 bp, Homo sapiens
cctcagacattta

SEQ ID NO: 135883 - DNA, 12 bp, Homo sapiens
cctcagccccca

SEQ ID NO: 135884 - DNA, 17 bp, Homo sapiens
cctcagcccccaggcca

SEQ ID NO: 135885 - DNA, 12 bp, Homo sapiens
cctcagcctccg

SEQ ID NO: 135886 - DNA, 19 bp, Homo sapiens
cctcagctcagctgggcca

SEQ ID NO: 135887 - DNA, 11 bp, Homo sapiens
cctcagctccc

SEQ ID NO: 135888 - DNA, 15 bp, Homo sapiens
cctcagctccctgac

SEQ ID NO: 135889 - DNA, 20 bp, Homo sapiens
cctcagctccctgaccccct

SEQ ID NO: 135890 - DNA, 21 bp, Homo sapiens
cctcagctccctgaccccctg

SEQ ID NO: 135891 - DNA, 16 bp, Homo sapiens
cctcaggaaagaatag

SEQ ID NO: 135892 - DNA, 13 bp, Homo sapiens
cctccacccacta

SEQ ID NO: 135893 - DNA, 21 bp, Homo sapiens
cctccccgaaaacccccagca

SEQ ID NO: 135894 - DNA, 16 bp, Homo sapiens
cctccccgccccctga

SEQ ID NO: 135895 - DNA, 17 bp, Homo sapiens
cctccccgccccctgaa

SEQ ID NO: 135896 - DNA, 20 bp, Homo sapiens
cctcccgccaccctgtctca

SEQ ID NO: 135897 - DNA, 21 bp, Homo sapiens
cctcccgtagtctcctgggtg

SEQ ID NO: 135898 - DNA, 13 bp, Homo sapiens
cctccctgctccc

SEQ ID NO: 135899 - DNA, 14 bp, Homo sapiens
cctcctcagccccc

SEQ ID NO: 135900 - DNA, 12 bp, Homo sapiens
cctcctctcctg

SEQ ID NO: 135901 - DNA, 15 bp, Homo sapiens
cctccttctcccttt

SEQ ID NO: 135902 - DNA, 17 bp, Homo sapiens
cctccttctcccttttt

SEQ ID NO: 135903 - DNA, 16 bp, Homo sapiens
gtgcacctatggccca

SEQ ID NO: 135904 - DNA, 21 bp, Homo sapiens
gtgcacctatggcccagccac

SEQ ID NO: 135905 - DNA, 16 bp, Homo sapiens
gtgcatcctcctcagc

SEQ ID NO: 135906 - DNA, 22 bp, Homo sapiens
gtgcatcctcctcagcccccag

SEQ ID NO: 135907 - DNA, 16 bp, Homo sapiens
gtgcatttaaggagat

SEQ ID NO: 135908 - DNA, 17 bp, Homo sapiens
gtgccccaaggaggtgg

SEQ ID NO: 135909 - DNA, 16 bp, Homo sapiens
gtgcctcagtgctgca

SEQ ID NO: 135910 - DNA, 18 bp, Homo sapiens
gtgctcgcccacaaactg

SEQ ID NO: 135911 - DNA, 13 bp, Homo sapiens
gtgctgagcctgc

SEQ ID NO: 135912 - DNA, 15 bp, Homo sapiens
gtgctgatccttgca

SEQ ID NO: 135913 - DNA, 20 bp, Homo sapiens
gtgcttgttccctctccctg

SEQ ID NO: 135914 - DNA, 11 bp, Homo sapiens
gtggactggtg

SEQ ID NO: 135915 - DNA, 21 bp, Homo sapiens
gtggactggtgtcataaactt

SEQ ID NO: 135916 - DNA, 14 bp, Homo sapiens
gtggggcccatggg

SEQ ID NO: 135917 - DNA, 16 bp, Homo sapiens
gtgggtgaggctgggc

SEQ ID NO: 135918 - DNA, 16 bp, Homo sapiens
gtggttctataataag

SEQ ID NO: 135919 - DNA, 22 bp, Homo sapiens
gtggttttattacaaatgcaaa

SEQ ID NO: 135920 - DNA, 13 bp, Homo sapiens
gtgtcataaactt

SEQ ID NO: 135921 - DNA, 19 bp, Homo sapiens
gtgtctcttgactggctca

SEQ ID NO: 135922 - DNA, 16 bp, Homo sapiens
gtgtgttatattccaa

SEQ ID NO: 135923 - DNA, 22 bp, Homo sapiens
gtgtgttatattccaaggaaaa

SEQ ID NO: 135924 - DNA, 16 bp, Homo sapiens
gtgttactaaagtcac

SEQ ID NO: 135925 - DNA, 18 bp, Homo sapiens
gtgttatattccaaggaa

SEQ ID NO: 135926 - DNA, 17 bp, Homo sapiens
gttaaccacccgccccg

SEQ ID NO: 135927 - DNA, 21 bp, Homo sapiens
gttaagaaaggatataaaagg

SEQ ID NO: 135928 - DNA, 15 bp, Homo sapiens
gttacaagtttgcta

SEQ ID NO: 135929 - DNA, 16 bp, Homo sapiens
gttacaagtttgctaa

SEQ ID NO: 135930 - DNA, 17 bp, Homo sapiens
gttacaagtttgctaaa

SEQ ID NO: 135931 - DNA, 18 bp, Homo sapiens
gttacaagtttgctaaaa

SEQ ID NO: 135932 - DNA, 21 bp, Homo sapiens
gttacaagtttgctaaaagaa

SEQ ID NO: 135933 - DNA, 18 bp, Homo sapiens
gttaggtagagggagttg

SEQ ID NO: 135934 - DNA, 21 bp, Homo sapiens
gttaggtagagggagttgtca

SEQ ID NO: 135935 - DNA, 14 bp, Homo sapiens
gttataataactga

SEQ ID NO: 135936 - DNA, 21 bp, Homo sapiens
gttataataactgaactgttt

SEQ ID NO: 135937 - DNA, 13 bp, Homo sapiens
gttatatattgta

SEQ ID NO: 135938 - DNA, 17 bp, Homo sapiens
gttatatattgtattaa

SEQ ID NO: 135939 - DNA, 13 bp, Homo sapiens
gttatgaaaatcc

SEQ ID NO: 135940 - DNA, 16 bp, Homo sapiens
gttccccccatagaga

SEQ ID NO: 135941 - DNA, 15 bp, Homo sapiens
gttccctctccctgt

SEQ ID NO: 135942 - DNA, 17 bp, Homo sapiens
gttcgggattccctggt

SEQ ID NO: 135943 - DNA, 23 bp, Homo sapiens
gttctcagtggtcaccttcctca

SEQ ID NO: 135944 - DNA, 23 bp, Homo sapiens
gttctgcaagaattaaaactgag

SEQ ID NO: 135945 - DNA, 14 bp, Homo sapiens
gttgcactttgtag

SEQ ID NO: 135946 - DNA, 21 bp, Homo sapiens
gttgcccgccctccacccact

SEQ ID NO: 135947 - DNA, 13 bp, Homo sapiens
gttggcctgcact

SEQ ID NO: 135948 - DNA, 17 bp, Homo sapiens
gttggcgaggaaaaaca

SEQ ID NO: 135949 - DNA, 18 bp, Homo sapiens
gttgggatcgcattgcat

SEQ ID NO: 135950 - DNA, 18 bp, Homo sapiens
gttggttgcactttgtag

SEQ ID NO: 135951 - DNA, 16 bp, Homo sapiens
gttgtagtcaagaggt

SEQ ID NO: 135952 - DNA, 15 bp, Homo sapiens
gttgtatctacagta

SEQ ID NO: 135953 - DNA, 19 bp, Homo sapiens
gtttaattatctgcattta

SEQ ID NO: 135954 - DNA, 16 bp, Homo sapiens
gtttacagtttgtgtt

SEQ ID NO: 135955 - DNA, 17 bp, Homo sapiens
gtttacagtttgtgttt

SEQ ID NO: 135956 - DNA, 20 bp, Homo sapiens
gtttacagtttgtgttttaa

SEQ ID NO: 135957 - DNA, 18 bp, Homo sapiens
gtttattctgtggttcta

SEQ ID NO: 135958 - DNA, 14 bp, Homo sapiens
gtttcagaataaaa

SEQ ID NO: 135959 - DNA, 15 bp, Homo sapiens
gtttcagaataaaat

SEQ ID NO: 135960 - DNA, 13 bp, Homo sapiens
gtttcatgagccc

SEQ ID NO: 135961 - DNA, 15 bp, Homo sapiens
gtttcatgagcccaa

SEQ ID NO: 135962 - DNA, 17 bp, Homo sapiens
gtttcccagtgagcctc

SEQ ID NO: 135963 - DNA, 19 bp, Homo sapiens
gtttcccagtgagcctctg

SEQ ID NO: 135964 - DNA, 14 bp, Homo sapiens
gtttgctaaaagaa

SEQ ID NO: 135965 - DNA, 16 bp, Homo sapiens
gtttgcttaatttcct

SEQ ID NO: 135966 - DNA, 12 bp, Homo sapiens
gtttgtatattt

SEQ ID NO: 135967 - DNA, 13 bp, Homo sapiens
gttttattacaaa

SEQ ID NO: 135968 - DNA, 14 bp, Homo sapiens
gttttgaataaaaa

SEQ ID NO: 135969 - DNA, 16 bp, Homo sapiens
gttttgaataaaaagt

SEQ ID NO: 135970 - DNA, 23 bp, Homo sapiens
gttttgaataaaaagtgaacttt

SEQ ID NO: 135971 - DNA, 23 bp, Homo sapiens
gttttgcttacaaagtatattta

SEQ ID NO: 135972 - DNA, 21 bp, Homo sapiens
gtttttaactctactgtgtaa

SEQ ID NO: 135973 - DNA, 19 bp, Homo sapiens
gttttttttttaagtgcaa

SEQ ID NO: 135974 - DNA, 18 bp, Homo sapiens
taaaaaaactgaaggttt

SEQ ID NO: 135975 - DNA, 19 bp, Homo sapiens
taaaaaataccattgaaat

SEQ ID NO: 135976 - DNA, 15 bp, Homo sapiens
taaaaaatattttaa

SEQ ID NO: 135977 - DNA, 17 bp, Homo sapiens
taaaaaatattttaaga

SEQ ID NO: 135978 - DNA, 22 bp, Homo sapiens
taaaaaatgtgtgtattcttaa

SEQ ID NO: 135979 - DNA, 19 bp, Homo sapiens
taaaaagattatatatcat

SEQ ID NO: 135980 - DNA, 20 bp, Homo sapiens
taaaaaggagaatttttcct

SEQ ID NO: 135981 - DNA, 15 bp, Homo sapiens
taaaaagtgaacttt

SEQ ID NO: 135982 - DNA, 19 bp, Homo sapiens
taaaaatataaattgtaca

SEQ ID NO: 135983 - DNA, 22 bp, Homo sapiens
taaaacaccatcattaagaata

SEQ ID NO: 135984 - DNA, 19 bp, Homo sapiens
taaaactgagtccatgaaa

SEQ ID NO: 135985 - DNA, 20 bp, Homo sapiens
taaaactgagtccatgaaaa

SEQ ID NO: 135986 - DNA, 12 bp, Homo sapiens
taaaactttaaa

SEQ ID NO: 135987 - DNA, 13 bp, Homo sapiens
taaaagaagagag

SEQ ID NO: 135988 - DNA, 16 bp, Homo sapiens
taaaagatcttgcaga

SEQ ID NO: 135989 - DNA, 11 bp, Homo sapiens
taaaaggatgt

SEQ ID NO: 135990 - DNA, 16 bp, Homo sapiens
taaaaggatgttacaa

SEQ ID NO: 135991 - DNA, 16 bp, Homo sapiens
taaaagtgcatttaag

SEQ ID NO: 135992 - DNA, 14 bp, Homo sapiens
taaaagttataata

SEQ ID NO: 135993 - DNA, 17 bp, Homo sapiens
taaaagttataataact

SEQ ID NO: 135994 - DNA, 21 bp, Homo sapiens
taaaagttataataactgaac

SEQ ID NO: 135995 - DNA, 15 bp, Homo sapiens
taaaataaactttct

SEQ ID NO: 135996 - DNA, 15 bp, Homo sapiens
taaaataagaagggg

SEQ ID NO: 135997 - DNA, 16 bp, Homo sapiens
taaaataatgctttga

SEQ ID NO: 135998 - DNA, 16 bp, Homo sapiens
taaaatatatgttctg

SEQ ID NO: 135999 - DNA, 14 bp, Homo sapiens
taaaatattatttg

SEQ ID NO: 136000 - DNA, 18 bp, Homo sapiens
taaaatattatttgatat

SEQ ID NO: 136001 - DNA, 19 bp, Homo sapiens
tcctggagtctgaagcctg

SEQ ID NO: 136002 - DNA, 14 bp, Homo sapiens
tgaaatcagcatga

SEQ ID NO: 136003 - DNA, 21 bp, Homo sapiens
tgaaattcaacctgtgtctta

SEQ ID NO: 136004 - DNA, 19 bp, Homo sapiens
tgaacagcaggatgccctg

SEQ ID NO: 136005 - DNA, 14 bp, Homo sapiens
tgaaccgacttttc

SEQ ID NO: 136006 - DNA, 17 bp, Homo sapiens
tgaactttccaaaacct

SEQ ID NO: 136007 - DNA, 17 bp, Homo sapiens
tgaacttttgtaatttg

SEQ ID NO: 136008 - DNA, 23 bp, Homo sapiens
tgaacttttgtaatttgaattgg

SEQ ID NO: 136009 - DNA, 11 bp, Homo sapiens
tgaagaatcac

SEQ ID NO: 136010 - DNA, 19 bp, Homo sapiens
tgaagattcagtttaagag

SEQ ID NO: 136011 - DNA, 18 bp, Homo sapiens
tgaagctggccctcagct

SEQ ID NO: 136012 - DNA, 19 bp, Homo sapiens
tgaaggacactctgcaggg

SEQ ID NO: 136013 - DNA, 13 bp, Homo sapiens
tgaaggagaaaat

SEQ ID NO: 136014 - DNA, 17 bp, Homo sapiens
tgaagtatttctcactc

SEQ ID NO: 136015 - DNA, 20 bp, Homo sapiens
tgaagtcgagcactctaatt

SEQ ID NO: 136016 - DNA, 15 bp, Homo sapiens
tgaataaaaagtgaa

SEQ ID NO: 136017 - DNA, 12 bp, Homo sapiens
tgaatttcaaaa

SEQ ID NO: 136018 - DNA, 18 bp, Homo sapiens
tgacaaaaataacactgt

SEQ ID NO: 136019 - DNA, 21 bp, Homo sapiens
tgacaaagactcctctgggcc

SEQ ID NO: 136020 - DNA, 13 bp, Homo sapiens
tgaccccctgtcc

SEQ ID NO: 136021 - DNA, 14 bp, Homo sapiens
tgacctctgcaaga

SEQ ID NO: 136022 - DNA, 14 bp, Homo sapiens
tgagaagtgtatat

SEQ ID NO: 136023 - DNA, 18 bp, Homo sapiens
tgagaagtgtatatagtt

SEQ ID NO: 136024 - DNA, 19 bp, Homo sapiens
tgagatataggataaaata

SEQ ID NO: 136025 - DNA, 20 bp, Homo sapiens
tgagatataggataaaataa

SEQ ID NO: 136026 - DNA, 16 bp, Homo sapiens
tgagattaaaaatcta

SEQ ID NO: 136027 - DNA, 22 bp, Homo sapiens
tgagcacgttggcgaggaaaaa

SEQ ID NO: 136028 - DNA, 14 bp, Homo sapiens
tgagccccagcccc

SEQ ID NO: 136029 - DNA, 15 bp, Homo sapiens
tgagcctctgcgcct

SEQ ID NO: 136030 - DNA, 15 bp, Homo sapiens
tgagctgggcccagc

SEQ ID NO: 136031 - DNA, 18 bp, Homo sapiens
tgagctgggcccagcccc

SEQ ID NO: 136032 - DNA, 15 bp, Homo sapiens
tgaggactgaagctg

SEQ ID NO: 136033 - DNA, 21 bp, Homo sapiens
tgaggactgaagctggggctt

SEQ ID NO: 136034 - DNA, 16 bp, Homo sapiens
tgaggctgggcagggc

SEQ ID NO: 136035 - DNA, 21 bp, Homo sapiens
tgagggaagaataaagagctg

SEQ ID NO: 136036 - DNA, 17 bp, Homo sapiens
tgaggtccaccggcccc

SEQ ID NO: 136037 - DNA, 21 bp, Homo sapiens
tgaggtccaccggcccctggc

SEQ ID NO: 136038 - DNA, 14 bp, Homo sapiens
tgagtcagtgaagt

SEQ ID NO: 136039 - DNA, 17 bp, Homo sapiens
tgagtgtaaataatttt

SEQ ID NO: 136040 - DNA, 22 bp, Homo sapiens
tgagtgtaaataattttaaata

SEQ ID NO: 136041 - DNA, 23 bp, Homo sapiens
tgagtgtaaataattttaaataa

SEQ ID NO: 136042 - DNA, 14 bp, Homo sapiens
tgagttctgacact

SEQ ID NO: 136043 - DNA, 17 bp, Homo sapiens
tgatcaaaaataatgca

SEQ ID NO: 136044 - DNA, 18 bp, Homo sapiens
tgatcaaaaataatgcat

SEQ ID NO: 136045 - DNA, 20 bp, Homo sapiens
tgatgagtaaactgaggccc

SEQ ID NO: 136046 - DNA, 16 bp, Homo sapiens
tgatggagggaagggg

SEQ ID NO: 136047 - DNA, 20 bp, Homo sapiens
tgattacctcctgtgtggaa

SEQ ID NO: 136048 - DNA, 14 bp, Homo sapiens
tgattgattcagta

SEQ ID NO: 136049 - DNA, 17 bp, Homo sapiens
tgattgattcagtatct

SEQ ID NO: 136050 - DNA, 22 bp, Homo sapiens
tgcaaaattaaatctagacatt

SEQ ID NO: 136051 - DNA, 20 bp, Homo sapiens
tgcaaacccatgaagctggc

SEQ ID NO: 136052 - DNA, 15 bp, Homo sapiens
tgcaaaccctttgta

SEQ ID NO: 136053 - DNA, 17 bp, Homo sapiens
tgcaaaccctttgtatt

SEQ ID NO: 136054 - DNA, 18 bp, Homo sapiens
tgcaaaccctttgtatta

SEQ ID NO: 136055 - DNA, 22 bp, Homo sapiens
tgcaaatttctataaatttaag

SEQ ID NO: 136056 - DNA, 22 bp, Homo sapiens
tgcaacaagacaaagcaaagcc

SEQ ID NO: 136057 - DNA, 15 bp, Homo sapiens
tgcaagaattaaaac

SEQ ID NO: 136058 - DNA, 21 bp, Homo sapiens
tgcaagacttcactgcagcct

SEQ ID NO: 136059 - DNA, 20 bp, Homo sapiens
tgcaataaaattatttgcag

SEQ ID NO: 136060 - DNA, 22 bp, Homo sapiens
tgcaataaaattatttgcaggt

SEQ ID NO: 136061 - DNA, 18 bp, Homo sapiens
tgcaatgtgatctatgtt

SEQ ID NO: 136062 - DNA, 20 bp, Homo sapiens
tgcaattttaattgattatt

SEQ ID NO: 136063 - DNA, 19 bp, Homo sapiens
tgcacattttgtacaaaga

SEQ ID NO: 136064 - DNA, 21 bp, Homo sapiens
tgcacctatggcccagccact

SEQ ID NO: 136065 - DNA, 20 bp, Homo sapiens
tgcacgcgccctttctacca

SEQ ID NO: 136066 - DNA, 14 bp, Homo sapiens
tgcactcatcatat

SEQ ID NO: 136067 - DNA, 18 bp, Homo sapiens
tgcagatagtgcctctgc

SEQ ID NO: 136068 - DNA, 16 bp, Homo sapiens
tgcagcgggccaggca

SEQ ID NO: 136069 - DNA, 17 bp, Homo sapiens
tgcagcgggccaggcag

SEQ ID NO: 136070 - DNA, 21 bp, Homo sapiens
tgcagttttcaaattataatc

SEQ ID NO: 136071 - DNA, 13 bp, Homo sapiens
tgcatcctcctca

SEQ ID NO: 136072 - DNA, 17 bp, Homo sapiens
tgcatcctcctcagccc

SEQ ID NO: 136073 - DNA, 21 bp, Homo sapiens
tgcatcctcctcagcccccag

SEQ ID NO: 136074 - DNA, 22 bp, Homo sapiens
tgcatgggggcaccgggctcca

SEQ ID NO: 136075 - DNA, 13 bp, Homo sapiens
tgcattacaaagt

SEQ ID NO: 136076 - DNA, 15 bp, Homo sapiens
tgcatttaaggagat

SEQ ID NO: 136077 - DNA, 12 bp, Homo sapiens
tgcatttcatgc

SEQ ID NO: 136078 - DNA, 13 bp, Homo sapiens
tgcatttcatgct

SEQ ID NO: 136079 - DNA, 22 bp, Homo sapiens
tgcatttcatgctatcagaaac

SEQ ID NO: 136080 - DNA, 20 bp, Homo sapiens
tgccactaagtacagctgac

SEQ ID NO: 136081 - DNA, 20 bp, Homo sapiens
tgcccaccgaggagccccag

SEQ ID NO: 136082 - DNA, 11 bp, Homo sapiens
tgcccactgcc

SEQ ID NO: 136083 - DNA, 21 bp, Homo sapiens
tgcccagttggaggagactgg

SEQ ID NO: 136084 - DNA, 22 bp, Homo sapiens
tgcccagttggaggagactggg

SEQ ID NO: 136085 - DNA, 15 bp, Homo sapiens
tgccccacccacccc

SEQ ID NO: 136086 - DNA, 20 bp, Homo sapiens
tgccccacccaccccacaga

SEQ ID NO: 136087 - DNA, 22 bp, Homo sapiens
tgcccctgagttctgacactgt

SEQ ID NO: 136088 - DNA, 13 bp, Homo sapiens
tgcccgccctcca

SEQ ID NO: 136089 - DNA, 16 bp, Homo sapiens
tgcccgccctccaccc

SEQ ID NO: 136090 - DNA, 22 bp, Homo sapiens
tgcccgccctccacccactagg

SEQ ID NO: 136091 - DNA, 18 bp, Homo sapiens
tgccctgttgggggcttc

SEQ ID NO: 136092 - DNA, 22 bp, Homo sapiens
tgccgatgcccaatccaggccc

SEQ ID NO: 136093 - DNA, 24 bp, Homo sapiens
tgcctcccgcctcccgccaccctg

SEQ ID NO: 136094 - DNA, 19 bp, Homo sapiens
tgcctctggaggcctctgg

SEQ ID NO: 136095 - DNA, 16 bp, Homo sapiens
tgcgcctctccactgt

SEQ ID NO: 136096 - DNA, 11 bp, Homo sapiens
tgctaaaagaa

SEQ ID NO: 136097 - DNA, 14 bp, Homo sapiens
tgctaaaagaagag

SEQ ID NO: 136098 - DNA, 23 bp, Homo sapiens
tgctaaaagaagagaggggaaga

SEQ ID NO: 136099 - DNA, 16 bp, Homo sapiens
tgctaaaagtgcattt

SEQ ID NO: 136100 - DNA, 15 bp, Homo sapiens
tgctacttatcattt

SEQ ID NO: 136101 - DNA, 15 bp, Homo sapiens
tgctatcagaaacag

SEQ ID NO: 136102 - DNA, 18 bp, Homo sapiens
tgctccaggcatcactga

SEQ ID NO: 136103 - DNA, 14 bp, Homo sapiens
tttttgaaaaatat

SEQ ID NO: 136104 - DNA, 21 bp, Homo sapiens
tttttgaaaaatattgctaaa

SEQ ID NO: 136105 - DNA, 20 bp, Homo sapiens
tttttggtaaatttttgaaa

SEQ ID NO: 136106 - DNA, 23 bp, Homo sapiens
tttttggtaaatttttgaaaaat

SEQ ID NO: 136107 - DNA, 14 bp, Homo sapiens
tttttgtaacttca

SEQ ID NO: 136108 - DNA, 23 bp, Homo sapiens
tttttgtacgttatatattgtat

SEQ ID NO: 136109 - DNA, 21 bp, Homo sapiens
tttttgtataaaaaggaaatt

SEQ ID NO: 136110 - DNA, 17 bp, Homo sapiens
ttttttaagtgcaacat

SEQ ID NO: 136111 - DNA, 13 bp, Homo sapiens
ttttttgtaactt

SEQ ID NO: 136112 - DNA, 13 bp, Homo sapiens
ttttttttttcca

SEQ ID NO: 136113 - DNA, 18 bp, Homo sapiens
gaccacacattttatgag

SEQ ID NO: 136114 - DNA, 20 bp, Homo sapiens
gaccacacattttatgagag

SEQ ID NO: 136115 - DNA, 15 bp, Homo sapiens
gaccaggagggagag

SEQ ID NO: 136116 - DNA, 11 bp, Homo sapiens
gacccacagcc

SEQ ID NO: 136117 - DNA, 19 bp, Homo sapiens
gacccacctgggccaagga

SEQ ID NO: 136118 - DNA, 17 bp, Homo sapiens
gaccgggctctgacagc

SEQ ID NO: 136119 - DNA, 18 bp, Homo sapiens
gacgtgaatgtctcagcg

SEQ ID NO: 136120 - DNA, 12 bp, Homo sapiens
gactgaagctgg

SEQ ID NO: 136121 - DNA, 14 bp, Homo sapiens
gactgaagctgggg

SEQ ID NO: 136122 - DNA, 14 bp, Homo sapiens
gactggctcaagaa

SEQ ID NO: 136123 - DNA, 21 bp, Homo sapiens
gactgggcacccctgcctcct

SEQ ID NO: 136124 - DNA, 16 bp, Homo sapiens
gactgtcaaatgaact

SEQ ID NO: 136125 - DNA, 15 bp, Homo sapiens
gacttcactgcagcc

SEQ ID NO: 136126 - DNA, 17 bp, Homo sapiens
gacttcactgcagcctt

SEQ ID NO: 136127 - DNA, 22 bp, Homo sapiens
gagaaactgagaaatgaatgct

SEQ ID NO: 136128 - DNA, 22 bp, Homo sapiens
gagaaagaaaaggcaaaagact

SEQ ID NO: 136129 - DNA, 23 bp, Homo sapiens
gagaaagaaaaggcaaaagactg

SEQ ID NO: 136130 - DNA, 15 bp, Homo sapiens
gagaaagactgatta

SEQ ID NO: 136131 - DNA, 19 bp, Homo sapiens
gagaaatgaatgctgagac

SEQ ID NO: 136132 - DNA, 21 bp, Homo sapiens
gagaaattttactgacagaaa

SEQ ID NO: 136133 - DNA, 11 bp, Homo sapiens
gagaagaatag

SEQ ID NO: 136134 - DNA, 16 bp, Homo sapiens
gagacaataaacagct

SEQ ID NO: 136135 - DNA, 20 bp, Homo sapiens
gagacaattagcagaatgga

SEQ ID NO: 136136 - DNA, 22 bp, Homo sapiens
gagacaggagcagcccacccag

SEQ ID NO: 136137 - DNA, 13 bp, Homo sapiens
gagaccaggaggg

SEQ ID NO: 136138 - DNA, 13 bp, Homo sapiens
gagacccacagcc

SEQ ID NO: 136139 - DNA, 14 bp, Homo sapiens
gagacccacagccc

SEQ ID NO: 136140 - DNA, 19 bp, Homo sapiens
gagacccacagccctgaaa

SEQ ID NO: 136141 - DNA, 17 bp, Homo sapiens
gagagaccacacatttt

SEQ ID NO: 136142 - DNA, 19 bp, Homo sapiens
gagaggcctcggctgtctc

SEQ ID NO: 136143 - DNA, 23 bp, Homo sapiens
gagaggcctcggctgtctcctgt

SEQ ID NO: 136144 - DNA, 18 bp, Homo sapiens
gagagtttttaatagaac

SEQ ID NO: 136145 - DNA, 20 bp, Homo sapiens
gagcacgttggcgaggaaaa

SEQ ID NO: 136146 - DNA, 23 bp, Homo sapiens
gagcacgttggcgaggaaaaaca

SEQ ID NO: 136147 - DNA, 18 bp, Homo sapiens
gagcagcccacccagcag

SEQ ID NO: 136148 - DNA, 18 bp, Homo sapiens
gagcaggggtctgagcca

SEQ ID NO: 136149 - DNA, 16 bp, Homo sapiens
gagccccagccccaat

SEQ ID NO: 136150 - DNA, 14 bp, Homo sapiens
gagccccagccccg

SEQ ID NO: 136151 - DNA, 18 bp, Homo sapiens
gagcctctgttttgtaaa

SEQ ID NO: 136152 - DNA, 22 bp, Homo sapiens
gagcctgcccagttggaggaga

SEQ ID NO: 136153 - DNA, 22 bp, Homo sapiens
gagctgggcccagcccctccac

SEQ ID NO: 136154 - DNA, 18 bp, Homo sapiens
gagctgtccggctggtgg

SEQ ID NO: 136155 - DNA, 20 bp, Homo sapiens
gaggaaaagtgcaatgcgtg

SEQ ID NO: 136156 - DNA, 22 bp, Homo sapiens
gaggaaccacatataacactta

SEQ ID NO: 136157 - DNA, 23 bp, Homo sapiens
gaggaaccacatataacacttaa

SEQ ID NO: 136158 - DNA, 15 bp, Homo sapiens
gaggaaggcccaggg

SEQ ID NO: 136159 - DNA, 20 bp, Homo sapiens
gaggacactaggagactggt

SEQ ID NO: 136160 - DNA, 13 bp, Homo sapiens
gaggacccacctg

SEQ ID NO: 136161 - DNA, 15 bp, Homo sapiens
gaggactgaagctgg

SEQ ID NO: 136162 - DNA, 16 bp, Homo sapiens
gaggagaaactgagaa

SEQ ID NO: 136163 - DNA, 12 bp, Homo sapiens
gaggagccccag

SEQ ID NO: 136164 - DNA, 18 bp, Homo sapiens
gaggccaaggtttcccag

SEQ ID NO: 136165 - DNA, 18 bp, Homo sapiens
gaggccgctgcccctgag

SEQ ID NO: 136166 - DNA, 17 bp, Homo sapiens
gaggcctcggctgtctc

SEQ ID NO: 136167 - DNA, 18 bp, Homo sapiens
gaggcctcggctgtctcc

SEQ ID NO: 136168 - DNA, 21 bp, Homo sapiens
gaggcctcggctgtctcctgt

SEQ ID NO: 136169 - DNA, 22 bp, Homo sapiens
gaggcctcggctgtctcctgtc

SEQ ID NO: 136170 - DNA, 13 bp, Homo sapiens
gaggcctctggcc

SEQ ID NO: 136171 - DNA, 15 bp, Homo sapiens
gaggcctctggccct

SEQ ID NO: 136172 - DNA, 17 bp, Homo sapiens
gaggctccgtgagccct

SEQ ID NO: 136173 - DNA, 20 bp, Homo sapiens
gaggctccgtgagcccttgg

SEQ ID NO: 136174 - DNA, 15 bp, Homo sapiens
gaggggaagaattta

SEQ ID NO: 136175 - DNA, 21 bp, Homo sapiens
gaggtaactatcaatatttaa

SEQ ID NO: 136176 - DNA, 19 bp, Homo sapiens
gaggtccaccggcccctgg

SEQ ID NO: 136177 - DNA, 18 bp, Homo sapiens
gaggtggccctcccaggc

SEQ ID NO: 136178 - DNA, 20 bp, Homo sapiens
gaggttcgggattccctggt

SEQ ID NO: 136179 - DNA, 23 bp, Homo sapiens
gagtcagtgaagtctagaatcat

SEQ ID NO: 136180 - DNA, 12 bp, Homo sapiens
gagtctgaagcc

SEQ ID NO: 136181 - DNA, 14 bp, Homo sapiens
gagtgaaacagaga

SEQ ID NO: 136182 - DNA, 19 bp, Homo sapiens
gagtgaaacagagaaagaa

SEQ ID NO: 136183 - DNA, 15 bp, Homo sapiens
gatagtgcctctgca

SEQ ID NO: 136184 - DNA, 14 bp, Homo sapiens
gatataaaaggatg

SEQ ID NO: 136185 - DNA, 20 bp, Homo sapiens
gatataaaaggatgttacaa

SEQ ID NO: 136186 - DNA, 18 bp, Homo sapiens
gatataatcttggcttct

SEQ ID NO: 136187 - DNA, 17 bp, Homo sapiens
gatataggataaaataa

SEQ ID NO: 136188 - DNA, 23 bp, Homo sapiens
gatatgaatatatggcatttgca

SEQ ID NO: 136189 - DNA, 18 bp, Homo sapiens
gatatggcttaggaatga

SEQ ID NO: 136190 - DNA, 24 bp, Homo sapiens
taaagtatttataaaaatataaat

SEQ ID NO: 136191 - DNA, 14 bp, Homo sapiens
taaataacctctgg

SEQ ID NO: 136192 - DNA, 19 bp, Homo sapiens
taaataacctctggccctt

SEQ ID NO: 136193 - DNA, 22 bp, Homo sapiens
taaataacctctggcccttgga

SEQ ID NO: 136194 - DNA, 23 bp, Homo sapiens
taaataacctctggcccttggaa

SEQ ID NO: 136195 - DNA, 21 bp, Homo sapiens
taaatatctgaacatttacta

SEQ ID NO: 136196 - DNA, 20 bp, Homo sapiens
taaatcattttaggaaagga

SEQ ID NO: 136197 - DNA, 21 bp, Homo sapiens
taaatcattttaggaaaggat

SEQ ID NO: 136198 - DNA, 19 bp, Homo sapiens
taaattgtacattttgtaa

SEQ ID NO: 136199 - DNA, 21 bp, Homo sapiens
taaattgtacattttgtaaaa

SEQ ID NO: 136200 - DNA, 15 bp, Homo sapiens
taaatttttgaaaaa

SEQ ID NO: 136201 - DNA, 16 bp, Homo sapiens
taaatttttgaaaaat

SEQ ID NO: 136202 - DNA, 17 bp, Homo sapiens
taaatttttgaaaaata

SEQ ID NO: 136203 - DNA, 18 bp, Homo sapiens
taaatttttgaaaaatat

SEQ ID NO: 136204 - DNA, 14 bp, Homo sapiens
taacaaaaaatgta

SEQ ID NO: 136205 - DNA, 16 bp, Homo sapiens
taacaaaaaatgtaat

SEQ ID NO: 136206 - DNA, 17 bp, Homo sapiens
taacatttcattgtaca

SEQ ID NO: 136207 - DNA, 22 bp, Homo sapiens
taaccacccgccccgccccctc

SEQ ID NO: 136208 - DNA, 10 bp, Homo sapiens
taacctctgg

SEQ ID NO: 136209 - DNA, 13 bp, Homo sapiens
taacctctggccc

SEQ ID NO: 136210 - DNA, 18 bp, Homo sapiens
taacctctggcccttgga

SEQ ID NO: 136211 - DNA, 19 bp, Homo sapiens
taacgtgattgattcagta

SEQ ID NO: 136212 - DNA, 16 bp, Homo sapiens
taactatcaatattta

SEQ ID NO: 136213 - DNA, 18 bp, Homo sapiens
taactatcaatatttaag

SEQ ID NO: 136214 - DNA, 19 bp, Homo sapiens
taactgatgagtaaactga

SEQ ID NO: 136215 - DNA, 13 bp, Homo sapiens
taactgtaaactt

SEQ ID NO: 136216 - DNA, 15 bp, Homo sapiens
taagaaaacaagtat

SEQ ID NO: 136217 - DNA, 12 bp, Homo sapiens
taagaaaagtaa

SEQ ID NO: 136218 - DNA, 19 bp, Homo sapiens
taagaaagagaatgaactg

SEQ ID NO: 136219 - DNA, 22 bp, Homo sapiens
taagatggcttatttgtataat

SEQ ID NO: 136220 - DNA, 13 bp, Homo sapiens
taagcagaaacag

SEQ ID NO: 136221 - DNA, 19 bp, Homo sapiens
taagcttctagacactcct

SEQ ID NO: 136222 - DNA, 21 bp, Homo sapiens
taaggatcaccccagccccca

SEQ ID NO: 136223 - DNA, 14 bp, Homo sapiens
taagtaagaaacac

SEQ ID NO: 136224 - DNA, 17 bp, Homo sapiens
taagtacccttggggtg

SEQ ID NO: 136225 - DNA, 13 bp, Homo sapiens
taagtgcaacatt

SEQ ID NO: 136226 - DNA, 12 bp, Homo sapiens
taataactgaac

SEQ ID NO: 136227 - DNA, 15 bp, Homo sapiens
taataactgaactgt

SEQ ID NO: 136228 - DNA, 16 bp, Homo sapiens
taataactgaactgtt

SEQ ID NO: 136229 - DNA, 15 bp, Homo sapiens
taataagttttgata

SEQ ID NO: 136230 - DNA, 17 bp, Homo sapiens
taatatttttacatgca

SEQ ID NO: 136231 - DNA, 16 bp, Homo sapiens
taatcagctctcctgg

SEQ ID NO: 136232 - DNA, 17 bp, Homo sapiens
taatcagctctcctggc

SEQ ID NO: 136233 - DNA, 16 bp, Homo sapiens
taatgaaatgtttact

SEQ ID NO: 136234 - DNA, 15 bp, Homo sapiens
taatgctttgagaag

SEQ ID NO: 136235 - DNA, 14 bp, Homo sapiens
taatggactgtgaa

SEQ ID NO: 136236 - DNA, 15 bp, Homo sapiens
taatggactgtgaat

SEQ ID NO: 136237 - DNA, 20 bp, Homo sapiens
taatggactgtgaatttcaa

SEQ ID NO: 136238 - DNA, 22 bp, Homo sapiens
taatggactgtgaatttcaaaa

SEQ ID NO: 136239 - DNA, 20 bp, Homo sapiens
taatgtgatcatatgaggac

SEQ ID NO: 136240 - DNA, 20 bp, Homo sapiens
taatgttatttcttaaaatt

SEQ ID NO: 136241 - DNA, 12 bp, Homo sapiens
taattagagaac

SEQ ID NO: 136242 - DNA, 21 bp, Homo sapiens
taattagagaactggaggaac

SEQ ID NO: 136243 - DNA, 16 bp, Homo sapiens
taattgaacaataaag

SEQ ID NO: 136244 - DNA, 17 bp, Homo sapiens
taatttccttctgttaa

SEQ ID NO: 136245 - DNA, 18 bp, Homo sapiens
taatttccttctgttaag

SEQ ID NO: 136246 - DNA, 20 bp, Homo sapiens
taatttccttctgttaagaa

SEQ ID NO: 136247 - DNA, 21 bp, Homo sapiens
taatttccttctgttaagaaa

SEQ ID NO: 136248 - DNA, 12 bp, Homo sapiens
taatttgaattg

SEQ ID NO: 136249 - DNA, 22 bp, Homo sapiens
tacaaggtaggctgcaaaatta

SEQ ID NO: 136250 - DNA, 14 bp, Homo sapiens
tacaagtttgctaa

SEQ ID NO: 136251 - DNA, 16 bp, Homo sapiens
tacaagtttgctaaaa

SEQ ID NO: 136252 - DNA, 18 bp, Homo sapiens
tacaagtttgctaaaaga

SEQ ID NO: 136253 - DNA, 21 bp, Homo sapiens
tacaagtttgctaaaagaaga

SEQ ID NO: 136254 - DNA, 13 bp, Homo sapiens
tacaataaaagta

SEQ ID NO: 136255 - DNA, 23 bp, Homo sapiens
tacaatatatagctggcaagaat

SEQ ID NO: 136256 - DNA, 20 bp, Homo sapiens
tacacacccccaagccacag

SEQ ID NO: 136257 - DNA, 18 bp, Homo sapiens
tacactaggaaacgtgtt

SEQ ID NO: 136258 - DNA, 17 bp, Homo sapiens
tacagaatgcattaaaa

SEQ ID NO: 136259 - DNA, 13 bp, Homo sapiens
tacagtttgtgtt

SEQ ID NO: 136260 - DNA, 21 bp, Homo sapiens
tacagtttgtgttttaaaaaa

SEQ ID NO: 136261 - DNA, 18 bp, Homo sapiens
tacattttgtaaaatatt

SEQ ID NO: 136262 - DNA, 14 bp, Homo sapiens
taccataggaagac

SEQ ID NO: 136263 - DNA, 20 bp, Homo sapiens
taccataggaagacataaaa

SEQ ID NO: 136264 - DNA, 23 bp, Homo sapiens
taccataggaagacataaaactt

SEQ ID NO: 136265 - DNA, 16 bp, Homo sapiens
taccattgaaatcagc

SEQ ID NO: 136266 - DNA, 19 bp, Homo sapiens
taccccacctgacctctgc

SEQ ID NO: 136267 - DNA, 14 bp, Homo sapiens
taccctgcagcttg

SEQ ID NO: 136268 - DNA, 16 bp, Homo sapiens
tacctcaggaaagaat

SEQ ID NO: 136269 - DNA, 18 bp, Homo sapiens
tacctcaggaaagaatag

SEQ ID NO: 136270 - DNA, 21 bp, Homo sapiens
tacctctagctgttctttttt

SEQ ID NO: 136271 - DNA, 20 bp, Homo sapiens
tactaatgttatttcttaaa

SEQ ID NO: 136272 - DNA, 14 bp, Homo sapiens
tactacagttttta

SEQ ID NO: 136273 - DNA, 15 bp, Homo sapiens
tacttatcatttttg

SEQ ID NO: 136274 - DNA, 15 bp, Homo sapiens
tacttctgagcccca

SEQ ID NO: 136275 - DNA, 20 bp, Homo sapiens
tacttctgagccccagcccc

SEQ ID NO: 136276 - DNA, 20 bp, Homo sapiens
tacttgcagctcccattcta

SEQ ID NO: 136277 - DNA, 22 bp, Homo sapiens
tacttgcagctcccattctatg

SEQ ID NO: 136278 - DNA, 13 bp, Homo sapiens
tactttgtagact

SEQ ID NO: 136279 - DNA, 16 bp, Homo sapiens
tactttgtagactgtt

SEQ ID NO: 136280 - DNA, 19 bp, Homo sapiens
tactttgtagactgtttca

SEQ ID NO: 136281 - DNA, 18 bp, Homo sapiens
tacttttctggttccaaa

SEQ ID NO: 136282 - DNA, 14 bp, Homo sapiens
tacttttctgttta

SEQ ID NO: 136283 - DNA, 17 bp, Homo sapiens
tacttttctgtttagtt

SEQ ID NO: 136284 - DNA, 15 bp, Homo sapiens
tacttttgaaaatca

SEQ ID NO: 136285 - DNA, 12 bp, Homo sapiens
tagaaaattaaa

SEQ ID NO: 136286 - DNA, 16 bp, Homo sapiens
tagaaaattaaaataa

SEQ ID NO: 136287 - DNA, 21 bp, Homo sapiens
tagaaagaaactaaacagaaa

SEQ ID NO: 136288 - DNA, 19 bp, Homo sapiens
tagagaccaggagggagag

SEQ ID NO: 136289 - DNA, 17 bp, Homo sapiens
tagaggacactaggaga

SEQ ID NO: 136290 - DNA, 13 bp, Homo sapiens
gtgagtgtaaata

SEQ ID NO: 136291 - DNA, 14 bp, Homo sapiens
gtgatcatatgagg

SEQ ID NO: 136292 - DNA, 13 bp, Homo sapiens
gtgatgacatatt

SEQ ID NO: 136293 - DNA, 22 bp, Homo sapiens
gtgcaacatttctgtatactgt

SEQ ID NO: 136294 - DNA, 15 bp, Homo sapiens
gtgcacccagaagaa

SEQ ID NO: 136295 - DNA, 22 bp, Homo sapiens
aggatgggtctggtttgcagag

SEQ ID NO: 136296 - DNA, 16 bp, Homo sapiens
aggatgtcacagggcc

SEQ ID NO: 136297 - DNA, 17 bp, Homo sapiens
aggatgtcacagggcca

SEQ ID NO: 136298 - DNA, 16 bp, Homo sapiens
aggattacatgcatgt

SEQ ID NO: 136299 - DNA, 16 bp, Homo sapiens
aggatttaacagtcat

SEQ ID NO: 136300 - DNA, 20 bp, Homo sapiens
aggatttaacagtcatttaa

SEQ ID NO: 136301 - DNA, 22 bp, Homo sapiens
aggcaaacccatcaacaaaaat

SEQ ID NO: 136302 - DNA, 17 bp, Homo sapiens
aggcaactcatcttagg

SEQ ID NO: 136303 - DNA, 17 bp, Homo sapiens
aggcaactgaggcagac

SEQ ID NO: 136304 - DNA, 17 bp, Homo sapiens
aggcaagtgaagaaaag

SEQ ID NO: 136305 - DNA, 15 bp, Homo sapiens
aggcaagtttctagc

SEQ ID NO: 136306 - DNA, 18 bp, Homo sapiens
aggcaagtttctagctag

SEQ ID NO: 136307 - DNA, 18 bp, Homo sapiens
aggcacgaacccacctgc

SEQ ID NO: 136308 - DNA, 23 bp, Homo sapiens
aggcactagcctttggctctgga

SEQ ID NO: 136309 - DNA, 14 bp, Homo sapiens
aggcactgctgccc

SEQ ID NO: 136310 - DNA, 21 bp, Homo sapiens
aggcagacacagggacttgaa

SEQ ID NO: 136311 - DNA, 13 bp, Homo sapiens
aggcagacagcag

SEQ ID NO: 136312 - DNA, 15 bp, Homo sapiens
aggcagacagcagct

SEQ ID NO: 136313 - DNA, 21 bp, Homo sapiens
aggcagacagcagctcaggca

SEQ ID NO: 136314 - DNA, 22 bp, Homo sapiens
aggcagacttccctgaatgtat

SEQ ID NO: 136315 - DNA, 9 bp, Homo sapiens
aggcagaga

SEQ ID NO: 136316 - DNA, 20 bp, Homo sapiens
aggcagagagcggtctcagg

SEQ ID NO: 136317 - DNA, 20 bp, Homo sapiens
aggcagcagtgtgaggccag

SEQ ID NO: 136318 - DNA, 23 bp, Homo sapiens
aggcagcagtgtgaggccagggc

SEQ ID NO: 136319 - DNA, 12 bp, Homo sapiens
aggcaggatggc

SEQ ID NO: 136320 - DNA, 21 bp, Homo sapiens
aggcagggccttgcccagaga

SEQ ID NO: 136321 - DNA, 23 bp, Homo sapiens
aggcagggccttgcccagagatg

SEQ ID NO: 136322 - DNA, 13 bp, Homo sapiens
aggcaggggcgga

SEQ ID NO: 136323 - DNA, 17 bp, Homo sapiens
aggcagggtcaggagag

SEQ ID NO: 136324 - DNA, 20 bp, Homo sapiens
aggcagggtcaggagagggg

SEQ ID NO: 136325 - DNA, 14 bp, Homo sapiens
aggcaggtagccag

SEQ ID NO: 136326 - DNA, 15 bp, Homo sapiens
aggcaggtgcctgga

SEQ ID NO: 136327 - DNA, 12 bp, Homo sapiens
aggcatggccct

SEQ ID NO: 136328 - DNA, 14 bp, Homo sapiens
aggcattgccaagg

SEQ ID NO: 136329 - DNA, 16 bp, Homo sapiens
aggcattgccaagggc

SEQ ID NO: 136330 - DNA, 21 bp, Homo sapiens
aggcattgccaagggctttgt

SEQ ID NO: 136331 - DNA, 18 bp, Homo sapiens
aggccaaggtgggaggat

SEQ ID NO: 136332 - DNA, 23 bp, Homo sapiens
aggccaagtttgtatcaggtgcc

SEQ ID NO: 136333 - DNA, 13 bp, Homo sapiens
aggccactcctcc

SEQ ID NO: 136334 - DNA, 18 bp, Homo sapiens
aggccagctggcagcaga

SEQ ID NO: 136335 - DNA, 22 bp, Homo sapiens
aggccaggctccttcctgtctt

SEQ ID NO: 136336 - DNA, 13 bp, Homo sapiens
aggccccactggg

SEQ ID NO: 136337 - DNA, 15 bp, Homo sapiens
aggccccactgggga

SEQ ID NO: 136338 - DNA, 12 bp, Homo sapiens
aggccccaggaa

SEQ ID NO: 136339 - DNA, 20 bp, Homo sapiens
aggccccgcttgtccagcgc

SEQ ID NO: 136340 - DNA, 17 bp, Homo sapiens
aggcccctggacaagca

SEQ ID NO: 136341 - DNA, 13 bp, Homo sapiens
aggccctgtctgt

SEQ ID NO: 136342 - DNA, 19 bp, Homo sapiens
aggcccttcctctccactg

SEQ ID NO: 136343 - DNA, 22 bp, Homo sapiens
aggccgaagaagggtccttccc

SEQ ID NO: 136344 - DNA, 15 bp, Homo sapiens
aggccgagaagcaag

SEQ ID NO: 136345 - DNA, 19 bp, Homo sapiens
aggccggcgagccctgtgg

SEQ ID NO: 136346 - DNA, 14 bp, Homo sapiens
aggcctctgtgtcc

SEQ ID NO: 136347 - DNA, 16 bp, Homo sapiens
aggcctctgtgtcctt

SEQ ID NO: 136348 - DNA, 18 bp, Homo sapiens
aggcctgaaaggagccct

SEQ ID NO: 136349 - DNA, 13 bp, Homo sapiens
aggcctgcctgtt

SEQ ID NO: 136350 - DNA, 14 bp, Homo sapiens
aggcgccccttccc

SEQ ID NO: 136351 - DNA, 14 bp, Homo sapiens
aggcgggaaggagg

SEQ ID NO: 136352 - DNA, 15 bp, Homo sapiens
aggcgggaaggaggg

SEQ ID NO: 136353 - DNA, 18 bp, Homo sapiens
aggcgttcttcgaggtgg

SEQ ID NO: 136354 - DNA, 19 bp, Homo sapiens
aggcgttcttcgaggtgga

SEQ ID NO: 136355 - DNA, 21 bp, Homo sapiens
aggctcacccccttctccatc

SEQ ID NO: 136356 - DNA, 22 bp, Homo sapiens
aggctcatagggaagacctgct

SEQ ID NO: 136357 - DNA, 16 bp, Homo sapiens
aggctccttcctgtct

SEQ ID NO: 136358 - DNA, 16 bp, Homo sapiens
agcctttgcctccccg

SEQ ID NO: 136359 - DNA, 18 bp, Homo sapiens
agcctttggctctggaga

SEQ ID NO: 136360 - DNA, 13 bp, Homo sapiens
agcgacagtgaga

SEQ ID NO: 136361 - DNA, 19 bp, Homo sapiens
agcgacatagcccatccct

SEQ ID NO: 136362 - DNA, 21 bp, Homo sapiens
agcgacatagcccatccctgc

SEQ ID NO: 136363 - DNA, 19 bp, Homo sapiens
agcgaggtcaacagagaag

SEQ ID NO: 136364 - DNA, 23 bp, Homo sapiens
agcgaggtcaacagagaaggcag

SEQ ID NO: 136365 - DNA, 23 bp, Homo sapiens
agcgcctagtggggtctccctct

SEQ ID NO: 136366 - DNA, 12 bp, Homo sapiens
agcgcctgcccc

SEQ ID NO: 136367 - DNA, 12 bp, Homo sapiens
agcgcgccactc

SEQ ID NO: 136368 - DNA, 22 bp, Homo sapiens
agcgcgccactcgcttccccca

SEQ ID NO: 136369 - DNA, 17 bp, Homo sapiens
agcgctgccgcacccca

SEQ ID NO: 136370 - DNA, 21 bp, Homo sapiens
agcgctgccgcaccccagagt

SEQ ID NO: 136371 - DNA, 17 bp, Homo sapiens
agcggaaagcagctcaa

SEQ ID NO: 136372 - DNA, 23 bp, Homo sapiens
agcggctggcagcccacccctca

SEQ ID NO: 136373 - DNA, 21 bp, Homo sapiens
agcggtggccctgtccctccc

SEQ ID NO: 136374 - DNA, 15 bp, Homo sapiens
agcgtcctcctctgt

SEQ ID NO: 136375 - DNA, 22 bp, Homo sapiens
agcgtgaaggccgagaagcaag

SEQ ID NO: 136376 - DNA, 23 bp, Homo sapiens
agcgtgaaggccgagaagcaaga

SEQ ID NO: 136377 - DNA, 15 bp, Homo sapiens
agcgtgcataagtta

SEQ ID NO: 136378 - DNA, 13 bp, Homo sapiens
agctaaatccttt

SEQ ID NO: 136379 - DNA, 23 bp, Homo sapiens
agctaatgtaataactgtgaagt

SEQ ID NO: 136380 - DNA, 13 bp, Homo sapiens
agctactcaggag

SEQ ID NO: 136381 - DNA, 17 bp, Homo sapiens
agctactcaggaggctg

SEQ ID NO: 136382 - DNA, 21 bp, Homo sapiens
agctagaagtgggccaggaca

SEQ ID NO: 136383 - DNA, 22 bp, Homo sapiens
agctagaagtgggccaggacag

SEQ ID NO: 136384 - DNA, 12 bp, Homo sapiens
agctagaggaac

SEQ ID NO: 136385 - DNA, 18 bp, Homo sapiens
agctagcgctgccgcacc

SEQ ID NO: 136386 - DNA, 17 bp, Homo sapiens
agctagttcgtagcttt

SEQ ID NO: 136387 - DNA, 21 bp, Homo sapiens
agctattactgtctggtttta

SEQ ID NO: 136388 - DNA, 15 bp, Homo sapiens
agctcaaaggcacag

SEQ ID NO: 136389 - DNA, 21 bp, Homo sapiens
agctcacagttcctcgccctg

SEQ ID NO: 136390 - DNA, 23 bp, Homo sapiens
agctcacagttcctcgccctggg

SEQ ID NO: 136391 - DNA, 16 bp, Homo sapiens
agctcacgtcacactt

SEQ ID NO: 136392 - DNA, 16 bp, Homo sapiens
agctcagacccccact

SEQ ID NO: 136393 - DNA, 14 bp, Homo sapiens
agctcatattttgt

SEQ ID NO: 136394 - DNA, 18 bp, Homo sapiens
agctcatattttgtatat

SEQ ID NO: 136395 - DNA, 23 bp, Homo sapiens
agctccacaccctctcccaggac

SEQ ID NO: 136396 - DNA, 21 bp, Homo sapiens
agctccactgtcaccctccac

SEQ ID NO: 136397 - DNA, 16 bp, Homo sapiens
agctccatctccactc

SEQ ID NO: 136398 - DNA, 15 bp, Homo sapiens
agctcccaccccacc

SEQ ID NO: 136399 - DNA, 23 bp, Homo sapiens
agctcccaccccacccccttcag

SEQ ID NO: 136400 - DNA, 23 bp, Homo sapiens
agctccccctcccccactgccat

SEQ ID NO: 136401 - DNA, 13 bp, Homo sapiens
agctccctctgcc

SEQ ID NO: 136402 - DNA, 12 bp, Homo sapiens
agctcctgtcct

SEQ ID NO: 136403 - DNA, 17 bp, Homo sapiens
agctcctgtcctcccat

SEQ ID NO: 136404 - DNA, 13 bp, Homo sapiens
agctccttcctgg

SEQ ID NO: 136405 - DNA, 19 bp, Homo sapiens
agctccttcctggagactg

SEQ ID NO: 136406 - DNA, 12 bp, Homo sapiens
agctcggtggac

SEQ ID NO: 136407 - DNA, 15 bp, Homo sapiens
agctcggtggaccca

SEQ ID NO: 136408 - DNA, 13 bp, Homo sapiens
agctctacccagg

SEQ ID NO: 136409 - DNA, 17 bp, Homo sapiens
agctctacccagggcct

SEQ ID NO: 136410 - DNA, 12 bp, Homo sapiens
agctctcagcca

SEQ ID NO: 136411 - DNA, 14 bp, Homo sapiens
agctctccctctgg

SEQ ID NO: 136412 - DNA, 23 bp, Homo sapiens
agctctccctctggccctgcctt

SEQ ID NO: 136413 - DNA, 19 bp, Homo sapiens
agctctgaaaccagtgtta

SEQ ID NO: 136414 - DNA, 13 bp, Homo sapiens
agctctgcattat

SEQ ID NO: 136415 - DNA, 23 bp, Homo sapiens
agctctgcccatcctgcccctga

SEQ ID NO: 136416 - DNA, 21 bp, Homo sapiens
agctctggtgacaccagcctt

SEQ ID NO: 136417 - DNA, 15 bp, Homo sapiens
agctgaacctgggta

SEQ ID NO: 136418 - DNA, 21 bp, Homo sapiens
agctgcaagtgacatctcttt

SEQ ID NO: 136419 - DNA, 13 bp, Homo sapiens
agctgcaccctca

SEQ ID NO: 136420 - DNA, 19 bp, Homo sapiens
agctgcaccctcaggcagg

SEQ ID NO: 136421 - DNA, 20 bp, Homo sapiens
agctgcaccctcaggcaggt

SEQ ID NO: 136422 - DNA, 20 bp, Homo sapiens
agctgcctctcggtggccag

SEQ ID NO: 136423 - DNA, 15 bp, Homo sapiens
agctgcctgtagtta

SEQ ID NO: 136424 - DNA, 22 bp, Homo sapiens
agctgccttgagccttaaaacc

SEQ ID NO: 136425 - DNA, 15 bp, Homo sapiens
agctgctcccctccc

SEQ ID NO: 136426 - DNA, 16 bp, Homo sapiens
agctgctgaaacaaca

SEQ ID NO: 136427 - DNA, 14 bp, Homo sapiens
agctgggaggcatg

SEQ ID NO: 136428 - DNA, 20 bp, Homo sapiens
agctgggaggcatggccctg

SEQ ID NO: 136429 - DNA, 14 bp, Homo sapiens
agctgggttggaaa

SEQ ID NO: 136430 - DNA, 20 bp, Homo sapiens
agctgggttggaaaacagta

SEQ ID NO: 136431 - DNA, 13 bp, Homo sapiens
agctggtgggaag

SEQ ID NO: 136432 - DNA, 20 bp, Homo sapiens
agctgtaggtgtgcgggacc

SEQ ID NO: 136433 - DNA, 15 bp, Homo sapiens
agctgtccctgtcac

SEQ ID NO: 136434 - DNA, 18 bp, Homo sapiens
agctgtccctgtcaccaa

SEQ ID NO: 136435 - DNA, 12 bp, Homo sapiens
agctgtgcaggt

SEQ ID NO: 136436 - DNA, 18 bp, Homo sapiens
agctgtgcaggtggggag

SEQ ID NO: 136437 - DNA, 21 bp, Homo sapiens
agctgtgtccttgcacctgca

SEQ ID NO: 136438 - DNA, 18 bp, Homo sapiens
agctgttactgtcttcag

SEQ ID NO: 136439 - DNA, 16 bp, Homo sapiens
agctgtttaagatggg

SEQ ID NO: 136440 - DNA, 16 bp, Homo sapiens
agctgtttactaggga

SEQ ID NO: 136441 - DNA, 14 bp, Homo sapiens
agctgtttccatag

SEQ ID NO: 136442 - DNA, 15 bp, Homo sapiens
agctgttttccctga

SEQ ID NO: 136443 - DNA, 18 bp, Homo sapiens
agctgttttccctgacct

SEQ ID NO: 136444 - DNA, 12 bp, Homo sapiens
agcttatctcag

SEQ ID NO: 136445 - DNA, 15 bp, Homo sapiens
agcttatctcagggg

SEQ ID NO: 136446 - DNA, 19 bp, Homo sapiens
agcttcatggcagaaggca

SEQ ID NO: 136447 - DNA, 23 bp, Homo sapiens
agcttcctttgtttttttttcct

SEQ ID NO: 136448 - DNA, 20 bp, Homo sapiens
agcttcttaatataactgcc

SEQ ID NO: 136449 - DNA, 22 bp, Homo sapiens
agcttcttaatataactgcctt

SEQ ID NO: 136450 - DNA, 20 bp, Homo sapiens
agcttgccctggtgcctcac

SEQ ID NO: 136451 - DNA, 14 bp, Homo sapiens
agcttgctcttcag

SEQ ID NO: 136452 - DNA, 16 bp, Homo sapiens
agcttgctgccctagg

SEQ ID NO: 136453 - DNA, 18 bp, Homo sapiens
agcttggaagagcctgca

SEQ ID NO: 136454 - DNA, 21 bp, Homo sapiens
agcttgtatagtgtaaaataa

SEQ ID NO: 136455 - DNA, 22 bp, Homo sapiens
agcttgtctatggtacaaaaat

SEQ ID NO: 136456 - DNA, 21 bp, Homo sapiens
agctttacatgcaatttatta

SEQ ID NO: 136457 - DNA, 22 bp, Homo sapiens
agctttcatgtaaactgtgcac

SEQ ID NO: 136458 - DNA, 21 bp, Homo sapiens
agctttcccaaataaactcta

SEQ ID NO: 136459 - DNA, 15 bp, Homo sapiens
agctttcctgcccca

SEQ ID NO: 136460 - DNA, 16 bp, Homo sapiens
agctttgaaaattcag

SEQ ID NO: 136461 - DNA, 12 bp, Homo sapiens
agctttgttctt

SEQ ID NO: 136462 - DNA, 22 bp, Homo sapiens
agctttgtttgttgtcagctga

SEQ ID NO: 136463 - DNA, 23 bp, Homo sapiens
agctttgtttgttgtcagctgaa

SEQ ID NO: 136464 - DNA, 15 bp, Homo sapiens
agcttttattgtata

SEQ ID NO: 136465 - DNA, 17 bp, Homo sapiens
agctttttgtcttttct

SEQ ID NO: 136466 - DNA, 21 bp, Homo sapiens
aggaaactctgcattctagta

SEQ ID NO: 136467 - DNA, 16 bp, Homo sapiens
aggaaaggccagctgg

SEQ ID NO: 136468 - DNA, 13 bp, Homo sapiens
aggaaagggaagg

SEQ ID NO: 136469 - DNA, 16 bp, Homo sapiens
aggaaataaaaccttt

SEQ ID NO: 136470 - DNA, 13 bp, Homo sapiens
aggaagcaacgaa

SEQ ID NO: 136471 - DNA, 19 bp, Homo sapiens
aggaagcattcagagagca

SEQ ID NO: 136472 - DNA, 21 bp, Homo sapiens
aggaaggagactcacctctgc

SEQ ID NO: 136473 - DNA, 14 bp, Homo sapiens
aggaagtaggaagt

SEQ ID NO: 136474 - DNA, 17 bp, Homo sapiens
aggaagtctaggagctg

SEQ ID NO: 136475 - DNA, 15 bp, Homo sapiens
aggaatcagacttca

SEQ ID NO: 136476 - DNA, 16 bp, Homo sapiens
aggaatgcctgtgtga

SEQ ID NO: 136477 - DNA, 12 bp, Homo sapiens
aggaatggacag

SEQ ID NO: 136478 - DNA, 20 bp, Homo sapiens
aggaatggacagacagagga

SEQ ID NO: 136479 - DNA, 18 bp, Homo sapiens
aggacaaaaatgaactga

SEQ ID NO: 136480 - DNA, 19 bp, Homo sapiens
aggacaaaaatgaactgaa

SEQ ID NO: 136481 - DNA, 22 bp, Homo sapiens
agatgtgaacacatcagcttgc

SEQ ID NO: 136482 - DNA, 17 bp, Homo sapiens
agatgtgataaggatca

SEQ ID NO: 136483 - DNA, 19 bp, Homo sapiens
agatgtgttgctatcctga

SEQ ID NO: 136484 - DNA, 22 bp, Homo sapiens
agatgttctaagtctttccatt

SEQ ID NO: 136485 - DNA, 14 bp, Homo sapiens
agatgtttcacgaa

SEQ ID NO: 136486 - DNA, 21 bp, Homo sapiens
agatgtttcttttgtatgtaa

SEQ ID NO: 136487 - DNA, 15 bp, Homo sapiens
agatgtttgtcagat

SEQ ID NO: 136488 - DNA, 16 bp, Homo sapiens
agattcatatttactt

SEQ ID NO: 136489 - DNA, 21 bp, Homo sapiens
agattccagagagtggctcct

SEQ ID NO: 136490 - DNA, 13 bp, Homo sapiens
agattcccagaga

SEQ ID NO: 136491 - DNA, 14 bp, Homo sapiens
agattcccagagac

SEQ ID NO: 136492 - DNA, 24 bp, Homo sapiens
agattccccattgcctcctccttc

SEQ ID NO: 136493 - DNA, 15 bp, Homo sapiens
agattccctgagcag

SEQ ID NO: 136494 - DNA, 16 bp, Homo sapiens
agattcgctttccatg

SEQ ID NO: 136495 - DNA, 15 bp, Homo sapiens
agattctcctgtgct

SEQ ID NO: 136496 - DNA, 15 bp, Homo sapiens
agattgacgacaagt

SEQ ID NO: 136497 - DNA, 17 bp, Homo sapiens
agattgacgacaagtgc

SEQ ID NO: 136498 - DNA, 15 bp, Homo sapiens
agattgagaaggaga

SEQ ID NO: 136499 - DNA, 16 bp, Homo sapiens
agattgagaaggagag

SEQ ID NO: 136500 - DNA, 23 bp, Homo sapiens
agattggagaaacccttgaaaag

SEQ ID NO: 136501 - DNA, 16 bp, Homo sapiens
agattgtgcccctgca

SEQ ID NO: 136502 - DNA, 21 bp, Homo sapiens
agattgtgtaacaattttaat

SEQ ID NO: 136503 - DNA, 15 bp, Homo sapiens
agattgttaaaataa

SEQ ID NO: 136504 - DNA, 13 bp, Homo sapiens
agattttaaattc

SEQ ID NO: 136505 - DNA, 19 bp, Homo sapiens
agattttaaattcacaata

SEQ ID NO: 136506 - DNA, 22 bp, Homo sapiens
agattttaaattcacaatagaa

SEQ ID NO: 136507 - DNA, 14 bp, Homo sapiens
agattttaattttg

SEQ ID NO: 136508 - DNA, 21 bp, Homo sapiens
agattttaattttgaataaat

SEQ ID NO: 136509 - DNA, 12 bp, Homo sapiens
agattttcagaa

SEQ ID NO: 136510 - DNA, 16 bp, Homo sapiens
agatttttaacgaatg

SEQ ID NO: 136511 - DNA, 23 bp, Homo sapiens
aggaggaggcaattgggatggcg

SEQ ID NO: 136512 - DNA, 13 bp, Homo sapiens
aggaggccaggcc

SEQ ID NO: 136513 - DNA, 18 bp, Homo sapiens
aggagggttagggagggg

SEQ ID NO: 136514 - DNA, 18 bp, Homo sapiens
aggaggtttaggtcaaga

SEQ ID NO: 136515 - DNA, 21 bp, Homo sapiens
aggagtttgagaccaacctgg

SEQ ID NO: 136516 - DNA, 18 bp, Homo sapiens
aggatactgtaacacttt

SEQ ID NO: 136517 - DNA, 22 bp, Homo sapiens
aggatactgtaacactttacaa

SEQ ID NO: 136518 - DNA, 19 bp, Homo sapiens
aggatctcttgagcctggg

SEQ ID NO: 136519 - DNA, 22 bp, Homo sapiens
aggatgcccagggccactctgc

SEQ ID NO: 136520 - DNA, 19 bp, Homo sapiens
aggatgggggctggcctct

SEQ ID NO: 136521 - DNA, 18 bp, Homo sapiens
aggatgtaaacagtgcct

SEQ ID NO: 136522 - DNA, 21 bp, Homo sapiens
aggatgtaaacagtgcctgct

SEQ ID NO: 136523 - DNA, 16 bp, Homo sapiens
aggattctatgaggca

SEQ ID NO: 136524 - DNA, 19 bp, Homo sapiens
aggatttcatgatttcatt

SEQ ID NO: 136525 - DNA, 13 bp, Homo sapiens
aggcacaaaatga

SEQ ID NO: 136526 - DNA, 17 bp, Homo sapiens
aggcacaaaatgatgga

SEQ ID NO: 136527 - DNA, 14 bp, Homo sapiens
aggcacacagctgc

SEQ ID NO: 136528 - DNA, 23 bp, Homo sapiens
aggcacacagctgcagagacaga

SEQ ID NO: 136529 - DNA, 12 bp, Homo sapiens
aggcacacttct

SEQ ID NO: 136530 - DNA, 15 bp, Homo sapiens
aggcacacttcttct

SEQ ID NO: 136531 - DNA, 16 bp, Homo sapiens
aggcacacttcttctt

SEQ ID NO: 136532 - DNA, 20 bp, Homo sapiens
aggcacacttcttcttggtc

SEQ ID NO: 136533 - DNA, 21 bp, Homo sapiens
aggcacgaacccacctgctga

SEQ ID NO: 136534 - DNA, 15 bp, Homo sapiens
aggcactagcctttg

SEQ ID NO: 136535 - DNA, 23 bp, Homo sapiens
aggcactgagataccagcgagga

SEQ ID NO: 136536 - DNA, 21 bp, Homo sapiens
aggcagaagaattgaacccag

SEQ ID NO: 136537 - DNA, 11 bp, Homo sapiens
aggcagacaca

SEQ ID NO: 136538 - DNA, 18 bp, Homo sapiens
aggcagacagcagctcag

SEQ ID NO: 136539 - DNA, 13 bp, Homo sapiens
aggcagagagcgg

SEQ ID NO: 136540 - DNA, 15 bp, Homo sapiens
aggcagcttgaaact

SEQ ID NO: 136541 - DNA, 21 bp, Homo sapiens
aggcagggaagtgtaagaaac

SEQ ID NO: 136542 - DNA, 20 bp, Homo sapiens
aggcagggccttgcccagag

SEQ ID NO: 136543 - DNA, 14 bp, Homo sapiens
aggcagggtcagga

SEQ ID NO: 136544 - DNA, 15 bp, Homo sapiens
aggcaggtagccagg

SEQ ID NO: 136545 - DNA, 16 bp, Homo sapiens
aggcaggtagccaggg

SEQ ID NO: 136546 - DNA, 13 bp, Homo sapiens
aggcaggtgcctg

SEQ ID NO: 136547 - DNA, 19 bp, Homo sapiens
aggcagtgatgctggatgc

SEQ ID NO: 136548 - DNA, 14 bp, Homo sapiens
aggcatggccctgg

SEQ ID NO: 136549 - DNA, 15 bp, Homo sapiens
aggcatggccctggg

SEQ ID NO: 136550 - DNA, 20 bp, Homo sapiens
aggcatttgctgaatacaga

SEQ ID NO: 136551 - DNA, 14 bp, Homo sapiens
aggccactcctcca

SEQ ID NO: 136552 - DNA, 22 bp, Homo sapiens
aggccagccagtgacctgagga

SEQ ID NO: 136553 - DNA, 16 bp, Homo sapiens
aggccagctggcagca

SEQ ID NO: 136554 - DNA, 12 bp, Homo sapiens
aggccaggccgg

SEQ ID NO: 136555 - DNA, 21 bp, Homo sapiens
aggccagtaagggaaatagaa

SEQ ID NO: 136556 - DNA, 17 bp, Homo sapiens
aggccccactggggaaa

SEQ ID NO: 136557 - DNA, 13 bp, Homo sapiens
aggccccaggaag

SEQ ID NO: 136558 - DNA, 17 bp, Homo sapiens
aggccccgcttgtccag

SEQ ID NO: 136559 - DNA, 18 bp, Homo sapiens
aggccccgcttgtccagc

SEQ ID NO: 136560 - DNA, 22 bp, Homo sapiens
aggccccgcttgtccagcgcct

SEQ ID NO: 136561 - DNA, 14 bp, Homo sapiens
aggcccggggctgg

SEQ ID NO: 136562 - DNA, 15 bp, Homo sapiens
aggcccggggctggc

SEQ ID NO: 136563 - DNA, 15 bp, Homo sapiens
aggcccgtccggcag

SEQ ID NO: 136564 - DNA, 15 bp, Homo sapiens
aggccctcgctgcca

SEQ ID NO: 136565 - DNA, 22 bp, Homo sapiens
aggccctcgctgccagctctgt

SEQ ID NO: 136566 - DNA, 13 bp, Homo sapiens
aggcccttcctct

SEQ ID NO: 136567 - DNA, 18 bp, Homo sapiens
aggcccttcctctccact

SEQ ID NO: 136568 - DNA, 22 bp, Homo sapiens
aggcccttcctctccactgcct

SEQ ID NO: 136569 - DNA, 17 bp, Homo sapiens
aggccgaagaagggtcc

SEQ ID NO: 136570 - DNA, 19 bp, Homo sapiens
aggccgagaagcaagaaag

SEQ ID NO: 136571 - DNA, 20 bp, Homo sapiens
aggccgctgttcacccacag

SEQ ID NO: 136572 - DNA, 20 bp, Homo sapiens
aggccggcgagccctgtgga

SEQ ID NO: 136573 - DNA, 13 bp, Homo sapiens
aggcctctgtgtc

SEQ ID NO: 136574 - DNA, 22 bp, Homo sapiens
aggcctctgtgtccttccctgc

SEQ ID NO: 136575 - DNA, 23 bp, Homo sapiens
aggcctctgtgtccttccctgca

SEQ ID NO: 136576 - DNA, 17 bp, Homo sapiens
aggcctgaaagaggctg

SEQ ID NO: 136577 - DNA, 23 bp, Homo sapiens
aggcctgaaagaggctgaggcct

SEQ ID NO: 136578 - DNA, 19 bp, Homo sapiens
aggcctggactttcctgca

SEQ ID NO: 136579 - DNA, 12 bp, Homo sapiens
aggcctgtgtgt

SEQ ID NO: 136580 - DNA, 14 bp, Homo sapiens
aggcgtgaggatgg

SEQ ID NO: 136581 - DNA, 16 bp, Homo sapiens
aggctcacccccttct

SEQ ID NO: 136582 - DNA, 19 bp, Homo sapiens
aggctcacccccttctcca

SEQ ID NO: 136583 - DNA, 20 bp, Homo sapiens
aggctcatagggaagacctg

SEQ ID NO: 136584 - DNA, 21 bp, Homo sapiens
aggctcatagggaagacctgc

SEQ ID NO: 136585 - DNA, 13 bp, Homo sapiens
aggctccagaggg

SEQ ID NO: 136586 - DNA, 15 bp, Homo sapiens
aggctccagagggca

SEQ ID NO: 136587 - DNA, 16 bp, Homo sapiens
aggctccagagggcac

SEQ ID NO: 136588 - DNA, 12 bp, Homo sapiens
aggctctgccct

SEQ ID NO: 136589 - DNA, 18 bp, Homo sapiens
aggctctgcgcctgcccc

SEQ ID NO: 136590 - DNA, 13 bp, Homo sapiens
aggctcttctcct

SEQ ID NO: 136591 - DNA, 14 bp, Homo sapiens
aggctcttctcctt

SEQ ID NO: 136592 - DNA, 22 bp, Homo sapiens
aggctgaccttgaactcctggg

SEQ ID NO: 136593 - DNA, 18 bp, Homo sapiens
aggctgaggaaaggccag

SEQ ID NO: 136594 - DNA, 15 bp, Homo sapiens
aggctgaggcctgga

SEQ ID NO: 136595 - DNA, 16 bp, Homo sapiens
aggctgaggcctggac

SEQ ID NO: 136596 - DNA, 17 bp, Homo sapiens
aggctgcagtgagccga

SEQ ID NO: 136597 - DNA, 15 bp, Homo sapiens
aggctggaggcaggg

SEQ ID NO: 136598 - DNA, 23 bp, Homo sapiens
aggctggaggcagggccttgccc

SEQ ID NO: 136599 - DNA, 22 bp, Homo sapiens
aggctggattttgaattttctt

SEQ ID NO: 136600 - DNA, 20 bp, Homo sapiens
aggctggcttgtcccctcct

SEQ ID NO: 136601 - DNA, 22 bp, Homo sapiens
aggctgggggaagaagctctct

SEQ ID NO: 136602 - DNA, 14 bp, Homo sapiens
aggctggtgggagg

SEQ ID NO: 136603 - DNA, 17 bp, Homo sapiens
aggctggtgggaggggc

SEQ ID NO: 136604 - DNA, 15 bp, Homo sapiens
aggctgtcctgtaca

SEQ ID NO: 136605 - DNA, 16 bp, Homo sapiens
aggctgtcctgtacat

SEQ ID NO: 136606 - DNA, 21 bp, Homo sapiens
aggctgtccttacccatctgc

SEQ ID NO: 136607 - DNA, 20 bp, Homo sapiens
aggctgtcttctcaggctct

SEQ ID NO: 136608 - DNA, 21 bp, Homo sapiens
aggctgtcttctcaggctctg

SEQ ID NO: 136609 - DNA, 23 bp, Homo sapiens
aggcttcttcagatcagtgcttg

SEQ ID NO: 136610 - DNA, 16 bp, Homo sapiens
agggaaactattgtcc

SEQ ID NO: 136611 - DNA, 14 bp, Homo sapiens
agggaaactgccag

SEQ ID NO: 136612 - DNA, 15 bp, Homo sapiens
agggaaactgccagc

SEQ ID NO: 136613 - DNA, 23 bp, Homo sapiens
agggaaatagaaaaaccctgccc

SEQ ID NO: 136614 - DNA, 14 bp, Homo sapiens
agggaacagacagg

SEQ ID NO: 136615 - DNA, 14 bp, Homo sapiens
agggaagggcctgc

SEQ ID NO: 136616 - DNA, 23 bp, Homo sapiens
agggaatccccgaaggtgctgga

SEQ ID NO: 136617 - DNA, 19 bp, Homo sapiens
agggacagagacacctgca

SEQ ID NO: 136618 - DNA, 14 bp, Homo sapiens
agggacagagccat

SEQ ID NO: 136619 - DNA, 22 bp, Homo sapiens
agggacagatgaatgccgtgga

SEQ ID NO: 136620 - DNA, 14 bp, Homo sapiens
agggaccagccaag

SEQ ID NO: 136621 - DNA, 20 bp, Homo sapiens
agggaccagccaagagggct

SEQ ID NO: 136622 - DNA, 13 bp, Homo sapiens
agggacgcctggg

SEQ ID NO: 136623 - DNA, 14 bp, Homo sapiens
agtatctgggaact

SEQ ID NO: 136624 - DNA, 14 bp, Homo sapiens
agtatgttgtcaaa

SEQ ID NO: 136625 - DNA, 15 bp, Homo sapiens
agtattcttgtcaaa

SEQ ID NO: 136626 - DNA, 20 bp, Homo sapiens
agtatttcaaattggagctt

SEQ ID NO: 136627 - DNA, 17 bp, Homo sapiens
agtcaaaaggtgcctgt

SEQ ID NO: 136628 - DNA, 21 bp, Homo sapiens
agtcaaaaggtgcctgtgagg

SEQ ID NO: 136629 - DNA, 18 bp, Homo sapiens
agtcaaaccataaacttc

SEQ ID NO: 136630 - DNA, 14 bp, Homo sapiens
agtcaacctgggca

SEQ ID NO: 136631 - DNA, 15 bp, Homo sapiens
agtcaacctgggcaa

SEQ ID NO: 136632 - DNA, 12 bp, Homo sapiens
agtcaagaaaaa

SEQ ID NO: 136633 - DNA, 19 bp, Homo sapiens
agtcaagaaaaattattgt

SEQ ID NO: 136634 - DNA, 16 bp, Homo sapiens
agtcaagtgaaaaagg

SEQ ID NO: 136635 - DNA, 20 bp, Homo sapiens
agtcaagtgcgtccacgagc

SEQ ID NO: 136636 - DNA, 18 bp, Homo sapiens
agtcaatcccctcattca

SEQ ID NO: 136637 - DNA, 13 bp, Homo sapiens
agtcactgcacag

SEQ ID NO: 136638 - DNA, 21 bp, Homo sapiens
agtcactgcctctccctggcc

SEQ ID NO: 136639 - DNA, 14 bp, Homo sapiens
agtcagagagaatc

SEQ ID NO: 136640 - DNA, 17 bp, Homo sapiens
agtcagagagagtgttt

SEQ ID NO: 136641 - DNA, 23 bp, Homo sapiens
agtcataccaatgaaaaaatgta

SEQ ID NO: 136642 - DNA, 22 bp, Homo sapiens
agtcataggttaatatttaaga

SEQ ID NO: 136643 - DNA, 21 bp, Homo sapiens
agtcatcttgaccaagcagga

SEQ ID NO: 136644 - DNA, 19 bp, Homo sapiens
agtcatgatctccctgccg

SEQ ID NO: 136645 - DNA, 13 bp, Homo sapiens
agtcatgttcctt

SEQ ID NO: 136646 - DNA, 19 bp, Homo sapiens
agtcatgttccttcaagat

SEQ ID NO: 136647 - DNA, 19 bp, Homo sapiens
agtccaacgtggggcagca

SEQ ID NO: 136648 - DNA, 11 bp, Homo sapiens
agtccaagcat

SEQ ID NO: 136649 - DNA, 14 bp, Homo sapiens
agtccacaaaataa

SEQ ID NO: 136650 - DNA, 15 bp, Homo sapiens
agtccccgtgccccg

SEQ ID NO: 136651 - DNA, 14 bp, Homo sapiens
agtccctgggggaa

SEQ ID NO: 136652 - DNA, 14 bp, Homo sapiens
agtcctgtgaattt

SEQ ID NO: 136653 - DNA, 13 bp, Homo sapiens
agtcgctgaggaa

SEQ ID NO: 136654 - DNA, 14 bp, Homo sapiens
agtctacagagtga

SEQ ID NO: 136655 - DNA, 22 bp, Homo sapiens
agtctaggagctgggaggaaaa

SEQ ID NO: 136656 - DNA, 18 bp, Homo sapiens
agtctatcaatcaactta

SEQ ID NO: 136657 - DNA, 11 bp, Homo sapiens
agtctctgagc

SEQ ID NO: 136658 - DNA, 16 bp, Homo sapiens
agtctctgagcagtga

SEQ ID NO: 136659 - DNA, 15 bp, Homo sapiens
agtctcttctccact

SEQ ID NO: 136660 - DNA, 17 bp, Homo sapiens
agtctcttctccactgg

SEQ ID NO: 136661 - DNA, 18 bp, Homo sapiens
agtctgaacagctgtaat

SEQ ID NO: 136662 - DNA, 21 bp, Homo sapiens
agtctgaagcagatgcaaaga

SEQ ID NO: 136663 - DNA, 13 bp, Homo sapiens
agtctgcaaaatg

SEQ ID NO: 136664 - DNA, 18 bp, Homo sapiens
agcaaaagggtgtctgag

SEQ ID NO: 136665 - DNA, 14 bp, Homo sapiens
agcaaaatgtgaat

SEQ ID NO: 136666 - DNA, 19 bp, Homo sapiens
agcaaaattgatgtgttta

SEQ ID NO: 136667 - DNA, 11 bp, Homo sapiens
agcaaatacat

SEQ ID NO: 136668 - DNA, 15 bp, Homo sapiens
agcaaatgtgacctg

SEQ ID NO: 136669 - DNA, 16 bp, Homo sapiens
agcaaatgtggctcct

SEQ ID NO: 136670 - DNA, 16 bp, Homo sapiens
agcaagggtgatggga

SEQ ID NO: 136671 - DNA, 22 bp, Homo sapiens
agcaagggtgatgggaaagcat

SEQ ID NO: 136672 - DNA, 15 bp, Homo sapiens
agcaatatgtaaata

SEQ ID NO: 136673 - DNA, 15 bp, Homo sapiens
agcacagtgcctgca

SEQ ID NO: 136674 - DNA, 15 bp, Homo sapiens
agcacatctgcattt

SEQ ID NO: 136675 - DNA, 23 bp, Homo sapiens
agcaccaggcacgaacccacctg

SEQ ID NO: 136676 - DNA, 17 bp, Homo sapiens
agcacgaaatgttattt

SEQ ID NO: 136677 - DNA, 13 bp, Homo sapiens
agcactcccaagt

SEQ ID NO: 136678 - DNA, 20 bp, Homo sapiens
agcactcccaagtctacaga

SEQ ID NO: 136679 - DNA, 17 bp, Homo sapiens
agcactgacttctaagt

SEQ ID NO: 136680 - DNA, 13 bp, Homo sapiens
agcactgatttca

SEQ ID NO: 136681 - DNA, 13 bp, Homo sapiens
agcactgtccctt

SEQ ID NO: 136682 - DNA, 19 bp, Homo sapiens
agcactgtcccttgcctca

SEQ ID NO: 136683 - DNA, 14 bp, Homo sapiens
agcacttggagcca

SEQ ID NO: 136684 - DNA, 21 bp, Homo sapiens
agcacttgtgggtttttgttt

SEQ ID NO: 136685 - DNA, 14 bp, Homo sapiens
agcactttgggagg

SEQ ID NO: 136686 - DNA, 14 bp, Homo sapiens
agcagactggtgag

SEQ ID NO: 136687 - DNA, 14 bp, Homo sapiens
agcagagaattctc

SEQ ID NO: 136688 - DNA, 23 bp, Homo sapiens
agcagaggtggccagagctggga

SEQ ID NO: 136689 - DNA, 17 bp, Homo sapiens
agcagatgacccctccc

SEQ ID NO: 136690 - DNA, 18 bp, Homo sapiens
agcagatgcaaagaggca

SEQ ID NO: 136691 - DNA, 19 bp, Homo sapiens
agcagatgcaaagaggcaa

SEQ ID NO: 136692 - DNA, 21 bp, Homo sapiens
agcagatgcaaagaggcaaga

SEQ ID NO: 136693 - DNA, 21 bp, Homo sapiens
agcagccaagctccttgggag

SEQ ID NO: 136694 - DNA, 15 bp, Homo sapiens
agcagccagctctca

SEQ ID NO: 136695 - DNA, 17 bp, Homo sapiens
agcagccagctctcagc

SEQ ID NO: 136696 - DNA, 14 bp, Homo sapiens
agcagctcaggcac

SEQ ID NO: 136697 - DNA, 18 bp, Homo sapiens
agcagcttagactaaggc

SEQ ID NO: 136698 - DNA, 21 bp, Homo sapiens
agcaggaaatgaaaatgtctt

SEQ ID NO: 136699 - DNA, 22 bp, Homo sapiens
agcaggacctctgaaaccctgg

SEQ ID NO: 136700 - DNA, 15 bp, Homo sapiens
agcaggagattgaga

SEQ ID NO: 136701 - DNA, 18 bp, Homo sapiens
agcaggagattgagaagg

SEQ ID NO: 136702 - DNA, 21 bp, Homo sapiens
agcaggatagttgctccgcct

SEQ ID NO: 136703 - DNA, 22 bp, Homo sapiens
agcaggatagttgctccgcctc

SEQ ID NO: 136704 - DNA, 14 bp, Homo sapiens
agcaggctactgtc

SEQ ID NO: 136705 - DNA, 20 bp, Homo sapiens
agcagggagggcttctgcca

SEQ ID NO: 136706 - DNA, 19 bp, Homo sapiens
agcagggattaacctctgc

SEQ ID NO: 136707 - DNA, 21 bp, Homo sapiens
agcagggattaacctctgcac

SEQ ID NO: 136708 - DNA, 23 bp, Homo sapiens
agcagggctaccctgagctgagg

SEQ ID NO: 136709 - DNA, 17 bp, Homo sapiens
agcagggtgttgggata

SEQ ID NO: 136710 - DNA, 14 bp, Homo sapiens
agcaggtaccactg

SEQ ID NO: 136711 - DNA, 22 bp, Homo sapiens
agcagtagaaataatatgcatt

SEQ ID NO: 136712 - DNA, 22 bp, Homo sapiens
agcagtcctgcctcagcctccg

SEQ ID NO: 136713 - DNA, 22 bp, Homo sapiens
agcagtgagaaaaagctcctgt

SEQ ID NO: 136714 - DNA, 14 bp, Homo sapiens
agcagtgagccgca

SEQ ID NO: 136715 - DNA, 22 bp, Homo sapiens
agcagtgagccgcatcttctcc

SEQ ID NO: 136716 - DNA, 15 bp, Homo sapiens
agcagtggacaccag

SEQ ID NO: 136717 - DNA, 16 bp, Homo sapiens
agcagtggctggtcca

SEQ ID NO: 136718 - DNA, 13 bp, Homo sapiens
agcagtgtcatca

SEQ ID NO: 136719 - DNA, 21 bp, Homo sapiens
agcagtgtgaggccagggcag

SEQ ID NO: 136720 - DNA, 21 bp, Homo sapiens
agcagtgttccccatctgggt

SEQ ID NO: 136721 - DNA, 14 bp, Homo sapiens
agcagtttgctttg

SEQ ID NO: 136722 - DNA, 19 bp, Homo sapiens
agcataaaaattagccaag

SEQ ID NO: 136723 - DNA, 19 bp, Homo sapiens
agcataccaacacgagcag

SEQ ID NO: 136724 - DNA, 22 bp, Homo sapiens
agcataccaacacgagcaggct

SEQ ID NO: 136725 - DNA, 16 bp, Homo sapiens
agcatacctttattgt

SEQ ID NO: 136726 - DNA, 19 bp, Homo sapiens
agcatacctttattgtgat

SEQ ID NO: 136727 - DNA, 16 bp, Homo sapiens
agcatatgaggatgca

SEQ ID NO: 136728 - DNA, 20 bp, Homo sapiens
agcatctcagcctaccatga

SEQ ID NO: 136729 - DNA, 14 bp, Homo sapiens
agcattcagagagc

SEQ ID NO: 136730 - DNA, 18 bp, Homo sapiens
agcattgtaaatgtgctt

SEQ ID NO: 136731 - DNA, 21 bp, Homo sapiens
agcattgtggctgtcagcagg

SEQ ID NO: 136732 - DNA, 18 bp, Homo sapiens
agcatttttgatttatgc

SEQ ID NO: 136733 - DNA, 14 bp, Homo sapiens
agccaaaccctgtc

SEQ ID NO: 136734 - DNA, 16 bp, Homo sapiens
agccaaaccctgtctg

SEQ ID NO: 136735 - DNA, 21 bp, Homo sapiens
agccaacagtcaaaacagaga

SEQ ID NO: 136736 - DNA, 17 bp, Homo sapiens
agccaagctccttggga

SEQ ID NO: 136737 - DNA, 14 bp, Homo sapiens
agccaatatttttc

SEQ ID NO: 136738 - DNA, 21 bp, Homo sapiens
agccacactgtgggactcttc

SEQ ID NO: 136739 - DNA, 13 bp, Homo sapiens
agccaccaactct

SEQ ID NO: 136740 - DNA, 23 bp, Homo sapiens
agccaccatgcccagctcagagg

SEQ ID NO: 136741 - DNA, 14 bp, Homo sapiens
agccacctctcttt

SEQ ID NO: 136742 - DNA, 18 bp, Homo sapiens
agccacctctctttttca

SEQ ID NO: 136743 - DNA, 21 bp, Homo sapiens
agccacgttccttactgcaga

SEQ ID NO: 136744 - DNA, 21 bp, Homo sapiens
agccactcctctgactcaggg

SEQ ID NO: 136745 - DNA, 17 bp, Homo sapiens
agccacttaaaatgttc

SEQ ID NO: 136746 - DNA, 22 bp, Homo sapiens
agccagaacgtggctctgctgg

SEQ ID NO: 136747 - DNA, 20 bp, Homo sapiens
agccagaagctgagcaccag

SEQ ID NO: 136748 - DNA, 11 bp, Homo sapiens
agccagcagcc

SEQ ID NO: 136749 - DNA, 20 bp, Homo sapiens
agccagcagccagctctcag

SEQ ID NO: 136750 - DNA, 14 bp, Homo sapiens
agccagcccagccc

SEQ ID NO: 136751 - DNA, 17 bp, Homo sapiens
agccagcccagcccagc

SEQ ID NO: 136752 - DNA, 18 bp, Homo sapiens
agccagccctccctgtcc

SEQ ID NO: 136753 - DNA, 23 bp, Homo sapiens
agccagccctccctgtcctcctc

SEQ ID NO: 136754 - DNA, 21 bp, Homo sapiens
agccagccttcttccatccca

SEQ ID NO: 136755 - DNA, 18 bp, Homo sapiens
agccagcgtcctcctctg

SEQ ID NO: 136756 - DNA, 19 bp, Homo sapiens
agccagcgtcctcctctgt

SEQ ID NO: 136757 - DNA, 16 bp, Homo sapiens
agccagctctgcatta

SEQ ID NO: 136758 - DNA, 21 bp, Homo sapiens
agccagtgacctgaggaagcg

SEQ ID NO: 136759 - DNA, 15 bp, Homo sapiens
agcccaatattataa

SEQ ID NO: 136760 - DNA, 20 bp, Homo sapiens
agcccaatattataattttt

SEQ ID NO: 136761 - DNA, 16 bp, Homo sapiens
agcccagcccagctgg

SEQ ID NO: 136762 - DNA, 17 bp, Homo sapiens
agcccaggagagagaaa

SEQ ID NO: 136763 - DNA, 20 bp, Homo sapiens
agcccagggagcggaaagca

SEQ ID NO: 136764 - DNA, 21 bp, Homo sapiens
agcccagggagcggaaagcag

SEQ ID NO: 136765 - DNA, 18 bp, Homo sapiens
agttattgacaaactctc

SEQ ID NO: 136766 - DNA, 12 bp, Homo sapiens
agttattgtaca

SEQ ID NO: 136767 - DNA, 19 bp, Homo sapiens
agttattttaattatcttt

SEQ ID NO: 136768 - DNA, 19 bp, Homo sapiens
agttcaggtagctgcccct

SEQ ID NO: 136769 - DNA, 21 bp, Homo sapiens
agttcaggtagctgcccctgg

SEQ ID NO: 136770 - DNA, 18 bp, Homo sapiens
agttcatatgtaccatgt

SEQ ID NO: 136771 - DNA, 22 bp, Homo sapiens
agttcatatgtaccatgtacat

SEQ ID NO: 136772 - DNA, 23 bp, Homo sapiens
agttcctcattagcattttgcta

SEQ ID NO: 136773 - DNA, 14 bp, Homo sapiens
agttcctcgccctg

SEQ ID NO: 136774 - DNA, 16 bp, Homo sapiens
agttcctcgccctggg

SEQ ID NO: 136775 - DNA, 18 bp, Homo sapiens
agttcctgaacctgatgc

SEQ ID NO: 136776 - DNA, 14 bp, Homo sapiens
agttccttatgtat

SEQ ID NO: 136777 - DNA, 14 bp, Homo sapiens
agttctgacttgac

SEQ ID NO: 136778 - DNA, 14 bp, Homo sapiens
agttctgagtgttt

SEQ ID NO: 136779 - DNA, 21 bp, Homo sapiens
agttctgcagataaacagtag

SEQ ID NO: 136780 - DNA, 22 bp, Homo sapiens
agttcttaaggattgtgatatt

SEQ ID NO: 136781 - DNA, 21 bp, Homo sapiens
agttgaatgacaacagaagct

SEQ ID NO: 136782 - DNA, 20 bp, Homo sapiens
agttgagtcgtcatcacttt

SEQ ID NO: 136783 - DNA, 15 bp, Homo sapiens
agttgatgttgcatt

SEQ ID NO: 136784 - DNA, 13 bp, Homo sapiens
agttggcttctaa

SEQ ID NO: 136785 - DNA, 13 bp, Homo sapiens
agttggtgacaga

SEQ ID NO: 136786 - DNA, 13 bp, Homo sapiens
agttgtaaatata

SEQ ID NO: 136787 - DNA, 15 bp, Homo sapiens
agttgtaaatatata

SEQ ID NO: 136788 - DNA, 22 bp, Homo sapiens
agttgtaaatatataaatatat

SEQ ID NO: 136789 - DNA, 18 bp, Homo sapiens
agttgtaccgcaatgtga

SEQ ID NO: 136790 - DNA, 16 bp, Homo sapiens
agttgtatctcttttg

SEQ ID NO: 136791 - DNA, 17 bp, Homo sapiens
agttgtatctcttttga

SEQ ID NO: 136792 - DNA, 22 bp, Homo sapiens
agttgtatctcttttgaatcca

SEQ ID NO: 136793 - DNA, 19 bp, Homo sapiens
agttgtcaagtctctgctg

SEQ ID NO: 136794 - DNA, 15 bp, Homo sapiens
agttgtgccttttat

SEQ ID NO: 136795 - DNA, 22 bp, Homo sapiens
agttgtgccttttatagctatt

SEQ ID NO: 136796 - DNA, 19 bp, Homo sapiens
agttgtggtgctgacaaag

SEQ ID NO: 136797 - DNA, 23 bp, Homo sapiens
agttgttactaactaaactctct

SEQ ID NO: 136798 - DNA, 13 bp, Homo sapiens
agttgtttcattg

SEQ ID NO: 136799 - DNA, 19 bp, Homo sapiens
agttgtttcattgactatc

SEQ ID NO: 136800 - DNA, 22 bp, Homo sapiens
agtttaacacaagtcctgtgaa

SEQ ID NO: 136801 - DNA, 19 bp, Homo sapiens
agtttacaagtgtatatca

SEQ ID NO: 136802 - DNA, 19 bp, Homo sapiens
agtttagaggaaaaaaatg

SEQ ID NO: 136803 - DNA, 21 bp, Homo sapiens
agtttagaggaaaaaaatgac

SEQ ID NO: 136804 - DNA, 16 bp, Homo sapiens
agtttcaattcagtgc

SEQ ID NO: 136805 - DNA, 17 bp, Homo sapiens
agtttcaattcagtgct

SEQ ID NO: 136806 - DNA, 13 bp, Homo sapiens
agtttcctcaggc

SEQ ID NO: 136807 - DNA, 15 bp, Homo sapiens
agtttctcagctccc

SEQ ID NO: 136808 - DNA, 16 bp, Homo sapiens
agtttctcagctccca

SEQ ID NO: 136809 - DNA, 17 bp, Homo sapiens
agtttctgggacctcag

SEQ ID NO: 136810 - DNA, 14 bp, Homo sapiens
agtttgattattca

SEQ ID NO: 136811 - DNA, 22 bp, Homo sapiens
agtttgcagaaaagcacctgcc

SEQ ID NO: 136812 - DNA, 23 bp, Homo sapiens
agtttgcagaaaagcacctgccg

SEQ ID NO: 136813 - DNA, 17 bp, Homo sapiens
agtttggcaatagtttg

SEQ ID NO: 136814 - DNA, 20 bp, Homo sapiens
agttttatcattttcaaaat

SEQ ID NO: 136815 - DNA, 23 bp, Homo sapiens
agttttattaataaacattctat

SEQ ID NO: 136816 - DNA, 12 bp, Homo sapiens
acctcctgccca

SEQ ID NO: 136817 - DNA, 18 bp, Homo sapiens
acctcctgcccaggagag

SEQ ID NO: 136818 - DNA, 16 bp, Homo sapiens
acctcgctggactctc

SEQ ID NO: 136819 - DNA, 19 bp, Homo sapiens
acctcggtgccttcctctt

SEQ ID NO: 136820 - DNA, 21 bp, Homo sapiens
acctcgtcctccccctgccag

SEQ ID NO: 136821 - DNA, 13 bp, Homo sapiens
acctctgatacct

SEQ ID NO: 136822 - DNA, 12 bp, Homo sapiens
acctctgcctca

SEQ ID NO: 136823 - DNA, 15 bp, Homo sapiens
acctctgcctcaatg

SEQ ID NO: 136824 - DNA, 18 bp, Homo sapiens
acctcttcagaggccctc

SEQ ID NO: 136825 - DNA, 19 bp, Homo sapiens
acctgaaaaaaagtttaca

SEQ ID NO: 136826 - DNA, 18 bp, Homo sapiens
acctgaaaacactgtgca

SEQ ID NO: 136827 - DNA, 16 bp, Homo sapiens
acctgacactcccttg

SEQ ID NO: 136828 - DNA, 20 bp, Homo sapiens
acctgactattgaagttgca

SEQ ID NO: 136829 - DNA, 17 bp, Homo sapiens
acctgagccccaaaagg

SEQ ID NO: 136830 - DNA, 14 bp, Homo sapiens
acctgagctcccca

SEQ ID NO: 136831 - DNA, 18 bp, Homo sapiens
acctgagctgccatccag

SEQ ID NO: 136832 - DNA, 13 bp, Homo sapiens
acctgaggaagcg

SEQ ID NO: 136833 - DNA, 20 bp, Homo sapiens
acctgcaagggctccccact

SEQ ID NO: 136834 - DNA, 14 bp, Homo sapiens
acctgcacctcccc

SEQ ID NO: 136835 - DNA, 17 bp, Homo sapiens
acctgccgacctcgtcc

SEQ ID NO: 136836 - DNA, 13 bp, Homo sapiens
acctgctcccagg

SEQ ID NO: 136837 - DNA, 12 bp, Homo sapiens
acctgctctcct

SEQ ID NO: 136838 - DNA, 17 bp, Homo sapiens
acctgctctcctcttgc

SEQ ID NO: 136839 - DNA, 18 bp, Homo sapiens
acctgctgagggaccagc

SEQ ID NO: 136840 - DNA, 19 bp, Homo sapiens
acctgctgagggaccagcc

SEQ ID NO: 136841 - DNA, 21 bp, Homo sapiens
acctggccccatgtctctcag

SEQ ID NO: 136842 - DNA, 15 bp, Homo sapiens
acctgggcatatcca

SEQ ID NO: 136843 - DNA, 14 bp, Homo sapiens
acctggggagccag

SEQ ID NO: 136844 - DNA, 18 bp, Homo sapiens
acctggggtgtgggaggc

SEQ ID NO: 136845 - DNA, 21 bp, Homo sapiens
acctgggtaactagggaagat

SEQ ID NO: 136846 - DNA, 22 bp, Homo sapiens
acctggtcacaggactctgcct

SEQ ID NO: 136847 - DNA, 16 bp, Homo sapiens
acctggtgctgcctct

SEQ ID NO: 136848 - DNA, 20 bp, Homo sapiens
acctgtaatcccagctactt

SEQ ID NO: 136849 - DNA, 19 bp, Homo sapiens
acctgtcaaacaaagccag

SEQ ID NO: 136850 - DNA, 24 bp, Homo sapiens
acctgtcaaacaaagccagaagct

SEQ ID NO: 136851 - DNA, 14 bp, Homo sapiens
acctgtctcagcct

SEQ ID NO: 136852 - DNA, 12 bp, Homo sapiens
acctgtctcctt

SEQ ID NO: 136853 - DNA, 22 bp, Homo sapiens
acctgtctcctttcaccccagg

SEQ ID NO: 136854 - DNA, 16 bp, Homo sapiens
acctgtttttaagctg

SEQ ID NO: 136855 - DNA, 20 bp, Homo sapiens
accttattgtacctctctta

SEQ ID NO: 136856 - DNA, 22 bp, Homo sapiens
accttattgtacctctcttata

SEQ ID NO: 136857 - DNA, 23 bp, Homo sapiens
accttcgtttactatgcctgtgt

SEQ ID NO: 136858 - DNA, 13 bp, Homo sapiens
accttctgtggct

SEQ ID NO: 136859 - DNA, 15 bp, Homo sapiens
accttctgtggctca

SEQ ID NO: 136860 - DNA, 19 bp, Homo sapiens
accttgaaaactttatgct

SEQ ID NO: 136861 - DNA, 18 bp, Homo sapiens
accttgaacactggggga

SEQ ID NO: 136862 - DNA, 18 bp, Homo sapiens
accttgaactcctgggct

SEQ ID NO: 136863 - DNA, 16 bp, Homo sapiens
accttgttcacactct

SEQ ID NO: 136864 - DNA, 21 bp, Homo sapiens
accttgttcacactctcacat

SEQ ID NO: 136865 - DNA, 22 bp, Homo sapiens
accttgttgcatgatgtatttt

SEQ ID NO: 136866 - DNA, 15 bp, Homo sapiens
acctttattaaaatc

SEQ ID NO: 136867 - DNA, 17 bp, Homo sapiens
acctttcaaatttcaca

SEQ ID NO: 136868 - DNA, 18 bp, Homo sapiens
acctttggagcaaagctg

SEQ ID NO: 136869 - DNA, 13 bp, Homo sapiens
acgaaatgttatt

SEQ ID NO: 136870 - DNA, 23 bp, Homo sapiens
acgaaatgttattttttaattat

SEQ ID NO: 136871 - DNA, 15 bp, Homo sapiens
acgaacccacctgct

SEQ ID NO: 136872 - DNA, 16 bp, Homo sapiens
acgaacccacctgctg

SEQ ID NO: 136873 - DNA, 19 bp, Homo sapiens
acgagcaggctactgtcag

SEQ ID NO: 136874 - DNA, 19 bp, Homo sapiens
acgcacgtgggtcttcagg

SEQ ID NO: 136875 - DNA, 21 bp, Homo sapiens
acgcctgaggaacccttacag

SEQ ID NO: 136876 - DNA, 22 bp, Homo sapiens
acgcctgcaaacgctgcctgcc

SEQ ID NO: 136877 - DNA, 23 bp, Homo sapiens
acgcctgcaaacgctgcctgccc

SEQ ID NO: 136878 - DNA, 18 bp, Homo sapiens
acgcctgggggtgccagg

SEQ ID NO: 136879 - DNA, 16 bp, Homo sapiens
acgcctgtaatcccag

SEQ ID NO: 136880 - DNA, 20 bp, Homo sapiens
acgcctgtaatcccagcact

SEQ ID NO: 136881 - DNA, 12 bp, Homo sapiens
acgcgtctcctg

SEQ ID NO: 136882 - DNA, 13 bp, Homo sapiens
acgcgtcttcctg

SEQ ID NO: 136883 - DNA, 15 bp, Homo sapiens
acgcgtcttcctgag

SEQ ID NO: 136884 - DNA, 22 bp, Homo sapiens
acgctctcctttctttctaact

SEQ ID NO: 136885 - DNA, 13 bp, Homo sapiens
acgctgcctgccc

SEQ ID NO: 136886 - DNA, 15 bp, Homo sapiens
acgctgcctgcccac

SEQ ID NO: 136887 - DNA, 17 bp, Homo sapiens
acgctttctagctgttg

SEQ ID NO: 136888 - DNA, 19 bp, Homo sapiens
acggaagttttcaatgatg

SEQ ID NO: 136889 - DNA, 17 bp, Homo sapiens
acggacactcaaaagct

SEQ ID NO: 136890 - DNA, 14 bp, Homo sapiens
acggagatgtttca

SEQ ID NO: 136891 - DNA, 20 bp, Homo sapiens
acggagccactcctctgact

SEQ ID NO: 136892 - DNA, 18 bp, Homo sapiens
acggagccccaggcctct

SEQ ID NO: 136893 - DNA, 20 bp, Homo sapiens
acggatccatgtagcaggac

SEQ ID NO: 136894 - DNA, 21 bp, Homo sapiens
acggatccatgtagcaggact

SEQ ID NO: 136895 - DNA, 15 bp, Homo sapiens
acggatctgagaatc

SEQ ID NO: 136896 - DNA, 17 bp, Homo sapiens
acggatctgagaatctt

SEQ ID NO: 136897 - DNA, 16 bp, Homo sapiens
acggatgattggatta

SEQ ID NO: 136898 - DNA, 15 bp, Homo sapiens
acggttttactgcag

SEQ ID NO: 136899 - DNA, 16 bp, Homo sapiens
acgtacttagcagcta

SEQ ID NO: 136900 - DNA, 16 bp, Homo sapiens
acgtattggtccagct

SEQ ID NO: 136901 - DNA, 17 bp, Homo sapiens
acgtcaaacatgaagtg

SEQ ID NO: 136902 - DNA, 23 bp, Homo sapiens
acgtccaccatggggtcctacca

SEQ ID NO: 136903 - DNA, 14 bp, Homo sapiens
acgtgactgcccca

SEQ ID NO: 136904 - DNA, 18 bp, Homo sapiens
acgtgactgccccaactc

SEQ ID NO: 136905 - DNA, 14 bp, Homo sapiens
acgtgagagtgtct

SEQ ID NO: 136906 - DNA, 15 bp, Homo sapiens
acgtgagagtgtctt

SEQ ID NO: 136907 - DNA, 13 bp, Homo sapiens
acgtggagaggga

SEQ ID NO: 136908 - DNA, 14 bp, Homo sapiens
acgtggagagggat

SEQ ID NO: 136909 - DNA, 22 bp, Homo sapiens
acgtgggtcttcagggggccag

SEQ ID NO: 136910 - DNA, 16 bp, Homo sapiens
acgtgtttgtgctgtg

SEQ ID NO: 136911 - DNA, 17 bp, Homo sapiens
acgttagaccacaaata

SEQ ID NO: 136912 - DNA, 16 bp, Homo sapiens
acgttcacccctccac

SEQ ID NO: 136913 - DNA, 16 bp, Homo sapiens
acgttccttactgcag

SEQ ID NO: 136914 - DNA, 18 bp, Homo sapiens
acgttccttactgcagaa

SEQ ID NO: 136915 - DNA, 13 bp, Homo sapiens
acgttgctcccca

SEQ ID NO: 136916 - DNA, 20 bp, Homo sapiens
acgtttttaatataaagcct

SEQ ID NO: 136917 - DNA, 13 bp, Homo sapiens
actaaaaatacaa

SEQ ID NO: 136918 - DNA, 13 bp, Homo sapiens
actaaaaatatta

SEQ ID NO: 136919 - DNA, 16 bp, Homo sapiens
actaaactctctttgg

SEQ ID NO: 136920 - DNA, 20 bp, Homo sapiens
actaaagcagtggacaccag

SEQ ID NO: 136921 - DNA, 14 bp, Homo sapiens
actaaagtatgtaa

SEQ ID NO: 136922 - DNA, 16 bp, Homo sapiens
actaaatctctaatat

SEQ ID NO: 136923 - DNA, 15 bp, Homo sapiens
actaacatataatgt

SEQ ID NO: 136924 - DNA, 19 bp, Homo sapiens
actaatctgggaagggaag

SEQ ID NO: 136925 - DNA, 15 bp, Homo sapiens
actacagtcaggaaa

SEQ ID NO: 136926 - DNA, 23 bp, Homo sapiens
actacataaactgactttatcct

SEQ ID NO: 136927 - DNA, 15 bp, Homo sapiens
actacatgtggttta

SEQ ID NO: 136928 - DNA, 18 bp, Homo sapiens
actaccttggttccccca

SEQ ID NO: 136929 - DNA, 17 bp, Homo sapiens
actactcagggaatgaa

SEQ ID NO: 136930 - DNA, 18 bp, Homo sapiens
actactgacatgtggggc

SEQ ID NO: 136931 - DNA, 15 bp, Homo sapiens
actagagtctgaaca

SEQ ID NO: 136932 - DNA, 21 bp, Homo sapiens
actagagtctgaacagctgta

SEQ ID NO: 136933 - DNA, 16 bp, Homo sapiens
actagccaccaactct

SEQ ID NO: 136934 - DNA, 21 bp, Homo sapiens
actagccatgataactgcaat

SEQ ID NO: 136935 - DNA, 21 bp, Homo sapiens
actagcccctgtggagactgg

SEQ ID NO: 136936 - DNA, 17 bp, Homo sapiens
actagcctttggctctg

SEQ ID NO: 136937 - DNA, 16 bp, Homo sapiens
actagggatccctcat

SEQ ID NO: 136938 - DNA, 18 bp, Homo sapiens
actagggatccctcatct

SEQ ID NO: 136939 - DNA, 16 bp, Homo sapiens
actagtgaggaaagat

SEQ ID NO: 136940 - DNA, 13 bp, Homo sapiens
actagtgcaaatc

SEQ ID NO: 136941 - DNA, 15 bp, Homo sapiens
actagtgttgcttgg

SEQ ID NO: 136942 - DNA, 14 bp, Homo sapiens
actatcaaactgaa

SEQ ID NO: 136943 - DNA, 19 bp, Homo sapiens
actatcaaactgaagccag

SEQ ID NO: 136944 - DNA, 16 bp, Homo sapiens
actatgcacaatttaa

SEQ ID NO: 136945 - DNA, 19 bp, Homo sapiens
actatgcctgtgtcttctc

SEQ ID NO: 136946 - DNA, 16 bp, Homo sapiens
actatggtatttgagt

SEQ ID NO: 136947 - DNA, 14 bp, Homo sapiens
actattcaaacagt

SEQ ID NO: 136948 - DNA, 18 bp, Homo sapiens
actattcaaacagtctca

SEQ ID NO: 136949 - DNA, 18 bp, Homo sapiens
actattgaagttgcagat

SEQ ID NO: 136950 - DNA, 20 bp, Homo sapiens
actatttagtttttgtaatt

SEQ ID NO: 136951 - DNA, 12 bp, Homo sapiens
actatttatctg

SEQ ID NO: 136952 - DNA, 15 bp, Homo sapiens
actcaaaacttaaca

SEQ ID NO: 136953 - DNA, 18 bp, Homo sapiens
actcaaaagctgggcagg

SEQ ID NO: 136954 - DNA, 16 bp, Homo sapiens
actcaagccaagcagc

SEQ ID NO: 136955 - DNA, 17 bp, Homo sapiens
actcaaggactttgcag

SEQ ID NO: 136956 - DNA, 23 bp, Homo sapiens
actcaccagtgtcccctccactg

SEQ ID NO: 136957 - DNA, 16 bp, Homo sapiens
actcacctctgcctca

SEQ ID NO: 136958 - DNA, 12 bp, Homo sapiens
actcagaagcct

SEQ ID NO: 136959 - DNA, 16 bp, Homo sapiens
agcctggtgggcctcc

SEQ ID NO: 136960 - DNA, 16 bp, Homo sapiens
agcctgtaatcccagc

SEQ ID NO: 136961 - DNA, 14 bp, Homo sapiens
agcctgtctcttcc

SEQ ID NO: 136962 - DNA, 19 bp, Homo sapiens
agcctgtggcggtgcctgg

SEQ ID NO: 136963 - DNA, 20 bp, Homo sapiens
agcctgtggcggtgcctggg

SEQ ID NO: 136964 - DNA, 22 bp, Homo sapiens
agccttcttccatcccaggaca

SEQ ID NO: 136965 - DNA, 19 bp, Homo sapiens
agccttggataatgctgtt

SEQ ID NO: 136966 - DNA, 22 bp, Homo sapiens
agccttggataatgctgttgcc

SEQ ID NO: 136967 - DNA, 23 bp, Homo sapiens
agccttgggaacatgcgtgtgac

SEQ ID NO: 136968 - DNA, 18 bp, Homo sapiens
agccttggtgtccacctg

SEQ ID NO: 136969 - DNA, 23 bp, Homo sapiens
agccttgtgtctacagagaacct

SEQ ID NO: 136970 - DNA, 21 bp, Homo sapiens
agaaagcctgggtgacatttg

SEQ ID NO: 136971 - DNA, 19 bp, Homo sapiens
agaaagctggtaaactatt

SEQ ID NO: 136972 - DNA, 21 bp, Homo sapiens
agaaataaagttggtgacaga

SEQ ID NO: 136973 - DNA, 14 bp, Homo sapiens
agaaataatatgca

SEQ ID NO: 136974 - DNA, 21 bp, Homo sapiens
agaaatatgcacaatagcagt

SEQ ID NO: 136975 - DNA, 15 bp, Homo sapiens
agaaatatgtggttt

SEQ ID NO: 136976 - DNA, 22 bp, Homo sapiens
agaaatccctgtttaatattta

SEQ ID NO: 136977 - DNA, 18 bp, Homo sapiens
agaaatgcatccattcct

SEQ ID NO: 136978 - DNA, 22 bp, Homo sapiens
agaaatgcatccattcctcagg

SEQ ID NO: 136979 - DNA, 17 bp, Homo sapiens
agaaattagctgtgtga

SEQ ID NO: 136980 - DNA, 17 bp, Homo sapiens
agaaattgcatttcctg

SEQ ID NO: 136981 - DNA, 20 bp, Homo sapiens
agaaatttgatttctattca

SEQ ID NO: 136982 - DNA, 15 bp, Homo sapiens
agaacaatgtgctat

SEQ ID NO: 136983 - DNA, 22 bp, Homo sapiens
agaacagccgctcctgtctgcc

SEQ ID NO: 136984 - DNA, 23 bp, Homo sapiens
agaacagccgctcctgtctgcca

SEQ ID NO: 136985 - DNA, 13 bp, Homo sapiens
agaacctgtcctt

SEQ ID NO: 136986 - DNA, 22 bp, Homo sapiens
agaacgtattggtccagcttgc

SEQ ID NO: 136987 - DNA, 18 bp, Homo sapiens
agaacgtggctctgctgg

SEQ ID NO: 136988 - DNA, 19 bp, Homo sapiens
agaacgtggctctgctggc

SEQ ID NO: 136989 - DNA, 19 bp, Homo sapiens
agaactactcagggaatga

SEQ ID NO: 136990 - DNA, 17 bp, Homo sapiens
agaactcagttttaact

SEQ ID NO: 136991 - DNA, 15 bp, Homo sapiens
agaactggactcagg

SEQ ID NO: 136992 - DNA, 17 bp, Homo sapiens
agaagaattgaacccag

SEQ ID NO: 136993 - DNA, 19 bp, Homo sapiens
agaagaattgaacccagga

SEQ ID NO: 136994 - DNA, 14 bp, Homo sapiens
agaagactctacca

SEQ ID NO: 136995 - DNA, 15 bp, Homo sapiens
agaagagaggagagg

SEQ ID NO: 136996 - DNA, 21 bp, Homo sapiens
agaagagaggagaggagagag

SEQ ID NO: 136997 - DNA, 22 bp, Homo sapiens
agaagagaggagaggagagagg

SEQ ID NO: 136998 - DNA, 21 bp, Homo sapiens
agaagagattgtggtttcatt

SEQ ID NO: 136999 - DNA, 13 bp, Homo sapiens
agaagagctgttc

SEQ ID NO: 137000 - DNA, 21 bp, Homo sapiens
agaagagctgttcacagccag

SEQ ID NO: 137001 - DNA, 22 bp, Homo sapiens
agaagagctgttcacagccaga

SEQ ID NO: 137002 - DNA, 17 bp, Homo sapiens
agaagcaacagaaaaaa

SEQ ID NO: 137003 - DNA, 15 bp, Homo sapiens
agaagcaagaaagaa

SEQ ID NO: 137004 - DNA, 16 bp, Homo sapiens
agaagcagaggaagga

SEQ ID NO: 137005 - DNA, 21 bp, Homo sapiens
agaagcccaatattataattt

SEQ ID NO: 137006 - DNA, 14 bp, Homo sapiens
agaagccgtgggtg

SEQ ID NO: 137007 - DNA, 23 bp, Homo sapiens
agaagcctctgggtcagtggtcc

SEQ ID NO: 137008 - DNA, 15 bp, Homo sapiens
agaaggagaaggaag

SEQ ID NO: 137009 - DNA, 18 bp, Homo sapiens
agaaggagagaaagtggg

SEQ ID NO: 137010 - DNA, 23 bp, Homo sapiens
agaagggtccttccctctcccca

SEQ ID NO: 137011 - DNA, 18 bp, Homo sapiens
agaaggtttcagaaagaa

SEQ ID NO: 137012 - DNA, 14 bp, Homo sapiens
agaagtaacttact

SEQ ID NO: 137013 - DNA, 21 bp, Homo sapiens
agaagtgaaaatctacactcc

SEQ ID NO: 137014 - DNA, 19 bp, Homo sapiens
agaagtggaccaggacagg

SEQ ID NO: 137015 - DNA, 23 bp, Homo sapiens
agaagtggaccaggacaggacca

SEQ ID NO: 137016 - DNA, 17 bp, Homo sapiens
agaagtgggccaggaca

SEQ ID NO: 137017 - DNA, 19 bp, Homo sapiens
agaagtgggccaggacagg

SEQ ID NO: 137018 - DNA, 23 bp, Homo sapiens
agaagtgggccaggacaggcccg

SEQ ID NO: 137019 - DNA, 20 bp, Homo sapiens
agaagtggggacagagcaga

SEQ ID NO: 137020 - DNA, 15 bp, Homo sapiens
agaagtttgtcaagt

SEQ ID NO: 137021 - DNA, 14 bp, Homo sapiens
agaataaaatgttg

SEQ ID NO: 137022 - DNA, 16 bp, Homo sapiens
agaataaaatgttgaa

SEQ ID NO: 137023 - DNA, 20 bp, Homo sapiens
agaataaaatgttgaaaagt

SEQ ID NO: 137024 - DNA, 21 bp, Homo sapiens
agaataagagaaagaaaatga

SEQ ID NO: 137025 - DNA, 18 bp, Homo sapiens
agaataagtcatgttcct

SEQ ID NO: 137026 - DNA, 14 bp, Homo sapiens
agaataataagagg

SEQ ID NO: 137027 - DNA, 16 bp, Homo sapiens
agaatagatgctgact

SEQ ID NO: 137028 - DNA, 11 bp, Homo sapiens
agaatatttat

SEQ ID NO: 137029 - DNA, 14 bp, Homo sapiens
agaatattttaagt

SEQ ID NO: 137030 - DNA, 14 bp, Homo sapiens
agaatcacttgaac

SEQ ID NO: 137031 - DNA, 23 bp, Homo sapiens
agaatctttagagaagtatacat

SEQ ID NO: 137032 - DNA, 13 bp, Homo sapiens
agaatgaggagga

SEQ ID NO: 137033 - DNA, 16 bp, Homo sapiens
agaatgaggaggaagg

SEQ ID NO: 137034 - DNA, 17 bp, Homo sapiens
agaatgggaatatttta

SEQ ID NO: 137035 - DNA, 21 bp, Homo sapiens
agaatggttgccttaaagaaa

SEQ ID NO: 137036 - DNA, 21 bp, Homo sapiens
agaatgtgtttaaacttggtt

SEQ ID NO: 137037 - DNA, 22 bp, Homo sapiens
agaattatataggttgtgcaaa

SEQ ID NO: 137038 - DNA, 19 bp, Homo sapiens
agaattccctctctctgac

SEQ ID NO: 137039 - DNA, 17 bp, Homo sapiens
agaattctcttatccaa

SEQ ID NO: 137040 - DNA, 13 bp, Homo sapiens
agaattctgctac

SEQ ID NO: 137041 - DNA, 18 bp, Homo sapiens
agaattgaacccaggagg

SEQ ID NO: 137042 - DNA, 18 bp, Homo sapiens
agaatttgagtgctctga

SEQ ID NO: 137043 - DNA, 18 bp, Homo sapiens
agaattttaaattataac

SEQ ID NO: 137044 - DNA, 20 bp, Homo sapiens
agaattttcagaccccagcg

SEQ ID NO: 137045 - DNA, 17 bp, Homo sapiens
agacaaaaacagcctca

SEQ ID NO: 137046 - DNA, 16 bp, Homo sapiens
agacaaaccagaagca

SEQ ID NO: 137047 - DNA, 16 bp, Homo sapiens
agacaaggtagccctg

SEQ ID NO: 137048 - DNA, 20 bp, Homo sapiens
agacaatgtgaaaagaaaaa

SEQ ID NO: 137049 - DNA, 14 bp, Homo sapiens
agacacaactattt

SEQ ID NO: 137050 - DNA, 11 bp, Homo sapiens
agacacacaca

SEQ ID NO: 137051 - DNA, 12 bp, Homo sapiens
agacacacacac

SEQ ID NO: 137052 - DNA, 13 bp, Homo sapiens
agacacacacaca

SEQ ID NO: 137053 - DNA, 20 bp, Homo sapiens
agacacagggacttgaagtt

SEQ ID NO: 137054 - DNA, 17 bp, Homo sapiens
agacacctgcacctccc

SEQ ID NO: 137055 - DNA, 18 bp, Homo sapiens
agacacggatctgagaat

SEQ ID NO: 137056 - DNA, 18 bp, Homo sapiens
agacactgaaaaatctaa

SEQ ID NO: 137057 - DNA, 16 bp, Homo sapiens
agacagcagctcaggc

SEQ ID NO: 137058 - DNA, 15 bp, Homo sapiens
agacagccccagagc

SEQ ID NO: 137059 - DNA, 14 bp, Homo sapiens
agacaggaaaggga

SEQ ID NO: 137060 - DNA, 22 bp, Homo sapiens
agacagggtttggctgtgtcta

SEQ ID NO: 137061 - DNA, 18 bp, Homo sapiens
agacatccatgtttgtaa

SEQ ID NO: 137062 - DNA, 17 bp, Homo sapiens
agacatgaatatgatta

SEQ ID NO: 137063 - DNA, 16 bp, Homo sapiens
agacatggggaggaag

SEQ ID NO: 137064 - DNA, 12 bp, Homo sapiens
agacatgtgaca

SEQ ID NO: 137065 - DNA, 14 bp, Homo sapiens
agacattctgccag

SEQ ID NO: 137066 - DNA, 15 bp, Homo sapiens
agacattctgccagg

SEQ ID NO: 137067 - DNA, 19 bp, Homo sapiens
agacattcttccaaaaaga

SEQ ID NO: 137068 - DNA, 22 bp, Homo sapiens
agacatttgtaaatgtaaaact

SEQ ID NO: 137069 - DNA, 21 bp, Homo sapiens
agaccacaaatagtgctcgct

SEQ ID NO: 137070 - DNA, 16 bp, Homo sapiens
agacccaaggaggaaa

SEQ ID NO: 137071 - DNA, 15 bp, Homo sapiens
agacccattcctatt

SEQ ID NO: 137072 - DNA, 16 bp, Homo sapiens
agacccattcctattt

SEQ ID NO: 137073 - DNA, 13 bp, Homo sapiens
agacccccactct

SEQ ID NO: 137074 - DNA, 17 bp, Homo sapiens
agaccctctgccaccag

SEQ ID NO: 137075 - DNA, 18 bp, Homo sapiens
agaccgtcctcacccctg

SEQ ID NO: 137076 - DNA, 18 bp, Homo sapiens
agacctcagccatgagga

SEQ ID NO: 137077 - DNA, 14 bp, Homo sapiens
agacctcagcctgt

SEQ ID NO: 137078 - DNA, 16 bp, Homo sapiens
agaccttgttcacact

SEQ ID NO: 137079 - DNA, 21 bp, Homo sapiens
agaccttgttcacactctcac

SEQ ID NO: 137080 - DNA, 22 bp, Homo sapiens
agaccttgttcacactctcaca

SEQ ID NO: 137081 - DNA, 13 bp, Homo sapiens
agacgcctgagga

SEQ ID NO: 137082 - DNA, 15 bp, Homo sapiens
agactaatttaaaaa

SEQ ID NO: 137083 - DNA, 12 bp, Homo sapiens
agactattcaaa

SEQ ID NO: 137084 - DNA, 14 bp, Homo sapiens
agactattcaaaca

SEQ ID NO: 137085 - DNA, 18 bp, Homo sapiens
agactattcaaacagtct

SEQ ID NO: 137086 - DNA, 21 bp, Homo sapiens
agactattcaaacagtctcag

SEQ ID NO: 137087 - DNA, 14 bp, Homo sapiens
agactcacctctgc

SEQ ID NO: 137088 - DNA, 18 bp, Homo sapiens
agactcagggccccagca

SEQ ID NO: 137089 - DNA, 19 bp, Homo sapiens
agactccaaagaaatgtaa

SEQ ID NO: 137090 - DNA, 22 bp, Homo sapiens
agactccaaagaaatgtaaggg

SEQ ID NO: 137091 - DNA, 21 bp, Homo sapiens
agactccagctgggttggaaa

SEQ ID NO: 137092 - DNA, 18 bp, Homo sapiens
agactccgtctcaaggaa

SEQ ID NO: 137093 - DNA, 23 bp, Homo sapiens
agactggaggggacgctggtaga

SEQ ID NO: 137094 - DNA, 18 bp, Homo sapiens
agactggcacagttttct

SEQ ID NO: 137095 - DNA, 15 bp, Homo sapiens
agactgggctgaggg

SEQ ID NO: 137096 - DNA, 18 bp, Homo sapiens
agactggtcctgtgtgca

SEQ ID NO: 137097 - DNA, 18 bp, Homo sapiens
agactggtgagcagactg

SEQ ID NO: 137098 - DNA, 11 bp, Homo sapiens
agactgtgtat

SEQ ID NO: 137099 - DNA, 15 bp, Homo sapiens
agacttcacactgca

SEQ ID NO: 137100 - DNA, 22 bp, Homo sapiens
acacagctttatcaccagagag

SEQ ID NO: 137101 - DNA, 15 bp, Homo sapiens
acacaggcaactgag

SEQ ID NO: 137102 - DNA, 16 bp, Homo sapiens
acacaggttcacgtgc

SEQ ID NO: 137103 - DNA, 22 bp, Homo sapiens
acacatataaacatcacacaca

SEQ ID NO: 137104 - DNA, 14 bp, Homo sapiens
acacatctcctcca

SEQ ID NO: 137105 - DNA, 17 bp, Homo sapiens
acacattcaataagcat

SEQ ID NO: 137106 - DNA, 15 bp, Homo sapiens
acaccacacccagcc

SEQ ID NO: 137107 - DNA, 19 bp, Homo sapiens
acaccaggagtccctggta

SEQ ID NO: 137108 - DNA, 23 bp, Homo sapiens
acaccatgtttgagctcagaccc

SEQ ID NO: 137109 - DNA, 17 bp, Homo sapiens
acacccagcctcagtcc

SEQ ID NO: 137110 - DNA, 23 bp, Homo sapiens
acacccctcccctgccctagagc

SEQ ID NO: 137111 - DNA, 19 bp, Homo sapiens
acaccctcccccgccactc

SEQ ID NO: 137112 - DNA, 22 bp, Homo sapiens
acaccctcgaagcgcgccactc

SEQ ID NO: 137113 - DNA, 12 bp, Homo sapiens
acaccctctccc

SEQ ID NO: 137114 - DNA, 16 bp, Homo sapiens
acaccctctcccagga

SEQ ID NO: 137115 - DNA, 20 bp, Homo sapiens
acacccttcacataccctcc

SEQ ID NO: 137116 - DNA, 16 bp, Homo sapiens
acaccgggcctggaga

SEQ ID NO: 137117 - DNA, 19 bp, Homo sapiens
acaccggggtggtgggaac

SEQ ID NO: 137118 - DNA, 18 bp, Homo sapiens
acacctctgcacaagctg

SEQ ID NO: 137119 - DNA, 11 bp, Homo sapiens
acacctgcacc

SEQ ID NO: 137120 - DNA, 15 bp, Homo sapiens
acacctgcacctccc

SEQ ID NO: 137121 - DNA, 18 bp, Homo sapiens
acacctgcacctcccccc

SEQ ID NO: 137122 - DNA, 19 bp, Homo sapiens
acacctgcacctcccccca

SEQ ID NO: 137123 - DNA, 24 bp, Homo sapiens
acacctgcacctccccccactgca

SEQ ID NO: 137124 - DNA, 13 bp, Homo sapiens
acacctgccctgc

SEQ ID NO: 137125 - DNA, 19 bp, Homo sapiens
acacctgtagtcccagcta

SEQ ID NO: 137126 - DNA, 21 bp, Homo sapiens
acacctgtagtcccagctact

SEQ ID NO: 137127 - DNA, 22 bp, Homo sapiens
acacgcctgcaaacgctgcctg

SEQ ID NO: 137128 - DNA, 17 bp, Homo sapiens
acacgtctgaccctctc

SEQ ID NO: 137129 - DNA, 19 bp, Homo sapiens
acacgtctgaccctctcca

SEQ ID NO: 137130 - DNA, 23 bp, Homo sapiens
acactaattcctttctatcctac

SEQ ID NO: 137131 - DNA, 17 bp, Homo sapiens
acactatggtatttgag

SEQ ID NO: 137132 - DNA, 13 bp, Homo sapiens
acactcaaatcaa

SEQ ID NO: 137133 - DNA, 17 bp, Homo sapiens
acactcaaatcaagaaa

SEQ ID NO: 137134 - DNA, 14 bp, Homo sapiens
acactccagtgaga

SEQ ID NO: 137135 - DNA, 15 bp, Homo sapiens
acactcccctgcact

SEQ ID NO: 137136 - DNA, 20 bp, Homo sapiens
acactgtgcacatctgtgtc

SEQ ID NO: 137137 - DNA, 13 bp, Homo sapiens
acacttaaaaatg

SEQ ID NO: 137138 - DNA, 15 bp, Homo sapiens
acacttcaggctctt

SEQ ID NO: 137139 - DNA, 15 bp, Homo sapiens
acacttccaccagcc

SEQ ID NO: 137140 - DNA, 16 bp, Homo sapiens
acacttccaccagcct

SEQ ID NO: 137141 - DNA, 14 bp, Homo sapiens
acacttccataatc

SEQ ID NO: 137142 - DNA, 17 bp, Homo sapiens
acacttggttgggtcct

SEQ ID NO: 137143 - DNA, 20 bp, Homo sapiens
acacttggttgggtcctcac

SEQ ID NO: 137144 - DNA, 13 bp, Homo sapiens
acagaagcttcag

SEQ ID NO: 137145 - DNA, 19 bp, Homo sapiens
acagaagcttcagaagttt

SEQ ID NO: 137146 - DNA, 13 bp, Homo sapiens
acagaagcttcca

SEQ ID NO: 137147 - DNA, 18 bp, Homo sapiens
acagacaaaaacagcctc

SEQ ID NO: 137148 - DNA, 19 bp, Homo sapiens
acagacaaaaacagcctca

SEQ ID NO: 137149 - DNA, 20 bp, Homo sapiens
acagacaaaaacagcctcac

SEQ ID NO: 137150 - DNA, 15 bp, Homo sapiens
acagacaggagaaat

SEQ ID NO: 137151 - DNA, 13 bp, Homo sapiens
acagacaggctct

SEQ ID NO: 137152 - DNA, 16 bp, Homo sapiens
acagacgtccctccac

SEQ ID NO: 137153 - DNA, 14 bp, Homo sapiens
acagagaaggcagg

SEQ ID NO: 137154 - DNA, 14 bp, Homo sapiens
acagagacacctgc

SEQ ID NO: 137155 - DNA, 11 bp, Homo sapiens
acagagccagt

SEQ ID NO: 137156 - DNA, 15 bp, Homo sapiens
acagagcttccctga

SEQ ID NO: 137157 - DNA, 16 bp, Homo sapiens
acagagcttccctgac

SEQ ID NO: 137158 - DNA, 20 bp, Homo sapiens
acagaggatgagctctaccc

SEQ ID NO: 137159 - DNA, 15 bp, Homo sapiens
acagagggaagaaaa

SEQ ID NO: 137160 - DNA, 12 bp, Homo sapiens
acagatgcctcc

SEQ ID NO: 137161 - DNA, 17 bp, Homo sapiens
acagcagtgtcatcaga

SEQ ID NO: 137162 - DNA, 21 bp, Homo sapiens
acagcagttgaaaagactcca

SEQ ID NO: 137163 - DNA, 23 bp, Homo sapiens
acagcagttgaaaagactccaaa

SEQ ID NO: 137164 - DNA, 19 bp, Homo sapiens
acagccgattcacctgagc

SEQ ID NO: 137165 - DNA, 18 bp, Homo sapiens
acagccgctcctgtctgc

SEQ ID NO: 137166 - DNA, 15 bp, Homo sapiens
acagcctcccacccc

SEQ ID NO: 137167 - DNA, 17 bp, Homo sapiens
acagcctcccctgccag

SEQ ID NO: 137168 - DNA, 12 bp, Homo sapiens
acagcctctgac

SEQ ID NO: 137169 - DNA, 18 bp, Homo sapiens
acagcctctgacccctcc

SEQ ID NO: 137170 - DNA, 22 bp, Homo sapiens
acagcctctgacccctcctcac

SEQ ID NO: 137171 - DNA, 12 bp, Homo sapiens
acagcctggcac

SEQ ID NO: 137172 - DNA, 20 bp, Homo sapiens
acagcctgtggcggtgcctg

SEQ ID NO: 137173 - DNA, 22 bp, Homo sapiens
acagcctgtggcggtgcctggg

SEQ ID NO: 137174 - DNA, 14 bp, Homo sapiens
acagcgacatagcc

SEQ ID NO: 137175 - DNA, 19 bp, Homo sapiens
acagcggcccctgcatccc

SEQ ID NO: 137176 - DNA, 16 bp, Homo sapiens
acagcggggccccagg

SEQ ID NO: 137177 - DNA, 20 bp, Homo sapiens
acagctaatcagcattctca

SEQ ID NO: 137178 - DNA, 15 bp, Homo sapiens
acagctgcagagaca

SEQ ID NO: 137179 - DNA, 21 bp, Homo sapiens
acagctgcagagacagagagg

SEQ ID NO: 137180 - DNA, 14 bp, Homo sapiens
acagctgtccctgt

SEQ ID NO: 137181 - DNA, 18 bp, Homo sapiens
acagctgtccctgtcacc

SEQ ID NO: 137182 - DNA, 14 bp, Homo sapiens
acagctgtttaaga

SEQ ID NO: 137183 - DNA, 20 bp, Homo sapiens
acagcttcccctctctcctc

SEQ ID NO: 137184 - DNA, 16 bp, Homo sapiens
acacctgcacctcccc

SEQ ID NO: 137185 - DNA, 14 bp, Homo sapiens
acacctgccctgcc

SEQ ID NO: 137186 - DNA, 21 bp, Homo sapiens
acacgagcaggctactgtcag

SEQ ID NO: 137187 - DNA, 15 bp, Homo sapiens
acacggatctgagaa

SEQ ID NO: 137188 - DNA, 16 bp, Homo sapiens
acacggatctgagaat

SEQ ID NO: 137189 - DNA, 14 bp, Homo sapiens
acacgtccacccca

SEQ ID NO: 137190 - DNA, 17 bp, Homo sapiens
acactaattcctttcta

SEQ ID NO: 137191 - DNA, 21 bp, Homo sapiens
acactcaaaagctgggcaggt

SEQ ID NO: 137192 - DNA, 16 bp, Homo sapiens
acactccatcagctta

SEQ ID NO: 137193 - DNA, 12 bp, Homo sapiens
acactctttgta

SEQ ID NO: 137194 - DNA, 16 bp, Homo sapiens
acactctttgtaagag

SEQ ID NO: 137195 - DNA, 16 bp, Homo sapiens
acactgaggcagggaa

SEQ ID NO: 137196 - DNA, 18 bp, Homo sapiens
acactgcaagagccttgg

SEQ ID NO: 137197 - DNA, 15 bp, Homo sapiens
acactgggggagggg

SEQ ID NO: 137198 - DNA, 18 bp, Homo sapiens
acactgtgcacatctgtg

SEQ ID NO: 137199 - DNA, 15 bp, Homo sapiens
acacttaaaaatggt

SEQ ID NO: 137200 - DNA, 16 bp, Homo sapiens
acacttacactttatg

SEQ ID NO: 137201 - DNA, 18 bp, Homo sapiens
acacttacactttatgca

SEQ ID NO: 137202 - DNA, 17 bp, Homo sapiens
acacttccaccagcctg

SEQ ID NO: 137203 - DNA, 22 bp, Homo sapiens
acacttggttgggtcctcacat

SEQ ID NO: 137204 - DNA, 19 bp, Homo sapiens
acagaaagcagaacagtga

SEQ ID NO: 137205 - DNA, 18 bp, Homo sapiens
acagaagcttcagaagtt

SEQ ID NO: 137206 - DNA, 15 bp, Homo sapiens
acagaataatgaatg

SEQ ID NO: 137207 - DNA, 21 bp, Homo sapiens
acagacaaggtagccctggcc

SEQ ID NO: 137208 - DNA, 22 bp, Homo sapiens
acagacaaggtagccctggcca

SEQ ID NO: 137209 - DNA, 13 bp, Homo sapiens
acagacacacaca

SEQ ID NO: 137210 - DNA, 14 bp, Homo sapiens
acagacacacacac

SEQ ID NO: 137211 - DNA, 16 bp, Homo sapiens
acagacagacacacac

SEQ ID NO: 137212 - DNA, 13 bp, Homo sapiens
acagacaggagaa

SEQ ID NO: 137213 - DNA, 14 bp, Homo sapiens
acagacaggagaaa

SEQ ID NO: 137214 - DNA, 15 bp, Homo sapiens
acagagaaggcagga

SEQ ID NO: 137215 - DNA, 15 bp, Homo sapiens
acagagacacctgca

SEQ ID NO: 137216 - DNA, 16 bp, Homo sapiens
acagagacacctgcac

SEQ ID NO: 137217 - DNA, 17 bp, Homo sapiens
acagagacacctgcacc

SEQ ID NO: 137218 - DNA, 15 bp, Homo sapiens
acagagaggacgtgg

SEQ ID NO: 137219 - DNA, 15 bp, Homo sapiens
acagagcaagactct

SEQ ID NO: 137220 - DNA, 21 bp, Homo sapiens
acagagcctcgggacatcaaa

SEQ ID NO: 137221 - DNA, 21 bp, Homo sapiens
acagagctggttgggaagaca

SEQ ID NO: 137222 - DNA, 16 bp, Homo sapiens
acagaggatgagctct

SEQ ID NO: 137223 - DNA, 20 bp, Homo sapiens
acagagggaagaaaagagct

SEQ ID NO: 137224 - DNA, 14 bp, Homo sapiens
acagataatcagtg

SEQ ID NO: 137225 - DNA, 22 bp, Homo sapiens
acagatctctgctttggaaatc

SEQ ID NO: 137226 - DNA, 15 bp, Homo sapiens
acagcagctcaggca

SEQ ID NO: 137227 - DNA, 18 bp, Homo sapiens
acagcagttgaaaagact

SEQ ID NO: 137228 - DNA, 22 bp, Homo sapiens
acagcagttgaaaagactccaa

SEQ ID NO: 137229 - DNA, 13 bp, Homo sapiens
acagccagactgg

SEQ ID NO: 137230 - DNA, 17 bp, Homo sapiens
acagccccagagcaggg

SEQ ID NO: 137231 - DNA, 19 bp, Homo sapiens
acagccgctcctgtctgcc

SEQ ID NO: 137232 - DNA, 24 bp, Homo sapiens
acagccgctcctgtctgccagcca

SEQ ID NO: 137233 - DNA, 16 bp, Homo sapiens
acagcctcccaccccc

SEQ ID NO: 137234 - DNA, 15 bp, Homo sapiens
acagcctcccctgcc

SEQ ID NO: 137235 - DNA, 19 bp, Homo sapiens
acagcctcccctgccaggg

SEQ ID NO: 137236 - DNA, 16 bp, Homo sapiens
acagcctctgacccct

SEQ ID NO: 137237 - DNA, 14 bp, Homo sapiens
acagcctggcacag

SEQ ID NO: 137238 - DNA, 15 bp, Homo sapiens
acagcctggcacagg

SEQ ID NO: 137239 - DNA, 21 bp, Homo sapiens
acagcctgtggcggtgcctgg

SEQ ID NO: 137240 - DNA, 18 bp, Homo sapiens
acagcgagactccgtctc

SEQ ID NO: 137241 - DNA, 21 bp, Homo sapiens
acagctcagctttttgtcttt

SEQ ID NO: 137242 - DNA, 13 bp, Homo sapiens
acagctcccaccc

SEQ ID NO: 137243 - DNA, 21 bp, Homo sapiens
acatgaagtgtgtttccttca

SEQ ID NO: 137244 - DNA, 13 bp, Homo sapiens
acatgaatatgat

SEQ ID NO: 137245 - DNA, 18 bp, Homo sapiens
acatgaattgcattttac

SEQ ID NO: 137246 - DNA, 16 bp, Homo sapiens
acatgaggtactgaga

SEQ ID NO: 137247 - DNA, 20 bp, Homo sapiens
acatgaggtactgagagtga

SEQ ID NO: 137248 - DNA, 21 bp, Homo sapiens
acatgcaatttattaaaatga

SEQ ID NO: 137249 - DNA, 22 bp, Homo sapiens
acatgcctgccccaaacaaata

SEQ ID NO: 137250 - DNA, 14 bp, Homo sapiens
acatgcgggctggg

SEQ ID NO: 137251 - DNA, 21 bp, Homo sapiens
acatgcgggctgggcagctgt

SEQ ID NO: 137252 - DNA, 17 bp, Homo sapiens
acatggaactcattcct

SEQ ID NO: 137253 - DNA, 19 bp, Homo sapiens
acatggcttagttttcata

SEQ ID NO: 137254 - DNA, 20 bp, Homo sapiens
acatgggagccgggtctgcc

SEQ ID NO: 137255 - DNA, 16 bp, Homo sapiens
acatggggaggaagga

SEQ ID NO: 137256 - DNA, 15 bp, Homo sapiens
acatgtccctacacc

SEQ ID NO: 137257 - DNA, 14 bp, Homo sapiens
acatgtgacattta

SEQ ID NO: 137258 - DNA, 14 bp, Homo sapiens
acatgttatatatt

SEQ ID NO: 137259 - DNA, 18 bp, Homo sapiens
acatgtttagagttgcaa

SEQ ID NO: 137260 - DNA, 13 bp, Homo sapiens
acattaagaaaat

SEQ ID NO: 137261 - DNA, 17 bp, Homo sapiens
acattaagaaaatcata

SEQ ID NO: 137262 - DNA, 15 bp, Homo sapiens
acattaatgttaatt

SEQ ID NO: 137263 - DNA, 22 bp, Homo sapiens
acattaatgttaattcagcact

SEQ ID NO: 137264 - DNA, 18 bp, Homo sapiens
acattagcagtttgcttt

SEQ ID NO: 137265 - DNA, 17 bp, Homo sapiens
acattcccatctgtcac

SEQ ID NO: 137266 - DNA, 19 bp, Homo sapiens
acattcttccaaaaagatt

SEQ ID NO: 137267 - DNA, 18 bp, Homo sapiens
acattgaattagaaacat

SEQ ID NO: 137268 - DNA, 22 bp, Homo sapiens
acatttaacttgtttccaatgt

SEQ ID NO: 137269 - DNA, 21 bp, Homo sapiens
acatttccccagacctgagct

SEQ ID NO: 137270 - DNA, 13 bp, Homo sapiens
acatttgccttgc

SEQ ID NO: 137271 - DNA, 14 bp, Homo sapiens
acatttgccttgct

SEQ ID NO: 137272 - DNA, 17 bp, Homo sapiens
acatttgggagacatgt

SEQ ID NO: 137273 - DNA, 19 bp, Homo sapiens
acatttgggagacatgtga

SEQ ID NO: 137274 - DNA, 15 bp, Homo sapiens
acatttttacaataa

SEQ ID NO: 137275 - DNA, 16 bp, Homo sapiens
accaaaattatttcag

SEQ ID NO: 137276 - DNA, 14 bp, Homo sapiens
accaaagccaccag

SEQ ID NO: 137277 - DNA, 17 bp, Homo sapiens
accaaaggtgaaggaat

SEQ ID NO: 137278 - DNA, 19 bp, Homo sapiens
accaaaggtgaaggaatat

SEQ ID NO: 137279 - DNA, 18 bp, Homo sapiens
accaacatcccattgccc

SEQ ID NO: 137280 - DNA, 22 bp, Homo sapiens
accaacatcccattgccctggt

SEQ ID NO: 137281 - DNA, 24 bp, Homo sapiens
accaacatggagaaaccctgtctc

SEQ ID NO: 137282 - DNA, 15 bp, Homo sapiens
accaaccctcagagc

SEQ ID NO: 137283 - DNA, 14 bp, Homo sapiens
accaactcttgcag

SEQ ID NO: 137284 - DNA, 14 bp, Homo sapiens
accaagaaagcagg

SEQ ID NO: 137285 - DNA, 16 bp, Homo sapiens
accaagactctgaaat

SEQ ID NO: 137286 - DNA, 14 bp, Homo sapiens
accaagccgtggct

SEQ ID NO: 137287 - DNA, 15 bp, Homo sapiens
accaagccgtggctt

SEQ ID NO: 137288 - DNA, 16 bp, Homo sapiens
accaagccgtggcttc

SEQ ID NO: 137289 - DNA, 17 bp, Homo sapiens
accaagccgtggcttcc

SEQ ID NO: 137290 - DNA, 17 bp, Homo sapiens
accaagctcacagttcc

SEQ ID NO: 137291 - DNA, 18 bp, Homo sapiens
accaagctcacagttcct

SEQ ID NO: 137292 - DNA, 19 bp, Homo sapiens
accaagctcacagttcctc

SEQ ID NO: 137293 - DNA, 19 bp, Homo sapiens
accaaggctgattaaacca

SEQ ID NO: 137294 - DNA, 13 bp, Homo sapiens
accaatgtcttga

SEQ ID NO: 137295 - DNA, 14 bp, Homo sapiens
accacaaaaattga

SEQ ID NO: 137296 - DNA, 17 bp, Homo sapiens
accacaccaaacctctc

SEQ ID NO: 137297 - DNA, 15 bp, Homo sapiens
accacacccagcctc

SEQ ID NO: 137298 - DNA, 24 bp, Homo sapiens
accacacccagcctcagtcctccc

SEQ ID NO: 137299 - DNA, 19 bp, Homo sapiens
accaccccagctgctcccc

SEQ ID NO: 137300 - DNA, 17 bp, Homo sapiens
accacctaggccactcc

SEQ ID NO: 137301 - DNA, 18 bp, Homo sapiens
accacctaggccactcct

SEQ ID NO: 137302 - DNA, 14 bp, Homo sapiens
accaccttcccagc

SEQ ID NO: 137303 - DNA, 22 bp, Homo sapiens
accaccttcccagctctccctc

SEQ ID NO: 137304 - DNA, 16 bp, Homo sapiens
accacgatgtggccct

SEQ ID NO: 137305 - DNA, 18 bp, Homo sapiens
accacgatgtggccctgg

SEQ ID NO: 137306 - DNA, 20 bp, Homo sapiens
accacgatgtggccctggcc

SEQ ID NO: 137307 - DNA, 16 bp, Homo sapiens
accacgctggggtctg

SEQ ID NO: 137308 - DNA, 14 bp, Homo sapiens
accacgtccagctg

SEQ ID NO: 137309 - DNA, 20 bp, Homo sapiens
accactgcactccagcctgg

SEQ ID NO: 137310 - DNA, 13 bp, Homo sapiens
accactgcagaag

SEQ ID NO: 137311 - DNA, 16 bp, Homo sapiens
accactggtctgtagg

SEQ ID NO: 137312 - DNA, 16 bp, Homo sapiens
accactgtgtatttaa

SEQ ID NO: 137313 - DNA, 15 bp, Homo sapiens
accacttcagctgac

SEQ ID NO: 137314 - DNA, 17 bp, Homo sapiens
accagcaatatgtaaat

SEQ ID NO: 137315 - DNA, 15 bp, Homo sapiens
accagcagatcccag

SEQ ID NO: 137316 - DNA, 21 bp, Homo sapiens
accagcagatcccagctcacg

SEQ ID NO: 137317 - DNA, 20 bp, Homo sapiens
accagcctccatgctgcctc

SEQ ID NO: 137318 - DNA, 17 bp, Homo sapiens
accagcctcgtcttcat

SEQ ID NO: 137319 - DNA, 19 bp, Homo sapiens
accagcctcgtcttcatta

SEQ ID NO: 137320 - DNA, 23 bp, Homo sapiens
accagcgaggaggctccagaggg

SEQ ID NO: 137321 - DNA, 20 bp, Homo sapiens
accaggcacgaacccacctg

SEQ ID NO: 137322 - DNA, 23 bp, Homo sapiens
accaggcacgaacccacctgctg

SEQ ID NO: 137323 - DNA, 16 bp, Homo sapiens
accaggccgccccagc

SEQ ID NO: 137324 - DNA, 19 bp, Homo sapiens
accaggccgccccagcctc

SEQ ID NO: 137325 - DNA, 20 bp, Homo sapiens
accagggagcccctttgatg

SEQ ID NO: 137326 - DNA, 19 bp, Homo sapiens
accagggcctgagccaagc

SEQ ID NO: 137327 - DNA, 14 bp, Homo sapiens
accagtctgaccct

SEQ ID NO: 137328 - DNA, 13 bp, Homo sapiens
accagtgtcccct

SEQ ID NO: 137329 - DNA, 18 bp, Homo sapiens
accatccctttttgaagt

SEQ ID NO: 137330 - DNA, 21 bp, Homo sapiens
accatccctttttgaagtgta

SEQ ID NO: 137331 - DNA, 17 bp, Homo sapiens
accatcctgcagcctcc

SEQ ID NO: 137332 - DNA, 21 bp, Homo sapiens
accatgtaaagaacataaata

SEQ ID NO: 137333 - DNA, 17 bp, Homo sapiens
accatgtagaaaatttg

SEQ ID NO: 137334 - DNA, 16 bp, Homo sapiens
accatgtgcctgatcc

SEQ ID NO: 137335 - DNA, 12 bp, Homo sapiens
accatgtttgag

SEQ ID NO: 137336 - DNA, 15 bp, Homo sapiens
accattccccatggg

SEQ ID NO: 137337 - DNA, 18 bp, Homo sapiens
accattgaattcttggtt

SEQ ID NO: 137338 - DNA, 17 bp, Homo sapiens
cacagctcccaccccac

SEQ ID NO: 137339 - DNA, 22 bp, Homo sapiens
cacagctcccaccccaccccct

SEQ ID NO: 137340 - DNA, 18 bp, Homo sapiens
cacagctgcagagacaga

SEQ ID NO: 137341 - DNA, 19 bp, Homo sapiens
cacagctgcagagacagag

SEQ ID NO: 137342 - DNA, 16 bp, Homo sapiens
cacagcttcccctctc

SEQ ID NO: 137343 - DNA, 14 bp, Homo sapiens
cacaggcagcattt

SEQ ID NO: 137344 - DNA, 15 bp, Homo sapiens
cacaggcccttcctc

SEQ ID NO: 137345 - DNA, 14 bp, Homo sapiens
cacagggacttgaa

SEQ ID NO: 137346 - DNA, 21 bp, Homo sapiens
cacagggacttgaagttgtta

SEQ ID NO: 137347 - DNA, 23 bp, Homo sapiens
cacagggcatgccccggccacct

SEQ ID NO: 137348 - DNA, 17 bp, Homo sapiens
cacagggtctgctcttt

SEQ ID NO: 137349 - DNA, 19 bp, Homo sapiens
cacagggtctgctctttct

SEQ ID NO: 137350 - DNA, 20 bp, Homo sapiens
cacaggttcacgtgcagctc

SEQ ID NO: 137351 - DNA, 19 bp, Homo sapiens
cacaggttcatgccaccat

SEQ ID NO: 137352 - DNA, 17 bp, Homo sapiens
cacagtgaaggctgtcc

SEQ ID NO: 137353 - DNA, 17 bp, Homo sapiens
cacagtgcatctcagcc

SEQ ID NO: 137354 - DNA, 14 bp, Homo sapiens
cacagtgttgccca

SEQ ID NO: 137355 - DNA, 19 bp, Homo sapiens
cacagtgttgcccaggctg

SEQ ID NO: 137356 - DNA, 22 bp, Homo sapiens
cacagttcctcgccctgggtct

SEQ ID NO: 137357 - DNA, 17 bp, Homo sapiens
cacagttggctggatga

SEQ ID NO: 137358 - DNA, 17 bp, Homo sapiens
cacagttttctgagaaa

SEQ ID NO: 137359 - DNA, 22 bp, Homo sapiens
cacagttttctgagaaagacta

SEQ ID NO: 137360 - DNA, 13 bp, Homo sapiens
cacataccctccc

SEQ ID NO: 137361 - DNA, 13 bp, Homo sapiens
cacatcagcttgc

SEQ ID NO: 137362 - DNA, 21 bp, Homo sapiens
cacatccatttcatctatttc

SEQ ID NO: 137363 - DNA, 17 bp, Homo sapiens
cacatctaacctcatct

SEQ ID NO: 137364 - DNA, 13 bp, Homo sapiens
cacatctgcattt

SEQ ID NO: 137365 - DNA, 19 bp, Homo sapiens
cacatctttcacacttcca

SEQ ID NO: 137366 - DNA, 18 bp, Homo sapiens
cacatgtttagagttgca

SEQ ID NO: 137367 - DNA, 18 bp, Homo sapiens
cacattaatatttgctga

SEQ ID NO: 137368 - DNA, 18 bp, Homo sapiens
cacatttccccagacctg

SEQ ID NO: 137369 - DNA, 17 bp, Homo sapiens
cacatttgattctgtgt

SEQ ID NO: 137370 - DNA, 17 bp, Homo sapiens
caccaacatcccattgc

SEQ ID NO: 137371 - DNA, 13 bp, Homo sapiens
caccaaccctcag

SEQ ID NO: 137372 - DNA, 18 bp, Homo sapiens
caccaactcttgcaggtc

SEQ ID NO: 137373 - DNA, 22 bp, Homo sapiens
caccaagacttgttttatgctc

SEQ ID NO: 137374 - DNA, 24 bp, Homo sapiens
caccaattggttaatctttcctga

SEQ ID NO: 137375 - DNA, 15 bp, Homo sapiens
caccacacccagcct

SEQ ID NO: 137376 - DNA, 16 bp, Homo sapiens
caccacacccagcctc

SEQ ID NO: 137377 - DNA, 18 bp, Homo sapiens
caccacacccagcctcag

SEQ ID NO: 137378 - DNA, 21 bp, Homo sapiens
caccaccccagctgctcccct

SEQ ID NO: 137379 - DNA, 14 bp, Homo sapiens
caccaccttcccag

SEQ ID NO: 137380 - DNA, 15 bp, Homo sapiens
caccaccttcccagc

SEQ ID NO: 137381 - DNA, 18 bp, Homo sapiens
caccaccttcccagctct

SEQ ID NO: 137382 - DNA, 15 bp, Homo sapiens
caccacgatgtggcc

SEQ ID NO: 137383 - DNA, 21 bp, Homo sapiens
caccacgatgtggccctggcc

SEQ ID NO: 137384 - DNA, 19 bp, Homo sapiens
caccagagaccgtcctcac

SEQ ID NO: 137385 - DNA, 14 bp, Homo sapiens
caccagagagggac

SEQ ID NO: 137386 - DNA, 12 bp, Homo sapiens
caccagcagcct

SEQ ID NO: 137387 - DNA, 15 bp, Homo sapiens
caccagcagcctgga

SEQ ID NO: 137388 - DNA, 23 bp, Homo sapiens
caccaggaatgttaaagtcagtg

SEQ ID NO: 137389 - DNA, 17 bp, Homo sapiens
caccaggagtccctggt

SEQ ID NO: 137390 - DNA, 19 bp, Homo sapiens
caccaggcacgaacccacc

SEQ ID NO: 137391 - DNA, 20 bp, Homo sapiens
caccaggcacgaacccacct

SEQ ID NO: 137392 - DNA, 24 bp, Homo sapiens
caccaggcacgaacccacctgctg

SEQ ID NO: 137393 - DNA, 12 bp, Homo sapiens
caccatggccag

SEQ ID NO: 137394 - DNA, 17 bp, Homo sapiens
caccatttggcaatgcc

SEQ ID NO: 137395 - DNA, 14 bp, Homo sapiens
cacccaaaagtcaa

SEQ ID NO: 137396 - DNA, 22 bp, Homo sapiens
cacccagacagctccctctgcc

SEQ ID NO: 137397 - DNA, 12 bp, Homo sapiens
cacccagcccat

SEQ ID NO: 137398 - DNA, 15 bp, Homo sapiens
cacccagcccattct

SEQ ID NO: 137399 - DNA, 11 bp, Homo sapiens
cacccagcctc

SEQ ID NO: 137400 - DNA, 22 bp, Homo sapiens
caccccacccccttcagtgccc

SEQ ID NO: 137401 - DNA, 13 bp, Homo sapiens
caccccagctgct

SEQ ID NO: 137402 - DNA, 22 bp, Homo sapiens
caccccagggcctgagcctggc

SEQ ID NO: 137403 - DNA, 18 bp, Homo sapiens
caccccagtgcacccact

SEQ ID NO: 137404 - DNA, 20 bp, Homo sapiens
caccccagtgcacccactct

SEQ ID NO: 137405 - DNA, 21 bp, Homo sapiens
caccccatcccacaccctgga

SEQ ID NO: 137406 - DNA, 21 bp, Homo sapiens
caccccccagaacctgtcctt

SEQ ID NO: 137407 - DNA, 15 bp, Homo sapiens
caccccctccccagg

SEQ ID NO: 137408 - DNA, 16 bp, Homo sapiens
caccccctccccaggg

SEQ ID NO: 137409 - DNA, 16 bp, Homo sapiens
cacccccttcagtgcc

SEQ ID NO: 137410 - DNA, 18 bp, Homo sapiens
cacccccttctccatcca

SEQ ID NO: 137411 - DNA, 23 bp, Homo sapiens
cacccctccttccttgaccagca

SEQ ID NO: 137412 - DNA, 24 bp, Homo sapiens
cacccctgccctgggatgtccaca

SEQ ID NO: 137413 - DNA, 14 bp, Homo sapiens
caccctcaggcagg

SEQ ID NO: 137414 - DNA, 23 bp, Homo sapiens
caccctcgaagcgcgccactcgc

SEQ ID NO: 137415 - DNA, 16 bp, Homo sapiens
caccctctcccaggac

SEQ ID NO: 137416 - DNA, 17 bp, Homo sapiens
caccctgaaagccctga

SEQ ID NO: 137417 - DNA, 12 bp, Homo sapiens
caccctgcctta

SEQ ID NO: 137418 - DNA, 19 bp, Homo sapiens
caccctgccttatcttgca

SEQ ID NO: 137419 - DNA, 22 bp, Homo sapiens
cacccttcacataccctccccc

SEQ ID NO: 137420 - DNA, 22 bp, Homo sapiens
cacccttcccctccttctccct

SEQ ID NO: 137421 - DNA, 19 bp, Homo sapiens
cacccttggaggctgtctt

SEQ ID NO: 137422 - DNA, 22 bp, Homo sapiens
caccctttgctgtgaggctgtc

SEQ ID NO: 137423 - DNA, 21 bp, Homo sapiens
cacccttttccagctggatga

SEQ ID NO: 137424 - DNA, 18 bp, Homo sapiens
caccgacgcgtctcctgt

SEQ ID NO: 137425 - DNA, 22 bp, Homo sapiens
caccggatcctgggtggtctgc

SEQ ID NO: 137426 - DNA, 17 bp, Homo sapiens
caccgtgggctccctga

SEQ ID NO: 137427 - DNA, 17 bp, Homo sapiens
cacctaccatcagggac

SEQ ID NO: 137428 - DNA, 20 bp, Homo sapiens
cacctactacatcgccctcc

SEQ ID NO: 137429 - DNA, 17 bp, Homo sapiens
cacctaggccactcctc

SEQ ID NO: 137430 - DNA, 19 bp, Homo sapiens
cacctataaaacaggtcaa

SEQ ID NO: 137431 - DNA, 11 bp, Homo sapiens
cacctcagcct

SEQ ID NO: 137432 - DNA, 15 bp, Homo sapiens
cacctcagccttgga

SEQ ID NO: 137433 - DNA, 14 bp, Homo sapiens
cacctccccacgcc

SEQ ID NO: 137434 - DNA, 19 bp, Homo sapiens
cacctccccacgccctccc

SEQ ID NO: 137435 - DNA, 13 bp, Homo sapiens
cacctcccctatc

SEQ ID NO: 137436 - DNA, 18 bp, Homo sapiens
cacctcccctatccaccc

SEQ ID NO: 137437 - DNA, 18 bp, Homo sapiens
cacctctgcggaccccag

SEQ ID NO: 137438 - DNA, 15 bp, Homo sapiens
cacctctgtgacctc

SEQ ID NO: 137439 - DNA, 17 bp, Homo sapiens
cacctctgtgacctcag

SEQ ID NO: 137440 - DNA, 19 bp, Homo sapiens
cacctgcacctccccccac

SEQ ID NO: 137441 - DNA, 22 bp, Homo sapiens
cacctgcacctccccccactgc

SEQ ID NO: 137442 - DNA, 13 bp, Homo sapiens
cacctgcccaacc

SEQ ID NO: 137443 - DNA, 19 bp, Homo sapiens
cacctgcccaacctgctct

SEQ ID NO: 137444 - DNA, 12 bp, Homo sapiens
cacctgccctgc

SEQ ID NO: 137445 - DNA, 13 bp, Homo sapiens
cacctgccctgcc

SEQ ID NO: 137446 - DNA, 14 bp, Homo sapiens
cacctgccctgccc

SEQ ID NO: 137447 - DNA, 19 bp, Homo sapiens
cacctgctgagagacccaa

SEQ ID NO: 137448 - DNA, 22 bp, Homo sapiens
cacctgctgagagacccaagga

SEQ ID NO: 137449 - DNA, 11 bp, Homo sapiens
cacctggcccc

SEQ ID NO: 137450 - DNA, 14 bp, Homo sapiens
cacctggccccatg

SEQ ID NO: 137451 - DNA, 14 bp, Homo sapiens
cacctggggcagtc

SEQ ID NO: 137452 - DNA, 22 bp, Homo sapiens
cacctggggtgtgggaggcccg

SEQ ID NO: 137453 - DNA, 15 bp, Homo sapiens
cacctggtggcctct

SEQ ID NO: 137454 - DNA, 16 bp, Homo sapiens
cacctggttccggaat

SEQ ID NO: 137455 - DNA, 16 bp, Homo sapiens
cacctgtagtcccagc

SEQ ID NO: 137456 - DNA, 19 bp, Homo sapiens
cacctgtctcagcctccca

SEQ ID NO: 137457 - DNA, 17 bp, Homo sapiens
caccttaccaactttct

SEQ ID NO: 137458 - DNA, 14 bp, Homo sapiens
caccttaggcaggg

SEQ ID NO: 137459 - DNA, 15 bp, Homo sapiens
caccttcccagctct

SEQ ID NO: 137460 - DNA, 17 bp, Homo sapiens
caccttcccagctctcc

SEQ ID NO: 137461 - DNA, 21 bp, Homo sapiens
caccttcgtttactatgcctg

SEQ ID NO: 137462 - DNA, 19 bp, Homo sapiens
caccttgggatgatgcctc

SEQ ID NO: 137463 - DNA, 12 bp, Homo sapiens
cacctttattaa

SEQ ID NO: 137464 - DNA, 17 bp, Homo sapiens
cacctttattaaaatct

SEQ ID NO: 137465 - DNA, 13 bp, Homo sapiens
cacgaaatgttat

SEQ ID NO: 137466 - DNA, 14 bp, Homo sapiens
cacgaacccacctg

SEQ ID NO: 137467 - DNA, 22 bp, Homo sapiens
cacgaatttgctggggaatctc

SEQ ID NO: 137468 - DNA, 17 bp, Homo sapiens
cacgactgcccggcagg

SEQ ID NO: 137469 - DNA, 13 bp, Homo sapiens
cacgactgtctcc

SEQ ID NO: 137470 - DNA, 17 bp, Homo sapiens
cacgagcaggctactgt

SEQ ID NO: 137471 - DNA, 19 bp, Homo sapiens
cacgagcaggctactgtca

SEQ ID NO: 137472 - DNA, 20 bp, Homo sapiens
cacgagcaggctactgtcag

SEQ ID NO: 137473 - DNA, 12 bp, Homo sapiens
cacgatgaaaaa

SEQ ID NO: 137474 - DNA, 18 bp, Homo sapiens
cacgatgtggccctggcc

SEQ ID NO: 137475 - DNA, 22 bp, Homo sapiens
cacgatgtggccctggcctgct

SEQ ID NO: 137476 - DNA, 14 bp, Homo sapiens
cacgcacctcccat

SEQ ID NO: 137477 - DNA, 13 bp, Homo sapiens
cacgcacctgggt

SEQ ID NO: 137478 - DNA, 23 bp, Homo sapiens
cacgcccatgtgtgagtgtgtgc

SEQ ID NO: 137479 - DNA, 21 bp, Homo sapiens
cacgcctgcaaacgctgcctg

SEQ ID NO: 137480 - DNA, 22 bp, Homo sapiens
aatttcatacctatcatcttaa

SEQ ID NO: 137481 - DNA, 16 bp, Homo sapiens
aatttggttctaatag

SEQ ID NO: 137482 - DNA, 16 bp, Homo sapiens
aatttgttataatgaa

SEQ ID NO: 137483 - DNA, 18 bp, Homo sapiens
aatttgttattttgcaac

SEQ ID NO: 137484 - DNA, 15 bp, Homo sapiens
aattttctagacttt

SEQ ID NO: 137485 - DNA, 18 bp, Homo sapiens
aattttctagactttctg

SEQ ID NO: 137486 - DNA, 21 bp, Homo sapiens
aattttctttttaataaaaag

SEQ ID NO: 137487 - DNA, 20 bp, Homo sapiens
aattttgttctagttttcag

SEQ ID NO: 137488 - DNA, 22 bp, Homo sapiens
aatttttaaagtatatatttat

SEQ ID NO: 137489 - DNA, 18 bp, Homo sapiens
aatttttattaaattatg

SEQ ID NO: 137490 - DNA, 16 bp, Homo sapiens
aatttttatttttcta

SEQ ID NO: 137491 - DNA, 21 bp, Homo sapiens
aatttttcttatttcatttct

SEQ ID NO: 137492 - DNA, 15 bp, Homo sapiens
aatttttttcaatat

SEQ ID NO: 137493 - DNA, 13 bp, Homo sapiens
acaaaaaaatctg

SEQ ID NO: 137494 - DNA, 13 bp, Homo sapiens
acaaaaacacagc

SEQ ID NO: 137495 - DNA, 16 bp, Homo sapiens
acaaaaagcataaaaa

SEQ ID NO: 137496 - DNA, 22 bp, Homo sapiens
acaaaagtttcatccttttcat

SEQ ID NO: 137497 - DNA, 22 bp, Homo sapiens
acaaaatgtagggttataataa

SEQ ID NO: 137498 - DNA, 14 bp, Homo sapiens
acaaacatgaccct

SEQ ID NO: 137499 - DNA, 15 bp, Homo sapiens
acaaacgggctcagc

SEQ ID NO: 137500 - DNA, 23 bp, Homo sapiens
acaaagatgtttgtcagatatga

SEQ ID NO: 137501 - DNA, 24 bp, Homo sapiens
acaaagatgtttgtcagatatgat

SEQ ID NO: 137502 - DNA, 11 bp, Homo sapiens
acaaagccaga

SEQ ID NO: 137503 - DNA, 20 bp, Homo sapiens
acaaagccagaagctgagca

SEQ ID NO: 137504 - DNA, 18 bp, Homo sapiens
acaaagcccttccatgtc

SEQ ID NO: 137505 - DNA, 14 bp, Homo sapiens
acaaagtaattcct

SEQ ID NO: 137506 - DNA, 16 bp, Homo sapiens
acaaataataagcaaa

SEQ ID NO: 137507 - DNA, 15 bp, Homo sapiens
acaaatactcttagg

SEQ ID NO: 137508 - DNA, 12 bp, Homo sapiens
acaaatatgcaa

SEQ ID NO: 137509 - DNA, 16 bp, Homo sapiens
acaaatgccacacatc

SEQ ID NO: 137510 - DNA, 22 bp, Homo sapiens
acaaatgctgcgcccttcccca

SEQ ID NO: 137511 - DNA, 22 bp, Homo sapiens
acaaattatgttacatctgttt

SEQ ID NO: 137512 - DNA, 13 bp, Homo sapiens
acaacaagagttt

SEQ ID NO: 137513 - DNA, 19 bp, Homo sapiens
acaacagaagcttcagaag

SEQ ID NO: 137514 - DNA, 14 bp, Homo sapiens
acaacgaggaagcc

SEQ ID NO: 137515 - DNA, 15 bp, Homo sapiens
acaacgaggaagccc

SEQ ID NO: 137516 - DNA, 16 bp, Homo sapiens
acaagaaatccctgtt

SEQ ID NO: 137517 - DNA, 18 bp, Homo sapiens
acaagaaatttgatttct

SEQ ID NO: 137518 - DNA, 20 bp, Homo sapiens
acaagacccaaaaggcagaa

SEQ ID NO: 137519 - DNA, 14 bp, Homo sapiens
acaagacttcagta

SEQ ID NO: 137520 - DNA, 17 bp, Homo sapiens
acaagagcgaaactccg

SEQ ID NO: 137521 - DNA, 16 bp, Homo sapiens
acaagattcccagaga

SEQ ID NO: 137522 - DNA, 18 bp, Homo sapiens
cactccaccacccaaaag

SEQ ID NO: 137523 - DNA, 19 bp, Homo sapiens
cactccaccacccaaaagt

SEQ ID NO: 137524 - DNA, 14 bp, Homo sapiens
cactccagacccct

SEQ ID NO: 137525 - DNA, 13 bp, Homo sapiens
cactccagcctgg

SEQ ID NO: 137526 - DNA, 21 bp, Homo sapiens
cactcccttggtggcaagagc

SEQ ID NO: 137527 - DNA, 21 bp, Homo sapiens
cactcctctgactcagggctc

SEQ ID NO: 137528 - DNA, 13 bp, Homo sapiens
cactcctgccaag

SEQ ID NO: 137529 - DNA, 15 bp, Homo sapiens
cactccttcctgcca

SEQ ID NO: 137530 - DNA, 21 bp, Homo sapiens
cactccttcctgccacctgct

SEQ ID NO: 137531 - DNA, 18 bp, Homo sapiens
cactctcattccccaggt

SEQ ID NO: 137532 - DNA, 23 bp, Homo sapiens
cactctctgaagatgatcatttg

SEQ ID NO: 137533 - DNA, 17 bp, Homo sapiens
cactctgcctctgcctg

SEQ ID NO: 137534 - DNA, 20 bp, Homo sapiens
cactctgcctctgcctgcat

SEQ ID NO: 137535 - DNA, 19 bp, Homo sapiens
cactctgctttgactgagc

SEQ ID NO: 137536 - DNA, 12 bp, Homo sapiens
cactctggcctc

SEQ ID NO: 137537 - DNA, 13 bp, Homo sapiens
cactctggcctca

SEQ ID NO: 137538 - DNA, 22 bp, Homo sapiens
cactgaagttaacagagacaga

SEQ ID NO: 137539 - DNA, 20 bp, Homo sapiens
cactgacttctaagtaaaac

SEQ ID NO: 137540 - DNA, 21 bp, Homo sapiens
cactgacttctaagtaaaacc

SEQ ID NO: 137541 - DNA, 18 bp, Homo sapiens
cactgagataccagcgag

SEQ ID NO: 137542 - DNA, 13 bp, Homo sapiens
cactgaggcaggg

SEQ ID NO: 137543 - DNA, 16 bp, Homo sapiens
cactgaggcagggaag

SEQ ID NO: 137544 - DNA, 18 bp, Homo sapiens
cactgaggcagggaagtc

SEQ ID NO: 137545 - DNA, 19 bp, Homo sapiens
cactgaggcagggaagtcc

SEQ ID NO: 137546 - DNA, 20 bp, Homo sapiens
cactgatatatcatgagtga

SEQ ID NO: 137547 - DNA, 18 bp, Homo sapiens
cactgcaagagccttggt

SEQ ID NO: 137548 - DNA, 19 bp, Homo sapiens
cactgcaagagccttggtg

SEQ ID NO: 137549 - DNA, 23 bp, Homo sapiens
cactgcacagtgcatctcagccc

SEQ ID NO: 137550 - DNA, 15 bp, Homo sapiens
cactgcactccagcc

SEQ ID NO: 137551 - DNA, 16 bp, Homo sapiens
cactgcactccagcct

SEQ ID NO: 137552 - DNA, 18 bp, Homo sapiens
cactgcactccagcctgg

SEQ ID NO: 137553 - DNA, 21 bp, Homo sapiens
cactgcagaagacagtatggc

SEQ ID NO: 137554 - DNA, 16 bp, Homo sapiens
cactgcaggccccgct

SEQ ID NO: 137555 - DNA, 11 bp, Homo sapiens
cactgccacac

SEQ ID NO: 137556 - DNA, 16 bp, Homo sapiens
cactgccataaaacat

SEQ ID NO: 137557 - DNA, 17 bp, Homo sapiens
cactgccataaaacatt

SEQ ID NO: 137558 - DNA, 17 bp, Homo sapiens
cactgccatgccagctt

SEQ ID NO: 137559 - DNA, 19 bp, Homo sapiens
cactgccatggaggcacac

SEQ ID NO: 137560 - DNA, 22 bp, Homo sapiens
cactgccatggaggcacacagc

SEQ ID NO: 137561 - DNA, 19 bp, Homo sapiens
cactgcctctccctggccc

SEQ ID NO: 137562 - DNA, 20 bp, Homo sapiens
cactgcctctccctggccct

SEQ ID NO: 137563 - DNA, 17 bp, Homo sapiens
cactgctccctgaagcc

SEQ ID NO: 137564 - DNA, 21 bp, Homo sapiens
cactgctgtgctgtgcccaag

SEQ ID NO: 137565 - DNA, 13 bp, Homo sapiens
cactgcttgagga

SEQ ID NO: 137566 - DNA, 21 bp, Homo sapiens
cactggagcaccaggcacgaa

SEQ ID NO: 137567 - DNA, 16 bp, Homo sapiens
cactggagtccagtct

SEQ ID NO: 137568 - DNA, 22 bp, Homo sapiens
cactggagttacattaatgtta

SEQ ID NO: 137569 - DNA, 19 bp, Homo sapiens
cactggatgcaaagaaaat

SEQ ID NO: 137570 - DNA, 23 bp, Homo sapiens
cactgggatgagccgctgtgagc

SEQ ID NO: 137571 - DNA, 18 bp, Homo sapiens
cactggggtcctggggcc

SEQ ID NO: 137572 - DNA, 19 bp, Homo sapiens
cactggggtcctggggcct

SEQ ID NO: 137573 - DNA, 15 bp, Homo sapiens
cactgggttgacttt

SEQ ID NO: 137574 - DNA, 21 bp, Homo sapiens
cactggtggcccgacagcctg

SEQ ID NO: 137575 - DNA, 17 bp, Homo sapiens
cactgtcccttgcctca

SEQ ID NO: 137576 - DNA, 18 bp, Homo sapiens
cactgtcccttgcctcaa

SEQ ID NO: 137577 - DNA, 15 bp, Homo sapiens
cactgtgtatttaac

SEQ ID NO: 137578 - DNA, 14 bp, Homo sapiens
cactgttgaaaatt

SEQ ID NO: 137579 - DNA, 13 bp, Homo sapiens
cactgttgaattt

SEQ ID NO: 137580 - DNA, 17 bp, Homo sapiens
cactgttgaattttctc

SEQ ID NO: 137581 - DNA, 14 bp, Homo sapiens
cactgtttctctgc

SEQ ID NO: 137582 - DNA, 15 bp, Homo sapiens
cacttaagagaatat

SEQ ID NO: 137583 - DNA, 18 bp, Homo sapiens
cacttacactttatgcac

SEQ ID NO: 137584 - DNA, 21 bp, Homo sapiens
cacttcaagtgaccaccagga

SEQ ID NO: 137585 - DNA, 12 bp, Homo sapiens
cacttcagctga

SEQ ID NO: 137586 - DNA, 15 bp, Homo sapiens
cacttcaggctcttc

SEQ ID NO: 137587 - DNA, 20 bp, Homo sapiens
cacttcaggctcttctcctt

SEQ ID NO: 137588 - DNA, 22 bp, Homo sapiens
cacttcagggttctcctctccc

SEQ ID NO: 137589 - DNA, 16 bp, Homo sapiens
cacttccaccagcctg

SEQ ID NO: 137590 - DNA, 23 bp, Homo sapiens
cacttcttcttggtcttatttat

SEQ ID NO: 137591 - DNA, 22 bp, Homo sapiens
cacttgaggtcaggagttccta

SEQ ID NO: 137592 - DNA, 13 bp, Homo sapiens
cacttgagtccag

SEQ ID NO: 137593 - DNA, 12 bp, Homo sapiens
cacttggagcca

SEQ ID NO: 137594 - DNA, 16 bp, Homo sapiens
cacttgggtcttccct

SEQ ID NO: 137595 - DNA, 16 bp, Homo sapiens
cacttggttgggtcct

SEQ ID NO: 137596 - DNA, 19 bp, Homo sapiens
cacttggttgggtcctcac

SEQ ID NO: 137597 - DNA, 22 bp, Homo sapiens
cacttgtgggtttttgttttgt

SEQ ID NO: 137598 - DNA, 22 bp, Homo sapiens
cactttacaatgttcatcccat

SEQ ID NO: 137599 - DNA, 13 bp, Homo sapiens
cactttgggaggc

SEQ ID NO: 137600 - DNA, 19 bp, Homo sapiens
cagaaagatggatgtgctt

SEQ ID NO: 137601 - DNA, 18 bp, Homo sapiens
cagaaagcagaacagtga

SEQ ID NO: 137602 - DNA, 19 bp, Homo sapiens
cagaaagcagaacagtgat

SEQ ID NO: 137603 - DNA, 22 bp, Homo sapiens
cagaaagcctgggtgacatttg

SEQ ID NO: 137604 - DNA, 20 bp, Homo sapiens
cagaaataaagttggtgaca

SEQ ID NO: 137605 - DNA, 13 bp, Homo sapiens
cagaaatacatat

SEQ ID NO: 137606 - DNA, 20 bp, Homo sapiens
cagaaatcagtaatatttat

SEQ ID NO: 137607 - DNA, 14 bp, Homo sapiens
cagaaatttttatt

SEQ ID NO: 137608 - DNA, 17 bp, Homo sapiens
cagaacagtgattacca

SEQ ID NO: 137609 - DNA, 23 bp, Homo sapiens
cagaacagtgattaccagggact

SEQ ID NO: 137610 - DNA, 22 bp, Homo sapiens
cagaacccttggagccaatgga

SEQ ID NO: 137611 - DNA, 14 bp, Homo sapiens
cagaacccttggct

SEQ ID NO: 137612 - DNA, 14 bp, Homo sapiens
cagaacctgtcctt

SEQ ID NO: 137613 - DNA, 13 bp, Homo sapiens
cagaacgtggctc

SEQ ID NO: 137614 - DNA, 18 bp, Homo sapiens
cagaagaatatgacagct

SEQ ID NO: 137615 - DNA, 22 bp, Homo sapiens
cagaagataacttgagcaccgt

SEQ ID NO: 137616 - DNA, 20 bp, Homo sapiens
cagaagcctcactgcaagca

SEQ ID NO: 137617 - DNA, 19 bp, Homo sapiens
cagaagctgagcaccaggg

SEQ ID NO: 137618 - DNA, 14 bp, Homo sapiens
cagaagcttcagaa

SEQ ID NO: 137619 - DNA, 18 bp, Homo sapiens
cagaaggcaaacccatca

SEQ ID NO: 137620 - DNA, 22 bp, Homo sapiens
cagaagtttgagatcagcctgg

SEQ ID NO: 137621 - DNA, 13 bp, Homo sapiens
attgagaaggaga

SEQ ID NO: 137622 - DNA, 14 bp, Homo sapiens
attgagaaggagag

SEQ ID NO: 137623 - DNA, 17 bp, Homo sapiens
attgagaaggagagaaa

SEQ ID NO: 137624 - DNA, 16 bp, Homo sapiens
attgagttttcagtgg

SEQ ID NO: 137625 - DNA, 18 bp, Homo sapiens
attgatagagtgttatca

SEQ ID NO: 137626 - DNA, 23 bp, Homo sapiens
attgatcggagcctcctctctca

SEQ ID NO: 137627 - DNA, 22 bp, Homo sapiens
attgattattctgattccactt

SEQ ID NO: 137628 - DNA, 15 bp, Homo sapiens
attgcacgtggcctc

SEQ ID NO: 137629 - DNA, 23 bp, Homo sapiens
attgcacgtggcctcttgagcag

SEQ ID NO: 137630 - DNA, 16 bp, Homo sapiens
attgcatttcctgaca

SEQ ID NO: 137631 - DNA, 14 bp, Homo sapiens
attgccaagggctt

SEQ ID NO: 137632 - DNA, 19 bp, Homo sapiens
attgcgccattgcactcca

SEQ ID NO: 137633 - DNA, 21 bp, Homo sapiens
attgctaatcaccaaaggctc

SEQ ID NO: 137634 - DNA, 15 bp, Homo sapiens
attgctgtgtatctg

SEQ ID NO: 137635 - DNA, 13 bp, Homo sapiens
attgcttacattt

SEQ ID NO: 137636 - DNA, 20 bp, Homo sapiens
attgcttacatttttacaat

SEQ ID NO: 137637 - DNA, 22 bp, Homo sapiens
attgcttcttctcctatgtgta

SEQ ID NO: 137638 - DNA, 14 bp, Homo sapiens
attgcttgagctca

SEQ ID NO: 137639 - DNA, 18 bp, Homo sapiens
attgcttgagctcaggag

SEQ ID NO: 137640 - DNA, 15 bp, Homo sapiens
attggacccttccat

SEQ ID NO: 137641 - DNA, 23 bp, Homo sapiens
attggctttaaacacccttcaca

SEQ ID NO: 137642 - DNA, 17 bp, Homo sapiens
attgtaaaactgaggca

SEQ ID NO: 137643 - DNA, 22 bp, Homo sapiens
attgtaaaatagcttgtatagt

SEQ ID NO: 137644 - DNA, 14 bp, Homo sapiens
attgtaaaatggtg

SEQ ID NO: 137645 - DNA, 21 bp, Homo sapiens
attgtaataatgctaaagaaa

SEQ ID NO: 137646 - DNA, 14 bp, Homo sapiens
attgtacagctgtt

SEQ ID NO: 137647 - DNA, 17 bp, Homo sapiens
attgtataaactatcag

SEQ ID NO: 137648 - DNA, 21 bp, Homo sapiens
attgtataaactatcagtttg

SEQ ID NO: 137649 - DNA, 21 bp, Homo sapiens
attgtataagattagaatgaa

SEQ ID NO: 137650 - DNA, 14 bp, Homo sapiens
attgtcagatattt

SEQ ID NO: 137651 - DNA, 23 bp, Homo sapiens
attgtcagatattttttcagaaa

SEQ ID NO: 137652 - DNA, 23 bp, Homo sapiens
attgtcattcctgtattcacccg

SEQ ID NO: 137653 - DNA, 16 bp, Homo sapiens
attgtgagccaccacg

SEQ ID NO: 137654 - DNA, 19 bp, Homo sapiens
attgtgcacatacttgaga

SEQ ID NO: 137655 - DNA, 23 bp, Homo sapiens
attgtgtaacaattttaatgcta

SEQ ID NO: 137656 - DNA, 18 bp, Homo sapiens
attgtgtgttatttaaat

SEQ ID NO: 137657 - DNA, 17 bp, Homo sapiens
attgttaatttttccta

SEQ ID NO: 137658 - DNA, 14 bp, Homo sapiens
attgtttattcttt

SEQ ID NO: 137659 - DNA, 13 bp, Homo sapiens
attgtttcaattg

SEQ ID NO: 137660 - DNA, 13 bp, Homo sapiens
attgttttatcat

SEQ ID NO: 137661 - DNA, 14 bp, Homo sapiens
atttaaaaaaaatc

SEQ ID NO: 137662 - DNA, 13 bp, Homo sapiens
atttaaaatgatt

SEQ ID NO: 137663 - DNA, 14 bp, Homo sapiens
atttaaaatgatta

SEQ ID NO: 137664 - DNA, 16 bp, Homo sapiens
atttaaaatgattaga

SEQ ID NO: 137665 - DNA, 15 bp, Homo sapiens
atttaaacagcagtg

SEQ ID NO: 137666 - DNA, 20 bp, Homo sapiens
atttaaacagcagtgttccc

SEQ ID NO: 137667 - DNA, 21 bp, Homo sapiens
atttaaatacagtcttccatt

SEQ ID NO: 137668 - DNA, 13 bp, Homo sapiens
atttaactgcctt

SEQ ID NO: 137669 - DNA, 15 bp, Homo sapiens
atttaagataattat

SEQ ID NO: 137670 - DNA, 17 bp, Homo sapiens
atttaagcctcatattt

SEQ ID NO: 137671 - DNA, 18 bp, Homo sapiens
atttaagcttatgtcaga

SEQ ID NO: 137672 - DNA, 15 bp, Homo sapiens
atttaataatctgta

SEQ ID NO: 137673 - DNA, 22 bp, Homo sapiens
atttaatgataagtaaatgcta

SEQ ID NO: 137674 - DNA, 14 bp, Homo sapiens
atttacaaagtgtg

SEQ ID NO: 137675 - DNA, 15 bp, Homo sapiens
atttacaaagtgtgt

SEQ ID NO: 137676 - DNA, 20 bp, Homo sapiens
atttacaaagtgtgtattaa

SEQ ID NO: 137677 - DNA, 20 bp, Homo sapiens
atttactgagcttctctgtg

SEQ ID NO: 137678 - DNA, 14 bp, Homo sapiens
atttacttcttata

SEQ ID NO: 137679 - DNA, 14 bp, Homo sapiens
atttagaactgtat

SEQ ID NO: 137680 - DNA, 18 bp, Homo sapiens
atttagattgttaaaata

SEQ ID NO: 137681 - DNA, 17 bp, Homo sapiens
acaagattcccagagac

SEQ ID NO: 137682 - DNA, 18 bp, Homo sapiens
acaagattcccagagaca

SEQ ID NO: 137683 - DNA, 21 bp, Homo sapiens
acaagattcccagagacagga

SEQ ID NO: 137684 - DNA, 23 bp, Homo sapiens
acaaggcattcaagtgtacagtg

SEQ ID NO: 137685 - DNA, 21 bp, Homo sapiens
acaagtatgaataaagacacc

SEQ ID NO: 137686 - DNA, 23 bp, Homo sapiens
acaagtatgaataaagacaccta

SEQ ID NO: 137687 - DNA, 17 bp, Homo sapiens
acaagtcctgtgaattt

SEQ ID NO: 137688 - DNA, 14 bp, Homo sapiens
acaataaagagatt

SEQ ID NO: 137689 - DNA, 15 bp, Homo sapiens
acaataaatgtgctt

SEQ ID NO: 137690 - DNA, 13 bp, Homo sapiens
acaataatttcag

SEQ ID NO: 137691 - DNA, 16 bp, Homo sapiens
acaatacatgctgcta

SEQ ID NO: 137692 - DNA, 19 bp, Homo sapiens
acaatcagccacattctag

SEQ ID NO: 137693 - DNA, 19 bp, Homo sapiens
acaatcatgaaatatgcat

SEQ ID NO: 137694 - DNA, 17 bp, Homo sapiens
acaatgtgaaaagaaaa

SEQ ID NO: 137695 - DNA, 21 bp, Homo sapiens
acaatgttcatcccatgatgt

SEQ ID NO: 137696 - DNA, 15 bp, Homo sapiens
acaattccctgctgt

SEQ ID NO: 137697 - DNA, 13 bp, Homo sapiens
acaatttacaaag

SEQ ID NO: 137698 - DNA, 18 bp, Homo sapiens
acacaactatttttccaa

SEQ ID NO: 137699 - DNA, 21 bp, Homo sapiens
acacacatataaacatcacac

SEQ ID NO: 137700 - DNA, 15 bp, Homo sapiens
acacactgaggcagg

SEQ ID NO: 137701 - DNA, 19 bp, Homo sapiens
acacactttttaagaaata

SEQ ID NO: 137702 - DNA, 14 bp, Homo sapiens
acacagggacttga

SEQ ID NO: 137703 - DNA, 23 bp, Homo sapiens
acacagtctcacccagactccag

SEQ ID NO: 137704 - DNA, 14 bp, Homo sapiens
acacatataaacat

SEQ ID NO: 137705 - DNA, 15 bp, Homo sapiens
acacatcagcttgcc

SEQ ID NO: 137706 - DNA, 17 bp, Homo sapiens
acacatccctaatgtgt

SEQ ID NO: 137707 - DNA, 12 bp, Homo sapiens
acacatctcctc

SEQ ID NO: 137708 - DNA, 18 bp, Homo sapiens
acacatgatcctgcaatt

SEQ ID NO: 137709 - DNA, 16 bp, Homo sapiens
acacattcaataagca

SEQ ID NO: 137710 - DNA, 13 bp, Homo sapiens
acaccacacccag

SEQ ID NO: 137711 - DNA, 18 bp, Homo sapiens
acaccacacccagcctca

SEQ ID NO: 137712 - DNA, 19 bp, Homo sapiens
acaccagcctcgtcttcat

SEQ ID NO: 137713 - DNA, 17 bp, Homo sapiens
acacccactcagctccg

SEQ ID NO: 137714 - DNA, 13 bp, Homo sapiens
acacccatgtttc

SEQ ID NO: 137715 - DNA, 16 bp, Homo sapiens
acacccctcccctgcc

SEQ ID NO: 137716 - DNA, 14 bp, Homo sapiens
acaccgggcctgga

SEQ ID NO: 137717 - DNA, 15 bp, Homo sapiens
acacctagcatctca

SEQ ID NO: 137718 - DNA, 19 bp, Homo sapiens
acacctctgcacaagctgc

SEQ ID NO: 137719 - DNA, 14 bp, Homo sapiens
acacctgcacctcc

SEQ ID NO: 137720 - DNA, 16 bp, Homo sapiens
acacctgtagtcccag

SEQ ID NO: 137721 - DNA, 22 bp, Homo sapiens
acacgaggtatgaggtctagga

SEQ ID NO: 137722 - DNA, 19 bp, Homo sapiens
acacgccttgttcttggcc

SEQ ID NO: 137723 - DNA, 15 bp, Homo sapiens
acacggacactcaaa

SEQ ID NO: 137724 - DNA, 17 bp, Homo sapiens
acacggatctgagaatc

SEQ ID NO: 137725 - DNA, 19 bp, Homo sapiens
acacggatctgagaatctt

SEQ ID NO: 137726 - DNA, 12 bp, Homo sapiens
acactaattcct

SEQ ID NO: 137727 - DNA, 18 bp, Homo sapiens
acactatggtatttgagt

SEQ ID NO: 137728 - DNA, 22 bp, Homo sapiens
acactatggtatttgagtgttt

SEQ ID NO: 137729 - DNA, 15 bp, Homo sapiens
acactcaaaagctgg

SEQ ID NO: 137730 - DNA, 19 bp, Homo sapiens
acactcaaatcaagaaact

SEQ ID NO: 137731 - DNA, 13 bp, Homo sapiens
acactccagtgcc

SEQ ID NO: 137732 - DNA, 19 bp, Homo sapiens
acactccagtgccagcaat

SEQ ID NO: 137733 - DNA, 21 bp, Homo sapiens
acactccagtgccagcaatga

SEQ ID NO: 137734 - DNA, 14 bp, Homo sapiens
acactccatcagct

SEQ ID NO: 137735 - DNA, 22 bp, Homo sapiens
acacttcaggctcttctccttt

SEQ ID NO: 137736 - DNA, 19 bp, Homo sapiens
acacttccaccagcctgca

SEQ ID NO: 137737 - DNA, 22 bp, Homo sapiens
acacttcttcttggtcttattt

SEQ ID NO: 137738 - DNA, 12 bp, Homo sapiens
acactttacaat

SEQ ID NO: 137739 - DNA, 13 bp, Homo sapiens
acactttacaatg

SEQ ID NO: 137740 - DNA, 17 bp, Homo sapiens
acactttgcactgatat

SEQ ID NO: 137741 - DNA, 19 bp, Homo sapiens
acactttgcactgatatat

SEQ ID NO: 137742 - DNA, 22 bp, Homo sapiens
acactttgcactgatatatcat

SEQ ID NO: 137743 - DNA, 19 bp, Homo sapiens
acactttgccatattttca

SEQ ID NO: 137744 - DNA, 20 bp, Homo sapiens
acagaaaacggttaaaactg

SEQ ID NO: 137745 - DNA, 21 bp, Homo sapiens
acagaagcctcactgcaagca

SEQ ID NO: 137746 - DNA, 17 bp, Homo sapiens
acagacattctgccagg

SEQ ID NO: 137747 - DNA, 15 bp, Homo sapiens
acagacgtccctcca

SEQ ID NO: 137748 - DNA, 14 bp, Homo sapiens
acagagaacctgga

SEQ ID NO: 137749 - DNA, 16 bp, Homo sapiens
acagagaaggcaggaa

SEQ ID NO: 137750 - DNA, 21 bp, Homo sapiens
acagagacacctgcacctccc

SEQ ID NO: 137751 - DNA, 21 bp, Homo sapiens
acagagagggggccacctccc

SEQ ID NO: 137752 - DNA, 14 bp, Homo sapiens
acagagcttccctg

SEQ ID NO: 137753 - DNA, 16 bp, Homo sapiens
acagagggaagaaaag

SEQ ID NO: 137754 - DNA, 19 bp, Homo sapiens
acagagtgatagccttccg

SEQ ID NO: 137755 - DNA, 16 bp, Homo sapiens
acagatgggcaaatta

SEQ ID NO: 137756 - DNA, 23 bp, Homo sapiens
acagatgtttcttttgtatgtaa

SEQ ID NO: 137757 - DNA, 24 bp, Homo sapiens
acagatgtttcttttgtatgtaaa

SEQ ID NO: 137758 - DNA, 14 bp, Homo sapiens
acagcagctcaggc

SEQ ID NO: 137759 - DNA, 16 bp, Homo sapiens
acagcagctcaggcac

SEQ ID NO: 137760 - DNA, 17 bp, Homo sapiens
acagcagctcaggcaca

SEQ ID NO: 137761 - DNA, 16 bp, Homo sapiens
acagcagtgtcatcag

SEQ ID NO: 137762 - DNA, 13 bp, Homo sapiens
acagcagtgttcc

SEQ ID NO: 137763 - DNA, 14 bp, Homo sapiens
attttcagaaaata

SEQ ID NO: 137764 - DNA, 21 bp, Homo sapiens
attttcctaataaagttctgt

SEQ ID NO: 137765 - DNA, 16 bp, Homo sapiens
attttcctgccaggca

SEQ ID NO: 137766 - DNA, 19 bp, Homo sapiens
attttctagactttctgtt

SEQ ID NO: 137767 - DNA, 15 bp, Homo sapiens
attttctttgaaatt

SEQ ID NO: 137768 - DNA, 19 bp, Homo sapiens
attttcttttgtaaatgtt

SEQ ID NO: 137769 - DNA, 20 bp, Homo sapiens
attttgaaatcatgaagata

SEQ ID NO: 137770 - DNA, 14 bp, Homo sapiens
attttgatgaacaa

SEQ ID NO: 137771 - DNA, 18 bp, Homo sapiens
attttgccagtgggaact

SEQ ID NO: 137772 - DNA, 18 bp, Homo sapiens
attttgcctcttttctct

SEQ ID NO: 137773 - DNA, 14 bp, Homo sapiens
attttggaaaataa

SEQ ID NO: 137774 - DNA, 22 bp, Homo sapiens
attttggtaaaatacttcttga

SEQ ID NO: 137775 - DNA, 21 bp, Homo sapiens
attttgtatctgcaggcagac

SEQ ID NO: 137776 - DNA, 20 bp, Homo sapiens
attttgtggctttctttctt

SEQ ID NO: 137777 - DNA, 21 bp, Homo sapiens
attttgtttttgtcttaaaaa

SEQ ID NO: 137778 - DNA, 19 bp, Homo sapiens
atttttaaatgtaaaacat

SEQ ID NO: 137779 - DNA, 13 bp, Homo sapiens
atttttacaataa

SEQ ID NO: 137780 - DNA, 14 bp, Homo sapiens
atttttacaataaa

SEQ ID NO: 137781 - DNA, 19 bp, Homo sapiens
atttttacaataaataatc

SEQ ID NO: 137782 - DNA, 16 bp, Homo sapiens
atttttacattctgaa

SEQ ID NO: 137783 - DNA, 16 bp, Homo sapiens
atttttattaaattat

SEQ ID NO: 137784 - DNA, 16 bp, Homo sapiens
atttttatttttctaa

SEQ ID NO: 137785 - DNA, 19 bp, Homo sapiens
atttttcttatttcatttc

SEQ ID NO: 137786 - DNA, 23 bp, Homo sapiens
atttttgatttatgcatggaaac

SEQ ID NO: 137787 - DNA, 16 bp, Homo sapiens
attttttaagtattta

SEQ ID NO: 137788 - DNA, 18 bp, Homo sapiens
attttttaagtatttata

SEQ ID NO: 137789 - DNA, 15 bp, Homo sapiens
atttttttaaccaaa

SEQ ID NO: 137790 - DNA, 17 bp, Homo sapiens
atttttttgcaagtgaa

SEQ ID NO: 137791 - DNA, 20 bp, Homo sapiens
atttttttgcaagtgaaggt

SEQ ID NO: 137792 - DNA, 20 bp, Homo sapiens
caaaaaaaaaaaaaaattag

SEQ ID NO: 137793 - DNA, 18 bp, Homo sapiens
caaaaaaatatatttaat

SEQ ID NO: 137794 - DNA, 17 bp, Homo sapiens
caaaaacacagcaaggg

SEQ ID NO: 137795 - DNA, 13 bp, Homo sapiens
caaaaacagcctc

SEQ ID NO: 137796 - DNA, 14 bp, Homo sapiens
caaaaagaacaaaa

SEQ ID NO: 137797 - DNA, 19 bp, Homo sapiens
caaaaagaacaaaaaaatc

SEQ ID NO: 137798 - DNA, 15 bp, Homo sapiens
caaaaagcaaaatca

SEQ ID NO: 137799 - DNA, 20 bp, Homo sapiens
caaaaagggaaactattgtc

SEQ ID NO: 137800 - DNA, 19 bp, Homo sapiens
caaaacagagatgtgataa

SEQ ID NO: 137801 - DNA, 21 bp, Homo sapiens
caaaacggttttactgcagct

SEQ ID NO: 137802 - DNA, 14 bp, Homo sapiens
caaaactgcactgt

SEQ ID NO: 137803 - DNA, 15 bp, Homo sapiens
caaaagaatcagaaa

SEQ ID NO: 137804 - DNA, 19 bp, Homo sapiens
caaaagaatcagaaacagg

SEQ ID NO: 137805 - DNA, 15 bp, Homo sapiens
caaaagctgggcagg

SEQ ID NO: 137806 - DNA, 19 bp, Homo sapiens
caaaagctgggcaggttgg

SEQ ID NO: 137807 - DNA, 18 bp, Homo sapiens
caaaaggtgcctgtgagg

SEQ ID NO: 137808 - DNA, 22 bp, Homo sapiens
caaaaggtgcctgtgaggcagg

SEQ ID NO: 137809 - DNA, 18 bp, Homo sapiens
caaaagtttcatcctttt

SEQ ID NO: 137810 - DNA, 19 bp, Homo sapiens
caaaatatgttgatgaaaa

SEQ ID NO: 137811 - DNA, 18 bp, Homo sapiens
caaaatcgattggcttta

SEQ ID NO: 137812 - DNA, 19 bp, Homo sapiens
caaaatgaggaatgtatat

SEQ ID NO: 137813 - DNA, 15 bp, Homo sapiens
caaaattatttcaga

SEQ ID NO: 137814 - DNA, 11 bp, Homo sapiens
caaaattccca

SEQ ID NO: 137815 - DNA, 13 bp, Homo sapiens
caaaattcccagg

SEQ ID NO: 137816 - DNA, 22 bp, Homo sapiens
caaaattgatgtgtttatttat

SEQ ID NO: 137817 - DNA, 13 bp, Homo sapiens
caaaattttattc

SEQ ID NO: 137818 - DNA, 14 bp, Homo sapiens
caaaattttattcc

SEQ ID NO: 137819 - DNA, 18 bp, Homo sapiens
caaaattttattcctata

SEQ ID NO: 137820 - DNA, 13 bp, Homo sapiens
caaacaaagccag

SEQ ID NO: 137821 - DNA, 14 bp, Homo sapiens
caaacaaagccaga

SEQ ID NO: 137822 - DNA, 16 bp, Homo sapiens
caaacaaagccagaag

SEQ ID NO: 137823 - DNA, 17 bp, Homo sapiens
caaacagtctcaggaaa

SEQ ID NO: 137824 - DNA, 21 bp, Homo sapiens
caaacatgaagtgtgtttcct

SEQ ID NO: 137825 - DNA, 14 bp, Homo sapiens
caaaccaaataaaa

SEQ ID NO: 137826 - DNA, 19 bp, Homo sapiens
caaacctgcaagggctccc

SEQ ID NO: 137827 - DNA, 21 bp, Homo sapiens
caaacctgcaagggctcccca

SEQ ID NO: 137828 - DNA, 14 bp, Homo sapiens
caaacgctgcctgc

SEQ ID NO: 137829 - DNA, 17 bp, Homo sapiens
caaacgctgcctgccca

SEQ ID NO: 137830 - DNA, 13 bp, Homo sapiens
caaactagggcca

SEQ ID NO: 137831 - DNA, 19 bp, Homo sapiens
caaactagggccaagccca

SEQ ID NO: 137832 - DNA, 13 bp, Homo sapiens
caaagaaacccaa

SEQ ID NO: 137833 - DNA, 14 bp, Homo sapiens
caaagaaatgtaag

SEQ ID NO: 137834 - DNA, 16 bp, Homo sapiens
caaagatgtttgtcag

SEQ ID NO: 137835 - DNA, 13 bp, Homo sapiens
caaagcaaggaaa

SEQ ID NO: 137836 - DNA, 20 bp, Homo sapiens
caaagcacgaaatgttattt

SEQ ID NO: 137837 - DNA, 22 bp, Homo sapiens
caaagcacgaaatgttattttt

SEQ ID NO: 137838 - DNA, 21 bp, Homo sapiens
caaagcaggggagtatgcaaa

SEQ ID NO: 137839 - DNA, 22 bp, Homo sapiens
caaagccaacagtcaaaacaga

SEQ ID NO: 137840 - DNA, 13 bp, Homo sapiens
caaagccagaagc

SEQ ID NO: 137841 - DNA, 16 bp, Homo sapiens
caaagccagaagctga

SEQ ID NO: 137842 - DNA, 23 bp, Homo sapiens
caaagccagcgtcctcctctgtg

SEQ ID NO: 137843 - DNA, 18 bp, Homo sapiens
caaagcctcctccagccg

SEQ ID NO: 137844 - DNA, 21 bp, Homo sapiens
caaagcttggaagagcctgca

SEQ ID NO: 137845 - DNA, 18 bp, Homo sapiens
caaagctttcctgcccca

SEQ ID NO: 137846 - DNA, 22 bp, Homo sapiens
caaagctttcctgccccaggcc

SEQ ID NO: 137847 - DNA, 19 bp, Homo sapiens
caaaggaatctccagtttt

SEQ ID NO: 137848 - DNA, 22 bp, Homo sapiens
caaaggaatctccagttttcag

SEQ ID NO: 137849 - DNA, 15 bp, Homo sapiens
caaaggactccaccc

SEQ ID NO: 137850 - DNA, 20 bp, Homo sapiens
caaaggagggtcaggaagga

SEQ ID NO: 137851 - DNA, 17 bp, Homo sapiens
caaaggatgtgatatat

SEQ ID NO: 137852 - DNA, 20 bp, Homo sapiens
caaaggcacagtgaaggctg

SEQ ID NO: 137853 - DNA, 18 bp, Homo sapiens
caaagggaaatatcattt

SEQ ID NO: 137854 - DNA, 18 bp, Homo sapiens
caaaggtgaaggaatata

SEQ ID NO: 137855 - DNA, 16 bp, Homo sapiens
caaagtaaaacttgct

SEQ ID NO: 137856 - DNA, 18 bp, Homo sapiens
caaagtaaaacttgctgc

SEQ ID NO: 137857 - DNA, 15 bp, Homo sapiens
caaataaaaatattg

SEQ ID NO: 137858 - DNA, 14 bp, Homo sapiens
caaataataagcaa

SEQ ID NO: 137859 - DNA, 15 bp, Homo sapiens
caaatagcataagtt

SEQ ID NO: 137860 - DNA, 20 bp, Homo sapiens
caaatagtttataaatgtga

SEQ ID NO: 137861 - DNA, 17 bp, Homo sapiens
caaatatgcaaagcact

SEQ ID NO: 137862 - DNA, 21 bp, Homo sapiens
caaatatgcaaagcactgact

SEQ ID NO: 137863 - DNA, 13 bp, Homo sapiens
caaatatgtcctg

SEQ ID NO: 137864 - DNA, 14 bp, Homo sapiens
caaatcaagcttca

SEQ ID NO: 137865 - DNA, 15 bp, Homo sapiens
caaatcaagcttcag

SEQ ID NO: 137866 - DNA, 19 bp, Homo sapiens
caaatgaatgaccttgttg

SEQ ID NO: 137867 - DNA, 18 bp, Homo sapiens
caaatgcttggcttctca

SEQ ID NO: 137868 - DNA, 18 bp, Homo sapiens
caaatgtcatcagaactt

SEQ ID NO: 137869 - DNA, 14 bp, Homo sapiens
caaatgtgacctgt

SEQ ID NO: 137870 - DNA, 14 bp, Homo sapiens
caaatgtggctcct

SEQ ID NO: 137871 - DNA, 15 bp, Homo sapiens
caaattatttgtgta

SEQ ID NO: 137872 - DNA, 11 bp, Homo sapiens
caaatttcaca

SEQ ID NO: 137873 - DNA, 14 bp, Homo sapiens
caacaagagtttat

SEQ ID NO: 137874 - DNA, 19 bp, Homo sapiens
caacaatttctactttgaa

SEQ ID NO: 137875 - DNA, 20 bp, Homo sapiens
caacaatttctactttgaag

SEQ ID NO: 137876 - DNA, 22 bp, Homo sapiens
caacacctctgcacaagctgca

SEQ ID NO: 137877 - DNA, 15 bp, Homo sapiens
caacacgagcaggct

SEQ ID NO: 137878 - DNA, 21 bp, Homo sapiens
caacagcgacatagcccatcc

SEQ ID NO: 137879 - DNA, 11 bp, Homo sapiens
caacagtgagt

SEQ ID NO: 137880 - DNA, 17 bp, Homo sapiens
caacatcccattgccct

SEQ ID NO: 137881 - DNA, 23 bp, Homo sapiens
caacatggagaaaccctgtctct

SEQ ID NO: 137882 - DNA, 16 bp, Homo sapiens
caaccaatgtagaaag

SEQ ID NO: 137883 - DNA, 13 bp, Homo sapiens
caaccctcagagc

SEQ ID NO: 137884 - DNA, 13 bp, Homo sapiens
caacctaaatttg

SEQ ID NO: 137885 - DNA, 21 bp, Homo sapiens
caacctgcctgacatttggag

SEQ ID NO: 137886 - DNA, 16 bp, Homo sapiens
caacctggtcacagga

SEQ ID NO: 137887 - DNA, 17 bp, Homo sapiens
caaccttagatgttcta

SEQ ID NO: 137888 - DNA, 13 bp, Homo sapiens
caacgaggaagcc

SEQ ID NO: 137889 - DNA, 13 bp, Homo sapiens
caacgcagccctg

SEQ ID NO: 137890 - DNA, 15 bp, Homo sapiens
caacgcagccctgct

SEQ ID NO: 137891 - DNA, 21 bp, Homo sapiens
caacggagagcgcctgcccct

SEQ ID NO: 137892 - DNA, 19 bp, Homo sapiens
caactatgatttggaaaat

SEQ ID NO: 137893 - DNA, 15 bp, Homo sapiens
caactatttttccaa

SEQ ID NO: 137894 - DNA, 17 bp, Homo sapiens
caactccagtagcttgg

SEQ ID NO: 137895 - DNA, 14 bp, Homo sapiens
caactcctggaagc

SEQ ID NO: 137896 - DNA, 21 bp, Homo sapiens
caactcctggaagctgtgtcc

SEQ ID NO: 137897 - DNA, 16 bp, Homo sapiens
caactctttgagaaac

SEQ ID NO: 137898 - DNA, 13 bp, Homo sapiens
caactgaaaagac

SEQ ID NO: 137899 - DNA, 14 bp, Homo sapiens
caactgaaaagact

SEQ ID NO: 137900 - DNA, 14 bp, Homo sapiens
caactgaggcagac

SEQ ID NO: 137901 - DNA, 17 bp, Homo sapiens
caactgaggcagacagc

SEQ ID NO: 137902 - DNA, 21 bp, Homo sapiens
caactgaggcagacagcagct

SEQ ID NO: 137903 - DNA, 14 bp, Homo sapiens
caacttactactga

SEQ ID NO: 137904 - DNA, 16 bp, Homo sapiens
caacttcaagtgcatg

SEQ ID NO: 137905 - DNA, 18 bp, Homo sapiens
caacttcagcagtaccta

SEQ ID NO: 137906 - DNA, 14 bp, Homo sapiens
accacacccagcct

SEQ ID NO: 137907 - DNA, 22 bp, Homo sapiens
accacacccagcctcagtcctc

SEQ ID NO: 137908 - DNA, 11 bp, Homo sapiens
accacagcagt

SEQ ID NO: 137909 - DNA, 22 bp, Homo sapiens
accaccccagctgctcccctcc

SEQ ID NO: 137910 - DNA, 13 bp, Homo sapiens
accaccttcccag

SEQ ID NO: 137911 - DNA, 19 bp, Homo sapiens
accaccttcccagctctcc

SEQ ID NO: 137912 - DNA, 20 bp, Homo sapiens
accaccttcccagctctccc

SEQ ID NO: 137913 - DNA, 17 bp, Homo sapiens
accaccttttattacat

SEQ ID NO: 137914 - DNA, 21 bp, Homo sapiens
accacgatgtggccctggcct

SEQ ID NO: 137915 - DNA, 22 bp, Homo sapiens
accacgatgtggccctggcctg

SEQ ID NO: 137916 - DNA, 21 bp, Homo sapiens
accacggacgtttccatcagg

SEQ ID NO: 137917 - DNA, 13 bp, Homo sapiens
accacttcagctg

SEQ ID NO: 137918 - DNA, 16 bp, Homo sapiens
accacttcttttataa

SEQ ID NO: 137919 - DNA, 11 bp, Homo sapiens
accagacaggt

SEQ ID NO: 137920 - DNA, 20 bp, Homo sapiens
accagacggttcaccagcct

SEQ ID NO: 137921 - DNA, 19 bp, Homo sapiens
accagcagatcccagctca

SEQ ID NO: 137922 - DNA, 14 bp, Homo sapiens
accagcagcctgga

SEQ ID NO: 137923 - DNA, 14 bp, Homo sapiens
accagcctccatgc

SEQ ID NO: 137924 - DNA, 19 bp, Homo sapiens
accagcctccatgctgcct

SEQ ID NO: 137925 - DNA, 23 bp, Homo sapiens
accagcctctcttggtttccttc

SEQ ID NO: 137926 - DNA, 16 bp, Homo sapiens
accagcctttctccca

SEQ ID NO: 137927 - DNA, 14 bp, Homo sapiens
accaggacaggacc

SEQ ID NO: 137928 - DNA, 17 bp, Homo sapiens
accaggagtccctggta

SEQ ID NO: 137929 - DNA, 19 bp, Homo sapiens
accaggcaacttgggaact

SEQ ID NO: 137930 - DNA, 23 bp, Homo sapiens
accaggcgagagacttgtggcct

SEQ ID NO: 137931 - DNA, 14 bp, Homo sapiens
accagggactgagg

SEQ ID NO: 137932 - DNA, 18 bp, Homo sapiens
accagtaattgtgaaaat

SEQ ID NO: 137933 - DNA, 20 bp, Homo sapiens
accagtatcgctcatagatc

SEQ ID NO: 137934 - DNA, 12 bp, Homo sapiens
accagtggtctc

SEQ ID NO: 137935 - DNA, 21 bp, Homo sapiens
accagtgtggtttgtgtttga

SEQ ID NO: 137936 - DNA, 22 bp, Homo sapiens
accagtgttagggaagggcctg

SEQ ID NO: 137937 - DNA, 13 bp, Homo sapiens
accataatgttac

SEQ ID NO: 137938 - DNA, 20 bp, Homo sapiens
accatccctttttgaagtgt

SEQ ID NO: 137939 - DNA, 14 bp, Homo sapiens
accatgaagacagg

SEQ ID NO: 137940 - DNA, 24 bp, Homo sapiens
accatgaagagatttttcatgatt

SEQ ID NO: 137941 - DNA, 23 bp, Homo sapiens
accatgagaataagagaaagaaa

SEQ ID NO: 137942 - DNA, 19 bp, Homo sapiens
accatgtcagcaaaaagca

SEQ ID NO: 137943 - DNA, 22 bp, Homo sapiens
accatgtcagcaaaaagcaaaa

SEQ ID NO: 137944 - DNA, 19 bp, Homo sapiens
accatgtttgagctcagac

SEQ ID NO: 137945 - DNA, 21 bp, Homo sapiens
accatgtttgagctcagaccc

SEQ ID NO: 137946 - DNA, 15 bp, Homo sapiens
acccaaaaggcagaa

SEQ ID NO: 137947 - DNA, 23 bp, Homo sapiens
acccaaaagtcaaaaggtgcctg

SEQ ID NO: 137948 - DNA, 16 bp, Homo sapiens
acccaaatgttcatca

SEQ ID NO: 137949 - DNA, 21 bp, Homo sapiens
acccaaatgttcatcaatgaa

SEQ ID NO: 137950 - DNA, 16 bp, Homo sapiens
acccaagtccaagcat

SEQ ID NO: 137951 - DNA, 18 bp, Homo sapiens
acccacaggcccacagta

SEQ ID NO: 137952 - DNA, 13 bp, Homo sapiens
acccactcagctc

SEQ ID NO: 137953 - DNA, 22 bp, Homo sapiens
acccagaggaaggggccagagg

SEQ ID NO: 137954 - DNA, 11 bp, Homo sapiens
acccagcccat

SEQ ID NO: 137955 - DNA, 16 bp, Homo sapiens
acccagccccttgaga

SEQ ID NO: 137956 - DNA, 12 bp, Homo sapiens
acccagcctcag

SEQ ID NO: 137957 - DNA, 17 bp, Homo sapiens
acccagcctcagtcctc

SEQ ID NO: 137958 - DNA, 13 bp, Homo sapiens
acccagtccctgg

SEQ ID NO: 137959 - DNA, 16 bp, Homo sapiens
acccagtctgttcccc

SEQ ID NO: 137960 - DNA, 14 bp, Homo sapiens
acccagtgagcact

SEQ ID NO: 137961 - DNA, 18 bp, Homo sapiens
acccatcacgcctgtgca

SEQ ID NO: 137962 - DNA, 14 bp, Homo sapiens
acccatcagaagga

SEQ ID NO: 137963 - DNA, 21 bp, Homo sapiens
acccatctgcacccccctggg

SEQ ID NO: 137964 - DNA, 22 bp, Homo sapiens
acccatctgcacccccctgggc

SEQ ID NO: 137965 - DNA, 13 bp, Homo sapiens
acccattcctatt

SEQ ID NO: 137966 - DNA, 17 bp, Homo sapiens
accccaaagctttcctg

SEQ ID NO: 137967 - DNA, 18 bp, Homo sapiens
accccagctgtgagcctt

SEQ ID NO: 137968 - DNA, 19 bp, Homo sapiens
accccagctgtgagccttg

SEQ ID NO: 137969 - DNA, 21 bp, Homo sapiens
accccagctgtgagccttggc

SEQ ID NO: 137970 - DNA, 10 bp, Homo sapiens
accccagggc

SEQ ID NO: 137971 - DNA, 11 bp, Homo sapiens
accccagggcc

SEQ ID NO: 137972 - DNA, 15 bp, Homo sapiens
accccagggcctgag

SEQ ID NO: 137973 - DNA, 17 bp, Homo sapiens
accccagggcctgagcc

SEQ ID NO: 137974 - DNA, 17 bp, Homo sapiens
acccccatctctccctc

SEQ ID NO: 137975 - DNA, 20 bp, Homo sapiens
accccccagaacctgtcctt

SEQ ID NO: 137976 - DNA, 12 bp, Homo sapiens
accccctcccca

SEQ ID NO: 137977 - DNA, 13 bp, Homo sapiens
accccctccccag

SEQ ID NO: 137978 - DNA, 16 bp, Homo sapiens
acccccttcagtgccc

SEQ ID NO: 137979 - DNA, 19 bp, Homo sapiens
acccccttctccatccaca

SEQ ID NO: 137980 - DNA, 20 bp, Homo sapiens
accccgtcgaggggctctca

SEQ ID NO: 137981 - DNA, 20 bp, Homo sapiens
acccctcaacacctctgcac

SEQ ID NO: 137982 - DNA, 17 bp, Homo sapiens
acccctcactctggcct

SEQ ID NO: 137983 - DNA, 14 bp, Homo sapiens
acccctcctcactg

SEQ ID NO: 137984 - DNA, 18 bp, Homo sapiens
acccctcctcactggcca

SEQ ID NO: 137985 - DNA, 23 bp, Homo sapiens
acccctcctcactggccatccct

SEQ ID NO: 137986 - DNA, 16 bp, Homo sapiens
acccctccttccttga

SEQ ID NO: 137987 - DNA, 20 bp, Homo sapiens
acccctccttccttgaccag

SEQ ID NO: 137988 - DNA, 12 bp, Homo sapiens
acccctggcttt

SEQ ID NO: 137989 - DNA, 15 bp, Homo sapiens
acccctggcttttca

SEQ ID NO: 137990 - DNA, 18 bp, Homo sapiens
acccctggcttttcactg

SEQ ID NO: 137991 - DNA, 21 bp, Homo sapiens
acccctggcttttcactgctg

SEQ ID NO: 137992 - DNA, 16 bp, Homo sapiens
acccctgtcctcactg

SEQ ID NO: 137993 - DNA, 18 bp, Homo sapiens
acccgctcatcactggat

SEQ ID NO: 137994 - DNA, 18 bp, Homo sapiens
acccggaggggcctggca

SEQ ID NO: 137995 - DNA, 15 bp, Homo sapiens
accctaccccaccac

SEQ ID NO: 137996 - DNA, 14 bp, Homo sapiens
accctattgctgct

SEQ ID NO: 137997 - DNA, 14 bp, Homo sapiens
accctcaggcaggt

SEQ ID NO: 137998 - DNA, 19 bp, Homo sapiens
accctcctccagaccattc

SEQ ID NO: 137999 - DNA, 21 bp, Homo sapiens
accctcgaagcgcgccactcg

SEQ ID NO: 138000 - DNA, 13 bp, Homo sapiens
accctctgccacc

SEQ ID NO: 138001 - DNA, 20 bp, Homo sapiens
accctctgccaccagagacc

SEQ ID NO: 138002 - DNA, 16 bp, Homo sapiens
accctgaaagccctga

SEQ ID NO: 138003 - DNA, 23 bp, Homo sapiens
accctgagctgaggcagcagtgt

SEQ ID NO: 138004 - DNA, 18 bp, Homo sapiens
accctgccttatcttgca

SEQ ID NO: 138005 - DNA, 20 bp, Homo sapiens
accctggaccagtggtctca

SEQ ID NO: 138006 - DNA, 21 bp, Homo sapiens
accctgtctctactaaaaata

SEQ ID NO: 138007 - DNA, 19 bp, Homo sapiens
acccttacagcctctgact

SEQ ID NO: 138008 - DNA, 21 bp, Homo sapiens
acccttcacataccctccccc

SEQ ID NO: 138009 - DNA, 15 bp, Homo sapiens
accctttccttcctt

SEQ ID NO: 138010 - DNA, 19 bp, Homo sapiens
accctttccttccttccct

SEQ ID NO: 138011 - DNA, 23 bp, Homo sapiens
accctttgctgtgaggctgtcct

SEQ ID NO: 138012 - DNA, 17 bp, Homo sapiens
accgacgcgtctcctgt

SEQ ID NO: 138013 - DNA, 23 bp, Homo sapiens
cagaaattagaaaccttaatatg

SEQ ID NO: 138014 - DNA, 19 bp, Homo sapiens
cagaaatttttatttttct

SEQ ID NO: 138015 - DNA, 12 bp, Homo sapiens
cagaacagcaga

SEQ ID NO: 138016 - DNA, 21 bp, Homo sapiens
cagaacagcagaggttctttt

SEQ ID NO: 138017 - DNA, 20 bp, Homo sapiens
cagaacagccgctcctgtct

SEQ ID NO: 138018 - DNA, 12 bp, Homo sapiens
cagaacagtgat

SEQ ID NO: 138019 - DNA, 15 bp, Homo sapiens
cagaactctttcaaa

SEQ ID NO: 138020 - DNA, 16 bp, Homo sapiens
cagaactctttcaaaa

SEQ ID NO: 138021 - DNA, 19 bp, Homo sapiens
cagaagaattgaacccagg

SEQ ID NO: 138022 - DNA, 21 bp, Homo sapiens
cagaagaattgaacccaggag

SEQ ID NO: 138023 - DNA, 20 bp, Homo sapiens
cagaagcaacccaaatgttc

SEQ ID NO: 138024 - DNA, 14 bp, Homo sapiens
cagaagcaggatag

SEQ ID NO: 138025 - DNA, 23 bp, Homo sapiens
cagaagcagttgagtcgtcatca

SEQ ID NO: 138026 - DNA, 19 bp, Homo sapiens
cagaaggaaaaatgtgtaa

SEQ ID NO: 138027 - DNA, 20 bp, Homo sapiens
cagaaggagaaggaaggaga

SEQ ID NO: 138028 - DNA, 15 bp, Homo sapiens
cagaagtttctcagc

SEQ ID NO: 138029 - DNA, 20 bp, Homo sapiens
cagaagtttgagatcagcct

SEQ ID NO: 138030 - DNA, 23 bp, Homo sapiens
cagaagtttgagatcagcctggg

SEQ ID NO: 138031 - DNA, 16 bp, Homo sapiens
cagaagtttggcaata

SEQ ID NO: 138032 - DNA, 22 bp, Homo sapiens
cagaataaagttctgagtgttt

SEQ ID NO: 138033 - DNA, 13 bp, Homo sapiens
cagaatattgctt

SEQ ID NO: 138034 - DNA, 18 bp, Homo sapiens
cagaatctacccaaagga

SEQ ID NO: 138035 - DNA, 19 bp, Homo sapiens
cagacaaaaacagcctcac

SEQ ID NO: 138036 - DNA, 22 bp, Homo sapiens
cagacaaaaacagcctcacaga

SEQ ID NO: 138037 - DNA, 16 bp, Homo sapiens
cagacaaggtagccct

SEQ ID NO: 138038 - DNA, 14 bp, Homo sapiens
cagacacagaagag

SEQ ID NO: 138039 - DNA, 20 bp, Homo sapiens
cagacacagggacttgaagt

SEQ ID NO: 138040 - DNA, 14 bp, Homo sapiens
cagacagacacaca

SEQ ID NO: 138041 - DNA, 14 bp, Homo sapiens
cagacagaggatga

SEQ ID NO: 138042 - DNA, 17 bp, Homo sapiens
cagacagcagctcaggc

SEQ ID NO: 138043 - DNA, 15 bp, Homo sapiens
cagacaggaaaggga

SEQ ID NO: 138044 - DNA, 19 bp, Homo sapiens
cagacatccatgtttgtaa

SEQ ID NO: 138045 - DNA, 21 bp, Homo sapiens
cagacattctgccaggccccc

SEQ ID NO: 138046 - DNA, 13 bp, Homo sapiens
cagacccccactc

SEQ ID NO: 138047 - DNA, 16 bp, Homo sapiens
catctccacctgctcc

SEQ ID NO: 138048 - DNA, 14 bp, Homo sapiens
catctccactccag

SEQ ID NO: 138049 - DNA, 18 bp, Homo sapiens
catctcccagataatgtg

SEQ ID NO: 138050 - DNA, 19 bp, Homo sapiens
catctcctgccttcctcct

SEQ ID NO: 138051 - DNA, 22 bp, Homo sapiens
catctcctgccttcctcctggg

SEQ ID NO: 138052 - DNA, 22 bp, Homo sapiens
catctcgccacccctccttcct

SEQ ID NO: 138053 - DNA, 23 bp, Homo sapiens
catctctccctcccctgccattt

SEQ ID NO: 138054 - DNA, 14 bp, Homo sapiens
catctgaaagccac

SEQ ID NO: 138055 - DNA, 16 bp, Homo sapiens
catctgaaagccacgt

SEQ ID NO: 138056 - DNA, 15 bp, Homo sapiens
catctgaagagcaga

SEQ ID NO: 138057 - DNA, 19 bp, Homo sapiens
catctgcacccccctgggc

SEQ ID NO: 138058 - DNA, 19 bp, Homo sapiens
catctgcattttcacccca

SEQ ID NO: 138059 - DNA, 21 bp, Homo sapiens
catctgtataagtaagaaaat

SEQ ID NO: 138060 - DNA, 19 bp, Homo sapiens
catctgtataccctctgtt

SEQ ID NO: 138061 - DNA, 21 bp, Homo sapiens
catctgtataccctctgtttc

SEQ ID NO: 138062 - DNA, 20 bp, Homo sapiens
catctgtcaccaattggtta

SEQ ID NO: 138063 - DNA, 16 bp, Homo sapiens
catctgtccctccggg

SEQ ID NO: 138064 - DNA, 17 bp, Homo sapiens
catctgtgggcacgctg

SEQ ID NO: 138065 - DNA, 14 bp, Homo sapiens
catctgtgtcttgt

SEQ ID NO: 138066 - DNA, 19 bp, Homo sapiens
catcttagtatttgcatat

SEQ ID NO: 138067 - DNA, 18 bp, Homo sapiens
catgaagagatttttcat

SEQ ID NO: 138068 - DNA, 17 bp, Homo sapiens
catgaagatatttttcc

SEQ ID NO: 138069 - DNA, 19 bp, Homo sapiens
catgaagatgtagaggaga

SEQ ID NO: 138070 - DNA, 18 bp, Homo sapiens
catgaagattctttccca

SEQ ID NO: 138071 - DNA, 20 bp, Homo sapiens
catgaagtgtgtttccttca

SEQ ID NO: 138072 - DNA, 16 bp, Homo sapiens
catgaatccagtccag

SEQ ID NO: 138073 - DNA, 22 bp, Homo sapiens
catgacacagctttatcaccag

SEQ ID NO: 138074 - DNA, 14 bp, Homo sapiens
catgagacacatct

SEQ ID NO: 138075 - DNA, 17 bp, Homo sapiens
catgagaccactgttat

SEQ ID NO: 138076 - DNA, 20 bp, Homo sapiens
catgagatctaggtgaggat

SEQ ID NO: 138077 - DNA, 22 bp, Homo sapiens
catgagctatttccattccaga

SEQ ID NO: 138078 - DNA, 23 bp, Homo sapiens
catgagctatttccattccagaa

SEQ ID NO: 138079 - DNA, 15 bp, Homo sapiens
catgaggagttgctg

SEQ ID NO: 138080 - DNA, 15 bp, Homo sapiens
catgatctccctgcc

SEQ ID NO: 138081 - DNA, 19 bp, Homo sapiens
catgcactgttccccctgt

SEQ ID NO: 138082 - DNA, 23 bp, Homo sapiens
catgcactgttccccctgtgcag

SEQ ID NO: 138083 - DNA, 14 bp, Homo sapiens
catgcatcaagtta

SEQ ID NO: 138084 - DNA, 18 bp, Homo sapiens
catgcatctccacctgct

SEQ ID NO: 138085 - DNA, 19 bp, Homo sapiens
catgccccggccacctctg

SEQ ID NO: 138086 - DNA, 20 bp, Homo sapiens
catgccccggccacctctgc

SEQ ID NO: 138087 - DNA, 20 bp, Homo sapiens
catgcctgccccaaacaaat

SEQ ID NO: 138088 - DNA, 19 bp, Homo sapiens
catgccttccagcaccctg

SEQ ID NO: 138089 - DNA, 20 bp, Homo sapiens
catgccttccagcaccctgc

SEQ ID NO: 138090 - DNA, 19 bp, Homo sapiens
catgcgggctgggcagctg

SEQ ID NO: 138091 - DNA, 13 bp, Homo sapiens
catgctctctgca

SEQ ID NO: 138092 - DNA, 16 bp, Homo sapiens
catgctctctgcagcc

SEQ ID NO: 138093 - DNA, 23 bp, Homo sapiens
catgctctctgcagccagcccag

SEQ ID NO: 138094 - DNA, 20 bp, Homo sapiens
catgctgggaagacgcctga

SEQ ID NO: 138095 - DNA, 18 bp, Homo sapiens
catggaaacctgaaaaaa

SEQ ID NO: 138096 - DNA, 17 bp, Homo sapiens
catggaactcattcctg

SEQ ID NO: 138097 - DNA, 21 bp, Homo sapiens
catggaactcattcctgcctg

SEQ ID NO: 138098 - DNA, 19 bp, Homo sapiens
catggacactccagtgcca

SEQ ID NO: 138099 - DNA, 14 bp, Homo sapiens
catggagaaaccct

SEQ ID NO: 138100 - DNA, 19 bp, Homo sapiens
catggaggcacacagctgc

SEQ ID NO: 138101 - DNA, 20 bp, Homo sapiens
catggaggcacacagctgca

SEQ ID NO: 138102 - DNA, 13 bp, Homo sapiens
catggccaggtgg

SEQ ID NO: 138103 - DNA, 14 bp, Homo sapiens
catggccaggtggc

SEQ ID NO: 138104 - DNA, 20 bp, Homo sapiens
catggcctattatattaaaa

SEQ ID NO: 138105 - DNA, 21 bp, Homo sapiens
catggcctattatattaaaat

SEQ ID NO: 138106 - DNA, 17 bp, Homo sapiens
catggcttaatgtttat

SEQ ID NO: 138107 - DNA, 16 bp, Homo sapiens
catggggaagggatat

SEQ ID NO: 138108 - DNA, 19 bp, Homo sapiens
catgggggcagggcatgac

SEQ ID NO: 138109 - DNA, 20 bp, Homo sapiens
catggtggcgcaagcctgta

SEQ ID NO: 138110 - DNA, 18 bp, Homo sapiens
catggtgtgatcgtctga

SEQ ID NO: 138111 - DNA, 22 bp, Homo sapiens
catgtaaacacgcctgcaaacg

SEQ ID NO: 138112 - DNA, 15 bp, Homo sapiens
catgtacatgaagaa

SEQ ID NO: 138113 - DNA, 22 bp, Homo sapiens
catgtactgagccttgtaattc

SEQ ID NO: 138114 - DNA, 15 bp, Homo sapiens
catgtatttatctct

SEQ ID NO: 138115 - DNA, 14 bp, Homo sapiens
catgtcaaacgtga

SEQ ID NO: 138116 - DNA, 19 bp, Homo sapiens
catgtcaaacgtgaaaatg

SEQ ID NO: 138117 - DNA, 17 bp, Homo sapiens
catgtcagcaaaaagca

SEQ ID NO: 138118 - DNA, 22 bp, Homo sapiens
catgtcagcaaaaagcaaaatc

SEQ ID NO: 138119 - DNA, 16 bp, Homo sapiens
catgtcaggcctgtgt

SEQ ID NO: 138120 - DNA, 21 bp, Homo sapiens
catgtcaggcctgtgtgtgaa

SEQ ID NO: 138121 - DNA, 22 bp, Homo sapiens
catgtccctaccgagtctcttc

SEQ ID NO: 138122 - DNA, 17 bp, Homo sapiens
catgtctctcagaattc

SEQ ID NO: 138123 - DNA, 14 bp, Homo sapiens
catgtgacatttat

SEQ ID NO: 138124 - DNA, 16 bp, Homo sapiens
catgtgacatttatat

SEQ ID NO: 138125 - DNA, 18 bp, Homo sapiens
catgtgatccttttatgt

SEQ ID NO: 138126 - DNA, 14 bp, Homo sapiens
catgtggggccagg

SEQ ID NO: 138127 - DNA, 17 bp, Homo sapiens
catgtggggccaggtca

SEQ ID NO: 138128 - DNA, 12 bp, Homo sapiens
catgtggtggga

SEQ ID NO: 138129 - DNA, 20 bp, Homo sapiens
catgtggtttatagagggcc

SEQ ID NO: 138130 - DNA, 13 bp, Homo sapiens
catgtgtgcgtgt

SEQ ID NO: 138131 - DNA, 21 bp, Homo sapiens
catgtgtgtccacgactgtct

SEQ ID NO: 138132 - DNA, 15 bp, Homo sapiens
catgtgtgtgctcag

SEQ ID NO: 138133 - DNA, 13 bp, Homo sapiens
catgttccttcaa

SEQ ID NO: 138134 - DNA, 18 bp, Homo sapiens
catgttgcacacccactc

SEQ ID NO: 138135 - DNA, 22 bp, Homo sapiens
catgttgcacacccactcagct

SEQ ID NO: 138136 - DNA, 21 bp, Homo sapiens
catgtttctctggccccaagg

SEQ ID NO: 138137 - DNA, 13 bp, Homo sapiens
catgtttcttcat

SEQ ID NO: 138138 - DNA, 16 bp, Homo sapiens
catgtttgagctcaga

SEQ ID NO: 138139 - DNA, 18 bp, Homo sapiens
catgtttgagctcagacc

SEQ ID NO: 138140 - DNA, 23 bp, Homo sapiens
catgtttgatgtatctgagcagg

SEQ ID NO: 138141 - DNA, 13 bp, Homo sapiens
catgtttgtaaaa

SEQ ID NO: 138142 - DNA, 23 bp, Homo sapiens
catgtttttgttttctttgaatg

SEQ ID NO: 138143 - DNA, 17 bp, Homo sapiens
cattaacttagcatgtg

SEQ ID NO: 138144 - DNA, 13 bp, Homo sapiens
cattaagaaaatc

SEQ ID NO: 138145 - DNA, 23 bp, Homo sapiens
cattaatgttaattcagcactga

SEQ ID NO: 138146 - DNA, 19 bp, Homo sapiens
cattaattattattgctgt

SEQ ID NO: 138147 - DNA, 17 bp, Homo sapiens
cattaccgcgttgtaaa

SEQ ID NO: 138148 - DNA, 18 bp, Homo sapiens
cattaccgcgttgtaaaa

SEQ ID NO: 138149 - DNA, 17 bp, Homo sapiens
cattagcagtttgcttt

SEQ ID NO: 138150 - DNA, 15 bp, Homo sapiens
cattaggatggctag

SEQ ID NO: 138151 - DNA, 18 bp, Homo sapiens
cattataactgaaggaga

SEQ ID NO: 138152 - DNA, 13 bp, Homo sapiens
cattatctcaaaa

SEQ ID NO: 138153 - DNA, 13 bp, Homo sapiens
cattattatcaac

SEQ ID NO: 138154 - DNA, 22 bp, Homo sapiens
cattcaataagcatcaaactct

SEQ ID NO: 138155 - DNA, 16 bp, Homo sapiens
cattcaatacaagtgt

SEQ ID NO: 138156 - DNA, 18 bp, Homo sapiens
cattcacttgcatttctt

SEQ ID NO: 138157 - DNA, 16 bp, Homo sapiens
cattccaacagtgagt

SEQ ID NO: 138158 - DNA, 13 bp, Homo sapiens
cattccccatggg

SEQ ID NO: 138159 - DNA, 11 bp, Homo sapiens
cattccctgag

SEQ ID NO: 138160 - DNA, 20 bp, Homo sapiens
cattccctgagtcaccagga

SEQ ID NO: 138161 - DNA, 21 bp, Homo sapiens
cattccctgagtcaccaggaa

SEQ ID NO: 138162 - DNA, 23 bp, Homo sapiens
cattcctcagggacagagacacc

SEQ ID NO: 138163 - DNA, 21 bp, Homo sapiens
cattcctgggaaatattccct

SEQ ID NO: 138164 - DNA, 18 bp, Homo sapiens
cattcctgtattcacccg

SEQ ID NO: 138165 - DNA, 18 bp, Homo sapiens
cagccagactggcacagt

SEQ ID NO: 138166 - DNA, 11 bp, Homo sapiens
cagccagcagc

SEQ ID NO: 138167 - DNA, 12 bp, Homo sapiens
cagccagcagcc

SEQ ID NO: 138168 - DNA, 21 bp, Homo sapiens
cagccagcagccagctctcag

SEQ ID NO: 138169 - DNA, 14 bp, Homo sapiens
cagccagcccagcc

SEQ ID NO: 138170 - DNA, 16 bp, Homo sapiens
cagccagctctcagcc

SEQ ID NO: 138171 - DNA, 21 bp, Homo sapiens
cagccagtgacctgaggaagc

SEQ ID NO: 138172 - DNA, 22 bp, Homo sapiens
cagccagtgacctgaggaagcg

SEQ ID NO: 138173 - DNA, 17 bp, Homo sapiens
cagcccagcccagctgg

SEQ ID NO: 138174 - DNA, 18 bp, Homo sapiens
cagcccattctctctcct

SEQ ID NO: 138175 - DNA, 23 bp, Homo sapiens
cagcccattctctctcctgtcca

SEQ ID NO: 138176 - DNA, 12 bp, Homo sapiens
cagcccctcctc

SEQ ID NO: 138177 - DNA, 13 bp, Homo sapiens
cagcccctcctct

SEQ ID NO: 138178 - DNA, 15 bp, Homo sapiens
cagccccttctcaga

SEQ ID NO: 138179 - DNA, 22 bp, Homo sapiens
cagccccttctcagaatctacc

SEQ ID NO: 138180 - DNA, 13 bp, Homo sapiens
cagccctccctgc

SEQ ID NO: 138181 - DNA, 13 bp, Homo sapiens
cagccctccctgt

SEQ ID NO: 138182 - DNA, 18 bp, Homo sapiens
cagccctccctgtcctcc

SEQ ID NO: 138183 - DNA, 20 bp, Homo sapiens
cagccctccctgtcctcctc

SEQ ID NO: 138184 - DNA, 21 bp, Homo sapiens
cagccctccctgtcctcctcg

SEQ ID NO: 138185 - DNA, 14 bp, Homo sapiens
cagccctcctcacc

SEQ ID NO: 138186 - DNA, 13 bp, Homo sapiens
cagccctgctttg

SEQ ID NO: 138187 - DNA, 20 bp, Homo sapiens
cagccctgctttgggctgcc

SEQ ID NO: 138188 - DNA, 15 bp, Homo sapiens
catttaaaatgatta

SEQ ID NO: 138189 - DNA, 16 bp, Homo sapiens
catttaaaatgattag

SEQ ID NO: 138190 - DNA, 17 bp, Homo sapiens
catttagtttgattatt

SEQ ID NO: 138191 - DNA, 12 bp, Homo sapiens
catttatatatt

SEQ ID NO: 138192 - DNA, 15 bp, Homo sapiens
catttcatctatttc

SEQ ID NO: 138193 - DNA, 13 bp, Homo sapiens
catttccccagac

SEQ ID NO: 138194 - DNA, 20 bp, Homo sapiens
catttcctgacagaaggact

SEQ ID NO: 138195 - DNA, 18 bp, Homo sapiens
catttctaaaggcctctt

SEQ ID NO: 138196 - DNA, 23 bp, Homo sapiens
catttctatttatttactgagct

SEQ ID NO: 138197 - DNA, 15 bp, Homo sapiens
catttgattctgtgt

SEQ ID NO: 138198 - DNA, 22 bp, Homo sapiens
catttgcaagggaaaagtctct

SEQ ID NO: 138199 - DNA, 14 bp, Homo sapiens
catttgccttgctg

SEQ ID NO: 138200 - DNA, 15 bp, Homo sapiens
catttggattggatg

SEQ ID NO: 138201 - DNA, 19 bp, Homo sapiens
catttggcagagcttcttc

SEQ ID NO: 138202 - DNA, 18 bp, Homo sapiens
catttgggagacatgtga

SEQ ID NO: 138203 - DNA, 16 bp, Homo sapiens
catttgtgaaatgatg

SEQ ID NO: 138204 - DNA, 13 bp, Homo sapiens
catttgtgtgtgt

SEQ ID NO: 138205 - DNA, 19 bp, Homo sapiens
catttgtgtgtgtgcaagt

SEQ ID NO: 138206 - DNA, 22 bp, Homo sapiens
catttgtgtgtgtgcaagtgtg

SEQ ID NO: 138207 - DNA, 14 bp, Homo sapiens
cattttatatgtca

SEQ ID NO: 138208 - DNA, 16 bp, Homo sapiens
cattttcaccccaccc

SEQ ID NO: 138209 - DNA, 18 bp, Homo sapiens
cattttgctaaatgtgaa

SEQ ID NO: 138210 - DNA, 24 bp, Homo sapiens
cattttgctaaatgtgaatgatga

SEQ ID NO: 138211 - DNA, 17 bp, Homo sapiens
catttttacaataaata

SEQ ID NO: 138212 - DNA, 18 bp, Homo sapiens
catttttcctaacaggat

SEQ ID NO: 138213 - DNA, 13 bp, Homo sapiens
catttttgtattt

SEQ ID NO: 138214 - DNA, 19 bp, Homo sapiens
ccaaaaagattttcagaaa

SEQ ID NO: 138215 - DNA, 21 bp, Homo sapiens
ccaaaagtcaaaaggtgcctg

SEQ ID NO: 138216 - DNA, 16 bp, Homo sapiens
ccaaacaaatatgcaa

SEQ ID NO: 138217 - DNA, 16 bp, Homo sapiens
ccaaacagccacactg

SEQ ID NO: 138218 - DNA, 22 bp, Homo sapiens
ccaaagcctcctccagccgcca

SEQ ID NO: 138219 - DNA, 13 bp, Homo sapiens
ccaaagctttcct

SEQ ID NO: 138220 - DNA, 19 bp, Homo sapiens
ccaaagctttcctgcccca

SEQ ID NO: 138221 - DNA, 20 bp, Homo sapiens
ccaaagctttcctgccccag

SEQ ID NO: 138222 - DNA, 15 bp, Homo sapiens
ccaaaggtgaaggaa

SEQ ID NO: 138223 - DNA, 22 bp, Homo sapiens
ccaaaggtgaaggaatatatgg

SEQ ID NO: 138224 - DNA, 15 bp, Homo sapiens
ccaaatcaaaatatg

SEQ ID NO: 138225 - DNA, 18 bp, Homo sapiens
ccaaatgttcatcaatga

SEQ ID NO: 138226 - DNA, 20 bp, Homo sapiens
ccaaattccttggcatgcct

SEQ ID NO: 138227 - DNA, 23 bp, Homo sapiens
ccaacaggagctgggatcctaag

SEQ ID NO: 138228 - DNA, 19 bp, Homo sapiens
ccaacagtcaaaacagaga

SEQ ID NO: 138229 - DNA, 13 bp, Homo sapiens
ccaacatcaacat

SEQ ID NO: 138230 - DNA, 21 bp, Homo sapiens
ccaacatcccattgccctggt

SEQ ID NO: 138231 - DNA, 14 bp, Homo sapiens
ccaacccatcagaa

SEQ ID NO: 138232 - DNA, 18 bp, Homo sapiens
ccaacctaacccctttcc

SEQ ID NO: 138233 - DNA, 22 bp, Homo sapiens
ccaacctgaccaacatggagaa

SEQ ID NO: 138234 - DNA, 22 bp, Homo sapiens
ccaactcctggaagctgtgtcc

SEQ ID NO: 138235 - DNA, 11 bp, Homo sapiens
ccaacttgtaa

SEQ ID NO: 138236 - DNA, 21 bp, Homo sapiens
ccaagattgcgccattgcact

SEQ ID NO: 138237 - DNA, 12 bp, Homo sapiens
ccaagcaggaag

SEQ ID NO: 138238 - DNA, 20 bp, Homo sapiens
ccaagcaggaagctcagact

SEQ ID NO: 138239 - DNA, 13 bp, Homo sapiens
ccaagccgtggct

SEQ ID NO: 138240 - DNA, 14 bp, Homo sapiens
ccaagccgtggctt

SEQ ID NO: 138241 - DNA, 15 bp, Homo sapiens
ccaagccgtggcttc

SEQ ID NO: 138242 - DNA, 17 bp, Homo sapiens
ccaagccgtggcttccc

SEQ ID NO: 138243 - DNA, 21 bp, Homo sapiens
ccaagcgaggtcaacagagaa

SEQ ID NO: 138244 - DNA, 17 bp, Homo sapiens
ccaagctagaattccct

SEQ ID NO: 138245 - DNA, 22 bp, Homo sapiens
ccaagctagaattccctctctc

SEQ ID NO: 138246 - DNA, 17 bp, Homo sapiens
ccaagctcacagttcct

SEQ ID NO: 138247 - DNA, 22 bp, Homo sapiens
ccaagctcacagttcctcgccc

SEQ ID NO: 138248 - DNA, 13 bp, Homo sapiens
ccaaggaggaaaa

SEQ ID NO: 138249 - DNA, 18 bp, Homo sapiens
ccaaggtgggaggattgc

SEQ ID NO: 138250 - DNA, 17 bp, Homo sapiens
ccaagtctacagagtga

SEQ ID NO: 138251 - DNA, 12 bp, Homo sapiens
ccaagtgtgtgt

SEQ ID NO: 138252 - DNA, 22 bp, Homo sapiens
ccaatagttgttgattggcagg

SEQ ID NO: 138253 - DNA, 22 bp, Homo sapiens
ccaatcattttaattattattc

SEQ ID NO: 138254 - DNA, 21 bp, Homo sapiens
ccaatggagactgtctcaaga

SEQ ID NO: 138255 - DNA, 20 bp, Homo sapiens
ccaatgttctctcttctcca

SEQ ID NO: 138256 - DNA, 18 bp, Homo sapiens
ccacaaaggagagctagc

SEQ ID NO: 138257 - DNA, 15 bp, Homo sapiens
ccacaagattcccag

SEQ ID NO: 138258 - DNA, 20 bp, Homo sapiens
ccacaagattcccagagaca

SEQ ID NO: 138259 - DNA, 15 bp, Homo sapiens
ccacaccaaacctct

SEQ ID NO: 138260 - DNA, 12 bp, Homo sapiens
ccacacccagcc

SEQ ID NO: 138261 - DNA, 16 bp, Homo sapiens
ccacacccagcctcag

SEQ ID NO: 138262 - DNA, 17 bp, Homo sapiens
ccacacccagcctcagt

SEQ ID NO: 138263 - DNA, 21 bp, Homo sapiens
ccacacttcaggctcttctcc

SEQ ID NO: 138264 - DNA, 21 bp, Homo sapiens
ccacagacaaggtagccctgg

SEQ ID NO: 138265 - DNA, 19 bp, Homo sapiens
ccacagcctcccctgccag

SEQ ID NO: 138266 - DNA, 22 bp, Homo sapiens
ccacagctttttaccaagtttc

SEQ ID NO: 138267 - DNA, 21 bp, Homo sapiens
ccacaggacatttctctaaga

SEQ ID NO: 138268 - DNA, 16 bp, Homo sapiens
ccacaggcccttcctc

SEQ ID NO: 138269 - DNA, 17 bp, Homo sapiens
ccacaggcccttcctct

SEQ ID NO: 138270 - DNA, 18 bp, Homo sapiens
ccacaggcccttcctctc

SEQ ID NO: 138271 - DNA, 17 bp, Homo sapiens
ccacagggctaagagct

SEQ ID NO: 138272 - DNA, 20 bp, Homo sapiens
ccacagggctaagagctagc

SEQ ID NO: 138273 - DNA, 22 bp, Homo sapiens
ccacaggttcatgccaccatgg

SEQ ID NO: 138274 - DNA, 21 bp, Homo sapiens
ccacatagtgatggttcccct

SEQ ID NO: 138275 - DNA, 22 bp, Homo sapiens
ccacatagtgatggttcccctg

SEQ ID NO: 138276 - DNA, 22 bp, Homo sapiens
ccacatcaatattgtcattcct

SEQ ID NO: 138277 - DNA, 15 bp, Homo sapiens
ccaccaactcttgca

SEQ ID NO: 138278 - DNA, 17 bp, Homo sapiens
ccaccaagagggacgcc

SEQ ID NO: 138279 - DNA, 20 bp, Homo sapiens
ccaccacctaggccactcct

SEQ ID NO: 138280 - DNA, 22 bp, Homo sapiens
ccaccacctaggccactcctcc

SEQ ID NO: 138281 - DNA, 17 bp, Homo sapiens
ccaccacctccctcacc

SEQ ID NO: 138282 - DNA, 21 bp, Homo sapiens
ccaccagagaccgtcctcacc

SEQ ID NO: 138283 - DNA, 22 bp, Homo sapiens
ccaccagagaccgtcctcaccc

SEQ ID NO: 138284 - DNA, 11 bp, Homo sapiens
ccaccagcctg

SEQ ID NO: 138285 - DNA, 14 bp, Homo sapiens
ccaccagcctgcac

SEQ ID NO: 138286 - DNA, 22 bp, Homo sapiens
ccaccatgcccagctcagaggg

SEQ ID NO: 138287 - DNA, 17 bp, Homo sapiens
ccaccatggccagccaa

SEQ ID NO: 138288 - DNA, 21 bp, Homo sapiens
ccaccatggccagccaacttt

SEQ ID NO: 138289 - DNA, 19 bp, Homo sapiens
ccaccatggggtcctacca

SEQ ID NO: 138290 - DNA, 22 bp, Homo sapiens
ccacccagcccattctctctcc

SEQ ID NO: 138291 - DNA, 13 bp, Homo sapiens
ccaccccagctgc

SEQ ID NO: 138292 - DNA, 20 bp, Homo sapiens
ccacccccttcagtgcccac

SEQ ID NO: 138293 - DNA, 19 bp, Homo sapiens
ccacccctcaacacctctg

SEQ ID NO: 138294 - DNA, 16 bp, Homo sapiens
ccaccctgaaagccct

SEQ ID NO: 138295 - DNA, 17 bp, Homo sapiens
ccaccctgaaagccctg

SEQ ID NO: 138296 - DNA, 18 bp, Homo sapiens
ccaccctgaaagccctga

SEQ ID NO: 138297 - DNA, 16 bp, Homo sapiens
ccacctaggccactcc

SEQ ID NO: 138298 - DNA, 22 bp, Homo sapiens
ccacctaggccactcctccaaa

SEQ ID NO: 138299 - DNA, 10 bp, Homo sapiens
ccacctcagc

SEQ ID NO: 138300 - DNA, 15 bp, Homo sapiens
ccacctcagccttgg

SEQ ID NO: 138301 - DNA, 16 bp, Homo sapiens
ccacctcagccttgga

SEQ ID NO: 138302 - DNA, 10 bp, Homo sapiens
ccacctctgc

SEQ ID NO: 138303 - DNA, 20 bp, Homo sapiens
ccacctctgcggaccccagc

SEQ ID NO: 138304 - DNA, 22 bp, Homo sapiens
ccacctctgcggaccccagctg

SEQ ID NO: 138305 - DNA, 17 bp, Homo sapiens
ccacctctgtgacctca

SEQ ID NO: 138306 - DNA, 15 bp, Homo sapiens
ccacctgctgagaga

SEQ ID NO: 138307 - DNA, 16 bp, Homo sapiens
ccacctggggcagtca

SEQ ID NO: 138308 - DNA, 20 bp, Homo sapiens
ccacctggggcagtcacctg

SEQ ID NO: 138309 - DNA, 15 bp, Homo sapiens
ccacctgtctcagcc

SEQ ID NO: 138310 - DNA, 23 bp, Homo sapiens
ccacctgtctcagcctcccagag

SEQ ID NO: 138311 - DNA, 15 bp, Homo sapiens
ccaccttcccagctc

SEQ ID NO: 138312 - DNA, 16 bp, Homo sapiens
ccaccttcccagctct

SEQ ID NO: 138313 - DNA, 21 bp, Homo sapiens
ccaccttcccagctctccctc

SEQ ID NO: 138314 - DNA, 19 bp, Homo sapiens
ccacgaatttgctggggaa

SEQ ID NO: 138315 - DNA, 16 bp, Homo sapiens
ccacgagggtcaggac

SEQ ID NO: 138316 - DNA, 14 bp, Homo sapiens
ccacgccctcccct

SEQ ID NO: 138317 - DNA, 20 bp, Homo sapiens
ccacggagccactcctctga

SEQ ID NO: 138318 - DNA, 23 bp, Homo sapiens
caggaggactgccccgtgcagac

SEQ ID NO: 138319 - DNA, 16 bp, Homo sapiens
caggaggctgaggcag

SEQ ID NO: 138320 - DNA, 20 bp, Homo sapiens
caggaggctgaggcagaaga

SEQ ID NO: 138321 - DNA, 19 bp, Homo sapiens
caggaggtggaggttgcag

SEQ ID NO: 138322 - DNA, 13 bp, Homo sapiens
caggagtccctgg

SEQ ID NO: 138323 - DNA, 14 bp, Homo sapiens
caggagtccctggt

SEQ ID NO: 138324 - DNA, 22 bp, Homo sapiens
caggagttagaggccagcctgg

SEQ ID NO: 138325 - DNA, 23 bp, Homo sapiens
caggagtttgagaccaacctggg

SEQ ID NO: 138326 - DNA, 17 bp, Homo sapiens
caggatgacctggataa

SEQ ID NO: 138327 - DNA, 17 bp, Homo sapiens
caggatgcccagggcca

SEQ ID NO: 138328 - DNA, 22 bp, Homo sapiens
caggatgcccagggccactctg

SEQ ID NO: 138329 - DNA, 18 bp, Homo sapiens
ccactctcattccccagg

SEQ ID NO: 138330 - DNA, 14 bp, Homo sapiens
ccactctgcctctg

SEQ ID NO: 138331 - DNA, 21 bp, Homo sapiens
ccactctgctcgccttagcac

SEQ ID NO: 138332 - DNA, 18 bp, Homo sapiens
ccactgcactccagcctg

SEQ ID NO: 138333 - DNA, 23 bp, Homo sapiens
ccactgcactccagcctgggtga

SEQ ID NO: 138334 - DNA, 13 bp, Homo sapiens
ccactgcagaaga

SEQ ID NO: 138335 - DNA, 18 bp, Homo sapiens
ccactgcagaagacagta

SEQ ID NO: 138336 - DNA, 13 bp, Homo sapiens
ccactgcaggccc

SEQ ID NO: 138337 - DNA, 21 bp, Homo sapiens
ccactgccttcgatacaccgg

SEQ ID NO: 138338 - DNA, 12 bp, Homo sapiens
ccactggggaaa

SEQ ID NO: 138339 - DNA, 15 bp, Homo sapiens
ccactggttcttctt

SEQ ID NO: 138340 - DNA, 14 bp, Homo sapiens
ccactgtcaccctc

SEQ ID NO: 138341 - DNA, 17 bp, Homo sapiens
ccactgtcaccctccac

SEQ ID NO: 138342 - DNA, 22 bp, Homo sapiens
ccactgtcactgtttctctgct

SEQ ID NO: 138343 - DNA, 14 bp, Homo sapiens
ccactgttatcaaa

SEQ ID NO: 138344 - DNA, 13 bp, Homo sapiens
ccacttcagctga

SEQ ID NO: 138345 - DNA, 21 bp, Homo sapiens
ccacttcagggttctcctctc

SEQ ID NO: 138346 - DNA, 21 bp, Homo sapiens
ccacttcattcttgaaagctg

SEQ ID NO: 138347 - DNA, 23 bp, Homo sapiens
ccacttcattcttgaaagctgtg

SEQ ID NO: 138348 - DNA, 21 bp, Homo sapiens
ccagaaataaagttggtgaca

SEQ ID NO: 138349 - DNA, 18 bp, Homo sapiens
ccagaacgtggctctgct

SEQ ID NO: 138350 - DNA, 20 bp, Homo sapiens
ccagaacgtggctctgctgg

SEQ ID NO: 138351 - DNA, 20 bp, Homo sapiens
ccagaagtttgtcaagtcaa

SEQ ID NO: 138352 - DNA, 20 bp, Homo sapiens
ccagacagctccctctgcct

SEQ ID NO: 138353 - DNA, 23 bp, Homo sapiens
ccagacatgtggtgggacaggga

SEQ ID NO: 138354 - DNA, 18 bp, Homo sapiens
ccagacgcacgtgggtct

SEQ ID NO: 138355 - DNA, 15 bp, Homo sapiens
ccagacggcacccac

SEQ ID NO: 138356 - DNA, 19 bp, Homo sapiens
ccagacggttcaccagcct

SEQ ID NO: 138357 - DNA, 22 bp, Homo sapiens
ccagactttacatgacacagct

SEQ ID NO: 138358 - DNA, 14 bp, Homo sapiens
ccagagacaggaaa

SEQ ID NO: 138359 - DNA, 21 bp, Homo sapiens
ccagagaccgtcctcacccct

SEQ ID NO: 138360 - DNA, 16 bp, Homo sapiens
ccagagagtggctcct

SEQ ID NO: 138361 - DNA, 14 bp, Homo sapiens
ccagagctgggagg

SEQ ID NO: 138362 - DNA, 21 bp, Homo sapiens
ccagagctgggaggcatggcc

SEQ ID NO: 138363 - DNA, 22 bp, Homo sapiens
ccagaggaactgtccagagagc

SEQ ID NO: 138364 - DNA, 17 bp, Homo sapiens
ccagaggaaggggccag

SEQ ID NO: 138365 - DNA, 21 bp, Homo sapiens
ccagaggattgctgccccatc

SEQ ID NO: 138366 - DNA, 18 bp, Homo sapiens
ccagagtgtgggaaggga

SEQ ID NO: 138367 - DNA, 13 bp, Homo sapiens
ccagatcccagaa

SEQ ID NO: 138368 - DNA, 18 bp, Homo sapiens
ccagatcccagaaggacc

SEQ ID NO: 138369 - DNA, 13 bp, Homo sapiens
ccagattgacgac

SEQ ID NO: 138370 - DNA, 14 bp, Homo sapiens
ccagcacccagcaa

SEQ ID NO: 138371 - DNA, 24 bp, Homo sapiens
ccagcactaaagcagtggacacca

SEQ ID NO: 138372 - DNA, 12 bp, Homo sapiens
ccagcactgctt

SEQ ID NO: 138373 - DNA, 22 bp, Homo sapiens
ccagcactgcttgaggaaaaca

SEQ ID NO: 138374 - DNA, 21 bp, Homo sapiens
ccagcactttgggaggccaag

SEQ ID NO: 138375 - DNA, 18 bp, Homo sapiens
ccagcagatcccagctca

SEQ ID NO: 138376 - DNA, 16 bp, Homo sapiens
ccagcagccagctctc

SEQ ID NO: 138377 - DNA, 14 bp, Homo sapiens
ccagcagcctggac

SEQ ID NO: 138378 - DNA, 15 bp, Homo sapiens
ccagcagtttgggag

SEQ ID NO: 138379 - DNA, 22 bp, Homo sapiens
ccagccagaacgtggctctgct

SEQ ID NO: 138380 - DNA, 13 bp, Homo sapiens
ccagccagcagcc

SEQ ID NO: 138381 - DNA, 16 bp, Homo sapiens
ccagccagcagccagc

SEQ ID NO: 138382 - DNA, 22 bp, Homo sapiens
ccagccagtgacctgaggaagc

SEQ ID NO: 138383 - DNA, 23 bp, Homo sapiens
ccagccagtgacctgaggaagcg

SEQ ID NO: 138384 - DNA, 12 bp, Homo sapiens
ccagcccagccc

SEQ ID NO: 138385 - DNA, 14 bp, Homo sapiens
ccagcccagggtgg

SEQ ID NO: 138386 - DNA, 17 bp, Homo sapiens
ccagcccattctctctc

SEQ ID NO: 138387 - DNA, 13 bp, Homo sapiens
ccagcccctagcc

SEQ ID NO: 138388 - DNA, 19 bp, Homo sapiens
ccagcccctagcccaggag

SEQ ID NO: 138389 - DNA, 22 bp, Homo sapiens
ccagcccctagcccaggagaga

SEQ ID NO: 138390 - DNA, 13 bp, Homo sapiens
ccagccctcatcc

SEQ ID NO: 138391 - DNA, 13 bp, Homo sapiens
ccagccctccctg

SEQ ID NO: 138392 - DNA, 17 bp, Homo sapiens
ccagccctccctgtcct

SEQ ID NO: 138393 - DNA, 22 bp, Homo sapiens
ccagccctccctgtcctcctcg

SEQ ID NO: 138394 - DNA, 13 bp, Homo sapiens
ccagccctggctc

SEQ ID NO: 138395 - DNA, 18 bp, Homo sapiens
ccagccgccatgctcctg

SEQ ID NO: 138396 - DNA, 11 bp, Homo sapiens
ccagcctcagt

SEQ ID NO: 138397 - DNA, 19 bp, Homo sapiens
ccagcctcagtcctcccct

SEQ ID NO: 138398 - DNA, 22 bp, Homo sapiens
ccagcctcagtcctcccctcac

SEQ ID NO: 138399 - DNA, 21 bp, Homo sapiens
ccagcctctcttggtttcctt

SEQ ID NO: 138400 - DNA, 19 bp, Homo sapiens
ccagcctctgagcccctgg

SEQ ID NO: 138401 - DNA, 13 bp, Homo sapiens
ccagcctgggtga

SEQ ID NO: 138402 - DNA, 19 bp, Homo sapiens
ccagccttcttccatccca

SEQ ID NO: 138403 - DNA, 19 bp, Homo sapiens
ccagcctttctcccaggcc

SEQ ID NO: 138404 - DNA, 17 bp, Homo sapiens
ccagctactcaggaggc

SEQ ID NO: 138405 - DNA, 14 bp, Homo sapiens
ccagctcacgtcac

SEQ ID NO: 138406 - DNA, 14 bp, Homo sapiens
ccagctccccaaga

SEQ ID NO: 138407 - DNA, 12 bp, Homo sapiens
ccagctctcagc

SEQ ID NO: 138408 - DNA, 13 bp, Homo sapiens
ccagctctcagcc

SEQ ID NO: 138409 - DNA, 21 bp, Homo sapiens
ccagctctccctctggccctg

SEQ ID NO: 138410 - DNA, 21 bp, Homo sapiens
ccagctctgaaaccagtgtta

SEQ ID NO: 138411 - DNA, 14 bp, Homo sapiens
ccagctctgtatca

SEQ ID NO: 138412 - DNA, 21 bp, Homo sapiens
ccagctgaaatactgaggggt

SEQ ID NO: 138413 - DNA, 16 bp, Homo sapiens
ccagctgctcccctcc

SEQ ID NO: 138414 - DNA, 13 bp, Homo sapiens
ccagctggcagca

SEQ ID NO: 138415 - DNA, 14 bp, Homo sapiens
ccagctggcagcag

SEQ ID NO: 138416 - DNA, 16 bp, Homo sapiens
ccagctggcagcagag

SEQ ID NO: 138417 - DNA, 14 bp, Homo sapiens
ccagctgtgagcct

SEQ ID NO: 138418 - DNA, 16 bp, Homo sapiens
ccagctgtgagccttg

SEQ ID NO: 138419 - DNA, 17 bp, Homo sapiens
ccagctgtgagccttgg

SEQ ID NO: 138420 - DNA, 17 bp, Homo sapiens
ccagctgttcagctggt

SEQ ID NO: 138421 - DNA, 15 bp, Homo sapiens
ccagcttgttattta

SEQ ID NO: 138422 - DNA, 14 bp, Homo sapiens
ccaggaacctcctc

SEQ ID NO: 138423 - DNA, 15 bp, Homo sapiens
ccaggaagccgtgcc

SEQ ID NO: 138424 - DNA, 20 bp, Homo sapiens
ccaggaagccgtgccctgcc

SEQ ID NO: 138425 - DNA, 19 bp, Homo sapiens
ccaggacaccacacccagc

SEQ ID NO: 138426 - DNA, 22 bp, Homo sapiens
ccaggacaccacacccagcctc

SEQ ID NO: 138427 - DNA, 13 bp, Homo sapiens
ccaggacaggccc

SEQ ID NO: 138428 - DNA, 13 bp, Homo sapiens
ccaggactgagcc

SEQ ID NO: 138429 - DNA, 15 bp, Homo sapiens
ccaggactgagcccc

SEQ ID NO: 138430 - DNA, 19 bp, Homo sapiens
ccaggactgagccccgcag

SEQ ID NO: 138431 - DNA, 20 bp, Homo sapiens
ccaggcacgaacccacctgc

SEQ ID NO: 138432 - DNA, 19 bp, Homo sapiens
ccaggcaggtagccagggg

SEQ ID NO: 138433 - DNA, 19 bp, Homo sapiens
ccaggcaggtgcctggaca

SEQ ID NO: 138434 - DNA, 15 bp, Homo sapiens
ccaggccccaggaag

SEQ ID NO: 138435 - DNA, 16 bp, Homo sapiens
ccaggcccggggctgg

SEQ ID NO: 138436 - DNA, 18 bp, Homo sapiens
ccaggccgccccagcctc

SEQ ID NO: 138437 - DNA, 15 bp, Homo sapiens
ccaggcctctgtgtc

SEQ ID NO: 138438 - DNA, 17 bp, Homo sapiens
ccaggcctctgtgtcct

SEQ ID NO: 138439 - DNA, 19 bp, Homo sapiens
ccaggcctgaaagaggctg

SEQ ID NO: 138440 - DNA, 12 bp, Homo sapiens
ccaggcctgcct

SEQ ID NO: 138441 - DNA, 22 bp, Homo sapiens
ccaggcgagagacttgtggcct

SEQ ID NO: 138442 - DNA, 18 bp, Homo sapiens
ccaggcgatgtgcaagtg

SEQ ID NO: 138443 - DNA, 15 bp, Homo sapiens
ccaggctccttcctg

SEQ ID NO: 138444 - DNA, 14 bp, Homo sapiens
ccaggctgctggac

SEQ ID NO: 138445 - DNA, 17 bp, Homo sapiens
ccagggaagtgctctga

SEQ ID NO: 138446 - DNA, 17 bp, Homo sapiens
ccagggccacgtgccag

SEQ ID NO: 138447 - DNA, 22 bp, Homo sapiens
ccagggccacgtgccaggcccg

SEQ ID NO: 138448 - DNA, 21 bp, Homo sapiens
ccagggcccctcaccctgcct

SEQ ID NO: 138449 - DNA, 18 bp, Homo sapiens
ccagggcctgagcctggc

SEQ ID NO: 138450 - DNA, 19 bp, Homo sapiens
ccagggcctgagcctggcc

SEQ ID NO: 138451 - DNA, 15 bp, Homo sapiens
ccagggctcagcctg

SEQ ID NO: 138452 - DNA, 19 bp, Homo sapiens
ccaggggaaaatcagcctg

SEQ ID NO: 138453 - DNA, 20 bp, Homo sapiens
ccaggggaaaatcagcctgc

SEQ ID NO: 138454 - DNA, 20 bp, Homo sapiens
ccaggggagagggtctggag

SEQ ID NO: 138455 - DNA, 18 bp, Homo sapiens
ccagggggactagcccct

SEQ ID NO: 138456 - DNA, 19 bp, Homo sapiens
ccagggggactagcccctg

SEQ ID NO: 138457 - DNA, 22 bp, Homo sapiens
ccagggtggacttagaaagcag

SEQ ID NO: 138458 - DNA, 20 bp, Homo sapiens
ccaggtcaccctttgctgtg

SEQ ID NO: 138459 - DNA, 23 bp, Homo sapiens
ccaggtctcacgggcatgggcac

SEQ ID NO: 138460 - DNA, 13 bp, Homo sapiens
ccaggtgccagtt

SEQ ID NO: 138461 - DNA, 13 bp, Homo sapiens
ccaggtgcccagc

SEQ ID NO: 138462 - DNA, 22 bp, Homo sapiens
ccaggtgctacacccttttcca

SEQ ID NO: 138463 - DNA, 16 bp, Homo sapiens
ccaggtggctgaccca

SEQ ID NO: 138464 - DNA, 19 bp, Homo sapiens
ccaggtggctgacccagtc

SEQ ID NO: 138465 - DNA, 20 bp, Homo sapiens
ccaggtggctgacccagtcc

SEQ ID NO: 138466 - DNA, 15 bp, Homo sapiens
ccagtccctggggga

SEQ ID NO: 138467 - DNA, 12 bp, Homo sapiens
ccagtctcttct

SEQ ID NO: 138468 - DNA, 16 bp, Homo sapiens
ccagtctgttccccat

SEQ ID NO: 138469 - DNA, 16 bp, Homo sapiens
ccagtgaattcttgaa

SEQ ID NO: 138470 - DNA, 17 bp, Homo sapiens
ccagtgacagacaggct

SEQ ID NO: 138471 - DNA, 19 bp, Homo sapiens
cccagtgagattacagagg

SEQ ID NO: 138472 - DNA, 19 bp, Homo sapiens
cccagtgagcactcccaag

SEQ ID NO: 138473 - DNA, 17 bp, Homo sapiens
cccagtgccgagaagga

SEQ ID NO: 138474 - DNA, 14 bp, Homo sapiens
cccagttagctctc

SEQ ID NO: 138475 - DNA, 15 bp, Homo sapiens
cccatcattcatgct

SEQ ID NO: 138476 - DNA, 13 bp, Homo sapiens
cccatcccacacc

SEQ ID NO: 138477 - DNA, 18 bp, Homo sapiens
cagtcctcccctcacagc

SEQ ID NO: 138478 - DNA, 19 bp, Homo sapiens
cagtcctcccctcacagcc

SEQ ID NO: 138479 - DNA, 20 bp, Homo sapiens
cagtcctcccctcacagcct

SEQ ID NO: 138480 - DNA, 15 bp, Homo sapiens
cagtcgatagagctg

SEQ ID NO: 138481 - DNA, 17 bp, Homo sapiens
cagtctcacccagactc

SEQ ID NO: 138482 - DNA, 12 bp, Homo sapiens
cagtctggaggg

SEQ ID NO: 138483 - DNA, 13 bp, Homo sapiens
cagtctggagggg

SEQ ID NO: 138484 - DNA, 15 bp, Homo sapiens
cagtcttccatttgc

SEQ ID NO: 138485 - DNA, 18 bp, Homo sapiens
cagtcttccatttgcaag

SEQ ID NO: 138486 - DNA, 21 bp, Homo sapiens
cagtcttccatttgcaaggga

SEQ ID NO: 138487 - DNA, 12 bp, Homo sapiens
cagtgaattctt

SEQ ID NO: 138488 - DNA, 16 bp, Homo sapiens
cagtgacctgaggaag

SEQ ID NO: 138489 - DNA, 17 bp, Homo sapiens
cagtgacctgaggaagc

SEQ ID NO: 138490 - DNA, 19 bp, Homo sapiens
cagtgacctgaggaagcgt

SEQ ID NO: 138491 - DNA, 19 bp, Homo sapiens
cagtgacctgctgggtaaa

SEQ ID NO: 138492 - DNA, 14 bp, Homo sapiens
cagtgagaaaaagc

SEQ ID NO: 138493 - DNA, 19 bp, Homo sapiens
cagtgagaaaaagctcctg

SEQ ID NO: 138494 - DNA, 15 bp, Homo sapiens
cagtgagacagctct

SEQ ID NO: 138495 - DNA, 19 bp, Homo sapiens
cagtgagattacagaggaa

SEQ ID NO: 138496 - DNA, 17 bp, Homo sapiens
cagtgagtgagcctggc

SEQ ID NO: 138497 - DNA, 23 bp, Homo sapiens
cagtgatgtaccatgaaacaaag

SEQ ID NO: 138498 - DNA, 17 bp, Homo sapiens
cagtgcatctcagccca

SEQ ID NO: 138499 - DNA, 18 bp, Homo sapiens
cagtgcatctcagcccac

SEQ ID NO: 138500 - DNA, 19 bp, Homo sapiens
cagtgccaagcacagtgcc

SEQ ID NO: 138501 - DNA, 18 bp, Homo sapiens
cagtgccgagaaggaagc

SEQ ID NO: 138502 - DNA, 12 bp, Homo sapiens
cagtgcctgctg

SEQ ID NO: 138503 - DNA, 18 bp, Homo sapiens
cagtgccttacctcctgc

SEQ ID NO: 138504 - DNA, 14 bp, Homo sapiens
cagtgctccctcac

SEQ ID NO: 138505 - DNA, 15 bp, Homo sapiens
cagtgctgtacttga

SEQ ID NO: 138506 - DNA, 13 bp, Homo sapiens
cagtggagaatta

SEQ ID NO: 138507 - DNA, 16 bp, Homo sapiens
cagtggattgcatttc

SEQ ID NO: 138508 - DNA, 18 bp, Homo sapiens
cagtggctggtccagggc

SEQ ID NO: 138509 - DNA, 16 bp, Homo sapiens
cagtgggacagggcat

SEQ ID NO: 138510 - DNA, 16 bp, Homo sapiens
cagtgtcccctccact

SEQ ID NO: 138511 - DNA, 14 bp, Homo sapiens
cagtgtctcggagg

SEQ ID NO: 138512 - DNA, 19 bp, Homo sapiens
cagtgtgaggccagggcag

SEQ ID NO: 138513 - DNA, 14 bp, Homo sapiens
cagtgttattttct

SEQ ID NO: 138514 - DNA, 14 bp, Homo sapiens
cagtgttccccatc

SEQ ID NO: 138515 - DNA, 21 bp, Homo sapiens
cagtgttccccatctgggtcc

SEQ ID NO: 138516 - DNA, 15 bp, Homo sapiens
cagttaaaaaaaatt

SEQ ID NO: 138517 - DNA, 14 bp, Homo sapiens
cagttactcagccc

SEQ ID NO: 138518 - DNA, 19 bp, Homo sapiens
cagttactcagccctgggc

SEQ ID NO: 138519 - DNA, 13 bp, Homo sapiens
cagttatggctat

SEQ ID NO: 138520 - DNA, 23 bp, Homo sapiens
cagttcatatgtaccatgtacat

SEQ ID NO: 138521 - DNA, 19 bp, Homo sapiens
cagttgaaaaacagctgag

SEQ ID NO: 138522 - DNA, 20 bp, Homo sapiens
cagttgagtcgtcatcactt

SEQ ID NO: 138523 - DNA, 20 bp, Homo sapiens
cagttgcacttggcctctgg

SEQ ID NO: 138524 - DNA, 21 bp, Homo sapiens
cagtttgcagaaaagcacctg

SEQ ID NO: 138525 - DNA, 12 bp, Homo sapiens
cagtttgctttg

SEQ ID NO: 138526 - DNA, 21 bp, Homo sapiens
cataaaaattagccaagtgtg

SEQ ID NO: 138527 - DNA, 11 bp, Homo sapiens
cataaaacatt

SEQ ID NO: 138528 - DNA, 18 bp, Homo sapiens
cataaaacattaagaaaa

SEQ ID NO: 138529 - DNA, 19 bp, Homo sapiens
cataaaacattaagaaaat

SEQ ID NO: 138530 - DNA, 12 bp, Homo sapiens
cataaacttcat

SEQ ID NO: 138531 - DNA, 21 bp, Homo sapiens
cataagaatgaataataatta

SEQ ID NO: 138532 - DNA, 12 bp, Homo sapiens
cataagtttctg

SEQ ID NO: 138533 - DNA, 23 bp, Homo sapiens
cataatctggactcctctgtcca

SEQ ID NO: 138534 - DNA, 17 bp, Homo sapiens
cataccaacacgagcag

SEQ ID NO: 138535 - DNA, 13 bp, Homo sapiens
catacgtccacca

SEQ ID NO: 138536 - DNA, 21 bp, Homo sapiens
catagaggtgagggaagcctg

SEQ ID NO: 138537 - DNA, 23 bp, Homo sapiens
catagatcagcaaaccggggcct

SEQ ID NO: 138538 - DNA, 15 bp, Homo sapiens
catagccaggaaact

SEQ ID NO: 138539 - DNA, 13 bp, Homo sapiens
catagcccatccc

SEQ ID NO: 138540 - DNA, 17 bp, Homo sapiens
catagcccatccctgcc

SEQ ID NO: 138541 - DNA, 23 bp, Homo sapiens
catagcccatccctgcctggtca

SEQ ID NO: 138542 - DNA, 12 bp, Homo sapiens
cataggaaaagt

SEQ ID NO: 138543 - DNA, 21 bp, Homo sapiens
catagtattccattgtgtgag

SEQ ID NO: 138544 - DNA, 15 bp, Homo sapiens
catataatgttgtta

SEQ ID NO: 138545 - DNA, 22 bp, Homo sapiens
catatgactcacatgatgcata

SEQ ID NO: 138546 - DNA, 23 bp, Homo sapiens
catatgattgtgcacatacttga

SEQ ID NO: 138547 - DNA, 14 bp, Homo sapiens
catatgtaaaataa

SEQ ID NO: 138548 - DNA, 15 bp, Homo sapiens
catatgtaccatgta

SEQ ID NO: 138549 - DNA, 21 bp, Homo sapiens
catatgtaccatgtacatgaa

SEQ ID NO: 138550 - DNA, 16 bp, Homo sapiens
catattccatatttat

SEQ ID NO: 138551 - DNA, 17 bp, Homo sapiens
catattcctgcagcctg

SEQ ID NO: 138552 - DNA, 16 bp, Homo sapiens
catattggtattcact

SEQ ID NO: 138553 - DNA, 17 bp, Homo sapiens
catattgtggcacaagc

SEQ ID NO: 138554 - DNA, 18 bp, Homo sapiens
catattgtggcacaagca

SEQ ID NO: 138555 - DNA, 14 bp, Homo sapiens
catatttaaagaca

SEQ ID NO: 138556 - DNA, 16 bp, Homo sapiens
catatttacttcttat

SEQ ID NO: 138557 - DNA, 16 bp, Homo sapiens
catattttatagaact

SEQ ID NO: 138558 - DNA, 17 bp, Homo sapiens
catattttatagaactt

SEQ ID NO: 138559 - DNA, 18 bp, Homo sapiens
catattttcaccatttga

SEQ ID NO: 138560 - DNA, 15 bp, Homo sapiens
catcaacaaaaattg

SEQ ID NO: 138561 - DNA, 14 bp, Homo sapiens
catcaacatcttgg

SEQ ID NO: 138562 - DNA, 18 bp, Homo sapiens
catcaagcacagaaggag

SEQ ID NO: 138563 - DNA, 22 bp, Homo sapiens
catcaagttattgacaaactct

SEQ ID NO: 138564 - DNA, 23 bp, Homo sapiens
catcaagttattgacaaactctc

SEQ ID NO: 138565 - DNA, 16 bp, Homo sapiens
catcaattatagaaag

SEQ ID NO: 138566 - DNA, 11 bp, Homo sapiens
catcacacaca

SEQ ID NO: 138567 - DNA, 13 bp, Homo sapiens
catcaccacagtt

SEQ ID NO: 138568 - DNA, 23 bp, Homo sapiens
catcaccttaggcagggaagtgt

SEQ ID NO: 138569 - DNA, 19 bp, Homo sapiens
catcactggagcaccaggc

SEQ ID NO: 138570 - DNA, 11 bp, Homo sapiens
catcagaagga

SEQ ID NO: 138571 - DNA, 13 bp, Homo sapiens
catcagcatacct

SEQ ID NO: 138572 - DNA, 17 bp, Homo sapiens
catcagcatacctttat

SEQ ID NO: 138573 - DNA, 13 bp, Homo sapiens
catcagctgctga

SEQ ID NO: 138574 - DNA, 18 bp, Homo sapiens
catcagctgctgaaacaa

SEQ ID NO: 138575 - DNA, 17 bp, Homo sapiens
catcaggttccatcccg

SEQ ID NO: 138576 - DNA, 12 bp, Homo sapiens
catcataaaata

SEQ ID NO: 138577 - DNA, 13 bp, Homo sapiens
catcataaaataa

SEQ ID NO: 138578 - DNA, 18 bp, Homo sapiens
catcataaaataaagtat

SEQ ID NO: 138579 - DNA, 23 bp, Homo sapiens
catcataaaataaagtatatata

SEQ ID NO: 138580 - DNA, 21 bp, Homo sapiens
catcatgtccccaaacctgca

SEQ ID NO: 138581 - DNA, 21 bp, Homo sapiens
catcattatttgcagagacag

SEQ ID NO: 138582 - DNA, 22 bp, Homo sapiens
catcattccttgagaaaaacaa

SEQ ID NO: 138583 - DNA, 21 bp, Homo sapiens
catcattctctgtctcatcca

SEQ ID NO: 138584 - DNA, 24 bp, Homo sapiens
catcattctctgtctcatccatca

SEQ ID NO: 138585 - DNA, 14 bp, Homo sapiens
catccaatgctcaa

SEQ ID NO: 138586 - DNA, 19 bp, Homo sapiens
catccatgtttgtaaaact

SEQ ID NO: 138587 - DNA, 16 bp, Homo sapiens
catccattcctcaggg

SEQ ID NO: 138588 - DNA, 18 bp, Homo sapiens
catccattcctcagggac

SEQ ID NO: 138589 - DNA, 19 bp, Homo sapiens
catccattcctcagggaca

SEQ ID NO: 138590 - DNA, 23 bp, Homo sapiens
catcccaaaatcataagatattt

SEQ ID NO: 138591 - DNA, 19 bp, Homo sapiens
catcccaggacaccacacc

SEQ ID NO: 138592 - DNA, 20 bp, Homo sapiens
catcccatgatgtagtgcct

SEQ ID NO: 138593 - DNA, 17 bp, Homo sapiens
catcccattgccctggt

SEQ ID NO: 138594 - DNA, 14 bp, Homo sapiens
catcccctggactg

SEQ ID NO: 138595 - DNA, 16 bp, Homo sapiens
catccctgcctggtca

SEQ ID NO: 138596 - DNA, 16 bp, Homo sapiens
catccctttttgaagt

SEQ ID NO: 138597 - DNA, 17 bp, Homo sapiens
catccctttttgaagtg

SEQ ID NO: 138598 - DNA, 18 bp, Homo sapiens
catccctttttgaagtgt

SEQ ID NO: 138599 - DNA, 15 bp, Homo sapiens
catccgaggcagggt

SEQ ID NO: 138600 - DNA, 16 bp, Homo sapiens
catccgaggcagggtc

SEQ ID NO: 138601 - DNA, 15 bp, Homo sapiens
catccggcagcctgg

SEQ ID NO: 138602 - DNA, 16 bp, Homo sapiens
catccggcagcctgga

SEQ ID NO: 138603 - DNA, 17 bp, Homo sapiens
catccgtagttccctga

SEQ ID NO: 138604 - DNA, 18 bp, Homo sapiens
catccgtagttccctgaa

SEQ ID NO: 138605 - DNA, 14 bp, Homo sapiens
catcctttccagca

SEQ ID NO: 138606 - DNA, 13 bp, Homo sapiens
catcgggctgagg

SEQ ID NO: 138607 - DNA, 19 bp, Homo sapiens
catctaacctcatcttctt

SEQ ID NO: 138608 - DNA, 14 bp, Homo sapiens
catctatttctgag

SEQ ID NO: 138609 - DNA, 14 bp, Homo sapiens
catctcaaccatcc

SEQ ID NO: 138610 - DNA, 16 bp, Homo sapiens
catctcaggggccaga

SEQ ID NO: 138611 - DNA, 20 bp, Homo sapiens
catctccacctgctcccagg

SEQ ID NO: 138612 - DNA, 16 bp, Homo sapiens
catctctacaaaaagc

SEQ ID NO: 138613 - DNA, 13 bp, Homo sapiens
catctgaaagcca

SEQ ID NO: 138614 - DNA, 18 bp, Homo sapiens
ccgtacaacgtgtcctca

SEQ ID NO: 138615 - DNA, 22 bp, Homo sapiens
ccgtagttccctgaaaacccag

SEQ ID NO: 138616 - DNA, 20 bp, Homo sapiens
ccgtcagtatcaggcctgcc

SEQ ID NO: 138617 - DNA, 21 bp, Homo sapiens
ccgtcatggcttaatgtttat

SEQ ID NO: 138618 - DNA, 14 bp, Homo sapiens
ccgtcctcacccct

SEQ ID NO: 138619 - DNA, 20 bp, Homo sapiens
ccgtcctcacccctgtcctc

SEQ ID NO: 138620 - DNA, 13 bp, Homo sapiens
ccgtgcagactgg

SEQ ID NO: 138621 - DNA, 17 bp, Homo sapiens
ccgtgcagactggaggg

SEQ ID NO: 138622 - DNA, 16 bp, Homo sapiens
ccgtgccttcagctct

SEQ ID NO: 138623 - DNA, 20 bp, Homo sapiens
ccgtgcttgtttgctcacct

SEQ ID NO: 138624 - DNA, 22 bp, Homo sapiens
ccgtgcttgtttgctcacctgg

SEQ ID NO: 138625 - DNA, 23 bp, Homo sapiens
ccgtgcttgtttgctcacctggg

SEQ ID NO: 138626 - DNA, 23 bp, Homo sapiens
ccgtggcatcaccttaggcaggg

SEQ ID NO: 138627 - DNA, 11 bp, Homo sapiens
ccgtggcttcc

SEQ ID NO: 138628 - DNA, 14 bp, Homo sapiens
ccgtggcttcccgc

SEQ ID NO: 138629 - DNA, 21 bp, Homo sapiens
ccgtggcttcccgctcagccc

SEQ ID NO: 138630 - DNA, 14 bp, Homo sapiens
ccgtgggctccctg

SEQ ID NO: 138631 - DNA, 14 bp, Homo sapiens
ccgttcacattttt

SEQ ID NO: 138632 - DNA, 20 bp, Homo sapiens
ccgttggggattggggaaga

SEQ ID NO: 138633 - DNA, 23 bp, Homo sapiens
ccgtttcatttagtcatgtgacc

SEQ ID NO: 138634 - DNA, 14 bp, Homo sapiens
cctaaaaaagatat

SEQ ID NO: 138635 - DNA, 15 bp, Homo sapiens
cctaacccctttcct

SEQ ID NO: 138636 - DNA, 17 bp, Homo sapiens
cctaagaatctttagag

SEQ ID NO: 138637 - DNA, 14 bp, Homo sapiens
cctaagtggctgct

SEQ ID NO: 138638 - DNA, 16 bp, Homo sapiens
cctaagtggctgctga

SEQ ID NO: 138639 - DNA, 21 bp, Homo sapiens
cctacagttgaaaaacagctg

SEQ ID NO: 138640 - DNA, 17 bp, Homo sapiens
cctaccaatagattccc

SEQ ID NO: 138641 - DNA, 23 bp, Homo sapiens
cctaccaatagattccccattgc

SEQ ID NO: 138642 - DNA, 13 bp, Homo sapiens
cctacttcctgtg

SEQ ID NO: 138643 - DNA, 13 bp, Homo sapiens
cctagcccaggag

SEQ ID NO: 138644 - DNA, 15 bp, Homo sapiens
cctagcccaggagag

SEQ ID NO: 138645 - DNA, 19 bp, Homo sapiens
ccaagctcacagttcctcg

SEQ ID NO: 138646 - DNA, 14 bp, Homo sapiens
ccaagctccttggg

SEQ ID NO: 138647 - DNA, 22 bp, Homo sapiens
ccaagctccttgggaggcccca

SEQ ID NO: 138648 - DNA, 12 bp, Homo sapiens
ccaaggaggatt

SEQ ID NO: 138649 - DNA, 18 bp, Homo sapiens
ccaaggctagaaccacct

SEQ ID NO: 138650 - DNA, 22 bp, Homo sapiens
ccaagggcaaaattcccaggga

SEQ ID NO: 138651 - DNA, 24 bp, Homo sapiens
ccaagggcaaaattcccagggaag

SEQ ID NO: 138652 - DNA, 21 bp, Homo sapiens
ccaagggctttgttttgcaca

SEQ ID NO: 138653 - DNA, 15 bp, Homo sapiens
ccaaggggcagtctg

SEQ ID NO: 138654 - DNA, 18 bp, Homo sapiens
ccaaggggtgggccacag

SEQ ID NO: 138655 - DNA, 13 bp, Homo sapiens
ccaaggtgggagg

SEQ ID NO: 138656 - DNA, 14 bp, Homo sapiens
ccaagtatttatta

SEQ ID NO: 138657 - DNA, 16 bp, Homo sapiens
ccaagtggctcccaca

SEQ ID NO: 138658 - DNA, 14 bp, Homo sapiens
ccaagtgtgtgtgc

SEQ ID NO: 138659 - DNA, 18 bp, Homo sapiens
ccaatagattccccattg

SEQ ID NO: 138660 - DNA, 16 bp, Homo sapiens
ccaatattcatagcag

SEQ ID NO: 138661 - DNA, 20 bp, Homo sapiens
ccaatattcatagcagctta

SEQ ID NO: 138662 - DNA, 18 bp, Homo sapiens
ccaatatttctcagacat

SEQ ID NO: 138663 - DNA, 12 bp, Homo sapiens
ccaatcatttta

SEQ ID NO: 138664 - DNA, 15 bp, Homo sapiens
ccaatgaaaaaatgt

SEQ ID NO: 138665 - DNA, 21 bp, Homo sapiens
ccaattcaaccctttgcccca

SEQ ID NO: 138666 - DNA, 13 bp, Homo sapiens
ccacaaaaattga

SEQ ID NO: 138667 - DNA, 23 bp, Homo sapiens
ccacaaaataaccaatcctggac

SEQ ID NO: 138668 - DNA, 19 bp, Homo sapiens
ccacaagattcccagagac

SEQ ID NO: 138669 - DNA, 13 bp, Homo sapiens
ccacacccagcct

SEQ ID NO: 138670 - DNA, 14 bp, Homo sapiens
ccacacccagcctc

SEQ ID NO: 138671 - DNA, 11 bp, Homo sapiens
ccacaccctcc

SEQ ID NO: 138672 - DNA, 14 bp, Homo sapiens
ccacacctggcact

SEQ ID NO: 138673 - DNA, 17 bp, Homo sapiens
ccacacctggcactgct

SEQ ID NO: 138674 - DNA, 18 bp, Homo sapiens
ccacacctggcactgctg

SEQ ID NO: 138675 - DNA, 15 bp, Homo sapiens
ccacagacaaggtag

SEQ ID NO: 138676 - DNA, 18 bp, Homo sapiens
ccacagcagttgaaaaga

SEQ ID NO: 138677 - DNA, 23 bp, Homo sapiens
ccacagcagttgaaaagactcca

SEQ ID NO: 138678 - DNA, 16 bp, Homo sapiens
ccacaggacatttctc

SEQ ID NO: 138679 - DNA, 15 bp, Homo sapiens
ccacaggcccttcct

SEQ ID NO: 138680 - DNA, 22 bp, Homo sapiens
ccacaggcccttcctctccact

SEQ ID NO: 138681 - DNA, 23 bp, Homo sapiens
ccacaggcccttcctctccactg

SEQ ID NO: 138682 - DNA, 14 bp, Homo sapiens
ccacagtcaaagaa

SEQ ID NO: 138683 - DNA, 16 bp, Homo sapiens
ccacagtcaaagaagg

SEQ ID NO: 138684 - DNA, 12 bp, Homo sapiens
ccaccaacccat

SEQ ID NO: 138685 - DNA, 15 bp, Homo sapiens
ccaccaaccctcaga

SEQ ID NO: 138686 - DNA, 19 bp, Homo sapiens
ccaccacgatgtggccctg

SEQ ID NO: 138687 - DNA, 17 bp, Homo sapiens
ccaccagagaccgtcct

SEQ ID NO: 138688 - DNA, 20 bp, Homo sapiens
ccaccagagaccgtcctcac

SEQ ID NO: 138689 - DNA, 16 bp, Homo sapiens
ccaccatggccagcca

SEQ ID NO: 138690 - DNA, 11 bp, Homo sapiens
ccacccagccc

SEQ ID NO: 138691 - DNA, 13 bp, Homo sapiens
ccacccagcccat

SEQ ID NO: 138692 - DNA, 18 bp, Homo sapiens
ccaccccagctgctcccc

SEQ ID NO: 138693 - DNA, 19 bp, Homo sapiens
ccaccccagtgcacccact

SEQ ID NO: 138694 - DNA, 22 bp, Homo sapiens
ccaccccagtgcacccactctg

SEQ ID NO: 138695 - DNA, 23 bp, Homo sapiens
ccaccccatgtcaccggatcctg

SEQ ID NO: 138696 - DNA, 22 bp, Homo sapiens
ccaccccccagaacctgtcctt

SEQ ID NO: 138697 - DNA, 16 bp, Homo sapiens
ccaccccctccccagg

SEQ ID NO: 138698 - DNA, 17 bp, Homo sapiens
ccaccccctccccaggg

SEQ ID NO: 138699 - DNA, 12 bp, Homo sapiens
ccacccccttca

SEQ ID NO: 138700 - DNA, 16 bp, Homo sapiens
ccacccctccttcctt

SEQ ID NO: 138701 - DNA, 20 bp, Homo sapiens
ccacccttggaggctgtctt

SEQ ID NO: 138702 - DNA, 14 bp, Homo sapiens
ccaccgctgcctaa

SEQ ID NO: 138703 - DNA, 21 bp, Homo sapiens
ccaccgctgcctaagtggctg

SEQ ID NO: 138704 - DNA, 19 bp, Homo sapiens
ccaccgggctgggagctct

SEQ ID NO: 138705 - DNA, 22 bp, Homo sapiens
ccaccgggctgggagctctgca

SEQ ID NO: 138706 - DNA, 12 bp, Homo sapiens
ccacctcagcct

SEQ ID NO: 138707 - DNA, 14 bp, Homo sapiens
ccacctcagccttg

SEQ ID NO: 138708 - DNA, 17 bp, Homo sapiens
ccacctcccacaaagga

SEQ ID NO: 138709 - DNA, 13 bp, Homo sapiens
ccacctccccacg

SEQ ID NO: 138710 - DNA, 23 bp, Homo sapiens
ccacctccccacgccctcccctc

SEQ ID NO: 138711 - DNA, 16 bp, Homo sapiens
ccacctccccaggccg

SEQ ID NO: 138712 - DNA, 23 bp, Homo sapiens
ccacctccccaggccgtggctgc

SEQ ID NO: 138713 - DNA, 17 bp, Homo sapiens
ccacctcccctatccac

SEQ ID NO: 138714 - DNA, 22 bp, Homo sapiens
ccacctcccctatccacccagc

SEQ ID NO: 138715 - DNA, 11 bp, Homo sapiens
ccacctctgcg

SEQ ID NO: 138716 - DNA, 13 bp, Homo sapiens
ccacctctgcgga

SEQ ID NO: 138717 - DNA, 18 bp, Homo sapiens
ccacctctgcggacccca

SEQ ID NO: 138718 - DNA, 19 bp, Homo sapiens
ccacctctgcggaccccag

SEQ ID NO: 138719 - DNA, 15 bp, Homo sapiens
ccacctctgtgacct

SEQ ID NO: 138720 - DNA, 19 bp, Homo sapiens
ccacctctgtgacctcagg

SEQ ID NO: 138721 - DNA, 23 bp, Homo sapiens
ccacctgctgagagacccaagga

SEQ ID NO: 138722 - DNA, 21 bp, Homo sapiens
ccacctggccccatgtctctc

SEQ ID NO: 138723 - DNA, 11 bp, Homo sapiens
ccacctgtctc

SEQ ID NO: 138724 - DNA, 17 bp, Homo sapiens
ccacctttattaaaatc

SEQ ID NO: 138725 - DNA, 15 bp, Homo sapiens
ccacgaatttgctgg

SEQ ID NO: 138726 - DNA, 23 bp, Homo sapiens
ccacgaatttgctggggaatctc

SEQ ID NO: 138727 - DNA, 16 bp, Homo sapiens
ccacgactgtctccat

SEQ ID NO: 138728 - DNA, 17 bp, Homo sapiens
ccacgatgtggccctgg

SEQ ID NO: 138729 - DNA, 20 bp, Homo sapiens
ccacgccctcccctcccctg

SEQ ID NO: 138730 - DNA, 22 bp, Homo sapiens
ccacgccctcccctcccctgct

SEQ ID NO: 138731 - DNA, 19 bp, Homo sapiens
ccacggacgtttccatcag

SEQ ID NO: 138732 - DNA, 20 bp, Homo sapiens
ccacggacgtttccatcagg

SEQ ID NO: 138733 - DNA, 14 bp, Homo sapiens
ccacgtgccaggcc

SEQ ID NO: 138734 - DNA, 20 bp, Homo sapiens
ccacgttccttactgcagaa

SEQ ID NO: 138735 - DNA, 21 bp, Homo sapiens
ccacgttccttactgcagaat

SEQ ID NO: 138736 - DNA, 16 bp, Homo sapiens
ccactcaagccaagca

SEQ ID NO: 138737 - DNA, 17 bp, Homo sapiens
ccactccagacccctgg

SEQ ID NO: 138738 - DNA, 20 bp, Homo sapiens
ccactccagacccctggctt

SEQ ID NO: 138739 - DNA, 20 bp, Homo sapiens
ccactccagctccttcgctt

SEQ ID NO: 138740 - DNA, 18 bp, Homo sapiens
ccactcgcttcccccata

SEQ ID NO: 138741 - DNA, 17 bp, Homo sapiens
ccactctcattccccag

SEQ ID NO: 138742 - DNA, 16 bp, Homo sapiens
ccactctgcctctgcc

SEQ ID NO: 138743 - DNA, 21 bp, Homo sapiens
ccactgcatcgtttcatcttc

SEQ ID NO: 138744 - DNA, 14 bp, Homo sapiens
ccactgcctactgc

SEQ ID NO: 138745 - DNA, 16 bp, Homo sapiens
ccactgcctcttcctc

SEQ ID NO: 138746 - DNA, 11 bp, Homo sapiens
ccactggggaa

SEQ ID NO: 138747 - DNA, 24 bp, Homo sapiens
ccactgtcactgtttctctgctgt

SEQ ID NO: 138748 - DNA, 14 bp, Homo sapiens
ccactgtgaagaga

SEQ ID NO: 138749 - DNA, 21 bp, Homo sapiens
ccacttagaaattgcatttcc

SEQ ID NO: 138750 - DNA, 13 bp, Homo sapiens
ccacttcaataga

SEQ ID NO: 138751 - DNA, 20 bp, Homo sapiens
ccacttcttgttccccactg

SEQ ID NO: 138752 - DNA, 17 bp, Homo sapiens
ccagaaattagaaacct

SEQ ID NO: 138753 - DNA, 19 bp, Homo sapiens
ccagaacacactccatcag

SEQ ID NO: 138754 - DNA, 22 bp, Homo sapiens
ccagaacacactccatcagctt

SEQ ID NO: 138755 - DNA, 12 bp, Homo sapiens
ccagaactggac

SEQ ID NO: 138756 - DNA, 23 bp, Homo sapiens
cccatgtatttatctctatttaa

SEQ ID NO: 138757 - DNA, 19 bp, Homo sapiens
cccatgtgtgagtgtgtgc

SEQ ID NO: 138758 - DNA, 18 bp, Homo sapiens
cccattctctctcctgtc

SEQ ID NO: 138759 - DNA, 16 bp, Homo sapiens
ccccaaagctttcctg

SEQ ID NO: 138760 - DNA, 18 bp, Homo sapiens
ccccaaagctttcctgcc

SEQ ID NO: 138761 - DNA, 19 bp, Homo sapiens
ccccaaagctttcctgccc

SEQ ID NO: 138762 - DNA, 17 bp, Homo sapiens
ccccaaataagaaggga

SEQ ID NO: 138763 - DNA, 23 bp, Homo sapiens
ccccaagacttggtgtcctttcc

SEQ ID NO: 138764 - DNA, 15 bp, Homo sapiens
ccccaaggggcagtc

SEQ ID NO: 138765 - DNA, 22 bp, Homo sapiens
ccccaaggggcagtctggaggg

SEQ ID NO: 138766 - DNA, 17 bp, Homo sapiens
ccccaccccctccccag

SEQ ID NO: 138767 - DNA, 14 bp, Homo sapiens
ccccacgccctccc

SEQ ID NO: 138768 - DNA, 18 bp, Homo sapiens
ccccactcaccagtgtcc

SEQ ID NO: 138769 - DNA, 20 bp, Homo sapiens
ccccactctcattccccagg

SEQ ID NO: 138770 - DNA, 16 bp, Homo sapiens
ccccactgcaggcccc

SEQ ID NO: 138771 - DNA, 15 bp, Homo sapiens
ccccagaacctgtcc

SEQ ID NO: 138772 - DNA, 11 bp, Homo sapiens
ccccagcacta

SEQ ID NO: 138773 - DNA, 12 bp, Homo sapiens
ccccagcccagg

SEQ ID NO: 138774 - DNA, 22 bp, Homo sapiens
ccccagcccctagcccaggaga

SEQ ID NO: 138775 - DNA, 19 bp, Homo sapiens
ccccagccctggctctgca

SEQ ID NO: 138776 - DNA, 19 bp, Homo sapiens
ccccaggccccaggaagcc

SEQ ID NO: 138777 - DNA, 23 bp, Homo sapiens
ccccaggcctgaaagaggctgag

SEQ ID NO: 138778 - DNA, 14 bp, Homo sapiens
ccccagggcctgag

SEQ ID NO: 138779 - DNA, 19 bp, Homo sapiens
ccccagggcctgagcctgg

SEQ ID NO: 138780 - DNA, 23 bp, Homo sapiens
ccccaggtggctgacccagtccc

SEQ ID NO: 138781 - DNA, 22 bp, Homo sapiens
ccccaggtggttatggagaggg

SEQ ID NO: 138782 - DNA, 16 bp, Homo sapiens
ccccagtaagccactg

SEQ ID NO: 138783 - DNA, 18 bp, Homo sapiens
ccccagtaagccactgcc

SEQ ID NO: 138784 - DNA, 16 bp, Homo sapiens
ccccagtgcacccact

SEQ ID NO: 138785 - DNA, 12 bp, Homo sapiens
ccccatagccac

SEQ ID NO: 138786 - DNA, 20 bp, Homo sapiens
ccccatcagtgctccctcac

SEQ ID NO: 138787 - DNA, 16 bp, Homo sapiens
ccccatcccacaccct

SEQ ID NO: 138788 - DNA, 19 bp, Homo sapiens
ccccatctgggtccttgca

SEQ ID NO: 138789 - DNA, 17 bp, Homo sapiens
ccccattgcctcctcct

SEQ ID NO: 138790 - DNA, 15 bp, Homo sapiens
ccccattgtggtcac

SEQ ID NO: 138791 - DNA, 20 bp, Homo sapiens
ccccatttctatttatttac

SEQ ID NO: 138792 - DNA, 14 bp, Homo sapiens
cccccactccagct

SEQ ID NO: 138793 - DNA, 21 bp, Homo sapiens
cccccactctcattccccagg

SEQ ID NO: 138794 - DNA, 14 bp, Homo sapiens
cccccagctgtggg

SEQ ID NO: 138795 - DNA, 16 bp, Homo sapiens
cccccaggctgctgga

SEQ ID NO: 138796 - DNA, 12 bp, Homo sapiens
ccccccactgca

SEQ ID NO: 138797 - DNA, 12 bp, Homo sapiens
ccccctctgtcc

SEQ ID NO: 138798 - DNA, 19 bp, Homo sapiens
ccccctggggcttctcctg

SEQ ID NO: 138799 - DNA, 14 bp, Homo sapiens
cccccttcagtgcc

SEQ ID NO: 138800 - DNA, 23 bp, Homo sapiens
cccccttcagtgcccaccaacat

SEQ ID NO: 138801 - DNA, 14 bp, Homo sapiens
ccccgcagacctcc

SEQ ID NO: 138802 - DNA, 21 bp, Homo sapiens
ccccgcagacctccccagccc

SEQ ID NO: 138803 - DNA, 17 bp, Homo sapiens
ccccgcttgtccagcgc

SEQ ID NO: 138804 - DNA, 19 bp, Homo sapiens
ccccgcttgtccagcgcct

SEQ ID NO: 138805 - DNA, 17 bp, Homo sapiens
ccccggccacctctgcg

SEQ ID NO: 138806 - DNA, 15 bp, Homo sapiens
ccccggtcccttgag

SEQ ID NO: 138807 - DNA, 18 bp, Homo sapiens
cccctaatgcctgcggag

SEQ ID NO: 138808 - DNA, 12 bp, Homo sapiens
cccctagcccag

SEQ ID NO: 138809 - DNA, 17 bp, Homo sapiens
cccctagcccaggagag

SEQ ID NO: 138810 - DNA, 20 bp, Homo sapiens
cccctagcccaggagagaga

SEQ ID NO: 138811 - DNA, 16 bp, Homo sapiens
cccctatccacccagc

SEQ ID NO: 138812 - DNA, 19 bp, Homo sapiens
cccctatccacccagccca

SEQ ID NO: 138813 - DNA, 15 bp, Homo sapiens
cccctcaacacctct

SEQ ID NO: 138814 - DNA, 14 bp, Homo sapiens
cccctcacagcctc

SEQ ID NO: 138815 - DNA, 14 bp, Homo sapiens
cccctcactctggc

SEQ ID NO: 138816 - DNA, 12 bp, Homo sapiens
cccctcccagaa

SEQ ID NO: 138817 - DNA, 15 bp, Homo sapiens
cccctccccagggga

SEQ ID NO: 138818 - DNA, 19 bp, Homo sapiens
cccctcccctaatgcctgc

SEQ ID NO: 138819 - DNA, 15 bp, Homo sapiens
cccctcccctgctgc

SEQ ID NO: 138820 - DNA, 18 bp, Homo sapiens
cccctcccctgctgcagg

SEQ ID NO: 138821 - DNA, 17 bp, Homo sapiens
cccctccttccttgacc

SEQ ID NO: 138822 - DNA, 12 bp, Homo sapiens
cccctccttctc

SEQ ID NO: 138823 - DNA, 23 bp, Homo sapiens
cccctgccagggcagggccccag

SEQ ID NO: 138824 - DNA, 15 bp, Homo sapiens
cccctgccagtgcct

SEQ ID NO: 138825 - DNA, 16 bp, Homo sapiens
cccctgccagtgcctt

SEQ ID NO: 138826 - DNA, 19 bp, Homo sapiens
cccctggggcttctcctga

SEQ ID NO: 138827 - DNA, 13 bp, Homo sapiens
cccctgtcctcac

SEQ ID NO: 138828 - DNA, 14 bp, Homo sapiens
cccctgtcctcact

SEQ ID NO: 138829 - DNA, 13 bp, Homo sapiens
ccccttcagtgcc

SEQ ID NO: 138830 - DNA, 16 bp, Homo sapiens
ccccttcatcctctga

SEQ ID NO: 138831 - DNA, 17 bp, Homo sapiens
ccccttgcccagggctc

SEQ ID NO: 138832 - DNA, 22 bp, Homo sapiens
ccccttgctctcccctgccctg

SEQ ID NO: 138833 - DNA, 20 bp, Homo sapiens
cccctttgatgattaattca

SEQ ID NO: 138834 - DNA, 18 bp, Homo sapiens
cccgcaatgtgcccccag

SEQ ID NO: 138835 - DNA, 14 bp, Homo sapiens
cccgcagacctccc

SEQ ID NO: 138836 - DNA, 19 bp, Homo sapiens
cccgcagacctccccagcc

SEQ ID NO: 138837 - DNA, 13 bp, Homo sapiens
cccgctcagccct

SEQ ID NO: 138838 - DNA, 14 bp, Homo sapiens
cccgcttgtccagc

SEQ ID NO: 138839 - DNA, 14 bp, Homo sapiens
cccggaacaagcct

SEQ ID NO: 138840 - DNA, 17 bp, Homo sapiens
cccggaggggcctggca

SEQ ID NO: 138841 - DNA, 23 bp, Homo sapiens
cccgggaggcagaggttgcagtg

SEQ ID NO: 138842 - DNA, 20 bp, Homo sapiens
cccgtcgaggggctctcagc

SEQ ID NO: 138843 - DNA, 15 bp, Homo sapiens
cccgtcttcagccta

SEQ ID NO: 138844 - DNA, 17 bp, Homo sapiens
ccctaccacctccccag

SEQ ID NO: 138845 - DNA, 13 bp, Homo sapiens
ccctagcccagga

SEQ ID NO: 138846 - DNA, 20 bp, Homo sapiens
ccctagctccacaccctctc

SEQ ID NO: 138847 - DNA, 16 bp, Homo sapiens
ccctatggggatggtc

SEQ ID NO: 138848 - DNA, 18 bp, Homo sapiens
ccctattagagaagagat

SEQ ID NO: 138849 - DNA, 16 bp, Homo sapiens
ccctcaacacctctgc

SEQ ID NO: 138850 - DNA, 13 bp, Homo sapiens
ccctcacagcctc

SEQ ID NO: 138851 - DNA, 18 bp, Homo sapiens
ccctcacagcctctgacc

SEQ ID NO: 138852 - DNA, 16 bp, Homo sapiens
ccctcaccctgcctta

SEQ ID NO: 138853 - DNA, 13 bp, Homo sapiens
ccctcagagccac

SEQ ID NO: 138854 - DNA, 17 bp, Homo sapiens
ccctcatcccgagcacc

SEQ ID NO: 138855 - DNA, 14 bp, Homo sapiens
ccctcatctgtccc

SEQ ID NO: 138856 - DNA, 12 bp, Homo sapiens
ccctccactgtc

SEQ ID NO: 138857 - DNA, 17 bp, Homo sapiens
ccctcccacctctgtga

SEQ ID NO: 138858 - DNA, 14 bp, Homo sapiens
ccctcccccactgc

SEQ ID NO: 138859 - DNA, 12 bp, Homo sapiens
ccctcccctccc

SEQ ID NO: 138860 - DNA, 16 bp, Homo sapiens
ccctcccctgctgcag

SEQ ID NO: 138861 - DNA, 13 bp, Homo sapiens
ccctccctcctct

SEQ ID NO: 138862 - DNA, 14 bp, Homo sapiens
ccctccctgcccct

SEQ ID NO: 138863 - DNA, 16 bp, Homo sapiens
ccctccgccaggcgag

SEQ ID NO: 138864 - DNA, 14 bp, Homo sapiens
ccctcctcaccccg

SEQ ID NO: 138865 - DNA, 16 bp, Homo sapiens
ccctcctcactggcca

SEQ ID NO: 138866 - DNA, 19 bp, Homo sapiens
ccctcctcactggccatcc

SEQ ID NO: 138867 - DNA, 16 bp, Homo sapiens
ccctcctctgccacct

SEQ ID NO: 138868 - DNA, 11 bp, Homo sapiens
ccctccttcca

SEQ ID NO: 138869 - DNA, 15 bp, Homo sapiens
ccctcgaagcgcgcc

SEQ ID NO: 138870 - DNA, 19 bp, Homo sapiens
ccctcgaagcgcgccactc

SEQ ID NO: 138871 - DNA, 17 bp, Homo sapiens
ccctcgggcgagtcact

SEQ ID NO: 138872 - DNA, 12 bp, Homo sapiens
ccctctctctga

SEQ ID NO: 138873 - DNA, 15 bp, Homo sapiens
ccctctctctgactc

SEQ ID NO: 138874 - DNA, 18 bp, Homo sapiens
ccctctctctgactctca

SEQ ID NO: 138875 - DNA, 14 bp, Homo sapiens
ccctctctgctctg

SEQ ID NO: 138876 - DNA, 15 bp, Homo sapiens
ccctctctgctctgc

SEQ ID NO: 138877 - DNA, 16 bp, Homo sapiens
ccctctctgctctgcg

SEQ ID NO: 138878 - DNA, 21 bp, Homo sapiens
ccctctgcctgaaccttccat

SEQ ID NO: 138879 - DNA, 14 bp, Homo sapiens
ccctctggccctgc

SEQ ID NO: 138880 - DNA, 20 bp, Homo sapiens
ccctctgtccaggcactgag

SEQ ID NO: 138881 - DNA, 24 bp, Homo sapiens
ccctctgtccaggcactgagatac

SEQ ID NO: 138882 - DNA, 15 bp, Homo sapiens
ccctgaaagccctga

SEQ ID NO: 138883 - DNA, 18 bp, Homo sapiens
ccctgaagccagccttct

SEQ ID NO: 138884 - DNA, 21 bp, Homo sapiens
ccctgactcattctgaaggag

SEQ ID NO: 138885 - DNA, 13 bp, Homo sapiens
ccctgactgggag

SEQ ID NO: 138886 - DNA, 16 bp, Homo sapiens
ccctgagctttctgct

SEQ ID NO: 138887 - DNA, 17 bp, Homo sapiens
ccctgagtcaccaggaa

SEQ ID NO: 138888 - DNA, 20 bp, Homo sapiens
ccctgcaaaaggactctcag

SEQ ID NO: 138889 - DNA, 19 bp, Homo sapiens
ccctgcaaaatgagaccct

SEQ ID NO: 138890 - DNA, 23 bp, Homo sapiens
ccctgcacaaagcccttccatgt

SEQ ID NO: 138891 - DNA, 13 bp, Homo sapiens
ccctgcactggag

SEQ ID NO: 138892 - DNA, 17 bp, Homo sapiens
ccctgccctagctccac

SEQ ID NO: 138893 - DNA, 13 bp, Homo sapiens
ccctgccctgctg

SEQ ID NO: 138894 - DNA, 13 bp, Homo sapiens
ccctgcctggtca

SEQ ID NO: 138895 - DNA, 22 bp, Homo sapiens
ccctgctgcaggggctctggag

SEQ ID NO: 138896 - DNA, 22 bp, Homo sapiens
ccctgctgccgcctcccagcct

SEQ ID NO: 138897 - DNA, 17 bp, Homo sapiens
ccctggacaagcagagg

SEQ ID NO: 138898 - DNA, 17 bp, Homo sapiens
ccctggaccagtggtct

SEQ ID NO: 138899 - DNA, 13 bp, Homo sapiens
ccctggactggga

SEQ ID NO: 138900 - DNA, 20 bp, Homo sapiens
cctgagctcggtggacccag

SEQ ID NO: 138901 - DNA, 22 bp, Homo sapiens
cctgagctcggtggacccaggg

SEQ ID NO: 138902 - DNA, 16 bp, Homo sapiens
cctgagctgaggcagc

SEQ ID NO: 138903 - DNA, 18 bp, Homo sapiens
cctgaggaacccttacag

SEQ ID NO: 138904 - DNA, 23 bp, Homo sapiens
cctgaggaagcgtgaaggccgag

SEQ ID NO: 138905 - DNA, 13 bp, Homo sapiens
cctgatgctgact

SEQ ID NO: 138906 - DNA, 21 bp, Homo sapiens
cctgatggcacttagctatca

SEQ ID NO: 138907 - DNA, 21 bp, Homo sapiens
cctgatggtacaggaaagctc

SEQ ID NO: 138908 - DNA, 22 bp, Homo sapiens
cctgcaaaatttgatgccagga

SEQ ID NO: 138909 - DNA, 19 bp, Homo sapiens
cctgcaaacgctgcctgcc

SEQ ID NO: 138910 - DNA, 20 bp, Homo sapiens
cctgcaagggctccccactg

SEQ ID NO: 138911 - DNA, 19 bp, Homo sapiens
cctgcacctccccccactg

SEQ ID NO: 138912 - DNA, 20 bp, Homo sapiens
cctgcacctccccccactgc

SEQ ID NO: 138913 - DNA, 21 bp, Homo sapiens
cctgcacctccccccactgca

SEQ ID NO: 138914 - DNA, 20 bp, Homo sapiens
cctgcactggagtccagtct

SEQ ID NO: 138915 - DNA, 23 bp, Homo sapiens
cctgcactggagtccagtctctt

SEQ ID NO: 138916 - DNA, 15 bp, Homo sapiens
cctgcagcctcctcc

SEQ ID NO: 138917 - DNA, 18 bp, Homo sapiens
cctgcagcctcctcctga

SEQ ID NO: 138918 - DNA, 12 bp, Homo sapiens
cctgcagcctgg

SEQ ID NO: 138919 - DNA, 16 bp, Homo sapiens
cctgcagcctggaggc

SEQ ID NO: 138920 - DNA, 20 bp, Homo sapiens
cctgcaggacctgcctgtag

SEQ ID NO: 138921 - DNA, 17 bp, Homo sapiens
cctgcaggtgctgctgc

SEQ ID NO: 138922 - DNA, 20 bp, Homo sapiens
cctgcagtactttacctcct

SEQ ID NO: 138923 - DNA, 18 bp, Homo sapiens
cctgcatccccttggctg

SEQ ID NO: 138924 - DNA, 19 bp, Homo sapiens
cctgcatccgtagttccct

SEQ ID NO: 138925 - DNA, 22 bp, Homo sapiens
cctgcatccgtagttccctgaa

SEQ ID NO: 138926 - DNA, 21 bp, Homo sapiens
cctgcatgtaaacacgcctgc

SEQ ID NO: 138927 - DNA, 16 bp, Homo sapiens
cctgccacctgctgct

SEQ ID NO: 138928 - DNA, 16 bp, Homo sapiens
cctgccacctggggca

SEQ ID NO: 138929 - DNA, 12 bp, Homo sapiens
cctgccaggcat

SEQ ID NO: 138930 - DNA, 19 bp, Homo sapiens
cctgccagggcagggcccc

SEQ ID NO: 138931 - DNA, 14 bp, Homo sapiens
cctgccagtgcctt

SEQ ID NO: 138932 - DNA, 17 bp, Homo sapiens
cctgccagtgccttacc

SEQ ID NO: 138933 - DNA, 18 bp, Homo sapiens
cctgccagtgccttacct

SEQ ID NO: 138934 - DNA, 21 bp, Homo sapiens
cctgccagtgccttacctcct

SEQ ID NO: 138935 - DNA, 23 bp, Homo sapiens
cctgccagtgccttacctcctgc

SEQ ID NO: 138936 - DNA, 14 bp, Homo sapiens
cctgcccacacagg

SEQ ID NO: 138937 - DNA, 22 bp, Homo sapiens
cctgcccacacaggttcacgtg

SEQ ID NO: 138938 - DNA, 12 bp, Homo sapiens
cctgcccaggag

SEQ ID NO: 138939 - DNA, 20 bp, Homo sapiens
cctgcccaggagagccagcc

SEQ ID NO: 138940 - DNA, 16 bp, Homo sapiens
cctgcccccaatccat

SEQ ID NO: 138941 - DNA, 22 bp, Homo sapiens
cctgcccccagaccttttatcc

SEQ ID NO: 138942 - DNA, 15 bp, Homo sapiens
cctgcccctcccaga

SEQ ID NO: 138943 - DNA, 15 bp, Homo sapiens
cctgcccctcccttc

SEQ ID NO: 138944 - DNA, 16 bp, Homo sapiens
cctgcccctcccttca

SEQ ID NO: 138945 - DNA, 18 bp, Homo sapiens
cctgcccctcccttcaac

SEQ ID NO: 138946 - DNA, 17 bp, Homo sapiens
cctgcccctgagcccat

SEQ ID NO: 138947 - DNA, 20 bp, Homo sapiens
cctgccctgctgccgcctcc

SEQ ID NO: 138948 - DNA, 19 bp, Homo sapiens
cctgcccttgtcccactca

SEQ ID NO: 138949 - DNA, 16 bp, Homo sapiens
cctgccttcctcctgg

SEQ ID NO: 138950 - DNA, 19 bp, Homo sapiens
cctgcgggcttttccccgg

SEQ ID NO: 138951 - DNA, 12 bp, Homo sapiens
cctgctccagct

SEQ ID NO: 138952 - DNA, 13 bp, Homo sapiens
cctgctccagctg

SEQ ID NO: 138953 - DNA, 14 bp, Homo sapiens
cctgctccagctgt

SEQ ID NO: 138954 - DNA, 22 bp, Homo sapiens
cctgctccagctgttcagctgg

SEQ ID NO: 138955 - DNA, 12 bp, Homo sapiens
cctgctcccagg

SEQ ID NO: 138956 - DNA, 16 bp, Homo sapiens
cctgctcccccacccc

SEQ ID NO: 138957 - DNA, 23 bp, Homo sapiens
cctgctcccccaccccctcccca

SEQ ID NO: 138958 - DNA, 21 bp, Homo sapiens
cctgctctcctcttgccactg

SEQ ID NO: 138959 - DNA, 17 bp, Homo sapiens
cctgctgagagacccaa

SEQ ID NO: 138960 - DNA, 21 bp, Homo sapiens
cctgctgagagacccaaggag

SEQ ID NO: 138961 - DNA, 12 bp, Homo sapiens
cctgctgcaggg

SEQ ID NO: 138962 - DNA, 15 bp, Homo sapiens
cctgctgccgcctcc

SEQ ID NO: 138963 - DNA, 18 bp, Homo sapiens
cctgctgccgcctcccag

SEQ ID NO: 138964 - DNA, 16 bp, Homo sapiens
cctgctgggctctcca

SEQ ID NO: 138965 - DNA, 21 bp, Homo sapiens
cctgctttgggctgccctggt

SEQ ID NO: 138966 - DNA, 22 bp, Homo sapiens
cctgctttgggctgccctggtg

SEQ ID NO: 138967 - DNA, 13 bp, Homo sapiens
cctggaagctgtg

SEQ ID NO: 138968 - DNA, 17 bp, Homo sapiens
cctggaagctgtgtcct

SEQ ID NO: 138969 - DNA, 21 bp, Homo sapiens
cctggacatgaagattctttc

SEQ ID NO: 138970 - DNA, 23 bp, Homo sapiens
cctggacctgccctgggccacac

SEQ ID NO: 138971 - DNA, 13 bp, Homo sapiens
cctggactttcct

SEQ ID NO: 138972 - DNA, 15 bp, Homo sapiens
cctggactttcctgc

SEQ ID NO: 138973 - DNA, 17 bp, Homo sapiens
cctggactttcctgcaa

SEQ ID NO: 138974 - DNA, 16 bp, Homo sapiens
cctggaggatttcatc

SEQ ID NO: 138975 - DNA, 12 bp, Homo sapiens
cctggcagccgt

SEQ ID NO: 138976 - DNA, 22 bp, Homo sapiens
cctggcagccgtgccttcagct

SEQ ID NO: 138977 - DNA, 13 bp, Homo sapiens
cctggccagaggc

SEQ ID NO: 138978 - DNA, 14 bp, Homo sapiens
cctggcccactgca

SEQ ID NO: 138979 - DNA, 14 bp, Homo sapiens
cctggccccatgtc

SEQ ID NO: 138980 - DNA, 20 bp, Homo sapiens
cctggccccatgtctctcag

SEQ ID NO: 138981 - DNA, 22 bp, Homo sapiens
cctggctctgcaatgggcactg

SEQ ID NO: 138982 - DNA, 13 bp, Homo sapiens
cctggctcttgtg

SEQ ID NO: 138983 - DNA, 20 bp, Homo sapiens
cctggctcttgtgctggatg

SEQ ID NO: 138984 - DNA, 22 bp, Homo sapiens
cctggcttgtaactccaccaac

SEQ ID NO: 138985 - DNA, 20 bp, Homo sapiens
cctgggaggtcaaggctgca

SEQ ID NO: 138986 - DNA, 23 bp, Homo sapiens
cctgggaggtggaggttgcagtg

SEQ ID NO: 138987 - DNA, 13 bp, Homo sapiens
cctgggcaaagcc

SEQ ID NO: 138988 - DNA, 19 bp, Homo sapiens
actggagcaccaggcacga

SEQ ID NO: 138989 - DNA, 21 bp, Homo sapiens
actggaggggacgctggtaga

SEQ ID NO: 138990 - DNA, 14 bp, Homo sapiens
actggagttacatt

SEQ ID NO: 138991 - DNA, 16 bp, Homo sapiens
actggagttacattaa

SEQ ID NO: 138992 - DNA, 22 bp, Homo sapiens
actggctcatattcctgcagcc

SEQ ID NO: 138993 - DNA, 17 bp, Homo sapiens
actggggatgtgggagg

SEQ ID NO: 138994 - DNA, 20 bp, Homo sapiens
actggggtcctggggcctcg

SEQ ID NO: 138995 - DNA, 20 bp, Homo sapiens
actggtcctgtgtgcagtga

SEQ ID NO: 138996 - DNA, 22 bp, Homo sapiens
actggtggcccgacagcctggc

SEQ ID NO: 138997 - DNA, 22 bp, Homo sapiens
actggtgttatcaccgtgggct

SEQ ID NO: 138998 - DNA, 13 bp, Homo sapiens
actgtaacacttt

SEQ ID NO: 138999 - DNA, 20 bp, Homo sapiens
actgtaacactttacaatgt

SEQ ID NO: 139000 - DNA, 13 bp, Homo sapiens
actgtactcctcc

SEQ ID NO: 139001 - DNA, 16 bp, Homo sapiens
actgtcactgtttctc

SEQ ID NO: 139002 - DNA, 21 bp, Homo sapiens
actgtcagctcccctcggaga

SEQ ID NO: 139003 - DNA, 22 bp, Homo sapiens
actgtcagctcccctcggagaa

SEQ ID NO: 139004 - DNA, 14 bp, Homo sapiens
actgtccagagagc

SEQ ID NO: 139005 - DNA, 23 bp, Homo sapiens
actgtgatcaggctatgtatgga

SEQ ID NO: 139006 - DNA, 11 bp, Homo sapiens
actgtgccttt

SEQ ID NO: 139007 - DNA, 15 bp, Homo sapiens
actgtggcacacgcc

SEQ ID NO: 139008 - DNA, 19 bp, Homo sapiens
actgtggctgctagcactt

SEQ ID NO: 139009 - DNA, 13 bp, Homo sapiens
actgttcttgaat

SEQ ID NO: 139010 - DNA, 13 bp, Homo sapiens
actgttgaaaatt

SEQ ID NO: 139011 - DNA, 21 bp, Homo sapiens
actgttgaaaattattttaaa

SEQ ID NO: 139012 - DNA, 18 bp, Homo sapiens
actgttgccagagatgga

SEQ ID NO: 139013 - DNA, 15 bp, Homo sapiens
actgtttctctgctg

SEQ ID NO: 139014 - DNA, 16 bp, Homo sapiens
acttaaaaaaatgaca

SEQ ID NO: 139015 - DNA, 22 bp, Homo sapiens
acttaaaaaaatgacagatgtt

SEQ ID NO: 139016 - DNA, 13 bp, Homo sapiens
acttaaaaaactt

SEQ ID NO: 139017 - DNA, 17 bp, Homo sapiens
acttaaattttaattta

SEQ ID NO: 139018 - DNA, 14 bp, Homo sapiens
acttaacatattta

SEQ ID NO: 139019 - DNA, 13 bp, Homo sapiens
acttaagagaata

SEQ ID NO: 139020 - DNA, 19 bp, Homo sapiens
acttaagagaatattttaa

SEQ ID NO: 139021 - DNA, 17 bp, Homo sapiens
acttaagggagaaaaaa

SEQ ID NO: 139022 - DNA, 14 bp, Homo sapiens
acttaattgctaca

SEQ ID NO: 139023 - DNA, 16 bp, Homo sapiens
acttacactttatgca

SEQ ID NO: 139024 - DNA, 15 bp, Homo sapiens
acttagaaagcaggg

SEQ ID NO: 139025 - DNA, 16 bp, Homo sapiens
acttagaaattgcatt

SEQ ID NO: 139026 - DNA, 15 bp, Homo sapiens
acttaggtgtggggg

SEQ ID NO: 139027 - DNA, 17 bp, Homo sapiens
acttataattttcctaa

SEQ ID NO: 139028 - DNA, 18 bp, Homo sapiens
acttatcctaaaacaaat

SEQ ID NO: 139029 - DNA, 16 bp, Homo sapiens
acttcacacacaggca

SEQ ID NO: 139030 - DNA, 17 bp, Homo sapiens
acttcacacacaggcaa

SEQ ID NO: 139031 - DNA, 17 bp, Homo sapiens
acttcactttaattctc

SEQ ID NO: 139032 - DNA, 14 bp, Homo sapiens
acttcagctctgtt

SEQ ID NO: 139033 - DNA, 16 bp, Homo sapiens
acttcaggctcttctc

SEQ ID NO: 139034 - DNA, 18 bp, Homo sapiens
acttcaggctcttctcct

SEQ ID NO: 139035 - DNA, 22 bp, Homo sapiens
acttcagggttctcctctcccc

SEQ ID NO: 139036 - DNA, 17 bp, Homo sapiens
acttcagtatgttgtca

SEQ ID NO: 139037 - DNA, 19 bp, Homo sapiens
acttcagtatgttgtcaaa

SEQ ID NO: 139038 - DNA, 21 bp, Homo sapiens
acttcagtatgttgtcaaaga

SEQ ID NO: 139039 - DNA, 17 bp, Homo sapiens
acttcatagatttcctt

SEQ ID NO: 139040 - DNA, 14 bp, Homo sapiens
acttcattcttgaa

SEQ ID NO: 139041 - DNA, 10 bp, Homo sapiens
cgcagccctg

SEQ ID NO: 139042 - DNA, 13 bp, Homo sapiens
cgcagccctgctt

SEQ ID NO: 139043 - DNA, 15 bp, Homo sapiens
cgcaggaagctgctc

SEQ ID NO: 139044 - DNA, 12 bp, Homo sapiens
cgccaaggctgg

SEQ ID NO: 139045 - DNA, 23 bp, Homo sapiens
cgccaaggctgggggaagaagct

SEQ ID NO: 139046 - DNA, 22 bp, Homo sapiens
cgccaggggaaaatcagcctgc

SEQ ID NO: 139047 - DNA, 21 bp, Homo sapiens
cgcccctcatttatccctcaa

SEQ ID NO: 139048 - DNA, 16 bp, Homo sapiens
cgccctcccctcccct

SEQ ID NO: 139049 - DNA, 20 bp, Homo sapiens
cgccctcccctcccctgctg

SEQ ID NO: 139050 - DNA, 13 bp, Homo sapiens
cgccgtggctgcg

SEQ ID NO: 139051 - DNA, 20 bp, Homo sapiens
cgcctagtggggtctccctc

SEQ ID NO: 139052 - DNA, 11 bp, Homo sapiens
cgcctcccagc

SEQ ID NO: 139053 - DNA, 10 bp, Homo sapiens
cgcctccccg

SEQ ID NO: 139054 - DNA, 22 bp, Homo sapiens
cgcctccccgaaacaggctact

SEQ ID NO: 139055 - DNA, 13 bp, Homo sapiens
cgcctctgcattc

SEQ ID NO: 139056 - DNA, 13 bp, Homo sapiens
cgcctctgctggc

SEQ ID NO: 139057 - DNA, 20 bp, Homo sapiens
cgcctgaggaacccttacag

SEQ ID NO: 139058 - DNA, 22 bp, Homo sapiens
cgcctgcaaacgctgcctgccc

SEQ ID NO: 139059 - DNA, 22 bp, Homo sapiens
cgcctgcatgtaaacacgcctg

SEQ ID NO: 139060 - DNA, 16 bp, Homo sapiens
cgcctgtaatcccagc

SEQ ID NO: 139061 - DNA, 17 bp, Homo sapiens
cgcctgtaatcccagca

SEQ ID NO: 139062 - DNA, 22 bp, Homo sapiens
cgccttagcactaccactcctg

SEQ ID NO: 139063 - DNA, 15 bp, Homo sapiens
cgcgccactcgcttc

SEQ ID NO: 139064 - DNA, 22 bp, Homo sapiens
cgcgccactcgcttcccccata

SEQ ID NO: 139065 - DNA, 21 bp, Homo sapiens
cgcgtctcctgtttttctggg

SEQ ID NO: 139066 - DNA, 13 bp, Homo sapiens
cgcgtcttcctga

SEQ ID NO: 139067 - DNA, 16 bp, Homo sapiens
cgcgttgtaaaatata

SEQ ID NO: 139068 - DNA, 16 bp, Homo sapiens
cgctcctgtctgccag

SEQ ID NO: 139069 - DNA, 15 bp, Homo sapiens
cgctgccagctctgt

SEQ ID NO: 139070 - DNA, 17 bp, Homo sapiens
cgctgcctaagtggctg

SEQ ID NO: 139071 - DNA, 15 bp, Homo sapiens
cgctgcctgcccaca

SEQ ID NO: 139072 - DNA, 19 bp, Homo sapiens
cgctgtgagcccctggtcc

SEQ ID NO: 139073 - DNA, 14 bp, Homo sapiens
cgctgttcacccac

SEQ ID NO: 139074 - DNA, 22 bp, Homo sapiens
cgctttctagctgttgagctgt

SEQ ID NO: 139075 - DNA, 13 bp, Homo sapiens
cgctttctatgta

SEQ ID NO: 139076 - DNA, 13 bp, Homo sapiens
cggaagagccttg

SEQ ID NO: 139077 - DNA, 18 bp, Homo sapiens
cggaagttttcaatgatg

SEQ ID NO: 139078 - DNA, 15 bp, Homo sapiens
cggaatcctgtcctc

SEQ ID NO: 139079 - DNA, 17 bp, Homo sapiens
cggaatcctgtcctcag

SEQ ID NO: 139080 - DNA, 21 bp, Homo sapiens
cggaatcctgtcctcagcttc

SEQ ID NO: 139081 - DNA, 12 bp, Homo sapiens
cggaccccagct

SEQ ID NO: 139082 - DNA, 20 bp, Homo sapiens
cggaccccagctgtgagcct

SEQ ID NO: 139083 - DNA, 23 bp, Homo sapiens
cggagaagagctgttcacagcca

SEQ ID NO: 139084 - DNA, 17 bp, Homo sapiens
cggagcaaactctgctg

SEQ ID NO: 139085 - DNA, 17 bp, Homo sapiens
cggagccactcctctga

SEQ ID NO: 139086 - DNA, 20 bp, Homo sapiens
cggagcctcatccgaggcag

SEQ ID NO: 139087 - DNA, 18 bp, Homo sapiens
cggatcaccgagagtagc

SEQ ID NO: 139088 - DNA, 23 bp, Homo sapiens
cggatcaccgagagtagccgaga

SEQ ID NO: 139089 - DNA, 13 bp, Homo sapiens
cggcagagaggac

SEQ ID NO: 139090 - DNA, 11 bp, Homo sapiens
cggccacctct

SEQ ID NO: 139091 - DNA, 22 bp, Homo sapiens
cggcccctgcatccccttggct

SEQ ID NO: 139092 - DNA, 15 bp, Homo sapiens
cggccgcattccctg

SEQ ID NO: 139093 - DNA, 16 bp, Homo sapiens
cggccgcattccctga

SEQ ID NO: 139094 - DNA, 19 bp, Homo sapiens
cggccttcaactgaaaaga

SEQ ID NO: 139095 - DNA, 20 bp, Homo sapiens
cggcgcggtggctcacgcct

SEQ ID NO: 139096 - DNA, 14 bp, Homo sapiens
cggctactcagcag

SEQ ID NO: 139097 - DNA, 20 bp, Homo sapiens
cggctactcagcagccctcc

SEQ ID NO: 139098 - DNA, 22 bp, Homo sapiens
cggctgagtcatgatctccctg

SEQ ID NO: 139099 - DNA, 14 bp, Homo sapiens
cgggaaggagggtt

SEQ ID NO: 139100 - DNA, 18 bp, Homo sapiens
cgggacacctgccctgcc

SEQ ID NO: 139101 - DNA, 20 bp, Homo sapiens
cgggaggtcgaggcaggagg

SEQ ID NO: 139102 - DNA, 15 bp, Homo sapiens
cgggcatgggcactc

SEQ ID NO: 139103 - DNA, 16 bp, Homo sapiens
cgggcctggagaacta

SEQ ID NO: 139104 - DNA, 15 bp, Homo sapiens
cgggctcagcaaaag

SEQ ID NO: 139105 - DNA, 18 bp, Homo sapiens
cggggtggtgggaaccat

SEQ ID NO: 139106 - DNA, 19 bp, Homo sapiens
cggggtggtgggaaccatg

SEQ ID NO: 139107 - DNA, 18 bp, Homo sapiens
cgggtggctagtcagaga

SEQ ID NO: 139108 - DNA, 21 bp, Homo sapiens
cggtcccttgagacctcagcc

SEQ ID NO: 139109 - DNA, 22 bp, Homo sapiens
cggtcccttgagacctcagcca

SEQ ID NO: 139110 - DNA, 22 bp, Homo sapiens
cggtcgggttttattgtttaaa

SEQ ID NO: 139111 - DNA, 18 bp, Homo sapiens
cggtgtggagaagcggct

SEQ ID NO: 139112 - DNA, 13 bp, Homo sapiens
cggttcaccagcc

SEQ ID NO: 139113 - DNA, 18 bp, Homo sapiens
cggttccacgtccccctg

SEQ ID NO: 139114 - DNA, 16 bp, Homo sapiens
cggttttactgcagct

SEQ ID NO: 139115 - DNA, 14 bp, Homo sapiens
cgtaacccaactct

SEQ ID NO: 139116 - DNA, 17 bp, Homo sapiens
cgtaataattattatta

SEQ ID NO: 139117 - DNA, 13 bp, Homo sapiens
cgtagttccctga

SEQ ID NO: 139118 - DNA, 14 bp, Homo sapiens
cgtagttccctgaa

SEQ ID NO: 139119 - DNA, 15 bp, Homo sapiens
cgtattggtccagct

SEQ ID NO: 139120 - DNA, 15 bp, Homo sapiens
cgtcatgcttgtgtt

SEQ ID NO: 139121 - DNA, 19 bp, Homo sapiens
cgtcatggcttaatgttta

SEQ ID NO: 139122 - DNA, 20 bp, Homo sapiens
cgtcctcacccctgtcctca

SEQ ID NO: 139123 - DNA, 17 bp, Homo sapiens
cgtcctccccctgccag

SEQ ID NO: 139124 - DNA, 16 bp, Homo sapiens
cgtcgaggggctctca

SEQ ID NO: 139125 - DNA, 19 bp, Homo sapiens
cgtctaagtcatgagctga

SEQ ID NO: 139126 - DNA, 15 bp, Homo sapiens
cgtctgaccctctcc

SEQ ID NO: 139127 - DNA, 18 bp, Homo sapiens
cgtctggggttcagcccc

SEQ ID NO: 139128 - DNA, 19 bp, Homo sapiens
cgtctggggttcagcccct

SEQ ID NO: 139129 - DNA, 17 bp, Homo sapiens
cgtctgtttataaacat

SEQ ID NO: 139130 - DNA, 18 bp, Homo sapiens
cgtgacatccccaccctt

SEQ ID NO: 139131 - DNA, 17 bp, Homo sapiens
cgtgactcacccaagca

SEQ ID NO: 139132 - DNA, 16 bp, Homo sapiens
cgtgactgccccaact

SEQ ID NO: 139133 - DNA, 23 bp, Homo sapiens
cgtgagagtgtcttcacggcagg

SEQ ID NO: 139134 - DNA, 16 bp, Homo sapiens
cgtgcagactggaggg

SEQ ID NO: 139135 - DNA, 17 bp, Homo sapiens
cgtgcagactggagggg

SEQ ID NO: 139136 - DNA, 15 bp, Homo sapiens
cgtgccttcagctct

SEQ ID NO: 139137 - DNA, 16 bp, Homo sapiens
cgtgccttcagctcta

SEQ ID NO: 139138 - DNA, 18 bp, Homo sapiens
cgtgccttcagctctaca

SEQ ID NO: 139139 - DNA, 20 bp, Homo sapiens
cgtggcagataatcagcctc

SEQ ID NO: 139140 - DNA, 23 bp, Homo sapiens
cgtggcatagcccagacacagaa

SEQ ID NO: 139141 - DNA, 15 bp, Homo sapiens
cgtggctctgctggc

SEQ ID NO: 139142 - DNA, 19 bp, Homo sapiens
cgtggctgcggcacccttg

SEQ ID NO: 139143 - DNA, 17 bp, Homo sapiens
cgtgggcggcagagagg

SEQ ID NO: 139144 - DNA, 12 bp, Homo sapiens
cgtggggcagca

SEQ ID NO: 139145 - DNA, 18 bp, Homo sapiens
cgtgtgcacacacaccac

SEQ ID NO: 139146 - DNA, 14 bp, Homo sapiens
cgttaccaggcagg

SEQ ID NO: 139147 - DNA, 20 bp, Homo sapiens
cgttcacccctccacccttg

SEQ ID NO: 139148 - DNA, 21 bp, Homo sapiens
cgttgtaaaatatagctgtac

SEQ ID NO: 139149 - DNA, 24 bp, Homo sapiens
cgttgtaaaatatagctgtacaaa

SEQ ID NO: 139150 - DNA, 13 bp, Homo sapiens
ctaaaaaagatat

SEQ ID NO: 139151 - DNA, 15 bp, Homo sapiens
ctaaaaaagatatat

SEQ ID NO: 139152 - DNA, 20 bp, Homo sapiens
ctaaacgagtcaatcccctc

SEQ ID NO: 139153 - DNA, 12 bp, Homo sapiens
cggaaagcagct

SEQ ID NO: 139154 - DNA, 20 bp, Homo sapiens
cggaaagcagctcaaaggca

SEQ ID NO: 139155 - DNA, 20 bp, Homo sapiens
cggaagcctttttccccaaa

SEQ ID NO: 139156 - DNA, 18 bp, Homo sapiens
cggaatcctgtcctcagc

SEQ ID NO: 139157 - DNA, 15 bp, Homo sapiens
cggacgtttccatca

SEQ ID NO: 139158 - DNA, 16 bp, Homo sapiens
cggacgtttccatcag

SEQ ID NO: 139159 - DNA, 18 bp, Homo sapiens
cggacgtttccatcaggt

SEQ ID NO: 139160 - DNA, 12 bp, Homo sapiens
cggagacagggt

SEQ ID NO: 139161 - DNA, 21 bp, Homo sapiens
cggagccactcctctgactca

SEQ ID NO: 139162 - DNA, 21 bp, Homo sapiens
cggagcctcatccgaggcagg

SEQ ID NO: 139163 - DNA, 17 bp, Homo sapiens
cggagggattcccctaa

SEQ ID NO: 139164 - DNA, 16 bp, Homo sapiens
cggaggggcctggcag

SEQ ID NO: 139165 - DNA, 18 bp, Homo sapiens
cggaggggcctggcagcc

SEQ ID NO: 139166 - DNA, 16 bp, Homo sapiens
cggatctgagaatctt

SEQ ID NO: 139167 - DNA, 19 bp, Homo sapiens
cggcacagggtctgctctt

SEQ ID NO: 139168 - DNA, 11 bp, Homo sapiens
cggcagagagg

SEQ ID NO: 139169 - DNA, 13 bp, Homo sapiens
cggccacctctgc

SEQ ID NO: 139170 - DNA, 19 bp, Homo sapiens
cggcccacagctcccaccc

SEQ ID NO: 139171 - DNA, 17 bp, Homo sapiens
cggcgccaccatcctgc

SEQ ID NO: 139172 - DNA, 16 bp, Homo sapiens
cggctactcagcagcc

SEQ ID NO: 139173 - DNA, 18 bp, Homo sapiens
cggctactcagcagccct

SEQ ID NO: 139174 - DNA, 14 bp, Homo sapiens
cggctggcagccca

SEQ ID NO: 139175 - DNA, 15 bp, Homo sapiens
cgggacacctgccct

SEQ ID NO: 139176 - DNA, 16 bp, Homo sapiens
cgggaggtcgaggcag

SEQ ID NO: 139177 - DNA, 17 bp, Homo sapiens
cgggcatgggcactccc

SEQ ID NO: 139178 - DNA, 21 bp, Homo sapiens
cgggcccttcccacaggacat

SEQ ID NO: 139179 - DNA, 17 bp, Homo sapiens
cgggcgagtcactgcct

SEQ ID NO: 139180 - DNA, 19 bp, Homo sapiens
cgggcgagtcactgcctct

SEQ ID NO: 139181 - DNA, 19 bp, Homo sapiens
cgggctcagcaaaagatgc

SEQ ID NO: 139182 - DNA, 16 bp, Homo sapiens
cgggctgggcagctgt

SEQ ID NO: 139183 - DNA, 21 bp, Homo sapiens
gtcctcactgctccctgaagc

SEQ ID NO: 139184 - DNA, 19 bp, Homo sapiens
gtcctcccatcccctggac

SEQ ID NO: 139185 - DNA, 19 bp, Homo sapiens
gtcctccccctgccagtgc

SEQ ID NO: 139186 - DNA, 15 bp, Homo sapiens
gtcctcccctcacag

SEQ ID NO: 139187 - DNA, 20 bp, Homo sapiens
gtcctcccctcacagcctct

SEQ ID NO: 139188 - DNA, 22 bp, Homo sapiens
gtcctcccctcacagcctctga

SEQ ID NO: 139189 - DNA, 21 bp, Homo sapiens
gtcctcctcggatcaccgaga

SEQ ID NO: 139190 - DNA, 14 bp, Homo sapiens
gtcctcctctgtga

SEQ ID NO: 139191 - DNA, 15 bp, Homo sapiens
gtcctgcctcagcct

SEQ ID NO: 139192 - DNA, 12 bp, Homo sapiens
gtccttccctct

SEQ ID NO: 139193 - DNA, 12 bp, Homo sapiens
gtccttgcacac

SEQ ID NO: 139194 - DNA, 18 bp, Homo sapiens
gtccttgcacccctcact

SEQ ID NO: 139195 - DNA, 14 bp, Homo sapiens
gtccttgcacctgc

SEQ ID NO: 139196 - DNA, 15 bp, Homo sapiens
gtccttgcacctgca

SEQ ID NO: 139197 - DNA, 14 bp, Homo sapiens
gtcgaggggctctc

SEQ ID NO: 139198 - DNA, 19 bp, Homo sapiens
gtcgaggggctctcagctc

SEQ ID NO: 139199 - DNA, 23 bp, Homo sapiens
gtcgggttttattgtttaaaatc

SEQ ID NO: 139200 - DNA, 15 bp, Homo sapiens
gtcgtggcagataat

SEQ ID NO: 139201 - DNA, 22 bp, Homo sapiens
gtcgtggcagataatcagcctc

SEQ ID NO: 139202 - DNA, 23 bp, Homo sapiens
gtcgtggcagataatcagcctct

SEQ ID NO: 139203 - DNA, 10 bp, Homo sapiens
gtctaaactg

SEQ ID NO: 139204 - DNA, 21 bp, Homo sapiens
gtctaggagctgggaggaaaa

SEQ ID NO: 139205 - DNA, 16 bp, Homo sapiens
gtctcaaactcctggg

SEQ ID NO: 139206 - DNA, 20 bp, Homo sapiens
gtctcaaactcctgggctca

SEQ ID NO: 139207 - DNA, 19 bp, Homo sapiens
gtctcacagtgttgcccag

SEQ ID NO: 139208 - DNA, 23 bp, Homo sapiens
gtctcacgggcatgggcactccc

SEQ ID NO: 139209 - DNA, 22 bp, Homo sapiens
gtctcacttgtgcagtgttgac

SEQ ID NO: 139210 - DNA, 15 bp, Homo sapiens
gtctcaggacctagg

SEQ ID NO: 139211 - DNA, 13 bp, Homo sapiens
gtctcaggctggt

SEQ ID NO: 139212 - DNA, 18 bp, Homo sapiens
gtctcaggctggtgggag

SEQ ID NO: 139213 - DNA, 16 bp, Homo sapiens
gtctcagtccacctga

SEQ ID NO: 139214 - DNA, 12 bp, Homo sapiens
gtctcatcccat

SEQ ID NO: 139215 - DNA, 14 bp, Homo sapiens
gtctccatggccct

SEQ ID NO: 139216 - DNA, 13 bp, Homo sapiens
gtctccatgtttg

SEQ ID NO: 139217 - DNA, 18 bp, Homo sapiens
gtctccctctcctgccta

SEQ ID NO: 139218 - DNA, 14 bp, Homo sapiens
gtctcctcttaaaa

SEQ ID NO: 139219 - DNA, 23 bp, Homo sapiens
gtctcctcttaaaaaataaaaac

SEQ ID NO: 139220 - DNA, 18 bp, Homo sapiens
gtctcctttgcaggctca

SEQ ID NO: 139221 - DNA, 16 bp, Homo sapiens
gtctcgctttgttgcc

SEQ ID NO: 139222 - DNA, 17 bp, Homo sapiens
gtctcgctttgttgccc

SEQ ID NO: 139223 - DNA, 23 bp, Homo sapiens
gtctcgggtggctagtcagagag

SEQ ID NO: 139224 - DNA, 12 bp, Homo sapiens
gtctctcagaat

SEQ ID NO: 139225 - DNA, 13 bp, Homo sapiens
gtctctgctggcc

SEQ ID NO: 139226 - DNA, 17 bp, Homo sapiens
gtctctgctggcccagc

SEQ ID NO: 139227 - DNA, 20 bp, Homo sapiens
gtctctgctggcccagccaa

SEQ ID NO: 139228 - DNA, 14 bp, Homo sapiens
gtctgaagcagatg

SEQ ID NO: 139229 - DNA, 18 bp, Homo sapiens
gtctgcagcccggcgcca

SEQ ID NO: 139230 - DNA, 12 bp, Homo sapiens
gtctgcaggcag

SEQ ID NO: 139231 - DNA, 14 bp, Homo sapiens
gtctgccagccagc

SEQ ID NO: 139232 - DNA, 17 bp, Homo sapiens
gtctgccagccagcagc

SEQ ID NO: 139233 - DNA, 15 bp, Homo sapiens
gtctgctctttctct

SEQ ID NO: 139234 - DNA, 20 bp, Homo sapiens
gtctgggaggaatggacaga

SEQ ID NO: 139235 - DNA, 16 bp, Homo sapiens
gtctggggttcagccc

SEQ ID NO: 139236 - DNA, 20 bp, Homo sapiens
gtctggggttcagcccctcc

SEQ ID NO: 139237 - DNA, 17 bp, Homo sapiens
gtctgtttataaacatt

SEQ ID NO: 139238 - DNA, 19 bp, Homo sapiens
gtcttaattaaaagaatat

SEQ ID NO: 139239 - DNA, 19 bp, Homo sapiens
gtcttagaagtggaccagg

SEQ ID NO: 139240 - DNA, 20 bp, Homo sapiens
gtcttagaagtggaccagga

SEQ ID NO: 139241 - DNA, 13 bp, Homo sapiens
gtcttcacaacag

SEQ ID NO: 139242 - DNA, 15 bp, Homo sapiens
gtcttcagcctagcc

SEQ ID NO: 139243 - DNA, 23 bp, Homo sapiens
gtcttcagcctctttctgtccct

SEQ ID NO: 139244 - DNA, 22 bp, Homo sapiens
gtcttcattaagccctcttcca

SEQ ID NO: 139245 - DNA, 17 bp, Homo sapiens
gtcttctccaccacgct

SEQ ID NO: 139246 - DNA, 22 bp, Homo sapiens
gtcttgctatggggagaaaaga

SEQ ID NO: 139247 - DNA, 22 bp, Homo sapiens
gtcttggcagcacctgtctcct

SEQ ID NO: 139248 - DNA, 18 bp, Homo sapiens
gtctttccacggagccac

SEQ ID NO: 139249 - DNA, 22 bp, Homo sapiens
gtctttgtaatgtcaccacctt

SEQ ID NO: 139250 - DNA, 23 bp, Homo sapiens
gtgaaaagaaaaatgagcctggc

SEQ ID NO: 139251 - DNA, 15 bp, Homo sapiens
gtgaaaatggtccag

SEQ ID NO: 139252 - DNA, 17 bp, Homo sapiens
gtgaaagtacatttgga

SEQ ID NO: 139253 - DNA, 21 bp, Homo sapiens
gtgaactgtgagggtaaaggc

SEQ ID NO: 139254 - DNA, 17 bp, Homo sapiens
gtgaacttgggccactg

SEQ ID NO: 139255 - DNA, 20 bp, Homo sapiens
gtgaaggccgagaagcaaga

SEQ ID NO: 139256 - DNA, 14 bp, Homo sapiens
gtgaaggcttctct

SEQ ID NO: 139257 - DNA, 16 bp, Homo sapiens
gtgaataaatgtcttg

SEQ ID NO: 139258 - DNA, 16 bp, Homo sapiens
gtgaatattgttcata

SEQ ID NO: 139259 - DNA, 15 bp, Homo sapiens
gtgaatcagacccta

SEQ ID NO: 139260 - DNA, 23 bp, Homo sapiens
gtgacaccagcctttctcccagg

SEQ ID NO: 139261 - DNA, 16 bp, Homo sapiens
gtgacagacaggctct

SEQ ID NO: 139262 - DNA, 17 bp, Homo sapiens
gtgacagacaggctctt

SEQ ID NO: 139263 - DNA, 16 bp, Homo sapiens
gtgacatgcgggctgg

SEQ ID NO: 139264 - DNA, 17 bp, Homo sapiens
gtgaccaggcatcctcc

SEQ ID NO: 139265 - DNA, 19 bp, Homo sapiens
gtgacctcaggcactagcc

SEQ ID NO: 139266 - DNA, 14 bp, Homo sapiens
gtgacctgaggaag

SEQ ID NO: 139267 - DNA, 18 bp, Homo sapiens
gtgactcatcctcttgaa

SEQ ID NO: 139268 - DNA, 20 bp, Homo sapiens
gtgactctttttagggccag

SEQ ID NO: 139269 - DNA, 15 bp, Homo sapiens
gtgagaactactcag

SEQ ID NO: 139270 - DNA, 17 bp, Homo sapiens
gctaagcaaaatgtgat

SEQ ID NO: 139271 - DNA, 14 bp, Homo sapiens
gctaatcagcattc

SEQ ID NO: 139272 - DNA, 20 bp, Homo sapiens
gctacaaatactcttaggaa

SEQ ID NO: 139273 - DNA, 17 bp, Homo sapiens
gctacaacttcagcagt

SEQ ID NO: 139274 - DNA, 12 bp, Homo sapiens
gctaccctgagc

SEQ ID NO: 139275 - DNA, 14 bp, Homo sapiens
gctaccctgagctg

SEQ ID NO: 139276 - DNA, 19 bp, Homo sapiens
gctaccctgagctgaggca

SEQ ID NO: 139277 - DNA, 12 bp, Homo sapiens
gctactcagcag

SEQ ID NO: 139278 - DNA, 16 bp, Homo sapiens
gctactcagcagccct

SEQ ID NO: 139279 - DNA, 19 bp, Homo sapiens
gctactcagcagccctcct

SEQ ID NO: 139280 - DNA, 24 bp, Homo sapiens
gctactcagcagccctcctcaccc

SEQ ID NO: 139281 - DNA, 19 bp, Homo sapiens
gctactgcagctttacatg

SEQ ID NO: 139282 - DNA, 15 bp, Homo sapiens
gctactgtcagctcc

SEQ ID NO: 139283 - DNA, 13 bp, Homo sapiens
gctacttgggagg

SEQ ID NO: 139284 - DNA, 17 bp, Homo sapiens
gctacttgggaggctga

SEQ ID NO: 139285 - DNA, 21 bp, Homo sapiens
gctagagatatggcagcgaaa

SEQ ID NO: 139286 - DNA, 17 bp, Homo sapiens
gctagcacttggagcca

SEQ ID NO: 139287 - DNA, 22 bp, Homo sapiens
gctagcagcagggagggcttct

SEQ ID NO: 139288 - DNA, 14 bp, Homo sapiens
gctagcgctgccgc

SEQ ID NO: 139289 - DNA, 23 bp, Homo sapiens
gctagcgctgccgcaccccagag

SEQ ID NO: 139290 - DNA, 15 bp, Homo sapiens
gctataaatatataa

SEQ ID NO: 139291 - DNA, 15 bp, Homo sapiens
gctatacctgtgcct

SEQ ID NO: 139292 - DNA, 16 bp, Homo sapiens
gctatacctgtgcctc

SEQ ID NO: 139293 - DNA, 18 bp, Homo sapiens
gctataggtgctacaaaa

SEQ ID NO: 139294 - DNA, 19 bp, Homo sapiens
gctataggtgctacaaaaa

SEQ ID NO: 139295 - DNA, 21 bp, Homo sapiens
gctataggtgctacaaaaaca

SEQ ID NO: 139296 - DNA, 18 bp, Homo sapiens
gctatttccattccagaa

SEQ ID NO: 139297 - DNA, 12 bp, Homo sapiens
gctcaaaggcac

SEQ ID NO: 139298 - DNA, 21 bp, Homo sapiens
gctcaaaggcacagtgaaggc

SEQ ID NO: 139299 - DNA, 22 bp, Homo sapiens
gctcaagcagtctacccacctc

SEQ ID NO: 139300 - DNA, 17 bp, Homo sapiens
gctcaaggcgtgaggat

SEQ ID NO: 139301 - DNA, 17 bp, Homo sapiens
gctcacagttcctcgcc

SEQ ID NO: 139302 - DNA, 11 bp, Homo sapiens
gctcacctggg

SEQ ID NO: 139303 - DNA, 13 bp, Homo sapiens
gctcacgtgtgtg

SEQ ID NO: 139304 - DNA, 19 bp, Homo sapiens
gctcagacccccactctca

SEQ ID NO: 139305 - DNA, 17 bp, Homo sapiens
gctcagcaaaagatgct

SEQ ID NO: 139306 - DNA, 23 bp, Homo sapiens
gctcagcaaaagatgcttctcac

SEQ ID NO: 139307 - DNA, 12 bp, Homo sapiens
gctcagccctcc

SEQ ID NO: 139308 - DNA, 16 bp, Homo sapiens
gctcagccctccctgc

SEQ ID NO: 139309 - DNA, 18 bp, Homo sapiens
gctcagccctccctgccc

SEQ ID NO: 139310 - DNA, 19 bp, Homo sapiens
gctcagccctccctgcccc

SEQ ID NO: 139311 - DNA, 17 bp, Homo sapiens
gctcagcctggtgggcc

SEQ ID NO: 139312 - DNA, 21 bp, Homo sapiens
gctcagctttttgtcttttct

SEQ ID NO: 139313 - DNA, 19 bp, Homo sapiens
gctcaggactcagaagcct

SEQ ID NO: 139314 - DNA, 22 bp, Homo sapiens
gctcaggcgatccacctgtctc

SEQ ID NO: 139315 - DNA, 24 bp, Homo sapiens
gctcaggcgatccacctgtctcag

SEQ ID NO: 139316 - DNA, 20 bp, Homo sapiens
gctcaggggcgtgtggctca

SEQ ID NO: 139317 - DNA, 14 bp, Homo sapiens
gctcatattttgta

SEQ ID NO: 139318 - DNA, 18 bp, Homo sapiens
gctccactgtcaccctcc

SEQ ID NO: 139319 - DNA, 12 bp, Homo sapiens
gctccagagggc

SEQ ID NO: 139320 - DNA, 21 bp, Homo sapiens
gctccagagggcactctgctt

SEQ ID NO: 139321 - DNA, 15 bp, Homo sapiens
gctcccacaggccct

SEQ ID NO: 139322 - DNA, 17 bp, Homo sapiens
gctcccacaggcccttc

SEQ ID NO: 139323 - DNA, 22 bp, Homo sapiens
gctcccacaggcccttcctctc

SEQ ID NO: 139324 - DNA, 18 bp, Homo sapiens
gctcccaccccaccccct

SEQ ID NO: 139325 - DNA, 17 bp, Homo sapiens
gtgccttacctcctgcc

SEQ ID NO: 139326 - DNA, 18 bp, Homo sapiens
gtgccttacctcctgccc

SEQ ID NO: 139327 - DNA, 19 bp, Homo sapiens
gtgccttacctcctgccca

SEQ ID NO: 139328 - DNA, 21 bp, Homo sapiens
gtgcctttgagtttcctcagg

SEQ ID NO: 139329 - DNA, 18 bp, Homo sapiens
gtgccttttttcacggaa

SEQ ID NO: 139330 - DNA, 23 bp, Homo sapiens
gtgcgagtgtgtgcatgtgtgtg

SEQ ID NO: 139331 - DNA, 15 bp, Homo sapiens
gtgcgtccacgagct

SEQ ID NO: 139332 - DNA, 14 bp, Homo sapiens
gtgcgtgggtgaag

SEQ ID NO: 139333 - DNA, 15 bp, Homo sapiens
gtgctacaaaaacac

SEQ ID NO: 139334 - DNA, 20 bp, Homo sapiens
gtgctacaaaaacacagcaa

SEQ ID NO: 139335 - DNA, 22 bp, Homo sapiens
gtgctacaaaaacacagcaagg

SEQ ID NO: 139336 - DNA, 15 bp, Homo sapiens
gtgctccctaccacc

SEQ ID NO: 139337 - DNA, 18 bp, Homo sapiens
gtgctgcccgtcttcagc

SEQ ID NO: 139338 - DNA, 19 bp, Homo sapiens
gtgctgcccgtcttcagcc

SEQ ID NO: 139339 - DNA, 19 bp, Homo sapiens
gtgctgcctctacctgaca

SEQ ID NO: 139340 - DNA, 16 bp, Homo sapiens
gtgctggaggtgggag

SEQ ID NO: 139341 - DNA, 17 bp, Homo sapiens
gtgctggaggtgggagc

SEQ ID NO: 139342 - DNA, 15 bp, Homo sapiens
gtgcttcaattaata

SEQ ID NO: 139343 - DNA, 14 bp, Homo sapiens
gtgcttcgggccct

SEQ ID NO: 139344 - DNA, 17 bp, Homo sapiens
gtgcttcgggcccttcc

SEQ ID NO: 139345 - DNA, 20 bp, Homo sapiens
gtgcttgttccctctccctg

SEQ ID NO: 139346 - DNA, 23 bp, Homo sapiens
gtgcttgtttgctcacctggggt

SEQ ID NO: 139347 - DNA, 17 bp, Homo sapiens
gtggaagccctccttcc

SEQ ID NO: 139348 - DNA, 22 bp, Homo sapiens
gtggacaccaggagtccctggt

SEQ ID NO: 139349 - DNA, 13 bp, Homo sapiens
gtggactggaagg

SEQ ID NO: 139350 - DNA, 18 bp, Homo sapiens
gtggacttagaaagcagg

SEQ ID NO: 139351 - DNA, 22 bp, Homo sapiens
gtggagaaattccttgattcac

SEQ ID NO: 139352 - DNA, 16 bp, Homo sapiens
gtggagaactcctagg

SEQ ID NO: 139353 - DNA, 22 bp, Homo sapiens
gtggcacacacctgtagtccca

SEQ ID NO: 139354 - DNA, 13 bp, Homo sapiens
gtggcaccagcag

SEQ ID NO: 139355 - DNA, 19 bp, Homo sapiens
gtggcaccagcagcctgga

SEQ ID NO: 139356 - DNA, 23 bp, Homo sapiens
gtggccagagctgggaggcatgg

SEQ ID NO: 139357 - DNA, 19 bp, Homo sapiens
gtggcccgacagcctggca

SEQ ID NO: 139358 - DNA, 16 bp, Homo sapiens
gtggccctggcctgct

SEQ ID NO: 139359 - DNA, 19 bp, Homo sapiens
gtggccctggcctgctggg

SEQ ID NO: 139360 - DNA, 22 bp, Homo sapiens
gtggccctgtccctcccacctc

SEQ ID NO: 139361 - DNA, 23 bp, Homo sapiens
gtggccctgtccctcccacctct

SEQ ID NO: 139362 - DNA, 20 bp, Homo sapiens
gtggcctctgccccgtctca

SEQ ID NO: 139363 - DNA, 17 bp, Homo sapiens
gtggcctcttgagcagt

SEQ ID NO: 139364 - DNA, 12 bp, Homo sapiens
gtggccttcccc

SEQ ID NO: 139365 - DNA, 17 bp, Homo sapiens
gtggcggtgcctgggtg

SEQ ID NO: 139366 - DNA, 14 bp, Homo sapiens
gtggctgacccagt

SEQ ID NO: 139367 - DNA, 19 bp, Homo sapiens
gtggctgacccagtccctg

SEQ ID NO: 139368 - DNA, 18 bp, Homo sapiens
gtggcttcccgctcagcc

SEQ ID NO: 139369 - DNA, 20 bp, Homo sapiens
gtggcttcccgctcagccct

SEQ ID NO: 139370 - DNA, 21 bp, Homo sapiens
gtggcttcccgctcagccctc

SEQ ID NO: 139371 - DNA, 13 bp, Homo sapiens
gtgggagaggtct

SEQ ID NO: 139372 - DNA, 15 bp, Homo sapiens
gtgggagcaggagat

SEQ ID NO: 139373 - DNA, 22 bp, Homo sapiens
gtgggagcaggagattgagaag

SEQ ID NO: 139374 - DNA, 12 bp, Homo sapiens
gtgggagctgag

SEQ ID NO: 139375 - DNA, 23 bp, Homo sapiens
gtgggaggatctcttgagcctgg

SEQ ID NO: 139376 - DNA, 13 bp, Homo sapiens
gtgggagggagca

SEQ ID NO: 139377 - DNA, 17 bp, Homo sapiens
gtgggatatccctatgc

SEQ ID NO: 139378 - DNA, 17 bp, Homo sapiens
gtgggatggaggagaag

SEQ ID NO: 139379 - DNA, 24 bp, Homo sapiens
gtgggatgttcagcactgtccctt

SEQ ID NO: 139380 - DNA, 20 bp, Homo sapiens
gtgggcaggtgggagcttga

SEQ ID NO: 139381 - DNA, 20 bp, Homo sapiens
gtgggcattgatggggaagg

SEQ ID NO: 139382 - DNA, 23 bp, Homo sapiens
gtgggcctcctctgtccagggcc

SEQ ID NO: 139383 - DNA, 22 bp, Homo sapiens
gtggggacgtcctgccacctgg

SEQ ID NO: 139384 - DNA, 17 bp, Homo sapiens
gtggggagactgggctg

SEQ ID NO: 139385 - DNA, 14 bp, Homo sapiens
gtggggcagcacag

SEQ ID NO: 139386 - DNA, 23 bp, Homo sapiens
gtggggcagcacagagagggggc

SEQ ID NO: 139387 - DNA, 14 bp, Homo sapiens
gtggggccaggtca

SEQ ID NO: 139388 - DNA, 12 bp, Homo sapiens
gtggggctgctc

SEQ ID NO: 139389 - DNA, 22 bp, Homo sapiens
gtggggtctccctctcctgcct

SEQ ID NO: 139390 - DNA, 15 bp, Homo sapiens
gtgggtacagagagg

SEQ ID NO: 139391 - DNA, 18 bp, Homo sapiens
gtgggtccatgggcagag

SEQ ID NO: 139392 - DNA, 22 bp, Homo sapiens
gtgggtccatgggcagagccca

SEQ ID NO: 139393 - DNA, 19 bp, Homo sapiens
gtgggtggaaccaggaacc

SEQ ID NO: 139394 - DNA, 15 bp, Homo sapiens
gtggtctgcaggcag

SEQ ID NO: 139395 - DNA, 15 bp, Homo sapiens
gtggtgctgacaaag

SEQ ID NO: 139396 - DNA, 23 bp, Homo sapiens
gtggtgtgtccccctctgtccag

SEQ ID NO: 139397 - DNA, 17 bp, Homo sapiens
gtgtaacaggtctcctc

SEQ ID NO: 139398 - DNA, 16 bp, Homo sapiens
gtgtacgtggagaggg

SEQ ID NO: 139399 - DNA, 15 bp, Homo sapiens
gtgtacttaactatt

SEQ ID NO: 139400 - DNA, 12 bp, Homo sapiens
gtgtaggcagac

SEQ ID NO: 139401 - DNA, 14 bp, Homo sapiens
gtgtccatgtgtgt

SEQ ID NO: 139402 - DNA, 16 bp, Homo sapiens
gtgtccatgtgtgtgc

SEQ ID NO: 139403 - DNA, 14 bp, Homo sapiens
gtgtccccctctgt

SEQ ID NO: 139404 - DNA, 13 bp, Homo sapiens
gtgtctaaactgc

SEQ ID NO: 139405 - DNA, 21 bp, Homo sapiens
gtgtctcggagggattcccct

SEQ ID NO: 139406 - DNA, 20 bp, Homo sapiens
gtgtcttctccaccacgctg

SEQ ID NO: 139407 - DNA, 13 bp, Homo sapiens
gtgtgaaaatggg

SEQ ID NO: 139408 - DNA, 14 bp, Homo sapiens
gtgtgaggccaggg

SEQ ID NO: 139409 - DNA, 14 bp, Homo sapiens
gtgtgagtgtgtgc

SEQ ID NO: 139410 - DNA, 16 bp, Homo sapiens
gtgtgcaagtatgtga

SEQ ID NO: 139411 - DNA, 16 bp, Homo sapiens
gtgtgcaccagggttg

SEQ ID NO: 139412 - DNA, 18 bp, Homo sapiens
gtgtgcatgtgtgtgctc

SEQ ID NO: 139413 - DNA, 13 bp, Homo sapiens
gtgtggagaagcg

SEQ ID NO: 139414 - DNA, 21 bp, Homo sapiens
gtgtggagaagcggctggcag

SEQ ID NO: 139415 - DNA, 19 bp, Homo sapiens
gtgtggctcacgtgtgtga

SEQ ID NO: 139416 - DNA, 16 bp, Homo sapiens
gtgtgggaagggagag

SEQ ID NO: 139417 - DNA, 20 bp, Homo sapiens
gtgtgtatgtgcgtgtgtgc

SEQ ID NO: 139418 - DNA, 19 bp, Homo sapiens
gtgtgtccacgactgtctc

SEQ ID NO: 139419 - DNA, 18 bp, Homo sapiens
gtgtgtccccctctgtcc

SEQ ID NO: 139420 - DNA, 14 bp, Homo sapiens
gtgtgtgaaaggaa

SEQ ID NO: 139421 - DNA, 15 bp, Homo sapiens
gtgtgtttctgatct

SEQ ID NO: 139422 - DNA, 17 bp, Homo sapiens
gtgtgttttcataataa

SEQ ID NO: 139423 - DNA, 16 bp, Homo sapiens
gctggagaagagagga

SEQ ID NO: 139424 - DNA, 17 bp, Homo sapiens
gctggagaagagaggag

SEQ ID NO: 139425 - DNA, 16 bp, Homo sapiens
gctggagcccagggag

SEQ ID NO: 139426 - DNA, 13 bp, Homo sapiens
gctggaggcaggg

SEQ ID NO: 139427 - DNA, 14 bp, Homo sapiens
gctggaggtgggag

SEQ ID NO: 139428 - DNA, 15 bp, Homo sapiens
gctggaggtgggagc

SEQ ID NO: 139429 - DNA, 21 bp, Homo sapiens
gctggaggtgggagcaggaga

SEQ ID NO: 139430 - DNA, 18 bp, Homo sapiens
gctggatggagcccaggc

SEQ ID NO: 139431 - DNA, 15 bp, Homo sapiens
gctggcaaagacaga

SEQ ID NO: 139432 - DNA, 16 bp, Homo sapiens
gctggcatttgcacct

SEQ ID NO: 139433 - DNA, 11 bp, Homo sapiens
gctggctgcct

SEQ ID NO: 139434 - DNA, 20 bp, Homo sapiens
gctggctgccttagaacctt

SEQ ID NO: 139435 - DNA, 16 bp, Homo sapiens
gctgggagctctgcag

SEQ ID NO: 139436 - DNA, 20 bp, Homo sapiens
gctgggaggcatggccctgg

SEQ ID NO: 139437 - DNA, 14 bp, Homo sapiens
gctgggcagctgtt

SEQ ID NO: 139438 - DNA, 13 bp, Homo sapiens
gctgggctctcca

SEQ ID NO: 139439 - DNA, 14 bp, Homo sapiens
gctgggctctccac

SEQ ID NO: 139440 - DNA, 19 bp, Homo sapiens
gctgggctctccacctcag

SEQ ID NO: 139441 - DNA, 22 bp, Homo sapiens
gctgggctctccacctcagcct

SEQ ID NO: 139442 - DNA, 23 bp, Homo sapiens
gctgggggaagaagctctctcct

SEQ ID NO: 139443 - DNA, 14 bp, Homo sapiens
gctggtaaactatt

SEQ ID NO: 139444 - DNA, 18 bp, Homo sapiens
gctggtagagatggagga

SEQ ID NO: 139445 - DNA, 14 bp, Homo sapiens
gctggtccagggct

SEQ ID NO: 139446 - DNA, 20 bp, Homo sapiens
gctggtgcagagctgaagat

SEQ ID NO: 139447 - DNA, 13 bp, Homo sapiens
gctgtaggtgtgc

SEQ ID NO: 139448 - DNA, 18 bp, Homo sapiens
gctgtcataagaatgaat

SEQ ID NO: 139449 - DNA, 13 bp, Homo sapiens
gctgtccctcact

SEQ ID NO: 139450 - DNA, 15 bp, Homo sapiens
gctgtccctgtcacc

SEQ ID NO: 139451 - DNA, 12 bp, Homo sapiens
gctgtgagcccc

SEQ ID NO: 139452 - DNA, 12 bp, Homo sapiens
gctgtgaggctg

SEQ ID NO: 139453 - DNA, 18 bp, Homo sapiens
gctgtgaggctgtcctgt

SEQ ID NO: 139454 - DNA, 14 bp, Homo sapiens
gctgtgcctctgcc

SEQ ID NO: 139455 - DNA, 18 bp, Homo sapiens
gctgtgtccttgcacctg

SEQ ID NO: 139456 - DNA, 14 bp, Homo sapiens
gctgtgtctaaact

SEQ ID NO: 139457 - DNA, 15 bp, Homo sapiens
gctgtgtctaaactg

SEQ ID NO: 139458 - DNA, 16 bp, Homo sapiens
gctgttcacagccaga

SEQ ID NO: 139459 - DNA, 20 bp, Homo sapiens
gctgtttgtttgacaaagaa

SEQ ID NO: 139460 - DNA, 23 bp, Homo sapiens
gcttaatgtttattcctgataat

SEQ ID NO: 139461 - DNA, 13 bp, Homo sapiens
gcttagacctcag

SEQ ID NO: 139462 - DNA, 20 bp, Homo sapiens
gcttattcatctgtttttct

SEQ ID NO: 139463 - DNA, 15 bp, Homo sapiens
gcttcaattaataaa

SEQ ID NO: 139464 - DNA, 15 bp, Homo sapiens
gcttcacggaagagc

SEQ ID NO: 139465 - DNA, 17 bp, Homo sapiens
gcttcacggaagagcct

SEQ ID NO: 139466 - DNA, 14 bp, Homo sapiens
gcttcagtggagaa

SEQ ID NO: 139467 - DNA, 14 bp, Homo sapiens
gttcagcactgtcc

SEQ ID NO: 139468 - DNA, 15 bp, Homo sapiens
gttcagcactgtccc

SEQ ID NO: 139469 - DNA, 16 bp, Homo sapiens
gttcagcactgtccct

SEQ ID NO: 139470 - DNA, 17 bp, Homo sapiens
gttcagcccctcctctg

SEQ ID NO: 139471 - DNA, 13 bp, Homo sapiens
gttcaggtagctg

SEQ ID NO: 139472 - DNA, 21 bp, Homo sapiens
gttccacgtccccctggggct

SEQ ID NO: 139473 - DNA, 23 bp, Homo sapiens
gttccccatctgggtccttgcac

SEQ ID NO: 139474 - DNA, 17 bp, Homo sapiens
gttcccctgttcactct

SEQ ID NO: 139475 - DNA, 18 bp, Homo sapiens
gttcccctgttcactcta

SEQ ID NO: 139476 - DNA, 15 bp, Homo sapiens
gttccccttccactg

SEQ ID NO: 139477 - DNA, 22 bp, Homo sapiens
gttccccttccactgagggcag

SEQ ID NO: 139478 - DNA, 17 bp, Homo sapiens
gttccctctccctgttg

SEQ ID NO: 139479 - DNA, 18 bp, Homo sapiens
gttccctgaaaacccaga

SEQ ID NO: 139480 - DNA, 22 bp, Homo sapiens
gttcctcattagcattttgcta

SEQ ID NO: 139481 - DNA, 16 bp, Homo sapiens
gttcctcgccctgggt

SEQ ID NO: 139482 - DNA, 15 bp, Homo sapiens
gttccttactgcaga

SEQ ID NO: 139483 - DNA, 23 bp, Homo sapiens
gttccttgatctgtatatacaat

SEQ ID NO: 139484 - DNA, 16 bp, Homo sapiens
gttctaagtctttcca

SEQ ID NO: 139485 - DNA, 14 bp, Homo sapiens
gttctgagtgtttt

SEQ ID NO: 139486 - DNA, 15 bp, Homo sapiens
gttctggccctcacc

SEQ ID NO: 139487 - DNA, 14 bp, Homo sapiens
gttctttcttcctc

SEQ ID NO: 139488 - DNA, 16 bp, Homo sapiens
gttctttcttcctctg

SEQ ID NO: 139489 - DNA, 23 bp, Homo sapiens
gttgaaaagactccaaagaaatg

SEQ ID NO: 139490 - DNA, 15 bp, Homo sapiens
gttgaaagagtccta

SEQ ID NO: 139491 - DNA, 20 bp, Homo sapiens
gttgaaattatgtatgttta

SEQ ID NO: 139492 - DNA, 14 bp, Homo sapiens
gttgaagctctggt

SEQ ID NO: 139493 - DNA, 14 bp, Homo sapiens
gttgaccccagagg

SEQ ID NO: 139494 - DNA, 13 bp, Homo sapiens
gttgagctgtttt

SEQ ID NO: 139495 - DNA, 17 bp, Homo sapiens
gttgagggaacagacag

SEQ ID NO: 139496 - DNA, 22 bp, Homo sapiens
gttgagggaacagacaggagaa

SEQ ID NO: 139497 - DNA, 23 bp, Homo sapiens
gttgagggaacagacaggagaaa

SEQ ID NO: 139498 - DNA, 22 bp, Homo sapiens
gttgagttcaggtagctgcccc

SEQ ID NO: 139499 - DNA, 20 bp, Homo sapiens
gttgatatttcgaaagctgc

SEQ ID NO: 139500 - DNA, 20 bp, Homo sapiens
gttgatcactggcaatgaaa

SEQ ID NO: 139501 - DNA, 15 bp, Homo sapiens
gttgcaggacctcag

SEQ ID NO: 139502 - DNA, 13 bp, Homo sapiens
gttgcagtgagct

SEQ ID NO: 139503 - DNA, 15 bp, Homo sapiens
gttgcagtgagctga

SEQ ID NO: 139504 - DNA, 17 bp, Homo sapiens
gttgccaaacagccaca

SEQ ID NO: 139505 - DNA, 20 bp, Homo sapiens
gttgccaaatatgtcctggg

SEQ ID NO: 139506 - DNA, 11 bp, Homo sapiens
gttgccagaga

SEQ ID NO: 139507 - DNA, 15 bp, Homo sapiens
gttgccagagatgga

SEQ ID NO: 139508 - DNA, 23 bp, Homo sapiens
gttgctgatgaactcttaatcaa

SEQ ID NO: 139509 - DNA, 14 bp, Homo sapiens
gttggcaaaaaggc

SEQ ID NO: 139510 - DNA, 23 bp, Homo sapiens
gttggcagtgagtgagcctggct

SEQ ID NO: 139511 - DNA, 14 bp, Homo sapiens
gttggctggatgaa

SEQ ID NO: 139512 - DNA, 13 bp, Homo sapiens
gttgtaaaatata

SEQ ID NO: 139513 - DNA, 14 bp, Homo sapiens
gttgtaaaatatag

SEQ ID NO: 139514 - DNA, 15 bp, Homo sapiens
gttgtaaatatataa

SEQ ID NO: 139515 - DNA, 14 bp, Homo sapiens
gttgtaaatattta

SEQ ID NO: 139516 - DNA, 16 bp, Homo sapiens
gttgtcaaagagaggg

SEQ ID NO: 139517 - DNA, 17 bp, Homo sapiens
gttgtcaagtctctgct

SEQ ID NO: 139518 - DNA, 12 bp, Homo sapiens
gttgtcagctga

SEQ ID NO: 139519 - DNA, 18 bp, Homo sapiens
gttgtctctagagcaggg

SEQ ID NO: 139520 - DNA, 14 bp, Homo sapiens
gttgtgaatgttgt

SEQ ID NO: 139521 - DNA, 20 bp, Homo sapiens
gttgtgagtttaccttgtat

SEQ ID NO: 139522 - DNA, 21 bp, Homo sapiens
gttgtggagagtgcaacagta

SEQ ID NO: 139523 - DNA, 14 bp, Homo sapiens
gttgtggttaatct

SEQ ID NO: 139524 - DNA, 16 bp, Homo sapiens
gttgtgtacgtggaga

SEQ ID NO: 139525 - DNA, 21 bp, Homo sapiens
gttgttactaactaaactctc

SEQ ID NO: 139526 - DNA, 18 bp, Homo sapiens
gtttacaagtgtatatca

SEQ ID NO: 139527 - DNA, 23 bp, Homo sapiens
gtttacaatttacaaagtgtgta

SEQ ID NO: 139528 - DNA, 12 bp, Homo sapiens
gtttaccttgta

SEQ ID NO: 139529 - DNA, 18 bp, Homo sapiens
gtttattaacaaattatg

SEQ ID NO: 139530 - DNA, 16 bp, Homo sapiens
gtttcaaaataaaaac

SEQ ID NO: 139531 - DNA, 16 bp, Homo sapiens
gtttcaattgcatctc

SEQ ID NO: 139532 - DNA, 21 bp, Homo sapiens
gtttcagatatatatcatatt

SEQ ID NO: 139533 - DNA, 21 bp, Homo sapiens
gtttcatttagtcatgtgacc

SEQ ID NO: 139534 - DNA, 22 bp, Homo sapiens
gtttccacgatgaaaaacttcc

SEQ ID NO: 139535 - DNA, 14 bp, Homo sapiens
gtttcctcaggctg

SEQ ID NO: 139536 - DNA, 19 bp, Homo sapiens
gtttcctcaggctgctgga

SEQ ID NO: 139537 - DNA, 18 bp, Homo sapiens
gtttctagctagaaatat

SEQ ID NO: 139538 - DNA, 15 bp, Homo sapiens
gtttctctgctgttg

SEQ ID NO: 139539 - DNA, 23 bp, Homo sapiens
gtttcttcatccggcagcctgga

SEQ ID NO: 139540 - DNA, 16 bp, Homo sapiens
gtttgagctcagaccc

SEQ ID NO: 139541 - DNA, 15 bp, Homo sapiens
gtttgatttcattaa

SEQ ID NO: 139542 - DNA, 21 bp, Homo sapiens
gtttgattttagctgcagaac

SEQ ID NO: 139543 - DNA, 21 bp, Homo sapiens
gtttgcagaaaagcacctgcc

SEQ ID NO: 139544 - DNA, 20 bp, Homo sapiens
gtttgcagagcttgaacaca

SEQ ID NO: 139545 - DNA, 15 bp, Homo sapiens
gtttggctgtgtcta

SEQ ID NO: 139546 - DNA, 18 bp, Homo sapiens
gtttggctgtgtctaaac

SEQ ID NO: 139547 - DNA, 19 bp, Homo sapiens
gtttggctgtgtctaaact

SEQ ID NO: 139548 - DNA, 22 bp, Homo sapiens
gtttggctgtgtctaaactgca

SEQ ID NO: 139549 - DNA, 22 bp, Homo sapiens
gtttggggaatgcggccgcatt

SEQ ID NO: 139550 - DNA, 13 bp, Homo sapiens
gtttgtatattgt

SEQ ID NO: 139551 - DNA, 19 bp, Homo sapiens
gttttaaatttatttcaaa

SEQ ID NO: 139552 - DNA, 15 bp, Homo sapiens
gttttactgcagctt

SEQ ID NO: 139553 - DNA, 21 bp, Homo sapiens
gttttattttttattgttttc

SEQ ID NO: 139554 - DNA, 13 bp, Homo sapiens
gttttcaatgatg

SEQ ID NO: 139555 - DNA, 19 bp, Homo sapiens
gttttctcttgagagggtg

SEQ ID NO: 139556 - DNA, 22 bp, Homo sapiens
gttttctgagaaagactattca

SEQ ID NO: 139557 - DNA, 15 bp, Homo sapiens
gttttcttcccatca

SEQ ID NO: 139558 - DNA, 16 bp, Homo sapiens
gttttgctgtttcctt

SEQ ID NO: 139559 - DNA, 12 bp, Homo sapiens
gttttgtattct

SEQ ID NO: 139560 - DNA, 18 bp, Homo sapiens
gtttttaatataaagcct

SEQ ID NO: 139561 - DNA, 18 bp, Homo sapiens
gtttttgatagctttatt

SEQ ID NO: 139562 - DNA, 15 bp, Homo sapiens
gtttttgttcaaagc

SEQ ID NO: 139563 - DNA, 15 bp, Homo sapiens
gttttttatgctaat

SEQ ID NO: 139564 - DNA, 17 bp, Homo sapiens
taaaaaaaacaaaaaga

SEQ ID NO: 139565 - DNA, 22 bp, Homo sapiens
taaaaaaaacaaaaagaacaaa

SEQ ID NO: 139566 - DNA, 13 bp, Homo sapiens
taaaaaaatgaca

SEQ ID NO: 139567 - DNA, 20 bp, Homo sapiens
taaaaaactgctgactgttt

SEQ ID NO: 139568 - DNA, 15 bp, Homo sapiens
taaaaaatggaaaga

SEQ ID NO: 139569 - DNA, 17 bp, Homo sapiens
taaaaagaaaagataaa

SEQ ID NO: 139570 - DNA, 22 bp, Homo sapiens
taaaaagcctgcaatttcatat

SEQ ID NO: 139571 - DNA, 12 bp, Homo sapiens
taaaaatataaa

SEQ ID NO: 139572 - DNA, 15 bp, Homo sapiens
taaaaatggtttaaa

SEQ ID NO: 139573 - DNA, 17 bp, Homo sapiens
taaaaattgtgatcaga

SEQ ID NO: 139574 - DNA, 23 bp, Homo sapiens
taaaaattgtttcaaaataaaaa

SEQ ID NO: 139575 - DNA, 21 bp, Homo sapiens
taaaaccatgtagaaaatttg

SEQ ID NO: 139576 - DNA, 10 bp, Homo sapiens
taaaactgcg

SEQ ID NO: 139577 - DNA, 22 bp, Homo sapiens
taaaacttgatgtgttatctct

SEQ ID NO: 139578 - DNA, 15 bp, Homo sapiens
ggagaatcacttgaa

SEQ ID NO: 139579 - DNA, 17 bp, Homo sapiens
ggagacagccccagagc

SEQ ID NO: 139580 - DNA, 19 bp, Homo sapiens
ggagacagccccagagcag

SEQ ID NO: 139581 - DNA, 22 bp, Homo sapiens
ggagacagccccagagcagggt

SEQ ID NO: 139582 - DNA, 14 bp, Homo sapiens
ggagacatgtgaca

SEQ ID NO: 139583 - DNA, 18 bp, Homo sapiens
ggagactccatgagaagc

SEQ ID NO: 139584 - DNA, 13 bp, Homo sapiens
ggagactgggctg

SEQ ID NO: 139585 - DNA, 18 bp, Homo sapiens
ggagactggggggcttga

SEQ ID NO: 139586 - DNA, 16 bp, Homo sapiens
ggagactgtctcaaga

SEQ ID NO: 139587 - DNA, 18 bp, Homo sapiens
ggagagaaagtgggtgag

SEQ ID NO: 139588 - DNA, 24 bp, Homo sapiens
ggagagaaagtgggtgagatgctg

SEQ ID NO: 139589 - DNA, 10 bp, Homo sapiens
ggagagagaa

SEQ ID NO: 139590 - DNA, 16 bp, Homo sapiens
ggagagaggcagagag

SEQ ID NO: 139591 - DNA, 21 bp, Homo sapiens
ggagagccagccctccctgtc

SEQ ID NO: 139592 - DNA, 15 bp, Homo sapiens
ggagagctagcagca

SEQ ID NO: 139593 - DNA, 17 bp, Homo sapiens
ggagagctagcagcagg

SEQ ID NO: 139594 - DNA, 15 bp, Homo sapiens
ggagaggagagaggc

SEQ ID NO: 139595 - DNA, 14 bp, Homo sapiens
ggagagggatgagg

SEQ ID NO: 139596 - DNA, 23 bp, Homo sapiens
ggagatatttatggggggagaac

SEQ ID NO: 139597 - DNA, 20 bp, Homo sapiens
ggagatggaagttgcagtga

SEQ ID NO: 139598 - DNA, 16 bp, Homo sapiens
ggagcaaactctgctg

SEQ ID NO: 139599 - DNA, 16 bp, Homo sapiens
ggagcaggagattgag

SEQ ID NO: 139600 - DNA, 16 bp, Homo sapiens
ggagccaatggagact

SEQ ID NO: 139601 - DNA, 21 bp, Homo sapiens
ggagccactcctctgactcag

SEQ ID NO: 139602 - DNA, 12 bp, Homo sapiens
ggagccagctct

SEQ ID NO: 139603 - DNA, 16 bp, Homo sapiens
ggagcccagctctgaa

SEQ ID NO: 139604 - DNA, 19 bp, Homo sapiens
ggagcccaggcgggagcgg

SEQ ID NO: 139605 - DNA, 14 bp, Homo sapiens
ggagccccaggcct

SEQ ID NO: 139606 - DNA, 18 bp, Homo sapiens
ggagccgggtctgcctct

SEQ ID NO: 139607 - DNA, 19 bp, Homo sapiens
ggagcctcatccgaggcag

SEQ ID NO: 139608 - DNA, 20 bp, Homo sapiens
ggagcctcatccgaggcagg

SEQ ID NO: 139609 - DNA, 22 bp, Homo sapiens
taaacagcagtgttccccatct

SEQ ID NO: 139610 - DNA, 13 bp, Homo sapiens
taaacagtgcctg

SEQ ID NO: 139611 - DNA, 17 bp, Homo sapiens
taaacagtgcctgctga

SEQ ID NO: 139612 - DNA, 18 bp, Homo sapiens
taaacagtgcctgctgaa

SEQ ID NO: 139613 - DNA, 15 bp, Homo sapiens
taaacataattcttg

SEQ ID NO: 139614 - DNA, 16 bp, Homo sapiens
taaacatcacacacac

SEQ ID NO: 139615 - DNA, 15 bp, Homo sapiens
taaacctaaaaaaga

SEQ ID NO: 139616 - DNA, 18 bp, Homo sapiens
taaacctaaaaaagatat

SEQ ID NO: 139617 - DNA, 18 bp, Homo sapiens
taaacctcaaaatgtcta

SEQ ID NO: 139618 - DNA, 19 bp, Homo sapiens
taaacctcaaaatgtctaa

SEQ ID NO: 139619 - DNA, 15 bp, Homo sapiens
taaactatttgtctt

SEQ ID NO: 139620 - DNA, 15 bp, Homo sapiens
taaactcaaaactta

SEQ ID NO: 139621 - DNA, 20 bp, Homo sapiens
taaactcaaaacttaacata

SEQ ID NO: 139622 - DNA, 14 bp, Homo sapiens
taaactctaaacat

SEQ ID NO: 139623 - DNA, 21 bp, Homo sapiens
taaactctctttgggaatgtt

SEQ ID NO: 139624 - DNA, 12 bp, Homo sapiens
taaactgtgcac

SEQ ID NO: 139625 - DNA, 11 bp, Homo sapiens
taaagaaagtc

SEQ ID NO: 139626 - DNA, 17 bp, Homo sapiens
taaagaaagtcgaatta

SEQ ID NO: 139627 - DNA, 19 bp, Homo sapiens
taaagaacaccctatattt

SEQ ID NO: 139628 - DNA, 15 bp, Homo sapiens
taaagaacataaata

SEQ ID NO: 139629 - DNA, 15 bp, Homo sapiens
taaagacacctactg

SEQ ID NO: 139630 - DNA, 18 bp, Homo sapiens
taaagagattcacacaca

SEQ ID NO: 139631 - DNA, 16 bp, Homo sapiens
taaagcctgcttttta

SEQ ID NO: 139632 - DNA, 21 bp, Homo sapiens
taaagcctgctttttaagtgt

SEQ ID NO: 139633 - DNA, 14 bp, Homo sapiens
taaagctgaaaact

SEQ ID NO: 139634 - DNA, 23 bp, Homo sapiens
taaagctgcctgtagttaggaaa

SEQ ID NO: 139635 - DNA, 20 bp, Homo sapiens
taaaggctatacttgtcttg

SEQ ID NO: 139636 - DNA, 18 bp, Homo sapiens
taaaggctcgattttgta

SEQ ID NO: 139637 - DNA, 19 bp, Homo sapiens
taaaggctcgattttgtat

SEQ ID NO: 139638 - DNA, 13 bp, Homo sapiens
taaagtaaagcta

SEQ ID NO: 139639 - DNA, 14 bp, Homo sapiens
taaagtatatattt

SEQ ID NO: 139640 - DNA, 20 bp, Homo sapiens
taaagtatcaggatactata

SEQ ID NO: 139641 - DNA, 22 bp, Homo sapiens
taaagtatgtaaacaggagaca

SEQ ID NO: 139642 - DNA, 22 bp, Homo sapiens
taaagtatgtaaagtatgtaaa

SEQ ID NO: 139643 - DNA, 16 bp, Homo sapiens
taaagtgatatttccc

SEQ ID NO: 139644 - DNA, 17 bp, Homo sapiens
taaagttctgagtgttt

SEQ ID NO: 139645 - DNA, 13 bp, Homo sapiens
taaataaaatgac

SEQ ID NO: 139646 - DNA, 22 bp, Homo sapiens
taaataaacctcaaaatgtcta

SEQ ID NO: 139647 - DNA, 16 bp, Homo sapiens
taaataaatcattaat

SEQ ID NO: 139648 - DNA, 22 bp, Homo sapiens
taaataaatgtatcttattcac

SEQ ID NO: 139649 - DNA, 16 bp, Homo sapiens
taaatatataaatata

SEQ ID NO: 139650 - DNA, 15 bp, Homo sapiens
taaatatatataaac

SEQ ID NO: 139651 - DNA, 18 bp, Homo sapiens
taaatatgttagcaaaga

SEQ ID NO: 139652 - DNA, 14 bp, Homo sapiens
taaatcattaatac

SEQ ID NO: 139653 - DNA, 14 bp, Homo sapiens
taaatctctaatat

SEQ ID NO: 139654 - DNA, 15 bp, Homo sapiens
taaatctctaatatg

SEQ ID NO: 139655 - DNA, 12 bp, Homo sapiens
taaatgaatgtt

SEQ ID NO: 139656 - DNA, 17 bp, Homo sapiens
taaatgatttcattcaa

SEQ ID NO: 139657 - DNA, 21 bp, Homo sapiens
taaatgtgcattcttttaaaa

SEQ ID NO: 139658 - DNA, 16 bp, Homo sapiens
taaatgtgcttttaaa

SEQ ID NO: 139659 - DNA, 13 bp, Homo sapiens
taaatgtggtaaa

SEQ ID NO: 139660 - DNA, 17 bp, Homo sapiens
taaattttgagttctac

SEQ ID NO: 139661 - DNA, 12 bp, Homo sapiens
taacaaattatg

SEQ ID NO: 139662 - DNA, 14 bp, Homo sapiens
taacaatcagctcc

SEQ ID NO: 139663 - DNA, 17 bp, Homo sapiens
taacaatgaagataaaa

SEQ ID NO: 139664 - DNA, 13 bp, Homo sapiens
taacaattcctct

SEQ ID NO: 139665 - DNA, 18 bp, Homo sapiens
taacaattttaatgctat

SEQ ID NO: 139666 - DNA, 17 bp, Homo sapiens
taacacaagtcctgtga

SEQ ID NO: 139667 - DNA, 23 bp, Homo sapiens
taacacaagtcctgtgaatttct

SEQ ID NO: 139668 - DNA, 17 bp, Homo sapiens
taacacatttgattctg

SEQ ID NO: 139669 - DNA, 16 bp, Homo sapiens
taacactataaaggtt

SEQ ID NO: 139670 - DNA, 16 bp, Homo sapiens
taacataatttgtaca

SEQ ID NO: 139671 - DNA, 14 bp, Homo sapiens
taacatataatgtt

SEQ ID NO: 139672 - DNA, 22 bp, Homo sapiens
taacatatttactaagccacaa

SEQ ID NO: 139673 - DNA, 22 bp, Homo sapiens
taacatgtgttaagtattttca

SEQ ID NO: 139674 - DNA, 17 bp, Homo sapiens
taaccaaaggtgaagga

SEQ ID NO: 139675 - DNA, 18 bp, Homo sapiens
taaccacatcaatattgt

SEQ ID NO: 139676 - DNA, 22 bp, Homo sapiens
taaccacatcaatattgtcatt

SEQ ID NO: 139677 - DNA, 16 bp, Homo sapiens
taacccaactctcctg

SEQ ID NO: 139678 - DNA, 12 bp, Homo sapiens
taacccctttcc

SEQ ID NO: 139679 - DNA, 14 bp, Homo sapiens
taacctctgcacta

SEQ ID NO: 139680 - DNA, 17 bp, Homo sapiens
taactaaactctctttg

SEQ ID NO: 139681 - DNA, 18 bp, Homo sapiens
taactagaatttattcaa

SEQ ID NO: 139682 - DNA, 17 bp, Homo sapiens
taactagtgttgcttgg

SEQ ID NO: 139683 - DNA, 16 bp, Homo sapiens
taactatgttgataaa

SEQ ID NO: 139684 - DNA, 16 bp, Homo sapiens
taactcatcataaaat

SEQ ID NO: 139685 - DNA, 12 bp, Homo sapiens
taactgcaattt

SEQ ID NO: 139686 - DNA, 22 bp, Homo sapiens
taactgttaaattgctgtgtat

SEQ ID NO: 139687 - DNA, 15 bp, Homo sapiens
taacttagcatgtgt

SEQ ID NO: 139688 - DNA, 18 bp, Homo sapiens
taacttcttaaaagttgt

SEQ ID NO: 139689 - DNA, 16 bp, Homo sapiens
taacttggagccccag

SEQ ID NO: 139690 - DNA, 15 bp, Homo sapiens
taactttctctatga

SEQ ID NO: 139691 - DNA, 16 bp, Homo sapiens
taagaaaacatcactg

SEQ ID NO: 139692 - DNA, 20 bp, Homo sapiens
taagaaaatattttgtctaa

SEQ ID NO: 139693 - DNA, 21 bp, Homo sapiens
taagaaacaactctttgagaa

SEQ ID NO: 139694 - DNA, 20 bp, Homo sapiens
taagaagggatggattccaa

SEQ ID NO: 139695 - DNA, 18 bp, Homo sapiens
taagaagtgaaaatctac

SEQ ID NO: 139696 - DNA, 19 bp, Homo sapiens
taagaataaaatgttgaaa

SEQ ID NO: 139697 - DNA, 20 bp, Homo sapiens
taagagctagcgctgccgca

SEQ ID NO: 139698 - DNA, 12 bp, Homo sapiens
taagataattat

SEQ ID NO: 139699 - DNA, 21 bp, Homo sapiens
taagatatgggacatttttga

SEQ ID NO: 139700 - DNA, 14 bp, Homo sapiens
taagattcatattt

SEQ ID NO: 139701 - DNA, 14 bp, Homo sapiens
taagcaaaatgtga

SEQ ID NO: 139702 - DNA, 17 bp, Homo sapiens
taagcactacataaact

SEQ ID NO: 139703 - DNA, 10 bp, Homo sapiens
taagccaagg

SEQ ID NO: 139704 - DNA, 22 bp, Homo sapiens
taagccacaagaaatttgattt

SEQ ID NO: 139705 - DNA, 19 bp, Homo sapiens
taagccacttaaaatgttc

SEQ ID NO: 139706 - DNA, 20 bp, Homo sapiens
taagccacttaaaatgttca

SEQ ID NO: 139707 - DNA, 19 bp, Homo sapiens
taagccctcttccatcatg

SEQ ID NO: 139708 - DNA, 17 bp, Homo sapiens
taagcctcatatttaaa

SEQ ID NO: 139709 - DNA, 20 bp, Homo sapiens
taagcctcatatttaaagac

SEQ ID NO: 139710 - DNA, 20 bp, Homo sapiens
taagctcaaggcgtgaggat

SEQ ID NO: 139711 - DNA, 13 bp, Homo sapiens
taaggaagacaat

SEQ ID NO: 139712 - DNA, 19 bp, Homo sapiens
taaggatcagaacagcaga

SEQ ID NO: 139713 - DNA, 19 bp, Homo sapiens
taaggatggagccagctct

SEQ ID NO: 139714 - DNA, 16 bp, Homo sapiens
taaggatgggaaggag

SEQ ID NO: 139715 - DNA, 18 bp, Homo sapiens
taaggatgggaaggaggg

SEQ ID NO: 139716 - DNA, 20 bp, Homo sapiens
taaggatgtcacagggccaa

SEQ ID NO: 139717 - DNA, 20 bp, Homo sapiens
taaggctgaggaaaggccag

SEQ ID NO: 139718 - DNA, 13 bp, Homo sapiens
taagtaaaaccac

SEQ ID NO: 139719 - DNA, 15 bp, Homo sapiens
taagtaaaaccacag

SEQ ID NO: 139720 - DNA, 16 bp, Homo sapiens
taagtaaaaccacagc

SEQ ID NO: 139721 - DNA, 13 bp, Homo sapiens
taagtaagaaaat

SEQ ID NO: 139722 - DNA, 16 bp, Homo sapiens
taagtaattcaagaaa

SEQ ID NO: 139723 - DNA, 14 bp, Homo sapiens
taagtactgtgtac

SEQ ID NO: 139724 - DNA, 11 bp, Homo sapiens
taagtattgca

SEQ ID NO: 139725 - DNA, 17 bp, Homo sapiens
taagtattgcatctgta

SEQ ID NO: 139726 - DNA, 20 bp, Homo sapiens
taagtattgcatctgtataa

SEQ ID NO: 139727 - DNA, 13 bp, Homo sapiens
taagtatttatat

SEQ ID NO: 139728 - DNA, 23 bp, Homo sapiens
taagtatttatatatttataact

SEQ ID NO: 139729 - DNA, 22 bp, Homo sapiens
taagtcatgttccttcaagatc

SEQ ID NO: 139730 - DNA, 13 bp, Homo sapiens
taagtgaaataag

SEQ ID NO: 139731 - DNA, 16 bp, Homo sapiens
taagtgattgtatgaa

SEQ ID NO: 139732 - DNA, 21 bp, Homo sapiens
ggccactctgcctctgcctgc

SEQ ID NO: 139733 - DNA, 16 bp, Homo sapiens
ggccactgtgaagaga

SEQ ID NO: 139734 - DNA, 13 bp, Homo sapiens
ggccagcagcttg

SEQ ID NO: 139735 - DNA, 14 bp, Homo sapiens
ggccagctggcagc

SEQ ID NO: 139736 - DNA, 11 bp, Homo sapiens
ggccaggcagg

SEQ ID NO: 139737 - DNA, 12 bp, Homo sapiens
ggccaggcaggt

SEQ ID NO: 139738 - DNA, 11 bp, Homo sapiens
ggccaggctcc

SEQ ID NO: 139739 - DNA, 14 bp, Homo sapiens
ggcccacagctccc

SEQ ID NO: 139740 - DNA, 24 bp, Homo sapiens
ggcccatatctgtgaaatgctggc

SEQ ID NO: 139741 - DNA, 16 bp, Homo sapiens
ggccccagcactaaag

SEQ ID NO: 139742 - DNA, 15 bp, Homo sapiens
ggcccccagctgtgg

SEQ ID NO: 139743 - DNA, 15 bp, Homo sapiens
ggccccctccatcgg

SEQ ID NO: 139744 - DNA, 19 bp, Homo sapiens
ggcccctcaccctgcctta

SEQ ID NO: 139745 - DNA, 22 bp, Homo sapiens
ggcccctcaccctgccttatct

SEQ ID NO: 139746 - DNA, 17 bp, Homo sapiens
ggcccctgcatcccctt

SEQ ID NO: 139747 - DNA, 17 bp, Homo sapiens
ggcccgacagcctggca

SEQ ID NO: 139748 - DNA, 19 bp, Homo sapiens
ggcccggggctggcggcta

SEQ ID NO: 139749 - DNA, 22 bp, Homo sapiens
ggccctcgctgccagctctgta

SEQ ID NO: 139750 - DNA, 23 bp, Homo sapiens
ggccctcgctgccagctctgtat

SEQ ID NO: 139751 - DNA, 14 bp, Homo sapiens
ggccctgagctcgg

SEQ ID NO: 139752 - DNA, 16 bp, Homo sapiens
taatatactatattta

SEQ ID NO: 139753 - DNA, 17 bp, Homo sapiens
taatatatcccagaaat

SEQ ID NO: 139754 - DNA, 17 bp, Homo sapiens
taatatccctacatgta

SEQ ID NO: 139755 - DNA, 15 bp, Homo sapiens
taatatggcaaaaat

SEQ ID NO: 139756 - DNA, 22 bp, Homo sapiens
taatattaaaaatatggaactt

SEQ ID NO: 139757 - DNA, 13 bp, Homo sapiens
taatatttaaaca

SEQ ID NO: 139758 - DNA, 16 bp, Homo sapiens
taatatttatatattt

SEQ ID NO: 139759 - DNA, 14 bp, Homo sapiens
taatatttgctgac

SEQ ID NO: 139760 - DNA, 11 bp, Homo sapiens
taatcagcctc

SEQ ID NO: 139761 - DNA, 17 bp, Homo sapiens
taatcagtgtgtctaaa

SEQ ID NO: 139762 - DNA, 18 bp, Homo sapiens
taatcagtgtgtctaaat

SEQ ID NO: 139763 - DNA, 20 bp, Homo sapiens
taatcattcttatttcatga

SEQ ID NO: 139764 - DNA, 22 bp, Homo sapiens
taatcattcttatttcatgaaa

SEQ ID NO: 139765 - DNA, 19 bp, Homo sapiens
taatccgaatctctttttg

SEQ ID NO: 139766 - DNA, 15 bp, Homo sapiens
taatcggcccacagc

SEQ ID NO: 139767 - DNA, 16 bp, Homo sapiens
taatcggcccacagct

SEQ ID NO: 139768 - DNA, 22 bp, Homo sapiens
taatcggcccacagctcccacc

SEQ ID NO: 139769 - DNA, 15 bp, Homo sapiens
taatctggactcctc

SEQ ID NO: 139770 - DNA, 17 bp, Homo sapiens
taatctggactcctctg

SEQ ID NO: 139771 - DNA, 20 bp, Homo sapiens
taatctggactcctctgtcc

SEQ ID NO: 139772 - DNA, 16 bp, Homo sapiens
taatgaagaaagtgga

SEQ ID NO: 139773 - DNA, 22 bp, Homo sapiens
taatgaagaaagtggaaaacaa

SEQ ID NO: 139774 - DNA, 17 bp, Homo sapiens
taatgaatgaaacattt

SEQ ID NO: 139775 - DNA, 15 bp, Homo sapiens
taatgaatggactca

SEQ ID NO: 139776 - DNA, 17 bp, Homo sapiens
taatgcatgttaggaaa

SEQ ID NO: 139777 - DNA, 14 bp, Homo sapiens
taatgctgttgcct

SEQ ID NO: 139778 - DNA, 16 bp, Homo sapiens
taatgctgttgcctca

SEQ ID NO: 139779 - DNA, 14 bp, Homo sapiens
taatggtgttttaa

SEQ ID NO: 139780 - DNA, 18 bp, Homo sapiens
taatgtaataactgtgaa

SEQ ID NO: 139781 - DNA, 15 bp, Homo sapiens
taatgtcaccacctt

SEQ ID NO: 139782 - DNA, 21 bp, Homo sapiens
taatgtcaccaccttcccagc

SEQ ID NO: 139783 - DNA, 22 bp, Homo sapiens
taatgtcaccaccttcccagct

SEQ ID NO: 139784 - DNA, 19 bp, Homo sapiens
taatgtgtattacaaatat

SEQ ID NO: 139785 - DNA, 21 bp, Homo sapiens
taatgttgtatgtcttgttta

SEQ ID NO: 139786 - DNA, 14 bp, Homo sapiens
taatgttgttattt

SEQ ID NO: 139787 - DNA, 22 bp, Homo sapiens
taattaaataaatcattaatac

SEQ ID NO: 139788 - DNA, 14 bp, Homo sapiens
taattattattctt

SEQ ID NO: 139789 - DNA, 13 bp, Homo sapiens
taattcaagaaaa

SEQ ID NO: 139790 - DNA, 21 bp, Homo sapiens
taattcagcactgatttcaca

SEQ ID NO: 139791 - DNA, 11 bp, Homo sapiens
taattctaaat

SEQ ID NO: 139792 - DNA, 18 bp, Homo sapiens
taattgatcaaattcatt

SEQ ID NO: 139793 - DNA, 19 bp, Homo sapiens
taattgatcaaattcattt

SEQ ID NO: 139794 - DNA, 23 bp, Homo sapiens
taatttatcttgtctctgggctt

SEQ ID NO: 139795 - DNA, 14 bp, Homo sapiens
taatttatgagttt

SEQ ID NO: 139796 - DNA, 20 bp, Homo sapiens
taatttattgtttttccttg

SEQ ID NO: 139797 - DNA, 21 bp, Homo sapiens
taatttgtacatatgtaaaat

SEQ ID NO: 139798 - DNA, 13 bp, Homo sapiens
taattttaagaaa

SEQ ID NO: 139799 - DNA, 20 bp, Homo sapiens
taatttttttaaccaaaggt

SEQ ID NO: 139800 - DNA, 21 bp, Homo sapiens
tacaaaaaaaaaaaaaaatta

SEQ ID NO: 139801 - DNA, 13 bp, Homo sapiens
tacaaaaacacag

SEQ ID NO: 139802 - DNA, 15 bp, Homo sapiens
tacaaaaacacagca

SEQ ID NO: 139803 - DNA, 19 bp, Homo sapiens
tacaaatactcttaggaag

SEQ ID NO: 139804 - DNA, 17 bp, Homo sapiens
tacaaatataagaataa

SEQ ID NO: 139805 - DNA, 14 bp, Homo sapiens
tacaaggcaacata

SEQ ID NO: 139806 - DNA, 18 bp, Homo sapiens
tacaagggtctagggaga

SEQ ID NO: 139807 - DNA, 13 bp, Homo sapiens
tacaagtgtatat

SEQ ID NO: 139808 - DNA, 20 bp, Homo sapiens
tacaataaaatcttgaaaat

SEQ ID NO: 139809 - DNA, 16 bp, Homo sapiens
tacaatgttcatccca

SEQ ID NO: 139810 - DNA, 17 bp, Homo sapiens
tacacactcaaatcaag

SEQ ID NO: 139811 - DNA, 16 bp, Homo sapiens
tacacccttttccagc

SEQ ID NO: 139812 - DNA, 17 bp, Homo sapiens
tacaccgggcctggaga

SEQ ID NO: 139813 - DNA, 12 bp, Homo sapiens
tacactcttata

SEQ ID NO: 139814 - DNA, 13 bp, Homo sapiens
tacactcttatag

SEQ ID NO: 139815 - DNA, 19 bp, Homo sapiens
tacagaactctttcaaaac

SEQ ID NO: 139816 - DNA, 18 bp, Homo sapiens
tacagaattctgctacct

SEQ ID NO: 139817 - DNA, 13 bp, Homo sapiens
tacagctgcctgc

SEQ ID NO: 139818 - DNA, 16 bp, Homo sapiens
tacagctgtttaagat

SEQ ID NO: 139819 - DNA, 18 bp, Homo sapiens
tacagggtagcaggtacc

SEQ ID NO: 139820 - DNA, 21 bp, Homo sapiens
tacaggtaaggtgagggaata

SEQ ID NO: 139821 - DNA, 14 bp, Homo sapiens
tacagtaggagccc

SEQ ID NO: 139822 - DNA, 17 bp, Homo sapiens
tacagttgaaaaacagc

SEQ ID NO: 139823 - DNA, 20 bp, Homo sapiens
tacagttgaaaaacagctga

SEQ ID NO: 139824 - DNA, 15 bp, Homo sapiens
tacatatgtaaaata

SEQ ID NO: 139825 - DNA, 17 bp, Homo sapiens
tacatatgtaaaataaa

SEQ ID NO: 139826 - DNA, 20 bp, Homo sapiens
tacatatgtaaaataaaatt

SEQ ID NO: 139827 - DNA, 16 bp, Homo sapiens
tacatcacttgagaca

SEQ ID NO: 139828 - DNA, 22 bp, Homo sapiens
tacatgaggtactgagagtgaa

SEQ ID NO: 139829 - DNA, 16 bp, Homo sapiens
tacatgcaatttatta

SEQ ID NO: 139830 - DNA, 23 bp, Homo sapiens
tacattaatgttaattcagcact

SEQ ID NO: 139831 - DNA, 23 bp, Homo sapiens
tacattaattattattgctgttg

SEQ ID NO: 139832 - DNA, 17 bp, Homo sapiens
tacattgtaaatagtat

SEQ ID NO: 139833 - DNA, 13 bp, Homo sapiens
tacatttaataca

SEQ ID NO: 139834 - DNA, 17 bp, Homo sapiens
taccaaaattatttcag

SEQ ID NO: 139835 - DNA, 18 bp, Homo sapiens
taccaaaattatttcaga

SEQ ID NO: 139836 - DNA, 16 bp, Homo sapiens
taccaacacgagcagg

SEQ ID NO: 139837 - DNA, 17 bp, Homo sapiens
taccaactttctgtaaa

SEQ ID NO: 139838 - DNA, 21 bp, Homo sapiens
taccaagtttcaggtattaag

SEQ ID NO: 139839 - DNA, 22 bp, Homo sapiens
taccaatcattttaattattat

SEQ ID NO: 139840 - DNA, 13 bp, Homo sapiens
taccaatgaaaaa

SEQ ID NO: 139841 - DNA, 15 bp, Homo sapiens
taccagcgaggaggc

SEQ ID NO: 139842 - DNA, 11 bp, Homo sapiens
taccagtgtgg

SEQ ID NO: 139843 - DNA, 15 bp, Homo sapiens
taccataatgtattt

SEQ ID NO: 139844 - DNA, 17 bp, Homo sapiens
taccatcccctgtagag

SEQ ID NO: 139845 - DNA, 22 bp, Homo sapiens
tacccaaaggatactgtaacac

SEQ ID NO: 139846 - DNA, 22 bp, Homo sapiens
taccccaccacgatgtggccct

SEQ ID NO: 139847 - DNA, 17 bp, Homo sapiens
tacccgttcacattttt

SEQ ID NO: 139848 - DNA, 17 bp, Homo sapiens
taccctgagctgaggca

SEQ ID NO: 139849 - DNA, 18 bp, Homo sapiens
taccgagtctcttctcca

SEQ ID NO: 139850 - DNA, 22 bp, Homo sapiens
taccgagtctcttctccactgg

SEQ ID NO: 139851 - DNA, 19 bp, Homo sapiens
tacctaaaaggaaatctca

SEQ ID NO: 139852 - DNA, 22 bp, Homo sapiens
tacctaaaaggaaatctcaccc

SEQ ID NO: 139853 - DNA, 22 bp, Homo sapiens
tacctaacgaagtatccttcag

SEQ ID NO: 139854 - DNA, 11 bp, Homo sapiens
tacctcctcct

SEQ ID NO: 139855 - DNA, 18 bp, Homo sapiens
tacctcggtgccttcctc

SEQ ID NO: 139856 - DNA, 23 bp, Homo sapiens
tacctctcttatagaatatttat

SEQ ID NO: 139857 - DNA, 18 bp, Homo sapiens
taccttgaacactggggg

SEQ ID NO: 139858 - DNA, 14 bp, Homo sapiens
tacgaatacttttg

SEQ ID NO: 139859 - DNA, 16 bp, Homo sapiens
tacgatggcacccagt

SEQ ID NO: 139860 - DNA, 13 bp, Homo sapiens
tacgctctccttt

SEQ ID NO: 139861 - DNA, 15 bp, Homo sapiens
tacgctctcctttct

SEQ ID NO: 139862 - DNA, 18 bp, Homo sapiens
tacgtcaaacatgaagtg

SEQ ID NO: 139863 - DNA, 14 bp, Homo sapiens
tacgttaccaggca

SEQ ID NO: 139864 - DNA, 14 bp, Homo sapiens
tactaaaaatacaa

SEQ ID NO: 139865 - DNA, 18 bp, Homo sapiens
tactaaaaatacaaaaaa

SEQ ID NO: 139866 - DNA, 21 bp, Homo sapiens
tactacagttgttttttgaaa

SEQ ID NO: 139867 - DNA, 17 bp, Homo sapiens
tactacatcgccctcca

SEQ ID NO: 139868 - DNA, 16 bp, Homo sapiens
tactactgaatctcta

SEQ ID NO: 139869 - DNA, 17 bp, Homo sapiens
tactactgaatctctaa

SEQ ID NO: 139870 - DNA, 22 bp, Homo sapiens
tactcaattgataaacatttaa

SEQ ID NO: 139871 - DNA, 20 bp, Homo sapiens
tactcactttctagattaag

SEQ ID NO: 139872 - DNA, 16 bp, Homo sapiens
tactcagcagccctcc

SEQ ID NO: 139873 - DNA, 17 bp, Homo sapiens
tactcagcagccctcct

SEQ ID NO: 139874 - DNA, 23 bp, Homo sapiens
tactcagccctgggccccaccac

SEQ ID NO: 139875 - DNA, 22 bp, Homo sapiens
tactccctcaaagcacacgtca

SEQ ID NO: 139876 - DNA, 14 bp, Homo sapiens
tactctccaacctg

SEQ ID NO: 139877 - DNA, 16 bp, Homo sapiens
tactctccaacctgga

SEQ ID NO: 139878 - DNA, 18 bp, Homo sapiens
tactctccaacctggaca

SEQ ID NO: 139879 - DNA, 18 bp, Homo sapiens
tactcttaggaagagaaa

SEQ ID NO: 139880 - DNA, 15 bp, Homo sapiens
tactgagccttgtaa

SEQ ID NO: 139881 - DNA, 23 bp, Homo sapiens
tactgagccttgtaattctaaat

SEQ ID NO: 139882 - DNA, 18 bp, Homo sapiens
tactgagcttctctgtga

SEQ ID NO: 139883 - DNA, 13 bp, Homo sapiens
tactgatttttgt

SEQ ID NO: 139884 - DNA, 15 bp, Homo sapiens
tactgcagctttaca

SEQ ID NO: 139885 - DNA, 14 bp, Homo sapiens
tactgcagggccag

SEQ ID NO: 139886 - DNA, 14 bp, Homo sapiens
gggcaaagcctagt

SEQ ID NO: 139887 - DNA, 13 bp, Homo sapiens
gggcaaggagacc

SEQ ID NO: 139888 - DNA, 16 bp, Homo sapiens
gggcactggtggcccg

SEQ ID NO: 139889 - DNA, 14 bp, Homo sapiens
gggcagaggctgga

SEQ ID NO: 139890 - DNA, 16 bp, Homo sapiens
gggcagaggctggagg

SEQ ID NO: 139891 - DNA, 21 bp, Homo sapiens
gggcagaggctggaggcaggg

SEQ ID NO: 139892 - DNA, 14 bp, Homo sapiens
gggcagagggcaga

SEQ ID NO: 139893 - DNA, 14 bp, Homo sapiens
gggcagggcatgac

SEQ ID NO: 139894 - DNA, 19 bp, Homo sapiens
tactgcccaggcctgcctg

SEQ ID NO: 139895 - DNA, 20 bp, Homo sapiens
tactgcccaggcctgcctgt

SEQ ID NO: 139896 - DNA, 21 bp, Homo sapiens
tactgcccaggcctgcctgtt

SEQ ID NO: 139897 - DNA, 17 bp, Homo sapiens
tactgtattttgtattg

SEQ ID NO: 139898 - DNA, 23 bp, Homo sapiens
tactgtattttgtattgtttcaa

SEQ ID NO: 139899 - DNA, 23 bp, Homo sapiens
tactgtcagctcccctcggagaa

SEQ ID NO: 139900 - DNA, 13 bp, Homo sapiens
tacttaactattc

SEQ ID NO: 139901 - DNA, 15 bp, Homo sapiens
tacttagcagctatc

SEQ ID NO: 139902 - DNA, 19 bp, Homo sapiens
tacttcactttaattctca

SEQ ID NO: 139903 - DNA, 22 bp, Homo sapiens
tacttcactttaattctcatgt

SEQ ID NO: 139904 - DNA, 14 bp, Homo sapiens
tacttcttatacat

SEQ ID NO: 139905 - DNA, 18 bp, Homo sapiens
tacttcttcattcaatac

SEQ ID NO: 139906 - DNA, 23 bp, Homo sapiens
tacttgggagacctgtaatcata

SEQ ID NO: 139907 - DNA, 22 bp, Homo sapiens
tactttaagcactacataaact

SEQ ID NO: 139908 - DNA, 20 bp, Homo sapiens
tactttcctttccccagccc

SEQ ID NO: 139909 - DNA, 13 bp, Homo sapiens
tagaaaactgaaa

SEQ ID NO: 139910 - DNA, 15 bp, Homo sapiens
tagaaaactgaaaat

SEQ ID NO: 139911 - DNA, 15 bp, Homo sapiens
tagaaaccttaatat

SEQ ID NO: 139912 - DNA, 14 bp, Homo sapiens
tagaaagcaggggc

SEQ ID NO: 139913 - DNA, 22 bp, Homo sapiens
tagaaagcaggggctacaagag

SEQ ID NO: 139914 - DNA, 15 bp, Homo sapiens
tagaaatataattga

SEQ ID NO: 139915 - DNA, 18 bp, Homo sapiens
tagaaattagctgtgtga

SEQ ID NO: 139916 - DNA, 14 bp, Homo sapiens
tagaacatccctgc

SEQ ID NO: 139917 - DNA, 17 bp, Homo sapiens
tagaaggagacagagct

SEQ ID NO: 139918 - DNA, 23 bp, Homo sapiens
tagaaggagacagagctggttgg

SEQ ID NO: 139919 - DNA, 19 bp, Homo sapiens
tagaagtggaccaggacag

SEQ ID NO: 139920 - DNA, 12 bp, Homo sapiens
tagaatatttat

SEQ ID NO: 139921 - DNA, 15 bp, Homo sapiens
tagaatatttattac

SEQ ID NO: 139922 - DNA, 18 bp, Homo sapiens
tagaattaacacatgatc

SEQ ID NO: 139923 - DNA, 15 bp, Homo sapiens
tagaattccctctct

SEQ ID NO: 139924 - DNA, 19 bp, Homo sapiens
tagaattccctctctctga

SEQ ID NO: 139925 - DNA, 15 bp, Homo sapiens
tagaatttattcaat

SEQ ID NO: 139926 - DNA, 20 bp, Homo sapiens
tagaatttattcaattcctc

SEQ ID NO: 139927 - DNA, 23 bp, Homo sapiens
tagacatttctcttactgcaaat

SEQ ID NO: 139928 - DNA, 14 bp, Homo sapiens
tagacctcagcctg

SEQ ID NO: 139929 - DNA, 22 bp, Homo sapiens
tagacctcagcctgtgctgccc

SEQ ID NO: 139930 - DNA, 23 bp, Homo sapiens
tagactaaggccattattgtact

SEQ ID NO: 139931 - DNA, 11 bp, Homo sapiens
tagactttctg

SEQ ID NO: 139932 - DNA, 19 bp, Homo sapiens
tagagatcatcctttccag

SEQ ID NO: 139933 - DNA, 21 bp, Homo sapiens
tagagcaaaattgatgtgttt

SEQ ID NO: 139934 - DNA, 15 bp, Homo sapiens
tagagcttctggcac

SEQ ID NO: 139935 - DNA, 18 bp, Homo sapiens
tagaggaaaaaaatgact

SEQ ID NO: 139936 - DNA, 22 bp, Homo sapiens
tagaggaaaaaaatgactaaaa

SEQ ID NO: 139937 - DNA, 22 bp, Homo sapiens
tagaggagaaactggaactctc

SEQ ID NO: 139938 - DNA, 18 bp, Homo sapiens
tagagtgttgttgagaat

SEQ ID NO: 139939 - DNA, 16 bp, Homo sapiens
tagataggtaaatacc

SEQ ID NO: 139940 - DNA, 19 bp, Homo sapiens
tagatatccacttgagaca

SEQ ID NO: 139941 - DNA, 21 bp, Homo sapiens
tagatgagattgttttatcat

SEQ ID NO: 139942 - DNA, 22 bp, Homo sapiens
tagatgctctatgtgcttgtaa

SEQ ID NO: 139943 - DNA, 23 bp, Homo sapiens
tagatgctgactgtactcctccc

SEQ ID NO: 139944 - DNA, 15 bp, Homo sapiens
tagatggtgaaattt

SEQ ID NO: 139945 - DNA, 21 bp, Homo sapiens
tagatgttctaagtctttcca

SEQ ID NO: 139946 - DNA, 23 bp, Homo sapiens
tagattccccattgcctcctcct

SEQ ID NO: 139947 - DNA, 20 bp, Homo sapiens
tagattctacatattcttta

SEQ ID NO: 139948 - DNA, 15 bp, Homo sapiens
tagcagacagtgttt

SEQ ID NO: 139949 - DNA, 20 bp, Homo sapiens
tagcagattttaattttgaa

SEQ ID NO: 139950 - DNA, 20 bp, Homo sapiens
tagcagggcatggctgggaa

SEQ ID NO: 139951 - DNA, 14 bp, Homo sapiens
tagcatttttgatt

SEQ ID NO: 139952 - DNA, 22 bp, Homo sapiens
tagccaccaactcttgcaggtc

SEQ ID NO: 139953 - DNA, 12 bp, Homo sapiens
tagcccatccct

SEQ ID NO: 139954 - DNA, 20 bp, Homo sapiens
tagcccatccctgcctggtc

SEQ ID NO: 139955 - DNA, 16 bp, Homo sapiens
tagccctggccagagg

SEQ ID NO: 139956 - DNA, 13 bp, Homo sapiens
tagccctttctgt

SEQ ID NO: 139957 - DNA, 13 bp, Homo sapiens
tagccgacctcag

SEQ ID NO: 139958 - DNA, 17 bp, Homo sapiens
tagccgacctcagcctt

SEQ ID NO: 139959 - DNA, 15 bp, Homo sapiens
tagccgagagcctgc

SEQ ID NO: 139960 - DNA, 17 bp, Homo sapiens
tagccgagagcctgctc

SEQ ID NO: 139961 - DNA, 18 bp, Homo sapiens
tagccgagagcctgctcc

SEQ ID NO: 139962 - DNA, 19 bp, Homo sapiens
tagccgagagcctgctccc

SEQ ID NO: 139963 - DNA, 17 bp, Homo sapiens
tagcctgcctcttctct

SEQ ID NO: 139964 - DNA, 16 bp, Homo sapiens
tagcctttggctctgg

SEQ ID NO: 139965 - DNA, 22 bp, Homo sapiens
tagcgctgccgcaccccagagt

SEQ ID NO: 139966 - DNA, 12 bp, Homo sapiens
tagctaatgtaa

SEQ ID NO: 139967 - DNA, 19 bp, Homo sapiens
tagctaatgtaataactgt

SEQ ID NO: 139968 - DNA, 14 bp, Homo sapiens
tagctagaagtggg

SEQ ID NO: 139969 - DNA, 19 bp, Homo sapiens
tagctagaagtgggccagg

SEQ ID NO: 139970 - DNA, 14 bp, Homo sapiens
tagctagaggaacc

SEQ ID NO: 139971 - DNA, 15 bp, Homo sapiens
tagctagaggaacca

SEQ ID NO: 139972 - DNA, 14 bp, Homo sapiens
tagctatcagaaga

SEQ ID NO: 139973 - DNA, 20 bp, Homo sapiens
tagctccacaccctctccca

SEQ ID NO: 139974 - DNA, 23 bp, Homo sapiens
tagctgacccagccccttgagaa

SEQ ID NO: 139975 - DNA, 12 bp, Homo sapiens
tagctgtacaaa

SEQ ID NO: 139976 - DNA, 16 bp, Homo sapiens
tagctgtacaaatata

SEQ ID NO: 139977 - DNA, 15 bp, Homo sapiens
tagcttagacctcag

SEQ ID NO: 139978 - DNA, 17 bp, Homo sapiens
tagcttagacctcagcc

SEQ ID NO: 139979 - DNA, 20 bp, Homo sapiens
tagcttagacctcagcctgt

SEQ ID NO: 139980 - DNA, 23 bp, Homo sapiens
tagcttagacctcagcctgtgct

SEQ ID NO: 139981 - DNA, 18 bp, Homo sapiens
tagctttattttttaagt

SEQ ID NO: 139982 - DNA, 19 bp, Homo sapiens
tagctttattttttaagta

SEQ ID NO: 139983 - DNA, 20 bp, Homo sapiens
tagctttattttttaagtat

SEQ ID NO: 139984 - DNA, 18 bp, Homo sapiens
tagcttttattgtataaa

SEQ ID NO: 139985 - DNA, 13 bp, Homo sapiens
tagcttttccctt

SEQ ID NO: 139986 - DNA, 17 bp, Homo sapiens
taggaaaagtacattta

SEQ ID NO: 139987 - DNA, 19 bp, Homo sapiens
taggaaaagtacatttaat

SEQ ID NO: 139988 - DNA, 20 bp, Homo sapiens
taggaattgacccacaagaa

SEQ ID NO: 139989 - DNA, 20 bp, Homo sapiens
taggacataaattagaggtc

SEQ ID NO: 139990 - DNA, 21 bp, Homo sapiens
taggatttaacagtcatttaa

SEQ ID NO: 139991 - DNA, 11 bp, Homo sapiens
taggcagacac

SEQ ID NO: 139992 - DNA, 12 bp, Homo sapiens
taggcagacaca

SEQ ID NO: 139993 - DNA, 20 bp, Homo sapiens
taggcatttgctgaatacag

SEQ ID NO: 139994 - DNA, 19 bp, Homo sapiens
taggctggagcccagggag

SEQ ID NO: 139995 - DNA, 17 bp, Homo sapiens
tagggatccctcatctg

SEQ ID NO: 139996 - DNA, 16 bp, Homo sapiens
tagggccaagcccagc

SEQ ID NO: 139997 - DNA, 15 bp, Homo sapiens
tagggccaggcaggt

SEQ ID NO: 139998 - DNA, 17 bp, Homo sapiens
tagggttataataatgt

SEQ ID NO: 139999 - DNA, 23 bp, Homo sapiens
taggtgctacaaaaacacagcaa

SEQ ID NO: 140000 - DNA, 12 bp, Homo sapiens
taggttctaaaa

SEQ ID NO: 140001 - DNA, 16 bp, Homo sapiens
tagtaagaaaacatca

SEQ ID NO: 140002 - DNA, 14 bp, Homo sapiens
tagtaatagagcaa

SEQ ID NO: 140003 - DNA, 20 bp, Homo sapiens
tagtaatagagcaaaattga

SEQ ID NO: 140004 - DNA, 14 bp, Homo sapiens
tagtactaactcct

SEQ ID NO: 140005 - DNA, 16 bp, Homo sapiens
tagtagccctttctgt

SEQ ID NO: 140006 - DNA, 18 bp, Homo sapiens
tagtagccctttctgtgt

SEQ ID NO: 140007 - DNA, 19 bp, Homo sapiens
tagtagttcctgctacaac

SEQ ID NO: 140008 - DNA, 15 bp, Homo sapiens
tagtcaagattgtgt

SEQ ID NO: 140009 - DNA, 23 bp, Homo sapiens
tagtccagctttgttcttcttaa

SEQ ID NO: 140010 - DNA, 14 bp, Homo sapiens
tagtcccagctact

SEQ ID NO: 140011 - DNA, 21 bp, Homo sapiens
tagtgaaggcttctctctgtg

SEQ ID NO: 140012 - DNA, 18 bp, Homo sapiens
tagtgatggttcccctgt

SEQ ID NO: 140013 - DNA, 14 bp, Homo sapiens
tagtggcttcaaaa

SEQ ID NO: 140014 - DNA, 19 bp, Homo sapiens
tagtgtaaaataagaatga

SEQ ID NO: 140015 - DNA, 23 bp, Homo sapiens
tagttaatattgtgaagaaaaat

SEQ ID NO: 140016 - DNA, 22 bp, Homo sapiens
tagttagccaatatttttctta

SEQ ID NO: 140017 - DNA, 21 bp, Homo sapiens
tagttaggaaataaaaccttt

SEQ ID NO: 140018 - DNA, 15 bp, Homo sapiens
tagttaggatagcat

SEQ ID NO: 140019 - DNA, 16 bp, Homo sapiens
tagttgctccgcctct

SEQ ID NO: 140020 - DNA, 12 bp, Homo sapiens
tagtttcttgtg

SEQ ID NO: 140021 - DNA, 17 bp, Homo sapiens
tagttttcagtttgtat

SEQ ID NO: 140022 - DNA, 23 bp, Homo sapiens
tataaaaagaaaagataaagatg

SEQ ID NO: 140023 - DNA, 14 bp, Homo sapiens
tataaaataaatat

SEQ ID NO: 140024 - DNA, 17 bp, Homo sapiens
tataaaataaatatata

SEQ ID NO: 140025 - DNA, 22 bp, Homo sapiens
tataaaataaatatatataaac

SEQ ID NO: 140026 - DNA, 15 bp, Homo sapiens
tataaaattaagcaa

SEQ ID NO: 140027 - DNA, 18 bp, Homo sapiens
tataaacatcacacacac

SEQ ID NO: 140028 - DNA, 16 bp, Homo sapiens
tataaacctaaaaaag

SEQ ID NO: 140029 - DNA, 19 bp, Homo sapiens
tataaacctaaaaaagata

SEQ ID NO: 140030 - DNA, 16 bp, Homo sapiens
tataaaggttgacaat

SEQ ID NO: 140031 - DNA, 15 bp, Homo sapiens
tataaatatatttaa

SEQ ID NO: 140032 - DNA, 19 bp, Homo sapiens
tataactatgttgataaaa

SEQ ID NO: 140033 - DNA, 18 bp, Homo sapiens
tataactcatcataaaat

SEQ ID NO: 140034 - DNA, 20 bp, Homo sapiens
tataactcatcataaaataa

SEQ ID NO: 140035 - DNA, 20 bp, Homo sapiens
gtcagcaaaaagcaaaatca

SEQ ID NO: 140036 - DNA, 21 bp, Homo sapiens
gtcagcgcaggtttagtttac

SEQ ID NO: 140037 - DNA, 19 bp, Homo sapiens
gtcagctcccctcggagaa

SEQ ID NO: 140038 - DNA, 23 bp, Homo sapiens
gtcagctcccctcggagaagagc

SEQ ID NO: 140039 - DNA, 13 bp, Homo sapiens
gtcaggagttcct

SEQ ID NO: 140040 - DNA, 14 bp, Homo sapiens
gtcaggccacggca

SEQ ID NO: 140041 - DNA, 15 bp, Homo sapiens
gtcaggccacggcag

SEQ ID NO: 140042 - DNA, 16 bp, Homo sapiens
gtcagtatcaggcctg

SEQ ID NO: 140043 - DNA, 23 bp, Homo sapiens
gtcagtatcaggcctgccagacg

SEQ ID NO: 140044 - DNA, 22 bp, Homo sapiens
gtcagtgggaacgtgactgccc

SEQ ID NO: 140045 - DNA, 15 bp, Homo sapiens
tataacttcttaaaa

SEQ ID NO: 140046 - DNA, 14 bp, Homo sapiens
tataagtaagaaaa

SEQ ID NO: 140047 - DNA, 13 bp, Homo sapiens
tataagtgtacat

SEQ ID NO: 140048 - DNA, 16 bp, Homo sapiens
tataataaatgtacat

SEQ ID NO: 140049 - DNA, 17 bp, Homo sapiens
tataatatactatattt

SEQ ID NO: 140050 - DNA, 17 bp, Homo sapiens
tataattttatgaatgt

SEQ ID NO: 140051 - DNA, 22 bp, Homo sapiens
tataattttatgaatgtctttg

SEQ ID NO: 140052 - DNA, 14 bp, Homo sapiens
tatacatttgataa

SEQ ID NO: 140053 - DNA, 20 bp, Homo sapiens
tatacgcagcgtgctttaaa

SEQ ID NO: 140054 - DNA, 16 bp, Homo sapiens
tatagacaaataataa

SEQ ID NO: 140055 - DNA, 16 bp, Homo sapiens
tatagacccgaggaaa

SEQ ID NO: 140056 - DNA, 18 bp, Homo sapiens
tatagctgtacaaatata

SEQ ID NO: 140057 - DNA, 14 bp, Homo sapiens
tataggaattgacc

SEQ ID NO: 140058 - DNA, 20 bp, Homo sapiens
tataggtgctacaaaaacac

SEQ ID NO: 140059 - DNA, 13 bp, Homo sapiens
tatagtgatgtaa

SEQ ID NO: 140060 - DNA, 18 bp, Homo sapiens
tatagtgatgtaatcttg

SEQ ID NO: 140061 - DNA, 19 bp, Homo sapiens
tatagttaggatagcattt

SEQ ID NO: 140062 - DNA, 13 bp, Homo sapiens
tatagtttcagat

SEQ ID NO: 140063 - DNA, 22 bp, Homo sapiens
tatagtttcagatatatatcat

SEQ ID NO: 140064 - DNA, 12 bp, Homo sapiens
tatataaaaaga

SEQ ID NO: 140065 - DNA, 19 bp, Homo sapiens
tatataaaataaatatata

SEQ ID NO: 140066 - DNA, 15 bp, Homo sapiens
tatataaacctaaaa

SEQ ID NO: 140067 - DNA, 22 bp, Homo sapiens
tatataagatggaagcttccag

SEQ ID NO: 140068 - DNA, 23 bp, Homo sapiens
tatataagtgtacatatgtgctg

SEQ ID NO: 140069 - DNA, 22 bp, Homo sapiens
tatatacaataacataatttgt

SEQ ID NO: 140070 - DNA, 22 bp, Homo sapiens
tatatagtttattgacaataat

SEQ ID NO: 140071 - DNA, 10 bp, Homo sapiens
tatatataaa

SEQ ID NO: 140072 - DNA, 16 bp, Homo sapiens
tatatataaacctaaa

SEQ ID NO: 140073 - DNA, 12 bp, Homo sapiens
tatatatagaat

SEQ ID NO: 140074 - DNA, 21 bp, Homo sapiens
tatatatctgcttcagtggag

SEQ ID NO: 140075 - DNA, 14 bp, Homo sapiens
tatatatttataac

SEQ ID NO: 140076 - DNA, 13 bp, Homo sapiens
tatatcagaaaag

SEQ ID NO: 140077 - DNA, 14 bp, Homo sapiens
tatatcccagaaat

SEQ ID NO: 140078 - DNA, 17 bp, Homo sapiens
tatatcctttctaacaa

SEQ ID NO: 140079 - DNA, 20 bp, Homo sapiens
tatatcctttctaacaaaaa

SEQ ID NO: 140080 - DNA, 15 bp, Homo sapiens
tatatgatttatagt

SEQ ID NO: 140081 - DNA, 16 bp, Homo sapiens
tatatgatttatagtt

SEQ ID NO: 140082 - DNA, 21 bp, Homo sapiens
tatatgatttatagtttgtac

SEQ ID NO: 140083 - DNA, 19 bp, Homo sapiens
tatatggcagagttgtaaa

SEQ ID NO: 140084 - DNA, 22 bp, Homo sapiens
tatatggcagagttgtaaatat

SEQ ID NO: 140085 - DNA, 14 bp, Homo sapiens
tatatttaaaagaa

SEQ ID NO: 140086 - DNA, 21 bp, Homo sapiens
tatatttagattgttaaaata

SEQ ID NO: 140087 - DNA, 23 bp, Homo sapiens
tatatttataactcatcataaaa

SEQ ID NO: 140088 - DNA, 24 bp, Homo sapiens
tatatttataactcatcataaaat

SEQ ID NO: 140089 - DNA, 13 bp, Homo sapiens
tatatttttatat

SEQ ID NO: 140090 - DNA, 13 bp, Homo sapiens
tatcaaactgaag

SEQ ID NO: 140091 - DNA, 15 bp, Homo sapiens
tatcaatagtcaaga

SEQ ID NO: 140092 - DNA, 20 bp, Homo sapiens
tatcaatagtcaagaaaaat

SEQ ID NO: 140093 - DNA, 16 bp, Homo sapiens
tatcacaaatcttaac

SEQ ID NO: 140094 - DNA, 19 bp, Homo sapiens
tatcaccgtgggctccctg

SEQ ID NO: 140095 - DNA, 19 bp, Homo sapiens
tatcagcctgtctcttcca

SEQ ID NO: 140096 - DNA, 22 bp, Homo sapiens
tatcagcctgtctcttccatat

SEQ ID NO: 140097 - DNA, 15 bp, Homo sapiens
tatcaggtctcccac

SEQ ID NO: 140098 - DNA, 15 bp, Homo sapiens
tatcatattggtatt

SEQ ID NO: 140099 - DNA, 17 bp, Homo sapiens
tatcattttagaagact

SEQ ID NO: 140100 - DNA, 19 bp, Homo sapiens
tatccaacatcaacatctt

SEQ ID NO: 140101 - DNA, 13 bp, Homo sapiens
tatccaccacctc

SEQ ID NO: 140102 - DNA, 15 bp, Homo sapiens
tatccaccacctccc

SEQ ID NO: 140103 - DNA, 18 bp, Homo sapiens
tatccaggtaatccaaga

SEQ ID NO: 140104 - DNA, 21 bp, Homo sapiens
tatccaggtaatccaagatat

SEQ ID NO: 140105 - DNA, 17 bp, Homo sapiens
tatccatgggggcaggg

SEQ ID NO: 140106 - DNA, 19 bp, Homo sapiens
tatccatgggggcagggca

SEQ ID NO: 140107 - DNA, 20 bp, Homo sapiens
tatccatgggggcagggcat

SEQ ID NO: 140108 - DNA, 21 bp, Homo sapiens
tatcccccccctgtatagtta

SEQ ID NO: 140109 - DNA, 16 bp, Homo sapiens
tatcccctcccagtca

SEQ ID NO: 140110 - DNA, 15 bp, Homo sapiens
tatccctacatgtat

SEQ ID NO: 140111 - DNA, 15 bp, Homo sapiens
tatcctacaacaaga

SEQ ID NO: 140112 - DNA, 15 bp, Homo sapiens
tatccttcagcctga

SEQ ID NO: 140113 - DNA, 20 bp, Homo sapiens
tatcgcaccactgtgtattt

SEQ ID NO: 140114 - DNA, 17 bp, Homo sapiens
tatctagtttaattaat

SEQ ID NO: 140115 - DNA, 22 bp, Homo sapiens
tatctagtttaattaatctgta

SEQ ID NO: 140116 - DNA, 13 bp, Homo sapiens
tatctcagggcct

SEQ ID NO: 140117 - DNA, 23 bp, Homo sapiens
tatctcttttgaatccatgcttg

SEQ ID NO: 140118 - DNA, 18 bp, Homo sapiens
tatctgcaggcagacacg

SEQ ID NO: 140119 - DNA, 21 bp, Homo sapiens
tatctgcaggcagacacggat

SEQ ID NO: 140120 - DNA, 20 bp, Homo sapiens
tatctgcttcagtggagaat

SEQ ID NO: 140121 - DNA, 19 bp, Homo sapiens
tatctgtgaaatgctggca

SEQ ID NO: 140122 - DNA, 22 bp, Homo sapiens
tatctgtgctcaggactcagaa

SEQ ID NO: 140123 - DNA, 17 bp, Homo sapiens
tatcttgtctctgggct

SEQ ID NO: 140124 - DNA, 20 bp, Homo sapiens
tatgaaagatggctgtgcct

SEQ ID NO: 140125 - DNA, 23 bp, Homo sapiens
tatgaaagatggctgtgcctctg

SEQ ID NO: 140126 - DNA, 18 bp, Homo sapiens
tatgaacggtgagcattg

SEQ ID NO: 140127 - DNA, 16 bp, Homo sapiens
tatgacagctgtccct

SEQ ID NO: 140128 - DNA, 20 bp, Homo sapiens
tatgacagctgtccctgtca

SEQ ID NO: 140129 - DNA, 15 bp, Homo sapiens
tatgagggaaaatga

SEQ ID NO: 140130 - DNA, 15 bp, Homo sapiens
tatgaggtctaggaa

SEQ ID NO: 140131 - DNA, 22 bp, Homo sapiens
tatgagttgttttcagactcag

SEQ ID NO: 140132 - DNA, 23 bp, Homo sapiens
tatgagtttttgatagctttatt

SEQ ID NO: 140133 - DNA, 15 bp, Homo sapiens
tatgatttggaaaat

SEQ ID NO: 140134 - DNA, 12 bp, Homo sapiens
tatgcaaagcac

SEQ ID NO: 140135 - DNA, 19 bp, Homo sapiens
tatgcacttataattttcc

SEQ ID NO: 140136 - DNA, 20 bp, Homo sapiens
tatgcacttataattttcct

SEQ ID NO: 140137 - DNA, 22 bp, Homo sapiens
tatgccatagcaagattgctta

SEQ ID NO: 140138 - DNA, 13 bp, Homo sapiens
tatgctaatcagg

SEQ ID NO: 140139 - DNA, 15 bp, Homo sapiens
tatggaacttctaat

SEQ ID NO: 140140 - DNA, 17 bp, Homo sapiens
tatggaacttctaatat

SEQ ID NO: 140141 - DNA, 18 bp, Homo sapiens
tatggaattacatgtaaa

SEQ ID NO: 140142 - DNA, 22 bp, Homo sapiens
tatggaattacatgtaaaacat

SEQ ID NO: 140143 - DNA, 14 bp, Homo sapiens
tatggcaaaaatgg

SEQ ID NO: 140144 - DNA, 20 bp, Homo sapiens
tatggggctgaacggggaga

SEQ ID NO: 140145 - DNA, 13 bp, Homo sapiens
tatggtataatgg

SEQ ID NO: 140146 - DNA, 14 bp, Homo sapiens
tatgtaaacataat

SEQ ID NO: 140147 - DNA, 19 bp, Homo sapiens
tatgtaaactgcattagaa

SEQ ID NO: 140148 - DNA, 23 bp, Homo sapiens
tatgtaaactgcattagaaatta

SEQ ID NO: 140149 - DNA, 11 bp, Homo sapiens
tatgtaacatg

SEQ ID NO: 140150 - DNA, 12 bp, Homo sapiens
tatgtaacatgt

SEQ ID NO: 140151 - DNA, 15 bp, Homo sapiens
tatgtagcaaaatac

SEQ ID NO: 140152 - DNA, 20 bp, Homo sapiens
tatgtatggaatacagtgtt

SEQ ID NO: 140153 - DNA, 17 bp, Homo sapiens
tatgtatgtttacatat

SEQ ID NO: 140154 - DNA, 12 bp, Homo sapiens
tatgtctattta

SEQ ID NO: 140155 - DNA, 13 bp, Homo sapiens
tatgtctatttaa

SEQ ID NO: 140156 - DNA, 19 bp, Homo sapiens
tatgtggtttccacgatga

SEQ ID NO: 140157 - DNA, 14 bp, Homo sapiens
tatgtgtaaaatgt

SEQ ID NO: 140158 - DNA, 15 bp, Homo sapiens
tatgttaagttactt

SEQ ID NO: 140159 - DNA, 22 bp, Homo sapiens
tatgttacatctgttttaaatt

SEQ ID NO: 140160 - DNA, 13 bp, Homo sapiens
tatgttgtcaaag

SEQ ID NO: 140161 - DNA, 14 bp, Homo sapiens
tattaaaaaaaaca

SEQ ID NO: 140162 - DNA, 23 bp, Homo sapiens
tattaaaaaaaacaaaaagaaca

SEQ ID NO: 140163 - DNA, 12 bp, Homo sapiens
tattaaaaatat

SEQ ID NO: 140164 - DNA, 21 bp, Homo sapiens
tattaaaaatataaaactgcg

SEQ ID NO: 140165 - DNA, 22 bp, Homo sapiens
tattaaaaatatggaacttcta

SEQ ID NO: 140166 - DNA, 10 bp, Homo sapiens
tattaaaatc

SEQ ID NO: 140167 - DNA, 18 bp, Homo sapiens
tattaacaaattatgtta

SEQ ID NO: 140168 - DNA, 15 bp, Homo sapiens
tattaagatttccaa

SEQ ID NO: 140169 - DNA, 19 bp, Homo sapiens
tattaataaacattctatc

SEQ ID NO: 140170 - DNA, 12 bp, Homo sapiens
tattagagaaga

SEQ ID NO: 140171 - DNA, 15 bp, Homo sapiens
tattataatttaatg

SEQ ID NO: 140172 - DNA, 15 bp, Homo sapiens
tattattttcacctg

SEQ ID NO: 140173 - DNA, 15 bp, Homo sapiens
tattcaaacagtctc

SEQ ID NO: 140174 - DNA, 15 bp, Homo sapiens
tattcaattcctctg

SEQ ID NO: 140175 - DNA, 16 bp, Homo sapiens
tattcaattcctctgg

SEQ ID NO: 140176 - DNA, 16 bp, Homo sapiens
tattcaggagagtaga

SEQ ID NO: 140177 - DNA, 15 bp, Homo sapiens
gtgactcacccaagc

SEQ ID NO: 140178 - DNA, 16 bp, Homo sapiens
gtgactctttttaggg

SEQ ID NO: 140179 - DNA, 16 bp, Homo sapiens
gtgacttcagctctgt

SEQ ID NO: 140180 - DNA, 22 bp, Homo sapiens
gtgagaaaaagctcctgtcctc

SEQ ID NO: 140181 - DNA, 17 bp, Homo sapiens
gtgagaataggcagccc

SEQ ID NO: 140182 - DNA, 23 bp, Homo sapiens
gtgagcctggctcttgtgctgga

SEQ ID NO: 140183 - DNA, 17 bp, Homo sapiens
gtgaggatgggaaggag

SEQ ID NO: 140184 - DNA, 18 bp, Homo sapiens
gtgaggatgtcactcaga

SEQ ID NO: 140185 - DNA, 15 bp, Homo sapiens
gtgaggccagggcag

SEQ ID NO: 140186 - DNA, 20 bp, Homo sapiens
gtgaggtgggttttcttccc

SEQ ID NO: 140187 - DNA, 13 bp, Homo sapiens
gtgagtgagcctg

SEQ ID NO: 140188 - DNA, 14 bp, Homo sapiens
gtgagtgagcctgg

SEQ ID NO: 140189 - DNA, 15 bp, Homo sapiens
gtgagtgagcctggc

SEQ ID NO: 140190 - DNA, 20 bp, Homo sapiens
gtgatacaacttcaagtgca

SEQ ID NO: 140191 - DNA, 21 bp, Homo sapiens
gtgatatataagtgtacatat

SEQ ID NO: 140192 - DNA, 19 bp, Homo sapiens
gtgatccttttatgttatt

SEQ ID NO: 140193 - DNA, 15 bp, Homo sapiens
gtgatctgaacagaa

SEQ ID NO: 140194 - DNA, 22 bp, Homo sapiens
gtgatcttggcttactgcagcc

SEQ ID NO: 140195 - DNA, 14 bp, Homo sapiens
gtgatgaatactgt

SEQ ID NO: 140196 - DNA, 14 bp, Homo sapiens
gtgatggttcccct

SEQ ID NO: 140197 - DNA, 18 bp, Homo sapiens
gtgatttagaactgtatg

SEQ ID NO: 140198 - DNA, 22 bp, Homo sapiens
gtgcaagtgtatgcacgtgtgc

SEQ ID NO: 140199 - DNA, 21 bp, Homo sapiens
tattggtaacatcctttctat

SEQ ID NO: 140200 - DNA, 13 bp, Homo sapiens
tattggtccagct

SEQ ID NO: 140201 - DNA, 22 bp, Homo sapiens
tattgtataagattagaatgaa

SEQ ID NO: 140202 - DNA, 15 bp, Homo sapiens
tattgtccattgtcc

SEQ ID NO: 140203 - DNA, 13 bp, Homo sapiens
tattgtgatctat

SEQ ID NO: 140204 - DNA, 15 bp, Homo sapiens
tattgtttaaaatca

SEQ ID NO: 140205 - DNA, 16 bp, Homo sapiens
tattgtttaaaatcat

SEQ ID NO: 140206 - DNA, 20 bp, Homo sapiens
tattgtttaaaatcatttct

SEQ ID NO: 140207 - DNA, 22 bp, Homo sapiens
tattgtttattctttttaaagt

SEQ ID NO: 140208 - DNA, 12 bp, Homo sapiens
tattgtttcaat

SEQ ID NO: 140209 - DNA, 22 bp, Homo sapiens
tattgtttttccttgtatttaa

SEQ ID NO: 140210 - DNA, 22 bp, Homo sapiens
tatttaaagacagggaagagca

SEQ ID NO: 140211 - DNA, 17 bp, Homo sapiens
tatttaagataattata

SEQ ID NO: 140212 - DNA, 16 bp, Homo sapiens
tatttaagcttatgtc

SEQ ID NO: 140213 - DNA, 19 bp, Homo sapiens
tatttactgagcttctctg

SEQ ID NO: 140214 - DNA, 18 bp, Homo sapiens
tatttacttcttatacat

SEQ ID NO: 140215 - DNA, 17 bp, Homo sapiens
tatttagattgttaaaa

SEQ ID NO: 140216 - DNA, 17 bp, Homo sapiens
tatttataaatatattt

SEQ ID NO: 140217 - DNA, 19 bp, Homo sapiens
tatttataaatatatttaa

SEQ ID NO: 140218 - DNA, 21 bp, Homo sapiens
tatttataactcatcataaaa

SEQ ID NO: 140219 - DNA, 23 bp, Homo sapiens
tatttataactcatcataaaata

SEQ ID NO: 140220 - DNA, 17 bp, Homo sapiens
tatttataagcagattt

SEQ ID NO: 140221 - DNA, 23 bp, Homo sapiens
tatttatatatgtatttataaat

SEQ ID NO: 140222 - DNA, 20 bp, Homo sapiens
tatttatatattggtaacat

SEQ ID NO: 140223 - DNA, 19 bp, Homo sapiens
tatttatatatttataact

SEQ ID NO: 140224 - DNA, 16 bp, Homo sapiens
tatttatctctattta

SEQ ID NO: 140225 - DNA, 16 bp, Homo sapiens
tatttattacctctga

SEQ ID NO: 140226 - DNA, 14 bp, Homo sapiens
tatttattactatg

SEQ ID NO: 140227 - DNA, 19 bp, Homo sapiens
tatttattattttcacctg

SEQ ID NO: 140228 - DNA, 13 bp, Homo sapiens
tatttatttactg

SEQ ID NO: 140229 - DNA, 14 bp, Homo sapiens
tatttcaaattgga

SEQ ID NO: 140230 - DNA, 21 bp, Homo sapiens
tatttccccaacatgtaataa

SEQ ID NO: 140231 - DNA, 21 bp, Homo sapiens
tatttccccaggggaaaatga

SEQ ID NO: 140232 - DNA, 22 bp, Homo sapiens
tatttccccaggggaaaatgaa

SEQ ID NO: 140233 - DNA, 15 bp, Homo sapiens
tatttgagagttcta

SEQ ID NO: 140234 - DNA, 19 bp, Homo sapiens
tatttgagagttctaaatt

SEQ ID NO: 140235 - DNA, 21 bp, Homo sapiens
tatttgcataacaattcctct

SEQ ID NO: 140236 - DNA, 14 bp, Homo sapiens
tatttgttattttc

SEQ ID NO: 140237 - DNA, 19 bp, Homo sapiens
tattttattccctttcaca

SEQ ID NO: 140238 - DNA, 13 bp, Homo sapiens
tattttcaccatt

SEQ ID NO: 140239 - DNA, 17 bp, Homo sapiens
tattttcagtattttgg

SEQ ID NO: 140240 - DNA, 22 bp, Homo sapiens
tattttccctattagagaagag

SEQ ID NO: 140241 - DNA, 14 bp, Homo sapiens
tattttctttgaaa

SEQ ID NO: 140242 - DNA, 16 bp, Homo sapiens
tattttcttttgtaaa

SEQ ID NO: 140243 - DNA, 21 bp, Homo sapiens
tatttttaatatatactatga

SEQ ID NO: 140244 - DNA, 21 bp, Homo sapiens
tatttttatatttagttatag

SEQ ID NO: 140245 - DNA, 20 bp, Homo sapiens
tatttttcatgattttgaaa

SEQ ID NO: 140246 - DNA, 15 bp, Homo sapiens
tattttttaagtatt

SEQ ID NO: 140247 - DNA, 13 bp, Homo sapiens
tattttttattgt

SEQ ID NO: 140248 - DNA, 17 bp, Homo sapiens
tattttttattgttttc

SEQ ID NO: 140249 - DNA, 16 bp, Homo sapiens
tatttttttgcaagtg

SEQ ID NO: 140250 - DNA, 22 bp, Homo sapiens
tcaaaacggttttactgcagct

SEQ ID NO: 140251 - DNA, 15 bp, Homo sapiens
tcaaaactcaaatgc

SEQ ID NO: 140252 - DNA, 24 bp, Homo sapiens
tcaaaattagtgctttttgtgtca

SEQ ID NO: 140253 - DNA, 14 bp, Homo sapiens
tcaaacaaagccag

SEQ ID NO: 140254 - DNA, 15 bp, Homo sapiens
tcaaacaaagccaga

SEQ ID NO: 140255 - DNA, 22 bp, Homo sapiens
tcaaacatgaagtgtgtttcct

SEQ ID NO: 140256 - DNA, 15 bp, Homo sapiens
tcaaaccataaactt

SEQ ID NO: 140257 - DNA, 16 bp, Homo sapiens
tcaaaccataaacttc

SEQ ID NO: 140258 - DNA, 18 bp, Homo sapiens
tcaaaccataaacttcat

SEQ ID NO: 140259 - DNA, 20 bp, Homo sapiens
tcaaagagagaaaataaaga

SEQ ID NO: 140260 - DNA, 12 bp, Homo sapiens
tcaaatttcaca

SEQ ID NO: 140261 - DNA, 15 bp, Homo sapiens
tcaaccaatgtagaa

SEQ ID NO: 140262 - DNA, 15 bp, Homo sapiens
tcaaccattccccat

SEQ ID NO: 140263 - DNA, 18 bp, Homo sapiens
tcaaccattccccatggg

SEQ ID NO: 140264 - DNA, 20 bp, Homo sapiens
tcaacctactttcatactga

SEQ ID NO: 140265 - DNA, 13 bp, Homo sapiens
tcaacctgcctga

SEQ ID NO: 140266 - DNA, 14 bp, Homo sapiens
tcaacgcagccctg

SEQ ID NO: 140267 - DNA, 16 bp, Homo sapiens
tcaactcagactagtt

SEQ ID NO: 140268 - DNA, 17 bp, Homo sapiens
tcaagaaaacaacttca

SEQ ID NO: 140269 - DNA, 20 bp, Homo sapiens
tcaagagggcactggtggcc

SEQ ID NO: 140270 - DNA, 22 bp, Homo sapiens
tcaagatgatgatgatctttaa

SEQ ID NO: 140271 - DNA, 19 bp, Homo sapiens
tcaagcagtctacccacct

SEQ ID NO: 140272 - DNA, 20 bp, Homo sapiens
tcaagcagtctacccacctc

SEQ ID NO: 140273 - DNA, 14 bp, Homo sapiens
tcaagtctctgctg

SEQ ID NO: 140274 - DNA, 16 bp, Homo sapiens
tcaagtctctgctggc

SEQ ID NO: 140275 - DNA, 23 bp, Homo sapiens
tcaagtgaaaaaggaggaagaga

SEQ ID NO: 140276 - DNA, 20 bp, Homo sapiens
tcaagtgcatgctctctgca

SEQ ID NO: 140277 - DNA, 22 bp, Homo sapiens
tcaagtgcatgctctctgcagc

SEQ ID NO: 140278 - DNA, 21 bp, Homo sapiens
tcaagttattgacaaactctc

SEQ ID NO: 140279 - DNA, 15 bp, Homo sapiens
tcaatattgtcattc

SEQ ID NO: 140280 - DNA, 12 bp, Homo sapiens
tcaatatttatt

SEQ ID NO: 140281 - DNA, 13 bp, Homo sapiens
tcaatatttatta

SEQ ID NO: 140282 - DNA, 19 bp, Homo sapiens
tcaatcatctgtgtgaaaa

SEQ ID NO: 140283 - DNA, 15 bp, Homo sapiens
tcaatcccctcattc

SEQ ID NO: 140284 - DNA, 20 bp, Homo sapiens
tcaatcccctcattcaggaa

SEQ ID NO: 140285 - DNA, 23 bp, Homo sapiens
tcaatgaatgaatgaatggctaa

SEQ ID NO: 140286 - DNA, 15 bp, Homo sapiens
tcaatgtgaatcaga

SEQ ID NO: 140287 - DNA, 18 bp, Homo sapiens
tcaatgtttcttctaggt

SEQ ID NO: 140288 - DNA, 14 bp, Homo sapiens
tcaattcctctggg

SEQ ID NO: 140289 - DNA, 16 bp, Homo sapiens
tcaattgcatctccca

SEQ ID NO: 140290 - DNA, 13 bp, Homo sapiens
tcaatttaaaaaa

SEQ ID NO: 140291 - DNA, 17 bp, Homo sapiens
tcacaagacccaaaagg

SEQ ID NO: 140292 - DNA, 16 bp, Homo sapiens
tcacaatagaaactca

SEQ ID NO: 140293 - DNA, 20 bp, Homo sapiens
tcacactgcaagagccttgg

SEQ ID NO: 140294 - DNA, 18 bp, Homo sapiens
tcacacttccaccagcct

SEQ ID NO: 140295 - DNA, 19 bp, Homo sapiens
tcacacttccaccagcctg

SEQ ID NO: 140296 - DNA, 20 bp, Homo sapiens
tcacacttccaccagcctgc

SEQ ID NO: 140297 - DNA, 23 bp, Homo sapiens
tcacagatgtgtgattcacagtg

SEQ ID NO: 140298 - DNA, 16 bp, Homo sapiens
tcacagcctctgaccc

SEQ ID NO: 140299 - DNA, 20 bp, Homo sapiens
tcacagcctctgacccctcc

SEQ ID NO: 140300 - DNA, 22 bp, Homo sapiens
tcacagggccaacttgagggcc

SEQ ID NO: 140301 - DNA, 17 bp, Homo sapiens
tcacagtgttgcccagg

SEQ ID NO: 140302 - DNA, 22 bp, Homo sapiens
tcacagttggctggatgaaatt

SEQ ID NO: 140303 - DNA, 14 bp, Homo sapiens
tcacataccctccc

SEQ ID NO: 140304 - DNA, 15 bp, Homo sapiens
tcacataccctcccc

SEQ ID NO: 140305 - DNA, 21 bp, Homo sapiens
tcacatggtgctacgcctgca

SEQ ID NO: 140306 - DNA, 21 bp, Homo sapiens
tcaccaagctcacagttcctc

SEQ ID NO: 140307 - DNA, 22 bp, Homo sapiens
tcaccaagctcacagttcctcg

SEQ ID NO: 140308 - DNA, 23 bp, Homo sapiens
tcaccacaccaaacctctcttat

SEQ ID NO: 140309 - DNA, 15 bp, Homo sapiens
tcaccaccttcccag

SEQ ID NO: 140310 - DNA, 16 bp, Homo sapiens
tcaccagagagggact

SEQ ID NO: 140311 - DNA, 22 bp, Homo sapiens
tcaccaggaatgttaaagtcag

SEQ ID NO: 140312 - DNA, 23 bp, Homo sapiens
tcaccatttggcaatgccatcat

SEQ ID NO: 140313 - DNA, 11 bp, Homo sapiens
tcacccacagg

SEQ ID NO: 140314 - DNA, 15 bp, Homo sapiens
tcacccacagggcta

SEQ ID NO: 140315 - DNA, 16 bp, Homo sapiens
tcacccagacagctcc

SEQ ID NO: 140316 - DNA, 12 bp, Homo sapiens
tcaccccagggc

SEQ ID NO: 140317 - DNA, 20 bp, Homo sapiens
tcaccccagggcctgagcct

SEQ ID NO: 140318 - DNA, 13 bp, Homo sapiens
tcacccccaaggg

SEQ ID NO: 140319 - DNA, 13 bp, Homo sapiens
tcaccccccactc

SEQ ID NO: 140320 - DNA, 13 bp, Homo sapiens
tcacccctgtcct

SEQ ID NO: 140321 - DNA, 16 bp, Homo sapiens
tcacccctgtcctcac

SEQ ID NO: 140322 - DNA, 20 bp, Homo sapiens
tcacccctgtcctcactgct

SEQ ID NO: 140323 - DNA, 15 bp, Homo sapiens
tcacccgtccagacc

SEQ ID NO: 140324 - DNA, 18 bp, Homo sapiens
tcacccgtccagaccttg

SEQ ID NO: 140325 - DNA, 18 bp, Homo sapiens
tcacccttaccatgtgcc

SEQ ID NO: 140326 - DNA, 19 bp, Homo sapiens
tcacccttaccatgtgcct

SEQ ID NO: 140327 - DNA, 20 bp, Homo sapiens
tcaccgagagtagccgagag

SEQ ID NO: 140328 - DNA, 23 bp, Homo sapiens
tcaccgagagtagccgagagcct

SEQ ID NO: 140329 - DNA, 15 bp, Homo sapiens
tcaccgtgggctccc

SEQ ID NO: 140330 - DNA, 16 bp, Homo sapiens
tcaccgtgggctccct

SEQ ID NO: 140331 - DNA, 13 bp, Homo sapiens
tcacctctgcctc

SEQ ID NO: 140332 - DNA, 15 bp, Homo sapiens
tcacctctgcctcaa

SEQ ID NO: 140333 - DNA, 22 bp, Homo sapiens
tcacctgagcaggacctctgaa

SEQ ID NO: 140334 - DNA, 21 bp, Homo sapiens
tcacctgagcccggatgcttc

SEQ ID NO: 140335 - DNA, 17 bp, Homo sapiens
tcacctgaggtcgggag

SEQ ID NO: 140336 - DNA, 19 bp, Homo sapiens
tcacctggggtgtgggagg

SEQ ID NO: 140337 - DNA, 19 bp, Homo sapiens
tcacctgtttttaagctgt

SEQ ID NO: 140338 - DNA, 20 bp, Homo sapiens
tcacctgtttttaagctgtt

SEQ ID NO: 140339 - DNA, 21 bp, Homo sapiens
tcacctgtttttaagctgttt

SEQ ID NO: 140340 - DNA, 15 bp, Homo sapiens
tcaccttaggcaggg

SEQ ID NO: 140341 - DNA, 16 bp, Homo sapiens
tcacgcacctcccatc

SEQ ID NO: 140342 - DNA, 20 bp, Homo sapiens
tcacgcctgtaatcccagca

SEQ ID NO: 140343 - DNA, 13 bp, Homo sapiens
tcacgcctgtgca

SEQ ID NO: 140344 - DNA, 17 bp, Homo sapiens
tcacggaagagccttgc

SEQ ID NO: 140345 - DNA, 22 bp, Homo sapiens
tcacggcaggacaacgaggaag

SEQ ID NO: 140346 - DNA, 20 bp, Homo sapiens
gtgcacagacgtccctccac

SEQ ID NO: 140347 - DNA, 18 bp, Homo sapiens
gtgcacatctgtgtcttg

SEQ ID NO: 140348 - DNA, 20 bp, Homo sapiens
gtgcaccttaccaactttct

SEQ ID NO: 140349 - DNA, 17 bp, Homo sapiens
gtgcagcatatgaggat

SEQ ID NO: 140350 - DNA, 17 bp, Homo sapiens
gtgcagccgctgagcga

SEQ ID NO: 140351 - DNA, 15 bp, Homo sapiens
gtgcaggtggggaga

SEQ ID NO: 140352 - DNA, 13 bp, Homo sapiens
gtgcatctcagcc

SEQ ID NO: 140353 - DNA, 14 bp, Homo sapiens
gtgcatctcagccc

SEQ ID NO: 140354 - DNA, 13 bp, Homo sapiens
gtgcatgctctct

SEQ ID NO: 140355 - DNA, 18 bp, Homo sapiens
gtgcatgctctctgcagc

SEQ ID NO: 140356 - DNA, 19 bp, Homo sapiens
gtgcatgctctctgcagcc

SEQ ID NO: 140357 - DNA, 14 bp, Homo sapiens
gtgcatgtgtgtgc

SEQ ID NO: 140358 - DNA, 18 bp, Homo sapiens
gtgcatgtgtgtgctcag

SEQ ID NO: 140359 - DNA, 22 bp, Homo sapiens
gtgcattcttttaaaagacaag

SEQ ID NO: 140360 - DNA, 14 bp, Homo sapiens
gtgccaagcacagt

SEQ ID NO: 140361 - DNA, 16 bp, Homo sapiens
gtgccaggaccagtca

SEQ ID NO: 140362 - DNA, 12 bp, Homo sapiens
gtgccaggcccg

SEQ ID NO: 140363 - DNA, 20 bp, Homo sapiens
gtgccaggcccggggctggc

SEQ ID NO: 140364 - DNA, 20 bp, Homo sapiens
gtgcccaagaatagatgctg

SEQ ID NO: 140365 - DNA, 17 bp, Homo sapiens
gtgcccatccctggaag

SEQ ID NO: 140366 - DNA, 22 bp, Homo sapiens
gtgccgagaaggaagcctccca

SEQ ID NO: 140367 - DNA, 12 bp, Homo sapiens
gtgcctctgcct

SEQ ID NO: 140368 - DNA, 13 bp, Homo sapiens
gtgcctctgcctg

SEQ ID NO: 140369 - DNA, 14 bp, Homo sapiens
gtgcctctgggact

SEQ ID NO: 140370 - DNA, 20 bp, Homo sapiens
gtgcctgatccagcctctcc

SEQ ID NO: 140371 - DNA, 20 bp, Homo sapiens
gtgcctgggtggggctgctc

SEQ ID NO: 140372 - DNA, 23 bp, Homo sapiens
gtgcctgggtggggctgctcctc

SEQ ID NO: 140373 - DNA, 21 bp, Homo sapiens
gtgccttacctcctgcccagg

SEQ ID NO: 140374 - DNA, 15 bp, Homo sapiens
gtgccttcagctcta

SEQ ID NO: 140375 - DNA, 19 bp, Homo sapiens
gtgccttcttattctcact

SEQ ID NO: 140376 - DNA, 14 bp, Homo sapiens
gtgccttttatagc

SEQ ID NO: 140377 - DNA, 18 bp, Homo sapiens
gtgccttttatagctatt

SEQ ID NO: 140378 - DNA, 22 bp, Homo sapiens
gtgctcaggactcagaagcctc

SEQ ID NO: 140379 - DNA, 21 bp, Homo sapiens
gtgctgaacagtggaggaaga

SEQ ID NO: 140380 - DNA, 11 bp, Homo sapiens
gtgctgcctct

SEQ ID NO: 140381 - DNA, 19 bp, Homo sapiens
gtgctggaggtgggagcag

SEQ ID NO: 140382 - DNA, 16 bp, Homo sapiens
gtgctgtgcccaagtt

SEQ ID NO: 140383 - DNA, 22 bp, Homo sapiens
gtgcttgtttgctcacctgggg

SEQ ID NO: 140384 - DNA, 18 bp, Homo sapiens
gtggaaaaatagcctgcc

SEQ ID NO: 140385 - DNA, 15 bp, Homo sapiens
gtggaaccaggaacc

SEQ ID NO: 140386 - DNA, 16 bp, Homo sapiens
gtggaagccctccttc

SEQ ID NO: 140387 - DNA, 15 bp, Homo sapiens
gtggacaccaggagt

SEQ ID NO: 140388 - DNA, 13 bp, Homo sapiens
gtggaccaggaca

SEQ ID NO: 140389 - DNA, 14 bp, Homo sapiens
gtggaccaggacag

SEQ ID NO: 140390 - DNA, 18 bp, Homo sapiens
gtggaccaggacaggacc

SEQ ID NO: 140391 - DNA, 19 bp, Homo sapiens
gtggacttagaaagcaggg

SEQ ID NO: 140392 - DNA, 21 bp, Homo sapiens
gtggagaaactgtagtctcag

SEQ ID NO: 140393 - DNA, 22 bp, Homo sapiens
gtggagagggatgaggtgctgg

SEQ ID NO: 140394 - DNA, 15 bp, Homo sapiens
gtggatcacctgagg

SEQ ID NO: 140395 - DNA, 18 bp, Homo sapiens
gtggcaccagcagcctgg

SEQ ID NO: 140396 - DNA, 21 bp, Homo sapiens
gtggcagataatcagcctctt

SEQ ID NO: 140397 - DNA, 16 bp, Homo sapiens
gtggcccgacagcctg

SEQ ID NO: 140398 - DNA, 17 bp, Homo sapiens
gtggcccgacagcctgg

SEQ ID NO: 140399 - DNA, 13 bp, Homo sapiens
gtggccctggcct

SEQ ID NO: 140400 - DNA, 16 bp, Homo sapiens
gtggccctgtccctcc

SEQ ID NO: 140401 - DNA, 17 bp, Homo sapiens
gtggccctgtccctccc

SEQ ID NO: 140402 - DNA, 22 bp, Homo sapiens
gtggcctcgggacacctgccct

SEQ ID NO: 140403 - DNA, 21 bp, Homo sapiens
gtggcctcttgagcagtggct

SEQ ID NO: 140404 - DNA, 20 bp, Homo sapiens
gtggctcacgtgtgtgactc

SEQ ID NO: 140405 - DNA, 20 bp, Homo sapiens
gtggctcctcccggtgccca

SEQ ID NO: 140406 - DNA, 17 bp, Homo sapiens
gtggctggtccagggct

SEQ ID NO: 140407 - DNA, 20 bp, Homo sapiens
gtggcttactacatgtggga

SEQ ID NO: 140408 - DNA, 13 bp, Homo sapiens
gtgggaagggaga

SEQ ID NO: 140409 - DNA, 13 bp, Homo sapiens
gtgggagcaggag

SEQ ID NO: 140410 - DNA, 15 bp, Homo sapiens
gtgggagggagcaga

SEQ ID NO: 140411 - DNA, 21 bp, Homo sapiens
gtgggaggggcgcccacctcc

SEQ ID NO: 140412 - DNA, 16 bp, Homo sapiens
gtgggatggaggagaa

SEQ ID NO: 140413 - DNA, 23 bp, Homo sapiens
gtgggatgttcagcactgtccct

SEQ ID NO: 140414 - DNA, 14 bp, Homo sapiens
gtgggccaggacag

SEQ ID NO: 140415 - DNA, 15 bp, Homo sapiens
gtgggcctcctctgt

SEQ ID NO: 140416 - DNA, 13 bp, Homo sapiens
gtgggcggcagag

SEQ ID NO: 140417 - DNA, 14 bp, Homo sapiens
gtgggctaattaaa

SEQ ID NO: 140418 - DNA, 15 bp, Homo sapiens
gtgggctccctgact

SEQ ID NO: 140419 - DNA, 12 bp, Homo sapiens
gtggggcagcac

SEQ ID NO: 140420 - DNA, 18 bp, Homo sapiens
gtggggctgctcctccag

SEQ ID NO: 140421 - DNA, 14 bp, Homo sapiens
gtgggggcagaggg

SEQ ID NO: 140422 - DNA, 18 bp, Homo sapiens
gtgggggcagagggcaga

SEQ ID NO: 140423 - DNA, 17 bp, Homo sapiens
gtgggtcttcagggggc

SEQ ID NO: 140424 - DNA, 16 bp, Homo sapiens
gtggtctgcaggcagg

SEQ ID NO: 140425 - DNA, 18 bp, Homo sapiens
gtggttatggagagggtg

SEQ ID NO: 140426 - DNA, 15 bp, Homo sapiens
gtgtaaaatgtgaag

SEQ ID NO: 140427 - DNA, 19 bp, Homo sapiens
gtgtaacaggtctcctctt

SEQ ID NO: 140428 - DNA, 18 bp, Homo sapiens
gtgtacagaattctgcta

SEQ ID NO: 140429 - DNA, 20 bp, Homo sapiens
gtgtacgtggagagggatga

SEQ ID NO: 140430 - DNA, 14 bp, Homo sapiens
gtgtaggcagacac

SEQ ID NO: 140431 - DNA, 13 bp, Homo sapiens
gtgtatatcagaa

SEQ ID NO: 140432 - DNA, 21 bp, Homo sapiens
gtgtatcccccccctgtatag

SEQ ID NO: 140433 - DNA, 23 bp, Homo sapiens
gtgtatttgtatttttttgcaag

SEQ ID NO: 140434 - DNA, 16 bp, Homo sapiens
gtgtcatcagaagata

SEQ ID NO: 140435 - DNA, 12 bp, Homo sapiens
gtgtccttccct

SEQ ID NO: 140436 - DNA, 15 bp, Homo sapiens
gtgtccttccctgca

SEQ ID NO: 140437 - DNA, 19 bp, Homo sapiens
gtgtccttgcacctgcatc

SEQ ID NO: 140438 - DNA, 14 bp, Homo sapiens
gtgtctacagagaa

SEQ ID NO: 140439 - DNA, 22 bp, Homo sapiens
gtgtcttaattaaaagaatatt

SEQ ID NO: 140440 - DNA, 16 bp, Homo sapiens
gtgtgcaagtgtgtgc

SEQ ID NO: 140441 - DNA, 13 bp, Homo sapiens
gtgtgcagtgaag

SEQ ID NO: 140442 - DNA, 20 bp, Homo sapiens
gtgtgcatgtgtgtgctcag

SEQ ID NO: 140443 - DNA, 11 bp, Homo sapiens
gtgtgtattaa

SEQ ID NO: 140444 - DNA, 20 bp, Homo sapiens
gtgtgtattaaaaaaaacaa

SEQ ID NO: 140445 - DNA, 20 bp, Homo sapiens
gtgtgtccacgactgtctcc

SEQ ID NO: 140446 - DNA, 14 bp, Homo sapiens
gtgtgttatttaaa

SEQ ID NO: 140447 - DNA, 21 bp, Homo sapiens
gtgttaaatgtgatgaatact

SEQ ID NO: 140448 - DNA, 22 bp, Homo sapiens
gtgttagggaagggcctgccac

SEQ ID NO: 140449 - DNA, 22 bp, Homo sapiens
gtgttccccttccactgagggc

SEQ ID NO: 140450 - DNA, 14 bp, Homo sapiens
gtgttctctcttat

SEQ ID NO: 140451 - DNA, 17 bp, Homo sapiens
gtgttgccaaatatgtc

SEQ ID NO: 140452 - DNA, 13 bp, Homo sapiens
gtgtttatttata

SEQ ID NO: 140453 - DNA, 18 bp, Homo sapiens
gtgtttccatattttata

SEQ ID NO: 140454 - DNA, 13 bp, Homo sapiens
gtgttttcataat

SEQ ID NO: 140455 - DNA, 12 bp, Homo sapiens
gttaaaactgtc

SEQ ID NO: 140456 - DNA, 21 bp, Homo sapiens
gttaaaataactagtgttgct

SEQ ID NO: 140457 - DNA, 20 bp, Homo sapiens
gttaaccagaataaagttct

SEQ ID NO: 140458 - DNA, 22 bp, Homo sapiens
gttaagttacttcactttaatt

SEQ ID NO: 140459 - DNA, 22 bp, Homo sapiens
gttaagttgatggtgatgaaat

SEQ ID NO: 140460 - DNA, 14 bp, Homo sapiens
tcagtggggcagtc

SEQ ID NO: 140461 - DNA, 19 bp, Homo sapiens
tcagtgtgtctaaatttga

SEQ ID NO: 140462 - DNA, 21 bp, Homo sapiens
tcagtgttaaatgtgatgaat

SEQ ID NO: 140463 - DNA, 19 bp, Homo sapiens
tcagttactcagccctggg

SEQ ID NO: 140464 - DNA, 19 bp, Homo sapiens
tcagttctcttgattttca

SEQ ID NO: 140465 - DNA, 14 bp, Homo sapiens
tcagttggctgact

SEQ ID NO: 140466 - DNA, 19 bp, Homo sapiens
tcagtttcaattcagtgct

SEQ ID NO: 140467 - DNA, 16 bp, Homo sapiens
tcagtttcctggtctg

SEQ ID NO: 140468 - DNA, 15 bp, Homo sapiens
tcagtttgtatatac

SEQ ID NO: 140469 - DNA, 13 bp, Homo sapiens
tcagttttaacta

SEQ ID NO: 140470 - DNA, 21 bp, Homo sapiens
tcataagatatttttcatgat

SEQ ID NO: 140471 - DNA, 22 bp, Homo sapiens
tcataccaggccgccccagcct

SEQ ID NO: 140472 - DNA, 15 bp, Homo sapiens
tcatactgaagatgc

SEQ ID NO: 140473 - DNA, 22 bp, Homo sapiens
tcatatgtaccatgtacatgaa

SEQ ID NO: 140474 - DNA, 12 bp, Homo sapiens
tcatatttaaag

SEQ ID NO: 140475 - DNA, 19 bp, Homo sapiens
tcatatttaaagacaggga

SEQ ID NO: 140476 - DNA, 15 bp, Homo sapiens
tcatatttacttctt

SEQ ID NO: 140477 - DNA, 20 bp, Homo sapiens
tcatatttacttcttataca

SEQ ID NO: 140478 - DNA, 21 bp, Homo sapiens
tcatatttacttcttatacat

SEQ ID NO: 140479 - DNA, 23 bp, Homo sapiens
tcatattttgtatatatctgctt

SEQ ID NO: 140480 - DNA, 15 bp, Homo sapiens
tcatcacttttcagt

SEQ ID NO: 140481 - DNA, 15 bp, Homo sapiens
tcatcagaagataac

SEQ ID NO: 140482 - DNA, 14 bp, Homo sapiens
tcatcagcatacct

SEQ ID NO: 140483 - DNA, 14 bp, Homo sapiens
tcatcattccttga

SEQ ID NO: 140484 - DNA, 17 bp, Homo sapiens
tcatcattccttgagaa

SEQ ID NO: 140485 - DNA, 13 bp, Homo sapiens
tcatcattctctg

SEQ ID NO: 140486 - DNA, 19 bp, Homo sapiens
tcatcattctctgtctcat

SEQ ID NO: 140487 - DNA, 20 bp, Homo sapiens
tcatccactagtgcaaatca

SEQ ID NO: 140488 - DNA, 21 bp, Homo sapiens
tcatccactagtgcaaatcat

SEQ ID NO: 140489 - DNA, 16 bp, Homo sapiens
tcatcctttccagcat

SEQ ID NO: 140490 - DNA, 17 bp, Homo sapiens
tcatctatttctgagaa

SEQ ID NO: 140491 - DNA, 18 bp, Homo sapiens
tcatctatttctgagaag

SEQ ID NO: 140492 - DNA, 23 bp, Homo sapiens
tcatctcctgccttcctcctggg

SEQ ID NO: 140493 - DNA, 23 bp, Homo sapiens
tcatcttgaccaagcaggaagct

SEQ ID NO: 140494 - DNA, 19 bp, Homo sapiens
tcatgacatgttatatatt

SEQ ID NO: 140495 - DNA, 18 bp, Homo sapiens
tcatgagtgaataaatgt

SEQ ID NO: 140496 - DNA, 21 bp, Homo sapiens
tcatgattttgaaatcatgaa

SEQ ID NO: 140497 - DNA, 11 bp, Homo sapiens
tcatgattttt

SEQ ID NO: 140498 - DNA, 22 bp, Homo sapiens
tcatgcatctccacctgctccc

SEQ ID NO: 140499 - DNA, 19 bp, Homo sapiens
tcatgccaccatggccagc

SEQ ID NO: 140500 - DNA, 19 bp, Homo sapiens
gttcatattccatatttat

SEQ ID NO: 140501 - DNA, 16 bp, Homo sapiens
gttcatcaatgaatga

SEQ ID NO: 140502 - DNA, 16 bp, Homo sapiens
gttcatccattctatt

SEQ ID NO: 140503 - DNA, 19 bp, Homo sapiens
gttccccatctgggtcctt

SEQ ID NO: 140504 - DNA, 15 bp, Homo sapiens
gttccctctccctgt

SEQ ID NO: 140505 - DNA, 17 bp, Homo sapiens
gttccctgaaaacccag

SEQ ID NO: 140506 - DNA, 19 bp, Homo sapiens
gttccctgaaaacccagag

SEQ ID NO: 140507 - DNA, 20 bp, Homo sapiens
gttccctgaaaacccagaga

SEQ ID NO: 140508 - DNA, 19 bp, Homo sapiens
gttccggaatcctgtcctc

SEQ ID NO: 140509 - DNA, 22 bp, Homo sapiens
gttccggaatcctgtcctcagc

SEQ ID NO: 140510 - DNA, 15 bp, Homo sapiens
gttcctcgccctggg

SEQ ID NO: 140511 - DNA, 16 bp, Homo sapiens
gttcctgaacctgatg

SEQ ID NO: 140512 - DNA, 19 bp, Homo sapiens
gttcgagaccaacctgacc

SEQ ID NO: 140513 - DNA, 19 bp, Homo sapiens
gttctaaaaattgtgatca

SEQ ID NO: 140514 - DNA, 15 bp, Homo sapiens
gttctagttttcagt

SEQ ID NO: 140515 - DNA, 15 bp, Homo sapiens
gttctctcttctcca

SEQ ID NO: 140516 - DNA, 13 bp, Homo sapiens
gttctgacttgac

SEQ ID NO: 140517 - DNA, 17 bp, Homo sapiens
gttgaaaaacagctgag

SEQ ID NO: 140518 - DNA, 19 bp, Homo sapiens
gttgaaaattattttaaac

SEQ ID NO: 140519 - DNA, 15 bp, Homo sapiens
gttgaatgacaacag

SEQ ID NO: 140520 - DNA, 15 bp, Homo sapiens
gttgaccccagagga

SEQ ID NO: 140521 - DNA, 23 bp, Homo sapiens
gttgaggtggaagccctccttcc

SEQ ID NO: 140522 - DNA, 21 bp, Homo sapiens
gttgagttcaggtagctgccc

SEQ ID NO: 140523 - DNA, 15 bp, Homo sapiens
gttgcaaggccgctg

SEQ ID NO: 140524 - DNA, 17 bp, Homo sapiens
gttgcaagtactgctgt

SEQ ID NO: 140525 - DNA, 16 bp, Homo sapiens
gttgcatgatgtattt

SEQ ID NO: 140526 - DNA, 18 bp, Homo sapiens
gttgccttaaagaaagtc

SEQ ID NO: 140527 - DNA, 20 bp, Homo sapiens
gttgctccgcctctgctggc

SEQ ID NO: 140528 - DNA, 16 bp, Homo sapiens
gttggcagtgagtgag

SEQ ID NO: 140529 - DNA, 13 bp, Homo sapiens
gttggcctgcact

SEQ ID NO: 140530 - DNA, 20 bp, Homo sapiens
gttggctgacttccacacct

SEQ ID NO: 140531 - DNA, 14 bp, Homo sapiens
gttgggaagacatg

SEQ ID NO: 140532 - DNA, 14 bp, Homo sapiens
gttgggaggattct

SEQ ID NO: 140533 - DNA, 22 bp, Homo sapiens
gttgtaaaatatagctgtacaa

SEQ ID NO: 140534 - DNA, 20 bp, Homo sapiens
gttgtaaatatttatgtaaa

SEQ ID NO: 140535 - DNA, 18 bp, Homo sapiens
gttgtaccgcaatgtgac

SEQ ID NO: 140536 - DNA, 22 bp, Homo sapiens
gttgtcaagtctctgctggccc

SEQ ID NO: 140537 - DNA, 22 bp, Homo sapiens
gttgtctgaagtcactgcacag

SEQ ID NO: 140538 - DNA, 19 bp, Homo sapiens
gttgttactaactaaactc

SEQ ID NO: 140539 - DNA, 20 bp, Homo sapiens
gttgttactaactaaactct

SEQ ID NO: 140540 - DNA, 10 bp, Homo sapiens
gtttaaaatc

SEQ ID NO: 140541 - DNA, 17 bp, Homo sapiens
gtttaatatttaaacag

SEQ ID NO: 140542 - DNA, 19 bp, Homo sapiens
gtttacaagtgtatatcag

SEQ ID NO: 140543 - DNA, 18 bp, Homo sapiens
gtttacaatttacaaagt

SEQ ID NO: 140544 - DNA, 22 bp, Homo sapiens
gtttactagggatccctcatct

SEQ ID NO: 140545 - DNA, 17 bp, Homo sapiens
gtttagaaagcttgccc

SEQ ID NO: 140546 - DNA, 12 bp, Homo sapiens
gtttagcaaata

SEQ ID NO: 140547 - DNA, 20 bp, Homo sapiens
gtttaggatgttgaaaaagt

SEQ ID NO: 140548 - DNA, 15 bp, Homo sapiens
gtttagttaaatgag

SEQ ID NO: 140549 - DNA, 12 bp, Homo sapiens
gtttatttccaa

SEQ ID NO: 140550 - DNA, 19 bp, Homo sapiens
gtttcaaaataaaaaccaa

SEQ ID NO: 140551 - DNA, 17 bp, Homo sapiens
gtttcagatatatatca

SEQ ID NO: 140552 - DNA, 16 bp, Homo sapiens
gtttcatccttttcat

SEQ ID NO: 140553 - DNA, 19 bp, Homo sapiens
gtttcattctcctgcctgt

SEQ ID NO: 140554 - DNA, 11 bp, Homo sapiens
gtttcattgac

SEQ ID NO: 140555 - DNA, 20 bp, Homo sapiens
gtttcatttagtcatgtgac

SEQ ID NO: 140556 - DNA, 16 bp, Homo sapiens
gtttccacagcctgca

SEQ ID NO: 140557 - DNA, 21 bp, Homo sapiens
gtttcccatcccactgctccc

SEQ ID NO: 140558 - DNA, 18 bp, Homo sapiens
gtttcctcaggctgctgg

SEQ ID NO: 140559 - DNA, 13 bp, Homo sapiens
gtttgagctcaga

SEQ ID NO: 140560 - DNA, 15 bp, Homo sapiens
gtttggcaatagttt

SEQ ID NO: 140561 - DNA, 17 bp, Homo sapiens
gtttggctgtgtctaaa

SEQ ID NO: 140562 - DNA, 20 bp, Homo sapiens
gtttggctgtgtctaaactg

SEQ ID NO: 140563 - DNA, 21 bp, Homo sapiens
gtttggctgtgtctaaactgc

SEQ ID NO: 140564 - DNA, 13 bp, Homo sapiens
gtttgtaaaacta

SEQ ID NO: 140565 - DNA, 15 bp, Homo sapiens
gtttgtataacttct

SEQ ID NO: 140566 - DNA, 18 bp, Homo sapiens
gtttgtctgtcttcatag

SEQ ID NO: 140567 - DNA, 17 bp, Homo sapiens
gttttcagactcagact

SEQ ID NO: 140568 - DNA, 14 bp, Homo sapiens
gttttcataataaa

SEQ ID NO: 140569 - DNA, 21 bp, Homo sapiens
gttttccctgacctccctcta

SEQ ID NO: 140570 - DNA, 12 bp, Homo sapiens
gttttctcttga

SEQ ID NO: 140571 - DNA, 16 bp, Homo sapiens
gttttctgagaaagac

SEQ ID NO: 140572 - DNA, 12 bp, Homo sapiens
gttttcttccca

SEQ ID NO: 140573 - DNA, 14 bp, Homo sapiens
gttttctttgaatg

SEQ ID NO: 140574 - DNA, 22 bp, Homo sapiens
gttttgaactaataaaagcata

SEQ ID NO: 140575 - DNA, 23 bp, Homo sapiens
gttttgaactaataaaagcataa

SEQ ID NO: 140576 - DNA, 17 bp, Homo sapiens
gttttgacatttttagt

SEQ ID NO: 140577 - DNA, 16 bp, Homo sapiens
gtttttactacagttg

SEQ ID NO: 140578 - DNA, 19 bp, Homo sapiens
gtttttttgtatagtaaag

SEQ ID NO: 140579 - DNA, 19 bp, Homo sapiens
gtttttttttcctgtcctt

SEQ ID NO: 140580 - DNA, 13 bp, Homo sapiens
taaaaaaaacaaa

SEQ ID NO: 140581 - DNA, 18 bp, Homo sapiens
taaaaaaaacaaaaagaa

SEQ ID NO: 140582 - DNA, 19 bp, Homo sapiens
taaaaaaaacaaaaagaac

SEQ ID NO: 140583 - DNA, 21 bp, Homo sapiens
taaaaaaaacaaaaagaacaa

SEQ ID NO: 140584 - DNA, 19 bp, Homo sapiens
taaaaaagatatattaaaa

SEQ ID NO: 140585 - DNA, 21 bp, Homo sapiens
taaaaagacattcttccaaaa

SEQ ID NO: 140586 - DNA, 19 bp, Homo sapiens
taaaaaggcacctataaaa

SEQ ID NO: 140587 - DNA, 15 bp, Homo sapiens
taaaaagtggaaaaa

SEQ ID NO: 140588 - DNA, 20 bp, Homo sapiens
taaaaagttttagttttgat

SEQ ID NO: 140589 - DNA, 23 bp, Homo sapiens
taaaaatatggaacttctaatat

SEQ ID NO: 140590 - DNA, 14 bp, Homo sapiens
taaaaatattgtgt

SEQ ID NO: 140591 - DNA, 22 bp, Homo sapiens
taaaaatattgtgttgtgaatg

SEQ ID NO: 140592 - DNA, 17 bp, Homo sapiens
taaaacattaagaaaat

SEQ ID NO: 140593 - DNA, 14 bp, Homo sapiens
taaaaccacagcag

SEQ ID NO: 140594 - DNA, 15 bp, Homo sapiens
taaaaccacagcagt

SEQ ID NO: 140595 - DNA, 13 bp, Homo sapiens
taaaacccaagtg

SEQ ID NO: 140596 - DNA, 10 bp, Homo sapiens
taaaaccttt

SEQ ID NO: 140597 - DNA, 21 bp, Homo sapiens
taaaacctttcaaatttcaca

SEQ ID NO: 140598 - DNA, 13 bp, Homo sapiens
taaaactgtccct

SEQ ID NO: 140599 - DNA, 13 bp, Homo sapiens
taaaactttcctc

SEQ ID NO: 140600 - DNA, 14 bp, Homo sapiens
taaaactttgctgc

SEQ ID NO: 140601 - DNA, 16 bp, Homo sapiens
taaaactttgctgcca

SEQ ID NO: 140602 - DNA, 16 bp, Homo sapiens
taatattgacttgtat

SEQ ID NO: 140603 - DNA, 23 bp, Homo sapiens
taatatttatgtctatttaagcc

SEQ ID NO: 140604 - DNA, 12 bp, Homo sapiens
taatcagcctct

SEQ ID NO: 140605 - DNA, 14 bp, Homo sapiens
taatcagcctctta

SEQ ID NO: 140606 - DNA, 19 bp, Homo sapiens
taatcagggaggtcatttt

SEQ ID NO: 140607 - DNA, 23 bp, Homo sapiens
taatcagtgtgtctaaatttgaa

SEQ ID NO: 140608 - DNA, 22 bp, Homo sapiens
taatcatataataaatgtacat

SEQ ID NO: 140609 - DNA, 21 bp, Homo sapiens
taatccgaatctctttttgct

SEQ ID NO: 140610 - DNA, 18 bp, Homo sapiens
taatctggactcctctgt

SEQ ID NO: 140611 - DNA, 19 bp, Homo sapiens
taatctggactcctctgtc

SEQ ID NO: 140612 - DNA, 22 bp, Homo sapiens
taatctggactcctctgtccag

SEQ ID NO: 140613 - DNA, 23 bp, Homo sapiens
taatgaagaaagtggaaaacaag

SEQ ID NO: 140614 - DNA, 15 bp, Homo sapiens
taatgaatgcataaa

SEQ ID NO: 140615 - DNA, 23 bp, Homo sapiens
taatgatgtcgtttgaatcacag

SEQ ID NO: 140616 - DNA, 17 bp, Homo sapiens
taatgctgttgcctcat

SEQ ID NO: 140617 - DNA, 15 bp, Homo sapiens
taatgggattttctt

SEQ ID NO: 140618 - DNA, 21 bp, Homo sapiens
taatgtgaaaatggtccagga

SEQ ID NO: 140619 - DNA, 13 bp, Homo sapiens
taatgtgatatta

SEQ ID NO: 140620 - DNA, 20 bp, Homo sapiens
taatgttgtatgtcttgttt

SEQ ID NO: 140621 - DNA, 20 bp, Homo sapiens
taattaaaagaatattttaa

SEQ ID NO: 140622 - DNA, 22 bp, Homo sapiens
taattagagcagatgacccctc

SEQ ID NO: 140623 - DNA, 13 bp, Homo sapiens
taattattattaa

SEQ ID NO: 140624 - DNA, 12 bp, Homo sapiens
taattattattt

SEQ ID NO: 140625 - DNA, 13 bp, Homo sapiens
taattattattta

SEQ ID NO: 140626 - DNA, 22 bp, Homo sapiens
taattcagcactgatttcacaa

SEQ ID NO: 140627 - DNA, 22 bp, Homo sapiens
taattgacaggattattggaaa

SEQ ID NO: 140628 - DNA, 23 bp, Homo sapiens
taattgcttacatttttacaata

SEQ ID NO: 140629 - DNA, 15 bp, Homo sapiens
taatttaaaaaataa

SEQ ID NO: 140630 - DNA, 14 bp, Homo sapiens
taatttaatgcatg

SEQ ID NO: 140631 - DNA, 17 bp, Homo sapiens
taattttcctaataaag

SEQ ID NO: 140632 - DNA, 19 bp, Homo sapiens
taattttgttctagttttc

SEQ ID NO: 140633 - DNA, 16 bp, Homo sapiens
taatttttttcaatat

SEQ ID NO: 140634 - DNA, 20 bp, Homo sapiens
tacaaaaagcataaaaatta

SEQ ID NO: 140635 - DNA, 15 bp, Homo sapiens
tacaaagtgtgtatt

SEQ ID NO: 140636 - DNA, 19 bp, Homo sapiens
tacaaagtgtgtattaaaa

SEQ ID NO: 140637 - DNA, 14 bp, Homo sapiens
tacaaatataagaa

SEQ ID NO: 140638 - DNA, 16 bp, Homo sapiens
tacaaatataagaata

SEQ ID NO: 140639 - DNA, 19 bp, Homo sapiens
tacaaattgcttgaaagaa

SEQ ID NO: 140640 - DNA, 20 bp, Homo sapiens
tacaagtaggggttgtgggt

SEQ ID NO: 140641 - DNA, 14 bp, Homo sapiens
tacaagtgtatatc

SEQ ID NO: 140642 - DNA, 21 bp, Homo sapiens
tacaagtgtatatcagaaaag

SEQ ID NO: 140643 - DNA, 13 bp, Homo sapiens
tacaataaataat

SEQ ID NO: 140644 - DNA, 13 bp, Homo sapiens
tacaataacataa

SEQ ID NO: 140645 - DNA, 18 bp, Homo sapiens
tacaattctacattgtca

SEQ ID NO: 140646 - DNA, 17 bp, Homo sapiens
tacaattgtaaaactga

SEQ ID NO: 140647 - DNA, 22 bp, Homo sapiens
tacaatttacaaagtgtgtatt

SEQ ID NO: 140648 - DNA, 18 bp, Homo sapiens
tacacattcaataagcat

SEQ ID NO: 140649 - DNA, 15 bp, Homo sapiens
tacacccttttccag

SEQ ID NO: 140650 - DNA, 13 bp, Homo sapiens
tacactatcttaa

SEQ ID NO: 140651 - DNA, 16 bp, Homo sapiens
tacactctttgtaaga

SEQ ID NO: 140652 - DNA, 16 bp, Homo sapiens
tacagagcttccctga

SEQ ID NO: 140653 - DNA, 18 bp, Homo sapiens
tacagctaatcagcattc

SEQ ID NO: 140654 - DNA, 14 bp, Homo sapiens
tacagctgcctgca

SEQ ID NO: 140655 - DNA, 14 bp, Homo sapiens
tacagctgtttaag

SEQ ID NO: 140656 - DNA, 22 bp, Homo sapiens
tacagggtagcaggtaccactg

SEQ ID NO: 140657 - DNA, 15 bp, Homo sapiens
tacagtacaggcagc

SEQ ID NO: 140658 - DNA, 15 bp, Homo sapiens
tacagtaggagccca

SEQ ID NO: 140659 - DNA, 18 bp, Homo sapiens
tacagtaggagcccagct

SEQ ID NO: 140660 - DNA, 17 bp, Homo sapiens
tcccctcacagcctctg

SEQ ID NO: 140661 - DNA, 20 bp, Homo sapiens
tcccctcacagcctctgacc

SEQ ID NO: 140662 - DNA, 16 bp, Homo sapiens
tcccctccaaggtatg

SEQ ID NO: 140663 - DNA, 15 bp, Homo sapiens
tcccctcccctgctg

SEQ ID NO: 140664 - DNA, 14 bp, Homo sapiens
tcccctccttctcc

SEQ ID NO: 140665 - DNA, 21 bp, Homo sapiens
tcccctgattacaccagcctc

SEQ ID NO: 140666 - DNA, 20 bp, Homo sapiens
tcccctgccagggcagggcc

SEQ ID NO: 140667 - DNA, 23 bp, Homo sapiens
tcccctgcccccagaccttttat

SEQ ID NO: 140668 - DNA, 17 bp, Homo sapiens
tcccctgctgcaggggc

SEQ ID NO: 140669 - DNA, 15 bp, Homo sapiens
tccccttgcccaggg

SEQ ID NO: 140670 - DNA, 16 bp, Homo sapiens
tccccttgcccagggc

SEQ ID NO: 140671 - DNA, 17 bp, Homo sapiens
tccccttttattgctgc

SEQ ID NO: 140672 - DNA, 23 bp, Homo sapiens
tcccgaaccccaaggagggagat

SEQ ID NO: 140673 - DNA, 15 bp, Homo sapiens
tcccgctcagccctc

SEQ ID NO: 140674 - DNA, 15 bp, Homo sapiens
tcccgggacgcagca

SEQ ID NO: 140675 - DNA, 14 bp, Homo sapiens
tcccggggctccac

SEQ ID NO: 140676 - DNA, 13 bp, Homo sapiens
tccctaccacctc

SEQ ID NO: 140677 - DNA, 19 bp, Homo sapiens
tccctaccgagtctcttct

SEQ ID NO: 140678 - DNA, 21 bp, Homo sapiens
tccctaccgagtctcttctcc

SEQ ID NO: 140679 - DNA, 17 bp, Homo sapiens
tccctacttcctgtgac

SEQ ID NO: 140680 - DNA, 18 bp, Homo sapiens
tccctagaaacttccaaa

SEQ ID NO: 140681 - DNA, 13 bp, Homo sapiens
tccctcacctgta

SEQ ID NO: 140682 - DNA, 18 bp, Homo sapiens
tccctccacgttcacccc

SEQ ID NO: 140683 - DNA, 20 bp, Homo sapiens
tccctccacgttcacccctc

SEQ ID NO: 140684 - DNA, 16 bp, Homo sapiens
tccctcccacctctgt

SEQ ID NO: 140685 - DNA, 15 bp, Homo sapiens
tccctccgggacctg

SEQ ID NO: 140686 - DNA, 14 bp, Homo sapiens
tccctctaatttat

SEQ ID NO: 140687 - DNA, 22 bp, Homo sapiens
tccctctacagagcttccctga

SEQ ID NO: 140688 - DNA, 13 bp, Homo sapiens
tccctctcctgcc

SEQ ID NO: 140689 - DNA, 16 bp, Homo sapiens
tccctctcctgcctac

SEQ ID NO: 140690 - DNA, 18 bp, Homo sapiens
tccctctggccctgcctt

SEQ ID NO: 140691 - DNA, 17 bp, Homo sapiens
tccctgaaaacccagag

SEQ ID NO: 140692 - DNA, 16 bp, Homo sapiens
tccctgaagccagcct

SEQ ID NO: 140693 - DNA, 17 bp, Homo sapiens
tccctgaagccagcctt

SEQ ID NO: 140694 - DNA, 18 bp, Homo sapiens
tccctgaagccagccttc

SEQ ID NO: 140695 - DNA, 19 bp, Homo sapiens
tccctgaagccagccttct

SEQ ID NO: 140696 - DNA, 16 bp, Homo sapiens
tccctgacctccctct

SEQ ID NO: 140697 - DNA, 15 bp, Homo sapiens
tccctgagtcaccag

SEQ ID NO: 140698 - DNA, 17 bp, Homo sapiens
tccctgagtcaccagga

SEQ ID NO: 140699 - DNA, 18 bp, Homo sapiens
tccctgcccctcccttca

SEQ ID NO: 140700 - DNA, 19 bp, Homo sapiens
tccctgcccctcccttcaa

SEQ ID NO: 140701 - DNA, 19 bp, Homo sapiens
tccctgctgtcgtcttagc

SEQ ID NO: 140702 - DNA, 11 bp, Homo sapiens
tccctggcttg

SEQ ID NO: 140703 - DNA, 21 bp, Homo sapiens
tccctggcttgtaactccacc

SEQ ID NO: 140704 - DNA, 18 bp, Homo sapiens
tccctgggggaagccctg

SEQ ID NO: 140705 - DNA, 13 bp, Homo sapiens
tccctggtccctt

SEQ ID NO: 140706 - DNA, 14 bp, Homo sapiens
tccctggtcccttg

SEQ ID NO: 140707 - DNA, 14 bp, Homo sapiens
tccctgtaacctct

SEQ ID NO: 140708 - DNA, 12 bp, Homo sapiens
tccctgtcctcc

SEQ ID NO: 140709 - DNA, 14 bp, Homo sapiens
tccctgtcctcctc

SEQ ID NO: 140710 - DNA, 15 bp, Homo sapiens
tccctgtcctcctcg

SEQ ID NO: 140711 - DNA, 17 bp, Homo sapiens
tccctgtgttgtctcta

SEQ ID NO: 140712 - DNA, 18 bp, Homo sapiens
tccctgttggtcggtggg

SEQ ID NO: 140713 - DNA, 21 bp, Homo sapiens
tccctgtttaatatttaaaca

SEQ ID NO: 140714 - DNA, 15 bp, Homo sapiens
tcccttaaacaaaaa

SEQ ID NO: 140715 - DNA, 22 bp, Homo sapiens
tcccttaaacaaaaattaaaat

SEQ ID NO: 140716 - DNA, 16 bp, Homo sapiens
tcccttctgtccctca

SEQ ID NO: 140717 - DNA, 18 bp, Homo sapiens
tcccttgagacctcagcc

SEQ ID NO: 140718 - DNA, 12 bp, Homo sapiens
tcccttgcctca

SEQ ID NO: 140719 - DNA, 12 bp, Homo sapiens
tcccttgggctc

SEQ ID NO: 140720 - DNA, 14 bp, Homo sapiens
tcccttgggctccc

SEQ ID NO: 140721 - DNA, 16 bp, Homo sapiens
tcccttgtgcgtgggt

SEQ ID NO: 140722 - DNA, 15 bp, Homo sapiens
tccctttttgaagtg

SEQ ID NO: 140723 - DNA, 16 bp, Homo sapiens
tccctttttgaagtgt

SEQ ID NO: 140724 - DNA, 19 bp, Homo sapiens
tccgaacaccctcgaagcg

SEQ ID NO: 140725 - DNA, 20 bp, Homo sapiens
tccgaccactaattgccaag

SEQ ID NO: 140726 - DNA, 13 bp, Homo sapiens
tccgaggcagggt

SEQ ID NO: 140727 - DNA, 15 bp, Homo sapiens
tccggagtagctggg

SEQ ID NO: 140728 - DNA, 18 bp, Homo sapiens
tccggcagttctgggtgc

SEQ ID NO: 140729 - DNA, 21 bp, Homo sapiens
tccgggacctggtgctgcctc

SEQ ID NO: 140730 - DNA, 15 bp, Homo sapiens
tcctaatcatccaat

SEQ ID NO: 140731 - DNA, 16 bp, Homo sapiens
tcctaattttgagaaa

SEQ ID NO: 140732 - DNA, 20 bp, Homo sapiens
tcctacattaattatctagt

SEQ ID NO: 140733 - DNA, 20 bp, Homo sapiens
tcctacgtcaaacatgaagt

SEQ ID NO: 140734 - DNA, 20 bp, Homo sapiens
tcctagcactttgggaggcc

SEQ ID NO: 140735 - DNA, 18 bp, Homo sapiens
tcctatgtttttgttcaa

SEQ ID NO: 140736 - DNA, 15 bp, Homo sapiens
tcctatttcttatag

SEQ ID NO: 140737 - DNA, 16 bp, Homo sapiens
tcctatttgcactgta

SEQ ID NO: 140738 - DNA, 13 bp, Homo sapiens
tcctcaatccagc

SEQ ID NO: 140739 - DNA, 20 bp, Homo sapiens
tcctcacccctgtcctcact

SEQ ID NO: 140740 - DNA, 17 bp, Homo sapiens
tcctcactcccttccca

SEQ ID NO: 140741 - DNA, 23 bp, Homo sapiens
tcctcactgctccctgaagccag

SEQ ID NO: 140742 - DNA, 13 bp, Homo sapiens
tcctcactggcca

SEQ ID NO: 140743 - DNA, 22 bp, Homo sapiens
tcctcactggccatccctcgtg

SEQ ID NO: 140744 - DNA, 19 bp, Homo sapiens
tctactaaaaatacaaaaa

SEQ ID NO: 140745 - DNA, 18 bp, Homo sapiens
tctactctagggaaaaac

SEQ ID NO: 140746 - DNA, 22 bp, Homo sapiens
tctactttagaatgagagtgtg

SEQ ID NO: 140747 - DNA, 12 bp, Homo sapiens
tctactttgaag

SEQ ID NO: 140748 - DNA, 19 bp, Homo sapiens
tctagaacatccctgccag

SEQ ID NO: 140749 - DNA, 21 bp, Homo sapiens
tctagaacatccctgccagct

SEQ ID NO: 140750 - DNA, 14 bp, Homo sapiens
tctagactttctgt

SEQ ID NO: 140751 - DNA, 16 bp, Homo sapiens
tctagctagaaatatg

SEQ ID NO: 140752 - DNA, 18 bp, Homo sapiens
tctaggagctgggaggaa

SEQ ID NO: 140753 - DNA, 22 bp, Homo sapiens
tctagggaaaaaccagcgtgtg

SEQ ID NO: 140754 - DNA, 17 bp, Homo sapiens
tctaggtagtgccctat

SEQ ID NO: 140755 - DNA, 23 bp, Homo sapiens
tctaggtgcccttggaggccagc

SEQ ID NO: 140756 - DNA, 22 bp, Homo sapiens
tctagtacttgggagacctgta

SEQ ID NO: 140757 - DNA, 22 bp, Homo sapiens
tctagtttaattaatctgtaat

SEQ ID NO: 140758 - DNA, 14 bp, Homo sapiens
tctagtttcttgtg

SEQ ID NO: 140759 - DNA, 11 bp, Homo sapiens
tctagttttca

SEQ ID NO: 140760 - DNA, 15 bp, Homo sapiens
tctataacatgcatt

SEQ ID NO: 140761 - DNA, 14 bp, Homo sapiens
tctatcagagaaaa

SEQ ID NO: 140762 - DNA, 17 bp, Homo sapiens
tctatgtgcttgtaaaa

SEQ ID NO: 140763 - DNA, 18 bp, Homo sapiens
tctattaagatttccaag

SEQ ID NO: 140764 - DNA, 22 bp, Homo sapiens
tctattgttgtacacagaaata

SEQ ID NO: 140765 - DNA, 23 bp, Homo sapiens
tctattgttgtacacagaaatac

SEQ ID NO: 140766 - DNA, 12 bp, Homo sapiens
tctatttaagcc

SEQ ID NO: 140767 - DNA, 15 bp, Homo sapiens
tctatttctcctcca

SEQ ID NO: 140768 - DNA, 16 bp, Homo sapiens
tctatttctcctccat

SEQ ID NO: 140769 - DNA, 13 bp, Homo sapiens
tctatttctgaga

SEQ ID NO: 140770 - DNA, 13 bp, Homo sapiens
tctcaaccatccc

SEQ ID NO: 140771 - DNA, 21 bp, Homo sapiens
tctcaacccttttgtctgcct

SEQ ID NO: 140772 - DNA, 22 bp, Homo sapiens
tctcacgggcatgggcactccc

SEQ ID NO: 140773 - DNA, 15 bp, Homo sapiens
tctcactaaacttta

SEQ ID NO: 140774 - DNA, 17 bp, Homo sapiens
tctcactaaactttacc

SEQ ID NO: 140775 - DNA, 13 bp, Homo sapiens
tctcactcctacc

SEQ ID NO: 140776 - DNA, 16 bp, Homo sapiens
tctcactcctacctgg

SEQ ID NO: 140777 - DNA, 13 bp, Homo sapiens
tctcagcctccca

SEQ ID NO: 140778 - DNA, 12 bp, Homo sapiens
tctcaggaaatc

SEQ ID NO: 140779 - DNA, 14 bp, Homo sapiens
tctcaggctctgcc

SEQ ID NO: 140780 - DNA, 17 bp, Homo sapiens
tctcaggctctgccctg

SEQ ID NO: 140781 - DNA, 19 bp, Homo sapiens
tctcagggcctggtcgttt

SEQ ID NO: 140782 - DNA, 15 bp, Homo sapiens
tctcaggtccctgca

SEQ ID NO: 140783 - DNA, 11 bp, Homo sapiens
tctcagtctct

SEQ ID NO: 140784 - DNA, 13 bp, Homo sapiens
tctcagtctctga

SEQ ID NO: 140785 - DNA, 23 bp, Homo sapiens
tctcatgtgatccttttatgtta

SEQ ID NO: 140786 - DNA, 17 bp, Homo sapiens
tctcattccaacagtga

SEQ ID NO: 140787 - DNA, 13 bp, Homo sapiens
tctcattccccag

SEQ ID NO: 140788 - DNA, 15 bp, Homo sapiens
tctccaacctggaca

SEQ ID NO: 140789 - DNA, 15 bp, Homo sapiens
tctccacctcagcct

SEQ ID NO: 140790 - DNA, 18 bp, Homo sapiens
tctccacctcagccttgg

SEQ ID NO: 140791 - DNA, 19 bp, Homo sapiens
tctccacctcagccttgga

SEQ ID NO: 140792 - DNA, 19 bp, Homo sapiens
tctccaggtctcacgggca

SEQ ID NO: 140793 - DNA, 15 bp, Homo sapiens
tctcccacgtgggag

SEQ ID NO: 140794 - DNA, 21 bp, Homo sapiens
tctcccagataatgtgaaaat

SEQ ID NO: 140795 - DNA, 12 bp, Homo sapiens
tctccctcccct

SEQ ID NO: 140796 - DNA, 18 bp, Homo sapiens
tctccctcccctgccatt

SEQ ID NO: 140797 - DNA, 17 bp, Homo sapiens
tctccctctcctgccta

SEQ ID NO: 140798 - DNA, 19 bp, Homo sapiens
tctccctctggccctgcct

SEQ ID NO: 140799 - DNA, 15 bp, Homo sapiens
tctccctgccgcctc

SEQ ID NO: 140800 - DNA, 12 bp, Homo sapiens
tctcctcttaaa

SEQ ID NO: 140801 - DNA, 14 bp, Homo sapiens
tctcctcttaaaaa

SEQ ID NO: 140802 - DNA, 13 bp, Homo sapiens
tctcctcttgcca

SEQ ID NO: 140803 - DNA, 16 bp, Homo sapiens
tctcctgccttcctcc

SEQ ID NO: 140804 - DNA, 14 bp, Homo sapiens
tctcctgtccaacc

SEQ ID NO: 140805 - DNA, 19 bp, Homo sapiens
tctcctgtttttctgggtg

SEQ ID NO: 140806 - DNA, 15 bp, Homo sapiens
tctcctttctttcta

SEQ ID NO: 140807 - DNA, 22 bp, Homo sapiens
tctctaacttcaaggcccatat

SEQ ID NO: 140808 - DNA, 11 bp, Homo sapiens
tctctaatatg

SEQ ID NO: 140809 - DNA, 15 bp, Homo sapiens
tctctatttaatatt

SEQ ID NO: 140810 - DNA, 14 bp, Homo sapiens
tctctccctcccct

SEQ ID NO: 140811 - DNA, 21 bp, Homo sapiens
tctctccctcccctgccattt

SEQ ID NO: 140812 - DNA, 14 bp, Homo sapiens
tctctctgactctc

SEQ ID NO: 140813 - DNA, 20 bp, Homo sapiens
tctctctgactctcaaatct

SEQ ID NO: 140814 - DNA, 21 bp, Homo sapiens
tctctctgactctcaaatctt

SEQ ID NO: 140815 - DNA, 16 bp, Homo sapiens
tctctgcagccagccc

SEQ ID NO: 140816 - DNA, 18 bp, Homo sapiens
tctctgcagccagcccag

SEQ ID NO: 140817 - DNA, 19 bp, Homo sapiens
tctctgcagccagcccagc

SEQ ID NO: 140818 - DNA, 20 bp, Homo sapiens
tctctgcagccagcccagcc

SEQ ID NO: 140819 - DNA, 21 bp, Homo sapiens
tctctgctctgcgtgtcacct

SEQ ID NO: 140820 - DNA, 12 bp, Homo sapiens
tctctgtctcat

SEQ ID NO: 140821 - DNA, 16 bp, Homo sapiens
tagcttagacctcagc

SEQ ID NO: 140822 - DNA, 15 bp, Homo sapiens
tagcttgggacaaat

SEQ ID NO: 140823 - DNA, 22 bp, Homo sapiens
tagctttattttttaagtattt

SEQ ID NO: 140824 - DNA, 14 bp, Homo sapiens
tagcttttattgta

SEQ ID NO: 140825 - DNA, 14 bp, Homo sapiens
taggaaataaaacc

SEQ ID NO: 140826 - DNA, 17 bp, Homo sapiens
taggaaataaaaccttt

SEQ ID NO: 140827 - DNA, 19 bp, Homo sapiens
taggaaataaaacctttca

SEQ ID NO: 140828 - DNA, 20 bp, Homo sapiens
taggaaataaaacctttcaa

SEQ ID NO: 140829 - DNA, 15 bp, Homo sapiens
taggaagagaaacca

SEQ ID NO: 140830 - DNA, 23 bp, Homo sapiens
taggaattgacccacaagaaatg

SEQ ID NO: 140831 - DNA, 13 bp, Homo sapiens
taggatagcattt

SEQ ID NO: 140832 - DNA, 13 bp, Homo sapiens
taggatgttgaaa

SEQ ID NO: 140833 - DNA, 16 bp, Homo sapiens
taggcatttgctgaat

SEQ ID NO: 140834 - DNA, 14 bp, Homo sapiens
taggccactcctcc

SEQ ID NO: 140835 - DNA, 19 bp, Homo sapiens
tagggaaaaaccagcgtgt

SEQ ID NO: 140836 - DNA, 14 bp, Homo sapiens
tagggacttaaaaa

SEQ ID NO: 140837 - DNA, 11 bp, Homo sapiens
tagggccaggc

SEQ ID NO: 140838 - DNA, 14 bp, Homo sapiens
tagggccaggcagg

SEQ ID NO: 140839 - DNA, 14 bp, Homo sapiens
taggggtcaaagaa

SEQ ID NO: 140840 - DNA, 16 bp, Homo sapiens
tagggtggagagccac

SEQ ID NO: 140841 - DNA, 22 bp, Homo sapiens
taggtgctacaaaaacacagca

SEQ ID NO: 140842 - DNA, 13 bp, Homo sapiens
taggtgtggggga

SEQ ID NO: 140843 - DNA, 20 bp, Homo sapiens
taggttgccaataatacact

SEQ ID NO: 140844 - DNA, 19 bp, Homo sapiens
taggtttttttgtatagta

SEQ ID NO: 140845 - DNA, 16 bp, Homo sapiens
tagtaaaaataaaatt

SEQ ID NO: 140846 - DNA, 13 bp, Homo sapiens
tagtaaagaaatg

SEQ ID NO: 140847 - DNA, 14 bp, Homo sapiens
tagtaaagaaatga

SEQ ID NO: 140848 - DNA, 23 bp, Homo sapiens
tagtacaggtaaggtgagggaat

SEQ ID NO: 140849 - DNA, 23 bp, Homo sapiens
tagtcaagaaaaattattgtata

SEQ ID NO: 140850 - DNA, 18 bp, Homo sapiens
tagtgatctgaacagaaa

SEQ ID NO: 140851 - DNA, 14 bp, Homo sapiens
tagtgatggttccc

SEQ ID NO: 140852 - DNA, 19 bp, Homo sapiens
tagtgctcgctttctatgt

SEQ ID NO: 140853 - DNA, 18 bp, Homo sapiens
tagtggggtctccctctc

SEQ ID NO: 140854 - DNA, 11 bp, Homo sapiens
tagtgtaaaat

SEQ ID NO: 140855 - DNA, 13 bp, Homo sapiens
tagtgtaaaataa

SEQ ID NO: 140856 - DNA, 13 bp, Homo sapiens
tagttaattctgt

SEQ ID NO: 140857 - DNA, 16 bp, Homo sapiens
tagttaggaaataaaa

SEQ ID NO: 140858 - DNA, 23 bp, Homo sapiens
tagttaggaaataaaacctttca

SEQ ID NO: 140859 - DNA, 16 bp, Homo sapiens
tagttcctgctacaac

SEQ ID NO: 140860 - DNA, 17 bp, Homo sapiens
tagtttgtacatgcatt

SEQ ID NO: 140861 - DNA, 14 bp, Homo sapiens
tagtttgtataact

SEQ ID NO: 140862 - DNA, 18 bp, Homo sapiens
tagtttgtataacttctt

SEQ ID NO: 140863 - DNA, 17 bp, Homo sapiens
tataaaacaggtcaata

SEQ ID NO: 140864 - DNA, 16 bp, Homo sapiens
tataaaataaatatat

SEQ ID NO: 140865 - DNA, 18 bp, Homo sapiens
tataaacctaaaaaagat

SEQ ID NO: 140866 - DNA, 19 bp, Homo sapiens
tataaactatcagtttgtc

SEQ ID NO: 140867 - DNA, 17 bp, Homo sapiens
tataaagatggctgact

SEQ ID NO: 140868 - DNA, 16 bp, Homo sapiens
tataaagtaaagctaa

SEQ ID NO: 140869 - DNA, 14 bp, Homo sapiens
tataactagtcctt

SEQ ID NO: 140870 - DNA, 16 bp, Homo sapiens
tataactcatcataaa

SEQ ID NO: 140871 - DNA, 22 bp, Homo sapiens
tataacttaaaaaaatgacaga

SEQ ID NO: 140872 - DNA, 19 bp, Homo sapiens
tataagaataaaatgttga

SEQ ID NO: 140873 - DNA, 15 bp, Homo sapiens
tataagtaagaaaat

SEQ ID NO: 140874 - DNA, 18 bp, Homo sapiens
tataagtaagaaaatatt

SEQ ID NO: 140875 - DNA, 14 bp, Homo sapiens
tataagtgtacata

SEQ ID NO: 140876 - DNA, 18 bp, Homo sapiens
tataagtgtacatatgtg

SEQ ID NO: 140877 - DNA, 20 bp, Homo sapiens
tataatatactatatttatg

SEQ ID NO: 140878 - DNA, 20 bp, Homo sapiens
tataatcttccatacttctt

SEQ ID NO: 140879 - DNA, 18 bp, Homo sapiens
tataatgaatgaaacatt

SEQ ID NO: 140880 - DNA, 11 bp, Homo sapiens
tataatttaat

SEQ ID NO: 140881 - DNA, 21 bp, Homo sapiens
tataatttttttcaatattta

SEQ ID NO: 140882 - DNA, 21 bp, Homo sapiens
tatacacttacactttatgca

SEQ ID NO: 140883 - DNA, 22 bp, Homo sapiens
tatacacttacactttatgcac

SEQ ID NO: 140884 - DNA, 19 bp, Homo sapiens
tataccagtataattgagt

SEQ ID NO: 140885 - DNA, 17 bp, Homo sapiens
tatactcactttctaga

SEQ ID NO: 140886 - DNA, 14 bp, Homo sapiens
tatagctattactg

SEQ ID NO: 140887 - DNA, 14 bp, Homo sapiens
tattttaaacaaaa

SEQ ID NO: 140888 - DNA, 14 bp, Homo sapiens
tattttaagtattg

SEQ ID NO: 140889 - DNA, 13 bp, Homo sapiens
tattttattccct

SEQ ID NO: 140890 - DNA, 21 bp, Homo sapiens
tattttcaacgcagccctgct

SEQ ID NO: 140891 - DNA, 13 bp, Homo sapiens
tattttgtctaaa

SEQ ID NO: 140892 - DNA, 12 bp, Homo sapiens
tatttttcatga

SEQ ID NO: 140893 - DNA, 14 bp, Homo sapiens
tatttttctaaggt

SEQ ID NO: 140894 - DNA, 13 bp, Homo sapiens
tattttttaagta

SEQ ID NO: 140895 - DNA, 13 bp, Homo sapiens
tatttttttgcaa

SEQ ID NO: 140896 - DNA, 19 bp, Homo sapiens
tatttttttgcaagtgaag

SEQ ID NO: 140897 - DNA, 15 bp, Homo sapiens
tcaaaaaaagaaaaa

SEQ ID NO: 140898 - DNA, 23 bp, Homo sapiens
tcaaaaagtctacgctctccttt

SEQ ID NO: 140899 - DNA, 15 bp, Homo sapiens
tcaaaacagagatgt

SEQ ID NO: 140900 - DNA, 15 bp, Homo sapiens
tcaaaaccttttgaa

SEQ ID NO: 140901 - DNA, 14 bp, Homo sapiens
tcaaaactcaaatg

SEQ ID NO: 140902 - DNA, 18 bp, Homo sapiens
tcaaaagaaagaaaatca

SEQ ID NO: 140903 - DNA, 20 bp, Homo sapiens
tcaaacagtctcaggaaatc

SEQ ID NO: 140904 - DNA, 21 bp, Homo sapiens
tcaaacagtctcaggaaatca

SEQ ID NO: 140905 - DNA, 22 bp, Homo sapiens
tcaaacagtctcaggaaatcaa

SEQ ID NO: 140906 - DNA, 19 bp, Homo sapiens
tcaaaccccgaccacctgc

SEQ ID NO: 140907 - DNA, 16 bp, Homo sapiens
tcaaacgtgaaaatgc

SEQ ID NO: 140908 - DNA, 16 bp, Homo sapiens
tcaaactgaagccaga

SEQ ID NO: 140909 - DNA, 20 bp, Homo sapiens
tcaaactgccttggcttcag

SEQ ID NO: 140910 - DNA, 16 bp, Homo sapiens
tcaaagaaatgctgat

SEQ ID NO: 140911 - DNA, 19 bp, Homo sapiens
tcaaagaaatgctgatgga

SEQ ID NO: 140912 - DNA, 15 bp, Homo sapiens
tcaaagagagaaaat

SEQ ID NO: 140913 - DNA, 15 bp, Homo sapiens
tcaaagcaaggaaac

SEQ ID NO: 140914 - DNA, 16 bp, Homo sapiens
tcaaatctccagtatt

SEQ ID NO: 140915 - DNA, 20 bp, Homo sapiens
tcaaattcatttttttcact

SEQ ID NO: 140916 - DNA, 15 bp, Homo sapiens
tcaacaaaaattgtc

SEQ ID NO: 140917 - DNA, 22 bp, Homo sapiens
tcaacagagaaggcaggaatgt

SEQ ID NO: 140918 - DNA, 15 bp, Homo sapiens
tcaacatcttttaca

SEQ ID NO: 140919 - DNA, 18 bp, Homo sapiens
tcaacccttttgtctgcc

SEQ ID NO: 140920 - DNA, 20 bp, Homo sapiens
tcaacccttttgtctgcctc

SEQ ID NO: 140921 - DNA, 21 bp, Homo sapiens
tcaacccttttgtctgcctct

SEQ ID NO: 140922 - DNA, 18 bp, Homo sapiens
tcaacctgggcaaagcct

SEQ ID NO: 140923 - DNA, 15 bp, Homo sapiens
tcaacgcagccctgc

SEQ ID NO: 140924 - DNA, 18 bp, Homo sapiens
tcaacgcagccctgcttt

SEQ ID NO: 140925 - DNA, 20 bp, Homo sapiens
tcaactcagactagtttagt

SEQ ID NO: 140926 - DNA, 18 bp, Homo sapiens
tcaagaaaaattattgta

SEQ ID NO: 140927 - DNA, 16 bp, Homo sapiens
tcaagcagattggaga

SEQ ID NO: 140928 - DNA, 17 bp, Homo sapiens
tcaagcagattggagaa

SEQ ID NO: 140929 - DNA, 14 bp, Homo sapiens
tcaagccaagcagc

SEQ ID NO: 140930 - DNA, 17 bp, Homo sapiens
tcaagccaagcagccaa

SEQ ID NO: 140931 - DNA, 19 bp, Homo sapiens
tcaagccaagcagccaagc

SEQ ID NO: 140932 - DNA, 20 bp, Homo sapiens
tcaagccaagcagccaagct

SEQ ID NO: 140933 - DNA, 13 bp, Homo sapiens
tcaagcccaggag

SEQ ID NO: 140934 - DNA, 20 bp, Homo sapiens
tcaaggtggccaaattattt

SEQ ID NO: 140935 - DNA, 15 bp, Homo sapiens
tcaagtcacctcctt

SEQ ID NO: 140936 - DNA, 19 bp, Homo sapiens
tcaagtgcatgctctctgc

SEQ ID NO: 140937 - DNA, 19 bp, Homo sapiens
tcaatacagtacaggcagc

SEQ ID NO: 140938 - DNA, 17 bp, Homo sapiens
tcaatagtcaagaaaaa

SEQ ID NO: 140939 - DNA, 18 bp, Homo sapiens
tcaatatccaaaccaaat

SEQ ID NO: 140940 - DNA, 11 bp, Homo sapiens
tcaatatttat

SEQ ID NO: 140941 - DNA, 17 bp, Homo sapiens
tcaatcccctcattcag

SEQ ID NO: 140942 - DNA, 17 bp, Homo sapiens
tcaatgctataactatg

SEQ ID NO: 140943 - DNA, 15 bp, Homo sapiens
tcaatgttttcagtt

SEQ ID NO: 140944 - DNA, 14 bp, Homo sapiens
tcaattccacctgc

SEQ ID NO: 140945 - DNA, 16 bp, Homo sapiens
tcaattcctctgggaa

SEQ ID NO: 140946 - DNA, 12 bp, Homo sapiens
tcaatttaaaaa

SEQ ID NO: 140947 - DNA, 21 bp, Homo sapiens
tcaattttatccctcacctgt

SEQ ID NO: 140948 - DNA, 22 bp, Homo sapiens
tcaattttatccctcacctgta

SEQ ID NO: 140949 - DNA, 22 bp, Homo sapiens
tcacaaaattttattcctatat

SEQ ID NO: 140950 - DNA, 22 bp, Homo sapiens
tcacaagacccaaaaggcagaa

SEQ ID NO: 140951 - DNA, 22 bp, Homo sapiens
tcacaaggcattcaagtgtaca

SEQ ID NO: 140952 - DNA, 22 bp, Homo sapiens
tcacaagggcaaactttttcct

SEQ ID NO: 140953 - DNA, 23 bp, Homo sapiens
tcacaatgaaatgctctcctttc

SEQ ID NO: 140954 - DNA, 20 bp, Homo sapiens
tcacacacaggcaactgagg

SEQ ID NO: 140955 - DNA, 17 bp, Homo sapiens
tcacactctcacatgtt

SEQ ID NO: 140956 - DNA, 21 bp, Homo sapiens
tcacactgcaagagccttggt

SEQ ID NO: 140957 - DNA, 21 bp, Homo sapiens
tcacagaacccttggagccaa

SEQ ID NO: 140958 - DNA, 12 bp, Homo sapiens
tcacagaagaat

SEQ ID NO: 140959 - DNA, 17 bp, Homo sapiens
tcacagaggcttcttca

SEQ ID NO: 140960 - DNA, 23 bp, Homo sapiens
tcacagccagactggcacagttt

SEQ ID NO: 140961 - DNA, 11 bp, Homo sapiens
tcacagcctct

SEQ ID NO: 140962 - DNA, 12 bp, Homo sapiens
tcacagcctctg

SEQ ID NO: 140963 - DNA, 14 bp, Homo sapiens
tcacaggaagtaga

SEQ ID NO: 140964 - DNA, 19 bp, Homo sapiens
tcacaggactctgcctcct

SEQ ID NO: 140965 - DNA, 16 bp, Homo sapiens
tcacagtcacattcca

SEQ ID NO: 140966 - DNA, 17 bp, Homo sapiens
tcacagttcctcgccct

SEQ ID NO: 140967 - DNA, 16 bp, Homo sapiens
tcacataccctccccc

SEQ ID NO: 140968 - DNA, 21 bp, Homo sapiens
tcacatgtcagtaccttcaaa

SEQ ID NO: 140969 - DNA, 16 bp, Homo sapiens
tcaccaccttcccagc

SEQ ID NO: 140970 - DNA, 18 bp, Homo sapiens
tcaccaccttcccagctc

SEQ ID NO: 140971 - DNA, 21 bp, Homo sapiens
tcaccagtgtcccctccactg

SEQ ID NO: 140972 - DNA, 22 bp, Homo sapiens
tcaccatttgattatgtagcaa

SEQ ID NO: 140973 - DNA, 22 bp, Homo sapiens
tcacccacagggctaagagcta

SEQ ID NO: 140974 - DNA, 12 bp, Homo sapiens
tcaccccaccct

SEQ ID NO: 140975 - DNA, 13 bp, Homo sapiens
tcaccccaccctt

SEQ ID NO: 140976 - DNA, 15 bp, Homo sapiens
tcaccccagggcctg

SEQ ID NO: 140977 - DNA, 12 bp, Homo sapiens
tcaccccatccc

SEQ ID NO: 140978 - DNA, 19 bp, Homo sapiens
tcaccccatcccacaccct

SEQ ID NO: 140979 - DNA, 16 bp, Homo sapiens
tcacccccttctccat

SEQ ID NO: 140980 - DNA, 22 bp, Homo sapiens
tcttgtgctggatggagcccag

SEQ ID NO: 140981 - DNA, 21 bp, Homo sapiens
tcttgttttttttttccactt

SEQ ID NO: 140982 - DNA, 21 bp, Homo sapiens
tctttaaagggatggcaagat

SEQ ID NO: 140983 - DNA, 13 bp, Homo sapiens
tctttattgagaa

SEQ ID NO: 140984 - DNA, 14 bp, Homo sapiens
tctttattgagaaa

SEQ ID NO: 140985 - DNA, 15 bp, Homo sapiens
tctttattgagaaag

SEQ ID NO: 140986 - DNA, 21 bp, Homo sapiens
tctttcaaaaccttttgaaat

SEQ ID NO: 140987 - DNA, 21 bp, Homo sapiens
tctttcacacttccaccagcc

SEQ ID NO: 140988 - DNA, 13 bp, Homo sapiens
tctttcatccact

SEQ ID NO: 140989 - DNA, 19 bp, Homo sapiens
tctttccacggagccactc

SEQ ID NO: 140990 - DNA, 17 bp, Homo sapiens
tctttctctgccagtga

SEQ ID NO: 140991 - DNA, 16 bp, Homo sapiens
tctttctgatgtcaaa

SEQ ID NO: 140992 - DNA, 14 bp, Homo sapiens
tctttctgtccctt

SEQ ID NO: 140993 - DNA, 17 bp, Homo sapiens
tctttcttcctctgctg

SEQ ID NO: 140994 - DNA, 23 bp, Homo sapiens
tctttgtaatgtcaccaccttcc

SEQ ID NO: 140995 - DNA, 13 bp, Homo sapiens
tcttttaaaagac

SEQ ID NO: 140996 - DNA, 16 bp, Homo sapiens
tcttttaaaagacaag

SEQ ID NO: 140997 - DNA, 19 bp, Homo sapiens
tcttttataactagtcctt

SEQ ID NO: 140998 - DNA, 17 bp, Homo sapiens
tcttttctctgtgcttc

SEQ ID NO: 140999 - DNA, 14 bp, Homo sapiens
tctttttttgtgat

SEQ ID NO: 141000 - DNA, 17 bp, Homo sapiens
tgaaaaaaagtttacaa

SEQ ID NO: 141001 - DNA, 20 bp, Homo sapiens
tgaaaaaggaggaagagaaa

SEQ ID NO: 141002 - DNA, 22 bp, Homo sapiens
tgaaaaaggaggaagagaaaaa

SEQ ID NO: 141003 - DNA, 13 bp, Homo sapiens
tgaaaaattctca

SEQ ID NO: 141004 - DNA, 16 bp, Homo sapiens
tgaaaacactgtgcac

SEQ ID NO: 141005 - DNA, 18 bp, Homo sapiens
tgaaaacagaaaacggtt

SEQ ID NO: 141006 - DNA, 16 bp, Homo sapiens
tgaaaacccagagagg

SEQ ID NO: 141007 - DNA, 23 bp, Homo sapiens
tgaaaacccagagaggaatcaga

SEQ ID NO: 141008 - DNA, 22 bp, Homo sapiens
tgaaaagaaaaatgagcctggc

SEQ ID NO: 141009 - DNA, 17 bp, Homo sapiens
tgaaaagacatcaagca

SEQ ID NO: 141010 - DNA, 16 bp, Homo sapiens
tgaaaagactccaaag

SEQ ID NO: 141011 - DNA, 17 bp, Homo sapiens
tgaaaagactccaaaga

SEQ ID NO: 141012 - DNA, 12 bp, Homo sapiens
tgaaaagtcaaa

SEQ ID NO: 141013 - DNA, 17 bp, Homo sapiens
tgaaaatatttgtatca

SEQ ID NO: 141014 - DNA, 15 bp, Homo sapiens
tgaaaatctaatatt

SEQ ID NO: 141015 - DNA, 13 bp, Homo sapiens
tgaaaatgtcttg

SEQ ID NO: 141016 - DNA, 16 bp, Homo sapiens
tgaaaatgtcttgtgt

SEQ ID NO: 141017 - DNA, 16 bp, Homo sapiens
tgaaaattattttaaa

SEQ ID NO: 141018 - DNA, 14 bp, Homo sapiens
tgaaacattttgtc

SEQ ID NO: 141019 - DNA, 20 bp, Homo sapiens
tgaaaccagtgttagggaag

SEQ ID NO: 141020 - DNA, 17 bp, Homo sapiens
tgaaagaggaatgaagt

SEQ ID NO: 141021 - DNA, 18 bp, Homo sapiens
tgaaagaggcagcttgaa

SEQ ID NO: 141022 - DNA, 18 bp, Homo sapiens
tgaaagatggctgtgcct

SEQ ID NO: 141023 - DNA, 23 bp, Homo sapiens
tgaaagatggctgtgcctctgcc

SEQ ID NO: 141024 - DNA, 23 bp, Homo sapiens
tgaaagcagggacttgaacccat

SEQ ID NO: 141025 - DNA, 15 bp, Homo sapiens
tgaaaggtttacatt

SEQ ID NO: 141026 - DNA, 14 bp, Homo sapiens
tgaaagtacatttg

SEQ ID NO: 141027 - DNA, 14 bp, Homo sapiens
tgaaataagccaga

SEQ ID NO: 141028 - DNA, 14 bp, Homo sapiens
tgaaataataaatc

SEQ ID NO: 141029 - DNA, 13 bp, Homo sapiens
tgagacctcagcc

SEQ ID NO: 141030 - DNA, 17 bp, Homo sapiens
tgagacctcagccatga

SEQ ID NO: 141031 - DNA, 19 bp, Homo sapiens
tgagacctcagccatgagg

SEQ ID NO: 141032 - DNA, 20 bp, Homo sapiens
tgagactcagacaggaaagg

SEQ ID NO: 141033 - DNA, 18 bp, Homo sapiens
tgagactgggtctcgctt

SEQ ID NO: 141034 - DNA, 21 bp, Homo sapiens
tgagagacccaaggaggaaaa

SEQ ID NO: 141035 - DNA, 14 bp, Homo sapiens
tgagatcagcctgg

SEQ ID NO: 141036 - DNA, 15 bp, Homo sapiens
tgagatcagcctggg

SEQ ID NO: 141037 - DNA, 16 bp, Homo sapiens
tgagatgctggagaag

SEQ ID NO: 141038 - DNA, 20 bp, Homo sapiens
tgagatgctggagaagagag

SEQ ID NO: 141039 - DNA, 19 bp, Homo sapiens
tgagatgtgaacacatcag

SEQ ID NO: 141040 - DNA, 15 bp, Homo sapiens
tgagattacagagga

SEQ ID NO: 141041 - DNA, 16 bp, Homo sapiens
tgagcaccaggggatg

SEQ ID NO: 141042 - DNA, 19 bp, Homo sapiens
tgagcaccgtcatggctta

SEQ ID NO: 141043 - DNA, 15 bp, Homo sapiens
tgagcactcccaagt

SEQ ID NO: 141044 - DNA, 17 bp, Homo sapiens
tgagcactcccaagtct

SEQ ID NO: 141045 - DNA, 18 bp, Homo sapiens
tgagcactcccaagtcta

SEQ ID NO: 141046 - DNA, 16 bp, Homo sapiens
tgagcagactggtgag

SEQ ID NO: 141047 - DNA, 19 bp, Homo sapiens
tgagcagactggtgagcag

SEQ ID NO: 141048 - DNA, 22 bp, Homo sapiens
tgagcagggagatcctggttgg

SEQ ID NO: 141049 - DNA, 18 bp, Homo sapiens
tgagcagtggctggtcca

SEQ ID NO: 141050 - DNA, 13 bp, Homo sapiens
tgagccccaaaag

SEQ ID NO: 141051 - DNA, 16 bp, Homo sapiens
tgagccccgcagacct

SEQ ID NO: 141052 - DNA, 15 bp, Homo sapiens
tgagcccctgggact

SEQ ID NO: 141053 - DNA, 20 bp, Homo sapiens
tgagccctcagaacccttgg

SEQ ID NO: 141054 - DNA, 22 bp, Homo sapiens
tgagccctcagaacccttggct

SEQ ID NO: 141055 - DNA, 14 bp, Homo sapiens
tgagcctgggaggt

SEQ ID NO: 141056 - DNA, 13 bp, Homo sapiens
tgagccttgtaat

SEQ ID NO: 141057 - DNA, 23 bp, Homo sapiens
tgagcgaggagatgctccttggg

SEQ ID NO: 141058 - DNA, 19 bp, Homo sapiens
tgagctatttccattccag

SEQ ID NO: 141059 - DNA, 18 bp, Homo sapiens
tgagctcagacccccact

SEQ ID NO: 141060 - DNA, 14 bp, Homo sapiens
tgagctgaggcagc

SEQ ID NO: 141061 - DNA, 15 bp, Homo sapiens
tgagctgccatccag

SEQ ID NO: 141062 - DNA, 11 bp, Homo sapiens
tgagctgtttt

SEQ ID NO: 141063 - DNA, 15 bp, Homo sapiens
tgagcttctctgtga

SEQ ID NO: 141064 - DNA, 16 bp, Homo sapiens
tgagcttctctgtgaa

SEQ ID NO: 141065 - DNA, 19 bp, Homo sapiens
tgaggaaagcatgtattca

SEQ ID NO: 141066 - DNA, 22 bp, Homo sapiens
tgaggaagcgtgaaggccgaga

SEQ ID NO: 141067 - DNA, 16 bp, Homo sapiens
tgaggaatgatgaagc

SEQ ID NO: 141068 - DNA, 13 bp, Homo sapiens
tgaggaggaagga

SEQ ID NO: 141069 - DNA, 18 bp, Homo sapiens
tgaggaggaaggagagaa

SEQ ID NO: 141070 - DNA, 23 bp, Homo sapiens
tgaggcagacagcagctcaggca

SEQ ID NO: 141071 - DNA, 14 bp, Homo sapiens
tgaggcagggaagt

SEQ ID NO: 141072 - DNA, 15 bp, Homo sapiens
tgaggcaggggcgga

SEQ ID NO: 141073 - DNA, 11 bp, Homo sapiens
tgaggcctgga

SEQ ID NO: 141074 - DNA, 20 bp, Homo sapiens
tgaggcctggactttcctgc

SEQ ID NO: 141075 - DNA, 13 bp, Homo sapiens
tgaggctgtcctg

SEQ ID NO: 141076 - DNA, 14 bp, Homo sapiens
tgaggctgtcctgt

SEQ ID NO: 141077 - DNA, 18 bp, Homo sapiens
tgaggctgtcctgtacat

SEQ ID NO: 141078 - DNA, 20 bp, Homo sapiens
tgagggaacagacaggagaa

SEQ ID NO: 141079 - DNA, 22 bp, Homo sapiens
tgagggaacagacaggagaaat

SEQ ID NO: 141080 - DNA, 13 bp, Homo sapiens
tgagggaccagcc

SEQ ID NO: 141081 - DNA, 14 bp, Homo sapiens
tgagggagcctggc

SEQ ID NO: 141082 - DNA, 12 bp, Homo sapiens
tgagggcccaga

SEQ ID NO: 141083 - DNA, 15 bp, Homo sapiens
tgagggcccagagca

SEQ ID NO: 141084 - DNA, 18 bp, Homo sapiens
tgagggcccagagcagga

SEQ ID NO: 141085 - DNA, 19 bp, Homo sapiens
tgagggcccagagcaggaa

SEQ ID NO: 141086 - DNA, 20 bp, Homo sapiens
tgagggcccagagcaggaag

SEQ ID NO: 141087 - DNA, 16 bp, Homo sapiens
tgaggggcccgagcag

SEQ ID NO: 141088 - DNA, 23 bp, Homo sapiens
tgaggtctaggaacatacttcag

SEQ ID NO: 141089 - DNA, 17 bp, Homo sapiens
tgaggtgctgggaggga

SEQ ID NO: 141090 - DNA, 21 bp, Homo sapiens
tgaggtggaagccctccttcc

SEQ ID NO: 141091 - DNA, 19 bp, Homo sapiens
tgaggtttcaaacctccct

SEQ ID NO: 141092 - DNA, 15 bp, Homo sapiens
tgagtatctcctcgc

SEQ ID NO: 141093 - DNA, 20 bp, Homo sapiens
tgagtcatgatctccctgcc

SEQ ID NO: 141094 - DNA, 19 bp, Homo sapiens
tgagtccagaagtttgaga

SEQ ID NO: 141095 - DNA, 18 bp, Homo sapiens
tgagtcgtcatcactttt

SEQ ID NO: 141096 - DNA, 14 bp, Homo sapiens
tgagtgagcctggc

SEQ ID NO: 141097 - DNA, 15 bp, Homo sapiens
tgagtgcagtcctga

SEQ ID NO: 141098 - DNA, 22 bp, Homo sapiens
tgagtgtttttactacagttgt

SEQ ID NO: 141099 - DNA, 14 bp, Homo sapiens
tgagttattttaat

SEQ ID NO: 141100 - DNA, 15 bp, Homo sapiens
tgagttctacataag

SEQ ID NO: 141101 - DNA, 23 bp, Homo sapiens
tgagttgttttcagactcagact

SEQ ID NO: 141102 - DNA, 14 bp, Homo sapiens
tgagtttaaagcaa

SEQ ID NO: 141103 - DNA, 17 bp, Homo sapiens
tgagtttcctcaggctg

SEQ ID NO: 141104 - DNA, 19 bp, Homo sapiens
tgagtttttatggggctga

SEQ ID NO: 141105 - DNA, 18 bp, Homo sapiens
tgagtttttgatagcttt

SEQ ID NO: 141106 - DNA, 16 bp, Homo sapiens
tgataaaaccatgtag

SEQ ID NO: 141107 - DNA, 15 bp, Homo sapiens
tgatacttttaagag

SEQ ID NO: 141108 - DNA, 22 bp, Homo sapiens
tgatagctctttggcagtctat

SEQ ID NO: 141109 - DNA, 14 bp, Homo sapiens
tgatagctttattt

SEQ ID NO: 141110 - DNA, 23 bp, Homo sapiens
tgatagctttattttttaagtat

SEQ ID NO: 141111 - DNA, 18 bp, Homo sapiens
tgatatataagtgtacat

SEQ ID NO: 141112 - DNA, 16 bp, Homo sapiens
tgatatcccccagcct

SEQ ID NO: 141113 - DNA, 17 bp, Homo sapiens
tgatcaaattcattttt

SEQ ID NO: 141114 - DNA, 18 bp, Homo sapiens
tgatcagaccataatgtt

SEQ ID NO: 141115 - DNA, 22 bp, Homo sapiens
tgatcagagccgtggtcctttg

SEQ ID NO: 141116 - DNA, 15 bp, Homo sapiens
tgatcataagtctaa

SEQ ID NO: 141117 - DNA, 21 bp, Homo sapiens
tgatcataagtctaaataaat

SEQ ID NO: 141118 - DNA, 18 bp, Homo sapiens
tgatcggagcctcctctc

SEQ ID NO: 141119 - DNA, 16 bp, Homo sapiens
tgatctccctgccgcc

SEQ ID NO: 141120 - DNA, 14 bp, Homo sapiens
tgatctttaaaata

SEQ ID NO: 141121 - DNA, 23 bp, Homo sapiens
tgatgaactttctcttcatactt

SEQ ID NO: 141122 - DNA, 14 bp, Homo sapiens
tgatgacagacact

SEQ ID NO: 141123 - DNA, 15 bp, Homo sapiens
tgatgagctcctctt

SEQ ID NO: 141124 - DNA, 13 bp, Homo sapiens
tgatgagttgtga

SEQ ID NO: 141125 - DNA, 14 bp, Homo sapiens
tgatgatcctaggc

SEQ ID NO: 141126 - DNA, 14 bp, Homo sapiens
tgatgggaaagcat

SEQ ID NO: 141127 - DNA, 17 bp, Homo sapiens
tgatggggaaggaggct

SEQ ID NO: 141128 - DNA, 16 bp, Homo sapiens
tgatggtcttcagcct

SEQ ID NO: 141129 - DNA, 18 bp, Homo sapiens
tgatgtagtgcctctttc

SEQ ID NO: 141130 - DNA, 14 bp, Homo sapiens
tgatgtattctagc

SEQ ID NO: 141131 - DNA, 20 bp, Homo sapiens
tgatgtattctagctaatgt

SEQ ID NO: 141132 - DNA, 18 bp, Homo sapiens
tgatgtgtttatttatag

SEQ ID NO: 141133 - DNA, 15 bp, Homo sapiens
tgattccacttttat

SEQ ID NO: 141134 - DNA, 20 bp, Homo sapiens
tgattcttgagtttagtgat

SEQ ID NO: 141135 - DNA, 14 bp, Homo sapiens
tgattggattattc

SEQ ID NO: 141136 - DNA, 17 bp, Homo sapiens
tgattggattattcatt

SEQ ID NO: 141137 - DNA, 12 bp, Homo sapiens
tgattgtaaaat

SEQ ID NO: 141138 - DNA, 19 bp, Homo sapiens
tgatttcacaacagatcaa

SEQ ID NO: 141139 - DNA, 13 bp, Homo sapiens
tgatttcatttca

SEQ ID NO: 141140 - DNA, 15 bp, Homo sapiens
tcagttactcagccc

SEQ ID NO: 141141 - DNA, 17 bp, Homo sapiens
tcagttttatcattttc

SEQ ID NO: 141142 - DNA, 12 bp, Homo sapiens
tcataaaataaa

SEQ ID NO: 141143 - DNA, 20 bp, Homo sapiens
tcataagtatttcaaattgg

SEQ ID NO: 141144 - DNA, 12 bp, Homo sapiens
tcatagcagctt

SEQ ID NO: 141145 - DNA, 20 bp, Homo sapiens
tcataggaaaagtacattta

SEQ ID NO: 141146 - DNA, 19 bp, Homo sapiens
tcatagggaagacctgctg

SEQ ID NO: 141147 - DNA, 16 bp, Homo sapiens
tcataggttgccaata

SEQ ID NO: 141148 - DNA, 17 bp, Homo sapiens
tcatattcctgcagcct

SEQ ID NO: 141149 - DNA, 18 bp, Homo sapiens
tcatattttctttcaaaa

SEQ ID NO: 141150 - DNA, 17 bp, Homo sapiens
tcatcaatgaatgaatg

SEQ ID NO: 141151 - DNA, 17 bp, Homo sapiens
tcatcacttttcagtga

SEQ ID NO: 141152 - DNA, 15 bp, Homo sapiens
tcatcataaaataaa

SEQ ID NO: 141153 - DNA, 19 bp, Homo sapiens
tcatcataaaataaagtat

SEQ ID NO: 141154 - DNA, 15 bp, Homo sapiens
tcatcatacatgact

SEQ ID NO: 141155 - DNA, 22 bp, Homo sapiens
tcatcatgtatcgcttcatgta

SEQ ID NO: 141156 - DNA, 19 bp, Homo sapiens
tcatccactagtgcaaatc

SEQ ID NO: 141157 - DNA, 19 bp, Homo sapiens
tcatccattctattgttaa

SEQ ID NO: 141158 - DNA, 21 bp, Homo sapiens
tcatcccgagcacctccacat

SEQ ID NO: 141159 - DNA, 15 bp, Homo sapiens
tcatccgaggcaggg

SEQ ID NO: 141160 - DNA, 15 bp, Homo sapiens
tcatccggcagcctg

SEQ ID NO: 141161 - DNA, 17 bp, Homo sapiens
tcatccggcagcctgga

SEQ ID NO: 141162 - DNA, 19 bp, Homo sapiens
tcatccggcagcctggatg

SEQ ID NO: 141163 - DNA, 16 bp, Homo sapiens
tcatctatttctgaga

SEQ ID NO: 141164 - DNA, 20 bp, Homo sapiens
tcatctcaggcctccctcaa

SEQ ID NO: 141165 - DNA, 15 bp, Homo sapiens
tcatctcctgccttc

SEQ ID NO: 141166 - DNA, 18 bp, Homo sapiens
tcatctcctgccttcctc

SEQ ID NO: 141167 - DNA, 22 bp, Homo sapiens
tcatctcctgccttcctcctgg

SEQ ID NO: 141168 - DNA, 12 bp, Homo sapiens
tcatctgtccct

SEQ ID NO: 141169 - DNA, 17 bp, Homo sapiens
tcatctgtccctccggg

SEQ ID NO: 141170 - DNA, 23 bp, Homo sapiens
tcatcttaggttggcaaaaaggc

SEQ ID NO: 141171 - DNA, 16 bp, Homo sapiens
tcatcttcttcaccat

SEQ ID NO: 141172 - DNA, 20 bp, Homo sapiens
agagcagaacggagccccag

SEQ ID NO: 141173 - DNA, 22 bp, Homo sapiens
agagcagggattaacctctgca

SEQ ID NO: 141174 - DNA, 19 bp, Homo sapiens
agagccaccaagagggacg

SEQ ID NO: 141175 - DNA, 22 bp, Homo sapiens
agagccagccctccctgtcctc

SEQ ID NO: 141176 - DNA, 15 bp, Homo sapiens
agagcccttcatttg

SEQ ID NO: 141177 - DNA, 11 bp, Homo sapiens
agagcctgagg

SEQ ID NO: 141178 - DNA, 13 bp, Homo sapiens
agagcctgctccc

SEQ ID NO: 141179 - DNA, 20 bp, Homo sapiens
agagcctgctcccccacccc

SEQ ID NO: 141180 - DNA, 11 bp, Homo sapiens
agagccttgcg

SEQ ID NO: 141181 - DNA, 20 bp, Homo sapiens
agagccttggtgtccacctg

SEQ ID NO: 141182 - DNA, 21 bp, Homo sapiens
agagccttggtgtccacctgg

SEQ ID NO: 141183 - DNA, 23 bp, Homo sapiens
agagccttggtgtccacctggcc

SEQ ID NO: 141184 - DNA, 20 bp, Homo sapiens
agagcgcctgcccctcccag

SEQ ID NO: 141185 - DNA, 21 bp, Homo sapiens
agagctagcgctgccgcaccc

SEQ ID NO: 141186 - DNA, 22 bp, Homo sapiens
agagctgggaggcatggccctg

SEQ ID NO: 141187 - DNA, 19 bp, Homo sapiens
agagctgtattaagccact

SEQ ID NO: 141188 - DNA, 19 bp, Homo sapiens
agagctgttcacagccaga

SEQ ID NO: 141189 - DNA, 18 bp, Homo sapiens
ctctctttgggaatgttt

SEQ ID NO: 141190 - DNA, 15 bp, Homo sapiens
ctctgaaaccctgga

SEQ ID NO: 141191 - DNA, 21 bp, Homo sapiens
ctctgacccctcctcactggc

SEQ ID NO: 141192 - DNA, 16 bp, Homo sapiens
ctctgactcagggctc

SEQ ID NO: 141193 - DNA, 20 bp, Homo sapiens
ctctgactcagggctcctgg

SEQ ID NO: 141194 - DNA, 21 bp, Homo sapiens
ctctgactcagggctcctggg

SEQ ID NO: 141195 - DNA, 21 bp, Homo sapiens
ctctgagatctaaggatgtca

SEQ ID NO: 141196 - DNA, 22 bp, Homo sapiens
ctctgagatctaaggatgtcac

SEQ ID NO: 141197 - DNA, 13 bp, Homo sapiens
ctctgagcccctg

SEQ ID NO: 141198 - DNA, 22 bp, Homo sapiens
ctctgagcccctgggactgctg

SEQ ID NO: 141199 - DNA, 12 bp, Homo sapiens
ctctgagtgtga

SEQ ID NO: 141200 - DNA, 15 bp, Homo sapiens
ctctgataggccaag

SEQ ID NO: 141201 - DNA, 16 bp, Homo sapiens
ctctgcacaagctgca

SEQ ID NO: 141202 - DNA, 20 bp, Homo sapiens
ctctgcacaagctgcaccct

SEQ ID NO: 141203 - DNA, 20 bp, Homo sapiens
ctctgcactactgacatgtg

SEQ ID NO: 141204 - DNA, 17 bp, Homo sapiens
ctctgcagccagcccag

SEQ ID NO: 141205 - DNA, 11 bp, Homo sapiens
ctctgccacca

SEQ ID NO: 141206 - DNA, 16 bp, Homo sapiens
ctctgccaccagagac

SEQ ID NO: 141207 - DNA, 23 bp, Homo sapiens
ctctgccaccagagaccgtcctc

SEQ ID NO: 141208 - DNA, 15 bp, Homo sapiens
ctctgccctgcccta

SEQ ID NO: 141209 - DNA, 16 bp, Homo sapiens
ctctgccctgccctag

SEQ ID NO: 141210 - DNA, 20 bp, Homo sapiens
ctctgccctgccctagctcc

SEQ ID NO: 141211 - DNA, 17 bp, Homo sapiens
ctctgcctctgcctgca

SEQ ID NO: 141212 - DNA, 18 bp, Homo sapiens
ctctgcctgaaccttcca

SEQ ID NO: 141213 - DNA, 14 bp, Homo sapiens
ctctgcggacccca

SEQ ID NO: 141214 - DNA, 16 bp, Homo sapiens
ctctgcggaccccagc

SEQ ID NO: 141215 - DNA, 17 bp, Homo sapiens
ctctgcggaccccagct

SEQ ID NO: 141216 - DNA, 13 bp, Homo sapiens
ctctgctcgcctt

SEQ ID NO: 141217 - DNA, 13 bp, Homo sapiens
ctctgctctgcgt

SEQ ID NO: 141218 - DNA, 14 bp, Homo sapiens
ctctgctggcccag

SEQ ID NO: 141219 - DNA, 19 bp, Homo sapiens
ctctgctttgactgagcag

SEQ ID NO: 141220 - DNA, 18 bp, Homo sapiens
ctctggattgtgggaatt

SEQ ID NO: 141221 - DNA, 14 bp, Homo sapiens
ctctggccctgcct

SEQ ID NO: 141222 - DNA, 13 bp, Homo sapiens
ctctggctggcta

SEQ ID NO: 141223 - DNA, 23 bp, Homo sapiens
ctctgggccaagtcaaagacatt

SEQ ID NO: 141224 - DNA, 19 bp, Homo sapiens
ctctggtgacaccagcctt

SEQ ID NO: 141225 - DNA, 22 bp, Homo sapiens
ctctgtatcaggacccagagga

SEQ ID NO: 141226 - DNA, 14 bp, Homo sapiens
ctctgtctcatcca

SEQ ID NO: 141227 - DNA, 16 bp, Homo sapiens
ctctgtcttgtgtttc

SEQ ID NO: 141228 - DNA, 23 bp, Homo sapiens
ctctgtgaacgatttagaaagaa

SEQ ID NO: 141229 - DNA, 17 bp, Homo sapiens
ctctgtgaccaatgtct

SEQ ID NO: 141230 - DNA, 14 bp, Homo sapiens
ctctgtgacctcag

SEQ ID NO: 141231 - DNA, 14 bp, Homo sapiens
ctctgtgtccttcc

SEQ ID NO: 141232 - DNA, 19 bp, Homo sapiens
ctcttaaaaaataaaaact

SEQ ID NO: 141233 - DNA, 20 bp, Homo sapiens
ctcttaaagctgcctgtagt

SEQ ID NO: 141234 - DNA, 22 bp, Homo sapiens
ctcttactttcctttccccagc

SEQ ID NO: 141235 - DNA, 13 bp, Homo sapiens
ctcttagaaaaac

SEQ ID NO: 141236 - DNA, 15 bp, Homo sapiens
ctcttagaaaaacca

SEQ ID NO: 141237 - DNA, 19 bp, Homo sapiens
ctcttaggaagagaaacca

SEQ ID NO: 141238 - DNA, 18 bp, Homo sapiens
ctcttatagaatatttat

SEQ ID NO: 141239 - DNA, 16 bp, Homo sapiens
ctcttcaactgaccag

SEQ ID NO: 141240 - DNA, 14 bp, Homo sapiens
ctcttcaatctctt

SEQ ID NO: 141241 - DNA, 13 bp, Homo sapiens
ctcttcagaggcc

SEQ ID NO: 141242 - DNA, 16 bp, Homo sapiens
ctcttctcctttcaca

SEQ ID NO: 141243 - DNA, 22 bp, Homo sapiens
ctcttgagcagtggctggtcca

SEQ ID NO: 141244 - DNA, 14 bp, Homo sapiens
ctcttgtgctggat

SEQ ID NO: 141245 - DNA, 17 bp, Homo sapiens
ctctttctctgccagtg

SEQ ID NO: 141246 - DNA, 10 bp, Homo sapiens
ctctttgaga

SEQ ID NO: 141247 - DNA, 15 bp, Homo sapiens
ctctttggacactca

SEQ ID NO: 141248 - DNA, 18 bp, Homo sapiens
ctctttggacactcacac

SEQ ID NO: 141249 - DNA, 20 bp, Homo sapiens
ctctttgggaatgtttgtct

SEQ ID NO: 141250 - DNA, 21 bp, Homo sapiens
ctctttgggaatgtttgtctc

SEQ ID NO: 141251 - DNA, 12 bp, Homo sapiens
ctctttgtaaga

SEQ ID NO: 141252 - DNA, 20 bp, Homo sapiens
ctcttttgaatccatgcttg

SEQ ID NO: 141253 - DNA, 14 bp, Homo sapiens
ctgaaaaaaagttt

SEQ ID NO: 141254 - DNA, 19 bp, Homo sapiens
ctgaaaaatctaagtgata

SEQ ID NO: 141255 - DNA, 20 bp, Homo sapiens
ctgaaaatcgagtttttcct

SEQ ID NO: 141256 - DNA, 17 bp, Homo sapiens
ctgaaaatctaatatta

SEQ ID NO: 141257 - DNA, 20 bp, Homo sapiens
ctgaaaatctaatattaaaa

SEQ ID NO: 141258 - DNA, 13 bp, Homo sapiens
ctgaaagaggaat

SEQ ID NO: 141259 - DNA, 11 bp, Homo sapiens
ctgaaagccac

SEQ ID NO: 141260 - DNA, 12 bp, Homo sapiens
ctgaaagccacg

SEQ ID NO: 141261 - DNA, 16 bp, Homo sapiens
ctgaaagccctgagct

SEQ ID NO: 141262 - DNA, 19 bp, Homo sapiens
ctgaaagccctgagctttc

SEQ ID NO: 141263 - DNA, 16 bp, Homo sapiens
ctgaagatgatcattt

SEQ ID NO: 141264 - DNA, 14 bp, Homo sapiens
ctgaagccagcctt

SEQ ID NO: 141265 - DNA, 22 bp, Homo sapiens
ctgaaggaataaattgctcctt

SEQ ID NO: 141266 - DNA, 13 bp, Homo sapiens
ctgaagtcactgc

SEQ ID NO: 141267 - DNA, 13 bp, Homo sapiens
ctgaagtttcaca

SEQ ID NO: 141268 - DNA, 15 bp, Homo sapiens
ctgaatagcagaagg

SEQ ID NO: 141269 - DNA, 22 bp, Homo sapiens
ctgaatggaaggtttgtatatt

SEQ ID NO: 141270 - DNA, 11 bp, Homo sapiens
ctgaatgtatt

SEQ ID NO: 141271 - DNA, 20 bp, Homo sapiens
ctgaattaatgacagagcca

SEQ ID NO: 141272 - DNA, 21 bp, Homo sapiens
ctgaattaatgacagagccag

SEQ ID NO: 141273 - DNA, 22 bp, Homo sapiens
ctgaattaatgacagagccagt

SEQ ID NO: 141274 - DNA, 18 bp, Homo sapiens
ctgacaaccactggtctg

SEQ ID NO: 141275 - DNA, 20 bp, Homo sapiens
ctgacaaccactggtctgta

SEQ ID NO: 141276 - DNA, 21 bp, Homo sapiens
ctgacacccatgtttctctgg

SEQ ID NO: 141277 - DNA, 17 bp, Homo sapiens
ctgacactcccttgggc

SEQ ID NO: 141278 - DNA, 14 bp, Homo sapiens
ctgacagcctccca

SEQ ID NO: 141279 - DNA, 20 bp, Homo sapiens
ctgacagcctcccaccccca

SEQ ID NO: 141280 - DNA, 21 bp, Homo sapiens
ctgacatcttagtatttgcat

SEQ ID NO: 141281 - DNA, 23 bp, Homo sapiens
ctgaccacggacgtttccatcag

SEQ ID NO: 141282 - DNA, 14 bp, Homo sapiens
ctgacccagtccct

SEQ ID NO: 141283 - DNA, 13 bp, Homo sapiens
ctgacccagtgag

SEQ ID NO: 141284 - DNA, 14 bp, Homo sapiens
ctgacccctcctca

SEQ ID NO: 141285 - DNA, 15 bp, Homo sapiens
ctgacccctcctcac

SEQ ID NO: 141286 - DNA, 20 bp, Homo sapiens
ctgacccctcctcactggcc

SEQ ID NO: 141287 - DNA, 18 bp, Homo sapiens
ctgaccctctccacccca

SEQ ID NO: 141288 - DNA, 20 bp, Homo sapiens
ctgaccgaaacagcgctggg

SEQ ID NO: 141289 - DNA, 18 bp, Homo sapiens
ctgacctccctctaattt

SEQ ID NO: 141290 - DNA, 21 bp, Homo sapiens
ctgacctccctctaatttatc

SEQ ID NO: 141291 - DNA, 21 bp, Homo sapiens
ctgaccttgaactcctgggct

SEQ ID NO: 141292 - DNA, 18 bp, Homo sapiens
ctgactagtgaggaaaga

SEQ ID NO: 141293 - DNA, 12 bp, Homo sapiens
ctgactcagggc

SEQ ID NO: 141294 - DNA, 14 bp, Homo sapiens
ctgactcagggctc

SEQ ID NO: 141295 - DNA, 19 bp, Homo sapiens
ctgactcagggctcctggg

SEQ ID NO: 141296 - DNA, 21 bp, Homo sapiens
ctgactcagggctcctgggtt

SEQ ID NO: 141297 - DNA, 13 bp, Homo sapiens
ctgactccttaga

SEQ ID NO: 141298 - DNA, 14 bp, Homo sapiens
ctgactctcaaatc

SEQ ID NO: 141299 - DNA, 12 bp, Homo sapiens
ctgactgggagt

SEQ ID NO: 141300 - DNA, 14 bp, Homo sapiens
ctgactttgctctt

SEQ ID NO: 141301 - DNA, 18 bp, Homo sapiens
ctgactttgctctttctt

SEQ ID NO: 141302 - DNA, 19 bp, Homo sapiens
ctgagaaagactattcaaa

SEQ ID NO: 141303 - DNA, 16 bp, Homo sapiens
ctgagagacttttaat

SEQ ID NO: 141304 - DNA, 21 bp, Homo sapiens
ctgagatcaaaacggttttac

SEQ ID NO: 141305 - DNA, 21 bp, Homo sapiens
ctgagcaaatgtggctcctgg

SEQ ID NO: 141306 - DNA, 13 bp, Homo sapiens
ctgagcaccaggg

SEQ ID NO: 141307 - DNA, 21 bp, Homo sapiens
ctgagcagactggtgagcaga

SEQ ID NO: 141308 - DNA, 18 bp, Homo sapiens
ctgagcaggacctctgaa

SEQ ID NO: 141309 - DNA, 22 bp, Homo sapiens
ctgagccccgcagacctcccca

SEQ ID NO: 141310 - DNA, 17 bp, Homo sapiens
ctgagccctcaaagtga

SEQ ID NO: 141311 - DNA, 15 bp, Homo sapiens
ctgagcctggccagc

SEQ ID NO: 141312 - DNA, 17 bp, Homo sapiens
ctgagcctggccagcct

SEQ ID NO: 141313 - DNA, 21 bp, Homo sapiens
ctgagccttgtaattctaaat

SEQ ID NO: 141314 - DNA, 20 bp, Homo sapiens
ctgcaagcacatctgcattt

SEQ ID NO: 141315 - DNA, 16 bp, Homo sapiens
ctgcacaagctgcacc

SEQ ID NO: 141316 - DNA, 18 bp, Homo sapiens
ctgcacagtgcatctcag

SEQ ID NO: 141317 - DNA, 14 bp, Homo sapiens
ctgcacccccctgg

SEQ ID NO: 141318 - DNA, 22 bp, Homo sapiens
ctgcacctccccccactgcagg

SEQ ID NO: 141319 - DNA, 14 bp, Homo sapiens
ctgcacctgtgcag

SEQ ID NO: 141320 - DNA, 14 bp, Homo sapiens
ctgcactactgaca

SEQ ID NO: 141321 - DNA, 16 bp, Homo sapiens
ctgcactactgacatg

SEQ ID NO: 141322 - DNA, 13 bp, Homo sapiens
ctgcactccagcc

SEQ ID NO: 141323 - DNA, 16 bp, Homo sapiens
ctgcactccagcctgg

SEQ ID NO: 141324 - DNA, 20 bp, Homo sapiens
ctgcactccagcctgggtga

SEQ ID NO: 141325 - DNA, 12 bp, Homo sapiens
ctgcactgtcaa

SEQ ID NO: 141326 - DNA, 13 bp, Homo sapiens
ctgcagaagacag

SEQ ID NO: 141327 - DNA, 12 bp, Homo sapiens
ctgcagccagcc

SEQ ID NO: 141328 - DNA, 16 bp, Homo sapiens
ctgcagccagcccagc

SEQ ID NO: 141329 - DNA, 18 bp, Homo sapiens
ctgcagccagcccagccc

SEQ ID NO: 141330 - DNA, 24 bp, Homo sapiens
ctgcagcccggcgccaccatcctg

SEQ ID NO: 141331 - DNA, 17 bp, Homo sapiens
ctgcagcctcctcctga

SEQ ID NO: 141332 - DNA, 20 bp, Homo sapiens
ctgcagcctcctcctgacca

SEQ ID NO: 141333 - DNA, 15 bp, Homo sapiens
ctgcagcctggaggc

SEQ ID NO: 141334 - DNA, 12 bp, Homo sapiens
ctgcagctttac

SEQ ID NO: 141335 - DNA, 21 bp, Homo sapiens
ctgcagctttacatgcaattt

SEQ ID NO: 141336 - DNA, 12 bp, Homo sapiens
ctgcaggcaggg

SEQ ID NO: 141337 - DNA, 14 bp, Homo sapiens
ctgcaggccccgct

SEQ ID NO: 141338 - DNA, 22 bp, Homo sapiens
ctgcagggaaaattatttgcat

SEQ ID NO: 141339 - DNA, 16 bp, Homo sapiens
ctgcagggccaagcac

SEQ ID NO: 141340 - DNA, 14 bp, Homo sapiens
ctgcagggccagga

SEQ ID NO: 141341 - DNA, 17 bp, Homo sapiens
ctgcagggccaggactg

SEQ ID NO: 141342 - DNA, 19 bp, Homo sapiens
ctgcaggggctctggagag

SEQ ID NO: 141343 - DNA, 14 bp, Homo sapiens
ctgcaggtgctgct

SEQ ID NO: 141344 - DNA, 13 bp, Homo sapiens
ctgaggtgggagg

SEQ ID NO: 141345 - DNA, 20 bp, Homo sapiens
ctgagtttcattctcctgcc

SEQ ID NO: 141346 - DNA, 21 bp, Homo sapiens
ctgagtttcattctcctgcct

SEQ ID NO: 141347 - DNA, 19 bp, Homo sapiens
ctgataaaaccatgtagaa

SEQ ID NO: 141348 - DNA, 13 bp, Homo sapiens
ctgatcagtctaa

SEQ ID NO: 141349 - DNA, 13 bp, Homo sapiens
ctgatccctctac

SEQ ID NO: 141350 - DNA, 15 bp, Homo sapiens
ctgatccctctacag

SEQ ID NO: 141351 - DNA, 22 bp, Homo sapiens
ctgatggcacttagctatcaga

SEQ ID NO: 141352 - DNA, 13 bp, Homo sapiens
ctgatgttcctag

SEQ ID NO: 141353 - DNA, 18 bp, Homo sapiens
ctgatgttcctagtgaaa

SEQ ID NO: 141354 - DNA, 12 bp, Homo sapiens
ctgcaaaatgag

SEQ ID NO: 141355 - DNA, 19 bp, Homo sapiens
ctgcaaaatgaggaatgta

SEQ ID NO: 141356 - DNA, 21 bp, Homo sapiens
ctgcaaaatgaggaatgtata

SEQ ID NO: 141357 - DNA, 19 bp, Homo sapiens
ctgcaacttgtaaatgtgg

SEQ ID NO: 141358 - DNA, 20 bp, Homo sapiens
ctgcaagaattgaagcagga

SEQ ID NO: 141359 - DNA, 23 bp, Homo sapiens
ctgcaagagccttggtgtccacc

SEQ ID NO: 141360 - DNA, 17 bp, Homo sapiens
ctgcaagggctccccac

SEQ ID NO: 141361 - DNA, 18 bp, Homo sapiens
ctgcaatttcatatgctg

SEQ ID NO: 141362 - DNA, 20 bp, Homo sapiens
ctgcaatttcatatgctgta

SEQ ID NO: 141363 - DNA, 13 bp, Homo sapiens
ctgcacaaagccc

SEQ ID NO: 141364 - DNA, 15 bp, Homo sapiens
ctgcacaagctgcac

SEQ ID NO: 141365 - DNA, 22 bp, Homo sapiens
ctgcacaagctgcaccctcagg

SEQ ID NO: 141366 - DNA, 19 bp, Homo sapiens
ctgcacagcggcccctgca

SEQ ID NO: 141367 - DNA, 21 bp, Homo sapiens
ctgcacagtgcatctcagccc

SEQ ID NO: 141368 - DNA, 16 bp, Homo sapiens
ctgcacccccctgggc

SEQ ID NO: 141369 - DNA, 13 bp, Homo sapiens
ctgcaccctcagg

SEQ ID NO: 141370 - DNA, 16 bp, Homo sapiens
ctgcaccctcaggcag

SEQ ID NO: 141371 - DNA, 17 bp, Homo sapiens
ctgcactccagcctgag

SEQ ID NO: 141372 - DNA, 21 bp, Homo sapiens
ctgcagaacgtattggtccag

SEQ ID NO: 141373 - DNA, 23 bp, Homo sapiens
ctgcagaacgtattggtccagct

SEQ ID NO: 141374 - DNA, 13 bp, Homo sapiens
ctgcagaaggaaa

SEQ ID NO: 141375 - DNA, 20 bp, Homo sapiens
ctgcagaaggaaaaatgtgt

SEQ ID NO: 141376 - DNA, 20 bp, Homo sapiens
ctgcagcctttgcctccccg

SEQ ID NO: 141377 - DNA, 14 bp, Homo sapiens
ctgcaggacctgcc

SEQ ID NO: 141378 - DNA, 16 bp, Homo sapiens
ctgcaggacctgcctg

SEQ ID NO: 141379 - DNA, 18 bp, Homo sapiens
ctgcaggacctgcctgta

SEQ ID NO: 141380 - DNA, 22 bp, Homo sapiens
ctgcaggacctgcctgtagccc

SEQ ID NO: 141381 - DNA, 20 bp, Homo sapiens
ctgcaggccccgcttgtcca

SEQ ID NO: 141382 - DNA, 12 bp, Homo sapiens
ctgcagggaaaa

SEQ ID NO: 141383 - DNA, 13 bp, Homo sapiens
ctgcagggccagg

SEQ ID NO: 141384 - DNA, 12 bp, Homo sapiens
ctgcaggggctc

SEQ ID NO: 141385 - DNA, 17 bp, Homo sapiens
ctgcaggggctctggag

SEQ ID NO: 141386 - DNA, 18 bp, Homo sapiens
ctgcaggggctctggaga

SEQ ID NO: 141387 - DNA, 17 bp, Homo sapiens
ctgcaggtgctgctgcg

SEQ ID NO: 141388 - DNA, 21 bp, Homo sapiens
ctgcatagtattccattgtgt

SEQ ID NO: 141389 - DNA, 20 bp, Homo sapiens
ctgcatcagctgctgaaaca

SEQ ID NO: 141390 - DNA, 20 bp, Homo sapiens
ctgcatccgtagttccctga

SEQ ID NO: 141391 - DNA, 16 bp, Homo sapiens
ctgcatcgtttcatct

SEQ ID NO: 141392 - DNA, 20 bp, Homo sapiens
ctgcattcacccagacagct

SEQ ID NO: 141393 - DNA, 20 bp, Homo sapiens
ctgcattcaggatcaaaccc

SEQ ID NO: 141394 - DNA, 13 bp, Homo sapiens
ctgcattggcttt

SEQ ID NO: 141395 - DNA, 15 bp, Homo sapiens
ctgcatttgtgaaat

SEQ ID NO: 141396 - DNA, 17 bp, Homo sapiens
ctgcattttcaccccac

SEQ ID NO: 141397 - DNA, 16 bp, Homo sapiens
ctgccaaaggatgtga

SEQ ID NO: 141398 - DNA, 19 bp, Homo sapiens
ctgccaaaggatgtgatat

SEQ ID NO: 141399 - DNA, 22 bp, Homo sapiens
ctgccaccagagaccgtcctca

SEQ ID NO: 141400 - DNA, 11 bp, Homo sapiens
ctgccacctcc

SEQ ID NO: 141401 - DNA, 12 bp, Homo sapiens
ctgccacctccc

SEQ ID NO: 141402 - DNA, 14 bp, Homo sapiens
ctgccacctcccct

SEQ ID NO: 141403 - DNA, 12 bp, Homo sapiens
ctgccagccagc

SEQ ID NO: 141404 - DNA, 18 bp, Homo sapiens
ctgccagccagcagccag

SEQ ID NO: 141405 - DNA, 20 bp, Homo sapiens
ctgccagccagcagccagct

SEQ ID NO: 141406 - DNA, 17 bp, Homo sapiens
ctgccagctctgtatca

SEQ ID NO: 141407 - DNA, 16 bp, Homo sapiens
ctgccagggcagggcc

SEQ ID NO: 141408 - DNA, 21 bp, Homo sapiens
ctgccagtccccctgccccag

SEQ ID NO: 141409 - DNA, 12 bp, Homo sapiens
ctgccagtgaca

SEQ ID NO: 141410 - DNA, 21 bp, Homo sapiens
ctgccagtgacagacaggctc

SEQ ID NO: 141411 - DNA, 23 bp, Homo sapiens
ctgccagtgacagacaggctctt

SEQ ID NO: 141412 - DNA, 13 bp, Homo sapiens
ctgccagtgcctt

SEQ ID NO: 141413 - DNA, 20 bp, Homo sapiens
ctgccagtgccttacctcct

SEQ ID NO: 141414 - DNA, 13 bp, Homo sapiens
ctgccataaaaca

SEQ ID NO: 141415 - DNA, 23 bp, Homo sapiens
ctgccataaaacattaagaaaat

SEQ ID NO: 141416 - DNA, 19 bp, Homo sapiens
ctgccatgccagcttatct

SEQ ID NO: 141417 - DNA, 21 bp, Homo sapiens
ctgccatggaggcacacagct

SEQ ID NO: 141418 - DNA, 15 bp, Homo sapiens
ctgccatttctgaga

SEQ ID NO: 141419 - DNA, 16 bp, Homo sapiens
ctgccatttctgagat

SEQ ID NO: 141420 - DNA, 21 bp, Homo sapiens
ctgcccaggagagccagccct

SEQ ID NO: 141421 - DNA, 21 bp, Homo sapiens
ctgccccaaacaaatatgcaa

SEQ ID NO: 141422 - DNA, 17 bp, Homo sapiens
ctgccccaactcctgga

SEQ ID NO: 141423 - DNA, 14 bp, Homo sapiens
ctgccccaggcctg

SEQ ID NO: 141424 - DNA, 15 bp, Homo sapiens
ctgcccccaaataag

SEQ ID NO: 141425 - DNA, 22 bp, Homo sapiens
ctgcccccaaataagaagggat

SEQ ID NO: 141426 - DNA, 12 bp, Homo sapiens
ctgcccccacga

SEQ ID NO: 141427 - DNA, 21 bp, Homo sapiens
ctgcccccacgagggtcagga

SEQ ID NO: 141428 - DNA, 13 bp, Homo sapiens
ctgcccctcccag

SEQ ID NO: 141429 - DNA, 15 bp, Homo sapiens
ctgcccctcccagaa

SEQ ID NO: 141430 - DNA, 18 bp, Homo sapiens
ctgcccgtaaacacgcct

SEQ ID NO: 141431 - DNA, 16 bp, Homo sapiens
ctgcccgtcttcagcc

SEQ ID NO: 141432 - DNA, 18 bp, Homo sapiens
ctgcccgtcttcagccta

SEQ ID NO: 141433 - DNA, 19 bp, Homo sapiens
ctgccctagagcacactgt

SEQ ID NO: 141434 - DNA, 15 bp, Homo sapiens
ctgccctagctccac

SEQ ID NO: 141435 - DNA, 12 bp, Homo sapiens
ctgccctaggct

SEQ ID NO: 141436 - DNA, 18 bp, Homo sapiens
ctgccctgccctagctcc

SEQ ID NO: 141437 - DNA, 24 bp, Homo sapiens
ctgccctgggatgtccacagatgc

SEQ ID NO: 141438 - DNA, 18 bp, Homo sapiens
ctgccctggtgctgccac

SEQ ID NO: 141439 - DNA, 20 bp, Homo sapiens
ctgccctggtgctgccacac

SEQ ID NO: 141440 - DNA, 15 bp, Homo sapiens
ctgccgacctcgtcc

SEQ ID NO: 141441 - DNA, 19 bp, Homo sapiens
ctgccgacctcgtcctccc

SEQ ID NO: 141442 - DNA, 17 bp, Homo sapiens
ctgccgcaacagttttt

SEQ ID NO: 141443 - DNA, 14 bp, Homo sapiens
ctgccgcctcccag

SEQ ID NO: 141444 - DNA, 16 bp, Homo sapiens
ctgccggccctggggc

SEQ ID NO: 141445 - DNA, 21 bp, Homo sapiens
ctgccggccctggggctaggc

SEQ ID NO: 141446 - DNA, 21 bp, Homo sapiens
ctgcctcaatgtgaatcagac

SEQ ID NO: 141447 - DNA, 14 bp, Homo sapiens
ctgcctccagaatg

SEQ ID NO: 141448 - DNA, 22 bp, Homo sapiens
ctgcctccagaatggtctttct

SEQ ID NO: 141449 - DNA, 13 bp, Homo sapiens
ctgcctcctcttc

SEQ ID NO: 141450 - DNA, 17 bp, Homo sapiens
ctgcctctccctggccc

SEQ ID NO: 141451 - DNA, 17 bp, Homo sapiens
ctgcctgaaccttccat

SEQ ID NO: 141452 - DNA, 20 bp, Homo sapiens
ctgcctgacatttggagtgt

SEQ ID NO: 141453 - DNA, 23 bp, Homo sapiens
ctgcctgacatttggagtgttcc

SEQ ID NO: 141454 - DNA, 12 bp, Homo sapiens
ctgcctgcccac

SEQ ID NO: 141455 - DNA, 23 bp, Homo sapiens
ctgcctgccggtaaacacgcctg

SEQ ID NO: 141456 - DNA, 15 bp, Homo sapiens
cttgagacctcagcc

SEQ ID NO: 141457 - DNA, 14 bp, Homo sapiens
cttgagagggtgga

SEQ ID NO: 141458 - DNA, 13 bp, Homo sapiens
cttgagcagtggc

SEQ ID NO: 141459 - DNA, 21 bp, Homo sapiens
cttgagcagtggctggtccag

SEQ ID NO: 141460 - DNA, 16 bp, Homo sapiens
cttgagccagtaattg

SEQ ID NO: 141461 - DNA, 18 bp, Homo sapiens
cttgagggcccagagcag

SEQ ID NO: 141462 - DNA, 20 bp, Homo sapiens
cttgatctgtatatacaata

SEQ ID NO: 141463 - DNA, 22 bp, Homo sapiens
cttgcacactcccctgcactgg

SEQ ID NO: 141464 - DNA, 23 bp, Homo sapiens
cttgcacactcccctgcactgga

SEQ ID NO: 141465 - DNA, 22 bp, Homo sapiens
cttgcaccccaaagctttcctg

SEQ ID NO: 141466 - DNA, 18 bp, Homo sapiens
cttgcacccctcactctg

SEQ ID NO: 141467 - DNA, 20 bp, Homo sapiens
cttgcacccctcactctggc

SEQ ID NO: 141468 - DNA, 12 bp, Homo sapiens
cttgcacctgca

SEQ ID NO: 141469 - DNA, 13 bp, Homo sapiens
cttgcacctgcat

SEQ ID NO: 141470 - DNA, 19 bp, Homo sapiens
cttgcacgcccatgtgtga

SEQ ID NO: 141471 - DNA, 16 bp, Homo sapiens
cttgccagacatgtgg

SEQ ID NO: 141472 - DNA, 13 bp, Homo sapiens
cttgcccagagat

SEQ ID NO: 141473 - DNA, 14 bp, Homo sapiens
cttgcccagggctc

SEQ ID NO: 141474 - DNA, 21 bp, Homo sapiens
cttgcccagggctcagcctgg

SEQ ID NO: 141475 - DNA, 23 bp, Homo sapiens
cttgcccagggctcagcctggtg

SEQ ID NO: 141476 - DNA, 14 bp, Homo sapiens
cttgccctgttaaa

SEQ ID NO: 141477 - DNA, 15 bp, Homo sapiens
cttgcctcaatgcca

SEQ ID NO: 141478 - DNA, 18 bp, Homo sapiens
cttgcctcaatgccagta

SEQ ID NO: 141479 - DNA, 19 bp, Homo sapiens
cttgcgcttttgctggtca

SEQ ID NO: 141480 - DNA, 21 bp, Homo sapiens
cttgctgcagtatgaaaataa

SEQ ID NO: 141481 - DNA, 16 bp, Homo sapiens
cttggactcattttaa

SEQ ID NO: 141482 - DNA, 21 bp, Homo sapiens
cttggagccccagtgccaagc

SEQ ID NO: 141483 - DNA, 15 bp, Homo sapiens
cttggaggccagcca

SEQ ID NO: 141484 - DNA, 20 bp, Homo sapiens
cttggcaacagaagcagttg

SEQ ID NO: 141485 - DNA, 20 bp, Homo sapiens
cttggcagcacctgtctcct

SEQ ID NO: 141486 - DNA, 20 bp, Homo sapiens
cttggcatgccttccagcac

SEQ ID NO: 141487 - DNA, 20 bp, Homo sapiens
cttggctgttggcagtgagt

SEQ ID NO: 141488 - DNA, 15 bp, Homo sapiens
cttgggaggccccac

SEQ ID NO: 141489 - DNA, 19 bp, Homo sapiens
cttgggaggccccactggg

SEQ ID NO: 141490 - DNA, 17 bp, Homo sapiens
cttgggccctttgagtg

SEQ ID NO: 141491 - DNA, 19 bp, Homo sapiens
cttgggcttccatttgtgt

SEQ ID NO: 141492 - DNA, 14 bp, Homo sapiens
cttggggcaggcag

SEQ ID NO: 141493 - DNA, 23 bp, Homo sapiens
cttggggggctgaggtgggagga

SEQ ID NO: 141494 - DNA, 15 bp, Homo sapiens
cttgggtaggcggga

SEQ ID NO: 141495 - DNA, 15 bp, Homo sapiens
cttggtcttatttat

SEQ ID NO: 141496 - DNA, 20 bp, Homo sapiens
cttggtgtcctttccctcca

SEQ ID NO: 141497 - DNA, 14 bp, Homo sapiens
cttggttgaggaaa

SEQ ID NO: 141498 - DNA, 15 bp, Homo sapiens
cttggttgaggaaac

SEQ ID NO: 141499 - DNA, 16 bp, Homo sapiens
cttgtaattctaaatg

SEQ ID NO: 141500 - DNA, 17 bp, Homo sapiens
cttgtatatcttgtttt

SEQ ID NO: 141501 - DNA, 18 bp, Homo sapiens
cttgtcccactcaagcca

SEQ ID NO: 141502 - DNA, 21 bp, Homo sapiens
cttgtcccactcaagccaagc

SEQ ID NO: 141503 - DNA, 16 bp, Homo sapiens
cttgtgtcaaacagta

SEQ ID NO: 141504 - DNA, 16 bp, Homo sapiens
cttgttaagatagtta

SEQ ID NO: 141505 - DNA, 14 bp, Homo sapiens
cttgttccctctcc

SEQ ID NO: 141506 - DNA, 19 bp, Homo sapiens
cttgttgcatgatgtattt

SEQ ID NO: 141507 - DNA, 20 bp, Homo sapiens
cttgtttgattttagctgca

SEQ ID NO: 141508 - DNA, 19 bp, Homo sapiens
cttgtttgctcacctgggg

SEQ ID NO: 141509 - DNA, 13 bp, Homo sapiens
ctttaaactcagg

SEQ ID NO: 141510 - DNA, 15 bp, Homo sapiens
ctttaaactcaggga

SEQ ID NO: 141511 - DNA, 22 bp, Homo sapiens
ctttaaactcagggacagagcc

SEQ ID NO: 141512 - DNA, 20 bp, Homo sapiens
ctttaaagggatggcaagat

SEQ ID NO: 141513 - DNA, 19 bp, Homo sapiens
ctttaacttaattgctatg

SEQ ID NO: 141514 - DNA, 17 bp, Homo sapiens
ctttaattctcatgtga

SEQ ID NO: 141515 - DNA, 22 bp, Homo sapiens
ctgcatccccttggctgtgagg

SEQ ID NO: 141516 - DNA, 21 bp, Homo sapiens
ctgcatgtaaacacgcctgca

SEQ ID NO: 141517 - DNA, 23 bp, Homo sapiens
ctgcattaccgcgttgtaaaata

SEQ ID NO: 141518 - DNA, 13 bp, Homo sapiens
ctgcatttctgag

SEQ ID NO: 141519 - DNA, 14 bp, Homo sapiens
ctgcatttctgagt

SEQ ID NO: 141520 - DNA, 17 bp, Homo sapiens
ctgcatttgtgaaatga

SEQ ID NO: 141521 - DNA, 22 bp, Homo sapiens
ctgcatttgtgaaatgatggtg

SEQ ID NO: 141522 - DNA, 21 bp, Homo sapiens
ctgccaaagggaaatatcatt

SEQ ID NO: 141523 - DNA, 23 bp, Homo sapiens
ctgccacagcctcccctgccagg

SEQ ID NO: 141524 - DNA, 15 bp, Homo sapiens
ctgccaccagagacc

SEQ ID NO: 141525 - DNA, 21 bp, Homo sapiens
ctgccaccagagaccgtcctc

SEQ ID NO: 141526 - DNA, 16 bp, Homo sapiens
ctgccagccagcagcc

SEQ ID NO: 141527 - DNA, 23 bp, Homo sapiens
ctgccagccagcagccagctctc

SEQ ID NO: 141528 - DNA, 13 bp, Homo sapiens
ctgccaggcatgg

SEQ ID NO: 141529 - DNA, 18 bp, Homo sapiens
ctgccaggcccccaagcc

SEQ ID NO: 141530 - DNA, 22 bp, Homo sapiens
ctgccaggcccccaagcctgca

SEQ ID NO: 141531 - DNA, 13 bp, Homo sapiens
ctgccagggcagg

SEQ ID NO: 141532 - DNA, 16 bp, Homo sapiens
ctgccagtgacagaca

SEQ ID NO: 141533 - DNA, 17 bp, Homo sapiens
ctgccagtgccttacct

SEQ ID NO: 141534 - DNA, 18 bp, Homo sapiens
ctgccagtgccttacctc

SEQ ID NO: 141535 - DNA, 21 bp, Homo sapiens
ctgccagtgccttacctcctg

SEQ ID NO: 141536 - DNA, 22 bp, Homo sapiens
ctgccagtgccttacctcctgc

SEQ ID NO: 141537 - DNA, 23 bp, Homo sapiens
ctgccagtgccttacctcctgcc

SEQ ID NO: 141538 - DNA, 22 bp, Homo sapiens
ctgccataaaacattaagaaaa

SEQ ID NO: 141539 - DNA, 14 bp, Homo sapiens
ctgccatgccagct

SEQ ID NO: 141540 - DNA, 15 bp, Homo sapiens
ctgccatgccagctt

SEQ ID NO: 141541 - DNA, 17 bp, Homo sapiens
ctgccatgccagcttat

SEQ ID NO: 141542 - DNA, 20 bp, Homo sapiens
ctgccatggaggcacacagc

SEQ ID NO: 141543 - DNA, 12 bp, Homo sapiens
ctgcccacctgt

SEQ ID NO: 141544 - DNA, 18 bp, Homo sapiens
ctgcccagatcccagaag

SEQ ID NO: 141545 - DNA, 17 bp, Homo sapiens
ctgcccaggagagccag

SEQ ID NO: 141546 - DNA, 23 bp, Homo sapiens
ctgcccaggagagccagccctcc

SEQ ID NO: 141547 - DNA, 17 bp, Homo sapiens
ctgcccaggcctgcctg

SEQ ID NO: 141548 - DNA, 19 bp, Homo sapiens
ctgcccaggcctgcctgtt

SEQ ID NO: 141549 - DNA, 18 bp, Homo sapiens
ctgcccatctgggaaaat

SEQ ID NO: 141550 - DNA, 20 bp, Homo sapiens
ctgcccatctgggaaaatac

SEQ ID NO: 141551 - DNA, 15 bp, Homo sapiens
ctgccccaaacaaat

SEQ ID NO: 141552 - DNA, 16 bp, Homo sapiens
ctgccccaactcctgg

SEQ ID NO: 141553 - DNA, 13 bp, Homo sapiens
ctgccccaggcct

SEQ ID NO: 141554 - DNA, 15 bp, Homo sapiens
ctgccccaggcctga

SEQ ID NO: 141555 - DNA, 14 bp, Homo sapiens
ctgcccccaaataa

SEQ ID NO: 141556 - DNA, 23 bp, Homo sapiens
ctgcccccagctcttctccccag

SEQ ID NO: 141557 - DNA, 22 bp, Homo sapiens
ctgccccgtgcagactggaggg

SEQ ID NO: 141558 - DNA, 16 bp, Homo sapiens
ctgcccctcccagaac

SEQ ID NO: 141559 - DNA, 17 bp, Homo sapiens
ctgcccctcccttcaac

SEQ ID NO: 141560 - DNA, 16 bp, Homo sapiens
ctgcccctggctctga

SEQ ID NO: 141561 - DNA, 21 bp, Homo sapiens
ctgcccgtaaacacgcctgca

SEQ ID NO: 141562 - DNA, 21 bp, Homo sapiens
ctgccctagagcacactgtag

SEQ ID NO: 141563 - DNA, 11 bp, Homo sapiens
ctgccctgccc

SEQ ID NO: 141564 - DNA, 22 bp, Homo sapiens
ctgccctgctgccgcctcccag

SEQ ID NO: 141565 - DNA, 11 bp, Homo sapiens
ctgccctggga

SEQ ID NO: 141566 - DNA, 13 bp, Homo sapiens
ctgccctggtgct

SEQ ID NO: 141567 - DNA, 14 bp, Homo sapiens
ctgccctggtgctg

SEQ ID NO: 141568 - DNA, 15 bp, Homo sapiens
ctgccctggtgctgc

SEQ ID NO: 141569 - DNA, 17 bp, Homo sapiens
ctgcccttgtcccactc

SEQ ID NO: 141570 - DNA, 18 bp, Homo sapiens
ctgcccttgtcccactca

SEQ ID NO: 141571 - DNA, 15 bp, Homo sapiens
ctgccgcctcccagc

SEQ ID NO: 141572 - DNA, 15 bp, Homo sapiens
ctgcctaagtggctg

SEQ ID NO: 141573 - DNA, 18 bp, Homo sapiens
ctgcctaagtggctgctg

SEQ ID NO: 141574 - DNA, 19 bp, Homo sapiens
ctgcctaagtggctgctga

SEQ ID NO: 141575 - DNA, 20 bp, Homo sapiens
ctgcctaagtggctgctgac

SEQ ID NO: 141576 - DNA, 13 bp, Homo sapiens
ctgcctactcacg

SEQ ID NO: 141577 - DNA, 14 bp, Homo sapiens
ctgcctactcacga

SEQ ID NO: 141578 - DNA, 14 bp, Homo sapiens
ctgcctactgcatc

SEQ ID NO: 141579 - DNA, 16 bp, Homo sapiens
ctgcctaggctgacct

SEQ ID NO: 141580 - DNA, 12 bp, Homo sapiens
ctgcctcagcct

SEQ ID NO: 141581 - DNA, 16 bp, Homo sapiens
ctgcctcccattctga

SEQ ID NO: 141582 - DNA, 15 bp, Homo sapiens
ctgcctcctcttcaa

SEQ ID NO: 141583 - DNA, 24 bp, Homo sapiens
ctgcctcctcttcaactgaccagc

SEQ ID NO: 141584 - DNA, 14 bp, Homo sapiens
ctgcctctgcctgc

SEQ ID NO: 141585 - DNA, 17 bp, Homo sapiens
ctgcctctgcctgcatt

SEQ ID NO: 141586 - DNA, 19 bp, Homo sapiens
ctgcctcttagacttctgc

SEQ ID NO: 141587 - DNA, 15 bp, Homo sapiens
ctgcctcttctctac

SEQ ID NO: 141588 - DNA, 16 bp, Homo sapiens
ctgcctcttctgggag

SEQ ID NO: 141589 - DNA, 20 bp, Homo sapiens
ctgcctgcagtactttacct

SEQ ID NO: 141590 - DNA, 16 bp, Homo sapiens
ctgcctgcccacacag

SEQ ID NO: 141591 - DNA, 20 bp, Homo sapiens
ctgcctgtagcccactctgc

SEQ ID NO: 141592 - DNA, 13 bp, Homo sapiens
ctgcctgtagtta

SEQ ID NO: 141593 - DNA, 21 bp, Homo sapiens
ctgcctgtagttaggaaataa

SEQ ID NO: 141594 - DNA, 13 bp, Homo sapiens
ctgccttcctcct

SEQ ID NO: 141595 - DNA, 21 bp, Homo sapiens
ctgccttcctcctgggccctc

SEQ ID NO: 141596 - DNA, 24 bp, Homo sapiens
ctgccttcttcggggaactcctgg

SEQ ID NO: 141597 - DNA, 14 bp, Homo sapiens
ctgccttgtgtaca

SEQ ID NO: 141598 - DNA, 14 bp, Homo sapiens
ctgcggaccccagc

SEQ ID NO: 141599 - DNA, 16 bp, Homo sapiens
ctgcggaccccagctg

SEQ ID NO: 141600 - DNA, 20 bp, Homo sapiens
ctgcggaccccagctgtgag

SEQ ID NO: 141601 - DNA, 15 bp, Homo sapiens
ctgcggcctgctgga

SEQ ID NO: 141602 - DNA, 18 bp, Homo sapiens
ctgctaatcttcagggca

SEQ ID NO: 141603 - DNA, 15 bp, Homo sapiens
ctgctacctcactgg

SEQ ID NO: 141604 - DNA, 17 bp, Homo sapiens
ctgctacctcactgggg

SEQ ID NO: 141605 - DNA, 22 bp, Homo sapiens
ctgctagcacttggagccaagg

SEQ ID NO: 141606 - DNA, 14 bp, Homo sapiens
ctgctccagctgtt

SEQ ID NO: 141607 - DNA, 19 bp, Homo sapiens
ctgctccagctgttcagct

SEQ ID NO: 141608 - DNA, 20 bp, Homo sapiens
ctgctccagctgttcagctg

SEQ ID NO: 141609 - DNA, 20 bp, Homo sapiens
ctgctccccagccctggctc

SEQ ID NO: 141610 - DNA, 12 bp, Homo sapiens
ctgctcccccac

SEQ ID NO: 141611 - DNA, 14 bp, Homo sapiens
ctgctcccccaccc

SEQ ID NO: 141612 - DNA, 21 bp, Homo sapiens
ctgctcccccaccccctcccc

SEQ ID NO: 141613 - DNA, 13 bp, Homo sapiens
ctgctcccctccc

SEQ ID NO: 141614 - DNA, 14 bp, Homo sapiens
ctgctccctgaagc

SEQ ID NO: 141615 - DNA, 16 bp, Homo sapiens
ctgctccctgaagcca

SEQ ID NO: 141616 - DNA, 17 bp, Homo sapiens
ctgctccctgaagccag

SEQ ID NO: 141617 - DNA, 22 bp, Homo sapiens
ctgctccctgaagccagccttc

SEQ ID NO: 141618 - DNA, 14 bp, Homo sapiens
ctgctcctccaggg

SEQ ID NO: 141619 - DNA, 24 bp, Homo sapiens
ctgctcctccagggccacgtgcca

SEQ ID NO: 141620 - DNA, 20 bp, Homo sapiens
ctgctctgcgtgtcacctgt

SEQ ID NO: 141621 - DNA, 19 bp, Homo sapiens
ctgctctttctctgccagt

SEQ ID NO: 141622 - DNA, 22 bp, Homo sapiens
ctgctctttctctgccagtgac

SEQ ID NO: 141623 - DNA, 17 bp, Homo sapiens
ctgctgaaggaataaat

SEQ ID NO: 141624 - DNA, 18 bp, Homo sapiens
ctgctgactgttttctct

SEQ ID NO: 141625 - DNA, 18 bp, Homo sapiens
ctgctgagggaccagcca

SEQ ID NO: 141626 - DNA, 14 bp, Homo sapiens
ctgctgcaggggct

SEQ ID NO: 141627 - DNA, 18 bp, Homo sapiens
ctgctgcaggggctctgg

SEQ ID NO: 141628 - DNA, 19 bp, Homo sapiens
ctgctgcaggggctctgga

SEQ ID NO: 141629 - DNA, 12 bp, Homo sapiens
ctgctgcccagc

SEQ ID NO: 141630 - DNA, 11 bp, Homo sapiens
ctgctggagga

SEQ ID NO: 141631 - DNA, 15 bp, Homo sapiens
ctgctggcccagcca

SEQ ID NO: 141632 - DNA, 16 bp, Homo sapiens
ctgctggcccagccaa

SEQ ID NO: 141633 - DNA, 15 bp, Homo sapiens
ctgctggccggagca

SEQ ID NO: 141634 - DNA, 16 bp, Homo sapiens
ctgctggccggagcaa

SEQ ID NO: 141635 - DNA, 21 bp, Homo sapiens
ctgctgggctctccacctcag

SEQ ID NO: 141636 - DNA, 18 bp, Homo sapiens
ctgctggtgcagagctga

SEQ ID NO: 141637 - DNA, 12 bp, Homo sapiens
ctgcttcagtgg

SEQ ID NO: 141638 - DNA, 16 bp, Homo sapiens
ctgcttgaggaaaaca

SEQ ID NO: 141639 - DNA, 20 bp, Homo sapiens
ctgcttgaggcaactcatct

SEQ ID NO: 141640 - DNA, 18 bp, Homo sapiens
ctgctttgggctgccctg

SEQ ID NO: 141641 - DNA, 22 bp, Homo sapiens
ctgctttgggctgccctggtgc

SEQ ID NO: 141642 - DNA, 21 bp, Homo sapiens
ctgcttttccttggggcaggc

SEQ ID NO: 141643 - DNA, 12 bp, Homo sapiens
ctggaagagagg

SEQ ID NO: 141644 - DNA, 13 bp, Homo sapiens
ctggaagagagga

SEQ ID NO: 141645 - DNA, 23 bp, Homo sapiens
ctggaagcatgtaggagaatcca

SEQ ID NO: 141646 - DNA, 12 bp, Homo sapiens
ctggaagctgtg

SEQ ID NO: 141647 - DNA, 19 bp, Homo sapiens
ctggaaggggcccgtggga

SEQ ID NO: 141648 - DNA, 21 bp, Homo sapiens
ctggaatgtaatcaatgtttc

SEQ ID NO: 141649 - DNA, 23 bp, Homo sapiens
ctggacatgaagattctttccca

SEQ ID NO: 141650 - DNA, 18 bp, Homo sapiens
ctggacatttgccttgct

SEQ ID NO: 141651 - DNA, 15 bp, Homo sapiens
ctggacggggactgg

SEQ ID NO: 141652 - DNA, 19 bp, Homo sapiens
ctggactcaggatgcccag

SEQ ID NO: 141653 - DNA, 14 bp, Homo sapiens
ctggactcctctgt

SEQ ID NO: 141654 - DNA, 22 bp, Homo sapiens
ctggactcctctgtccaggcac

SEQ ID NO: 141655 - DNA, 14 bp, Homo sapiens
ctggactttcctgc

SEQ ID NO: 141656 - DNA, 16 bp, Homo sapiens
ctggactttcctgcaa

SEQ ID NO: 141657 - DNA, 12 bp, Homo sapiens
ctggagaagaga

SEQ ID NO: 141658 - DNA, 15 bp, Homo sapiens
ctggagaagagagga

SEQ ID NO: 141659 - DNA, 20 bp, Homo sapiens
ctggagaagagaggagagga

SEQ ID NO: 141660 - DNA, 16 bp, Homo sapiens
ctggagacagccccag

SEQ ID NO: 141661 - DNA, 22 bp, Homo sapiens
ctggagacagccccagagcagg

SEQ ID NO: 141662 - DNA, 16 bp, Homo sapiens
ctggaggcagggcctt

SEQ ID NO: 141663 - DNA, 20 bp, Homo sapiens
ctttaattctcatgtgatcc

SEQ ID NO: 141664 - DNA, 16 bp, Homo sapiens
ctttaccttttttctt

SEQ ID NO: 141665 - DNA, 19 bp, Homo sapiens
ctttagagaagtatacata

SEQ ID NO: 141666 - DNA, 22 bp, Homo sapiens
ctttagagaagtatacataagt

SEQ ID NO: 141667 - DNA, 15 bp, Homo sapiens
ctttagtcgctgagg

SEQ ID NO: 141668 - DNA, 14 bp, Homo sapiens
ctttagtctgcaaa

SEQ ID NO: 141669 - DNA, 19 bp, Homo sapiens
ctttataattctactttga

SEQ ID NO: 141670 - DNA, 22 bp, Homo sapiens
ctttatgaatgaaaaaacagtc

SEQ ID NO: 141671 - DNA, 13 bp, Homo sapiens
ctttattaaaatc

SEQ ID NO: 141672 - DNA, 18 bp, Homo sapiens
ctttattaaaatcttaaa

SEQ ID NO: 141673 - DNA, 13 bp, Homo sapiens
ctttattgagaaa

SEQ ID NO: 141674 - DNA, 16 bp, Homo sapiens
ctttattgagaaagag

SEQ ID NO: 141675 - DNA, 18 bp, Homo sapiens
ctttattttttaagtatt

SEQ ID NO: 141676 - DNA, 22 bp, Homo sapiens
ctttattttttaagtatttata

SEQ ID NO: 141677 - DNA, 23 bp, Homo sapiens
ctttattttttaagtatttatat

SEQ ID NO: 141678 - DNA, 15 bp, Homo sapiens
ctttcaaatttcaca

SEQ ID NO: 141679 - DNA, 14 bp, Homo sapiens
ctttcacaaccttc

SEQ ID NO: 141680 - DNA, 16 bp, Homo sapiens
ctttcacaaccttctg

SEQ ID NO: 141681 - DNA, 19 bp, Homo sapiens
ctttcacacttccaccagc

SEQ ID NO: 141682 - DNA, 22 bp, Homo sapiens
ctttcaccccagggcctgagcc

SEQ ID NO: 141683 - DNA, 17 bp, Homo sapiens
ctttcatactgaagatg

SEQ ID NO: 141684 - DNA, 16 bp, Homo sapiens
ctttccaaatgcccag

SEQ ID NO: 141685 - DNA, 15 bp, Homo sapiens
ctttccccagcccag

SEQ ID NO: 141686 - DNA, 16 bp, Homo sapiens
ctttccttccttccct

SEQ ID NO: 141687 - DNA, 23 bp, Homo sapiens
ctttctagctgttgagctgtttt

SEQ ID NO: 141688 - DNA, 19 bp, Homo sapiens
ctttctcccaggccaggct

SEQ ID NO: 141689 - DNA, 20 bp, Homo sapiens
ctttctcccaggccaggctc

SEQ ID NO: 141690 - DNA, 12 bp, Homo sapiens
ctttctgtgtgc

SEQ ID NO: 141691 - DNA, 17 bp, Homo sapiens
ctttctttctaactcca

SEQ ID NO: 141692 - DNA, 22 bp, Homo sapiens
ctttcttttctggaatgtaatc

SEQ ID NO: 141693 - DNA, 22 bp, Homo sapiens
ctttgaagaggaaaatgaataa

SEQ ID NO: 141694 - DNA, 21 bp, Homo sapiens
ctttgagtgtcttaattaaaa

SEQ ID NO: 141695 - DNA, 13 bp, Homo sapiens
ctttgcaggctca

SEQ ID NO: 141696 - DNA, 21 bp, Homo sapiens
ctttgggctgccctggtgctg

SEQ ID NO: 141697 - DNA, 12 bp, Homo sapiens
ctttgtatgcac

SEQ ID NO: 141698 - DNA, 18 bp, Homo sapiens
ctttgtcatctttcttct

SEQ ID NO: 141699 - DNA, 21 bp, Homo sapiens
ctttgtttttttttcctgtcc

SEQ ID NO: 141700 - DNA, 14 bp, Homo sapiens
cttttaaaagacaa

SEQ ID NO: 141701 - DNA, 20 bp, Homo sapiens
cttttagttgtatctctttt

SEQ ID NO: 141702 - DNA, 22 bp, Homo sapiens
cttttataactagtcctttact

SEQ ID NO: 141703 - DNA, 19 bp, Homo sapiens
cttttatagctattactgt

SEQ ID NO: 141704 - DNA, 17 bp, Homo sapiens
cttttatccacttacct

SEQ ID NO: 141705 - DNA, 19 bp, Homo sapiens
cttttattgtataaactat

SEQ ID NO: 141706 - DNA, 16 bp, Homo sapiens
cttttcactgctggct

SEQ ID NO: 141707 - DNA, 14 bp, Homo sapiens
cttttcccttcttt

SEQ ID NO: 141708 - DNA, 17 bp, Homo sapiens
cttttccttggggcagg

SEQ ID NO: 141709 - DNA, 21 bp, Homo sapiens
cttttccttggggcaggcagt

SEQ ID NO: 141710 - DNA, 17 bp, Homo sapiens
cttttctctggtaatat

SEQ ID NO: 141711 - DNA, 20 bp, Homo sapiens
cttttgaatccatgcttggg

SEQ ID NO: 141712 - DNA, 21 bp, Homo sapiens
cttttgcccttcacagtgttt

SEQ ID NO: 141713 - DNA, 13 bp, Homo sapiens
cttttgtaaatgt

SEQ ID NO: 141714 - DNA, 13 bp, Homo sapiens
cttttgtatgtaa

SEQ ID NO: 141715 - DNA, 16 bp, Homo sapiens
cttttgtatgtaaatg

SEQ ID NO: 141716 - DNA, 22 bp, Homo sapiens
cttttgttcagggctgtgatcg

SEQ ID NO: 141717 - DNA, 20 bp, Homo sapiens
ctttttaataaaaaggcacc

SEQ ID NO: 141718 - DNA, 22 bp, Homo sapiens
ctttttgaagtgtaggcagaca

SEQ ID NO: 141719 - DNA, 17 bp, Homo sapiens
ctttttggtttgcagat

SEQ ID NO: 141720 - DNA, 23 bp, Homo sapiens
cttttttatgtgccgtgttattg

SEQ ID NO: 141721 - DNA, 20 bp, Homo sapiens
cttttttgaaataataaatc

SEQ ID NO: 141722 - DNA, 21 bp, Homo sapiens
cttttttttcccccctagaaa

SEQ ID NO: 141723 - DNA, 19 bp, Homo sapiens
gaaaaaaaagtttcagaga

SEQ ID NO: 141724 - DNA, 13 bp, Homo sapiens
gaaaaaaatgact

SEQ ID NO: 141725 - DNA, 17 bp, Homo sapiens
gaaaaaataacacacat

SEQ ID NO: 141726 - DNA, 15 bp, Homo sapiens
gaaaaaggaggaaga

SEQ ID NO: 141727 - DNA, 16 bp, Homo sapiens
gaaaaatctaagtgat

SEQ ID NO: 141728 - DNA, 19 bp, Homo sapiens
gaaaacatcactgaaatgc

SEQ ID NO: 141729 - DNA, 23 bp, Homo sapiens
gaaaagaaaaatgagcctggcaa

SEQ ID NO: 141730 - DNA, 18 bp, Homo sapiens
gaaaagaatacagaaaga

SEQ ID NO: 141731 - DNA, 19 bp, Homo sapiens
gaaaagaatacagaaagat

SEQ ID NO: 141732 - DNA, 14 bp, Homo sapiens
gaaaagactccaaa

SEQ ID NO: 141733 - DNA, 17 bp, Homo sapiens
gaaaagactccaaagaa

SEQ ID NO: 141734 - DNA, 19 bp, Homo sapiens
gaaaagggaagttgtgcct

SEQ ID NO: 141735 - DNA, 12 bp, Homo sapiens
gaaaatatgcat

SEQ ID NO: 141736 - DNA, 21 bp, Homo sapiens
gaaaatattttgtctaaaatg

SEQ ID NO: 141737 - DNA, 20 bp, Homo sapiens
gaaaatctaatattaaaaat

SEQ ID NO: 141738 - DNA, 15 bp, Homo sapiens
gcagcagtgtgaggc

SEQ ID NO: 141739 - DNA, 21 bp, Homo sapiens
gcagcatcttcaaacatgtac

SEQ ID NO: 141740 - DNA, 13 bp, Homo sapiens
gcagccagcccag

SEQ ID NO: 141741 - DNA, 15 bp, Homo sapiens
gcagccagcccagcc

SEQ ID NO: 141742 - DNA, 13 bp, Homo sapiens
gcagccagctctc

SEQ ID NO: 141743 - DNA, 15 bp, Homo sapiens
gcagccagctctcag

SEQ ID NO: 141744 - DNA, 20 bp, Homo sapiens
gcagccccgtggggttcctc

SEQ ID NO: 141745 - DNA, 17 bp, Homo sapiens
gcagccgctgagcgagg

SEQ ID NO: 141746 - DNA, 14 bp, Homo sapiens
gcagccgtgccttc

SEQ ID NO: 141747 - DNA, 15 bp, Homo sapiens
gcagccgtgccttca

SEQ ID NO: 141748 - DNA, 18 bp, Homo sapiens
gcagccgtgccttcagct

SEQ ID NO: 141749 - DNA, 14 bp, Homo sapiens
gcagcctggaccct

SEQ ID NO: 141750 - DNA, 12 bp, Homo sapiens
gcagcctggagg

SEQ ID NO: 141751 - DNA, 12 bp, Homo sapiens
gcagcttccaga

SEQ ID NO: 141752 - DNA, 17 bp, Homo sapiens
gcagctttaaactcagg

SEQ ID NO: 141753 - DNA, 21 bp, Homo sapiens
gcagctttaaactcagggaca

SEQ ID NO: 141754 - DNA, 22 bp, Homo sapiens
gcagctttaaactcagggacag

SEQ ID NO: 141755 - DNA, 15 bp, Homo sapiens
gcaggaagctgctcc

SEQ ID NO: 141756 - DNA, 16 bp, Homo sapiens
gcaggaagctgctccg

SEQ ID NO: 141757 - DNA, 20 bp, Homo sapiens
gcaggaaggctgagaggaga

SEQ ID NO: 141758 - DNA, 12 bp, Homo sapiens
gcaggacctctg

SEQ ID NO: 141759 - DNA, 15 bp, Homo sapiens
gcaggacctgcctgt

SEQ ID NO: 141760 - DNA, 18 bp, Homo sapiens
gcaggagattgagaagga

SEQ ID NO: 141761 - DNA, 19 bp, Homo sapiens
gcaggagattgagaaggag

SEQ ID NO: 141762 - DNA, 23 bp, Homo sapiens
gcaggaggatcacttgagtccag

SEQ ID NO: 141763 - DNA, 22 bp, Homo sapiens
gcaggatagttgctccgcctct

SEQ ID NO: 141764 - DNA, 10 bp, Homo sapiens
gcaggcagac

SEQ ID NO: 141765 - DNA, 11 bp, Homo sapiens
gcaggcagaca

SEQ ID NO: 141766 - DNA, 12 bp, Homo sapiens
gcaggcagacac

SEQ ID NO: 141767 - DNA, 13 bp, Homo sapiens
gcaggcagggctg

SEQ ID NO: 141768 - DNA, 19 bp, Homo sapiens
gcagggccaggactgagcc

SEQ ID NO: 141769 - DNA, 21 bp, Homo sapiens
gcagggccttgcccagagatg

SEQ ID NO: 141770 - DNA, 23 bp, Homo sapiens
gcagggctaccctgagctgaggc

SEQ ID NO: 141771 - DNA, 19 bp, Homo sapiens
gcaggggctctggagagaa

SEQ ID NO: 141772 - DNA, 21 bp, Homo sapiens
gcaggggctctggagagaaac

SEQ ID NO: 141773 - DNA, 22 bp, Homo sapiens
gcaggggctctggagagaaaca

SEQ ID NO: 141774 - DNA, 15 bp, Homo sapiens
gcagggtcaggagag

SEQ ID NO: 141775 - DNA, 16 bp, Homo sapiens
gcagggtcaggagagg

SEQ ID NO: 141776 - DNA, 15 bp, Homo sapiens
gcagggtgggatgga

SEQ ID NO: 141777 - DNA, 14 bp, Homo sapiens
gcagggtgttggga

SEQ ID NO: 141778 - DNA, 21 bp, Homo sapiens
gcaggtggggagactgggctg

SEQ ID NO: 141779 - DNA, 16 bp, Homo sapiens
gcagtacctataaagt

SEQ ID NO: 141780 - DNA, 17 bp, Homo sapiens
gcagtcctgcctcagcc

SEQ ID NO: 141781 - DNA, 15 bp, Homo sapiens
gcagtctggaggggc

SEQ ID NO: 141782 - DNA, 21 bp, Homo sapiens
gcagtgagaaaaagctcctgt

SEQ ID NO: 141783 - DNA, 22 bp, Homo sapiens
gcagtgagaaaaagctcctgtc

SEQ ID NO: 141784 - DNA, 18 bp, Homo sapiens
gcagtgagtgagcctggc

SEQ ID NO: 141785 - DNA, 19 bp, Homo sapiens
gcagtggctggtccagggc

SEQ ID NO: 141786 - DNA, 15 bp, Homo sapiens
gcagtgtgaggccag

SEQ ID NO: 141787 - DNA, 21 bp, Homo sapiens
gcagtgtgaggccagggcaga

SEQ ID NO: 141788 - DNA, 21 bp, Homo sapiens
gcagtgttccccatctgggtc

SEQ ID NO: 141789 - DNA, 21 bp, Homo sapiens
gcagttgaaaagactccaaag

SEQ ID NO: 141790 - DNA, 22 bp, Homo sapiens
gcagttgaaaagactccaaaga

SEQ ID NO: 141791 - DNA, 20 bp, Homo sapiens
gcatagtaccaatcatttta

SEQ ID NO: 141792 - DNA, 23 bp, Homo sapiens
gcatagtattccattgtgtgagt

SEQ ID NO: 141793 - DNA, 18 bp, Homo sapiens
gcatatccaccacctccc

SEQ ID NO: 141794 - DNA, 22 bp, Homo sapiens
gcatcaccttaggcagggaagt

SEQ ID NO: 141795 - DNA, 12 bp, Homo sapiens
gcatccattcct

SEQ ID NO: 141796 - DNA, 21 bp, Homo sapiens
gcatccattcctcagggacag

SEQ ID NO: 141797 - DNA, 20 bp, Homo sapiens
gcatccccttggctgtgagg

SEQ ID NO: 141798 - DNA, 21 bp, Homo sapiens
gcatccccttggctgtgaggc

SEQ ID NO: 141799 - DNA, 18 bp, Homo sapiens
gcatcctccacaatagca

SEQ ID NO: 141800 - DNA, 13 bp, Homo sapiens
gcatctcagccca

SEQ ID NO: 141801 - DNA, 14 bp, Homo sapiens
gcatctcagcccac

SEQ ID NO: 141802 - DNA, 23 bp, Homo sapiens
gcatctgtataagtaagaaaata

SEQ ID NO: 141803 - DNA, 17 bp, Homo sapiens
gcatgcactgttccccc

SEQ ID NO: 141804 - DNA, 19 bp, Homo sapiens
gcatgccccggccacctct

SEQ ID NO: 141805 - DNA, 20 bp, Homo sapiens
gcatgccccggccacctctg

SEQ ID NO: 141806 - DNA, 23 bp, Homo sapiens
gcatgccccggccacctctgcgg

SEQ ID NO: 141807 - DNA, 21 bp, Homo sapiens
gcatgccttccagcaccctgc

SEQ ID NO: 141808 - DNA, 18 bp, Homo sapiens
gcatgctctctgcagcca

SEQ ID NO: 141809 - DNA, 21 bp, Homo sapiens
gcatgctctctgcagccagcc

SEQ ID NO: 141810 - DNA, 22 bp, Homo sapiens
gcatgctctctgcagccagccc

SEQ ID NO: 141811 - DNA, 13 bp, Homo sapiens
gcatggccaggtg

SEQ ID NO: 141812 - DNA, 14 bp, Homo sapiens
gcatggccaggtgg

SEQ ID NO: 141813 - DNA, 16 bp, Homo sapiens
gcatggccctggggtc

SEQ ID NO: 141814 - DNA, 15 bp, Homo sapiens
gcatgggcactccct

SEQ ID NO: 141815 - DNA, 23 bp, Homo sapiens
gcatgtccctaccgagtctcttc

SEQ ID NO: 141816 - DNA, 11 bp, Homo sapiens
gcatgtgtgtg

SEQ ID NO: 141817 - DNA, 15 bp, Homo sapiens
gcattatataccatt

SEQ ID NO: 141818 - DNA, 13 bp, Homo sapiens
gcattcagagagc

SEQ ID NO: 141819 - DNA, 16 bp, Homo sapiens
gcattcagagagcagc

SEQ ID NO: 141820 - DNA, 14 bp, Homo sapiens
gcattccctgagtc

SEQ ID NO: 141821 - DNA, 21 bp, Homo sapiens
gcattccctgagtcaccagga

SEQ ID NO: 141822 - DNA, 16 bp, Homo sapiens
gcattcctacaaagat

SEQ ID NO: 141823 - DNA, 19 bp, Homo sapiens
gcattcctacaaagatgtt

SEQ ID NO: 141824 - DNA, 13 bp, Homo sapiens
gcattctcactcc

SEQ ID NO: 141825 - DNA, 20 bp, Homo sapiens
gcattctgccgtgtgccctc

SEQ ID NO: 141826 - DNA, 16 bp, Homo sapiens
gcattcttttaaaaga

SEQ ID NO: 141827 - DNA, 16 bp, Homo sapiens
gcattgatggggaagg

SEQ ID NO: 141828 - DNA, 18 bp, Homo sapiens
gcattgatggggaaggag

SEQ ID NO: 141829 - DNA, 14 bp, Homo sapiens
gcattgccaagggc

SEQ ID NO: 141830 - DNA, 16 bp, Homo sapiens
gcattgtaaatgtgct

SEQ ID NO: 141831 - DNA, 19 bp, Homo sapiens
gcattgtggctgtcagcag

SEQ ID NO: 141832 - DNA, 14 bp, Homo sapiens
gcatttgctgaata

SEQ ID NO: 141833 - DNA, 21 bp, Homo sapiens
gcatttttgatttatgcatgg

SEQ ID NO: 141834 - DNA, 23 bp, Homo sapiens
gccaaacaaaaaggttctcaggt

SEQ ID NO: 141835 - DNA, 15 bp, Homo sapiens
gccaaaccctgtctg

SEQ ID NO: 141836 - DNA, 16 bp, Homo sapiens
gccaaagcctcctcca

SEQ ID NO: 141837 - DNA, 19 bp, Homo sapiens
gccaaagggaaatatcatt

SEQ ID NO: 141838 - DNA, 11 bp, Homo sapiens
gccaaattatt

SEQ ID NO: 141839 - DNA, 15 bp, Homo sapiens
gccaaattatttgtg

SEQ ID NO: 141840 - DNA, 18 bp, Homo sapiens
gccaaattatttgtgtaa

SEQ ID NO: 141841 - DNA, 17 bp, Homo sapiens
gccaacagaagcttcca

SEQ ID NO: 141842 - DNA, 19 bp, Homo sapiens
gccaacagaagcttccatt

SEQ ID NO: 141843 - DNA, 18 bp, Homo sapiens
gccaagacttggcaacag

SEQ ID NO: 141844 - DNA, 22 bp, Homo sapiens
gccaagacttggcaacagaagc

SEQ ID NO: 141845 - DNA, 22 bp, Homo sapiens
gccaagccctccccatcccatg

SEQ ID NO: 141846 - DNA, 17 bp, Homo sapiens
gccaagctccttgggag

SEQ ID NO: 141847 - DNA, 23 bp, Homo sapiens
gccaaggagggtggatcacctga

SEQ ID NO: 141848 - DNA, 13 bp, Homo sapiens
gccaattcctata

SEQ ID NO: 141849 - DNA, 16 bp, Homo sapiens
gccacaagaaatttga

SEQ ID NO: 141850 - DNA, 16 bp, Homo sapiens
gccacaccctcccccg

SEQ ID NO: 141851 - DNA, 21 bp, Homo sapiens
gccacacgtctgaccctctcc

SEQ ID NO: 141852 - DNA, 20 bp, Homo sapiens
gccacacttcaggctcttct

SEQ ID NO: 141853 - DNA, 23 bp, Homo sapiens
gccacacttcaggctcttctcct

SEQ ID NO: 141854 - DNA, 14 bp, Homo sapiens
gccaccaagaggga

SEQ ID NO: 141855 - DNA, 17 bp, Homo sapiens
gccaccatcctgcagcc

SEQ ID NO: 141856 - DNA, 16 bp, Homo sapiens
gccaccatggccagcc

SEQ ID NO: 141857 - DNA, 16 bp, Homo sapiens
gccacccctccttcct

SEQ ID NO: 141858 - DNA, 11 bp, Homo sapiens
gccacctcccc

SEQ ID NO: 141859 - DNA, 17 bp, Homo sapiens
gccacctccccaggccg

SEQ ID NO: 141860 - DNA, 13 bp, Homo sapiens
gccacctccccta

SEQ ID NO: 141861 - DNA, 17 bp, Homo sapiens
gccacctcccctatcca

SEQ ID NO: 141862 - DNA, 20 bp, Homo sapiens
gccacctctgcggaccccag

SEQ ID NO: 141863 - DNA, 12 bp, Homo sapiens
gccacctggggc

SEQ ID NO: 141864 - DNA, 14 bp, Homo sapiens
gccacctggggcag

SEQ ID NO: 141865 - DNA, 13 bp, Homo sapiens
gccacgtgccagg

SEQ ID NO: 141866 - DNA, 18 bp, Homo sapiens
gccactccagacccctgg

SEQ ID NO: 141867 - DNA, 19 bp, Homo sapiens
gccactccagacccctggc

SEQ ID NO: 141868 - DNA, 13 bp, Homo sapiens
gccactcctctga

SEQ ID NO: 141869 - DNA, 21 bp, Homo sapiens
gccactcctctgactcagggc

SEQ ID NO: 141870 - DNA, 23 bp, Homo sapiens
gccactcctctgactcagggctc

SEQ ID NO: 141871 - DNA, 13 bp, Homo sapiens
gccactctgcctc

SEQ ID NO: 141872 - DNA, 14 bp, Homo sapiens
gccactctgcctct

SEQ ID NO: 141873 - DNA, 17 bp, Homo sapiens
gccactctgcctctgcc

SEQ ID NO: 141874 - DNA, 19 bp, Homo sapiens
gccactctgcctctgcctg

SEQ ID NO: 141875 - DNA, 21 bp, Homo sapiens
gccacttgatgacccccaacc

SEQ ID NO: 141876 - DNA, 21 bp, Homo sapiens
gccagaagctgagcaccaggg

SEQ ID NO: 141877 - DNA, 14 bp, Homo sapiens
gccagacatgtggt

SEQ ID NO: 141878 - DNA, 15 bp, Homo sapiens
gccagactggcacag

SEQ ID NO: 141879 - DNA, 18 bp, Homo sapiens
gccagactggcacagttt

SEQ ID NO: 141880 - DNA, 23 bp, Homo sapiens
gatctgggaccctttccttcctt

SEQ ID NO: 141881 - DNA, 20 bp, Homo sapiens
gatctgttgtgtacgtggag

SEQ ID NO: 141882 - DNA, 13 bp, Homo sapiens
gatctttaaaata

SEQ ID NO: 141883 - DNA, 23 bp, Homo sapiens
gatgaaattttctagactttctg

SEQ ID NO: 141884 - DNA, 16 bp, Homo sapiens
gatgaatgccgtggat

SEQ ID NO: 141885 - DNA, 12 bp, Homo sapiens
gatgagcattta

SEQ ID NO: 141886 - DNA, 18 bp, Homo sapiens
gatgagcatttagggcaa

SEQ ID NO: 141887 - DNA, 22 bp, Homo sapiens
gatgagcatttagggcaaggag

SEQ ID NO: 141888 - DNA, 19 bp, Homo sapiens
gatgagccctcagaaccct

SEQ ID NO: 141889 - DNA, 22 bp, Homo sapiens
gatgagccctcagaacccttgg

SEQ ID NO: 141890 - DNA, 13 bp, Homo sapiens
gatgagccgctgt

SEQ ID NO: 141891 - DNA, 20 bp, Homo sapiens
gatgagctctacccagggcc

SEQ ID NO: 141892 - DNA, 15 bp, Homo sapiens
gatgatctactcaga

SEQ ID NO: 141893 - DNA, 16 bp, Homo sapiens
gatgatctttaaaata

SEQ ID NO: 141894 - DNA, 22 bp, Homo sapiens
gatgatggttgcaaaagactaa

SEQ ID NO: 141895 - DNA, 14 bp, Homo sapiens
gatgcaaagaggca

SEQ ID NO: 141896 - DNA, 16 bp, Homo sapiens
gatgcaaagaggcaag

SEQ ID NO: 141897 - DNA, 11 bp, Homo sapiens
gatgccaggac

SEQ ID NO: 141898 - DNA, 20 bp, Homo sapiens
gccgcatcttctccatctgg

SEQ ID NO: 141899 - DNA, 16 bp, Homo sapiens
gccgccatgctcctgg

SEQ ID NO: 141900 - DNA, 13 bp, Homo sapiens
gccgcctcccagc

SEQ ID NO: 141901 - DNA, 12 bp, Homo sapiens
gccgctgtgagc

SEQ ID NO: 141902 - DNA, 23 bp, Homo sapiens
gccgctgtgagcccctggtcctg

SEQ ID NO: 141903 - DNA, 17 bp, Homo sapiens
gccgctgttcacccaca

SEQ ID NO: 141904 - DNA, 14 bp, Homo sapiens
gccgggtctgcctc

SEQ ID NO: 141905 - DNA, 21 bp, Homo sapiens
gccgggtctgcctcttctggg

SEQ ID NO: 141906 - DNA, 16 bp, Homo sapiens
gccgggtgctcagggc

SEQ ID NO: 141907 - DNA, 14 bp, Homo sapiens
gccgtgccctgccc

SEQ ID NO: 141908 - DNA, 14 bp, Homo sapiens
gccgtgccttcagc

SEQ ID NO: 141909 - DNA, 19 bp, Homo sapiens
gccgtgccttcagctctac

SEQ ID NO: 141910 - DNA, 21 bp, Homo sapiens
gccgtggattgcacgtggcct

SEQ ID NO: 141911 - DNA, 22 bp, Homo sapiens
gccgtggattgcacgtggcctc

SEQ ID NO: 141912 - DNA, 15 bp, Homo sapiens
gccgttactctccaa

SEQ ID NO: 141913 - DNA, 17 bp, Homo sapiens
gcctaagtggctgctga

SEQ ID NO: 141914 - DNA, 12 bp, Homo sapiens
gcctactcacga

SEQ ID NO: 141915 - DNA, 23 bp, Homo sapiens
gcctagtggggtctccctctcct

SEQ ID NO: 141916 - DNA, 22 bp, Homo sapiens
gcctattagtagttaattctgt

SEQ ID NO: 141917 - DNA, 15 bp, Homo sapiens
gcctattatattaaa

SEQ ID NO: 141918 - DNA, 20 bp, Homo sapiens
gcctattatattaaaatatg

SEQ ID NO: 141919 - DNA, 14 bp, Homo sapiens
gcctcaatgccagt

SEQ ID NO: 141920 - DNA, 21 bp, Homo sapiens
gcctcaatgtggttgcaaggc

SEQ ID NO: 141921 - DNA, 16 bp, Homo sapiens
gcctcacagaagaata

SEQ ID NO: 141922 - DNA, 17 bp, Homo sapiens
gcctcagccattcactg

SEQ ID NO: 141923 - DNA, 15 bp, Homo sapiens
gcctcagtcctcccc

SEQ ID NO: 141924 - DNA, 18 bp, Homo sapiens
gcctcagtcctcccctca

SEQ ID NO: 141925 - DNA, 23 bp, Homo sapiens
gcctcagtcctcccctcacagcc

SEQ ID NO: 141926 - DNA, 22 bp, Homo sapiens
gcctcatatttaaagacaggga

SEQ ID NO: 141927 - DNA, 17 bp, Homo sapiens
gcctcccacccccatct

SEQ ID NO: 141928 - DNA, 15 bp, Homo sapiens
gcctcccctgccagg

SEQ ID NO: 141929 - DNA, 18 bp, Homo sapiens
gcctcccctgccagggca

SEQ ID NO: 141930 - DNA, 20 bp, Homo sapiens
gcctcccctgctgaaggtgg

SEQ ID NO: 141931 - DNA, 16 bp, Homo sapiens
gcctccctggtccctt

SEQ ID NO: 141932 - DNA, 13 bp, Homo sapiens
gcctcctccagcc

SEQ ID NO: 141933 - DNA, 13 bp, Homo sapiens
gcctcctcctgac

SEQ ID NO: 141934 - DNA, 16 bp, Homo sapiens
gcctcctctgtccagg

SEQ ID NO: 141935 - DNA, 18 bp, Homo sapiens
gcctcctgtgtagctggg

SEQ ID NO: 141936 - DNA, 14 bp, Homo sapiens
gcctcggagcctca

SEQ ID NO: 141937 - DNA, 15 bp, Homo sapiens
gcctcggagcctcat

SEQ ID NO: 141938 - DNA, 23 bp, Homo sapiens
gcctcggagcctcatccgaggca

SEQ ID NO: 141939 - DNA, 13 bp, Homo sapiens
gcctctcccctga

SEQ ID NO: 141940 - DNA, 14 bp, Homo sapiens
gcctctccctggcc

SEQ ID NO: 141941 - DNA, 14 bp, Homo sapiens
gcctctgacccctc

SEQ ID NO: 141942 - DNA, 22 bp, Homo sapiens
gcctctgacccctcctcactgg

SEQ ID NO: 141943 - DNA, 15 bp, Homo sapiens
gcctctgcattcagg

SEQ ID NO: 141944 - DNA, 15 bp, Homo sapiens
gcctctgccccgtct

SEQ ID NO: 141945 - DNA, 16 bp, Homo sapiens
gcctctgccccgtctc

SEQ ID NO: 141946 - DNA, 12 bp, Homo sapiens
gcctctgggact

SEQ ID NO: 141947 - DNA, 14 bp, Homo sapiens
gcctctgtgtcctt

SEQ ID NO: 141948 - DNA, 18 bp, Homo sapiens
gcctcttaaagctgcctg

SEQ ID NO: 141949 - DNA, 18 bp, Homo sapiens
gcctcttagacttctgct

SEQ ID NO: 141950 - DNA, 17 bp, Homo sapiens
gcctcttctagagccgt

SEQ ID NO: 141951 - DNA, 18 bp, Homo sapiens
gcctcttctgggagggca

SEQ ID NO: 141952 - DNA, 20 bp, Homo sapiens
gcctcttgagcagtggctgg

SEQ ID NO: 141953 - DNA, 21 bp, Homo sapiens
gcctcttgagcagtggctggt

SEQ ID NO: 141954 - DNA, 12 bp, Homo sapiens
gcctcttttctc

SEQ ID NO: 141955 - DNA, 18 bp, Homo sapiens
gcctcttttctctgtgct

SEQ ID NO: 141956 - DNA, 14 bp, Homo sapiens
gcctgaaaggagcc

SEQ ID NO: 141957 - DNA, 22 bp, Homo sapiens
gcctgacatttggagtgttccc

SEQ ID NO: 141958 - DNA, 14 bp, Homo sapiens
gcctgagcctggcc

SEQ ID NO: 141959 - DNA, 22 bp, Homo sapiens
gcctgatccagcctctcccctg

SEQ ID NO: 141960 - DNA, 16 bp, Homo sapiens
gcctgcaaacgctgcc

SEQ ID NO: 141961 - DNA, 19 bp, Homo sapiens
gcctgcaaacgctgcctgc

SEQ ID NO: 141962 - DNA, 15 bp, Homo sapiens
gcctgcaatttcata

SEQ ID NO: 141963 - DNA, 14 bp, Homo sapiens
gcctgcaggacctg

SEQ ID NO: 141964 - DNA, 14 bp, Homo sapiens
gcctgcaggtgctg

SEQ ID NO: 141965 - DNA, 16 bp, Homo sapiens
gcctgcaggtgctgct

SEQ ID NO: 141966 - DNA, 17 bp, Homo sapiens
gcctgccccaaacaaat

SEQ ID NO: 141967 - DNA, 16 bp, Homo sapiens
gcctgcccgtaaacac

SEQ ID NO: 141968 - DNA, 21 bp, Homo sapiens
gcctgcccgtaaacacgcctg

SEQ ID NO: 141969 - DNA, 16 bp, Homo sapiens
gcctgcctcttctcta

SEQ ID NO: 141970 - DNA, 17 bp, Homo sapiens
gcctgcctgttcccatt

SEQ ID NO: 141971 - DNA, 15 bp, Homo sapiens
gcctgctccagctgt

SEQ ID NO: 141972 - DNA, 18 bp, Homo sapiens
gcctgctccagctgttca

SEQ ID NO: 141973 - DNA, 11 bp, Homo sapiens
gcctgctcccc

SEQ ID NO: 141974 - DNA, 15 bp, Homo sapiens
gcctgctcccccacc

SEQ ID NO: 141975 - DNA, 19 bp, Homo sapiens
gcctgctcccccaccccct

SEQ ID NO: 141976 - DNA, 15 bp, Homo sapiens
gcctggactttcctg

SEQ ID NO: 141977 - DNA, 16 bp, Homo sapiens
gcctggactttcctgc

SEQ ID NO: 141978 - DNA, 18 bp, Homo sapiens
gcctggcaagtgggtgaa

SEQ ID NO: 141979 - DNA, 18 bp, Homo sapiens
gcctggcacagggcagtg

SEQ ID NO: 141980 - DNA, 22 bp, Homo sapiens
gcctggcagccgtgccttcagc

SEQ ID NO: 141981 - DNA, 16 bp, Homo sapiens
gcctggccagcctaca

SEQ ID NO: 141982 - DNA, 15 bp, Homo sapiens
gcctgggtggggctg

SEQ ID NO: 141983 - DNA, 18 bp, Homo sapiens
gcctgggtggggctgctc

SEQ ID NO: 141984 - DNA, 19 bp, Homo sapiens
gcctgtaatcccagcactt

SEQ ID NO: 141985 - DNA, 17 bp, Homo sapiens
gcctgtaatcccagcag

SEQ ID NO: 141986 - DNA, 14 bp, Homo sapiens
gcctgtagcagtga

SEQ ID NO: 141987 - DNA, 13 bp, Homo sapiens
gcctgtagcccac

SEQ ID NO: 141988 - DNA, 22 bp, Homo sapiens
gcctgtagcccactctgctcgc

SEQ ID NO: 141989 - DNA, 18 bp, Homo sapiens
gcctgtagttaggaaata

SEQ ID NO: 141990 - DNA, 23 bp, Homo sapiens
gcctgtagttaggaaataaaacc

SEQ ID NO: 141991 - DNA, 21 bp, Homo sapiens
gcctgtcccatggacactcca

SEQ ID NO: 141992 - DNA, 22 bp, Homo sapiens
gcctgtcccatggacactccag

SEQ ID NO: 141993 - DNA, 14 bp, Homo sapiens
gcctgtctcttcca

SEQ ID NO: 141994 - DNA, 18 bp, Homo sapiens
gcctgtgaggcaggggcg

SEQ ID NO: 141995 - DNA, 17 bp, Homo sapiens
gcctgtgaggtgcagag

SEQ ID NO: 141996 - DNA, 24 bp, Homo sapiens
gcctgtgaggtgcagagtgcccag

SEQ ID NO: 141997 - DNA, 12 bp, Homo sapiens
gcctgtgcagtg

SEQ ID NO: 141998 - DNA, 16 bp, Homo sapiens
gcctgtgcctctggga

SEQ ID NO: 141999 - DNA, 19 bp, Homo sapiens
gcctgtgcctctgggactg

SEQ ID NO: 142000 - DNA, 15 bp, Homo sapiens
gcctgtgctgcccgt

SEQ ID NO: 142001 - DNA, 18 bp, Homo sapiens
gcctgtggcggtgcctgg

SEQ ID NO: 142002 - DNA, 16 bp, Homo sapiens
gccttaaaactttaat

SEQ ID NO: 142003 - DNA, 12 bp, Homo sapiens
gccttacctcct

SEQ ID NO: 142004 - DNA, 19 bp, Homo sapiens
gccttacctcctgcccagg

SEQ ID NO: 142005 - DNA, 21 bp, Homo sapiens
gccttacctcctgcccaggag

SEQ ID NO: 142006 - DNA, 22 bp, Homo sapiens
gccttacctcctgcccaggaga

SEQ ID NO: 142007 - DNA, 16 bp, Homo sapiens
gccttagaacctttct

SEQ ID NO: 142008 - DNA, 15 bp, Homo sapiens
gccttccccagcctc

SEQ ID NO: 142009 - DNA, 17 bp, Homo sapiens
gccttccccagcctctt

SEQ ID NO: 142010 - DNA, 18 bp, Homo sapiens
gccttccccttgcccagg

SEQ ID NO: 142011 - DNA, 19 bp, Homo sapiens
gccttcggacaactcagtc

SEQ ID NO: 142012 - DNA, 18 bp, Homo sapiens
gccttcttattctcactc

SEQ ID NO: 142013 - DNA, 14 bp, Homo sapiens
gccttcttccatcc

SEQ ID NO: 142014 - DNA, 21 bp, Homo sapiens
gccttgaatatcccctcccag

SEQ ID NO: 142015 - DNA, 22 bp, Homo sapiens
gccttgaatatcccctcccagt

SEQ ID NO: 142016 - DNA, 12 bp, Homo sapiens
gccttgcccaga

SEQ ID NO: 142017 - DNA, 14 bp, Homo sapiens
gccttgcccagaga

SEQ ID NO: 142018 - DNA, 20 bp, Homo sapiens
gccttgcccagagatgcctc

SEQ ID NO: 142019 - DNA, 19 bp, Homo sapiens
gccttggataatgctgttg

SEQ ID NO: 142020 - DNA, 21 bp, Homo sapiens
gccttggataatgctgttgcc

SEQ ID NO: 142021 - DNA, 20 bp, Homo sapiens
gccttggcctcccctgctga

SEQ ID NO: 142022 - DNA, 19 bp, Homo sapiens
gctttcgtctccagcccct

SEQ ID NO: 142023 - DNA, 22 bp, Homo sapiens
gctttgactgagcagactggtg

SEQ ID NO: 142024 - DNA, 12 bp, Homo sapiens
gctttgcagtga

SEQ ID NO: 142025 - DNA, 22 bp, Homo sapiens
gctttgcattcctacaaagatg

SEQ ID NO: 142026 - DNA, 14 bp, Homo sapiens
gctttgggctgccc

SEQ ID NO: 142027 - DNA, 17 bp, Homo sapiens
gcttttaaaaaaaaata

SEQ ID NO: 142028 - DNA, 15 bp, Homo sapiens
gcttttattgtataa

SEQ ID NO: 142029 - DNA, 12 bp, Homo sapiens
gcttttcactgc

SEQ ID NO: 142030 - DNA, 14 bp, Homo sapiens
gcttttccttgggg

SEQ ID NO: 142031 - DNA, 14 bp, Homo sapiens
gcttttctcagctg

SEQ ID NO: 142032 - DNA, 14 bp, Homo sapiens
ggaaaaaaatgact

SEQ ID NO: 142033 - DNA, 22 bp, Homo sapiens
ggaaaaccaagccgtggcttcc

SEQ ID NO: 142034 - DNA, 14 bp, Homo sapiens
ggaaaagaatacag

SEQ ID NO: 142035 - DNA, 13 bp, Homo sapiens
ggaaaatacccca

SEQ ID NO: 142036 - DNA, 22 bp, Homo sapiens
ggaaaataccccatcattcatg

SEQ ID NO: 142037 - DNA, 19 bp, Homo sapiens
ggaaaatcagcctgctcca

SEQ ID NO: 142038 - DNA, 14 bp, Homo sapiens
ggaaaatgaataat

SEQ ID NO: 142039 - DNA, 18 bp, Homo sapiens
ggaaactgttgccagaga

SEQ ID NO: 142040 - DNA, 14 bp, Homo sapiens
ggaaagcagctcaa

SEQ ID NO: 142041 - DNA, 15 bp, Homo sapiens
ggaaagcagctcaaa

SEQ ID NO: 142042 - DNA, 23 bp, Homo sapiens
ggaaagctcagctactgattttt

SEQ ID NO: 142043 - DNA, 15 bp, Homo sapiens
ggaaaggagaggaaa

SEQ ID NO: 142044 - DNA, 18 bp, Homo sapiens
ggaaaggccagctggcag

SEQ ID NO: 142045 - DNA, 18 bp, Homo sapiens
ggaaataaaacctttcaa

SEQ ID NO: 142046 - DNA, 16 bp, Homo sapiens
ggaaatcaaatatgca

SEQ ID NO: 142047 - DNA, 17 bp, Homo sapiens
ggaaatcaaatatgcaa

SEQ ID NO: 142048 - DNA, 13 bp, Homo sapiens
ggaacaatctaaa

SEQ ID NO: 142049 - DNA, 13 bp, Homo sapiens
ggaacagacagga

SEQ ID NO: 142050 - DNA, 16 bp, Homo sapiens
ggaacagacaggagaa

SEQ ID NO: 142051 - DNA, 16 bp, Homo sapiens
ggaaccgcaggaagct

SEQ ID NO: 142052 - DNA, 17 bp, Homo sapiens
ggaaccgcaggaagctg

SEQ ID NO: 142053 - DNA, 17 bp, Homo sapiens
ggaacgtgactgcccca

SEQ ID NO: 142054 - DNA, 21 bp, Homo sapiens
ggaactcattcctgcctgtct

SEQ ID NO: 142055 - DNA, 14 bp, Homo sapiens
ggaactgtccagag

SEQ ID NO: 142056 - DNA, 15 bp, Homo sapiens
ggaacttctaatata

SEQ ID NO: 142057 - DNA, 14 bp, Homo sapiens
ggaagaaaagagct

SEQ ID NO: 142058 - DNA, 22 bp, Homo sapiens
ggaagacaatgtgaaaagaaaa

SEQ ID NO: 142059 - DNA, 19 bp, Homo sapiens
ggaagagcagaacggagcc

SEQ ID NO: 142060 - DNA, 18 bp, Homo sapiens
ggaagattttaaattcac

SEQ ID NO: 142061 - DNA, 18 bp, Homo sapiens
ggaagcattcagagagca

SEQ ID NO: 142062 - DNA, 12 bp, Homo sapiens
ggaagccctcct

SEQ ID NO: 142063 - DNA, 16 bp, Homo sapiens
ggaagccgtgccctgc

SEQ ID NO: 142064 - DNA, 21 bp, Homo sapiens
ggaagcgtgaaggccgagaag

SEQ ID NO: 142065 - DNA, 17 bp, Homo sapiens
gcagactggtgagcaga

SEQ ID NO: 142066 - DNA, 15 bp, Homo sapiens
gcagagacagagagg

SEQ ID NO: 142067 - DNA, 17 bp, Homo sapiens
gcagagacaggacctga

SEQ ID NO: 142068 - DNA, 11 bp, Homo sapiens
gcagaggctgg

SEQ ID NO: 142069 - DNA, 19 bp, Homo sapiens
gcagagggcagaggctgga

SEQ ID NO: 142070 - DNA, 14 bp, Homo sapiens
gcagagtcagcaga

SEQ ID NO: 142071 - DNA, 14 bp, Homo sapiens
gcagagttgtaaat

SEQ ID NO: 142072 - DNA, 23 bp, Homo sapiens
gcagagttgtaaatatataaata

SEQ ID NO: 142073 - DNA, 16 bp, Homo sapiens
gcagataatcagcctc

SEQ ID NO: 142074 - DNA, 18 bp, Homo sapiens
gcagataatcagcctctt

SEQ ID NO: 142075 - DNA, 15 bp, Homo sapiens
gcagatgacccctcc

SEQ ID NO: 142076 - DNA, 15 bp, Homo sapiens
gcagatgcaaagagg

SEQ ID NO: 142077 - DNA, 17 bp, Homo sapiens
gcagatgcaaagaggca

SEQ ID NO: 142078 - DNA, 22 bp, Homo sapiens
gcagatggaatgctgtgttaaa

SEQ ID NO: 142079 - DNA, 14 bp, Homo sapiens
gcagcacagagagg

SEQ ID NO: 142080 - DNA, 12 bp, Homo sapiens
gcagcagggcta

SEQ ID NO: 142081 - DNA, 13 bp, Homo sapiens
gcagccaagctcc

SEQ ID NO: 142082 - DNA, 16 bp, Homo sapiens
gcagccagcccagccc

SEQ ID NO: 142083 - DNA, 16 bp, Homo sapiens
gcagccagctctcagc

SEQ ID NO: 142084 - DNA, 17 bp, Homo sapiens
gcagccagctctcagcc

SEQ ID NO: 142085 - DNA, 18 bp, Homo sapiens
gcagccagctctcagcca

SEQ ID NO: 142086 - DNA, 18 bp, Homo sapiens
gcagccctcctcaccccg

SEQ ID NO: 142087 - DNA, 18 bp, Homo sapiens
gcagccggcacagggtct

SEQ ID NO: 142088 - DNA, 17 bp, Homo sapiens
gcagccgtgccttcagc

SEQ ID NO: 142089 - DNA, 14 bp, Homo sapiens
gcagcctcctcctg

SEQ ID NO: 142090 - DNA, 18 bp, Homo sapiens
gcagcctcctcctgacca

SEQ ID NO: 142091 - DNA, 13 bp, Homo sapiens
gcagcctggaggc

SEQ ID NO: 142092 - DNA, 14 bp, Homo sapiens
gcagctcaaaggca

SEQ ID NO: 142093 - DNA, 15 bp, Homo sapiens
gcagctcaaaggcac

SEQ ID NO: 142094 - DNA, 14 bp, Homo sapiens
gcagctgttagagt

SEQ ID NO: 142095 - DNA, 17 bp, Homo sapiens
gcagctgttagagtcca

SEQ ID NO: 142096 - DNA, 21 bp, Homo sapiens
gcaggaaatgaaaatgtcttg

SEQ ID NO: 142097 - DNA, 20 bp, Homo sapiens
gcaggaagcattcagagagc

SEQ ID NO: 142098 - DNA, 14 bp, Homo sapiens
gcaggaagctcaga

SEQ ID NO: 142099 - DNA, 13 bp, Homo sapiens
gcaggaagctgct

SEQ ID NO: 142100 - DNA, 17 bp, Homo sapiens
gcaggaatgtgtggcag

SEQ ID NO: 142101 - DNA, 17 bp, Homo sapiens
gcaggacaacgaggaag

SEQ ID NO: 142102 - DNA, 18 bp, Homo sapiens
gcaggacaacgaggaagc

SEQ ID NO: 142103 - DNA, 19 bp, Homo sapiens
gcaggacaacgaggaagcc

SEQ ID NO: 142104 - DNA, 14 bp, Homo sapiens
gcaggacctgcctg

SEQ ID NO: 142105 - DNA, 16 bp, Homo sapiens
gcaggacctgcctgta

SEQ ID NO: 142106 - DNA, 20 bp, Homo sapiens
gcaggacctgcctgtagccc

SEQ ID NO: 142107 - DNA, 14 bp, Homo sapiens
gcaggaggccaggc

SEQ ID NO: 142108 - DNA, 23 bp, Homo sapiens
gcaggcagacacggatctgagaa

SEQ ID NO: 142109 - DNA, 15 bp, Homo sapiens
gcaggctactgtcag

SEQ ID NO: 142110 - DNA, 21 bp, Homo sapiens
gcagggaaaattatttgcata

SEQ ID NO: 142111 - DNA, 21 bp, Homo sapiens
gcagggaagtgtaagaaacac

SEQ ID NO: 142112 - DNA, 15 bp, Homo sapiens
gcagggccaggactg

SEQ ID NO: 142113 - DNA, 20 bp, Homo sapiens
gcagggctaccctgagctga

SEQ ID NO: 142114 - DNA, 21 bp, Homo sapiens
gcagggctaccctgagctgag

SEQ ID NO: 142115 - DNA, 17 bp, Homo sapiens
gcaggggctctggagag

SEQ ID NO: 142116 - DNA, 20 bp, Homo sapiens
gcaggggctctggagagaaa

SEQ ID NO: 142117 - DNA, 17 bp, Homo sapiens
gcagggtcaggagaggg

SEQ ID NO: 142118 - DNA, 15 bp, Homo sapiens
gcaggtgctgctgcg

SEQ ID NO: 142119 - DNA, 20 bp, Homo sapiens
gcagtagaaataatatgcat

SEQ ID NO: 142120 - DNA, 21 bp, Homo sapiens
gcagtagaaataatatgcatt

SEQ ID NO: 142121 - DNA, 19 bp, Homo sapiens
gcagtcattatccaggtaa

SEQ ID NO: 142122 - DNA, 12 bp, Homo sapiens
gcagtctggagg

SEQ ID NO: 142123 - DNA, 13 bp, Homo sapiens
gcagtctggaggg

SEQ ID NO: 142124 - DNA, 20 bp, Homo sapiens
gcagtgaatgattcagtgtt

SEQ ID NO: 142125 - DNA, 21 bp, Homo sapiens
gcagtgatgctggatgctcct

SEQ ID NO: 142126 - DNA, 13 bp, Homo sapiens
gcagtgatgtcac

SEQ ID NO: 142127 - DNA, 15 bp, Homo sapiens
gcagtggacaccagg

SEQ ID NO: 142128 - DNA, 20 bp, Homo sapiens
gcagtggctggtccagggct

SEQ ID NO: 142129 - DNA, 19 bp, Homo sapiens
gcagttctgggtgctccct

SEQ ID NO: 142130 - DNA, 22 bp, Homo sapiens
gcagttgaatgacaacagaagc

SEQ ID NO: 142131 - DNA, 15 bp, Homo sapiens
gcataaaaattagcc

SEQ ID NO: 142132 - DNA, 13 bp, Homo sapiens
gcatacctttatt

SEQ ID NO: 142133 - DNA, 16 bp, Homo sapiens
gcatacctttattgtg

SEQ ID NO: 142134 - DNA, 22 bp, Homo sapiens
gcatagcccagacacagaagag

SEQ ID NO: 142135 - DNA, 18 bp, Homo sapiens
gcatcaccttaggcaggg

SEQ ID NO: 142136 - DNA, 20 bp, Homo sapiens
gcatcaccttaggcagggaa

SEQ ID NO: 142137 - DNA, 16 bp, Homo sapiens
gcatccattcctcagg

SEQ ID NO: 142138 - DNA, 19 bp, Homo sapiens
gcatccccttggctgtgag

SEQ ID NO: 142139 - DNA, 17 bp, Homo sapiens
gcatccgtagttccctg

SEQ ID NO: 142140 - DNA, 12 bp, Homo sapiens
gcatctcagccc

SEQ ID NO: 142141 - DNA, 17 bp, Homo sapiens
gcatctccacctgctcc

SEQ ID NO: 142142 - DNA, 12 bp, Homo sapiens
gcatctcccaga

SEQ ID NO: 142143 - DNA, 21 bp, Homo sapiens
gcatctcccagataatgtgaa

SEQ ID NO: 142144 - DNA, 21 bp, Homo sapiens
gcatctgtataagtaagaaaa

SEQ ID NO: 142145 - DNA, 14 bp, Homo sapiens
gcatcttctccatc

SEQ ID NO: 142146 - DNA, 22 bp, Homo sapiens
gcatgaggaactagccaccaac

SEQ ID NO: 142147 - DNA, 20 bp, Homo sapiens
gcatgatgttaaccagaata

SEQ ID NO: 142148 - DNA, 16 bp, Homo sapiens
gcatgcactgttcccc

SEQ ID NO: 142149 - DNA, 21 bp, Homo sapiens
gcatgcactgttccccctgtg

SEQ ID NO: 142150 - DNA, 23 bp, Homo sapiens
gcatgcactgttccccctgtgca

SEQ ID NO: 142151 - DNA, 17 bp, Homo sapiens
gcatgccccggccacct

SEQ ID NO: 142152 - DNA, 18 bp, Homo sapiens
gcatgccccggccacctc

SEQ ID NO: 142153 - DNA, 22 bp, Homo sapiens
gcatgccccggccacctctgcg

SEQ ID NO: 142154 - DNA, 20 bp, Homo sapiens
gcatggcaaggactgcaggg

SEQ ID NO: 142155 - DNA, 12 bp, Homo sapiens
gcatggccctgg

SEQ ID NO: 142156 - DNA, 22 bp, Homo sapiens
gcatggccctggggtcccacga

SEQ ID NO: 142157 - DNA, 19 bp, Homo sapiens
gcatggtggcgcaagcctg

SEQ ID NO: 142158 - DNA, 17 bp, Homo sapiens
gcatgtaaacacgcctg

SEQ ID NO: 142159 - DNA, 19 bp, Homo sapiens
gcatgtgtgcgagtgtgtg

SEQ ID NO: 142160 - DNA, 14 bp, Homo sapiens
gcatgtgtgtgctc

SEQ ID NO: 142161 - DNA, 16 bp, Homo sapiens
gcatgtgtgtgctcag

SEQ ID NO: 142162 - DNA, 19 bp, Homo sapiens
gcattatataccatttatc

SEQ ID NO: 142163 - DNA, 15 bp, Homo sapiens
gcattctcactccta

SEQ ID NO: 142164 - DNA, 21 bp, Homo sapiens
gcattcttttaaaagacaaga

SEQ ID NO: 142165 - DNA, 16 bp, Homo sapiens
gcccctcctctgccac

SEQ ID NO: 142166 - DNA, 17 bp, Homo sapiens
gcccctcctctgccacc

SEQ ID NO: 142167 - DNA, 20 bp, Homo sapiens
gcccctcctctgccacctcc

SEQ ID NO: 142168 - DNA, 21 bp, Homo sapiens
gcccctcctctgccacctccc

SEQ ID NO: 142169 - DNA, 16 bp, Homo sapiens
gcccctggtcctgagg

SEQ ID NO: 142170 - DNA, 12 bp, Homo sapiens
gccccttccccc

SEQ ID NO: 142171 - DNA, 17 bp, Homo sapiens
gcccgtaaacacgcctg

SEQ ID NO: 142172 - DNA, 15 bp, Homo sapiens
gcccgtcttcagcct

SEQ ID NO: 142173 - DNA, 18 bp, Homo sapiens
gcccgtcttcagcctagc

SEQ ID NO: 142174 - DNA, 17 bp, Homo sapiens
gccctagagcacactgt

SEQ ID NO: 142175 - DNA, 17 bp, Homo sapiens
gccctaggctccgtcag

SEQ ID NO: 142176 - DNA, 15 bp, Homo sapiens
gccctatttttgcaa

SEQ ID NO: 142177 - DNA, 14 bp, Homo sapiens
gccctcagaaccct

SEQ ID NO: 142178 - DNA, 17 bp, Homo sapiens
gccctcagaacccttgg

SEQ ID NO: 142179 - DNA, 19 bp, Homo sapiens
gccctcagaacccttggct

SEQ ID NO: 142180 - DNA, 12 bp, Homo sapiens
gccctcatcccg

SEQ ID NO: 142181 - DNA, 17 bp, Homo sapiens
gccctccccatcccatg

SEQ ID NO: 142182 - DNA, 12 bp, Homo sapiens
gccctcccctcc

SEQ ID NO: 142183 - DNA, 13 bp, Homo sapiens
gccctcccctccc

SEQ ID NO: 142184 - DNA, 16 bp, Homo sapiens
gccctcccctcccctg

SEQ ID NO: 142185 - DNA, 17 bp, Homo sapiens
gccctcccctcccctgc

SEQ ID NO: 142186 - DNA, 18 bp, Homo sapiens
gccctcccctcccctgct

SEQ ID NO: 142187 - DNA, 19 bp, Homo sapiens
gccctcccctcccctgctg

SEQ ID NO: 142188 - DNA, 16 bp, Homo sapiens
gccctctctgctctgc

SEQ ID NO: 142189 - DNA, 16 bp, Homo sapiens
gccctgagctcggtgg

SEQ ID NO: 142190 - DNA, 22 bp, Homo sapiens
gccctgagctcggtggacccag

SEQ ID NO: 142191 - DNA, 14 bp, Homo sapiens
gccctgagctttct

SEQ ID NO: 142192 - DNA, 21 bp, Homo sapiens
gccctgctgccgcctcccagc

SEQ ID NO: 142193 - DNA, 16 bp, Homo sapiens
gccctgctttgggctg

SEQ ID NO: 142194 - DNA, 20 bp, Homo sapiens
gccctgctttgggctgccct

SEQ ID NO: 142195 - DNA, 21 bp, Homo sapiens
gccctgctttgggctgccctg

SEQ ID NO: 142196 - DNA, 17 bp, Homo sapiens
gccctggcctgctgggc

SEQ ID NO: 142197 - DNA, 18 bp, Homo sapiens
gccctgggccccaccacc

SEQ ID NO: 142198 - DNA, 19 bp, Homo sapiens
gccctgggccccaccacct

SEQ ID NO: 142199 - DNA, 20 bp, Homo sapiens
gccctgggccccaccaccta

SEQ ID NO: 142200 - DNA, 13 bp, Homo sapiens
gccctgtccctcc

SEQ ID NO: 142201 - DNA, 23 bp, Homo sapiens
gccctgtccctcccacctctgtg

SEQ ID NO: 142202 - DNA, 20 bp, Homo sapiens
gccctgttcagctactccca

SEQ ID NO: 142203 - DNA, 20 bp, Homo sapiens
gcccttatctgtgctcagga

SEQ ID NO: 142204 - DNA, 16 bp, Homo sapiens
gcccttcacagtgttt

SEQ ID NO: 142205 - DNA, 12 bp, Homo sapiens
gcccttccatgt

SEQ ID NO: 142206 - DNA, 21 bp, Homo sapiens
gcccttccatgtcgcctctgc

SEQ ID NO: 142207 - DNA, 18 bp, Homo sapiens
gccctttgagtgcagtcc

SEQ ID NO: 142208 - DNA, 17 bp, Homo sapiens
gccgacctcagccttcc

SEQ ID NO: 142209 - DNA, 16 bp, Homo sapiens
gccgagagcctgctcc

SEQ ID NO: 142210 - DNA, 18 bp, Homo sapiens
gccgagattgcaccactg

SEQ ID NO: 142211 - DNA, 23 bp, Homo sapiens
gccgcaccccagagtgtgggaag

SEQ ID NO: 142212 - DNA, 15 bp, Homo sapiens
gccgcatcttctcca

SEQ ID NO: 142213 - DNA, 17 bp, Homo sapiens
gccgcatcttctccatc

SEQ ID NO: 142214 - DNA, 14 bp, Homo sapiens
gccgcattccctga

SEQ ID NO: 142215 - DNA, 16 bp, Homo sapiens
gccgcattccctgagt

SEQ ID NO: 142216 - DNA, 19 bp, Homo sapiens
gccgccccagcctctgagc

SEQ ID NO: 142217 - DNA, 13 bp, Homo sapiens
gccgcctcaatgt

SEQ ID NO: 142218 - DNA, 14 bp, Homo sapiens
gccgcctcccagcc

SEQ ID NO: 142219 - DNA, 17 bp, Homo sapiens
gccgcctcccagcctgg

SEQ ID NO: 142220 - DNA, 19 bp, Homo sapiens
gccgcctcccagcctgggg

SEQ ID NO: 142221 - DNA, 20 bp, Homo sapiens
gccgctcctgtctgccagcc

SEQ ID NO: 142222 - DNA, 15 bp, Homo sapiens
gccgctgttcaccca

SEQ ID NO: 142223 - DNA, 16 bp, Homo sapiens
gccgctgttcacccac

SEQ ID NO: 142224 - DNA, 20 bp, Homo sapiens
gccggccctggggctaggct

SEQ ID NO: 142225 - DNA, 16 bp, Homo sapiens
ggcactgctgtgctgt

SEQ ID NO: 142226 - DNA, 20 bp, Homo sapiens
ggcactgggatgagccgctg

SEQ ID NO: 142227 - DNA, 15 bp, Homo sapiens
ggcactggtggcccg

SEQ ID NO: 142228 - DNA, 20 bp, Homo sapiens
ggcagacacagggacttgaa

SEQ ID NO: 142229 - DNA, 13 bp, Homo sapiens
ggcagacagcagc

SEQ ID NO: 142230 - DNA, 15 bp, Homo sapiens
ggcagacagcagctc

SEQ ID NO: 142231 - DNA, 17 bp, Homo sapiens
ggcagacagcagctcag

SEQ ID NO: 142232 - DNA, 18 bp, Homo sapiens
ggcagacagcagctcagg

SEQ ID NO: 142233 - DNA, 12 bp, Homo sapiens
ggcagaggctgg

SEQ ID NO: 142234 - DNA, 22 bp, Homo sapiens
ggcagaggctggaggcagggcc

SEQ ID NO: 142235 - DNA, 15 bp, Homo sapiens
ggcagataatcagcc

SEQ ID NO: 142236 - DNA, 18 bp, Homo sapiens
ggcagataatcagcctct

SEQ ID NO: 142237 - DNA, 13 bp, Homo sapiens
ggcagcagggcta

SEQ ID NO: 142238 - DNA, 18 bp, Homo sapiens
ggcagcagggctaccctg

SEQ ID NO: 142239 - DNA, 13 bp, Homo sapiens
ggcagcagtgtga

SEQ ID NO: 142240 - DNA, 11 bp, Homo sapiens
ggcagcctgga

SEQ ID NO: 142241 - DNA, 19 bp, Homo sapiens
ggcagggccttgcccagag

SEQ ID NO: 142242 - DNA, 15 bp, Homo sapiens
ggcagggctgactct

SEQ ID NO: 142243 - DNA, 15 bp, Homo sapiens
ggcagggtcaggaga

SEQ ID NO: 142244 - DNA, 23 bp, Homo sapiens
ggcagggtgggatggaggagaag

SEQ ID NO: 142245 - DNA, 16 bp, Homo sapiens
ggcaggtgggagcttg

SEQ ID NO: 142246 - DNA, 17 bp, Homo sapiens
ggcaggttggtgggggc

SEQ ID NO: 142247 - DNA, 21 bp, Homo sapiens
ggcagtctggaggggcatggc

SEQ ID NO: 142248 - DNA, 18 bp, Homo sapiens
ggcagtgagtgagcctgg

SEQ ID NO: 142249 - DNA, 19 bp, Homo sapiens
ggcagtgagtgagcctggc

SEQ ID NO: 142250 - DNA, 15 bp, Homo sapiens
ggcagttctgggtgc

SEQ ID NO: 142251 - DNA, 14 bp, Homo sapiens
ggcatactaataaa

SEQ ID NO: 142252 - DNA, 21 bp, Homo sapiens
ggcatagcccagacacagaag

SEQ ID NO: 142253 - DNA, 19 bp, Homo sapiens
ggcatggtggcgcaagcct

SEQ ID NO: 142254 - DNA, 22 bp, Homo sapiens
ggcatggtggcgcaagcctgta

SEQ ID NO: 142255 - DNA, 16 bp, Homo sapiens
ggcattgatggggaag

SEQ ID NO: 142256 - DNA, 23 bp, Homo sapiens
ggcattgatggggaaggaggctg

SEQ ID NO: 142257 - DNA, 15 bp, Homo sapiens
ggccaagacttggca

SEQ ID NO: 142258 - DNA, 12 bp, Homo sapiens
ggccacgtgcca

SEQ ID NO: 142259 - DNA, 17 bp, Homo sapiens
ggccactccagacccct

SEQ ID NO: 142260 - DNA, 12 bp, Homo sapiens
ggccactcctcc

SEQ ID NO: 142261 - DNA, 20 bp, Homo sapiens
ggccactgtgaagagaacca

SEQ ID NO: 142262 - DNA, 16 bp, Homo sapiens
ggccagagctgggagg

SEQ ID NO: 142263 - DNA, 21 bp, Homo sapiens
ggccagagctgggaggcatgg

SEQ ID NO: 142264 - DNA, 11 bp, Homo sapiens
ggccagaggct

SEQ ID NO: 142265 - DNA, 18 bp, Homo sapiens
ggccagctggcagcagag

SEQ ID NO: 142266 - DNA, 16 bp, Homo sapiens
ggccaggacaggcccg

SEQ ID NO: 142267 - DNA, 15 bp, Homo sapiens
ggcccacagctccca

SEQ ID NO: 142268 - DNA, 19 bp, Homo sapiens
ggcccacagctcccacccc

SEQ ID NO: 142269 - DNA, 14 bp, Homo sapiens
ggcccagagcagga

SEQ ID NO: 142270 - DNA, 12 bp, Homo sapiens
ggccccactggg

SEQ ID NO: 142271 - DNA, 13 bp, Homo sapiens
ggccccagcacta

SEQ ID NO: 142272 - DNA, 13 bp, Homo sapiens
ggccccaggaagc

SEQ ID NO: 142273 - DNA, 17 bp, Homo sapiens
ggccccagggctaccct

SEQ ID NO: 142274 - DNA, 18 bp, Homo sapiens
ggccccagggctaccctc

SEQ ID NO: 142275 - DNA, 12 bp, Homo sapiens
ggcccccagctg

SEQ ID NO: 142276 - DNA, 19 bp, Homo sapiens
ggccccgcttgtccagcgc

SEQ ID NO: 142277 - DNA, 23 bp, Homo sapiens
ggcccggcgcggtggctcacgcc

SEQ ID NO: 142278 - DNA, 22 bp, Homo sapiens
ggcccggggctggcggctactc

SEQ ID NO: 142279 - DNA, 20 bp, Homo sapiens
ggccctcacccctgccctgg

SEQ ID NO: 142280 - DNA, 15 bp, Homo sapiens
ggccctcgctgccag

SEQ ID NO: 142281 - DNA, 16 bp, Homo sapiens
ggccctcgctgccagc

SEQ ID NO: 142282 - DNA, 15 bp, Homo sapiens
ggccctctctgctct

SEQ ID NO: 142283 - DNA, 19 bp, Homo sapiens
ggccctgcaaaaggactct

SEQ ID NO: 142284 - DNA, 12 bp, Homo sapiens
ggccctggcctg

SEQ ID NO: 142285 - DNA, 14 bp, Homo sapiens
ggccctggcctgct

SEQ ID NO: 142286 - DNA, 15 bp, Homo sapiens
ggccctggcctgctg

SEQ ID NO: 142287 - DNA, 16 bp, Homo sapiens
ggccctggcctgctgg

SEQ ID NO: 142288 - DNA, 17 bp, Homo sapiens
ggccctggcctgctggg

SEQ ID NO: 142289 - DNA, 17 bp, Homo sapiens
ggcccttcctctccact

SEQ ID NO: 142290 - DNA, 19 bp, Homo sapiens
ggcccttcctctccactgc

SEQ ID NO: 142291 - DNA, 12 bp, Homo sapiens
ggccgagaagca

SEQ ID NO: 142292 - DNA, 16 bp, Homo sapiens
ggccgctgttcaccca

SEQ ID NO: 142293 - DNA, 19 bp, Homo sapiens
ggcctcctctgtccagggc

SEQ ID NO: 142294 - DNA, 13 bp, Homo sapiens
ggcctcggagcct

SEQ ID NO: 142295 - DNA, 20 bp, Homo sapiens
ggcctcggtgtggagaagcg

SEQ ID NO: 142296 - DNA, 15 bp, Homo sapiens
ggcctgagcctggcc

SEQ ID NO: 142297 - DNA, 16 bp, Homo sapiens
ggcctgagcctggcca

SEQ ID NO: 142298 - DNA, 21 bp, Homo sapiens
ggcctgcaggacctgcctgta

SEQ ID NO: 142299 - DNA, 20 bp, Homo sapiens
ggcctgctgggctctccacc

SEQ ID NO: 142300 - DNA, 21 bp, Homo sapiens
ggcctgctgggctctccacct

SEQ ID NO: 142301 - DNA, 14 bp, Homo sapiens
ggcctggcagccgt

SEQ ID NO: 142302 - DNA, 14 bp, Homo sapiens
ggccttgcccagag

SEQ ID NO: 142303 - DNA, 15 bp, Homo sapiens
ggccttgcccagaga

SEQ ID NO: 142304 - DNA, 14 bp, Homo sapiens
ggcctttggcttca

SEQ ID NO: 142305 - DNA, 15 bp, Homo sapiens
ggcgagtcactgcct

SEQ ID NO: 142306 - DNA, 14 bp, Homo sapiens
ggcgcccacctccc

SEQ ID NO: 142307 - DNA, 15 bp, Homo sapiens
ggcgcccacctcccc

SEQ ID NO: 142308 - DNA, 22 bp, Homo sapiens
ggcggctactcagcagccctcc

SEQ ID NO: 142309 - DNA, 21 bp, Homo sapiens
gtaattttgttctagttttca

SEQ ID NO: 142310 - DNA, 13 bp, Homo sapiens
gtacaaatataag

SEQ ID NO: 142311 - DNA, 17 bp, Homo sapiens
gtacaaatataagaata

SEQ ID NO: 142312 - DNA, 22 bp, Homo sapiens
gtacaaatataagaataaaatg

SEQ ID NO: 142313 - DNA, 22 bp, Homo sapiens
gtacaataagtgtttttgtatt

SEQ ID NO: 142314 - DNA, 15 bp, Homo sapiens
gtacaggcagcacag

SEQ ID NO: 142315 - DNA, 15 bp, Homo sapiens
gtacaggtaaggtga

SEQ ID NO: 142316 - DNA, 18 bp, Homo sapiens
gtacatatgtaaaataaa

SEQ ID NO: 142317 - DNA, 16 bp, Homo sapiens
gtacatatgtgctgga

SEQ ID NO: 142318 - DNA, 16 bp, Homo sapiens
gtaccagcaatatgta

SEQ ID NO: 142319 - DNA, 13 bp, Homo sapiens
gtacctataaagt

SEQ ID NO: 142320 - DNA, 21 bp, Homo sapiens
gtacctataaagtaaagctaa

SEQ ID NO: 142321 - DNA, 18 bp, Homo sapiens
gtaccttgaacactgggg

SEQ ID NO: 142322 - DNA, 14 bp, Homo sapiens
gtactcctcccagg

SEQ ID NO: 142323 - DNA, 14 bp, Homo sapiens
gtactggcatggta

SEQ ID NO: 142324 - DNA, 15 bp, Homo sapiens
gtagaaactgcaggg

SEQ ID NO: 142325 - DNA, 16 bp, Homo sapiens
gtagaaataatatgca

SEQ ID NO: 142326 - DNA, 17 bp, Homo sapiens
gtagaaataatatgcat

SEQ ID NO: 142327 - DNA, 16 bp, Homo sapiens
gtagagatggaggagg

SEQ ID NO: 142328 - DNA, 15 bp, Homo sapiens
gtagaggagaaactg

SEQ ID NO: 142329 - DNA, 15 bp, Homo sapiens
gtagcattacagtgg

SEQ ID NO: 142330 - DNA, 16 bp, Homo sapiens
gtagcccactctgctc

SEQ ID NO: 142331 - DNA, 14 bp, Homo sapiens
gtagccctttctgt

SEQ ID NO: 142332 - DNA, 21 bp, Homo sapiens
gtagcctcgccgtctgtgaat

SEQ ID NO: 142333 - DNA, 15 bp, Homo sapiens
gtagctgcccctggc

SEQ ID NO: 142334 - DNA, 20 bp, Homo sapiens
gtaggggtcaaagaaatgct

SEQ ID NO: 142335 - DNA, 22 bp, Homo sapiens
gtagggtaattagtaacatgtg

SEQ ID NO: 142336 - DNA, 16 bp, Homo sapiens
gtagggttataataat

SEQ ID NO: 142337 - DNA, 21 bp, Homo sapiens
gtagtagccctttctgtgtgc

SEQ ID NO: 142338 - DNA, 18 bp, Homo sapiens
gtagtagggtcaggccac

SEQ ID NO: 142339 - DNA, 14 bp, Homo sapiens
gtagttaggaaata

SEQ ID NO: 142340 - DNA, 20 bp, Homo sapiens
gtagttaggaaataaaacct

SEQ ID NO: 142341 - DNA, 15 bp, Homo sapiens
gtataaaactttcct

SEQ ID NO: 142342 - DNA, 21 bp, Homo sapiens
gtataaaactttcctcgcctg

SEQ ID NO: 142343 - DNA, 13 bp, Homo sapiens
gtataaactatca

SEQ ID NO: 142344 - DNA, 18 bp, Homo sapiens
gtataagtaagaaaatat

SEQ ID NO: 142345 - DNA, 19 bp, Homo sapiens
gtatagtactggcatggta

SEQ ID NO: 142346 - DNA, 14 bp, Homo sapiens
gtatatatagaatc

SEQ ID NO: 142347 - DNA, 14 bp, Homo sapiens
gtatcaggacccag

SEQ ID NO: 142348 - DNA, 21 bp, Homo sapiens
gtatcaggacccagaggaagg

SEQ ID NO: 142349 - DNA, 18 bp, Homo sapiens
gtatcaggcctgccagac

SEQ ID NO: 142350 - DNA, 22 bp, Homo sapiens
gtatcaggcctgccagacggca

SEQ ID NO: 142351 - DNA, 16 bp, Homo sapiens
gtatccatgggggcag

SEQ ID NO: 142352 - DNA, 17 bp, Homo sapiens
gtatctgcaggcagaca

SEQ ID NO: 142353 - DNA, 23 bp, Homo sapiens
gtatgaaagatggctgtgcctct

SEQ ID NO: 142354 - DNA, 13 bp, Homo sapiens
gtatgttgtcaaa

SEQ ID NO: 142355 - DNA, 15 bp, Homo sapiens
gtattaaaaaaaaca

SEQ ID NO: 142356 - DNA, 19 bp, Homo sapiens
gtattaaaaaaaacaaaaa

SEQ ID NO: 142357 - DNA, 22 bp, Homo sapiens
gtattcgtgcagcatatgagga

SEQ ID NO: 142358 - DNA, 11 bp, Homo sapiens
gtattctctga

SEQ ID NO: 142359 - DNA, 19 bp, Homo sapiens
gtattctctgagctgtgca

SEQ ID NO: 142360 - DNA, 15 bp, Homo sapiens
gtattcttcaacctc

SEQ ID NO: 142361 - DNA, 18 bp, Homo sapiens
gtattttgtattgtttca

SEQ ID NO: 142362 - DNA, 19 bp, Homo sapiens
gtattttgtttttgtctta

SEQ ID NO: 142363 - DNA, 17 bp, Homo sapiens
gtatttttttgcaagtg

SEQ ID NO: 142364 - DNA, 16 bp, Homo sapiens
gtcaaaactcaaatgc

SEQ ID NO: 142365 - DNA, 15 bp, Homo sapiens
gtcaaaaggtgcctg

SEQ ID NO: 142366 - DNA, 16 bp, Homo sapiens
gtcaaaaggtgcctgt

SEQ ID NO: 142367 - DNA, 15 bp, Homo sapiens
gtcaaacaaagccag

SEQ ID NO: 142368 - DNA, 16 bp, Homo sapiens
gtcaaacatgaagtgt

SEQ ID NO: 142369 - DNA, 15 bp, Homo sapiens
gtcaaacgtgaaaat

SEQ ID NO: 142370 - DNA, 13 bp, Homo sapiens
gtcaaagtaaaac

SEQ ID NO: 142371 - DNA, 18 bp, Homo sapiens
gtcaagtgaaaaaggagg

SEQ ID NO: 142372 - DNA, 21 bp, Homo sapiens
gtcaatacagtacaggcagca

SEQ ID NO: 142373 - DNA, 17 bp, Homo sapiens
gtcaatcccctcattca

SEQ ID NO: 142374 - DNA, 15 bp, Homo sapiens
gtcaatcctgtgggt

SEQ ID NO: 142375 - DNA, 16 bp, Homo sapiens
gtcaatcctgtgggtg

SEQ ID NO: 142376 - DNA, 21 bp, Homo sapiens
gtcaattttgttatgtatatt

SEQ ID NO: 142377 - DNA, 21 bp, Homo sapiens
gtcacaaatcctaaaagaagc

SEQ ID NO: 142378 - DNA, 13 bp, Homo sapiens
gtcacaggaagta

SEQ ID NO: 142379 - DNA, 15 bp, Homo sapiens
gtcacaggaagtaga

SEQ ID NO: 142380 - DNA, 20 bp, Homo sapiens
gtcacaggaagtagaggagg

SEQ ID NO: 142381 - DNA, 20 bp, Homo sapiens
gtcacagggcatgccccggc

SEQ ID NO: 142382 - DNA, 12 bp, Homo sapiens
gtcacagggcca

SEQ ID NO: 142383 - DNA, 17 bp, Homo sapiens
gtcaccaagctcacagt

SEQ ID NO: 142384 - DNA, 17 bp, Homo sapiens
gtcaccaccttcccagc

SEQ ID NO: 142385 - DNA, 20 bp, Homo sapiens
gtcaccaccttcccagctct

SEQ ID NO: 142386 - DNA, 15 bp, Homo sapiens
gccggcgagccctgt

SEQ ID NO: 142387 - DNA, 18 bp, Homo sapiens
gccggcgagccctgtgga

SEQ ID NO: 142388 - DNA, 15 bp, Homo sapiens
gccgtgatgcctccc

SEQ ID NO: 142389 - DNA, 15 bp, Homo sapiens
gccgtgccttcagct

SEQ ID NO: 142390 - DNA, 15 bp, Homo sapiens
gccgtggctgcggca

SEQ ID NO: 142391 - DNA, 11 bp, Homo sapiens
gccgtggcttc

SEQ ID NO: 142392 - DNA, 21 bp, Homo sapiens
gccgtggcttcccgctcagcc

SEQ ID NO: 142393 - DNA, 16 bp, Homo sapiens
gccgtggtcctttggg

SEQ ID NO: 142394 - DNA, 20 bp, Homo sapiens
gccgtgtaaccatggaccca

SEQ ID NO: 142395 - DNA, 14 bp, Homo sapiens
gccgttactctcca

SEQ ID NO: 142396 - DNA, 18 bp, Homo sapiens
gccgttactctccaacct

SEQ ID NO: 142397 - DNA, 20 bp, Homo sapiens
gccgttactctccaacctgg

SEQ ID NO: 142398 - DNA, 15 bp, Homo sapiens
gcctagccgacctca

SEQ ID NO: 142399 - DNA, 20 bp, Homo sapiens
gcctagccgacctcagcctt

SEQ ID NO: 142400 - DNA, 19 bp, Homo sapiens
gcctagtgaaggcttctct

SEQ ID NO: 142401 - DNA, 22 bp, Homo sapiens
gcctagtggggtctccctctcc

SEQ ID NO: 142402 - DNA, 22 bp, Homo sapiens
gcctatattttttgttaaatga

SEQ ID NO: 142403 - DNA, 15 bp, Homo sapiens
gcctcagccattcac

SEQ ID NO: 142404 - DNA, 16 bp, Homo sapiens
gcctcagtcctcccct

SEQ ID NO: 142405 - DNA, 22 bp, Homo sapiens
gcctcatccgaggcagggtcag

SEQ ID NO: 142406 - DNA, 22 bp, Homo sapiens
gcctcatgtccactggttcttc

SEQ ID NO: 142407 - DNA, 18 bp, Homo sapiens
gcctccaccccccagaac

SEQ ID NO: 142408 - DNA, 18 bp, Homo sapiens
gcctccaccgctgcctaa

SEQ ID NO: 142409 - DNA, 10 bp, Homo sapiens
gcctcccagc

SEQ ID NO: 142410 - DNA, 12 bp, Homo sapiens
gcctccccacct

SEQ ID NO: 142411 - DNA, 18 bp, Homo sapiens
gcctccccgaaacaggct

SEQ ID NO: 142412 - DNA, 15 bp, Homo sapiens
gcctcccctgctgaa

SEQ ID NO: 142413 - DNA, 13 bp, Homo sapiens
gcctccctcaacc

SEQ ID NO: 142414 - DNA, 15 bp, Homo sapiens
gcctcctcctgacca

SEQ ID NO: 142415 - DNA, 18 bp, Homo sapiens
gcctcggcttttctcagc

SEQ ID NO: 142416 - DNA, 19 bp, Homo sapiens
gcctcggcttttctcagct

SEQ ID NO: 142417 - DNA, 22 bp, Homo sapiens
gcctcgggacacctgccctgcc

SEQ ID NO: 142418 - DNA, 12 bp, Homo sapiens
gcctctcccctg

SEQ ID NO: 142419 - DNA, 16 bp, Homo sapiens
gcctctgacccctcct

SEQ ID NO: 142420 - DNA, 17 bp, Homo sapiens
gcctctgacccctcctc

SEQ ID NO: 142421 - DNA, 18 bp, Homo sapiens
gcctctgacccctcctca

SEQ ID NO: 142422 - DNA, 20 bp, Homo sapiens
gcctctgacccctcctcact

SEQ ID NO: 142423 - DNA, 21 bp, Homo sapiens
gcctctgacccctcctcactg

SEQ ID NO: 142424 - DNA, 12 bp, Homo sapiens
gcctctgcattc

SEQ ID NO: 142425 - DNA, 23 bp, Homo sapiens
gcctctgccaaaggatgtgatat

SEQ ID NO: 142426 - DNA, 12 bp, Homo sapiens
gcctctgcctgt

SEQ ID NO: 142427 - DNA, 13 bp, Homo sapiens
gcctctgcctgtc

SEQ ID NO: 142428 - DNA, 12 bp, Homo sapiens
gcctctgctggc

SEQ ID NO: 142429 - DNA, 19 bp, Homo sapiens
gcctcttaaagctgcctgt

SEQ ID NO: 142430 - DNA, 20 bp, Homo sapiens
gcctcttaaagctgcctgta

SEQ ID NO: 142431 - DNA, 19 bp, Homo sapiens
gcctcttagacttctgctt

SEQ ID NO: 142432 - DNA, 12 bp, Homo sapiens
gcctcttcctcc

SEQ ID NO: 142433 - DNA, 23 bp, Homo sapiens
gcctcttctctactctagggaaa

SEQ ID NO: 142434 - DNA, 14 bp, Homo sapiens
gcctcttctgggag

SEQ ID NO: 142435 - DNA, 23 bp, Homo sapiens
gcctctttcatccactagtgcaa

SEQ ID NO: 142436 - DNA, 23 bp, Homo sapiens
gcctgaaagaggctgaggcctgg

SEQ ID NO: 142437 - DNA, 17 bp, Homo sapiens
gcctgaaaggagccctt

SEQ ID NO: 142438 - DNA, 14 bp, Homo sapiens
gcctgaaccttcca

SEQ ID NO: 142439 - DNA, 15 bp, Homo sapiens
gcctgaaccttccat

SEQ ID NO: 142440 - DNA, 16 bp, Homo sapiens
gcctgagcctggccag

SEQ ID NO: 142441 - DNA, 17 bp, Homo sapiens
gcctgagcgacagtgag

SEQ ID NO: 142442 - DNA, 21 bp, Homo sapiens
gcctgatccagcctctcccct

SEQ ID NO: 142443 - DNA, 17 bp, Homo sapiens
gcctgcaaacgctgcct

SEQ ID NO: 142444 - DNA, 21 bp, Homo sapiens
gcctgcaaacgctgcctgccc

SEQ ID NO: 142445 - DNA, 13 bp, Homo sapiens
gcctgcattctgc

SEQ ID NO: 142446 - DNA, 15 bp, Homo sapiens
gcctgcccctcccag

SEQ ID NO: 142447 - DNA, 16 bp, Homo sapiens
gcctgccggtaaacac

SEQ ID NO: 142448 - DNA, 17 bp, Homo sapiens
gcctgcggcctgctgga

SEQ ID NO: 142449 - DNA, 13 bp, Homo sapiens
gcctgctccagct

SEQ ID NO: 142450 - DNA, 16 bp, Homo sapiens
gcctgctcccccaccc

SEQ ID NO: 142451 - DNA, 23 bp, Homo sapiens
gcctgctgaatgatttccaaaga

SEQ ID NO: 142452 - DNA, 18 bp, Homo sapiens
tgcacacccactcagctc

SEQ ID NO: 142453 - DNA, 21 bp, Homo sapiens
tgcacactcccctgcactgga

SEQ ID NO: 142454 - DNA, 15 bp, Homo sapiens
tgcacagtgcatctc

SEQ ID NO: 142455 - DNA, 19 bp, Homo sapiens
tgcacagtgcatctcagcc

SEQ ID NO: 142456 - DNA, 15 bp, Homo sapiens
tgcacatctgtgtct

SEQ ID NO: 142457 - DNA, 16 bp, Homo sapiens
tgcacatctgtgtctt

SEQ ID NO: 142458 - DNA, 19 bp, Homo sapiens
tgcacatctgtgtcttgtt

SEQ ID NO: 142459 - DNA, 13 bp, Homo sapiens
tgcacatgtgtgc

SEQ ID NO: 142460 - DNA, 19 bp, Homo sapiens
tgcacatgtgtgcgtgtgc

SEQ ID NO: 142461 - DNA, 22 bp, Homo sapiens
tgcaccaagcaggaaatgaaaa

SEQ ID NO: 142462 - DNA, 21 bp, Homo sapiens
tgcaccactgcactccagcct

SEQ ID NO: 142463 - DNA, 20 bp, Homo sapiens
tgcaccccaaagctttcctg

SEQ ID NO: 142464 - DNA, 19 bp, Homo sapiens
tgcacctccccccactgca

SEQ ID NO: 142465 - DNA, 11 bp, Homo sapiens
tgcacctgcat

SEQ ID NO: 142466 - DNA, 18 bp, Homo sapiens
tgcaccttaccaactttc

SEQ ID NO: 142467 - DNA, 19 bp, Homo sapiens
tgcaccttaccaactttct

SEQ ID NO: 142468 - DNA, 19 bp, Homo sapiens
tgcacgtagtagggtcagg

SEQ ID NO: 142469 - DNA, 14 bp, Homo sapiens
tgcacgtggcctct

SEQ ID NO: 142470 - DNA, 15 bp, Homo sapiens
tgcacgtggcctctt

SEQ ID NO: 142471 - DNA, 17 bp, Homo sapiens
tgcacgtggcctcttga

SEQ ID NO: 142472 - DNA, 19 bp, Homo sapiens
tgcacgtggcctcttgagc

SEQ ID NO: 142473 - DNA, 14 bp, Homo sapiens
tgcactactgacat

SEQ ID NO: 142474 - DNA, 22 bp, Homo sapiens
tgcactgatatatcatgagtga

SEQ ID NO: 142475 - DNA, 13 bp, Homo sapiens
tgcactgttcccc

SEQ ID NO: 142476 - DNA, 23 bp, Homo sapiens
tgcactgttccccctgtgcagcc

SEQ ID NO: 142477 - DNA, 18 bp, Homo sapiens
tgcagaaaagcacctgcc

SEQ ID NO: 142478 - DNA, 22 bp, Homo sapiens
tgcagaaggaaaaatgtgtaat

SEQ ID NO: 142479 - DNA, 13 bp, Homo sapiens
tgcagactggagg

SEQ ID NO: 142480 - DNA, 14 bp, Homo sapiens
tgcagactggaggg

SEQ ID NO: 142481 - DNA, 17 bp, Homo sapiens
tgcagactggaggggac

SEQ ID NO: 142482 - DNA, 20 bp, Homo sapiens
tgcagagacaggacctgact

SEQ ID NO: 142483 - DNA, 14 bp, Homo sapiens
tgcagagtcagcag

SEQ ID NO: 142484 - DNA, 15 bp, Homo sapiens
tgcagagtcagcaga

SEQ ID NO: 142485 - DNA, 14 bp, Homo sapiens
tgcagagtgcccag

SEQ ID NO: 142486 - DNA, 17 bp, Homo sapiens
tgcagcatatgaggatg

SEQ ID NO: 142487 - DNA, 12 bp, Homo sapiens
tgcagccagccc

SEQ ID NO: 142488 - DNA, 14 bp, Homo sapiens
tgcagccagcccag

SEQ ID NO: 142489 - DNA, 16 bp, Homo sapiens
tgcagccagcccagcc

SEQ ID NO: 142490 - DNA, 17 bp, Homo sapiens
tgcagccagcccagccc

SEQ ID NO: 142491 - DNA, 19 bp, Homo sapiens
tgcagccagcccagcccag

SEQ ID NO: 142492 - DNA, 22 bp, Homo sapiens
tgcagccagcccagcccagctg

SEQ ID NO: 142493 - DNA, 16 bp, Homo sapiens
tgcagcctcctcctga

SEQ ID NO: 142494 - DNA, 19 bp, Homo sapiens
tgcagcctcctcctgacca

SEQ ID NO: 142495 - DNA, 15 bp, Homo sapiens
tgcagcctggaggcc

SEQ ID NO: 142496 - DNA, 19 bp, Homo sapiens
tgcagctgagagaaaataa

SEQ ID NO: 142497 - DNA, 18 bp, Homo sapiens
tgcaggacctcaggtgag

SEQ ID NO: 142498 - DNA, 14 bp, Homo sapiens
tgcaggcagacacg

SEQ ID NO: 142499 - DNA, 13 bp, Homo sapiens
tgcaggggctctg

SEQ ID NO: 142500 - DNA, 21 bp, Homo sapiens
tgcaggggctctggagagaaa

SEQ ID NO: 142501 - DNA, 18 bp, Homo sapiens
tgcagtactttacctcct

SEQ ID NO: 142502 - DNA, 15 bp, Homo sapiens
tgcagtatgaaaata

SEQ ID NO: 142503 - DNA, 17 bp, Homo sapiens
tgcataagttaacttcc

SEQ ID NO: 142504 - DNA, 20 bp, Homo sapiens
tgcatagtaccaatcatttt

SEQ ID NO: 142505 - DNA, 22 bp, Homo sapiens
tgcatcaatttttcttatttca

SEQ ID NO: 142506 - DNA, 13 bp, Homo sapiens
tgcatcagctgct

SEQ ID NO: 142507 - DNA, 14 bp, Homo sapiens
tgcatccattcctc

SEQ ID NO: 142508 - DNA, 16 bp, Homo sapiens
tgcatccattcctcag

SEQ ID NO: 142509 - DNA, 17 bp, Homo sapiens
tgcatccattcctcagg

SEQ ID NO: 142510 - DNA, 18 bp, Homo sapiens
tgcatccattcctcaggg

SEQ ID NO: 142511 - DNA, 16 bp, Homo sapiens
tgcatccccttggctg

SEQ ID NO: 142512 - DNA, 20 bp, Homo sapiens
tgcatccgtagttccctgaa

SEQ ID NO: 142513 - DNA, 18 bp, Homo sapiens
tgcatcgagtcaaaactc

SEQ ID NO: 142514 - DNA, 13 bp, Homo sapiens
tgcatctccacct

SEQ ID NO: 142515 - DNA, 19 bp, Homo sapiens
tgcatgcactgttccccct

SEQ ID NO: 142516 - DNA, 15 bp, Homo sapiens
tgcatggaaacctga

SEQ ID NO: 142517 - DNA, 17 bp, Homo sapiens
tgcatggtttagaaagc

SEQ ID NO: 142518 - DNA, 11 bp, Homo sapiens
tgcatgtgtgt

SEQ ID NO: 142519 - DNA, 14 bp, Homo sapiens
tgcatgtgtgtgct

SEQ ID NO: 142520 - DNA, 22 bp, Homo sapiens
tgcatgttaggaaaatttcaca

SEQ ID NO: 142521 - DNA, 13 bp, Homo sapiens
tgcattagaaatt

SEQ ID NO: 142522 - DNA, 16 bp, Homo sapiens
tgcattcacccagaca

SEQ ID NO: 142523 - DNA, 21 bp, Homo sapiens
tgcattcttttaaaagacaag

SEQ ID NO: 142524 - DNA, 22 bp, Homo sapiens
tgcattcttttaaaagacaaga

SEQ ID NO: 142525 - DNA, 16 bp, Homo sapiens
tgcatttaaatacagt

SEQ ID NO: 142526 - DNA, 19 bp, Homo sapiens
tgccaaaatcattttaatg

SEQ ID NO: 142527 - DNA, 16 bp, Homo sapiens
tgccaaaggatgtgat

SEQ ID NO: 142528 - DNA, 17 bp, Homo sapiens
tgccaaaggatgtgata

SEQ ID NO: 142529 - DNA, 14 bp, Homo sapiens
tgccaaagggaaat

SEQ ID NO: 142530 - DNA, 16 bp, Homo sapiens
tgccaaatatgtcctg

SEQ ID NO: 142531 - DNA, 17 bp, Homo sapiens
tgccaaatatgtcctgg

SEQ ID NO: 142532 - DNA, 13 bp, Homo sapiens
tgccacaccctcc

SEQ ID NO: 142533 - DNA, 16 bp, Homo sapiens
tgccacacgtctgacc

SEQ ID NO: 142534 - DNA, 16 bp, Homo sapiens
tgccacacttcaggct

SEQ ID NO: 142535 - DNA, 22 bp, Homo sapiens
tgccacagcctcccctgccagg

SEQ ID NO: 142536 - DNA, 23 bp, Homo sapiens
tgccaccagagaccgtcctcacc

SEQ ID NO: 142537 - DNA, 13 bp, Homo sapiens
tgccacctcccct

SEQ ID NO: 142538 - DNA, 17 bp, Homo sapiens
tgccacctcccctatcc

SEQ ID NO: 142539 - DNA, 13 bp, Homo sapiens
tgccagacatgtg

SEQ ID NO: 142540 - DNA, 23 bp, Homo sapiens
tgccagcaatgacatctcagggg

SEQ ID NO: 142541 - DNA, 17 bp, Homo sapiens
tgccagccagcagccag

SEQ ID NO: 142542 - DNA, 18 bp, Homo sapiens
tgccagcttatctcaggg

SEQ ID NO: 142543 - DNA, 10 bp, Homo sapiens
tgccaggcat

SEQ ID NO: 142544 - DNA, 14 bp, Homo sapiens
tgccaggcccgggg

SEQ ID NO: 142545 - DNA, 11 bp, Homo sapiens
tgccagggcag

SEQ ID NO: 142546 - DNA, 16 bp, Homo sapiens
tgccagggcagggccc

SEQ ID NO: 142547 - DNA, 18 bp, Homo sapiens
tgccagtaacgcgtcttc

SEQ ID NO: 142548 - DNA, 22 bp, Homo sapiens
tgccagtaacgcgtcttcctga

SEQ ID NO: 142549 - DNA, 17 bp, Homo sapiens
tgccagtccccctgccc

SEQ ID NO: 142550 - DNA, 19 bp, Homo sapiens
tgccagtccccctgcccca

SEQ ID NO: 142551 - DNA, 20 bp, Homo sapiens
tgccagtccccctgccccag

SEQ ID NO: 142552 - DNA, 11 bp, Homo sapiens
tgccagtgcct

SEQ ID NO: 142553 - DNA, 15 bp, Homo sapiens
tgccagtgccttacc

SEQ ID NO: 142554 - DNA, 23 bp, Homo sapiens
tgccagtgccttacctcctgccc

SEQ ID NO: 142555 - DNA, 17 bp, Homo sapiens
tgccagttatggctata

SEQ ID NO: 142556 - DNA, 14 bp, Homo sapiens
tgccataaaacatt

SEQ ID NO: 142557 - DNA, 16 bp, Homo sapiens
tgccataaaacattaa

SEQ ID NO: 142558 - DNA, 21 bp, Homo sapiens
tgccataaaacattaagaaaa

SEQ ID NO: 142559 - DNA, 22 bp, Homo sapiens
tgccataaaacattaagaaaat

SEQ ID NO: 142560 - DNA, 20 bp, Homo sapiens
tgccatagagtttaacacaa

SEQ ID NO: 142561 - DNA, 14 bp, Homo sapiens
tgccatattttcac

SEQ ID NO: 142562 - DNA, 21 bp, Homo sapiens
tgcccaagaatagatgctgac

SEQ ID NO: 142563 - DNA, 23 bp, Homo sapiens
tgcccaagaatagatgctgactg

SEQ ID NO: 142564 - DNA, 22 bp, Homo sapiens
tgcccaagttgtggtgctgaca

SEQ ID NO: 142565 - DNA, 11 bp, Homo sapiens
tgcccagagat

SEQ ID NO: 142566 - DNA, 16 bp, Homo sapiens
tgcccagagatgcctc

SEQ ID NO: 142567 - DNA, 18 bp, Homo sapiens
tgcccagagatgcctcca

SEQ ID NO: 142568 - DNA, 22 bp, Homo sapiens
tgcccagagatgcctccaccgc

SEQ ID NO: 142569 - DNA, 15 bp, Homo sapiens
tgcccagagatggga

SEQ ID NO: 142570 - DNA, 17 bp, Homo sapiens
tgcccagatcccagaag

SEQ ID NO: 142571 - DNA, 22 bp, Homo sapiens
tgcccagatcccagaaggacct

SEQ ID NO: 142572 - DNA, 21 bp, Homo sapiens
tgcccagctatacctgtgcct

SEQ ID NO: 142573 - DNA, 20 bp, Homo sapiens
tcccaccccacccccttcag

SEQ ID NO: 142574 - DNA, 20 bp, Homo sapiens
tcccacctctgtgacctcag

SEQ ID NO: 142575 - DNA, 21 bp, Homo sapiens
tcccacctctgtgacctcagg

SEQ ID NO: 142576 - DNA, 22 bp, Homo sapiens
tcccacctctgtgacctcaggc

SEQ ID NO: 142577 - DNA, 20 bp, Homo sapiens
tcccacgaatttgctgggga

SEQ ID NO: 142578 - DNA, 14 bp, Homo sapiens
tcccacgtgggaga

SEQ ID NO: 142579 - DNA, 17 bp, Homo sapiens
tcccagaacacactcca

SEQ ID NO: 142580 - DNA, 20 bp, Homo sapiens
tcccagagacaggaaaatcc

SEQ ID NO: 142581 - DNA, 18 bp, Homo sapiens
tcccagcactttgggagg

SEQ ID NO: 142582 - DNA, 14 bp, Homo sapiens
tcccagctactcag

SEQ ID NO: 142583 - DNA, 16 bp, Homo sapiens
tcccagctactcagga

SEQ ID NO: 142584 - DNA, 18 bp, Homo sapiens
tcccagctacttgggagg

SEQ ID NO: 142585 - DNA, 21 bp, Homo sapiens
tcccagctctccctctggccc

SEQ ID NO: 142586 - DNA, 16 bp, Homo sapiens
tcccaggcgccccttc

SEQ ID NO: 142587 - DNA, 18 bp, Homo sapiens
tcccaggcgccccttccc

SEQ ID NO: 142588 - DNA, 21 bp, Homo sapiens
tcccaggcgccccttccccct

SEQ ID NO: 142589 - DNA, 22 bp, Homo sapiens
tcccagtcaccttgtggcaagc

SEQ ID NO: 142590 - DNA, 14 bp, Homo sapiens
tcccatcactggag

SEQ ID NO: 142591 - DNA, 16 bp, Homo sapiens
tcccatcccagctgaa

SEQ ID NO: 142592 - DNA, 13 bp, Homo sapiens
tcccatcccctgg

SEQ ID NO: 142593 - DNA, 20 bp, Homo sapiens
tcccatggacactccagtgc

SEQ ID NO: 142594 - DNA, 15 bp, Homo sapiens
tcctcgcaagctggg

SEQ ID NO: 142595 - DNA, 13 bp, Homo sapiens
tcctcgccctggg

SEQ ID NO: 142596 - DNA, 14 bp, Homo sapiens
tcctcgccctgggt

SEQ ID NO: 142597 - DNA, 15 bp, Homo sapiens
tcctcgcctgacaac

SEQ ID NO: 142598 - DNA, 19 bp, Homo sapiens
tcctcggccccctccatcg

SEQ ID NO: 142599 - DNA, 19 bp, Homo sapiens
tcctctactaacaatcagc

SEQ ID NO: 142600 - DNA, 17 bp, Homo sapiens
tcctctcccctctaagg

SEQ ID NO: 142601 - DNA, 15 bp, Homo sapiens
tcctctgactcaggg

SEQ ID NO: 142602 - DNA, 17 bp, Homo sapiens
tcctctgactcagggct

SEQ ID NO: 142603 - DNA, 14 bp, Homo sapiens
tcctctgccacctc

SEQ ID NO: 142604 - DNA, 15 bp, Homo sapiens
tcctctgccacctcc

SEQ ID NO: 142605 - DNA, 23 bp, Homo sapiens
tcctctgtccagggccctgagct

SEQ ID NO: 142606 - DNA, 19 bp, Homo sapiens
tcctctgtgaccaatgtct

SEQ ID NO: 142607 - DNA, 19 bp, Homo sapiens
tcctcttgccactgcctct

SEQ ID NO: 142608 - DNA, 20 bp, Homo sapiens
tcctgaacctgatgctgact

SEQ ID NO: 142609 - DNA, 24 bp, Homo sapiens
tcctgagaaaaaaggttccgcttg

SEQ ID NO: 142610 - DNA, 15 bp, Homo sapiens
tcctgagtggtgcca

SEQ ID NO: 142611 - DNA, 19 bp, Homo sapiens
tcctgataataattgatca

SEQ ID NO: 142612 - DNA, 17 bp, Homo sapiens
tcctgcaactcaaggac

SEQ ID NO: 142613 - DNA, 18 bp, Homo sapiens
tcctgcagcctcctcctg

SEQ ID NO: 142614 - DNA, 22 bp, Homo sapiens
tcctgcagcctcctcctgacca

SEQ ID NO: 142615 - DNA, 16 bp, Homo sapiens
tcctgcattcacccag

SEQ ID NO: 142616 - DNA, 22 bp, Homo sapiens
tcctgcattcacccagacagct

SEQ ID NO: 142617 - DNA, 16 bp, Homo sapiens
tcctgcatttgtgaaa

SEQ ID NO: 142618 - DNA, 13 bp, Homo sapiens
tcctgccacctgc

SEQ ID NO: 142619 - DNA, 13 bp, Homo sapiens
tcctgccaggcat

SEQ ID NO: 142620 - DNA, 12 bp, Homo sapiens
tcctgcccagga

SEQ ID NO: 142621 - DNA, 14 bp, Homo sapiens
tcctgcccaggaga

SEQ ID NO: 142622 - DNA, 16 bp, Homo sapiens
tcctgcccaggagagc

SEQ ID NO: 142623 - DNA, 19 bp, Homo sapiens
tcctgcccaggagagccag

SEQ ID NO: 142624 - DNA, 20 bp, Homo sapiens
tcctgcctgtctcctttgca

SEQ ID NO: 142625 - DNA, 14 bp, Homo sapiens
tcctgccttcctcc

SEQ ID NO: 142626 - DNA, 22 bp, Homo sapiens
tcctgccttcctcctgggccct

SEQ ID NO: 142627 - DNA, 20 bp, Homo sapiens
tcctgcgggcttttccccgg

SEQ ID NO: 142628 - DNA, 23 bp, Homo sapiens
tcctgcgggcttttccccggtcc

SEQ ID NO: 142629 - DNA, 19 bp, Homo sapiens
tcctgctacaacttcagca

SEQ ID NO: 142630 - DNA, 20 bp, Homo sapiens
tcctgctacaacttcagcag

SEQ ID NO: 142631 - DNA, 21 bp, Homo sapiens
tcctggacatgaagattcttt

SEQ ID NO: 142632 - DNA, 17 bp, Homo sapiens
tcctggcccactgcatc

SEQ ID NO: 142633 - DNA, 21 bp, Homo sapiens
tcctgggccctctctgctctg

SEQ ID NO: 142634 - DNA, 21 bp, Homo sapiens
tcctgggtggtctgcaggcag

SEQ ID NO: 142635 - DNA, 22 bp, Homo sapiens
tcctgggttttgtattctctga

SEQ ID NO: 142636 - DNA, 20 bp, Homo sapiens
tcctgtacattgtgggatgt

SEQ ID NO: 142637 - DNA, 20 bp, Homo sapiens
tcctgtccaacctaacccct

SEQ ID NO: 142638 - DNA, 21 bp, Homo sapiens
tcctgtcccttctcttaattt

SEQ ID NO: 142639 - DNA, 22 bp, Homo sapiens
tcctgtccttctctcacctcct

SEQ ID NO: 142640 - DNA, 16 bp, Homo sapiens
tcctgtctgccagcca

SEQ ID NO: 142641 - DNA, 22 bp, Homo sapiens
tcctgtctgccagccagcagcc

SEQ ID NO: 142642 - DNA, 15 bp, Homo sapiens
tcctgtcttcctgca

SEQ ID NO: 142643 - DNA, 17 bp, Homo sapiens
tcctgtttttctgggtg

SEQ ID NO: 142644 - DNA, 14 bp, Homo sapiens
tccttacccatctg

SEQ ID NO: 142645 - DNA, 18 bp, Homo sapiens
tccttacccatctgcacc

SEQ ID NO: 142646 - DNA, 23 bp, Homo sapiens
tccttagcttagacctcagcctg

SEQ ID NO: 142647 - DNA, 20 bp, Homo sapiens
tccttccaacaggagctggg

SEQ ID NO: 142648 - DNA, 12 bp, Homo sapiens
tccttccctggc

SEQ ID NO: 142649 - DNA, 12 bp, Homo sapiens
tccttcctgtct

SEQ ID NO: 142650 - DNA, 19 bp, Homo sapiens
tccttcctgtcttcctgca

SEQ ID NO: 142651 - DNA, 16 bp, Homo sapiens
tccttccttccctggc

SEQ ID NO: 142652 - DNA, 16 bp, Homo sapiens
tccttccttgaccagc

SEQ ID NO: 142653 - DNA, 14 bp, Homo sapiens
tccttgcacccctc

SEQ ID NO: 142654 - DNA, 20 bp, Homo sapiens
tccttgcacccctcactctg

SEQ ID NO: 142655 - DNA, 21 bp, Homo sapiens
tccttgcacccctcactctgg

SEQ ID NO: 142656 - DNA, 14 bp, Homo sapiens
tccttgcacctgca

SEQ ID NO: 142657 - DNA, 17 bp, Homo sapiens
tccttggcatgccttcc

SEQ ID NO: 142658 - DNA, 18 bp, Homo sapiens
tccttggcatgccttcca

SEQ ID NO: 142659 - DNA, 16 bp, Homo sapiens
tccttgggccctttga

SEQ ID NO: 142660 - DNA, 14 bp, Homo sapiens
tccttggggcaggc

SEQ ID NO: 142661 - DNA, 15 bp, Homo sapiens
tccttgtatttaaat

SEQ ID NO: 142662 - DNA, 16 bp, Homo sapiens
tcctttccccagccca

SEQ ID NO: 142663 - DNA, 20 bp, Homo sapiens
tcctttccccagcccagggt

SEQ ID NO: 142664 - DNA, 13 bp, Homo sapiens
tcctttccctcca

SEQ ID NO: 142665 - DNA, 14 bp, Homo sapiens
tcctttccctccac

SEQ ID NO: 142666 - DNA, 15 bp, Homo sapiens
tcctttgaagaggaa

SEQ ID NO: 142667 - DNA, 19 bp, Homo sapiens
tcctttgtttttttttcct

SEQ ID NO: 142668 - DNA, 14 bp, Homo sapiens
tccttttatgttat

SEQ ID NO: 142669 - DNA, 15 bp, Homo sapiens
tccttttatgttatt

SEQ ID NO: 142670 - DNA, 18 bp, Homo sapiens
tcgagaccaacctgacca

SEQ ID NO: 142671 - DNA, 21 bp, Homo sapiens
tcgagcagtcctgcctcagcc

SEQ ID NO: 142672 - DNA, 18 bp, Homo sapiens
tcgaggcccagcgacctc

SEQ ID NO: 142673 - DNA, 17 bp, Homo sapiens
tcgattttgtatctgca

SEQ ID NO: 142674 - DNA, 12 bp, Homo sapiens
tcgcacctacca

SEQ ID NO: 142675 - DNA, 18 bp, Homo sapiens
tcgcacctaccatcaggg

SEQ ID NO: 142676 - DNA, 18 bp, Homo sapiens
tcgccacccctccttcct

SEQ ID NO: 142677 - DNA, 15 bp, Homo sapiens
tcgccgtctgtgaat

SEQ ID NO: 142678 - DNA, 14 bp, Homo sapiens
tcgccgtggctgcg

SEQ ID NO: 142679 - DNA, 22 bp, Homo sapiens
tcgccttagcactaccactcct

SEQ ID NO: 142680 - DNA, 22 bp, Homo sapiens
tcgctggactctcagtctctga

SEQ ID NO: 142681 - DNA, 23 bp, Homo sapiens
tcgctgtgtcagcatagaagtaa

SEQ ID NO: 142682 - DNA, 17 bp, Homo sapiens
tcgcttcccccatagcc

SEQ ID NO: 142683 - DNA, 16 bp, Homo sapiens
tcggagaagagctgtt

SEQ ID NO: 142684 - DNA, 17 bp, Homo sapiens
tcggagtatctgggaac

SEQ ID NO: 142685 - DNA, 19 bp, Homo sapiens
tcggagtatctgggaactg

SEQ ID NO: 142686 - DNA, 20 bp, Homo sapiens
tcggatctggggctctggga

SEQ ID NO: 142687 - DNA, 16 bp, Homo sapiens
tcggcccacagctccc

SEQ ID NO: 142688 - DNA, 23 bp, Homo sapiens
tcggcccacagctcccaccccac

SEQ ID NO: 142689 - DNA, 17 bp, Homo sapiens
tcggcttttctcagctg

SEQ ID NO: 142690 - DNA, 19 bp, Homo sapiens
tcgggacacctgccctgcc

SEQ ID NO: 142691 - DNA, 15 bp, Homo sapiens
tcggttccacgtccc

SEQ ID NO: 142692 - DNA, 14 bp, Homo sapiens
tcgtcctccccctg

SEQ ID NO: 142693 - DNA, 19 bp, Homo sapiens
tcgtgcagcatatgaggat

SEQ ID NO: 142694 - DNA, 18 bp, Homo sapiens
tcgtgcggaatcagcttc

SEQ ID NO: 142695 - DNA, 21 bp, Homo sapiens
tcgtggcagataatcagcctc

SEQ ID NO: 142696 - DNA, 13 bp, Homo sapiens
tctaaacattaat

SEQ ID NO: 142697 - DNA, 13 bp, Homo sapiens
tctaaatgaagtg

SEQ ID NO: 142698 - DNA, 12 bp, Homo sapiens
tctaacaagtca

SEQ ID NO: 142699 - DNA, 23 bp, Homo sapiens
tctaagtaaaaccacagcagttg

SEQ ID NO: 142700 - DNA, 16 bp, Homo sapiens
tctaatttttaagcaa

SEQ ID NO: 142701 - DNA, 17 bp, Homo sapiens
tctacactccagtgaga

SEQ ID NO: 142702 - DNA, 16 bp, Homo sapiens
tctaccagactgtgta

SEQ ID NO: 142703 - DNA, 21 bp, Homo sapiens
tctacccaaaggatactgtaa

SEQ ID NO: 142704 - DNA, 15 bp, Homo sapiens
tctacgctctccttt

SEQ ID NO: 142705 - DNA, 16 bp, Homo sapiens
tctacgctctcctttc

SEQ ID NO: 142706 - DNA, 17 bp, Homo sapiens
tctacgctctcctttct

SEQ ID NO: 142707 - DNA, 21 bp, Homo sapiens
tctagattaccccctcattgt

SEQ ID NO: 142708 - DNA, 17 bp, Homo sapiens
tctaggagctgggagga

SEQ ID NO: 142709 - DNA, 12 bp, Homo sapiens
tctagggaaaaa

SEQ ID NO: 142710 - DNA, 20 bp, Homo sapiens
tctaggtaggggcccacttc

SEQ ID NO: 142711 - DNA, 14 bp, Homo sapiens
tctaggttctaaaa

SEQ ID NO: 142712 - DNA, 16 bp, Homo sapiens
tctatagactctagga

SEQ ID NO: 142713 - DNA, 15 bp, Homo sapiens
tctatcaatagtcaa

SEQ ID NO: 142714 - DNA, 16 bp, Homo sapiens
tctatcctacaacaag

SEQ ID NO: 142715 - DNA, 13 bp, Homo sapiens
tctattgaaaaat

SEQ ID NO: 142716 - DNA, 12 bp, Homo sapiens
tctatttaatat

SEQ ID NO: 142717 - DNA, 13 bp, Homo sapiens
tctatttaatatt

SEQ ID NO: 142718 - DNA, 15 bp, Homo sapiens
tctatttatttactg

SEQ ID NO: 142719 - DNA, 17 bp, Homo sapiens
tctcaaaactgcactgt

SEQ ID NO: 142720 - DNA, 14 bp, Homo sapiens
tctcaaactggggc

SEQ ID NO: 142721 - DNA, 21 bp, Homo sapiens
tctcaaatttggattgctaat

SEQ ID NO: 142722 - DNA, 19 bp, Homo sapiens
tctcaagagggcactggtg

SEQ ID NO: 142723 - DNA, 12 bp, Homo sapiens
tctcactccacc

SEQ ID NO: 142724 - DNA, 15 bp, Homo sapiens
tctcactccaccacc

SEQ ID NO: 142725 - DNA, 18 bp, Homo sapiens
tctcactcctacctggta

SEQ ID NO: 142726 - DNA, 20 bp, Homo sapiens
tctcactgccatgccagctt

SEQ ID NO: 142727 - DNA, 20 bp, Homo sapiens
tctcagaatctacccaaagg

SEQ ID NO: 142728 - DNA, 11 bp, Homo sapiens
tctcagcctcc

SEQ ID NO: 142729 - DNA, 14 bp, Homo sapiens
tctcaggaaatcaa

SEQ ID NO: 142730 - DNA, 21 bp, Homo sapiens
tctcaggacctagggatgttc

SEQ ID NO: 142731 - DNA, 22 bp, Homo sapiens
tctcaggatcccctctcttcct

SEQ ID NO: 142732 - DNA, 15 bp, Homo sapiens
tctcaggctctgccc

SEQ ID NO: 142733 - DNA, 23 bp, Homo sapiens
tgcttgtttgctcacctggggtg

SEQ ID NO: 142734 - DNA, 20 bp, Homo sapiens
tgctttccacacctggcact

SEQ ID NO: 142735 - DNA, 18 bp, Homo sapiens
tgctttcgaactgctagt

SEQ ID NO: 142736 - DNA, 18 bp, Homo sapiens
tgggaccctttccttcct

SEQ ID NO: 142737 - DNA, 23 bp, Homo sapiens
tgggacctcagttttatcatttt

SEQ ID NO: 142738 - DNA, 16 bp, Homo sapiens
tgggactgggagggcc

SEQ ID NO: 142739 - DNA, 18 bp, Homo sapiens
tgggactgggagggccca

SEQ ID NO: 142740 - DNA, 14 bp, Homo sapiens
tgggagacatgtga

SEQ ID NO: 142741 - DNA, 16 bp, Homo sapiens
tgggagacatgtgaca

SEQ ID NO: 142742 - DNA, 13 bp, Homo sapiens
tgggagcaggaga

SEQ ID NO: 142743 - DNA, 22 bp, Homo sapiens
tgggagcaggagattgagaagg

SEQ ID NO: 142744 - DNA, 23 bp, Homo sapiens
tgggagcaggagattgagaagga

SEQ ID NO: 142745 - DNA, 23 bp, Homo sapiens
tgggagccgggtctgcctcttct

SEQ ID NO: 142746 - DNA, 20 bp, Homo sapiens
tgggagcttgattctcagca

SEQ ID NO: 142747 - DNA, 20 bp, Homo sapiens
tgggaggaaaagaaaagagg

SEQ ID NO: 142748 - DNA, 16 bp, Homo sapiens
tgggaggatctcttga

SEQ ID NO: 142749 - DNA, 20 bp, Homo sapiens
tgggaggatctcttgagcct

SEQ ID NO: 142750 - DNA, 20 bp, Homo sapiens
tgggaggattctatgaggca

SEQ ID NO: 142751 - DNA, 16 bp, Homo sapiens
tgggaggccccactgg

SEQ ID NO: 142752 - DNA, 18 bp, Homo sapiens
tgggaggccccactgggg

SEQ ID NO: 142753 - DNA, 13 bp, Homo sapiens
tgggaggctcacc

SEQ ID NO: 142754 - DNA, 19 bp, Homo sapiens
tgggaggctgagatgggag

SEQ ID NO: 142755 - DNA, 17 bp, Homo sapiens
tgggagggagcagacag

SEQ ID NO: 142756 - DNA, 17 bp, Homo sapiens
tgggagggcagcagggc

SEQ ID NO: 142757 - DNA, 13 bp, Homo sapiens
tgggatggaggag

SEQ ID NO: 142758 - DNA, 16 bp, Homo sapiens
tgggatggaggagaag

SEQ ID NO: 142759 - DNA, 17 bp, Homo sapiens
tgggatggtggagggcc

SEQ ID NO: 142760 - DNA, 19 bp, Homo sapiens
tgggatgtccacagatgcc

SEQ ID NO: 142761 - DNA, 15 bp, Homo sapiens
tgggcactgggatga

SEQ ID NO: 142762 - DNA, 21 bp, Homo sapiens
tgggcatactaataaagtatg

SEQ ID NO: 142763 - DNA, 14 bp, Homo sapiens
tgggccaggacagg

SEQ ID NO: 142764 - DNA, 16 bp, Homo sapiens
tgggccctctctgctc

SEQ ID NO: 142765 - DNA, 13 bp, Homo sapiens
tgggccctttgag

SEQ ID NO: 142766 - DNA, 20 bp, Homo sapiens
tgggcctcctctgtccaggg

SEQ ID NO: 142767 - DNA, 15 bp, Homo sapiens
tgggcggcagagagg

SEQ ID NO: 142768 - DNA, 16 bp, Homo sapiens
tgggctcaagcagtct

SEQ ID NO: 142769 - DNA, 18 bp, Homo sapiens
tgggctctccacctcagc

SEQ ID NO: 142770 - DNA, 15 bp, Homo sapiens
tgggctgccctggtg

SEQ ID NO: 142771 - DNA, 17 bp, Homo sapiens
tgggctgccctggtgct

SEQ ID NO: 142772 - DNA, 23 bp, Homo sapiens
tgggcttccatttgtgtgtgtgc

SEQ ID NO: 142773 - DNA, 17 bp, Homo sapiens
tgggcttgtctgtagat

SEQ ID NO: 142774 - DNA, 21 bp, Homo sapiens
tgggcttgtctgtagatttta

SEQ ID NO: 142775 - DNA, 14 bp, Homo sapiens
tggggaagactgtg

SEQ ID NO: 142776 - DNA, 16 bp, Homo sapiens
tggggaagactgtggc

SEQ ID NO: 142777 - DNA, 20 bp, Homo sapiens
tggggacgtcctgccacctg

SEQ ID NO: 142778 - DNA, 16 bp, Homo sapiens
tggggagccaacagaa

SEQ ID NO: 142779 - DNA, 16 bp, Homo sapiens
tggggatgtgggaggg

SEQ ID NO: 142780 - DNA, 22 bp, Homo sapiens
tggggcagcacagagagggggc

SEQ ID NO: 142781 - DNA, 22 bp, Homo sapiens
tggggcagtcacctgcccagat

SEQ ID NO: 142782 - DNA, 11 bp, Homo sapiens
tggggctgaac

SEQ ID NO: 142783 - DNA, 15 bp, Homo sapiens
tggggctgctcctcc

SEQ ID NO: 142784 - DNA, 18 bp, Homo sapiens
tggggcttctcctgaccc

SEQ ID NO: 142785 - DNA, 15 bp, Homo sapiens
tgggggaagccctgg

SEQ ID NO: 142786 - DNA, 19 bp, Homo sapiens
tggggggctgaggtgggag

SEQ ID NO: 142787 - DNA, 22 bp, Homo sapiens
tgggggttctttcttcctctgc

SEQ ID NO: 142788 - DNA, 19 bp, Homo sapiens
tggggtctccctctcctgc

SEQ ID NO: 142789 - DNA, 22 bp, Homo sapiens
tggggtctccctctcctgccta

SEQ ID NO: 142790 - DNA, 15 bp, Homo sapiens
tggggtgggagaggt

SEQ ID NO: 142791 - DNA, 19 bp, Homo sapiens
tggggttcagcccctcctc

SEQ ID NO: 142792 - DNA, 21 bp, Homo sapiens
tggggttcagcccctcctctg

SEQ ID NO: 142793 - DNA, 22 bp, Homo sapiens
tggggttcagcccctcctctgc

SEQ ID NO: 142794 - DNA, 19 bp, Homo sapiens
tgggtatattcatttcaaa

SEQ ID NO: 142795 - DNA, 21 bp, Homo sapiens
tgggtccaggggatgggaggt

SEQ ID NO: 142796 - DNA, 17 bp, Homo sapiens
tgggtccatgggcagag

SEQ ID NO: 142797 - DNA, 23 bp, Homo sapiens
tgggtctaaggggttggttgagg

SEQ ID NO: 142798 - DNA, 22 bp, Homo sapiens
tgggtctcgctttgttgcccag

SEQ ID NO: 142799 - DNA, 15 bp, Homo sapiens
tgggtgaagacagag

SEQ ID NO: 142800 - DNA, 12 bp, Homo sapiens
tgggtgacattt

SEQ ID NO: 142801 - DNA, 21 bp, Homo sapiens
tgggtgagatgctggagaaga

SEQ ID NO: 142802 - DNA, 13 bp, Homo sapiens
tgggtgctcccta

SEQ ID NO: 142803 - DNA, 17 bp, Homo sapiens
tgggttggaaaacagta

SEQ ID NO: 142804 - DNA, 21 bp, Homo sapiens
tgggttttgtattctctgagc

SEQ ID NO: 142805 - DNA, 13 bp, Homo sapiens
tggtaaactattt

SEQ ID NO: 142806 - DNA, 21 bp, Homo sapiens
tggtaacatcctttctattga

SEQ ID NO: 142807 - DNA, 22 bp, Homo sapiens
tggtaatttaagattccagaga

SEQ ID NO: 142808 - DNA, 20 bp, Homo sapiens
tggtagagtgtgcctgaagt

SEQ ID NO: 142809 - DNA, 21 bp, Homo sapiens
tggtagcttttcccttctttt

SEQ ID NO: 142810 - DNA, 22 bp, Homo sapiens
tggtcaatccgaagtatgaggg

SEQ ID NO: 142811 - DNA, 20 bp, Homo sapiens
tggtcacaggactctgcctc

SEQ ID NO: 142812 - DNA, 17 bp, Homo sapiens
tggtcacagggcatgcc

SEQ ID NO: 142813 - DNA, 22 bp, Homo sapiens
tggtcactgccatggaggcaca

SEQ ID NO: 142814 - DNA, 15 bp, Homo sapiens
tggtcagccctaggg

SEQ ID NO: 142815 - DNA, 20 bp, Homo sapiens
tggtcctgtgtgcagtgaag

SEQ ID NO: 142816 - DNA, 12 bp, Homo sapiens
tggtcctttggg

SEQ ID NO: 142817 - DNA, 14 bp, Homo sapiens
tggtctgcaggcag

SEQ ID NO: 142818 - DNA, 16 bp, Homo sapiens
tggtgacaccagcctt

SEQ ID NO: 142819 - DNA, 17 bp, Homo sapiens
tggtgacccagtcagag

SEQ ID NO: 142820 - DNA, 22 bp, Homo sapiens
tggtgagaactactcagggaat

SEQ ID NO: 142821 - DNA, 23 bp, Homo sapiens
tggtgagaactactcagggaatg

SEQ ID NO: 142822 - DNA, 14 bp, Homo sapiens
tggtgcaaatccta

SEQ ID NO: 142823 - DNA, 16 bp, Homo sapiens
tggtgggggcctcggt

SEQ ID NO: 142824 - DNA, 16 bp, Homo sapiens
tggtgggtccatgggc

SEQ ID NO: 142825 - DNA, 13 bp, Homo sapiens
tggtgtccacctg

SEQ ID NO: 142826 - DNA, 14 bp, Homo sapiens
tggtgtccacctgg

SEQ ID NO: 142827 - DNA, 16 bp, Homo sapiens
tggtgtgatcgtctga

SEQ ID NO: 142828 - DNA, 19 bp, Homo sapiens
tggtgtgtccccctctgtc

SEQ ID NO: 142829 - DNA, 20 bp, Homo sapiens
tggttccggaatcctgtcct

SEQ ID NO: 142830 - DNA, 15 bp, Homo sapiens
tggttgaggtggaag

SEQ ID NO: 142831 - DNA, 22 bp, Homo sapiens
tggttgagttcaggtagctgcc

SEQ ID NO: 142832 - DNA, 17 bp, Homo sapiens
tggttgccttaaagaaa

SEQ ID NO: 142833 - DNA, 18 bp, Homo sapiens
tggttgccttaaagaaag

SEQ ID NO: 142834 - DNA, 11 bp, Homo sapiens
tggtttataga

SEQ ID NO: 142835 - DNA, 12 bp, Homo sapiens
tggtttatgtca

SEQ ID NO: 142836 - DNA, 20 bp, Homo sapiens
tggtttccacgatgaaaaac

SEQ ID NO: 142837 - DNA, 21 bp, Homo sapiens
tggtttccacgatgaaaaact

SEQ ID NO: 142838 - DNA, 12 bp, Homo sapiens
tggttttaacaa

SEQ ID NO: 142839 - DNA, 12 bp, Homo sapiens
tgtaaaatagct

SEQ ID NO: 142840 - DNA, 20 bp, Homo sapiens
tgtaaaatgtgaagtgaatg

SEQ ID NO: 142841 - DNA, 20 bp, Homo sapiens
tgtaaacaggagacaggaag

SEQ ID NO: 142842 - DNA, 14 bp, Homo sapiens
tgtaaacagtgcct

SEQ ID NO: 142843 - DNA, 16 bp, Homo sapiens
tgtaaacagtgcctgc

SEQ ID NO: 142844 - DNA, 14 bp, Homo sapiens
tgtaaatatataaa

SEQ ID NO: 142845 - DNA, 16 bp, Homo sapiens
tgtaaatatataaata

SEQ ID NO: 142846 - DNA, 18 bp, Homo sapiens
tgtaacaggtctcctctt

SEQ ID NO: 142847 - DNA, 11 bp, Homo sapiens
tgtaacatgta

SEQ ID NO: 142848 - DNA, 21 bp, Homo sapiens
tgtaactatagtccagctttg

SEQ ID NO: 142849 - DNA, 14 bp, Homo sapiens
tgtaagctgaaaat

SEQ ID NO: 142850 - DNA, 14 bp, Homo sapiens
tgtaataactgtga

SEQ ID NO: 142851 - DNA, 16 bp, Homo sapiens
tgtaatagaaaactga

SEQ ID NO: 142852 - DNA, 18 bp, Homo sapiens
tgtaatagaaaactgaaa

SEQ ID NO: 142853 - DNA, 14 bp, Homo sapiens
tgtaatcacagcta

SEQ ID NO: 142854 - DNA, 15 bp, Homo sapiens
tgtaatcccagcact

SEQ ID NO: 142855 - DNA, 16 bp, Homo sapiens
tgtaatcccagcactt

SEQ ID NO: 142856 - DNA, 22 bp, Homo sapiens
tgtaatcccagcactttgggag

SEQ ID NO: 142857 - DNA, 21 bp, Homo sapiens
tgtaatcccagctactcagga

SEQ ID NO: 142858 - DNA, 23 bp, Homo sapiens
tgtaatcccagctactcaggagg

SEQ ID NO: 142859 - DNA, 19 bp, Homo sapiens
tgtaatgtcaccaccttcc

SEQ ID NO: 142860 - DNA, 13 bp, Homo sapiens
tgtaattctaaat

SEQ ID NO: 142861 - DNA, 14 bp, Homo sapiens
tgtaattctaaatg

SEQ ID NO: 142862 - DNA, 14 bp, Homo sapiens
tgtaattgcttaca

SEQ ID NO: 142863 - DNA, 15 bp, Homo sapiens
tgtaattgcttacat

SEQ ID NO: 142864 - DNA, 23 bp, Homo sapiens
tgtaattgcttacatttttacaa

SEQ ID NO: 142865 - DNA, 15 bp, Homo sapiens
tgtacaaatataaga

SEQ ID NO: 142866 - DNA, 21 bp, Homo sapiens
tgtacaaatataagaataaaa

SEQ ID NO: 142867 - DNA, 18 bp, Homo sapiens
tgtacatatgtaaaataa

SEQ ID NO: 142868 - DNA, 20 bp, Homo sapiens
tgtacatatgtgctggaatt

SEQ ID NO: 142869 - DNA, 14 bp, Homo sapiens
tgtacatgcattca

SEQ ID NO: 142870 - DNA, 12 bp, Homo sapiens
tgtaccatgtac

SEQ ID NO: 142871 - DNA, 15 bp, Homo sapiens
tgtaccgcaatgtga

SEQ ID NO: 142872 - DNA, 12 bp, Homo sapiens
tgtactcctccc

SEQ ID NO: 142873 - DNA, 13 bp, Homo sapiens
tgtactcctccca

SEQ ID NO: 142874 - DNA, 17 bp, Homo sapiens
tgtactgagccttgtaa

SEQ ID NO: 142875 - DNA, 16 bp, Homo sapiens
tgtacttttaaggcag

SEQ ID NO: 142876 - DNA, 22 bp, Homo sapiens
tgtagcctcgccgtctgtgaat

SEQ ID NO: 142877 - DNA, 11 bp, Homo sapiens
tgtaggagaat

SEQ ID NO: 142878 - DNA, 23 bp, Homo sapiens
tgttaagcagatggaatgctgtg

SEQ ID NO: 142879 - DNA, 16 bp, Homo sapiens
tgttaagtatgtgtaa

SEQ ID NO: 142880 - DNA, 17 bp, Homo sapiens
tgttaagtattttcata

SEQ ID NO: 142881 - DNA, 20 bp, Homo sapiens
tgttaattcagcactgattt

SEQ ID NO: 142882 - DNA, 15 bp, Homo sapiens
tgttacattattatc

SEQ ID NO: 142883 - DNA, 20 bp, Homo sapiens
tgttacctaattagagcaga

SEQ ID NO: 142884 - DNA, 22 bp, Homo sapiens
tgttacctgaaaacactgtgca

SEQ ID NO: 142885 - DNA, 13 bp, Homo sapiens
tgttactaactaa

SEQ ID NO: 142886 - DNA, 14 bp, Homo sapiens
tgttactaactaaa

SEQ ID NO: 142887 - DNA, 15 bp, Homo sapiens
tgttactgtcttcag

SEQ ID NO: 142888 - DNA, 18 bp, Homo sapiens
tgttagagtccaacgtgg

SEQ ID NO: 142889 - DNA, 17 bp, Homo sapiens
tgttagccccataattt

SEQ ID NO: 142890 - DNA, 15 bp, Homo sapiens
tgttagtcatttgct

SEQ ID NO: 142891 - DNA, 20 bp, Homo sapiens
tgttatcaaaactttctttt

SEQ ID NO: 142892 - DNA, 21 bp, Homo sapiens
tgttattagagattacctcct

SEQ ID NO: 142893 - DNA, 15 bp, Homo sapiens
tgttatttaaatgag

SEQ ID NO: 142894 - DNA, 18 bp, Homo sapiens
tgttatttcttacaggca

SEQ ID NO: 142895 - DNA, 14 bp, Homo sapiens
tgttattttcagta

SEQ ID NO: 142896 - DNA, 18 bp, Homo sapiens
tgttattttcagtatttt

SEQ ID NO: 142897 - DNA, 14 bp, Homo sapiens
tgttattttgcaac

SEQ ID NO: 142898 - DNA, 18 bp, Homo sapiens
tgttattttttaattatt

SEQ ID NO: 142899 - DNA, 14 bp, Homo sapiens
tgttcagcactgtc

SEQ ID NO: 142900 - DNA, 11 bp, Homo sapiens
tgttcatccca

SEQ ID NO: 142901 - DNA, 19 bp, Homo sapiens
tgttccacaagttaaataa

SEQ ID NO: 142902 - DNA, 15 bp, Homo sapiens
tgttccccctgtgca

SEQ ID NO: 142903 - DNA, 17 bp, Homo sapiens
tgttccccttccactga

SEQ ID NO: 142904 - DNA, 16 bp, Homo sapiens
tgttctagttttcagt

SEQ ID NO: 142905 - DNA, 22 bp, Homo sapiens
tgttctagttttcagtttgtat

SEQ ID NO: 142906 - DNA, 15 bp, Homo sapiens
tgttctctcttctcc

SEQ ID NO: 142907 - DNA, 22 bp, Homo sapiens
tgttgaaaattattttaaacaa

SEQ ID NO: 142908 - DNA, 15 bp, Homo sapiens
tgttgaaattatgta

SEQ ID NO: 142909 - DNA, 16 bp, Homo sapiens
tgttgatgctttcgtc

SEQ ID NO: 142910 - DNA, 19 bp, Homo sapiens
tgttgccaaatatgtcctg

SEQ ID NO: 142911 - DNA, 20 bp, Homo sapiens
tgttgccaaatatgtcctgg

SEQ ID NO: 142912 - DNA, 23 bp, Homo sapiens
tgttgccaaatatgtcctggggt

SEQ ID NO: 142913 - DNA, 21 bp, Homo sapiens
tgttgtaaatatttatgtaaa

SEQ ID NO: 142914 - DNA, 13 bp, Homo sapiens
tgttgtcaaagag

SEQ ID NO: 142915 - DNA, 20 bp, Homo sapiens
tgttgtgatgtattctagct

SEQ ID NO: 142916 - DNA, 21 bp, Homo sapiens
tgttgtgtacgtggagaggga

SEQ ID NO: 142917 - DNA, 13 bp, Homo sapiens
tgttgttatttaa

SEQ ID NO: 142918 - DNA, 14 bp, Homo sapiens
tgtttaaaatcatt

SEQ ID NO: 142919 - DNA, 14 bp, Homo sapiens
tgtttaatatttaa

SEQ ID NO: 142920 - DNA, 19 bp, Homo sapiens
tgtttacactctttgtaag

SEQ ID NO: 142921 - DNA, 13 bp, Homo sapiens
tgtttactaggga

SEQ ID NO: 142922 - DNA, 20 bp, Homo sapiens
tgtttccctttcactggcat

SEQ ID NO: 142923 - DNA, 13 bp, Homo sapiens
tgtttcttttgta

SEQ ID NO: 142924 - DNA, 13 bp, Homo sapiens
tgtttgagctcag

SEQ ID NO: 142925 - DNA, 20 bp, Homo sapiens
tgtttgccttctacttttaa

SEQ ID NO: 142926 - DNA, 19 bp, Homo sapiens
tgtttgtataatgaatgag

SEQ ID NO: 142927 - DNA, 12 bp, Homo sapiens
tgttttaaaaaa

SEQ ID NO: 142928 - DNA, 18 bp, Homo sapiens
tgttttattttttattgt

SEQ ID NO: 142929 - DNA, 19 bp, Homo sapiens
tgttttcattatctcaaaa

SEQ ID NO: 142930 - DNA, 12 bp, Homo sapiens
tgttttccctga

SEQ ID NO: 142931 - DNA, 17 bp, Homo sapiens
tgttttgacggatgatt

SEQ ID NO: 142932 - DNA, 20 bp, Homo sapiens
tgtttttaagctgtttccat

SEQ ID NO: 142933 - DNA, 13 bp, Homo sapiens
tgtttttgtctta

SEQ ID NO: 142934 - DNA, 14 bp, Homo sapiens
tgttttttgaaaac

SEQ ID NO: 142935 - DNA, 19 bp, Homo sapiens
tgttttttttttccactta

SEQ ID NO: 142936 - DNA, 21 bp, Homo sapiens
ttaaaaaaaacaaaaagaaca

SEQ ID NO: 142937 - DNA, 14 bp, Homo sapiens
ttaaaaaaatgaca

SEQ ID NO: 142938 - DNA, 13 bp, Homo sapiens
ttaaaaaacttgt

SEQ ID NO: 142939 - DNA, 14 bp, Homo sapiens
ttaaaaagtcttca

SEQ ID NO: 142940 - DNA, 18 bp, Homo sapiens
ttaaaaagtggaaaaata

SEQ ID NO: 142941 - DNA, 16 bp, Homo sapiens
ttaaaaatataaaact

SEQ ID NO: 142942 - DNA, 14 bp, Homo sapiens
ttaaaacccaagtg

SEQ ID NO: 142943 - DNA, 20 bp, Homo sapiens
ttaaaagaaagcctcagaga

SEQ ID NO: 142944 - DNA, 15 bp, Homo sapiens
ttaaaagacaagact

SEQ ID NO: 142945 - DNA, 18 bp, Homo sapiens
ttaaaatacacactcaaa

SEQ ID NO: 142946 - DNA, 14 bp, Homo sapiens
ttaaaatatggcta

SEQ ID NO: 142947 - DNA, 17 bp, Homo sapiens
ttaaaatatttatttat

SEQ ID NO: 142948 - DNA, 14 bp, Homo sapiens
ttaaaatattttat

SEQ ID NO: 142949 - DNA, 17 bp, Homo sapiens
ttaaaccgccaaggctg

SEQ ID NO: 142950 - DNA, 11 bp, Homo sapiens
ttaaagaaagt

SEQ ID NO: 142951 - DNA, 15 bp, Homo sapiens
ttaaataaatcataa

SEQ ID NO: 142952 - DNA, 12 bp, Homo sapiens
ttaaatgagaag

SEQ ID NO: 142953 - DNA, 16 bp, Homo sapiens
ttaaatgtaaataatc

SEQ ID NO: 142954 - DNA, 21 bp, Homo sapiens
ttaaattataacttaaaatat

SEQ ID NO: 142955 - DNA, 16 bp, Homo sapiens
ttaaattgctgtgtat

SEQ ID NO: 142956 - DNA, 16 bp, Homo sapiens
ttaaattttaatttat

SEQ ID NO: 142957 - DNA, 20 bp, Homo sapiens
ttaaattttgagttctacat

SEQ ID NO: 142958 - DNA, 17 bp, Homo sapiens
ttaacatatttactaag

SEQ ID NO: 142959 - DNA, 14 bp, Homo sapiens
ttaaccaaaggtga

SEQ ID NO: 142960 - DNA, 18 bp, Homo sapiens
ttaaccaaaggtgaagga

SEQ ID NO: 142961 - DNA, 16 bp, Homo sapiens
ttaactagaatttatt

SEQ ID NO: 142962 - DNA, 20 bp, Homo sapiens
ttaagaaaaaataacacaca

SEQ ID NO: 142963 - DNA, 16 bp, Homo sapiens
ttaagataattataat

SEQ ID NO: 142964 - DNA, 20 bp, Homo sapiens
ttaagcactacataaactga

SEQ ID NO: 142965 - DNA, 21 bp, Homo sapiens
ttaagccacttaaaatgttca

SEQ ID NO: 142966 - DNA, 19 bp, Homo sapiens
ttaagcctcatatttaaag

SEQ ID NO: 142967 - DNA, 21 bp, Homo sapiens
ttaaggaagacaatgtgaaaa

SEQ ID NO: 142968 - DNA, 14 bp, Homo sapiens
ttaagtatgtgtaa

SEQ ID NO: 142969 - DNA, 13 bp, Homo sapiens
ttaagtattgcat

SEQ ID NO: 142970 - DNA, 19 bp, Homo sapiens
ttaagtattgcatctgtat

SEQ ID NO: 142971 - DNA, 21 bp, Homo sapiens
ttaagtattgcatctgtataa

SEQ ID NO: 142972 - DNA, 11 bp, Homo sapiens
ttaagtattta

SEQ ID NO: 142973 - DNA, 17 bp, Homo sapiens
ttaagtatttatatatt

SEQ ID NO: 142974 - DNA, 15 bp, Homo sapiens
ttaataccacagctt

SEQ ID NO: 142975 - DNA, 18 bp, Homo sapiens
ttaatagcttttattgta

SEQ ID NO: 142976 - DNA, 20 bp, Homo sapiens
ttaatatccctacatgtatt

SEQ ID NO: 142977 - DNA, 18 bp, Homo sapiens
ttaatattgatatgctta

SEQ ID NO: 142978 - DNA, 22 bp, Homo sapiens
ttaatattgatatgcttataca

SEQ ID NO: 142979 - DNA, 12 bp, Homo sapiens
ttaatatttaaa

SEQ ID NO: 142980 - DNA, 15 bp, Homo sapiens
ttaatatttaaacag

SEQ ID NO: 142981 - DNA, 21 bp, Homo sapiens
ttaatatttaaacagcagtgt

SEQ ID NO: 142982 - DNA, 21 bp, Homo sapiens
ttaatgataagtaaatgctag

SEQ ID NO: 142983 - DNA, 20 bp, Homo sapiens
ttaatgcatgttaggaaaat

SEQ ID NO: 142984 - DNA, 17 bp, Homo sapiens
ttaatgtttattcctga

SEQ ID NO: 142985 - DNA, 17 bp, Homo sapiens
ttaattctcatgtgatc

SEQ ID NO: 142986 - DNA, 23 bp, Homo sapiens
ttaatttttttaaccaaaggtga

SEQ ID NO: 142987 - DNA, 14 bp, Homo sapiens
ttacaaagtgtgta

SEQ ID NO: 142988 - DNA, 15 bp, Homo sapiens
ttacaaagtgtgtat

SEQ ID NO: 142989 - DNA, 16 bp, Homo sapiens
ttacaaagtgtgtatt

SEQ ID NO: 142990 - DNA, 12 bp, Homo sapiens
ttacaatttaca

SEQ ID NO: 142991 - DNA, 19 bp, Homo sapiens
ttacaatttacaaagtgtg

SEQ ID NO: 142992 - DNA, 16 bp, Homo sapiens
ttacacaaaacaaatg

SEQ ID NO: 142993 - DNA, 14 bp, Homo sapiens
ttacactctttgta

SEQ ID NO: 142994 - DNA, 13 bp, Homo sapiens
ttacactttatgc

SEQ ID NO: 142995 - DNA, 20 bp, Homo sapiens
ttacactttatgcacaaaat

SEQ ID NO: 142996 - DNA, 13 bp, Homo sapiens
ttacagctgcctg

SEQ ID NO: 142997 - DNA, 14 bp, Homo sapiens
ttacagctgcctgc

SEQ ID NO: 142998 - DNA, 17 bp, Homo sapiens
ttacaggcacaaaatga

SEQ ID NO: 142999 - DNA, 19 bp, Homo sapiens
ttacagtaggagcccagct

SEQ ID NO: 143000 - DNA, 22 bp, Homo sapiens
ttacatatcacctcatggccta

SEQ ID NO: 143001 - DNA, 14 bp, Homo sapiens
ttacatctgtttta

SEQ ID NO: 143002 - DNA, 16 bp, Homo sapiens
ttacattaatgttaat

SEQ ID NO: 143003 - DNA, 17 bp, Homo sapiens
ttacattgtttgtctgt

SEQ ID NO: 143004 - DNA, 16 bp, Homo sapiens
ttacatttccaaatga

SEQ ID NO: 143005 - DNA, 13 bp, Homo sapiens
ttacatttttaca

SEQ ID NO: 143006 - DNA, 17 bp, Homo sapiens
ttacatttttacaataa

SEQ ID NO: 143007 - DNA, 22 bp, Homo sapiens
ttaccagacggttcaccagcct

SEQ ID NO: 143008 - DNA, 22 bp, Homo sapiens
ttaccagcctccgtatttcaga

SEQ ID NO: 143009 - DNA, 18 bp, Homo sapiens
ttaccgcgttgtaaaata

SEQ ID NO: 143010 - DNA, 12 bp, Homo sapiens
ttacctcctgcc

SEQ ID NO: 143011 - DNA, 16 bp, Homo sapiens
ttaccttgtatactgt

SEQ ID NO: 143012 - DNA, 20 bp, Homo sapiens
ttactaactaaactctcttt

SEQ ID NO: 143013 - DNA, 17 bp, Homo sapiens
ttactaagccacaagaa

SEQ ID NO: 143014 - DNA, 18 bp, Homo sapiens
ttactaagccacaagaaa

SEQ ID NO: 143015 - DNA, 20 bp, Homo sapiens
ttactaagccacaagaaatt

SEQ ID NO: 143016 - DNA, 16 bp, Homo sapiens
ttactagggatccctc

SEQ ID NO: 143017 - DNA, 19 bp, Homo sapiens
ttactatcatgtcaaacgt

SEQ ID NO: 143018 - DNA, 13 bp, Homo sapiens
ttactcagccctg

SEQ ID NO: 143019 - DNA, 19 bp, Homo sapiens
ttactctccaacctggaca

SEQ ID NO: 143020 - DNA, 21 bp, Homo sapiens
ttactgccaaagggaaatatc

SEQ ID NO: 143021 - DNA, 14 bp, Homo sapiens
tctggattgtggga

SEQ ID NO: 143022 - DNA, 17 bp, Homo sapiens
tctgggaaaatacccca

SEQ ID NO: 143023 - DNA, 14 bp, Homo sapiens
tctgggaagggaag

SEQ ID NO: 143024 - DNA, 13 bp, Homo sapiens
tctgggacctcag

SEQ ID NO: 143025 - DNA, 19 bp, Homo sapiens
tctgggaggaatggacaga

SEQ ID NO: 143026 - DNA, 18 bp, Homo sapiens
tctgggataagtaagttt

SEQ ID NO: 143027 - DNA, 15 bp, Homo sapiens
tctgggattctactt

SEQ ID NO: 143028 - DNA, 19 bp, Homo sapiens
tctgggattctactttaag

SEQ ID NO: 143029 - DNA, 17 bp, Homo sapiens
tctggggttcagcccct

SEQ ID NO: 143030 - DNA, 19 bp, Homo sapiens
tctggggttcagcccctcc

SEQ ID NO: 143031 - DNA, 21 bp, Homo sapiens
tctggggttcagcccctcctc

SEQ ID NO: 143032 - DNA, 22 bp, Homo sapiens
tctggggttcagcccctcctct

SEQ ID NO: 143033 - DNA, 15 bp, Homo sapiens
tctgggtcagtggtc

SEQ ID NO: 143034 - DNA, 22 bp, Homo sapiens
tctggtaatattgacttgtata

SEQ ID NO: 143035 - DNA, 16 bp, Homo sapiens
tctggtgacaccagcc

SEQ ID NO: 143036 - DNA, 17 bp, Homo sapiens
tctggtgacaccagcct

SEQ ID NO: 143037 - DNA, 18 bp, Homo sapiens
tctggtgacaccagcctt

SEQ ID NO: 143038 - DNA, 13 bp, Homo sapiens
tctggttttaaca

SEQ ID NO: 143039 - DNA, 22 bp, Homo sapiens
tctgtagggatttttggctaca

SEQ ID NO: 143040 - DNA, 16 bp, Homo sapiens
tctgtataagtaagaa

SEQ ID NO: 143041 - DNA, 18 bp, Homo sapiens
tctgtataagtaagaaaa

SEQ ID NO: 143042 - DNA, 22 bp, Homo sapiens
tctgtataagtaagaaaatatt

SEQ ID NO: 143043 - DNA, 20 bp, Homo sapiens
tctgtatcaggacccagagg

SEQ ID NO: 143044 - DNA, 20 bp, Homo sapiens
tctgtatttccccaacatgt

SEQ ID NO: 143045 - DNA, 18 bp, Homo sapiens
ttagcttagacctcagcc

SEQ ID NO: 143046 - DNA, 15 bp, Homo sapiens
ttaggaaataaaacc

SEQ ID NO: 143047 - DNA, 20 bp, Homo sapiens
ttaggaaataaaacctttca

SEQ ID NO: 143048 - DNA, 14 bp, Homo sapiens
ttaggatttaacag

SEQ ID NO: 143049 - DNA, 14 bp, Homo sapiens
ttaggcagggaagt

SEQ ID NO: 143050 - DNA, 14 bp, Homo sapiens
ttagggagagaaga

SEQ ID NO: 143051 - DNA, 12 bp, Homo sapiens
ttagggaggggt

SEQ ID NO: 143052 - DNA, 18 bp, Homo sapiens
ttaggtggcaagctgtga

SEQ ID NO: 143053 - DNA, 12 bp, Homo sapiens
ttagtaacatgt

SEQ ID NO: 143054 - DNA, 14 bp, Homo sapiens
ttagtcatgtgacc

SEQ ID NO: 143055 - DNA, 17 bp, Homo sapiens
ttagtctgcaaaatgag

SEQ ID NO: 143056 - DNA, 16 bp, Homo sapiens
ttagttcctcattagc

SEQ ID NO: 143057 - DNA, 17 bp, Homo sapiens
ttagtttacaatcagcc

SEQ ID NO: 143058 - DNA, 22 bp, Homo sapiens
ttataactactccggagacagg

SEQ ID NO: 143059 - DNA, 17 bp, Homo sapiens
ttataactcatcataaa

SEQ ID NO: 143060 - DNA, 21 bp, Homo sapiens
ttataactcatcataaaataa

SEQ ID NO: 143061 - DNA, 22 bp, Homo sapiens
ttataactcatcataaaataaa

SEQ ID NO: 143062 - DNA, 18 bp, Homo sapiens
ttataactgaaggagaag

SEQ ID NO: 143063 - DNA, 17 bp, Homo sapiens
ttataacttaaaatatt

SEQ ID NO: 143064 - DNA, 16 bp, Homo sapiens
ttataagcagatttaa

SEQ ID NO: 143065 - DNA, 18 bp, Homo sapiens
ttataataatgttaacat

SEQ ID NO: 143066 - DNA, 13 bp, Homo sapiens
ttataatatacta

SEQ ID NO: 143067 - DNA, 20 bp, Homo sapiens
ttataatcttccatacttct

SEQ ID NO: 143068 - DNA, 16 bp, Homo sapiens
ttataatttttttcaa

SEQ ID NO: 143069 - DNA, 18 bp, Homo sapiens
ttatacagctcagctttt

SEQ ID NO: 143070 - DNA, 14 bp, Homo sapiens
ttatagaaagttca

SEQ ID NO: 143071 - DNA, 19 bp, Homo sapiens
ttatagagggccaagactt

SEQ ID NO: 143072 - DNA, 23 bp, Homo sapiens
ttatagagtgtacttaactattc

SEQ ID NO: 143073 - DNA, 21 bp, Homo sapiens
ttatagatcccccagacttta

SEQ ID NO: 143074 - DNA, 17 bp, Homo sapiens
ttatagctattactgtc

SEQ ID NO: 143075 - DNA, 12 bp, Homo sapiens
ttatagtttgta

SEQ ID NO: 143076 - DNA, 15 bp, Homo sapiens
ttatagtttgtacat

SEQ ID NO: 143077 - DNA, 16 bp, Homo sapiens
ttatagtttgtacatg

SEQ ID NO: 143078 - DNA, 14 bp, Homo sapiens
ttatatatttataa

SEQ ID NO: 143079 - DNA, 20 bp, Homo sapiens
ttatatatttataactcatc

SEQ ID NO: 143080 - DNA, 23 bp, Homo sapiens
ttatatatttataactcatcata

SEQ ID NO: 143081 - DNA, 21 bp, Homo sapiens
ttatatcatcagcataccttt

SEQ ID NO: 143082 - DNA, 19 bp, Homo sapiens
ttatatttagttatagttt

SEQ ID NO: 143083 - DNA, 16 bp, Homo sapiens
ttatcaaaactttctt

SEQ ID NO: 143084 - DNA, 15 bp, Homo sapiens
ttatcaacaatagtg

SEQ ID NO: 143085 - DNA, 20 bp, Homo sapiens
ttatcaccagagagggactg

SEQ ID NO: 143086 - DNA, 23 bp, Homo sapiens
ttatcagtcataactaaataaag

SEQ ID NO: 143087 - DNA, 18 bp, Homo sapiens
ttatccatggggaaggga

SEQ ID NO: 143088 - DNA, 21 bp, Homo sapiens
ttatctccccttcacatgcat

SEQ ID NO: 143089 - DNA, 18 bp, Homo sapiens
ttatgaaaggtttacatt

SEQ ID NO: 143090 - DNA, 15 bp, Homo sapiens
ttatgttacatctgt

SEQ ID NO: 143091 - DNA, 12 bp, Homo sapiens
ttattaaaatct

SEQ ID NO: 143092 - DNA, 14 bp, Homo sapiens
ttattaataaacat

SEQ ID NO: 143093 - DNA, 20 bp, Homo sapiens
ttattagtaaatgcttatca

SEQ ID NO: 143094 - DNA, 16 bp, Homo sapiens
ttattcaagttattgt

SEQ ID NO: 143095 - DNA, 16 bp, Homo sapiens
ttattcatttaaaatg

SEQ ID NO: 143096 - DNA, 19 bp, Homo sapiens
ttattccctttcacaaaat

SEQ ID NO: 143097 - DNA, 20 bp, Homo sapiens
ttattcctatatagtttatt

SEQ ID NO: 143098 - DNA, 14 bp, Homo sapiens
ttattgacaataat

SEQ ID NO: 143099 - DNA, 18 bp, Homo sapiens
ttattgacaataatttca

SEQ ID NO: 143100 - DNA, 23 bp, Homo sapiens
ttattgagaaagagcacttaaga

SEQ ID NO: 143101 - DNA, 19 bp, Homo sapiens
ttattgagaattttaaatt

SEQ ID NO: 143102 - DNA, 14 bp, Homo sapiens
ttatttaaatttta

SEQ ID NO: 143103 - DNA, 22 bp, Homo sapiens
ttatttactgagcttctctgtg

SEQ ID NO: 143104 - DNA, 20 bp, Homo sapiens
ttatttatgcctctgtattt

SEQ ID NO: 143105 - DNA, 15 bp, Homo sapiens
ttatttcagaaatgt

SEQ ID NO: 143106 - DNA, 17 bp, Homo sapiens
ttatttcagaaatgtac

SEQ ID NO: 143107 - DNA, 19 bp, Homo sapiens
ttatttccaaataaaatga

SEQ ID NO: 143108 - DNA, 15 bp, Homo sapiens
ttatttgcagagaca

SEQ ID NO: 143109 - DNA, 17 bp, Homo sapiens
ttattttctttgaaatt

SEQ ID NO: 143110 - DNA, 22 bp, Homo sapiens
ttattttggaaaataaattatt

SEQ ID NO: 143111 - DNA, 21 bp, Homo sapiens
ttcaaaagaatcagaaacagg

SEQ ID NO: 143112 - DNA, 18 bp, Homo sapiens
ttcaaacagtctcaggaa

SEQ ID NO: 143113 - DNA, 13 bp, Homo sapiens
ttcaaagccagcg

SEQ ID NO: 143114 - DNA, 17 bp, Homo sapiens
ttcaaccattccccatg

SEQ ID NO: 143115 - DNA, 20 bp, Homo sapiens
ttcaaccattccccatggga

SEQ ID NO: 143116 - DNA, 13 bp, Homo sapiens
ttcaacgcagccc

SEQ ID NO: 143117 - DNA, 15 bp, Homo sapiens
ttcaacgcagccctg

SEQ ID NO: 143118 - DNA, 16 bp, Homo sapiens
ttcaacgcagccctgc

SEQ ID NO: 143119 - DNA, 14 bp, Homo sapiens
ttcaactgaaaaga

SEQ ID NO: 143120 - DNA, 17 bp, Homo sapiens
ttcaagcagattggaga

SEQ ID NO: 143121 - DNA, 18 bp, Homo sapiens
ttcaaggtggccaaatta

SEQ ID NO: 143122 - DNA, 20 bp, Homo sapiens
ttcaaggtggccaaattatt

SEQ ID NO: 143123 - DNA, 17 bp, Homo sapiens
ttcaagttattgtacag

SEQ ID NO: 143124 - DNA, 20 bp, Homo sapiens
ttcaagttattgtacagctg

SEQ ID NO: 143125 - DNA, 16 bp, Homo sapiens
ttcaataataaatatt

SEQ ID NO: 143126 - DNA, 19 bp, Homo sapiens
ttcaattcagtgctgtact

SEQ ID NO: 143127 - DNA, 23 bp, Homo sapiens
ttcacaagacccaaaaggcagaa

SEQ ID NO: 143128 - DNA, 21 bp, Homo sapiens
ttcacactgcaagagccttgg

SEQ ID NO: 143129 - DNA, 19 bp, Homo sapiens
ttcacacttccaccagcct

SEQ ID NO: 143130 - DNA, 18 bp, Homo sapiens
ttcacatctaacctcatc

SEQ ID NO: 143131 - DNA, 18 bp, Homo sapiens
ttcacatgcatcaagtta

SEQ ID NO: 143132 - DNA, 15 bp, Homo sapiens
ttcacccagacagct

SEQ ID NO: 143133 - DNA, 13 bp, Homo sapiens
ttcaccccaccct

SEQ ID NO: 143134 - DNA, 20 bp, Homo sapiens
ttcaccccagggcctgagcc

SEQ ID NO: 143135 - DNA, 22 bp, Homo sapiens
ttcaccccccactcaccagtgt

SEQ ID NO: 143136 - DNA, 12 bp, Homo sapiens
ttcacctgagca

SEQ ID NO: 143137 - DNA, 21 bp, Homo sapiens
ttcacgcctgtaatcccagca

SEQ ID NO: 143138 - DNA, 23 bp, Homo sapiens
ttcacgcctgtaatcccagcact

SEQ ID NO: 143139 - DNA, 13 bp, Homo sapiens
ttcacggaagagc

SEQ ID NO: 143140 - DNA, 14 bp, Homo sapiens
ttcacgtgcagctc

SEQ ID NO: 143141 - DNA, 12 bp, Homo sapiens
ttcactctctga

SEQ ID NO: 143142 - DNA, 15 bp, Homo sapiens
ttcactgctggctgc

SEQ ID NO: 143143 - DNA, 17 bp, Homo sapiens
ttcactgctggctgcct

SEQ ID NO: 143144 - DNA, 19 bp, Homo sapiens
ttcactgctggctgcctta

SEQ ID NO: 143145 - DNA, 19 bp, Homo sapiens
ttcactggagttacattaa

SEQ ID NO: 143146 - DNA, 13 bp, Homo sapiens
ttcagaaaatatt

SEQ ID NO: 143147 - DNA, 14 bp, Homo sapiens
ttcagaaaatatta

SEQ ID NO: 143148 - DNA, 21 bp, Homo sapiens
ttcagaaaatattatgtgttt

SEQ ID NO: 143149 - DNA, 15 bp, Homo sapiens
ttcagaaagaagtgg

SEQ ID NO: 143150 - DNA, 13 bp, Homo sapiens
ttcagaaagcatt

SEQ ID NO: 143151 - DNA, 20 bp, Homo sapiens
ttcagaaagcattacatttc

SEQ ID NO: 143152 - DNA, 13 bp, Homo sapiens
ttcagaaatatgt

SEQ ID NO: 143153 - DNA, 16 bp, Homo sapiens
ttcagacatagaatta

SEQ ID NO: 143154 - DNA, 13 bp, Homo sapiens
ttcagaccccagc

SEQ ID NO: 143155 - DNA, 23 bp, Homo sapiens
ttcagaggccctcgctgccagct

SEQ ID NO: 143156 - DNA, 15 bp, Homo sapiens
ttcagatatatatca

SEQ ID NO: 143157 - DNA, 17 bp, Homo sapiens
ttcagatcagtgcttga

SEQ ID NO: 143158 - DNA, 20 bp, Homo sapiens
ttcagattttaaaaagtctt

SEQ ID NO: 143159 - DNA, 16 bp, Homo sapiens
ttcagcccctcctctg

SEQ ID NO: 143160 - DNA, 17 bp, Homo sapiens
ttcagcccctcctctgc

SEQ ID NO: 143161 - DNA, 17 bp, Homo sapiens
ttcagctctgcaagaat

SEQ ID NO: 143162 - DNA, 24 bp, Homo sapiens
ttcagctctgcaagaattgaagca

SEQ ID NO: 143163 - DNA, 21 bp, Homo sapiens
ttcttcatccggcagcctgga

SEQ ID NO: 143164 - DNA, 17 bp, Homo sapiens
ttcttccaaaaagattt

SEQ ID NO: 143165 - DNA, 16 bp, Homo sapiens
ttcttccatcccagga

SEQ ID NO: 143166 - DNA, 19 bp, Homo sapiens
ttcttcccatcactggagc

SEQ ID NO: 143167 - DNA, 12 bp, Homo sapiens
ttcttcctctgc

SEQ ID NO: 143168 - DNA, 23 bp, Homo sapiens
ttcttcgaggtggatcacagagg

SEQ ID NO: 143169 - DNA, 17 bp, Homo sapiens
ttcttctcctatgtgta

SEQ ID NO: 143170 - DNA, 18 bp, Homo sapiens
ttcttctcctatgtgtaa

SEQ ID NO: 143171 - DNA, 13 bp, Homo sapiens
ttcttgaaagctg

SEQ ID NO: 143172 - DNA, 19 bp, Homo sapiens
ttctttctagttcagctgc

SEQ ID NO: 143173 - DNA, 17 bp, Homo sapiens
ttctttgagactgggtc

SEQ ID NO: 143174 - DNA, 21 bp, Homo sapiens
ttcttttaaaggggcagaaaa

SEQ ID NO: 143175 - DNA, 23 bp, Homo sapiens
ttcttttcgccgtggctgcggca

SEQ ID NO: 143176 - DNA, 21 bp, Homo sapiens
ttcttttctggaatgtaatca

SEQ ID NO: 143177 - DNA, 21 bp, Homo sapiens
ttcttttgcccttcacagtgt

SEQ ID NO: 143178 - DNA, 14 bp, Homo sapiens
ttcttttgtatgta

SEQ ID NO: 143179 - DNA, 20 bp, Homo sapiens
ttcttttgtatgtaaatgtg

SEQ ID NO: 143180 - DNA, 14 bp, Homo sapiens
ttctttttttgtga

SEQ ID NO: 143181 - DNA, 20 bp, Homo sapiens
ttgaaaaaatagagcctgag

SEQ ID NO: 143182 - DNA, 22 bp, Homo sapiens
ttgaaaaaatagagcctgaggg

SEQ ID NO: 143183 - DNA, 18 bp, Homo sapiens
ttgaaaagactccaaaga

SEQ ID NO: 143184 - DNA, 23 bp, Homo sapiens
ttgaaaagactccaaagaaatgt

SEQ ID NO: 143185 - DNA, 15 bp, Homo sapiens
ttgaaaagtcaaact

SEQ ID NO: 143186 - DNA, 15 bp, Homo sapiens
ttgaaaattatttta

SEQ ID NO: 143187 - DNA, 22 bp, Homo sapiens
ttgaaaattattttaaacaaaa

SEQ ID NO: 143188 - DNA, 15 bp, Homo sapiens
ttgaaataataaatc

SEQ ID NO: 143189 - DNA, 23 bp, Homo sapiens
ttgaaattatgtatgtttacata

SEQ ID NO: 143190 - DNA, 18 bp, Homo sapiens
ttgaacccgggaggcaga

SEQ ID NO: 143191 - DNA, 15 bp, Homo sapiens
ttgaactcctgggct

SEQ ID NO: 143192 - DNA, 13 bp, Homo sapiens
ttgaagaggaaaa

SEQ ID NO: 143193 - DNA, 18 bp, Homo sapiens
ttgaagatgctgaaacag

SEQ ID NO: 143194 - DNA, 23 bp, Homo sapiens
ttgaagctctggtgacaccagcc

SEQ ID NO: 143195 - DNA, 17 bp, Homo sapiens
ttgaaggaaaatgatac

SEQ ID NO: 143196 - DNA, 12 bp, Homo sapiens
ttgaataaataa

SEQ ID NO: 143197 - DNA, 13 bp, Homo sapiens
ttgaatatattat

SEQ ID NO: 143198 - DNA, 19 bp, Homo sapiens
ttgaatccatgcttgggtg

SEQ ID NO: 143199 - DNA, 17 bp, Homo sapiens
ttgaatgacaacagaag

SEQ ID NO: 143200 - DNA, 17 bp, Homo sapiens
ttgaatgctttttgaat

SEQ ID NO: 143201 - DNA, 23 bp, Homo sapiens
ttgaatgctttttgaatgttatt

SEQ ID NO: 143202 - DNA, 17 bp, Homo sapiens
ttgaatgttaagcagat

SEQ ID NO: 143203 - DNA, 23 bp, Homo sapiens
ttgaattaatatccctacatgta

SEQ ID NO: 143204 - DNA, 14 bp, Homo sapiens
ttgaattagaaaca

SEQ ID NO: 143205 - DNA, 21 bp, Homo sapiens
ttgaattcttggttgaggaaa

SEQ ID NO: 143206 - DNA, 15 bp, Homo sapiens
ttgaattgtaactgt

SEQ ID NO: 143207 - DNA, 18 bp, Homo sapiens
ttgaccaagcaggaagct

SEQ ID NO: 143208 - DNA, 21 bp, Homo sapiens
ttgaccagcagatcccagctc

SEQ ID NO: 143209 - DNA, 20 bp, Homo sapiens
ttgacggatgattggattat

SEQ ID NO: 143210 - DNA, 23 bp, Homo sapiens
ttgactccttgtggtttatgtca

SEQ ID NO: 143211 - DNA, 17 bp, Homo sapiens
ttgactgggtttctctg

SEQ ID NO: 143212 - DNA, 12 bp, Homo sapiens
ttgactttcagg

SEQ ID NO: 143213 - DNA, 14 bp, Homo sapiens
ttgactttcaggta

SEQ ID NO: 143214 - DNA, 19 bp, Homo sapiens
ttgagaaagagcacttaag

SEQ ID NO: 143215 - DNA, 14 bp, Homo sapiens
ttgagaaggagaga

SEQ ID NO: 143216 - DNA, 17 bp, Homo sapiens
ttgagaaggagagaaag

SEQ ID NO: 143217 - DNA, 14 bp, Homo sapiens
ttgagagttctaaa

SEQ ID NO: 143218 - DNA, 15 bp, Homo sapiens
ttgagatcagcctgg

SEQ ID NO: 143219 - DNA, 13 bp, Homo sapiens
ttgaggaaaacaa

SEQ ID NO: 143220 - DNA, 21 bp, Homo sapiens
ttgagggcccagagcaggaag

SEQ ID NO: 143221 - DNA, 19 bp, Homo sapiens
ttgaggtggaagccctcct

SEQ ID NO: 143222 - DNA, 17 bp, Homo sapiens
ttgagtgttttaagata

SEQ ID NO: 143223 - DNA, 20 bp, Homo sapiens
ttgagttgattcagctctgc

SEQ ID NO: 143224 - DNA, 19 bp, Homo sapiens
ttgagtttcctcaggctgc

SEQ ID NO: 143225 - DNA, 14 bp, Homo sapiens
ttgagttttcagtg

SEQ ID NO: 143226 - DNA, 12 bp, Homo sapiens
ttgataaagtaa

SEQ ID NO: 143227 - DNA, 16 bp, Homo sapiens
ttgatatgcttataca

SEQ ID NO: 143228 - DNA, 20 bp, Homo sapiens
ttgattattctgattccact

SEQ ID NO: 143229 - DNA, 14 bp, Homo sapiens
ttgcaacctcgctg

SEQ ID NO: 143230 - DNA, 14 bp, Homo sapiens
ttgcaaggccgctg

SEQ ID NO: 143231 - DNA, 18 bp, Homo sapiens
ttgcaagtgaaggtttac

SEQ ID NO: 143232 - DNA, 21 bp, Homo sapiens
ttgcacacccactcagctccg

SEQ ID NO: 143233 - DNA, 17 bp, Homo sapiens
ttgcacactcccctgca

SEQ ID NO: 143234 - DNA, 14 bp, Homo sapiens
ttgcaccactgcac

SEQ ID NO: 143235 - DNA, 21 bp, Homo sapiens
ttgcaccactgcactccagcc

SEQ ID NO: 143236 - DNA, 13 bp, Homo sapiens
ttgcacccctcac

SEQ ID NO: 143237 - DNA, 22 bp, Homo sapiens
ttgcacccctcactctggcctc

SEQ ID NO: 143238 - DNA, 17 bp, Homo sapiens
ttgcacgcccatgtgtg

SEQ ID NO: 143239 - DNA, 20 bp, Homo sapiens
ttgcacgcccatgtgtgagt

SEQ ID NO: 143240 - DNA, 19 bp, Homo sapiens
ttgcactaaagtatgtaaa

SEQ ID NO: 143241 - DNA, 14 bp, Homo sapiens
ttgcactccagcct

SEQ ID NO: 143242 - DNA, 18 bp, Homo sapiens
ttgcagaaaagcacctgc

SEQ ID NO: 143243 - DNA, 21 bp, Homo sapiens
ttgcagaaaagcacctgccga

SEQ ID NO: 143244 - DNA, 18 bp, Homo sapiens
ttgcatagattccctgag

SEQ ID NO: 143245 - DNA, 23 bp, Homo sapiens
ttgcatagtaccaatcattttaa

SEQ ID NO: 143246 - DNA, 20 bp, Homo sapiens
ttgcatctcccagataatgt

SEQ ID NO: 143247 - DNA, 15 bp, Homo sapiens
ttgcatgatgtattt

SEQ ID NO: 143248 - DNA, 14 bp, Homo sapiens
ttgcattgaatata

SEQ ID NO: 143249 - DNA, 17 bp, Homo sapiens
ttgcattgaatatatta

SEQ ID NO: 143250 - DNA, 16 bp, Homo sapiens
ttgccaaatatgtcct

SEQ ID NO: 143251 - DNA, 18 bp, Homo sapiens
ttgccaaatatgtcctgg

SEQ ID NO: 143252 - DNA, 12 bp, Homo sapiens
ttgcccagagat

SEQ ID NO: 143253 - DNA, 22 bp, Homo sapiens
ttgcccagagatgcctccaccg

SEQ ID NO: 143254 - DNA, 20 bp, Homo sapiens
ttgcccagggctcagcctgg

SEQ ID NO: 143255 - DNA, 10 bp, Homo sapiens
ttgccctggt

SEQ ID NO: 143256 - DNA, 17 bp, Homo sapiens
ttgcccttcacagtgtt

SEQ ID NO: 143257 - DNA, 18 bp, Homo sapiens
ttgcccttcacagtgttt

SEQ ID NO: 143258 - DNA, 16 bp, Homo sapiens
ttgccttaaagaaagt

SEQ ID NO: 143259 - DNA, 13 bp, Homo sapiens
ttgctcacctggg

SEQ ID NO: 143260 - DNA, 17 bp, Homo sapiens
ttgctcctaatgttgaa

SEQ ID NO: 143261 - DNA, 19 bp, Homo sapiens
ttgctgaatacagaggcaa

SEQ ID NO: 143262 - DNA, 20 bp, Homo sapiens
ttgctgtgagcaagaagtca

SEQ ID NO: 143263 - DNA, 17 bp, Homo sapiens
ttgctgtgaggctgtcc

SEQ ID NO: 143264 - DNA, 13 bp, Homo sapiens
ttgctgtttcctt

SEQ ID NO: 143265 - DNA, 15 bp, Homo sapiens
ttgctgtttcctttt

SEQ ID NO: 143266 - DNA, 13 bp, Homo sapiens
ttgctttgtatgc

SEQ ID NO: 143267 - DNA, 16 bp, Homo sapiens
ttgctttgtatgcact

SEQ ID NO: 143268 - DNA, 15 bp, Homo sapiens
ttggaaaataaatca

SEQ ID NO: 143269 - DNA, 17 bp, Homo sapiens
ttggaaaataaattatt

SEQ ID NO: 143270 - DNA, 13 bp, Homo sapiens
ttggacccttcca

SEQ ID NO: 143271 - DNA, 20 bp, Homo sapiens
ttggagagtaaaaactgaat

SEQ ID NO: 143272 - DNA, 14 bp, Homo sapiens
ttggagcttcatgg

SEQ ID NO: 143273 - DNA, 22 bp, Homo sapiens
ttggataatgctgttgcctcat

SEQ ID NO: 143274 - DNA, 14 bp, Homo sapiens
ttggcaacagaagc

SEQ ID NO: 143275 - DNA, 16 bp, Homo sapiens
ttggcaatagtttgca

SEQ ID NO: 143276 - DNA, 20 bp, Homo sapiens
ttggcaatagtttgcataga

SEQ ID NO: 143277 - DNA, 14 bp, Homo sapiens
ttggctctggagac

SEQ ID NO: 143278 - DNA, 20 bp, Homo sapiens
ttggctctggagacagcccc

SEQ ID NO: 143279 - DNA, 15 bp, Homo sapiens
ttggctgtgtctaaa

SEQ ID NO: 143280 - DNA, 20 bp, Homo sapiens
ttggctgtgtctaaactgca

SEQ ID NO: 143281 - DNA, 23 bp, Homo sapiens
ttggctgtgtctaaactgcatta

SEQ ID NO: 143282 - DNA, 17 bp, Homo sapiens
ttggcttactgcagcct

SEQ ID NO: 143283 - DNA, 17 bp, Homo sapiens
ttggctttaaacaccct

SEQ ID NO: 143284 - DNA, 14 bp, Homo sapiens
ttgggagacatgtg

SEQ ID NO: 143285 - DNA, 21 bp, Homo sapiens
ttggggtagctagaggaacca

SEQ ID NO: 143286 - DNA, 20 bp, Homo sapiens
ttgggtgtaacaggtctcct

SEQ ID NO: 143287 - DNA, 15 bp, Homo sapiens
ttggtcttatttatt

SEQ ID NO: 143288 - DNA, 19 bp, Homo sapiens
ttggtcttatttattattg

SEQ ID NO: 143289 - DNA, 14 bp, Homo sapiens
ttgtaaaactacac

SEQ ID NO: 143290 - DNA, 21 bp, Homo sapiens
ttgtaaaatagcttgtatagt

SEQ ID NO: 143291 - DNA, 13 bp, Homo sapiens
ttgtaaaatatag

SEQ ID NO: 143292 - DNA, 12 bp, Homo sapiens
ttgtaaatatat

SEQ ID NO: 143293 - DNA, 21 bp, Homo sapiens
ttgtaaatatataaatatata

SEQ ID NO: 143294 - DNA, 12 bp, Homo sapiens
ttgtaaatattt

SEQ ID NO: 143295 - DNA, 14 bp, Homo sapiens
ttgtaaatgtgctt

SEQ ID NO: 143296 - DNA, 16 bp, Homo sapiens
ttgtaaatgtggtaaa

SEQ ID NO: 143297 - DNA, 21 bp, Homo sapiens
ttgtaaatgtggtaaagagtt

SEQ ID NO: 143298 - DNA, 17 bp, Homo sapiens
ttgtaattctaaatgaa

SEQ ID NO: 143299 - DNA, 17 bp, Homo sapiens
ttgtaattgcttacatt

SEQ ID NO: 143300 - DNA, 15 bp, Homo sapiens
ttgtatagtaaagtg

SEQ ID NO: 143301 - DNA, 15 bp, Homo sapiens
ttgtatagtgtaaaa

SEQ ID NO: 143302 - DNA, 11 bp, Homo sapiens
ttgtatatatc

SEQ ID NO: 143303 - DNA, 20 bp, Homo sapiens
ttgtatattatggaagattt

SEQ ID NO: 143304 - DNA, 20 bp, Homo sapiens
ttgtatgatcctaatgaatg

SEQ ID NO: 143305 - DNA, 17 bp, Homo sapiens
agccctggccagaggct

SEQ ID NO: 143306 - DNA, 14 bp, Homo sapiens
agccctggctctgc

SEQ ID NO: 143307 - DNA, 16 bp, Homo sapiens
agccctgggccccacc

SEQ ID NO: 143308 - DNA, 18 bp, Homo sapiens
agcccttatctgtgctca

SEQ ID NO: 143309 - DNA, 14 bp, Homo sapiens
agcccttcatttgg

SEQ ID NO: 143310 - DNA, 23 bp, Homo sapiens
agcccttccatgtcgcctctgca

SEQ ID NO: 143311 - DNA, 16 bp, Homo sapiens
agccgagagcctgctc

SEQ ID NO: 143312 - DNA, 19 bp, Homo sapiens
agccgagattgcaccactg

SEQ ID NO: 143313 - DNA, 20 bp, Homo sapiens
agccgagattgcaccactgc

SEQ ID NO: 143314 - DNA, 19 bp, Homo sapiens
agccgctcctgtctgccag

SEQ ID NO: 143315 - DNA, 19 bp, Homo sapiens
agccgctgagcgaggagat

SEQ ID NO: 143316 - DNA, 22 bp, Homo sapiens
agccgctgtgagcccctggtcc

SEQ ID NO: 143317 - DNA, 15 bp, Homo sapiens
agccggcacagggtc

SEQ ID NO: 143318 - DNA, 21 bp, Homo sapiens
agccgggtctgcctcttctgg

SEQ ID NO: 143319 - DNA, 22 bp, Homo sapiens
agccgggtctgcctcttctggg

SEQ ID NO: 143320 - DNA, 14 bp, Homo sapiens
agccgtggcttccc

SEQ ID NO: 143321 - DNA, 21 bp, Homo sapiens
agcctagccgacctcagcctt

SEQ ID NO: 143322 - DNA, 21 bp, Homo sapiens
agcctcaagtcttatttcctc

SEQ ID NO: 143323 - DNA, 11 bp, Homo sapiens
agcctcagtcc

SEQ ID NO: 143324 - DNA, 19 bp, Homo sapiens
agcctcagtcctcccctca

SEQ ID NO: 143325 - DNA, 15 bp, Homo sapiens
agcctcatatttaaa

SEQ ID NO: 143326 - DNA, 14 bp, Homo sapiens
agcctcccctgcca

SEQ ID NO: 143327 - DNA, 18 bp, Homo sapiens
agcctcccctgccagggc

SEQ ID NO: 143328 - DNA, 14 bp, Homo sapiens
agcctcctccagcc

SEQ ID NO: 143329 - DNA, 12 bp, Homo sapiens
agcctcctcctg

SEQ ID NO: 143330 - DNA, 23 bp, Homo sapiens
agcctctgaaaaccaatgttctc

SEQ ID NO: 143331 - DNA, 12 bp, Homo sapiens
agcctctgaccc

SEQ ID NO: 143332 - DNA, 15 bp, Homo sapiens
agcctctgacccctc

SEQ ID NO: 143333 - DNA, 19 bp, Homo sapiens
agcctctgacccctcctca

SEQ ID NO: 143334 - DNA, 21 bp, Homo sapiens
agcctctgacccctcctcact

SEQ ID NO: 143335 - DNA, 23 bp, Homo sapiens
agcctcttaaagctgcctgtagt

SEQ ID NO: 143336 - DNA, 18 bp, Homo sapiens
agcctctttctgtccctt

SEQ ID NO: 143337 - DNA, 22 bp, Homo sapiens
agcctgcaggtgctgctgcgtg

SEQ ID NO: 143338 - DNA, 19 bp, Homo sapiens
agcctgcctcttctctact

SEQ ID NO: 143339 - DNA, 18 bp, Homo sapiens
agcctgcggcctgctgga

SEQ ID NO: 143340 - DNA, 16 bp, Homo sapiens
agcctgctccagctgt

SEQ ID NO: 143341 - DNA, 17 bp, Homo sapiens
agcctgctcccccaccc

SEQ ID NO: 143342 - DNA, 21 bp, Homo sapiens
agcctgctcccccaccccctc

SEQ ID NO: 143343 - DNA, 14 bp, Homo sapiens
agcctggaccctgt

SEQ ID NO: 143344 - DNA, 23 bp, Homo sapiens
agcctggaggccgggtgctcagg

SEQ ID NO: 143345 - DNA, 17 bp, Homo sapiens
agcctggccagcctaca

SEQ ID NO: 143346 - DNA, 12 bp, Homo sapiens
agcctggctctt

SEQ ID NO: 143347 - DNA, 12 bp, Homo sapiens
agcctgggaggt

SEQ ID NO: 143348 - DNA, 21 bp, Homo sapiens
agcctggtgggcctcctctgt

SEQ ID NO: 143349 - DNA, 22 bp, Homo sapiens
agcctggtgggcctcctctgtc

SEQ ID NO: 143350 - DNA, 16 bp, Homo sapiens
agcctgtctcttccat

SEQ ID NO: 143351 - DNA, 17 bp, Homo sapiens
agcctgtgcctctggga

SEQ ID NO: 143352 - DNA, 12 bp, Homo sapiens
tttacaaagtgt

SEQ ID NO: 143353 - DNA, 16 bp, Homo sapiens
tttacaaagtgtgtat

SEQ ID NO: 143354 - DNA, 21 bp, Homo sapiens
tttacaagtgtatatcagaaa

SEQ ID NO: 143355 - DNA, 19 bp, Homo sapiens
tttacaatttacaaagtgt

SEQ ID NO: 143356 - DNA, 13 bp, Homo sapiens
tttacagctgcct

SEQ ID NO: 143357 - DNA, 20 bp, Homo sapiens
tttacattgtaaatagtatt

SEQ ID NO: 143358 - DNA, 13 bp, Homo sapiens
tttaccttgtata

SEQ ID NO: 143359 - DNA, 22 bp, Homo sapiens
tttactaagccacaagaaattt

SEQ ID NO: 143360 - DNA, 21 bp, Homo sapiens
tttactgagcttctctgtgaa

SEQ ID NO: 143361 - DNA, 14 bp, Homo sapiens
tttacttcttatac

SEQ ID NO: 143362 - DNA, 19 bp, Homo sapiens
tttacttcttatacatttg

SEQ ID NO: 143363 - DNA, 22 bp, Homo sapiens
tttaggtcaagaagaagatgga

SEQ ID NO: 143364 - DNA, 23 bp, Homo sapiens
tttagtagatattaccagttttc

SEQ ID NO: 143365 - DNA, 17 bp, Homo sapiens
tttagttgtatctcttt

SEQ ID NO: 143366 - DNA, 20 bp, Homo sapiens
tttagttgtatctcttttga

SEQ ID NO: 143367 - DNA, 16 bp, Homo sapiens
tttataactcatcata

SEQ ID NO: 143368 - DNA, 18 bp, Homo sapiens
tttataactcatcataaa

SEQ ID NO: 143369 - DNA, 20 bp, Homo sapiens
tttataactcatcataaaat

SEQ ID NO: 143370 - DNA, 20 bp, Homo sapiens
tttatagctattactgtctg

SEQ ID NO: 143371 - DNA, 19 bp, Homo sapiens
tttatagtttgtacatgca

SEQ ID NO: 143372 - DNA, 14 bp, Homo sapiens
tttatatgtcaaag

SEQ ID NO: 143373 - DNA, 14 bp, Homo sapiens
tttatatttagtga

SEQ ID NO: 143374 - DNA, 14 bp, Homo sapiens
tttatcatgacatg

SEQ ID NO: 143375 - DNA, 15 bp, Homo sapiens
tttatcatgacatgt

SEQ ID NO: 143376 - DNA, 12 bp, Homo sapiens
tttatcattttc

SEQ ID NO: 143377 - DNA, 14 bp, Homo sapiens
tttatcttgtctct

SEQ ID NO: 143378 - DNA, 18 bp, Homo sapiens
tttatgaaaggtttacat

SEQ ID NO: 143379 - DNA, 14 bp, Homo sapiens
tttattaaaatctt

SEQ ID NO: 143380 - DNA, 14 bp, Homo sapiens
tttattaaaatgat

SEQ ID NO: 143381 - DNA, 23 bp, Homo sapiens
tttattaaaatgattgtaaaata

SEQ ID NO: 143382 - DNA, 21 bp, Homo sapiens
tttattaataaacattctatc

SEQ ID NO: 143383 - DNA, 13 bp, Homo sapiens
tttattacctctg

SEQ ID NO: 143384 - DNA, 12 bp, Homo sapiens
tttattgacaat

SEQ ID NO: 143385 - DNA, 17 bp, Homo sapiens
tttatttttcatttagt

SEQ ID NO: 143386 - DNA, 17 bp, Homo sapiens
tttattttttaagtatt

SEQ ID NO: 143387 - DNA, 15 bp, Homo sapiens
tttcaacgcagccct

SEQ ID NO: 143388 - DNA, 13 bp, Homo sapiens
tttcacaacagat

SEQ ID NO: 143389 - DNA, 18 bp, Homo sapiens
tttcacggaagttttcaa

SEQ ID NO: 143390 - DNA, 23 bp, Homo sapiens
tttcacggaagttttcaatgatg

SEQ ID NO: 143391 - DNA, 17 bp, Homo sapiens
tttcactgctggctgcc

SEQ ID NO: 143392 - DNA, 18 bp, Homo sapiens
tttcactgctggctgcct

SEQ ID NO: 143393 - DNA, 22 bp, Homo sapiens
tttcagaaaatattatgtgttt

SEQ ID NO: 143394 - DNA, 21 bp, Homo sapiens
tttcagaaagaagtggggaca

SEQ ID NO: 143395 - DNA, 14 bp, Homo sapiens
tttcagaccccagc

SEQ ID NO: 143396 - DNA, 17 bp, Homo sapiens
tttcataagtatttcaa

SEQ ID NO: 143397 - DNA, 23 bp, Homo sapiens
tttcatccctatgggattcagtg

SEQ ID NO: 143398 - DNA, 19 bp, Homo sapiens
tttcatttagtcatgtgac

SEQ ID NO: 143399 - DNA, 14 bp, Homo sapiens
tttccaaaataatt

SEQ ID NO: 143400 - DNA, 19 bp, Homo sapiens
tttccacgatgaaaaactt

SEQ ID NO: 143401 - DNA, 23 bp, Homo sapiens
tttccacggagccactcctctga

SEQ ID NO: 143402 - DNA, 19 bp, Homo sapiens
tttccaggtttaagctgtt

SEQ ID NO: 143403 - DNA, 13 bp, Homo sapiens
tttccattattta

SEQ ID NO: 143404 - DNA, 21 bp, Homo sapiens
tttccattatttatattagtt

SEQ ID NO: 143405 - DNA, 11 bp, Homo sapiens
tttccccagcc

SEQ ID NO: 143406 - DNA, 21 bp, Homo sapiens
tttccccaggggaaaatgaag

SEQ ID NO: 143407 - DNA, 18 bp, Homo sapiens
tttccccggtcccttgag

SEQ ID NO: 143408 - DNA, 22 bp, Homo sapiens
tttcctaacaggattagacagt

SEQ ID NO: 143409 - DNA, 23 bp, Homo sapiens
tttcctgacagaaggactcaggt

SEQ ID NO: 143410 - DNA, 13 bp, Homo sapiens
tttccttcagtgc

SEQ ID NO: 143411 - DNA, 19 bp, Homo sapiens
tttccttggggcaggcagt

SEQ ID NO: 143412 - DNA, 20 bp, Homo sapiens
tttcctttccccagcccagg

SEQ ID NO: 143413 - DNA, 19 bp, Homo sapiens
tttctaaaggcctcttcct

SEQ ID NO: 143414 - DNA, 13 bp, Homo sapiens
tttctaaatgttt

SEQ ID NO: 143415 - DNA, 14 bp, Homo sapiens
tttctaatgagata

SEQ ID NO: 143416 - DNA, 20 bp, Homo sapiens
tttctagaacatccctgcca

SEQ ID NO: 143417 - DNA, 22 bp, Homo sapiens
tttctagaacatccctgccagc

SEQ ID NO: 143418 - DNA, 16 bp, Homo sapiens
tttctagattaagata

SEQ ID NO: 143419 - DNA, 17 bp, Homo sapiens
tttctattgaaaaatca

SEQ ID NO: 143420 - DNA, 11 bp, Homo sapiens
tttctctgcca

SEQ ID NO: 143421 - DNA, 17 bp, Homo sapiens
tttctctgtatagtact

SEQ ID NO: 143422 - DNA, 22 bp, Homo sapiens
tttctgagaaagactattcaaa

SEQ ID NO: 143423 - DNA, 19 bp, Homo sapiens
tttctgagaaggtccttaa

SEQ ID NO: 143424 - DNA, 18 bp, Homo sapiens
tttctgaggagaaacaaa

SEQ ID NO: 143425 - DNA, 14 bp, Homo sapiens
tttctgcatcagct

SEQ ID NO: 143426 - DNA, 21 bp, Homo sapiens
tttctgggctgtctattctag

SEQ ID NO: 143427 - DNA, 22 bp, Homo sapiens
tttctgtgtgcaccttaccaac

SEQ ID NO: 143428 - DNA, 17 bp, Homo sapiens
tttcttatttcatttct

SEQ ID NO: 143429 - DNA, 16 bp, Homo sapiens
tttcttcctctgctga

SEQ ID NO: 143430 - DNA, 14 bp, Homo sapiens
tttctttcaaaatt

SEQ ID NO: 143431 - DNA, 16 bp, Homo sapiens
tttctttgaatgcttt

SEQ ID NO: 143432 - DNA, 22 bp, Homo sapiens
tttctttgaatgctttttgaat

SEQ ID NO: 143433 - DNA, 14 bp, Homo sapiens
tttgaaataataaa

SEQ ID NO: 143434 - DNA, 14 bp, Homo sapiens
tttgaactcttcaa

SEQ ID NO: 143435 - DNA, 19 bp, Homo sapiens
tttgaagaatgaacaaatt

SEQ ID NO: 143436 - DNA, 15 bp, Homo sapiens
tttgaagaggaaaat

SEQ ID NO: 143437 - DNA, 22 bp, Homo sapiens
tttgaagatgccgcatttggat

SEQ ID NO: 143438 - DNA, 18 bp, Homo sapiens
tttgaagtgtaggcagac

SEQ ID NO: 143439 - DNA, 20 bp, Homo sapiens
tttgaagtgtaggcagacac

SEQ ID NO: 143440 - DNA, 22 bp, Homo sapiens
tttgaagtgtaggcagacacag

SEQ ID NO: 143441 - DNA, 14 bp, Homo sapiens
tttgagtgctctga

SEQ ID NO: 143442 - DNA, 15 bp, Homo sapiens
tttgatgagttgtga

SEQ ID NO: 143443 - DNA, 12 bp, Homo sapiens
tttgatttatgc

SEQ ID NO: 143444 - DNA, 14 bp, Homo sapiens
tttgatttcattaa

SEQ ID NO: 143445 - DNA, 13 bp, Homo sapiens
tttgatttctatt

SEQ ID NO: 143446 - DNA, 21 bp, Homo sapiens
tttgcaagggaaaagtctctt

SEQ ID NO: 143447 - DNA, 22 bp, Homo sapiens
agctgtagtagccctttctgtg

SEQ ID NO: 143448 - DNA, 19 bp, Homo sapiens
agctgtgcaggtggggaga

SEQ ID NO: 143449 - DNA, 13 bp, Homo sapiens
agctgtgtgaaat

SEQ ID NO: 143450 - DNA, 14 bp, Homo sapiens
agctgttcagctgg

SEQ ID NO: 143451 - DNA, 13 bp, Homo sapiens
agctgttgagctg

SEQ ID NO: 143452 - DNA, 16 bp, Homo sapiens
agctgttgagctgttt

SEQ ID NO: 143453 - DNA, 17 bp, Homo sapiens
agctgttgagctgtttt

SEQ ID NO: 143454 - DNA, 12 bp, Homo sapiens
agctgtttaaga

SEQ ID NO: 143455 - DNA, 20 bp, Homo sapiens
agcttaaaggggctagagtg

SEQ ID NO: 143456 - DNA, 15 bp, Homo sapiens
agcttagacctcagc

SEQ ID NO: 143457 - DNA, 16 bp, Homo sapiens
agcttagacctcagcc

SEQ ID NO: 143458 - DNA, 18 bp, Homo sapiens
agcttagacctcagcctg

SEQ ID NO: 143459 - DNA, 15 bp, Homo sapiens
agcttattaaaactc

SEQ ID NO: 143460 - DNA, 15 bp, Homo sapiens
agcttcagtttcctg

SEQ ID NO: 143461 - DNA, 17 bp, Homo sapiens
agcttcccctctctcct

SEQ ID NO: 143462 - DNA, 14 bp, Homo sapiens
agcttctctgtgaa

SEQ ID NO: 143463 - DNA, 18 bp, Homo sapiens
agcttcttaaatgagaag

SEQ ID NO: 143464 - DNA, 21 bp, Homo sapiens
agcttcttaatataactgcct

SEQ ID NO: 143465 - DNA, 20 bp, Homo sapiens
agcttcttccaggtgcccag

SEQ ID NO: 143466 - DNA, 17 bp, Homo sapiens
agcttgaaactgagatg

SEQ ID NO: 143467 - DNA, 19 bp, Homo sapiens
agcttgctcttcagtggga

SEQ ID NO: 143468 - DNA, 20 bp, Homo sapiens
agcttgctgccctaggctcc

SEQ ID NO: 143469 - DNA, 16 bp, Homo sapiens
agcttgggacaaatca

SEQ ID NO: 143470 - DNA, 16 bp, Homo sapiens
agcttgttatttataa

SEQ ID NO: 143471 - DNA, 21 bp, Homo sapiens
agctttaaactcagggacaga

SEQ ID NO: 143472 - DNA, 15 bp, Homo sapiens
agctttacatgcaat

SEQ ID NO: 143473 - DNA, 19 bp, Homo sapiens
agctttacatgcaatttat

SEQ ID NO: 143474 - DNA, 22 bp, Homo sapiens
agctttattttttaagtattta

SEQ ID NO: 143475 - DNA, 12 bp, Homo sapiens
agctttgaaaat

SEQ ID NO: 143476 - DNA, 18 bp, Homo sapiens
agctttgaaaattcagtg

SEQ ID NO: 143477 - DNA, 16 bp, Homo sapiens
agcttttaaaccctat

SEQ ID NO: 143478 - DNA, 13 bp, Homo sapiens
agcttttcccttc

SEQ ID NO: 143479 - DNA, 14 bp, Homo sapiens
aggaaaaaaatgac

SEQ ID NO: 143480 - DNA, 15 bp, Homo sapiens
aggaaaaatgtgtaa

SEQ ID NO: 143481 - DNA, 19 bp, Homo sapiens
aggaaaaatgtgtaatttt

SEQ ID NO: 143482 - DNA, 19 bp, Homo sapiens
aggaaaaccaagccgtggc

SEQ ID NO: 143483 - DNA, 16 bp, Homo sapiens
aggaaaagtacattta

SEQ ID NO: 143484 - DNA, 13 bp, Homo sapiens
aggaaaggccagc

SEQ ID NO: 143485 - DNA, 15 bp, Homo sapiens
aggaaaggccagctg

SEQ ID NO: 143486 - DNA, 18 bp, Homo sapiens
aggaaaggccagctggca

SEQ ID NO: 143487 - DNA, 20 bp, Homo sapiens
aggaaataaaacctttcaaa

SEQ ID NO: 143488 - DNA, 23 bp, Homo sapiens
aggaaatcaaatatgcaaagcac

SEQ ID NO: 143489 - DNA, 16 bp, Homo sapiens
aggaaatctcacccca

SEQ ID NO: 143490 - DNA, 19 bp, Homo sapiens
aggaacctcctccacacca

SEQ ID NO: 143491 - DNA, 17 bp, Homo sapiens
aggaactgtccagagag

SEQ ID NO: 143492 - DNA, 14 bp, Homo sapiens
aggaagagggacag

SEQ ID NO: 143493 - DNA, 20 bp, Homo sapiens
aggaagccgtgccctgcccc

SEQ ID NO: 143494 - DNA, 14 bp, Homo sapiens
aggaagctcagact

SEQ ID NO: 143495 - DNA, 17 bp, Homo sapiens
aggaagctcagactggt

SEQ ID NO: 143496 - DNA, 15 bp, Homo sapiens
aggaagctccactgt

SEQ ID NO: 143497 - DNA, 21 bp, Homo sapiens
aggaaggagagaaggggagga

SEQ ID NO: 143498 - DNA, 17 bp, Homo sapiens
aggaaggatgagcattt

SEQ ID NO: 143499 - DNA, 15 bp, Homo sapiens
aggaaggctgagagg

SEQ ID NO: 143500 - DNA, 22 bp, Homo sapiens
aggaaggctgagaggagagaga

SEQ ID NO: 143501 - DNA, 16 bp, Homo sapiens
aggaaggggccagagg

SEQ ID NO: 143502 - DNA, 18 bp, Homo sapiens
aggaaggggccagaggct

SEQ ID NO: 143503 - DNA, 20 bp, Homo sapiens
aggaaggggccagaggctcg

SEQ ID NO: 143504 - DNA, 17 bp, Homo sapiens
aggaatatatggcagag

SEQ ID NO: 143505 - DNA, 20 bp, Homo sapiens
ttttccagctggatgagaat

SEQ ID NO: 143506 - DNA, 23 bp, Homo sapiens
ttttccccggtcccttgagacct

SEQ ID NO: 143507 - DNA, 19 bp, Homo sapiens
ttttcctccgggagagggg

SEQ ID NO: 143508 - DNA, 18 bp, Homo sapiens
ttttctagactttctgtt

SEQ ID NO: 143509 - DNA, 18 bp, Homo sapiens
ttttctggaatgtaatca

SEQ ID NO: 143510 - DNA, 14 bp, Homo sapiens
ttttgaatgttatt

SEQ ID NO: 143511 - DNA, 15 bp, Homo sapiens
ttttgatagctttat

SEQ ID NO: 143512 - DNA, 22 bp, Homo sapiens
ttttgcaagtgaaggtttacaa

SEQ ID NO: 143513 - DNA, 15 bp, Homo sapiens
ttttgccattaaact

SEQ ID NO: 143514 - DNA, 13 bp, Homo sapiens
ttttgccctttga

SEQ ID NO: 143515 - DNA, 15 bp, Homo sapiens
ttttgcctcttttct

SEQ ID NO: 143516 - DNA, 22 bp, Homo sapiens
ttttggtttgcagatgacaaaa

SEQ ID NO: 143517 - DNA, 21 bp, Homo sapiens
ttttgtaaagatgccgggttt

SEQ ID NO: 143518 - DNA, 18 bp, Homo sapiens
ttttgtatagtaaagtga

SEQ ID NO: 143519 - DNA, 14 bp, Homo sapiens
ttttgtatgtaaat

SEQ ID NO: 143520 - DNA, 16 bp, Homo sapiens
ttttgtcatataagat

SEQ ID NO: 143521 - DNA, 21 bp, Homo sapiens
ttttgtgatgtcccaacttgt

SEQ ID NO: 143522 - DNA, 16 bp, Homo sapiens
ttttgttcaaagccag

SEQ ID NO: 143523 - DNA, 15 bp, Homo sapiens
ttttgttccacaagt

SEQ ID NO: 143524 - DNA, 21 bp, Homo sapiens
ttttgttccacaagttaaata

SEQ ID NO: 143525 - DNA, 17 bp, Homo sapiens
ttttgtttttcattcag

SEQ ID NO: 143526 - DNA, 18 bp, Homo sapiens
tttttaagctgtttccat

SEQ ID NO: 143527 - DNA, 15 bp, Homo sapiens
tttttatatttagtt

SEQ ID NO: 143528 - DNA, 19 bp, Homo sapiens
tttttcacggaagttttca

SEQ ID NO: 143529 - DNA, 18 bp, Homo sapiens
tttttcatgattttgaaa

SEQ ID NO: 143530 - DNA, 14 bp, Homo sapiens
tttttgaaataata

SEQ ID NO: 143531 - DNA, 11 bp, Homo sapiens
tttttgaagtg

SEQ ID NO: 143532 - DNA, 14 bp, Homo sapiens
tttttgatagcttt

SEQ ID NO: 143533 - DNA, 22 bp, Homo sapiens
tttttgttccacaagttaaata

SEQ ID NO: 143534 - DNA, 17 bp, Homo sapiens
ttttttaagtatttata

SEQ ID NO: 143535 - DNA, 16 bp, Homo sapiens
ttttttatgctaatca

SEQ ID NO: 143536 - DNA, 18 bp, Homo sapiens
aggatgtgatatataagt

SEQ ID NO: 143537 - DNA, 21 bp, Homo sapiens
aggatgtgatatataagtgta

SEQ ID NO: 143538 - DNA, 17 bp, Homo sapiens
aggatgttgaaaaagtt

SEQ ID NO: 143539 - DNA, 12 bp, Homo sapiens
aggatttaacag

SEQ ID NO: 143540 - DNA, 20 bp, Homo sapiens
aggatttcatgatttcattt

SEQ ID NO: 143541 - DNA, 14 bp, Homo sapiens
aggcaactgaggca

SEQ ID NO: 143542 - DNA, 19 bp, Homo sapiens
aggcaactgaggcagacag

SEQ ID NO: 143543 - DNA, 13 bp, Homo sapiens
aggcaagtgaaga

SEQ ID NO: 143544 - DNA, 18 bp, Homo sapiens
aggcacacagctgcagag

SEQ ID NO: 143545 - DNA, 17 bp, Homo sapiens
aggcacagtgaaggctg

SEQ ID NO: 143546 - DNA, 14 bp, Homo sapiens
aggcacgaacccac

SEQ ID NO: 143547 - DNA, 20 bp, Homo sapiens
aggcacgaacccacctgctg

SEQ ID NO: 143548 - DNA, 13 bp, Homo sapiens
aggcactagcctt

SEQ ID NO: 143549 - DNA, 22 bp, Homo sapiens
aggcactgctgcccagcctcca

SEQ ID NO: 143550 - DNA, 22 bp, Homo sapiens
aggcagaagaattgaacccagg

SEQ ID NO: 143551 - DNA, 14 bp, Homo sapiens
aggcagacacaggg

SEQ ID NO: 143552 - DNA, 15 bp, Homo sapiens
aggcagacacaggga

SEQ ID NO: 143553 - DNA, 14 bp, Homo sapiens
aggcagacagcagc

SEQ ID NO: 143554 - DNA, 20 bp, Homo sapiens
aggcagacagcagctcaggc

SEQ ID NO: 143555 - DNA, 11 bp, Homo sapiens
aggcagagagc

SEQ ID NO: 143556 - DNA, 20 bp, Homo sapiens
aggcagaggttgcagtgagc

SEQ ID NO: 143557 - DNA, 19 bp, Homo sapiens
aggcagcagtgtgaggcca

SEQ ID NO: 143558 - DNA, 12 bp, Homo sapiens
aggcagggaagt

SEQ ID NO: 143559 - DNA, 23 bp, Homo sapiens
aggcagggaagtccccaggcccc

SEQ ID NO: 143560 - DNA, 19 bp, Homo sapiens
aggcagggccttgcccaga

SEQ ID NO: 143561 - DNA, 23 bp, Homo sapiens
aggcagggtcaggagaggggcag

SEQ ID NO: 143562 - DNA, 17 bp, Homo sapiens
aggcaggtgggatggat

SEQ ID NO: 143563 - DNA, 16 bp, Homo sapiens
aggcatggccctgggg

SEQ ID NO: 143564 - DNA, 21 bp, Homo sapiens
aggcatggccctggggtccca

SEQ ID NO: 143565 - DNA, 13 bp, Homo sapiens
aggcattgccaag

SEQ ID NO: 143566 - DNA, 16 bp, Homo sapiens
aggcatttgctgaata

SEQ ID NO: 143567 - DNA, 13 bp, Homo sapiens
aggccacggcagc

SEQ ID NO: 143568 - DNA, 13 bp, Homo sapiens
aggccagcctggc

SEQ ID NO: 143569 - DNA, 14 bp, Homo sapiens
aggccagctggcag

SEQ ID NO: 143570 - DNA, 15 bp, Homo sapiens
aggccagctggcagc

SEQ ID NO: 143571 - DNA, 19 bp, Homo sapiens
aggccagctggcagcagag

SEQ ID NO: 143572 - DNA, 20 bp, Homo sapiens
aggccagctggcagcagagt

SEQ ID NO: 143573 - DNA, 11 bp, Homo sapiens
aggccaggctc

SEQ ID NO: 143574 - DNA, 12 bp, Homo sapiens
aggccaggctcc

SEQ ID NO: 143575 - DNA, 13 bp, Homo sapiens
aggccagggcaga

SEQ ID NO: 143576 - DNA, 15 bp, Homo sapiens
aggccagggcagagt

SEQ ID NO: 143577 - DNA, 16 bp, Homo sapiens
aggccccaggaagccg

SEQ ID NO: 143578 - DNA, 13 bp, Homo sapiens
aggcccccaagcc

SEQ ID NO: 143579 - DNA, 15 bp, Homo sapiens
aggcccccaggtgcc

SEQ ID NO: 143580 - DNA, 15 bp, Homo sapiens
aggccccgcttgtcc

SEQ ID NO: 143581 - DNA, 21 bp, Homo sapiens
aggccccgcttgtccagcgcc

SEQ ID NO: 143582 - DNA, 17 bp, Homo sapiens
aggccctcgctgccagc

SEQ ID NO: 143583 - DNA, 15 bp, Homo sapiens
aggcccttcctctcc

SEQ ID NO: 143584 - DNA, 17 bp, Homo sapiens
aggcccttcctctccac

SEQ ID NO: 143585 - DNA, 18 bp, Homo sapiens
aggccgaagaagggtcct

SEQ ID NO: 143586 - DNA, 14 bp, Homo sapiens
aggccgccccagcc

SEQ ID NO: 143587 - DNA, 12 bp, Homo sapiens
aggccgtggctg

SEQ ID NO: 143588 - DNA, 20 bp, Homo sapiens
aggccgtggctgcccacaca

SEQ ID NO: 143589 - DNA, 21 bp, Homo sapiens
aggcctgaaagaggctgaggc

SEQ ID NO: 143590 - DNA, 23 bp, Homo sapiens
aggcctgccagacggcacccacc

SEQ ID NO: 143591 - DNA, 22 bp, Homo sapiens
aggcctggactttcctgcaact

SEQ ID NO: 143592 - DNA, 12 bp, Homo sapiens
aggcctggggac

SEQ ID NO: 143593 - DNA, 23 bp, Homo sapiens
aggcctgtgtgtgaaaggaagct

SEQ ID NO: 143594 - DNA, 23 bp, Homo sapiens
aggcgatccacctgtctcagcct

SEQ ID NO: 143595 - DNA, 13 bp, Homo sapiens
aggcgtgaggatg

SEQ ID NO: 143596 - DNA, 17 bp, Homo sapiens
aggctactgtcagctcc

SEQ ID NO: 143597 - DNA, 15 bp, Homo sapiens
aggctagatcatgaa

SEQ ID NO: 143598 - DNA, 14 bp, Homo sapiens
aggctccagagggc

SEQ ID NO: 143599 - DNA, 13 bp, Homo sapiens
aggctccttcctg

SEQ ID NO: 143600 - DNA, 23 bp, Homo sapiens
aggctccttcctgtcttcctgca

SEQ ID NO: 143601 - DNA, 14 bp, Homo sapiens
aggctcgattttgt

SEQ ID NO: 143602 - DNA, 15 bp, Homo sapiens
aggctcgattttgta

SEQ ID NO: 143603 - DNA, 17 bp, Homo sapiens
atcccagctactcagga

SEQ ID NO: 143604 - DNA, 18 bp, Homo sapiens
atcccagctactcaggag

SEQ ID NO: 143605 - DNA, 20 bp, Homo sapiens
atcccagctactcaggaggc

SEQ ID NO: 143606 - DNA, 13 bp, Homo sapiens
atcccagctcacg

SEQ ID NO: 143607 - DNA, 12 bp, Homo sapiens
atcccaggacac

SEQ ID NO: 143608 - DNA, 21 bp, Homo sapiens
atcccaggacaccacacccag

SEQ ID NO: 143609 - DNA, 16 bp, Homo sapiens
atcccattctgcgtca

SEQ ID NO: 143610 - DNA, 14 bp, Homo sapiens
atcccattgccctg

SEQ ID NO: 143611 - DNA, 13 bp, Homo sapiens
atccccacccttg

SEQ ID NO: 143612 - DNA, 13 bp, Homo sapiens
atcccctcccagt

SEQ ID NO: 143613 - DNA, 18 bp, Homo sapiens
atcccctggactgggagg

SEQ ID NO: 143614 - DNA, 15 bp, Homo sapiens
atcccctgtagagtg

SEQ ID NO: 143615 - DNA, 14 bp, Homo sapiens
atcccgaaaatctc

SEQ ID NO: 143616 - DNA, 17 bp, Homo sapiens
atcccgagcacctccac

SEQ ID NO: 143617 - DNA, 18 bp, Homo sapiens
atccctaatgtgtgccat

SEQ ID NO: 143618 - DNA, 13 bp, Homo sapiens
atccctacatgta

SEQ ID NO: 143619 - DNA, 18 bp, Homo sapiens
atccctacatgtattgca

SEQ ID NO: 143620 - DNA, 11 bp, Homo sapiens
atccctcatct

SEQ ID NO: 143621 - DNA, 20 bp, Homo sapiens
atccctctacagagcttccc

SEQ ID NO: 143622 - DNA, 22 bp, Homo sapiens
atccctctacagagcttccctg

SEQ ID NO: 143623 - DNA, 15 bp, Homo sapiens
atccctgcctggtca

SEQ ID NO: 143624 - DNA, 20 bp, Homo sapiens
atccctgtttaatatttaaa

SEQ ID NO: 143625 - DNA, 14 bp, Homo sapiens
atcctaaaacaaat

SEQ ID NO: 143626 - DNA, 19 bp, Homo sapiens
atcctaatgaatgcataaa

SEQ ID NO: 143627 - DNA, 19 bp, Homo sapiens
atcctatcaacaacaaggt

SEQ ID NO: 143628 - DNA, 12 bp, Homo sapiens
atcctcaatcca

SEQ ID NO: 143629 - DNA, 19 bp, Homo sapiens
atcctgatgaggtttctac

SEQ ID NO: 143630 - DNA, 20 bp, Homo sapiens
atcctggggcattaaaaaaa

SEQ ID NO: 143631 - DNA, 17 bp, Homo sapiens
atcctttaaatccttcc

SEQ ID NO: 143632 - DNA, 13 bp, Homo sapiens
atcctttctaaca

SEQ ID NO: 143633 - DNA, 16 bp, Homo sapiens
atccttttatgttatt

SEQ ID NO: 143634 - DNA, 19 bp, Homo sapiens
atccttttatgttatttat

SEQ ID NO: 143635 - DNA, 12 bp, Homo sapiens
atcgattggctt

SEQ ID NO: 143636 - DNA, 20 bp, Homo sapiens
atcgatttttaaaaattaaa

SEQ ID NO: 143637 - DNA, 19 bp, Homo sapiens
atcgccctccacatccctg

SEQ ID NO: 143638 - DNA, 16 bp, Homo sapiens
atcggagcctcctctc

SEQ ID NO: 143639 - DNA, 20 bp, Homo sapiens
atcggcccacagctcccacc

SEQ ID NO: 143640 - DNA, 18 bp, Homo sapiens
atcgtaatgtacagatgg

SEQ ID NO: 143641 - DNA, 23 bp, Homo sapiens
atcgtctctccctccctttgaaa

SEQ ID NO: 143642 - DNA, 19 bp, Homo sapiens
atctaaaaatagacttaaa

SEQ ID NO: 143643 - DNA, 14 bp, Homo sapiens
atctaatattaaaa

SEQ ID NO: 143644 - DNA, 15 bp, Homo sapiens
atctacccaaaggat

SEQ ID NO: 143645 - DNA, 21 bp, Homo sapiens
atctacccaaaggatactgta

SEQ ID NO: 143646 - DNA, 20 bp, Homo sapiens
atctaggtgaggattgatta

SEQ ID NO: 143647 - DNA, 17 bp, Homo sapiens
atctatcaatagtcaag

SEQ ID NO: 143648 - DNA, 14 bp, Homo sapiens
atctatttctgaga

SEQ ID NO: 143649 - DNA, 19 bp, Homo sapiens
atctcaaaactgcactgtc

SEQ ID NO: 143650 - DNA, 20 bp, Homo sapiens
atctcaaaactgcactgtca

SEQ ID NO: 143651 - DNA, 13 bp, Homo sapiens
atctcaccccatc

SEQ ID NO: 143652 - DNA, 23 bp, Homo sapiens
atctcaccccatcccacaccctg

SEQ ID NO: 143653 - DNA, 20 bp, Homo sapiens
atctcagaattccttttcta

SEQ ID NO: 143654 - DNA, 16 bp, Homo sapiens
atctcagggcctggtc

SEQ ID NO: 143655 - DNA, 15 bp, Homo sapiens
atctcaggggccaga

SEQ ID NO: 143656 - DNA, 19 bp, Homo sapiens
atctcataggttgccaata

SEQ ID NO: 143657 - DNA, 20 bp, Homo sapiens
atctcattggacccttccat

SEQ ID NO: 143658 - DNA, 19 bp, Homo sapiens
atctccacctgctcccagg

SEQ ID NO: 143659 - DNA, 15 bp, Homo sapiens
atctccagtattctt

SEQ ID NO: 143660 - DNA, 18 bp, Homo sapiens
atctccagtattcttgtc

SEQ ID NO: 143661 - DNA, 23 bp, Homo sapiens
atctccccttgcactaaagtatg

SEQ ID NO: 143662 - DNA, 12 bp, Homo sapiens
atctccctgccg

SEQ ID NO: 143663 - DNA, 15 bp, Homo sapiens
atctccctgccgcct

SEQ ID NO: 143664 - DNA, 16 bp, Homo sapiens
atctcctgccttcctc

SEQ ID NO: 143665 - DNA, 21 bp, Homo sapiens
atctcgccacccctccttcct

SEQ ID NO: 143666 - DNA, 22 bp, Homo sapiens
atctcgtttttcttcttaagac

SEQ ID NO: 143667 - DNA, 22 bp, Homo sapiens
atctctaatatggcaaaaatgg

SEQ ID NO: 143668 - DNA, 13 bp, Homo sapiens
atctctatttaat

SEQ ID NO: 143669 - DNA, 15 bp, Homo sapiens
atctctatttaatat

SEQ ID NO: 143670 - DNA, 16 bp, Homo sapiens
atctctatttaatatt

SEQ ID NO: 143671 - DNA, 19 bp, Homo sapiens
atctctatttaatatttat

SEQ ID NO: 143672 - DNA, 14 bp, Homo sapiens
atctctccctcccc

SEQ ID NO: 143673 - DNA, 20 bp, Homo sapiens
atctctcggttccacgtccc

SEQ ID NO: 143674 - DNA, 16 bp, Homo sapiens
atctctgctttggaaa

SEQ ID NO: 143675 - DNA, 17 bp, Homo sapiens
atctctgctttggaaat

SEQ ID NO: 143676 - DNA, 19 bp, Homo sapiens
atctcttattttacaataa

SEQ ID NO: 143677 - DNA, 18 bp, Homo sapiens
atctcttgagcctgggag

SEQ ID NO: 143678 - DNA, 22 bp, Homo sapiens
atctcttttgaatccatgcttg

SEQ ID NO: 143679 - DNA, 16 bp, Homo sapiens
atctgagaatctttat

SEQ ID NO: 143680 - DNA, 19 bp, Homo sapiens
atctgatttgttttcctct

SEQ ID NO: 143681 - DNA, 18 bp, Homo sapiens
atctgcacccccctgggc

SEQ ID NO: 143682 - DNA, 21 bp, Homo sapiens
atctgcacccccctgggctga

SEQ ID NO: 143683 - DNA, 22 bp, Homo sapiens
atctgcagaaggaaaaatgtgt

SEQ ID NO: 143684 - DNA, 23 bp, Homo sapiens
atctgcagaaggaaaaatgtgta

SEQ ID NO: 143685 - DNA, 16 bp, Homo sapiens
atctgcaggcagacac

SEQ ID NO: 143686 - DNA, 22 bp, Homo sapiens
atctgcattttcaccccaccct

SEQ ID NO: 143687 - DNA, 23 bp, Homo sapiens
atctgcattttcaccccaccctt

SEQ ID NO: 143688 - DNA, 21 bp, Homo sapiens
atctgcttacaattccctgct

SEQ ID NO: 143689 - DNA, 17 bp, Homo sapiens
atctggactcctctgtc

SEQ ID NO: 143690 - DNA, 12 bp, Homo sapiens
atctggcagggt

SEQ ID NO: 143691 - DNA, 22 bp, Homo sapiens
atctgggaaaataccccatcat

SEQ ID NO: 143692 - DNA, 16 bp, Homo sapiens
atctgggaagatttct

SEQ ID NO: 143693 - DNA, 16 bp, Homo sapiens
atctgggaccctttcc

SEQ ID NO: 143694 - DNA, 23 bp, Homo sapiens
atctgggaccctttccttccttc

SEQ ID NO: 143695 - DNA, 14 bp, Homo sapiens
atctgggtccttgc

SEQ ID NO: 143696 - DNA, 18 bp, Homo sapiens
atctgggtccttgcaccc

SEQ ID NO: 143697 - DNA, 21 bp, Homo sapiens
atctgtataagtaagaaaata

SEQ ID NO: 143698 - DNA, 23 bp, Homo sapiens
atctgtataagtaagaaaatatt

SEQ ID NO: 143699 - DNA, 21 bp, Homo sapiens
atctgtatatacaataacata

SEQ ID NO: 143700 - DNA, 17 bp, Homo sapiens
atctgtgaattcagatt

SEQ ID NO: 143701 - DNA, 22 bp, Homo sapiens
atctgtgcaaatccttgatact

SEQ ID NO: 143702 - DNA, 17 bp, Homo sapiens
atctgtgcccagagatg

SEQ ID NO: 143703 - DNA, 15 bp, Homo sapiens
atctgtgtcttgttt

SEQ ID NO: 143704 - DNA, 15 bp, Homo sapiens
atctgtgtgaaaatg

SEQ ID NO: 143705 - DNA, 17 bp, Homo sapiens
atctgtgtgaaaatggg

SEQ ID NO: 143706 - DNA, 16 bp, Homo sapiens
atcttagtatttgcat

SEQ ID NO: 143707 - DNA, 15 bp, Homo sapiens
atcttctccatctgg

SEQ ID NO: 143708 - DNA, 22 bp, Homo sapiens
atcttctccatctggcagggtg

SEQ ID NO: 143709 - DNA, 14 bp, Homo sapiens
atcttctttataat

SEQ ID NO: 143710 - DNA, 17 bp, Homo sapiens
atcttgaccaagcagga

SEQ ID NO: 143711 - DNA, 20 bp, Homo sapiens
atcttggtcagatttgaact

SEQ ID NO: 143712 - DNA, 16 bp, Homo sapiens
atctttattgagaaag

SEQ ID NO: 143713 - DNA, 17 bp, Homo sapiens
atctttattgagaaaga

SEQ ID NO: 143714 - DNA, 18 bp, Homo sapiens
atctttattgagaaagag

SEQ ID NO: 143715 - DNA, 22 bp, Homo sapiens
atctttcttctattttattccc

SEQ ID NO: 143716 - DNA, 13 bp, Homo sapiens
atgaaaatgtctt

SEQ ID NO: 143717 - DNA, 14 bp, Homo sapiens
atgaaaatgtcttg

SEQ ID NO: 143718 - DNA, 14 bp, Homo sapiens
atgaaaattgtatg

SEQ ID NO: 143719 - DNA, 20 bp, Homo sapiens
atgaaacactcagttgttca

SEQ ID NO: 143720 - DNA, 23 bp, Homo sapiens
atgaaagatggctgtgcctctgc

SEQ ID NO: 143721 - DNA, 16 bp, Homo sapiens
atgaaaggtttacatt

SEQ ID NO: 143722 - DNA, 14 bp, Homo sapiens
atgaactcaacttt

SEQ ID NO: 143723 - DNA, 19 bp, Homo sapiens
atgaactgaagtttcacat

SEQ ID NO: 143724 - DNA, 20 bp, Homo sapiens
atgaactgaagtttcacatg

SEQ ID NO: 143725 - DNA, 14 bp, Homo sapiens
atgaagaaagtgga

SEQ ID NO: 143726 - DNA, 18 bp, Homo sapiens
atgaagatgtagaggaga

SEQ ID NO: 143727 - DNA, 16 bp, Homo sapiens
atgaaggttaggattt

SEQ ID NO: 143728 - DNA, 13 bp, Homo sapiens
atgaagtactcat

SEQ ID NO: 143729 - DNA, 19 bp, Homo sapiens
atgaagtgtgtttccttca

SEQ ID NO: 143730 - DNA, 21 bp, Homo sapiens
atgaatactgtattttgtatt

SEQ ID NO: 143731 - DNA, 13 bp, Homo sapiens
atgaatgaatggc

SEQ ID NO: 143732 - DNA, 23 bp, Homo sapiens
atgaatggctaagcaaaatgtga

SEQ ID NO: 143733 - DNA, 11 bp, Homo sapiens
atgaatgttta

SEQ ID NO: 143734 - DNA, 14 bp, Homo sapiens
atgacaacagaagc

SEQ ID NO: 143735 - DNA, 16 bp, Homo sapiens
attgtgtgttatttaa

SEQ ID NO: 143736 - DNA, 15 bp, Homo sapiens
attgtttaaaatcat

SEQ ID NO: 143737 - DNA, 17 bp, Homo sapiens
atttaaaaaaaaacctg

SEQ ID NO: 143738 - DNA, 14 bp, Homo sapiens
atttaaacagcagt

SEQ ID NO: 143739 - DNA, 16 bp, Homo sapiens
atttaaatattaaata

SEQ ID NO: 143740 - DNA, 15 bp, Homo sapiens
atttaacagtcattt

SEQ ID NO: 143741 - DNA, 16 bp, Homo sapiens
atttaagacactgaaa

SEQ ID NO: 143742 - DNA, 21 bp, Homo sapiens
atttaagcctcatatttaaag

SEQ ID NO: 143743 - DNA, 16 bp, Homo sapiens
atttaataaatgtgcc

SEQ ID NO: 143744 - DNA, 13 bp, Homo sapiens
atttaatacagca

SEQ ID NO: 143745 - DNA, 16 bp, Homo sapiens
atttacaaagtgtgta

SEQ ID NO: 143746 - DNA, 18 bp, Homo sapiens
atttacaaagtgtgtatt

SEQ ID NO: 143747 - DNA, 19 bp, Homo sapiens
atttacaaagtgtgtatta

SEQ ID NO: 143748 - DNA, 23 bp, Homo sapiens
atttaccagcctccgtatttcag

SEQ ID NO: 143749 - DNA, 22 bp, Homo sapiens
atttactaagccacaagaaatt

SEQ ID NO: 143750 - DNA, 23 bp, Homo sapiens
atttactaagccacaagaaattt

SEQ ID NO: 143751 - DNA, 16 bp, Homo sapiens
atttacttcttataca

SEQ ID NO: 143752 - DNA, 19 bp, Homo sapiens
atttacttcttatacattt

SEQ ID NO: 143753 - DNA, 22 bp, Homo sapiens
atttagaaagaagcccaatatt

SEQ ID NO: 143754 - DNA, 15 bp, Homo sapiens
atttagaaatataat

SEQ ID NO: 143755 - DNA, 23 bp, Homo sapiens
atttagcacatactacacattca

SEQ ID NO: 143756 - DNA, 20 bp, Homo sapiens
atttagtgaaagctagagat

SEQ ID NO: 143757 - DNA, 16 bp, Homo sapiens
atttataactcatcat

SEQ ID NO: 143758 - DNA, 18 bp, Homo sapiens
atttataactcatcataa

SEQ ID NO: 143759 - DNA, 19 bp, Homo sapiens
atttataactcatcataaa

SEQ ID NO: 143760 - DNA, 21 bp, Homo sapiens
atttataactcatcataaaat

SEQ ID NO: 143761 - DNA, 23 bp, Homo sapiens
atttataactcatcataaaataa

SEQ ID NO: 143762 - DNA, 15 bp, Homo sapiens
atttatatatttata

SEQ ID NO: 143763 - DNA, 17 bp, Homo sapiens
atttatatatttataac

SEQ ID NO: 143764 - DNA, 18 bp, Homo sapiens
atttatatatttataact

SEQ ID NO: 143765 - DNA, 19 bp, Homo sapiens
atttatatatttataactc

SEQ ID NO: 143766 - DNA, 16 bp, Homo sapiens
atttatctctatttaa

SEQ ID NO: 143767 - DNA, 19 bp, Homo sapiens
atttatcttgtctctgggc

SEQ ID NO: 143768 - DNA, 15 bp, Homo sapiens
atttatgagtttttg

SEQ ID NO: 143769 - DNA, 19 bp, Homo sapiens
atttatgcatggaaacctg

SEQ ID NO: 143770 - DNA, 20 bp, Homo sapiens
atttatgcctctgtatttaa

SEQ ID NO: 143771 - DNA, 12 bp, Homo sapiens
atttatgtaaac

SEQ ID NO: 143772 - DNA, 15 bp, Homo sapiens
atttattacctctga

SEQ ID NO: 143773 - DNA, 16 bp, Homo sapiens
atttattagttaatat

SEQ ID NO: 143774 - DNA, 18 bp, Homo sapiens
atttattcaattcctctg

SEQ ID NO: 143775 - DNA, 19 bp, Homo sapiens
atttattcaattcctctgg

SEQ ID NO: 143776 - DNA, 17 bp, Homo sapiens
atttattcatattttct

SEQ ID NO: 143777 - DNA, 24 bp, Homo sapiens
atttatttactgagcttctctgtg

SEQ ID NO: 143778 - DNA, 14 bp, Homo sapiens
atttatttatttaa

SEQ ID NO: 143779 - DNA, 18 bp, Homo sapiens
atttattttttacattat

SEQ ID NO: 143780 - DNA, 23 bp, Homo sapiens
atttcacagtgtgtttgtgattg

SEQ ID NO: 143781 - DNA, 20 bp, Homo sapiens
atttcaggttttgtaaagat

SEQ ID NO: 143782 - DNA, 19 bp, Homo sapiens
atttcatctatttctgaga

SEQ ID NO: 143783 - DNA, 16 bp, Homo sapiens
atttccaaagagaaaa

SEQ ID NO: 143784 - DNA, 15 bp, Homo sapiens
atttccaaataaaat

SEQ ID NO: 143785 - DNA, 13 bp, Homo sapiens
atttccaaatgaa

SEQ ID NO: 143786 - DNA, 16 bp, Homo sapiens
atttccattccagaat

SEQ ID NO: 143787 - DNA, 17 bp, Homo sapiens
atttccattccagaata

SEQ ID NO: 143788 - DNA, 23 bp, Homo sapiens
atttccccagacctgagctcccc

SEQ ID NO: 143789 - DNA, 19 bp, Homo sapiens
atttcctaattttgagaaa

SEQ ID NO: 143790 - DNA, 18 bp, Homo sapiens
atttctatttctcctcca

SEQ ID NO: 143791 - DNA, 20 bp, Homo sapiens
atttctatttctcctccatg

SEQ ID NO: 143792 - DNA, 13 bp, Homo sapiens
atttgaatgttaa

SEQ ID NO: 143793 - DNA, 18 bp, Homo sapiens
atttgaatgttaagcaga

SEQ ID NO: 143794 - DNA, 23 bp, Homo sapiens
atttgacaaaatttgttgaaatt

SEQ ID NO: 143795 - DNA, 16 bp, Homo sapiens
atttgagtgctctgat

SEQ ID NO: 143796 - DNA, 19 bp, Homo sapiens
atttgagtgttttaagata

SEQ ID NO: 143797 - DNA, 15 bp, Homo sapiens
atttgcagagacagg

SEQ ID NO: 143798 - DNA, 19 bp, Homo sapiens
atttgcagagacaggacct

SEQ ID NO: 143799 - DNA, 22 bp, Homo sapiens
atttgcagagacaggacctgac

SEQ ID NO: 143800 - DNA, 22 bp, Homo sapiens
atttgcataacaattcctctac

SEQ ID NO: 143801 - DNA, 15 bp, Homo sapiens
atttgccttgctgga

SEQ ID NO: 143802 - DNA, 15 bp, Homo sapiens
atttgtaattgctta

SEQ ID NO: 143803 - DNA, 19 bp, Homo sapiens
atttgtaattgcttacatt

SEQ ID NO: 143804 - DNA, 23 bp, Homo sapiens
atttgtgaaatgatggtgaaagt

SEQ ID NO: 143805 - DNA, 15 bp, Homo sapiens
atttgtgtgtgtgca

SEQ ID NO: 143806 - DNA, 17 bp, Homo sapiens
atttgttattttcagta

SEQ ID NO: 143807 - DNA, 17 bp, Homo sapiens
atttgttattttgcaac

SEQ ID NO: 143808 - DNA, 16 bp, Homo sapiens
atttgttgaaattatg

SEQ ID NO: 143809 - DNA, 12 bp, Homo sapiens
attttataattt

SEQ ID NO: 143810 - DNA, 15 bp, Homo sapiens
attttatatgtcaaa

SEQ ID NO: 143811 - DNA, 13 bp, Homo sapiens
attttatctgtga

SEQ ID NO: 143812 - DNA, 16 bp, Homo sapiens
attttatgaatgtctt

SEQ ID NO: 143813 - DNA, 14 bp, Homo sapiens
attttatttgacaa

SEQ ID NO: 143814 - DNA, 22 bp, Homo sapiens
attttcacattcccatctgtca

SEQ ID NO: 143815 - DNA, 19 bp, Homo sapiens
attttccctattagagaag

SEQ ID NO: 143816 - DNA, 20 bp, Homo sapiens
attttctttttaataaaaag

SEQ ID NO: 143817 - DNA, 22 bp, Homo sapiens
attttgagaaagtcttatttat

SEQ ID NO: 143818 - DNA, 14 bp, Homo sapiens
attttggagaaatt

SEQ ID NO: 143819 - DNA, 18 bp, Homo sapiens
attttggtccaagttgtg

SEQ ID NO: 143820 - DNA, 13 bp, Homo sapiens
attttgtatctgc

SEQ ID NO: 143821 - DNA, 23 bp, Homo sapiens
attttgtatctgcaggcagacac

SEQ ID NO: 143822 - DNA, 23 bp, Homo sapiens
attttgtcatataagattcatat

SEQ ID NO: 143823 - DNA, 13 bp, Homo sapiens
attttgtctaaaa

SEQ ID NO: 143824 - DNA, 16 bp, Homo sapiens
attttgtctaaaatgc

SEQ ID NO: 143825 - DNA, 21 bp, Homo sapiens
attttgtctaaaatgcctcag

SEQ ID NO: 143826 - DNA, 18 bp, Homo sapiens
attttgttctagttttca

SEQ ID NO: 143827 - DNA, 15 bp, Homo sapiens
attttgtttaaatta

SEQ ID NO: 143828 - DNA, 17 bp, Homo sapiens
atttttaaaatatttat

SEQ ID NO: 143829 - DNA, 21 bp, Homo sapiens
atttttaagcaaaatattatt

SEQ ID NO: 143830 - DNA, 17 bp, Homo sapiens
atttttacattctgaat

SEQ ID NO: 143831 - DNA, 19 bp, Homo sapiens
atttttcatgattttgaaa

SEQ ID NO: 143832 - DNA, 15 bp, Homo sapiens
atttttccaaaataa

SEQ ID NO: 143833 - DNA, 20 bp, Homo sapiens
atttttcctccactgaacta

SEQ ID NO: 143834 - DNA, 20 bp, Homo sapiens
atttttgtacccttcctaca

SEQ ID NO: 143835 - DNA, 13 bp, Homo sapiens
ctatgtgtaaggt

SEQ ID NO: 143836 - DNA, 18 bp, Homo sapiens
ctatgttttgacattttt

SEQ ID NO: 143837 - DNA, 20 bp, Homo sapiens
ctatgtttttgttcaaagcc

SEQ ID NO: 143838 - DNA, 15 bp, Homo sapiens
ctattataatttaat

SEQ ID NO: 143839 - DNA, 17 bp, Homo sapiens
ctattataatttaatgc

SEQ ID NO: 143840 - DNA, 12 bp, Homo sapiens
ctatttaatatt

SEQ ID NO: 143841 - DNA, 17 bp, Homo sapiens
ctatttagtttttgtaa

SEQ ID NO: 143842 - DNA, 22 bp, Homo sapiens
ctatttagtttttgtaatttat

SEQ ID NO: 143843 - DNA, 14 bp, Homo sapiens
ctatttatttactg

SEQ ID NO: 143844 - DNA, 22 bp, Homo sapiens
ctatttccccaggggaaaatga

SEQ ID NO: 143845 - DNA, 16 bp, Homo sapiens
ctatttctcctccatg

SEQ ID NO: 143846 - DNA, 23 bp, Homo sapiens
ctatttctgagaaggtccttaat

SEQ ID NO: 143847 - DNA, 16 bp, Homo sapiens
ctcaaaacttaacata

SEQ ID NO: 143848 - DNA, 17 bp, Homo sapiens
ctcaaactgccttggct

SEQ ID NO: 143849 - DNA, 18 bp, Homo sapiens
ctcaaccccaccacttct

SEQ ID NO: 143850 - DNA, 22 bp, Homo sapiens
ctcaacccccatttctatttat

SEQ ID NO: 143851 - DNA, 23 bp, Homo sapiens
ctcaagcagtctacccacctcag

SEQ ID NO: 143852 - DNA, 16 bp, Homo sapiens
ctcaagccaagcagcc

SEQ ID NO: 143853 - DNA, 21 bp, Homo sapiens
ctcaagccaagcagccaagct

SEQ ID NO: 143854 - DNA, 17 bp, Homo sapiens
ctcaaggaaaggcctga

SEQ ID NO: 143855 - DNA, 16 bp, Homo sapiens
ctcaaggactttgcag

SEQ ID NO: 143856 - DNA, 21 bp, Homo sapiens
ctcaatgtgaatcagacccta

SEQ ID NO: 143857 - DNA, 23 bp, Homo sapiens
ctcaattttatccctcacctgta

SEQ ID NO: 143858 - DNA, 17 bp, Homo sapiens
ctcacagaacccttgga

SEQ ID NO: 143859 - DNA, 13 bp, Homo sapiens
ctcacagaagaat

SEQ ID NO: 143860 - DNA, 19 bp, Homo sapiens
ctcacagcctctgacccct

SEQ ID NO: 143861 - DNA, 16 bp, Homo sapiens
ctcacagttcctcgcc

SEQ ID NO: 143862 - DNA, 20 bp, Homo sapiens
ctcaccagtgtcccctccac

SEQ ID NO: 143863 - DNA, 24 bp, Homo sapiens
ctcaccagtgtcccctccactgtc

SEQ ID NO: 143864 - DNA, 12 bp, Homo sapiens
ctcaccccatcc

SEQ ID NO: 143865 - DNA, 16 bp, Homo sapiens
ctcacccccttctcca

SEQ ID NO: 143866 - DNA, 17 bp, Homo sapiens
ctcacccccttctccat

SEQ ID NO: 143867 - DNA, 19 bp, Homo sapiens
ctcacccccttctccatcc

SEQ ID NO: 143868 - DNA, 21 bp, Homo sapiens
ctcacccccttctccatccac

SEQ ID NO: 143869 - DNA, 16 bp, Homo sapiens
ctcaccccgtctgggg

SEQ ID NO: 143870 - DNA, 15 bp, Homo sapiens
ctcacccctgccctg

SEQ ID NO: 143871 - DNA, 16 bp, Homo sapiens
ctcacccctgccctgg

SEQ ID NO: 143872 - DNA, 17 bp, Homo sapiens
ctcacccctgccctggg

SEQ ID NO: 143873 - DNA, 20 bp, Homo sapiens
ctcacccctgtcctcactgc

SEQ ID NO: 143874 - DNA, 21 bp, Homo sapiens
ctcacccctgtcctcactgct

SEQ ID NO: 143875 - DNA, 14 bp, Homo sapiens
ctcaccctgcctta

SEQ ID NO: 143876 - DNA, 15 bp, Homo sapiens
ctcaccctgccttat

SEQ ID NO: 143877 - DNA, 21 bp, Homo sapiens
ctcaccgtggctaagagtgtc

SEQ ID NO: 143878 - DNA, 12 bp, Homo sapiens
ctcacctctgcc

SEQ ID NO: 143879 - DNA, 18 bp, Homo sapiens
ctcacctctgcctcaatg

SEQ ID NO: 143880 - DNA, 11 bp, Homo sapiens
ctcacctgggg

SEQ ID NO: 143881 - DNA, 15 bp, Homo sapiens
ctcacgcacctccca

SEQ ID NO: 143882 - DNA, 19 bp, Homo sapiens
ctcacgcacctcccatcct

SEQ ID NO: 143883 - DNA, 19 bp, Homo sapiens
ctcacgcctgtaatcccag

SEQ ID NO: 143884 - DNA, 19 bp, Homo sapiens
ctcacgggcagtagctgtg

SEQ ID NO: 143885 - DNA, 16 bp, Homo sapiens
ctcacgtgagagtgtc

SEQ ID NO: 143886 - DNA, 15 bp, Homo sapiens
ctcactcccttccca

SEQ ID NO: 143887 - DNA, 15 bp, Homo sapiens
ctcactcctacctgg

SEQ ID NO: 143888 - DNA, 19 bp, Homo sapiens
ctcactcctacctggtaat

SEQ ID NO: 143889 - DNA, 14 bp, Homo sapiens
ctcactctggcctc

SEQ ID NO: 143890 - DNA, 15 bp, Homo sapiens
ctcactgctccctga

SEQ ID NO: 143891 - DNA, 20 bp, Homo sapiens
ctcactggggtcctggggcc

SEQ ID NO: 143892 - DNA, 17 bp, Homo sapiens
ctcagaaatttttattt

SEQ ID NO: 143893 - DNA, 21 bp, Homo sapiens
ctcagaacccttggcttgccc

SEQ ID NO: 143894 - DNA, 14 bp, Homo sapiens
ctcagactccattt

SEQ ID NO: 143895 - DNA, 15 bp, Homo sapiens
ctcagagccacccct

SEQ ID NO: 143896 - DNA, 16 bp, Homo sapiens
ctcagatggaaccgca

SEQ ID NO: 143897 - DNA, 21 bp, Homo sapiens
ctcagatggaaccgcaggaag

SEQ ID NO: 143898 - DNA, 20 bp, Homo sapiens
ctcagcaaaagatgcttctc

SEQ ID NO: 143899 - DNA, 17 bp, Homo sapiens
ctcagcagccctcctca

SEQ ID NO: 143900 - DNA, 19 bp, Homo sapiens
ctcagcagccctcctcacc

SEQ ID NO: 143901 - DNA, 21 bp, Homo sapiens
ctcagcagccctcctcacccc

SEQ ID NO: 143902 - DNA, 12 bp, Homo sapiens
ctcagcatacct

SEQ ID NO: 143903 - DNA, 19 bp, Homo sapiens
ctcagcccacatagtgatg

SEQ ID NO: 143904 - DNA, 21 bp, Homo sapiens
ctcagcccacatagtgatggt

SEQ ID NO: 143905 - DNA, 14 bp, Homo sapiens
ctcagccctccctg

SEQ ID NO: 143906 - DNA, 13 bp, Homo sapiens
ctcagccctgggc

SEQ ID NO: 143907 - DNA, 14 bp, Homo sapiens
ctcagccctgggcc

SEQ ID NO: 143908 - DNA, 22 bp, Homo sapiens
ctcagcctcctgtgtagctggg

SEQ ID NO: 143909 - DNA, 19 bp, Homo sapiens
ctcagcctggtgggcctcc

SEQ ID NO: 143910 - DNA, 20 bp, Homo sapiens
ctcagcctggtgggcctcct

SEQ ID NO: 143911 - DNA, 16 bp, Homo sapiens
ctcagcctgtgctgcc

SEQ ID NO: 143912 - DNA, 17 bp, Homo sapiens
ctcagctcagcgccagc

SEQ ID NO: 143913 - DNA, 15 bp, Homo sapiens
ctcagctcccaaggc

SEQ ID NO: 143914 - DNA, 19 bp, Homo sapiens
ctcagctcccaaggctctg

SEQ ID NO: 143915 - DNA, 21 bp, Homo sapiens
ctcaggaccaaagctttcatg

SEQ ID NO: 143916 - DNA, 22 bp, Homo sapiens
ctcaggaccaaagctttcatgt

SEQ ID NO: 143917 - DNA, 12 bp, Homo sapiens
ctcaggacctag

SEQ ID NO: 143918 - DNA, 21 bp, Homo sapiens
ctcaggactcagaagcctctg

SEQ ID NO: 143919 - DNA, 15 bp, Homo sapiens
ctcaggaggctgagg

SEQ ID NO: 143920 - DNA, 23 bp, Homo sapiens
ctcaggagtttgagaccaacctg

SEQ ID NO: 143921 - DNA, 22 bp, Homo sapiens
ctcaggatgcccagggccactc

SEQ ID NO: 143922 - DNA, 19 bp, Homo sapiens
ctcaggcactagcctttgg

SEQ ID NO: 143923 - DNA, 21 bp, Homo sapiens
ctcaggcgatccacctgtctc

SEQ ID NO: 143924 - DNA, 15 bp, Homo sapiens
ctcaggctctgccct

SEQ ID NO: 143925 - DNA, 14 bp, Homo sapiens
ctcaggctgctgga

SEQ ID NO: 143926 - DNA, 15 bp, Homo sapiens
ctcaggctgctggag

SEQ ID NO: 143927 - DNA, 14 bp, Homo sapiens
ctcagggacagagc

SEQ ID NO: 143928 - DNA, 12 bp, Homo sapiens
ctcagggcccca

SEQ ID NO: 143929 - DNA, 16 bp, Homo sapiens
ctcagggccccagcac

SEQ ID NO: 143930 - DNA, 17 bp, Homo sapiens
ctcagggctcctgggtt

SEQ ID NO: 143931 - DNA, 20 bp, Homo sapiens
ctcaggggccagaggaactg

SEQ ID NO: 143932 - DNA, 14 bp, Homo sapiens
ctcaggtgttgcca

SEQ ID NO: 143933 - DNA, 14 bp, Homo sapiens
ctcaggttgtctga

SEQ ID NO: 143934 - DNA, 16 bp, Homo sapiens
ctcagtccatgaagat

SEQ ID NO: 143935 - DNA, 22 bp, Homo sapiens
ctcagtcctcccctcacagcct

SEQ ID NO: 143936 - DNA, 14 bp, Homo sapiens
ctcagtctctgagc

SEQ ID NO: 143937 - DNA, 20 bp, Homo sapiens
ctcagtctctgagcagtgaa

SEQ ID NO: 143938 - DNA, 16 bp, Homo sapiens
ctcagtgtatttgtat

SEQ ID NO: 143939 - DNA, 21 bp, Homo sapiens
ctcatatccagtattgttcct

SEQ ID NO: 143940 - DNA, 22 bp, Homo sapiens
ctcatattcctgcagcctggag

SEQ ID NO: 143941 - DNA, 16 bp, Homo sapiens
ctcatattttgtatat

SEQ ID NO: 143942 - DNA, 14 bp, Homo sapiens
ctcatcataaaata

SEQ ID NO: 143943 - DNA, 13 bp, Homo sapiens
ctcatcattctct

SEQ ID NO: 143944 - DNA, 22 bp, Homo sapiens
ctcatcattctctgtctcatcc

SEQ ID NO: 143945 - DNA, 16 bp, Homo sapiens
ctcatccatcatcatg

SEQ ID NO: 143946 - DNA, 19 bp, Homo sapiens
ctcatccatcatcatgtgt

SEQ ID NO: 143947 - DNA, 10 bp, Homo sapiens
ctcatcccat

SEQ ID NO: 143948 - DNA, 22 bp, Homo sapiens
ctcatgaggggcccgagcagaa

SEQ ID NO: 143949 - DNA, 12 bp, Homo sapiens
ctcatgcatctc

SEQ ID NO: 143950 - DNA, 20 bp, Homo sapiens
ctcatgcatctccacctgct

SEQ ID NO: 143951 - DNA, 20 bp, Homo sapiens
ctcatggagaagcagaaata

SEQ ID NO: 143952 - DNA, 16 bp, Homo sapiens
ctcatggggtccaagt

SEQ ID NO: 143953 - DNA, 17 bp, Homo sapiens
ctcattaggatggctag

SEQ ID NO: 143954 - DNA, 18 bp, Homo sapiens
ctcattaggatggctagt

SEQ ID NO: 143955 - DNA, 22 bp, Homo sapiens
ctcattcaggaaaactgacaga

SEQ ID NO: 143956 - DNA, 14 bp, Homo sapiens
ctcattccccaggt

SEQ ID NO: 143957 - DNA, 17 bp, Homo sapiens
ctcattcctgcctgtct

SEQ ID NO: 143958 - DNA, 18 bp, Homo sapiens
ctcattgacaagaactga

SEQ ID NO: 143959 - DNA, 19 bp, Homo sapiens
ctcattgcttacaagccta

SEQ ID NO: 143960 - DNA, 17 bp, Homo sapiens
ctcattggacccttcca

SEQ ID NO: 143961 - DNA, 20 bp, Homo sapiens
ctcatttggggtagctagag

SEQ ID NO: 143962 - DNA, 12 bp, Homo sapiens
ctccaaagaaat

SEQ ID NO: 143963 - DNA, 22 bp, Homo sapiens
ctccaaaggaagtctaggagct

SEQ ID NO: 143964 - DNA, 13 bp, Homo sapiens
ctccaccaaccca

SEQ ID NO: 143965 - DNA, 13 bp, Homo sapiens
ctccaccacccaa

SEQ ID NO: 143966 - DNA, 21 bp, Homo sapiens
ctccaccccccagaacctgtc

SEQ ID NO: 143967 - DNA, 16 bp, Homo sapiens
ctccacctcagccttg

SEQ ID NO: 143968 - DNA, 16 bp, Homo sapiens
ctccacgttcacccct

SEQ ID NO: 143969 - DNA, 18 bp, Homo sapiens
ctccacgttctgctcatc

SEQ ID NO: 143970 - DNA, 14 bp, Homo sapiens
ctccactgccttcg

SEQ ID NO: 143971 - DNA, 16 bp, Homo sapiens
ctccactggatggagg

SEQ ID NO: 143972 - DNA, 13 bp, Homo sapiens
ctccactgtcaca

SEQ ID NO: 143973 - DNA, 16 bp, Homo sapiens
ctccactgtcacattg

SEQ ID NO: 143974 - DNA, 13 bp, Homo sapiens
ctccactgtcacc

SEQ ID NO: 143975 - DNA, 21 bp, Homo sapiens
ctccacttcttgttccccact

SEQ ID NO: 143976 - DNA, 17 bp, Homo sapiens
ctccagacccctggctt

SEQ ID NO: 143977 - DNA, 21 bp, Homo sapiens
ctccagatagctcatttcatt

SEQ ID NO: 143978 - DNA, 22 bp, Homo sapiens
ctccagccccttctcagaatct

SEQ ID NO: 143979 - DNA, 12 bp, Homo sapiens
ctccagcctggg

SEQ ID NO: 143980 - DNA, 11 bp, Homo sapiens
ctccagctcct

SEQ ID NO: 143981 - DNA, 19 bp, Homo sapiens
ctccagggccacgtgccag

SEQ ID NO: 143982 - DNA, 20 bp, Homo sapiens
ctccagtattcttgtcaaaa

SEQ ID NO: 143983 - DNA, 22 bp, Homo sapiens
caagaattgaagcaggactaaa

SEQ ID NO: 143984 - DNA, 19 bp, Homo sapiens
caagacccaaaaggcagaa

SEQ ID NO: 143985 - DNA, 15 bp, Homo sapiens
caagactctgtctca

SEQ ID NO: 143986 - DNA, 18 bp, Homo sapiens
caagactctttggacact

SEQ ID NO: 143987 - DNA, 16 bp, Homo sapiens
caagacttcagtatgt

SEQ ID NO: 143988 - DNA, 15 bp, Homo sapiens
caagacttggcaaca

SEQ ID NO: 143989 - DNA, 22 bp, Homo sapiens
caagagaattgcttgaacccag

SEQ ID NO: 143990 - DNA, 15 bp, Homo sapiens
caagagggcactggt

SEQ ID NO: 143991 - DNA, 21 bp, Homo sapiens
caagatattttaaaatctgtc

SEQ ID NO: 143992 - DNA, 23 bp, Homo sapiens
caagatattttaaaatctgtcac

SEQ ID NO: 143993 - DNA, 18 bp, Homo sapiens
caagatcatgtaccccaa

SEQ ID NO: 143994 - DNA, 14 bp, Homo sapiens
caagattaaatgta

SEQ ID NO: 143995 - DNA, 13 bp, Homo sapiens
caagattcccaga

SEQ ID NO: 143996 - DNA, 13 bp, Homo sapiens
caagattgcttaa

SEQ ID NO: 143997 - DNA, 16 bp, Homo sapiens
caagattgcttaaaat

SEQ ID NO: 143998 - DNA, 18 bp, Homo sapiens
caagattttccacaagat

SEQ ID NO: 143999 - DNA, 16 bp, Homo sapiens
caagcaaaaggagaga

SEQ ID NO: 144000 - DNA, 17 bp, Homo sapiens
caagcacagtgcctgca

SEQ ID NO: 144001 - DNA, 18 bp, Homo sapiens
caagcagaggtggccaga

SEQ ID NO: 144002 - DNA, 12 bp, Homo sapiens
caagcaggaagc

SEQ ID NO: 144003 - DNA, 16 bp, Homo sapiens
caagcaggaagctcag

SEQ ID NO: 144004 - DNA, 16 bp, Homo sapiens
caagcataccaacacg

SEQ ID NO: 144005 - DNA, 21 bp, Homo sapiens
caagcataccaacacgagcag

SEQ ID NO: 144006 - DNA, 14 bp, Homo sapiens
caagccaagcagcc

SEQ ID NO: 144007 - DNA, 18 bp, Homo sapiens
caagccaagcagccaagc

SEQ ID NO: 144008 - DNA, 17 bp, Homo sapiens
caagcccctgcccatct

SEQ ID NO: 144009 - DNA, 16 bp, Homo sapiens
caagccgtggcttccc

SEQ ID NO: 144010 - DNA, 21 bp, Homo sapiens
caagcctgaccacgctttcta

SEQ ID NO: 144011 - DNA, 21 bp, Homo sapiens
caagcctgtaatcccagctac

SEQ ID NO: 144012 - DNA, 16 bp, Homo sapiens
caagctcacagttcct

SEQ ID NO: 144013 - DNA, 21 bp, Homo sapiens
caagctcacagttcctcgccc

SEQ ID NO: 144014 - DNA, 13 bp, Homo sapiens
caagctgcaccct

SEQ ID NO: 144015 - DNA, 22 bp, Homo sapiens
caagcttcagtttcctggtctg

SEQ ID NO: 144016 - DNA, 15 bp, Homo sapiens
caaggactttgcagc

SEQ ID NO: 144017 - DNA, 16 bp, Homo sapiens
caaggactttgcagcc

SEQ ID NO: 144018 - DNA, 20 bp, Homo sapiens
caaggaggaaaaacagacaa

SEQ ID NO: 144019 - DNA, 20 bp, Homo sapiens
caaggccgctgttcacccac

SEQ ID NO: 144020 - DNA, 17 bp, Homo sapiens
caaggctgattaaacca

SEQ ID NO: 144021 - DNA, 17 bp, Homo sapiens
caaggctgcagtgagcc

SEQ ID NO: 144022 - DNA, 19 bp, Homo sapiens
caagggcaaaattcccagg

SEQ ID NO: 144023 - DNA, 19 bp, Homo sapiens
caagggctccccactgcct

SEQ ID NO: 144024 - DNA, 23 bp, Homo sapiens
caagggtgatgggaaagcattgt

SEQ ID NO: 144025 - DNA, 20 bp, Homo sapiens
caagggttcagagactcagg

SEQ ID NO: 144026 - DNA, 19 bp, Homo sapiens
caaggtggccaaattattt

SEQ ID NO: 144027 - DNA, 16 bp, Homo sapiens
caagtactgctgtaaa

SEQ ID NO: 144028 - DNA, 16 bp, Homo sapiens
caagtatgaataaaga

SEQ ID NO: 144029 - DNA, 19 bp, Homo sapiens
caagtatgaataaagacac

SEQ ID NO: 144030 - DNA, 21 bp, Homo sapiens
caagtatgaataaagacacct

SEQ ID NO: 144031 - DNA, 17 bp, Homo sapiens
caagtcaagtgaaaaag

SEQ ID NO: 144032 - DNA, 13 bp, Homo sapiens
caagtcatgtgca

SEQ ID NO: 144033 - DNA, 16 bp, Homo sapiens
caagtcatgtgcattt

SEQ ID NO: 144034 - DNA, 14 bp, Homo sapiens
caagtccaagcata

SEQ ID NO: 144035 - DNA, 15 bp, Homo sapiens
caagtcctgtgaatt

SEQ ID NO: 144036 - DNA, 17 bp, Homo sapiens
caagtcctgtgaatttc

SEQ ID NO: 144037 - DNA, 19 bp, Homo sapiens
caagtctctgctggcccag

SEQ ID NO: 144038 - DNA, 22 bp, Homo sapiens
caagtctctgctggcccagcca

SEQ ID NO: 144039 - DNA, 15 bp, Homo sapiens
caagtgacatctctt

SEQ ID NO: 144040 - DNA, 17 bp, Homo sapiens
caagtgcatgctctctg

SEQ ID NO: 144041 - DNA, 18 bp, Homo sapiens
caagtgctgaacagtgga

SEQ ID NO: 144042 - DNA, 20 bp, Homo sapiens
caagtgctgaacagtggagg

SEQ ID NO: 144043 - DNA, 13 bp, Homo sapiens
caagtgggggcag

SEQ ID NO: 144044 - DNA, 20 bp, Homo sapiens
caagtgggggcagagggcag

SEQ ID NO: 144045 - DNA, 22 bp, Homo sapiens
caagtgtatgcacgtgtgcaca

SEQ ID NO: 144046 - DNA, 17 bp, Homo sapiens
caagtgtctcagtccac

SEQ ID NO: 144047 - DNA, 19 bp, Homo sapiens
caagtgtgtgcacatgtgt

SEQ ID NO: 144048 - DNA, 21 bp, Homo sapiens
caagtgtgtgcacatgtgtgc

SEQ ID NO: 144049 - DNA, 16 bp, Homo sapiens
caagtgtgtgcatgtg

SEQ ID NO: 144050 - DNA, 12 bp, Homo sapiens
caagttattgta

SEQ ID NO: 144051 - DNA, 20 bp, Homo sapiens
caagttgtggtgctgacaaa

SEQ ID NO: 144052 - DNA, 23 bp, Homo sapiens
caagtttctagctagaaatatga

SEQ ID NO: 144053 - DNA, 18 bp, Homo sapiens
caataagcatcaaactct

SEQ ID NO: 144054 - DNA, 18 bp, Homo sapiens
caatacagtacaggcagc

SEQ ID NO: 144055 - DNA, 14 bp, Homo sapiens
caatattataattt

SEQ ID NO: 144056 - DNA, 14 bp, Homo sapiens
caatatttattatt

SEQ ID NO: 144057 - DNA, 19 bp, Homo sapiens
caatatttattattttcac

SEQ ID NO: 144058 - DNA, 16 bp, Homo sapiens
caatcagctccttcct

SEQ ID NO: 144059 - DNA, 17 bp, Homo sapiens
caatcattttaattatt

SEQ ID NO: 144060 - DNA, 15 bp, Homo sapiens
caatcccctcattca

SEQ ID NO: 144061 - DNA, 20 bp, Homo sapiens
caatcctatgtttttgttca

SEQ ID NO: 144062 - DNA, 15 bp, Homo sapiens
caatgaaaaaatgta

SEQ ID NO: 144063 - DNA, 17 bp, Homo sapiens
caatgacatctcagggg

SEQ ID NO: 144064 - DNA, 22 bp, Homo sapiens
caatgacatctcaggggccaga

SEQ ID NO: 144065 - DNA, 13 bp, Homo sapiens
caatgccatcatc

SEQ ID NO: 144066 - DNA, 20 bp, Homo sapiens
caatggagactgtctcaaga

SEQ ID NO: 144067 - DNA, 18 bp, Homo sapiens
caatgggcactgggatga

SEQ ID NO: 144068 - DNA, 19 bp, Homo sapiens
caatgtgaaaagaaaaatg

SEQ ID NO: 144069 - DNA, 18 bp, Homo sapiens
caatgtgaatcagaccct

SEQ ID NO: 144070 - DNA, 19 bp, Homo sapiens
caatgtgaatcagacccta

SEQ ID NO: 144071 - DNA, 15 bp, Homo sapiens
caatgtgataaaacc

SEQ ID NO: 144072 - DNA, 13 bp, Homo sapiens
caatgtttctttt

SEQ ID NO: 144073 - DNA, 15 bp, Homo sapiens
caattccaaaggaat

SEQ ID NO: 144074 - DNA, 15 bp, Homo sapiens
caattcctctgggaa

SEQ ID NO: 144075 - DNA, 17 bp, Homo sapiens
caattgcatctcccaga

SEQ ID NO: 144076 - DNA, 19 bp, Homo sapiens
caattgtaaaactgaggca

SEQ ID NO: 144077 - DNA, 18 bp, Homo sapiens
caattgtgagccaccacg

SEQ ID NO: 144078 - DNA, 21 bp, Homo sapiens
caattgtgagccaccacgtcc

SEQ ID NO: 144079 - DNA, 12 bp, Homo sapiens
caatttaaaaaa

SEQ ID NO: 144080 - DNA, 14 bp, Homo sapiens
caatttattaaaat

SEQ ID NO: 144081 - DNA, 23 bp, Homo sapiens
caatttattaaaatgattgtaaa

SEQ ID NO: 144082 - DNA, 20 bp, Homo sapiens
caatttctactttgaagtca

SEQ ID NO: 144083 - DNA, 21 bp, Homo sapiens
caattttatccctcacctgta

SEQ ID NO: 144084 - DNA, 22 bp, Homo sapiens
cacaaaacaaatgccacacatc

SEQ ID NO: 144085 - DNA, 15 bp, Homo sapiens
cacaaaacaacccta

SEQ ID NO: 144086 - DNA, 17 bp, Homo sapiens
cacaaacgggctcagca

SEQ ID NO: 144087 - DNA, 18 bp, Homo sapiens
cacaaagcccttccatgt

SEQ ID NO: 144088 - DNA, 13 bp, Homo sapiens
cacaaaggagagc

SEQ ID NO: 144089 - DNA, 23 bp, Homo sapiens
cacaaccttctgtggctcacaga

SEQ ID NO: 144090 - DNA, 14 bp, Homo sapiens
cacaactatttttc

SEQ ID NO: 144091 - DNA, 13 bp, Homo sapiens
cacaagaaatgaa

SEQ ID NO: 144092 - DNA, 15 bp, Homo sapiens
cacaagaaatgaaag

SEQ ID NO: 144093 - DNA, 14 bp, Homo sapiens
cacaagaaatttga

SEQ ID NO: 144094 - DNA, 22 bp, Homo sapiens
cacaagattcccagagacagga

SEQ ID NO: 144095 - DNA, 16 bp, Homo sapiens
cacaagtcctgtgaat

SEQ ID NO: 144096 - DNA, 20 bp, Homo sapiens
cacaagtcctgtgaatttct

SEQ ID NO: 144097 - DNA, 11 bp, Homo sapiens
cacaatatttt

SEQ ID NO: 144098 - DNA, 13 bp, Homo sapiens
cacacaaaacaac

SEQ ID NO: 144099 - DNA, 13 bp, Homo sapiens
cacacaaaggtat

SEQ ID NO: 144100 - DNA, 12 bp, Homo sapiens
cacacacacaca

SEQ ID NO: 144101 - DNA, 13 bp, Homo sapiens
cacacacacacaa

SEQ ID NO: 144102 - DNA, 19 bp, Homo sapiens
cacacacctgtagtcccag

SEQ ID NO: 144103 - DNA, 20 bp, Homo sapiens
cacacacctgtagtcccagc

SEQ ID NO: 144104 - DNA, 20 bp, Homo sapiens
cacacaggcaactgaggcag

SEQ ID NO: 144105 - DNA, 15 bp, Homo sapiens
cacacccactcagct

SEQ ID NO: 144106 - DNA, 16 bp, Homo sapiens
cacacccagcctcagt

SEQ ID NO: 144107 - DNA, 21 bp, Homo sapiens
cacaccctcccccgccactcc

SEQ ID NO: 144108 - DNA, 18 bp, Homo sapiens
cacaccctctcccaggac

SEQ ID NO: 144109 - DNA, 19 bp, Homo sapiens
cacacctgtagtcccagct

SEQ ID NO: 144110 - DNA, 20 bp, Homo sapiens
cacacctgtagtcccagcta

SEQ ID NO: 144111 - DNA, 19 bp, Homo sapiens
cacacgtcatgtttcttca

SEQ ID NO: 144112 - DNA, 17 bp, Homo sapiens
cacactccatcagctta

SEQ ID NO: 144113 - DNA, 16 bp, Homo sapiens
cactggcaatgaaaaa

SEQ ID NO: 144114 - DNA, 21 bp, Homo sapiens
cactggggaaataacagctgt

SEQ ID NO: 144115 - DNA, 14 bp, Homo sapiens
cactgggggagggg

SEQ ID NO: 144116 - DNA, 21 bp, Homo sapiens
cactgggggaggggacattga

SEQ ID NO: 144117 - DNA, 20 bp, Homo sapiens
cactggggtcctggggcctc

SEQ ID NO: 144118 - DNA, 22 bp, Homo sapiens
cactggtggcccgacagcctgg

SEQ ID NO: 144119 - DNA, 22 bp, Homo sapiens
cactggttcttcttggtctcag

SEQ ID NO: 144120 - DNA, 21 bp, Homo sapiens
cactgtagcattacagtgggt

SEQ ID NO: 144121 - DNA, 20 bp, Homo sapiens
cactgtcaccctccacctct

SEQ ID NO: 144122 - DNA, 22 bp, Homo sapiens
cactgtcactgtttctctgctg

SEQ ID NO: 144123 - DNA, 20 bp, Homo sapiens
cactgtgcacatctgtgtct

SEQ ID NO: 144124 - DNA, 22 bp, Homo sapiens
cactgtgcacatctgtgtcttg

SEQ ID NO: 144125 - DNA, 15 bp, Homo sapiens
cactgttatcaaaac

SEQ ID NO: 144126 - DNA, 17 bp, Homo sapiens
cactgttccccctgtgc

SEQ ID NO: 144127 - DNA, 19 bp, Homo sapiens
cactgttccccctgtgcag

SEQ ID NO: 144128 - DNA, 18 bp, Homo sapiens
cactgttgaaaattattt

SEQ ID NO: 144129 - DNA, 22 bp, Homo sapiens
cacttaagagaatattttaagt

SEQ ID NO: 144130 - DNA, 16 bp, Homo sapiens
cacttacactttatgc

SEQ ID NO: 144131 - DNA, 18 bp, Homo sapiens
cacttcacacacaggcaa

SEQ ID NO: 144132 - DNA, 14 bp, Homo sapiens
cacttcaggctctt

SEQ ID NO: 144133 - DNA, 15 bp, Homo sapiens
cacttccaccagcct

SEQ ID NO: 144134 - DNA, 19 bp, Homo sapiens
cacttccaccagcctgcac

SEQ ID NO: 144135 - DNA, 20 bp, Homo sapiens
cacttccaccagcctgcact

SEQ ID NO: 144136 - DNA, 23 bp, Homo sapiens
cacttcgggaggtcgaggcagga

SEQ ID NO: 144137 - DNA, 21 bp, Homo sapiens
cacttgaacccgggaggcaga

SEQ ID NO: 144138 - DNA, 23 bp, Homo sapiens
cacttgcacgcccatgtgtgagt

SEQ ID NO: 144139 - DNA, 21 bp, Homo sapiens
cacttggttgggtcctcacat

SEQ ID NO: 144140 - DNA, 21 bp, Homo sapiens
cactttacaatgttcatccca

SEQ ID NO: 144141 - DNA, 16 bp, Homo sapiens
cactttgggaggccaa

SEQ ID NO: 144142 - DNA, 18 bp, Homo sapiens
cacttttgacaaaggcaa

SEQ ID NO: 144143 - DNA, 16 bp, Homo sapiens
cagaaaagcacctgcc

SEQ ID NO: 144144 - DNA, 19 bp, Homo sapiens
cagaaaagcacctgccgac

SEQ ID NO: 144145 - DNA, 18 bp, Homo sapiens
cagaaaagggaagttgtg

SEQ ID NO: 144146 - DNA, 18 bp, Homo sapiens
cagaaacaggtgcatctg

SEQ ID NO: 144147 - DNA, 21 bp, Homo sapiens
cagaaagatggatgtgctttg

SEQ ID NO: 144148 - DNA, 16 bp, Homo sapiens
cagaaagcattacatt

SEQ ID NO: 144149 - DNA, 19 bp, Homo sapiens
cagaaagcctgggtgacat

SEQ ID NO: 144150 - DNA, 19 bp, Homo sapiens
cagaaatacatatttccaa

SEQ ID NO: 144151 - DNA, 22 bp, Homo sapiens
cagaaataccaaaattatttca

SEQ ID NO: 144152 - DNA, 23 bp, Homo sapiens
cagaaataccaaaattatttcag

SEQ ID NO: 144153 - DNA, 18 bp, Homo sapiens
cagaaatttttatttttc

SEQ ID NO: 144154 - DNA, 18 bp, Homo sapiens
cagaacacactccatcag

SEQ ID NO: 144155 - DNA, 12 bp, Homo sapiens
cagaacagccgc

SEQ ID NO: 144156 - DNA, 19 bp, Homo sapiens
cagaacccttggcttgccc

SEQ ID NO: 144157 - DNA, 21 bp, Homo sapiens
cagaacggagccccaggcctc

SEQ ID NO: 144158 - DNA, 17 bp, Homo sapiens
cagaagaattgaaccca

SEQ ID NO: 144159 - DNA, 16 bp, Homo sapiens
cagaagcctctgggtc

SEQ ID NO: 144160 - DNA, 16 bp, Homo sapiens
cagaagctgagcacca

SEQ ID NO: 144161 - DNA, 21 bp, Homo sapiens
cagaagctgagcaccagggga

SEQ ID NO: 144162 - DNA, 20 bp, Homo sapiens
cagaaggaaaaatgtgtaat

SEQ ID NO: 144163 - DNA, 14 bp, Homo sapiens
cagaaggagaagga

SEQ ID NO: 144164 - DNA, 18 bp, Homo sapiens
cagaaggagaaggaagga

SEQ ID NO: 144165 - DNA, 13 bp, Homo sapiens
cagaaggaggagg

SEQ ID NO: 144166 - DNA, 23 bp, Homo sapiens
cagaataatgaatggactcaaac

SEQ ID NO: 144167 - DNA, 15 bp, Homo sapiens
cagaatatctgggat

SEQ ID NO: 144168 - DNA, 14 bp, Homo sapiens
cagaattctgctac

SEQ ID NO: 144169 - DNA, 18 bp, Homo sapiens
cagacaaaaacagcctca

SEQ ID NO: 144170 - DNA, 21 bp, Homo sapiens
cagacaaaaacagcctcacag

SEQ ID NO: 144171 - DNA, 17 bp, Homo sapiens
cagacaaaccagaagca

SEQ ID NO: 144172 - DNA, 22 bp, Homo sapiens
cagacaaatgtggttacacact

SEQ ID NO: 144173 - DNA, 23 bp, Homo sapiens
cagacaaggtagccctggccaga

SEQ ID NO: 144174 - DNA, 18 bp, Homo sapiens
cagacacagggacttgaa

SEQ ID NO: 144175 - DNA, 21 bp, Homo sapiens
cagacacagggacttgaagtt

SEQ ID NO: 144176 - DNA, 22 bp, Homo sapiens
cagacacagggacttgaagttg

SEQ ID NO: 144177 - DNA, 17 bp, Homo sapiens
cagacacggatctgaga

SEQ ID NO: 144178 - DNA, 15 bp, Homo sapiens
cagacagacacacac

SEQ ID NO: 144179 - DNA, 16 bp, Homo sapiens
cagacagacacacaca

SEQ ID NO: 144180 - DNA, 12 bp, Homo sapiens
cagacagctccc

SEQ ID NO: 144181 - DNA, 17 bp, Homo sapiens
cagacagctccctctgc

SEQ ID NO: 144182 - DNA, 23 bp, Homo sapiens
cagacaggaaagggaaggcccca

SEQ ID NO: 144183 - DNA, 13 bp, Homo sapiens
cagacaggagaaa

SEQ ID NO: 144184 - DNA, 18 bp, Homo sapiens
cagacatgtggtgggaca

SEQ ID NO: 144185 - DNA, 22 bp, Homo sapiens
cagacatgtggtgggacaggga

SEQ ID NO: 144186 - DNA, 14 bp, Homo sapiens
cagaccacaaaact

SEQ ID NO: 144187 - DNA, 12 bp, Homo sapiens
cagaccccagcg

SEQ ID NO: 144188 - DNA, 15 bp, Homo sapiens
cagaccccagcggct

SEQ ID NO: 144189 - DNA, 16 bp, Homo sapiens
cagaccccagcggctg

SEQ ID NO: 144190 - DNA, 14 bp, Homo sapiens
cagacccccactct

SEQ ID NO: 144191 - DNA, 15 bp, Homo sapiens
cagacccctggcttt

SEQ ID NO: 144192 - DNA, 16 bp, Homo sapiens
cagacccctggctttt

SEQ ID NO: 144193 - DNA, 23 bp, Homo sapiens
cagacccctggcttttcactgct

SEQ ID NO: 144194 - DNA, 16 bp, Homo sapiens
cagacctccccagccc

SEQ ID NO: 144195 - DNA, 18 bp, Homo sapiens
cagacctccccagcccct

SEQ ID NO: 144196 - DNA, 12 bp, Homo sapiens
cagacctgagct

SEQ ID NO: 144197 - DNA, 15 bp, Homo sapiens
cagacggcacccacc

SEQ ID NO: 144198 - DNA, 16 bp, Homo sapiens
cagacggcacccaccc

SEQ ID NO: 144199 - DNA, 15 bp, Homo sapiens
cagacgtccctccac

SEQ ID NO: 144200 - DNA, 11 bp, Homo sapiens
cagactggagg

SEQ ID NO: 144201 - DNA, 12 bp, Homo sapiens
cagactggaggg

SEQ ID NO: 144202 - DNA, 23 bp, Homo sapiens
cagactggcacagttttctgaga

SEQ ID NO: 144203 - DNA, 12 bp, Homo sapiens
cagactgtgtat

SEQ ID NO: 144204 - DNA, 21 bp, Homo sapiens
cagacttccctgaatgtattg

SEQ ID NO: 144205 - DNA, 13 bp, Homo sapiens
cagagacacctgc

SEQ ID NO: 144206 - DNA, 14 bp, Homo sapiens
cagagacacctgca

SEQ ID NO: 144207 - DNA, 16 bp, Homo sapiens
cagagacacctgcacc

SEQ ID NO: 144208 - DNA, 22 bp, Homo sapiens
cagagacacctgcacctccccc

SEQ ID NO: 144209 - DNA, 14 bp, Homo sapiens
cagagacagagagg

SEQ ID NO: 144210 - DNA, 13 bp, Homo sapiens
cagagacaggaaa

SEQ ID NO: 144211 - DNA, 15 bp, Homo sapiens
cagagacaggaaaat

SEQ ID NO: 144212 - DNA, 20 bp, Homo sapiens
cagagagcaactctgagatc

SEQ ID NO: 144213 - DNA, 13 bp, Homo sapiens
cagagaggaatca

SEQ ID NO: 144214 - DNA, 15 bp, Homo sapiens
cagagaggaatcaga

SEQ ID NO: 144215 - DNA, 17 bp, Homo sapiens
cagagaggagtcagaga

SEQ ID NO: 144216 - DNA, 20 bp, Homo sapiens
cagagagggggccacctccc

SEQ ID NO: 144217 - DNA, 21 bp, Homo sapiens
cagagaggtcaagcccaggag

SEQ ID NO: 144218 - DNA, 13 bp, Homo sapiens
cagagagtggctc

SEQ ID NO: 144219 - DNA, 13 bp, Homo sapiens
cagagatgcctcc

SEQ ID NO: 144220 - DNA, 15 bp, Homo sapiens
cagagatgcctccac

SEQ ID NO: 144221 - DNA, 16 bp, Homo sapiens
cagagatgcctccacc

SEQ ID NO: 144222 - DNA, 21 bp, Homo sapiens
cagagatggaggttctctcgg

SEQ ID NO: 144223 - DNA, 15 bp, Homo sapiens
cagagatgggactgg

SEQ ID NO: 144224 - DNA, 23 bp, Homo sapiens
cagagatgggactgggagggccc

SEQ ID NO: 144225 - DNA, 19 bp, Homo sapiens
cagagccgtggtcctttgg

SEQ ID NO: 144226 - DNA, 15 bp, Homo sapiens
cagagctgggaggca

SEQ ID NO: 144227 - DNA, 14 bp, Homo sapiens
cagagcttccctga

SEQ ID NO: 144228 - DNA, 17 bp, Homo sapiens
cagaggaactgtccaga

SEQ ID NO: 144229 - DNA, 20 bp, Homo sapiens
cagaggaactgtccagagag

SEQ ID NO: 144230 - DNA, 21 bp, Homo sapiens
cagaggaaggggccagaggct

SEQ ID NO: 144231 - DNA, 19 bp, Homo sapiens
cagaggatgagctctaccc

SEQ ID NO: 144232 - DNA, 13 bp, Homo sapiens
cagaggctggagg

SEQ ID NO: 144233 - DNA, 16 bp, Homo sapiens
cagaggctggaggcag

SEQ ID NO: 144234 - DNA, 18 bp, Homo sapiens
cagaggctggaggcaggg

SEQ ID NO: 144235 - DNA, 20 bp, Homo sapiens
cagaggctggaggcagggcc

SEQ ID NO: 144236 - DNA, 21 bp, Homo sapiens
cagaggctggaggcagggcct

SEQ ID NO: 144237 - DNA, 19 bp, Homo sapiens
cagagggaagaaaagagct

SEQ ID NO: 144238 - DNA, 16 bp, Homo sapiens
cagagggcagaggctg

SEQ ID NO: 144239 - DNA, 21 bp, Homo sapiens
cagaggtggccagagctggga

SEQ ID NO: 144240 - DNA, 15 bp, Homo sapiens
cagagtgagacccag

SEQ ID NO: 144241 - DNA, 15 bp, Homo sapiens
cagagtgcccagaac

SEQ ID NO: 144242 - DNA, 15 bp, Homo sapiens
cagagttctgctcta

SEQ ID NO: 144243 - DNA, 13 bp, Homo sapiens
cagagttgtaaat

SEQ ID NO: 144244 - DNA, 19 bp, Homo sapiens
cagagttgtaaatatataa

SEQ ID NO: 144245 - DNA, 23 bp, Homo sapiens
cagagtttagaggaaaaaaatga

SEQ ID NO: 144246 - DNA, 23 bp, Homo sapiens
cagataaatagtttatgattcca

SEQ ID NO: 144247 - DNA, 19 bp, Homo sapiens
cagatacttggggggctga

SEQ ID NO: 144248 - DNA, 18 bp, Homo sapiens
cagatatgatatgtaaac

SEQ ID NO: 144249 - DNA, 14 bp, Homo sapiens
cagatcccagctca

SEQ ID NO: 144250 - DNA, 14 bp, Homo sapiens
cagatgacccctcc

SEQ ID NO: 144251 - DNA, 18 bp, Homo sapiens
cagatgcaaagaggcaag

SEQ ID NO: 144252 - DNA, 23 bp, Homo sapiens
cagatgcaaagaggcaagaggct

SEQ ID NO: 144253 - DNA, 14 bp, Homo sapiens
cagatggaaccgca

SEQ ID NO: 144254 - DNA, 19 bp, Homo sapiens
cagatggaaccgcaggaag

SEQ ID NO: 144255 - DNA, 20 bp, Homo sapiens
cagatgtggtaactgttaaa

SEQ ID NO: 144256 - DNA, 23 bp, Homo sapiens
cagatgttgaatgcccacaggca

SEQ ID NO: 144257 - DNA, 15 bp, Homo sapiens
cagattcatttttct

SEQ ID NO: 144258 - DNA, 17 bp, Homo sapiens
cagatttagtgaaagct

SEQ ID NO: 144259 - DNA, 20 bp, Homo sapiens
cagatttagtgaaagctaga

SEQ ID NO: 144260 - DNA, 22 bp, Homo sapiens
cagatttagtgaaagctagaga

SEQ ID NO: 144261 - DNA, 15 bp, Homo sapiens
cagattttaattttg

SEQ ID NO: 144262 - DNA, 15 bp, Homo sapiens
cagcaaaaagcaaaa

SEQ ID NO: 144263 - DNA, 18 bp, Homo sapiens
cagcaaaagatgcttctc

SEQ ID NO: 144264 - DNA, 23 bp, Homo sapiens
cagcaagggtgatgggaaagcat

SEQ ID NO: 144265 - DNA, 18 bp, Homo sapiens
cagcaatgacatctcagg

SEQ ID NO: 144266 - DNA, 19 bp, Homo sapiens
cagcaatgacatctcaggg

SEQ ID NO: 144267 - DNA, 16 bp, Homo sapiens
cagcacagagaccccc

SEQ ID NO: 144268 - DNA, 14 bp, Homo sapiens
cagcactaaagcag

SEQ ID NO: 144269 - DNA, 19 bp, Homo sapiens
cagcactgcttgaggaaaa

SEQ ID NO: 144270 - DNA, 16 bp, Homo sapiens
cagcactttgggaggc

SEQ ID NO: 144271 - DNA, 18 bp, Homo sapiens
cagcactttgggaggcca

SEQ ID NO: 144272 - DNA, 23 bp, Homo sapiens
cagcactttgggaggccaaggag

SEQ ID NO: 144273 - DNA, 17 bp, Homo sapiens
cagcagatcccagctca

SEQ ID NO: 144274 - DNA, 18 bp, Homo sapiens
cagcagatcccagctcac

SEQ ID NO: 144275 - DNA, 21 bp, Homo sapiens
cagcagatcccagctcacgtc

SEQ ID NO: 144276 - DNA, 19 bp, Homo sapiens
cagcagccagctctcagcc

SEQ ID NO: 144277 - DNA, 20 bp, Homo sapiens
cagcagccagctctcagcca

SEQ ID NO: 144278 - DNA, 13 bp, Homo sapiens
cagcagcccctgc

SEQ ID NO: 144279 - DNA, 19 bp, Homo sapiens
cagcagccctcctcacccc

SEQ ID NO: 144280 - DNA, 14 bp, Homo sapiens
cagcaggaggccag

SEQ ID NO: 144281 - DNA, 20 bp, Homo sapiens
cagcagggagggcttctgcc

SEQ ID NO: 144282 - DNA, 16 bp, Homo sapiens
cagcagtgtcatcaga

SEQ ID NO: 144283 - DNA, 19 bp, Homo sapiens
cagcagtgttccccatctg

SEQ ID NO: 144284 - DNA, 23 bp, Homo sapiens
cagcagtgttccccatctgggtc

SEQ ID NO: 144285 - DNA, 20 bp, Homo sapiens
cagcagttgaaaagactcca

SEQ ID NO: 144286 - DNA, 22 bp, Homo sapiens
cagcagttgaaaagactccaaa

SEQ ID NO: 144287 - DNA, 16 bp, Homo sapiens
cagcatacctgctggt

SEQ ID NO: 144288 - DNA, 20 bp, Homo sapiens
cagcatcatggaggtttgaa

SEQ ID NO: 144289 - DNA, 17 bp, Homo sapiens
cagcatgaggaactagc

SEQ ID NO: 144290 - DNA, 16 bp, Homo sapiens
cagccaaaccctgtct

SEQ ID NO: 144291 - DNA, 17 bp, Homo sapiens
cagccaaaccctgtctg

SEQ ID NO: 144292 - DNA, 21 bp, Homo sapiens
cagccaaagcctcctccagcc

SEQ ID NO: 144293 - DNA, 12 bp, Homo sapiens
cagccacactgt

SEQ ID NO: 144294 - DNA, 20 bp, Homo sapiens
cagccagaacgtggctctgc

SEQ ID NO: 144295 - DNA, 21 bp, Homo sapiens
cagccagaacgtggctctgct

SEQ ID NO: 144296 - DNA, 18 bp, Homo sapiens
cagggacagagacacctg

SEQ ID NO: 144297 - DNA, 23 bp, Homo sapiens
cagggacagagacacctgcacct

SEQ ID NO: 144298 - DNA, 15 bp, Homo sapiens
cagggacagagccat

SEQ ID NO: 144299 - DNA, 14 bp, Homo sapiens
cagggacttgaagt

SEQ ID NO: 144300 - DNA, 19 bp, Homo sapiens
cagggacttgaagttgtta

SEQ ID NO: 144301 - DNA, 18 bp, Homo sapiens
cagggattaacctctgca

SEQ ID NO: 144302 - DNA, 19 bp, Homo sapiens
cagggattaacctctgcac

SEQ ID NO: 144303 - DNA, 19 bp, Homo sapiens
cagggcagagtgagaccca

SEQ ID NO: 144304 - DNA, 17 bp, Homo sapiens
cagggcatggctgggaa

SEQ ID NO: 144305 - DNA, 16 bp, Homo sapiens
cagggccacgtgccag

SEQ ID NO: 144306 - DNA, 20 bp, Homo sapiens
cagggccacgtgccaggccc

SEQ ID NO: 144307 - DNA, 13 bp, Homo sapiens
cagggccaggact

SEQ ID NO: 144308 - DNA, 14 bp, Homo sapiens
cagggccaggactg

SEQ ID NO: 144309 - DNA, 16 bp, Homo sapiens
cagggccccagcacta

SEQ ID NO: 144310 - DNA, 17 bp, Homo sapiens
cagggcctgagcctggc

SEQ ID NO: 144311 - DNA, 18 bp, Homo sapiens
cagggcctgagcctggcc

SEQ ID NO: 144312 - DNA, 19 bp, Homo sapiens
cagggcctgagcctggcca

SEQ ID NO: 144313 - DNA, 22 bp, Homo sapiens
cagggcctggggagatggagga

SEQ ID NO: 144314 - DNA, 13 bp, Homo sapiens
cagggccttgccc

SEQ ID NO: 144315 - DNA, 19 bp, Homo sapiens
cagggccttgcccagagat

SEQ ID NO: 144316 - DNA, 24 bp, Homo sapiens
cagggccttgcccagagatgcctc

SEQ ID NO: 144317 - DNA, 16 bp, Homo sapiens
cagggctaccctgagc

SEQ ID NO: 144318 - DNA, 18 bp, Homo sapiens
cagggctaccctgagctg

SEQ ID NO: 144319 - DNA, 23 bp, Homo sapiens
cagggctaccctgagctgaggca

SEQ ID NO: 144320 - DNA, 15 bp, Homo sapiens
cagggctagtgactt

SEQ ID NO: 144321 - DNA, 12 bp, Homo sapiens
cagggctcagcc

SEQ ID NO: 144322 - DNA, 16 bp, Homo sapiens
cagggctcagcctggt

SEQ ID NO: 144323 - DNA, 19 bp, Homo sapiens
cagggctcagcctggtggg

SEQ ID NO: 144324 - DNA, 14 bp, Homo sapiens
caggggaaaatgaa

SEQ ID NO: 144325 - DNA, 20 bp, Homo sapiens
caggggagagggtctggaga

SEQ ID NO: 144326 - DNA, 14 bp, Homo sapiens
caggggccagagga

SEQ ID NO: 144327 - DNA, 18 bp, Homo sapiens
caggggcgtgtggctcac

SEQ ID NO: 144328 - DNA, 19 bp, Homo sapiens
caggggctacaagagggaa

SEQ ID NO: 144329 - DNA, 17 bp, Homo sapiens
caggggctctggagaga

SEQ ID NO: 144330 - DNA, 18 bp, Homo sapiens
cagggggactagcccctg

SEQ ID NO: 144331 - DNA, 11 bp, Homo sapiens
cagggggccag

SEQ ID NO: 144332 - DNA, 16 bp, Homo sapiens
cagggggccaggtgca

SEQ ID NO: 144333 - DNA, 20 bp, Homo sapiens
cagggtattccagagtgggg

SEQ ID NO: 144334 - DNA, 21 bp, Homo sapiens
cagggtctgctctttctctgc

SEQ ID NO: 144335 - DNA, 23 bp, Homo sapiens
cagggtctgctctttctctgcca

SEQ ID NO: 144336 - DNA, 14 bp, Homo sapiens
cagggtgaggatgg

SEQ ID NO: 144337 - DNA, 17 bp, Homo sapiens
cagggtggacttagaaa

SEQ ID NO: 144338 - DNA, 17 bp, Homo sapiens
cagggttctcctctccc

SEQ ID NO: 144339 - DNA, 16 bp, Homo sapiens
caggtagctgcccctg

SEQ ID NO: 144340 - DNA, 17 bp, Homo sapiens
caggtatagactcctga

SEQ ID NO: 144341 - DNA, 23 bp, Homo sapiens
caggtcaatacagtacaggcagc

SEQ ID NO: 144342 - DNA, 13 bp, Homo sapiens
caggtctcccacg

SEQ ID NO: 144343 - DNA, 11 bp, Homo sapiens
caggtctcctc

SEQ ID NO: 144344 - DNA, 13 bp, Homo sapiens
caggtctcctctt

SEQ ID NO: 144345 - DNA, 14 bp, Homo sapiens
caggtctcctctta

SEQ ID NO: 144346 - DNA, 21 bp, Homo sapiens
caggtgagaagcagaggaagg

SEQ ID NO: 144347 - DNA, 15 bp, Homo sapiens
caggtgcacagacgt

SEQ ID NO: 144348 - DNA, 16 bp, Homo sapiens
caggtggccactccag

SEQ ID NO: 144349 - DNA, 19 bp, Homo sapiens
caggtggccactccagacc

SEQ ID NO: 144350 - DNA, 14 bp, Homo sapiens
caggtggctgaccc

SEQ ID NO: 144351 - DNA, 21 bp, Homo sapiens
caggtgtgtccacctgggcat

SEQ ID NO: 144352 - DNA, 14 bp, Homo sapiens
caggtgttgccaaa

SEQ ID NO: 144353 - DNA, 22 bp, Homo sapiens
caggttgtctgaagtcactgca

SEQ ID NO: 144354 - DNA, 23 bp, Homo sapiens
caggttgtctgaagtcactgcac

SEQ ID NO: 144355 - DNA, 14 bp, Homo sapiens
caggtttaagctgt

SEQ ID NO: 144356 - DNA, 21 bp, Homo sapiens
cagtaacgcgtcttcctgagt

SEQ ID NO: 144357 - DNA, 15 bp, Homo sapiens
cagtaagggaaatag

SEQ ID NO: 144358 - DNA, 21 bp, Homo sapiens
cagtaattggtccgatctttg

SEQ ID NO: 144359 - DNA, 12 bp, Homo sapiens
cagtacaggcag

SEQ ID NO: 144360 - DNA, 13 bp, Homo sapiens
cagtacaggcagc

SEQ ID NO: 144361 - DNA, 19 bp, Homo sapiens
cagtacaggcagcacagag

SEQ ID NO: 144362 - DNA, 20 bp, Homo sapiens
cagtacaggcagcacagaga

SEQ ID NO: 144363 - DNA, 19 bp, Homo sapiens
cagtagaaataatatgcat

SEQ ID NO: 144364 - DNA, 20 bp, Homo sapiens
cagtagctgtggtgaggtgg

SEQ ID NO: 144365 - DNA, 14 bp, Homo sapiens
cagtaggagcccag

SEQ ID NO: 144366 - DNA, 14 bp, Homo sapiens
cagtatcaggcctg

SEQ ID NO: 144367 - DNA, 24 bp, Homo sapiens
cagtatcaggcctgccagacggca

SEQ ID NO: 144368 - DNA, 13 bp, Homo sapiens
cagtatctcaggg

SEQ ID NO: 144369 - DNA, 15 bp, Homo sapiens
cagtatctcagggcc

SEQ ID NO: 144370 - DNA, 14 bp, Homo sapiens
cagtatgaaaataa

SEQ ID NO: 144371 - DNA, 18 bp, Homo sapiens
cagtatgttgtcaaagag

SEQ ID NO: 144372 - DNA, 16 bp, Homo sapiens
cagtattcttgtcaaa

SEQ ID NO: 144373 - DNA, 21 bp, Homo sapiens
cagtattttggagaaattatt

SEQ ID NO: 144374 - DNA, 23 bp, Homo sapiens
cagtattttggagaaattattta

SEQ ID NO: 144375 - DNA, 16 bp, Homo sapiens
cagtcaacctgggcaa

SEQ ID NO: 144376 - DNA, 21 bp, Homo sapiens
cagtcaacctgggcaaagcct

SEQ ID NO: 144377 - DNA, 15 bp, Homo sapiens
cagtcacattccaag

SEQ ID NO: 144378 - DNA, 22 bp, Homo sapiens
cagtcatcttgaccaagcagga

SEQ ID NO: 144379 - DNA, 22 bp, Homo sapiens
cagtccctgggggaagccctgg

SEQ ID NO: 144380 - DNA, 22 bp, Homo sapiens
cagtcctcccctcacagcctct

SEQ ID NO: 144381 - DNA, 22 bp, Homo sapiens
cagtcctgatcagagccgtggt

SEQ ID NO: 144382 - DNA, 16 bp, Homo sapiens
cagtcgatagagctgt

SEQ ID NO: 144383 - DNA, 15 bp, Homo sapiens
cagtctcaggaaatc

SEQ ID NO: 144384 - DNA, 12 bp, Homo sapiens
cagtctctgagc

SEQ ID NO: 144385 - DNA, 14 bp, Homo sapiens
cagtctctgagcag

SEQ ID NO: 144386 - DNA, 16 bp, Homo sapiens
cagtctggaggggcat

SEQ ID NO: 144387 - DNA, 18 bp, Homo sapiens
cagtctggaggggcatgg

SEQ ID NO: 144388 - DNA, 21 bp, Homo sapiens
cagtctggaggggcatggcca

SEQ ID NO: 144389 - DNA, 17 bp, Homo sapiens
cagtcttccatttgcaa

SEQ ID NO: 144390 - DNA, 15 bp, Homo sapiens
cagtgacagacaggc

SEQ ID NO: 144391 - DNA, 16 bp, Homo sapiens
cagtgacagacaggct

SEQ ID NO: 144392 - DNA, 17 bp, Homo sapiens
cagtgacagacaggctc

SEQ ID NO: 144393 - DNA, 18 bp, Homo sapiens
cagtgacagacaggctct

SEQ ID NO: 144394 - DNA, 13 bp, Homo sapiens
cagtgagccaaga

SEQ ID NO: 144395 - DNA, 13 bp, Homo sapiens
cagtgagctgaga

SEQ ID NO: 144396 - DNA, 18 bp, Homo sapiens
cagtgagtgagcctggct

SEQ ID NO: 144397 - DNA, 19 bp, Homo sapiens
cagtgagtgagcctggctc

SEQ ID NO: 144398 - DNA, 21 bp, Homo sapiens
cagtgagtgagcctggctctt

SEQ ID NO: 144399 - DNA, 17 bp, Homo sapiens
cagtgatgggagagtag

SEQ ID NO: 144400 - DNA, 15 bp, Homo sapiens
cagtgcacccactct

SEQ ID NO: 144401 - DNA, 23 bp, Homo sapiens
cagtgccaagcacagtgcctgca

SEQ ID NO: 144402 - DNA, 14 bp, Homo sapiens
cagtgccagcaatg

SEQ ID NO: 144403 - DNA, 17 bp, Homo sapiens
cagtgccagcaatgaca

SEQ ID NO: 144404 - DNA, 21 bp, Homo sapiens
cagtgcccaccaacatcccat

SEQ ID NO: 144405 - DNA, 15 bp, Homo sapiens
cagtgccgagaagga

SEQ ID NO: 144406 - DNA, 22 bp, Homo sapiens
cagtgccttacctcctgcccag

SEQ ID NO: 144407 - DNA, 23 bp, Homo sapiens
cagtgccttacctcctgcccagg

SEQ ID NO: 144408 - DNA, 20 bp, Homo sapiens
cagtggctggtccagggcta

SEQ ID NO: 144409 - DNA, 20 bp, Homo sapiens
cagtgggaacgtgactgccc

SEQ ID NO: 144410 - DNA, 21 bp, Homo sapiens
cagtgggaacgtgactgcccc

SEQ ID NO: 144411 - DNA, 19 bp, Homo sapiens
cagtgggacagggcatggc

SEQ ID NO: 144412 - DNA, 13 bp, Homo sapiens
cagtgggagaaaa

SEQ ID NO: 144413 - DNA, 13 bp, Homo sapiens
cagtgggtgcccc

SEQ ID NO: 144414 - DNA, 13 bp, Homo sapiens
cagtggtctcaca

SEQ ID NO: 144415 - DNA, 15 bp, Homo sapiens
cagtgtcccctccac

SEQ ID NO: 144416 - DNA, 17 bp, Homo sapiens
cagtgtcccctccactg

SEQ ID NO: 144417 - DNA, 20 bp, Homo sapiens
cagtgtcccctccactgtca

SEQ ID NO: 144418 - DNA, 17 bp, Homo sapiens
cagtgtgtttgtgattg

SEQ ID NO: 144419 - DNA, 19 bp, Homo sapiens
cagtgttagggaagggcct

SEQ ID NO: 144420 - DNA, 19 bp, Homo sapiens
cagtgttccccatctgggt

SEQ ID NO: 144421 - DNA, 18 bp, Homo sapiens
ctcaagtttttcagaaag

SEQ ID NO: 144422 - DNA, 19 bp, Homo sapiens
ctcaagtttttcagaaagc

SEQ ID NO: 144423 - DNA, 20 bp, Homo sapiens
ctcaagtttttcagaaagca

SEQ ID NO: 144424 - DNA, 20 bp, Homo sapiens
ctcaatgtgaatcagaccct

SEQ ID NO: 144425 - DNA, 19 bp, Homo sapiens
ctcacaccgcgtctggtga

SEQ ID NO: 144426 - DNA, 21 bp, Homo sapiens
ctcacaccgcgtctggtgaca

SEQ ID NO: 144427 - DNA, 11 bp, Homo sapiens
ctcacagcctc

SEQ ID NO: 144428 - DNA, 15 bp, Homo sapiens
ctcacagcctctgac

SEQ ID NO: 144429 - DNA, 21 bp, Homo sapiens
ctcacagcctctgacccctcc

SEQ ID NO: 144430 - DNA, 17 bp, Homo sapiens
ctcacagtgttgcccag

SEQ ID NO: 144431 - DNA, 21 bp, Homo sapiens
ctcacagtgttgcccaggctg

SEQ ID NO: 144432 - DNA, 20 bp, Homo sapiens
ctcacatctttcacacttcc

SEQ ID NO: 144433 - DNA, 21 bp, Homo sapiens
ctcacatggtgctacgcctgc

SEQ ID NO: 144434 - DNA, 23 bp, Homo sapiens
ctcacatggtgctacgcctgcat

SEQ ID NO: 144435 - DNA, 22 bp, Homo sapiens
ctcacatgtcagtaccttcaaa

SEQ ID NO: 144436 - DNA, 21 bp, Homo sapiens
ctcaccccatcccacaccctg

SEQ ID NO: 144437 - DNA, 20 bp, Homo sapiens
ctcacccccttctccatcca

SEQ ID NO: 144438 - DNA, 15 bp, Homo sapiens
ctcaccccgtctggg

SEQ ID NO: 144439 - DNA, 13 bp, Homo sapiens
ctcacccctgtcc

SEQ ID NO: 144440 - DNA, 18 bp, Homo sapiens
ctcacccctgtcctcact

SEQ ID NO: 144441 - DNA, 21 bp, Homo sapiens
ctcaccctgccttatcttgca

SEQ ID NO: 144442 - DNA, 13 bp, Homo sapiens
ctcacctctgcct

SEQ ID NO: 144443 - DNA, 15 bp, Homo sapiens
ctcacctctgcctca

SEQ ID NO: 144444 - DNA, 16 bp, Homo sapiens
ctcacctctgcctcaa

SEQ ID NO: 144445 - DNA, 21 bp, Homo sapiens
ctcacctggggtgtgggaggc

SEQ ID NO: 144446 - DNA, 14 bp, Homo sapiens
ctcactccaccacc

SEQ ID NO: 144447 - DNA, 13 bp, Homo sapiens
ctcactcctacct

SEQ ID NO: 144448 - DNA, 17 bp, Homo sapiens
ctcactcctacctggta

SEQ ID NO: 144449 - DNA, 19 bp, Homo sapiens
ctcactgccatgccagctt

SEQ ID NO: 144450 - DNA, 22 bp, Homo sapiens
ctcactgccatgccagcttatc

SEQ ID NO: 144451 - DNA, 16 bp, Homo sapiens
ctcactggccatccct

SEQ ID NO: 144452 - DNA, 17 bp, Homo sapiens
ctcactggggtcctggg

SEQ ID NO: 144453 - DNA, 15 bp, Homo sapiens
ctccgtatttcagac

SEQ ID NO: 144454 - DNA, 17 bp, Homo sapiens
ctcctaaagtagacttc

SEQ ID NO: 144455 - DNA, 13 bp, Homo sapiens
ctcctacctggta

SEQ ID NO: 144456 - DNA, 12 bp, Homo sapiens
ctcctagactga

SEQ ID NO: 144457 - DNA, 21 bp, Homo sapiens
ctcctagactgaccctgatca

SEQ ID NO: 144458 - DNA, 22 bp, Homo sapiens
ctcctagcctgtgcctctggga

SEQ ID NO: 144459 - DNA, 12 bp, Homo sapiens
ctcctatgtgta

SEQ ID NO: 144460 - DNA, 13 bp, Homo sapiens
ctcctatgtgtaa

SEQ ID NO: 144461 - DNA, 18 bp, Homo sapiens
ctcctcaccccgtctggg

SEQ ID NO: 144462 - DNA, 20 bp, Homo sapiens
ctcctcactggccatccctc

SEQ ID NO: 144463 - DNA, 20 bp, Homo sapiens
ctcctccagggccacgtgcc

SEQ ID NO: 144464 - DNA, 12 bp, Homo sapiens
ctcctccttccc

SEQ ID NO: 144465 - DNA, 14 bp, Homo sapiens
ctcctcgcaagctg

SEQ ID NO: 144466 - DNA, 15 bp, Homo sapiens
ctcctcgcaagctgg

SEQ ID NO: 144467 - DNA, 18 bp, Homo sapiens
ctcctcggccccctccat

SEQ ID NO: 144468 - DNA, 18 bp, Homo sapiens
ctcctctgactcagggct

SEQ ID NO: 144469 - DNA, 20 bp, Homo sapiens
ctcctctgactcagggctcc

SEQ ID NO: 144470 - DNA, 22 bp, Homo sapiens
ctcctctgactcagggctcctg

SEQ ID NO: 144471 - DNA, 17 bp, Homo sapiens
ctcctctgccacctccc

SEQ ID NO: 144472 - DNA, 16 bp, Homo sapiens
ctcctctgtccagggc

SEQ ID NO: 144473 - DNA, 20 bp, Homo sapiens
ctcctcttaaaaaataaaaa

SEQ ID NO: 144474 - DNA, 21 bp, Homo sapiens
ctcctcttaaaaaataaaaac

SEQ ID NO: 144475 - DNA, 14 bp, Homo sapiens
ctcctgccaaggag

SEQ ID NO: 144476 - DNA, 12 bp, Homo sapiens
ctcctgcccagg

SEQ ID NO: 144477 - DNA, 15 bp, Homo sapiens
ctcctgcccaggaga

SEQ ID NO: 144478 - DNA, 17 bp, Homo sapiens
ctcctgcccaggagagc

SEQ ID NO: 144479 - DNA, 13 bp, Homo sapiens
ctcctgcctactc

SEQ ID NO: 144480 - DNA, 14 bp, Homo sapiens
ctcctgcctactca

SEQ ID NO: 144481 - DNA, 16 bp, Homo sapiens
ctcctgcctactcacg

SEQ ID NO: 144482 - DNA, 14 bp, Homo sapiens
ctcctgggccctct

SEQ ID NO: 144483 - DNA, 13 bp, Homo sapiens
ctcctgggctcag

SEQ ID NO: 144484 - DNA, 20 bp, Homo sapiens
ctcctgggggttctttcttc

SEQ ID NO: 144485 - DNA, 12 bp, Homo sapiens
ctcctgtcctcc

SEQ ID NO: 144486 - DNA, 15 bp, Homo sapiens
ctcctgtctgccagc

SEQ ID NO: 144487 - DNA, 17 bp, Homo sapiens
ctcctgtctgccagcca

SEQ ID NO: 144488 - DNA, 17 bp, Homo sapiens
ctcctgtgcaactttcc

SEQ ID NO: 144489 - DNA, 11 bp, Homo sapiens
ctcctgtgcta

SEQ ID NO: 144490 - DNA, 13 bp, Homo sapiens
ctccttcccaaag

SEQ ID NO: 144491 - DNA, 23 bp, Homo sapiens
ctccttcccaaaggactccaccc

SEQ ID NO: 144492 - DNA, 21 bp, Homo sapiens
ctccttcctgccacctgctgc

SEQ ID NO: 144493 - DNA, 13 bp, Homo sapiens
ctccttcctggag

SEQ ID NO: 144494 - DNA, 19 bp, Homo sapiens
ctccttgactccttgtggt

SEQ ID NO: 144495 - DNA, 18 bp, Homo sapiens
ctccttgggccctttgag

SEQ ID NO: 144496 - DNA, 19 bp, Homo sapiens
ctccttgggccctttgagt

SEQ ID NO: 144497 - DNA, 17 bp, Homo sapiens
ctccttgtggtttatgt

SEQ ID NO: 144498 - DNA, 12 bp, Homo sapiens
ctcgaagcgcgc

SEQ ID NO: 144499 - DNA, 17 bp, Homo sapiens
ctcgaagcgcgccactc

SEQ ID NO: 144500 - DNA, 17 bp, Homo sapiens
ctcgagcagtcctgcct

SEQ ID NO: 144501 - DNA, 18 bp, Homo sapiens
ctcgattttgtatctgca

SEQ ID NO: 144502 - DNA, 19 bp, Homo sapiens
ctcgattttgtatctgcag

SEQ ID NO: 144503 - DNA, 23 bp, Homo sapiens
ctcgcctgacaaccactggtctg

SEQ ID NO: 144504 - DNA, 13 bp, Homo sapiens
ctcgctgccagct

SEQ ID NO: 144505 - DNA, 15 bp, Homo sapiens
ctcgctggactctca

SEQ ID NO: 144506 - DNA, 14 bp, Homo sapiens
ctcgcttcccccat

SEQ ID NO: 144507 - DNA, 19 bp, Homo sapiens
ctcgcttcccccatagcca

SEQ ID NO: 144508 - DNA, 13 bp, Homo sapiens
ctcggagcctcat

SEQ ID NO: 144509 - DNA, 22 bp, Homo sapiens
ctcggagcctcatccgaggcag

SEQ ID NO: 144510 - DNA, 17 bp, Homo sapiens
ctcggagggattcccct

SEQ ID NO: 144511 - DNA, 20 bp, Homo sapiens
ctcggagtatctgggaactg

SEQ ID NO: 144512 - DNA, 16 bp, Homo sapiens
ctcggtgtggagaagc

SEQ ID NO: 144513 - DNA, 23 bp, Homo sapiens
ctcggtgtggagaagcggctggc

SEQ ID NO: 144514 - DNA, 18 bp, Homo sapiens
ctcgtatatgtctcaggt

SEQ ID NO: 144515 - DNA, 14 bp, Homo sapiens
ctcgtcctccccct

SEQ ID NO: 144516 - DNA, 15 bp, Homo sapiens
ctcgtcctccccctg

SEQ ID NO: 144517 - DNA, 24 bp, Homo sapiens
ctcgtcctccccctgccagtgcct

SEQ ID NO: 144518 - DNA, 18 bp, Homo sapiens
ctcgtggccttccccagc

SEQ ID NO: 144519 - DNA, 20 bp, Homo sapiens
ctcgtggccttccccagcct

SEQ ID NO: 144520 - DNA, 17 bp, Homo sapiens
ctctacagagcttccct

SEQ ID NO: 144521 - DNA, 18 bp, Homo sapiens
ctctacagagcttccctg

SEQ ID NO: 144522 - DNA, 21 bp, Homo sapiens
ctctacagctaatcagcattc

SEQ ID NO: 144523 - DNA, 13 bp, Homo sapiens
ctctacccagggc

SEQ ID NO: 144524 - DNA, 12 bp, Homo sapiens
ctctacctgaca

SEQ ID NO: 144525 - DNA, 19 bp, Homo sapiens
ctctacttagcatgtccct

SEQ ID NO: 144526 - DNA, 20 bp, Homo sapiens
ctctacttagcatgtcccta

SEQ ID NO: 144527 - DNA, 13 bp, Homo sapiens
ctctatttaatat

SEQ ID NO: 144528 - DNA, 14 bp, Homo sapiens
ctctatttaatatt

SEQ ID NO: 144529 - DNA, 16 bp, Homo sapiens
ggcttaatgtttattc

SEQ ID NO: 144530 - DNA, 21 bp, Homo sapiens
ggcttcacggaagagccttgc

SEQ ID NO: 144531 - DNA, 16 bp, Homo sapiens
ggcttcccgctcagcc

SEQ ID NO: 144532 - DNA, 19 bp, Homo sapiens
ggcttcccgctcagccctc

SEQ ID NO: 144533 - DNA, 20 bp, Homo sapiens
ggcttctcatacgtccacca

SEQ ID NO: 144534 - DNA, 21 bp, Homo sapiens
ggcttctcatacgtccaccat

SEQ ID NO: 144535 - DNA, 13 bp, Homo sapiens
ggcttctcctgac

SEQ ID NO: 144536 - DNA, 23 bp, Homo sapiens
ggcttgggcttccatttgtgtgt

SEQ ID NO: 144537 - DNA, 15 bp, Homo sapiens
ggcttgtaactccac

SEQ ID NO: 144538 - DNA, 13 bp, Homo sapiens
ggcttttcactgc

SEQ ID NO: 144539 - DNA, 14 bp, Homo sapiens
ggcttttcactgct

SEQ ID NO: 144540 - DNA, 17 bp, Homo sapiens
ggcttttcactgctggc

SEQ ID NO: 144541 - DNA, 19 bp, Homo sapiens
ggcttttcactgctggctg

SEQ ID NO: 144542 - DNA, 15 bp, Homo sapiens
ggcttttctcagctg

SEQ ID NO: 144543 - DNA, 14 bp, Homo sapiens
gggaacgtgactgc

SEQ ID NO: 144544 - DNA, 20 bp, Homo sapiens
gggaaggagggttagggagg

SEQ ID NO: 144545 - DNA, 19 bp, Homo sapiens
gggaaggccccacagacaa

SEQ ID NO: 144546 - DNA, 12 bp, Homo sapiens
gggaaggtcacc

SEQ ID NO: 144547 - DNA, 19 bp, Homo sapiens
gggaatccccgaaggtgct

SEQ ID NO: 144548 - DNA, 14 bp, Homo sapiens
gggacacctgccct

SEQ ID NO: 144549 - DNA, 18 bp, Homo sapiens
gggacagagacacctgca

SEQ ID NO: 144550 - DNA, 23 bp, Homo sapiens
gggactgccagtccccctgcccc

SEQ ID NO: 144551 - DNA, 15 bp, Homo sapiens
gggactgggagggcc

SEQ ID NO: 144552 - DNA, 20 bp, Homo sapiens
gggactggggatgtgggagg

SEQ ID NO: 144553 - DNA, 15 bp, Homo sapiens
gggagacatgtgaca

SEQ ID NO: 144554 - DNA, 13 bp, Homo sapiens
gggagagaccctt

SEQ ID NO: 144555 - DNA, 16 bp, Homo sapiens
gggagcagacaggagg

SEQ ID NO: 144556 - DNA, 23 bp, Homo sapiens
gggaggatctcttgagcctggga

SEQ ID NO: 144557 - DNA, 21 bp, Homo sapiens
gggaggattgcttgagctcag

SEQ ID NO: 144558 - DNA, 16 bp, Homo sapiens
gggaggcatggccctg

SEQ ID NO: 144559 - DNA, 17 bp, Homo sapiens
gggaggcatggccctgg

SEQ ID NO: 144560 - DNA, 11 bp, Homo sapiens
gggaggcccca

SEQ ID NO: 144561 - DNA, 13 bp, Homo sapiens
gggagggcagcag

SEQ ID NO: 144562 - DNA, 14 bp, Homo sapiens
gggaggtcattttg

SEQ ID NO: 144563 - DNA, 18 bp, Homo sapiens
gggaggtcgaggcaggag

SEQ ID NO: 144564 - DNA, 19 bp, Homo sapiens
gggaggtcgaggcaggagg

SEQ ID NO: 144565 - DNA, 23 bp, Homo sapiens
gggagtctgaagcagatgcaaag

SEQ ID NO: 144566 - DNA, 20 bp, Homo sapiens
gggagttcgagaccaacctg

SEQ ID NO: 144567 - DNA, 23 bp, Homo sapiens
gggagttcgagaccaacctgacc

SEQ ID NO: 144568 - DNA, 16 bp, Homo sapiens
gggatagcactgagca

SEQ ID NO: 144569 - DNA, 17 bp, Homo sapiens
gggatctgtgcccagag

SEQ ID NO: 144570 - DNA, 14 bp, Homo sapiens
gggatggaggagaa

SEQ ID NO: 144571 - DNA, 17 bp, Homo sapiens
gggatggtggagggcca

SEQ ID NO: 144572 - DNA, 13 bp, Homo sapiens
gggatgttctggc

SEQ ID NO: 144573 - DNA, 18 bp, Homo sapiens
gggcaaaattcccaggga

SEQ ID NO: 144574 - DNA, 18 bp, Homo sapiens
gggcacgctgtgggcagg

SEQ ID NO: 144575 - DNA, 12 bp, Homo sapiens
gggcagagccca

SEQ ID NO: 144576 - DNA, 14 bp, Homo sapiens
gggcagagcccaag

SEQ ID NO: 144577 - DNA, 15 bp, Homo sapiens
gggcagagggcagag

SEQ ID NO: 144578 - DNA, 17 bp, Homo sapiens
gggcagagtgagaccca

SEQ ID NO: 144579 - DNA, 16 bp, Homo sapiens
gggcagcacagagagg

SEQ ID NO: 144580 - DNA, 14 bp, Homo sapiens
gggcagcagggcta

SEQ ID NO: 144581 - DNA, 19 bp, Homo sapiens
gggcagctgttagagtcca

SEQ ID NO: 144582 - DNA, 17 bp, Homo sapiens
gggcagtcattatccag

SEQ ID NO: 144583 - DNA, 17 bp, Homo sapiens
gggcatatccaccacct

SEQ ID NO: 144584 - DNA, 23 bp, Homo sapiens
gggcattgatggggaaggaggct

SEQ ID NO: 144585 - DNA, 23 bp, Homo sapiens
gggccaacttgagggcccagagc

SEQ ID NO: 144586 - DNA, 17 bp, Homo sapiens
gggccaagacttggcaa

SEQ ID NO: 144587 - DNA, 19 bp, Homo sapiens
gggccacatgggaggctca

SEQ ID NO: 144588 - DNA, 22 bp, Homo sapiens
gggccacctccccaggccgtgg

SEQ ID NO: 144589 - DNA, 23 bp, Homo sapiens
gggccagaggaactgtccagaga

SEQ ID NO: 144590 - DNA, 17 bp, Homo sapiens
gggccaggacaggcccg

SEQ ID NO: 144591 - DNA, 14 bp, Homo sapiens
gggccaggactgag

SEQ ID NO: 144592 - DNA, 17 bp, Homo sapiens
gggccaggactgagccc

SEQ ID NO: 144593 - DNA, 11 bp, Homo sapiens
gggccaggcag

SEQ ID NO: 144594 - DNA, 12 bp, Homo sapiens
gggcccagagca

SEQ ID NO: 144595 - DNA, 22 bp, Homo sapiens
gggccctgagctcggtggaccc

SEQ ID NO: 144596 - DNA, 18 bp, Homo sapiens
gggccctgcacctgtgca

SEQ ID NO: 144597 - DNA, 15 bp, Homo sapiens
gggcctcggagcctc

SEQ ID NO: 144598 - DNA, 18 bp, Homo sapiens
gggcctgagcctggccag

SEQ ID NO: 144599 - DNA, 10 bp, Homo sapiens
gggcctggca

SEQ ID NO: 144600 - DNA, 17 bp, Homo sapiens
gggccttgcccagagat

SEQ ID NO: 144601 - DNA, 14 bp, Homo sapiens
gggcggcagagagg

SEQ ID NO: 144602 - DNA, 15 bp, Homo sapiens
gggcgtggtggtgag

SEQ ID NO: 144603 - DNA, 20 bp, Homo sapiens
gggctaagagctagcgctgc

SEQ ID NO: 144604 - DNA, 13 bp, Homo sapiens
gggctacaagagg

SEQ ID NO: 144605 - DNA, 22 bp, Homo sapiens
gggctcagcaaaagatgcttct

SEQ ID NO: 144606 - DNA, 12 bp, Homo sapiens
gggctcagcctg

SEQ ID NO: 144607 - DNA, 20 bp, Homo sapiens
gggctcagcctggtgggcct

SEQ ID NO: 144608 - DNA, 14 bp, Homo sapiens
gggctccctgactg

SEQ ID NO: 144609 - DNA, 13 bp, Homo sapiens
gggctctggagag

SEQ ID NO: 144610 - DNA, 16 bp, Homo sapiens
gggctctggagagaaa

SEQ ID NO: 144611 - DNA, 18 bp, Homo sapiens
gggctgagagaacctcac

SEQ ID NO: 144612 - DNA, 12 bp, Homo sapiens
gggctgagggag

SEQ ID NO: 144613 - DNA, 13 bp, Homo sapiens
gggctgagggagc

SEQ ID NO: 144614 - DNA, 14 bp, Homo sapiens
gggctgccctggtg

SEQ ID NO: 144615 - DNA, 16 bp, Homo sapiens
gggctgggagctctgc

SEQ ID NO: 144616 - DNA, 14 bp, Homo sapiens
gggctgggcagctg

SEQ ID NO: 144617 - DNA, 21 bp, Homo sapiens
gggctggtgacccagtcagag

SEQ ID NO: 144618 - DNA, 12 bp, Homo sapiens
gggctgtgatcg

SEQ ID NO: 144619 - DNA, 16 bp, Homo sapiens
ggggaaaatcagcctg

SEQ ID NO: 144620 - DNA, 19 bp, Homo sapiens
ggggaaaatcagcctgctc

SEQ ID NO: 144621 - DNA, 18 bp, Homo sapiens
ggggagactgggctgagg

SEQ ID NO: 144622 - DNA, 16 bp, Homo sapiens
ggggagtctgaagcag

SEQ ID NO: 144623 - DNA, 18 bp, Homo sapiens
ggggatgtgggagggagc

SEQ ID NO: 144624 - DNA, 18 bp, Homo sapiens
ggggcagagggcagaggc

SEQ ID NO: 144625 - DNA, 14 bp, Homo sapiens
ggggcagtcacctg

SEQ ID NO: 144626 - DNA, 13 bp, Homo sapiens
ggggccagaggct

SEQ ID NO: 144627 - DNA, 14 bp, Homo sapiens
ggggccccagggct

SEQ ID NO: 144628 - DNA, 19 bp, Homo sapiens
ggggcgcccacctccccac

SEQ ID NO: 144629 - DNA, 17 bp, Homo sapiens
ggggctctggagagaaa

SEQ ID NO: 144630 - DNA, 12 bp, Homo sapiens
ggggctctggga

SEQ ID NO: 144631 - DNA, 20 bp, Homo sapiens
ggggctgctcctccagggcc

SEQ ID NO: 144632 - DNA, 21 bp, Homo sapiens
ggggctgctgacctccacagc

SEQ ID NO: 144633 - DNA, 22 bp, Homo sapiens
ggggtaaaattccttagcttag

SEQ ID NO: 144634 - DNA, 15 bp, Homo sapiens
ggggtgggagaggtc

SEQ ID NO: 144635 - DNA, 17 bp, Homo sapiens
ggggttcagcccctcct

SEQ ID NO: 144636 - DNA, 23 bp, Homo sapiens
ggggttcagcccctcctctgcca

SEQ ID NO: 144637 - DNA, 20 bp, Homo sapiens
ggggttctttcttcctctgc

SEQ ID NO: 144638 - DNA, 23 bp, Homo sapiens
gggtaccttgaacactgggggag

SEQ ID NO: 144639 - DNA, 15 bp, Homo sapiens
gggtagctagaggaa

SEQ ID NO: 144640 - DNA, 23 bp, Homo sapiens
gggtataaaactttcctcgcctg

SEQ ID NO: 144641 - DNA, 13 bp, Homo sapiens
gggtatattcatt

SEQ ID NO: 144642 - DNA, 19 bp, Homo sapiens
gggtccaggggatgggagg

SEQ ID NO: 144643 - DNA, 23 bp, Homo sapiens
gggtccttccctctccccaagac

SEQ ID NO: 144644 - DNA, 14 bp, Homo sapiens
gggtctagggagag

SEQ ID NO: 144645 - DNA, 20 bp, Homo sapiens
gggtctccctctcctgccta

SEQ ID NO: 144646 - DNA, 19 bp, Homo sapiens
gggtctgctctttctctgc

SEQ ID NO: 144647 - DNA, 22 bp, Homo sapiens
gggtctgctctttctctgccag

SEQ ID NO: 144648 - DNA, 20 bp, Homo sapiens
gggtcttcagggggccaggt

SEQ ID NO: 144649 - DNA, 19 bp, Homo sapiens
gggtgacagagcaagtgag

SEQ ID NO: 144650 - DNA, 18 bp, Homo sapiens
gggtgagatgctggagaa

SEQ ID NO: 144651 - DNA, 21 bp, Homo sapiens
gggtgccccccttgccagaca

SEQ ID NO: 144652 - DNA, 20 bp, Homo sapiens
gggtggagaactcctagggt

SEQ ID NO: 144653 - DNA, 23 bp, Homo sapiens
gggtggatttgggttggaagtga

SEQ ID NO: 144654 - DNA, 15 bp, Homo sapiens
gggtggcaccagcag

SEQ ID NO: 144655 - DNA, 16 bp, Homo sapiens
gggtggctagtcagag

SEQ ID NO: 144656 - DNA, 16 bp, Homo sapiens
gggtggtctgcaggca

SEQ ID NO: 144657 - DNA, 13 bp, Homo sapiens
gggtgtgggaggc

SEQ ID NO: 144658 - DNA, 20 bp, Homo sapiens
gggttcagcccctcctctgc

SEQ ID NO: 144659 - DNA, 17 bp, Homo sapiens
gggttctttcttcctct

SEQ ID NO: 144660 - DNA, 21 bp, Homo sapiens
gggtttggctgtgtctaaact

SEQ ID NO: 144661 - DNA, 13 bp, Homo sapiens
ggtaaaatacttc

SEQ ID NO: 144662 - DNA, 18 bp, Homo sapiens
ggtaccttgaacactggg

SEQ ID NO: 144663 - DNA, 15 bp, Homo sapiens
ggtagccctggccag

SEQ ID NO: 144664 - DNA, 18 bp, Homo sapiens
ggtagccctggccagagg

SEQ ID NO: 144665 - DNA, 19 bp, Homo sapiens
ggtagctgcccctggctct

SEQ ID NO: 144666 - DNA, 22 bp, Homo sapiens
ggtataaaactttcctcgcctg

SEQ ID NO: 144667 - DNA, 17 bp, Homo sapiens
ggtataatggttgactg

SEQ ID NO: 144668 - DNA, 14 bp, Homo sapiens
ggtcaacagagaag

SEQ ID NO: 144669 - DNA, 20 bp, Homo sapiens
ggtcaacagagaaggcagga

SEQ ID NO: 144670 - DNA, 17 bp, Homo sapiens
ggtcaagcccaggagga

SEQ ID NO: 144671 - DNA, 19 bp, Homo sapiens
ggtcaagcccaggaggact

SEQ ID NO: 144672 - DNA, 20 bp, Homo sapiens
ggtcaatacagtacaggcag

SEQ ID NO: 144673 - DNA, 22 bp, Homo sapiens
ggtcagcttgctgccctaggct

SEQ ID NO: 144674 - DNA, 22 bp, Homo sapiens
ggtcaggagaggggcagaacag

SEQ ID NO: 144675 - DNA, 21 bp, Homo sapiens
ggtcaggagttagaggccagc

SEQ ID NO: 144676 - DNA, 22 bp, Homo sapiens
ggtcaggagttagaggccagcc

SEQ ID NO: 144677 - DNA, 14 bp, Homo sapiens
ggagctgggaggaa

SEQ ID NO: 144678 - DNA, 15 bp, Homo sapiens
ggagctgggaggaaa

SEQ ID NO: 144679 - DNA, 19 bp, Homo sapiens
ggaggagggcggggggcac

SEQ ID NO: 144680 - DNA, 21 bp, Homo sapiens
ggaggatctcttgagcctggg

SEQ ID NO: 144681 - DNA, 17 bp, Homo sapiens
ggaggcacacagctgca

SEQ ID NO: 144682 - DNA, 20 bp, Homo sapiens
ggaggccaaggtgggaggat

SEQ ID NO: 144683 - DNA, 12 bp, Homo sapiens
ggaggccagcca

SEQ ID NO: 144684 - DNA, 13 bp, Homo sapiens
ggaggccagccag

SEQ ID NO: 144685 - DNA, 15 bp, Homo sapiens
ggaggctccagaggg

SEQ ID NO: 144686 - DNA, 15 bp, Homo sapiens
ggaggctgagatggg

SEQ ID NO: 144687 - DNA, 15 bp, Homo sapiens
ggaggctgaggcaga

SEQ ID NO: 144688 - DNA, 13 bp, Homo sapiens
ggagggagatgga

SEQ ID NO: 144689 - DNA, 17 bp, Homo sapiens
ggagggcagcagggcta

SEQ ID NO: 144690 - DNA, 23 bp, Homo sapiens
ggagggccacatgggaggctcac

SEQ ID NO: 144691 - DNA, 20 bp, Homo sapiens
ggaggggcatggccagcagc

SEQ ID NO: 144692 - DNA, 14 bp, Homo sapiens
ggaggggcctggca

SEQ ID NO: 144693 - DNA, 17 bp, Homo sapiens
ggaggggcgcccacctc

SEQ ID NO: 144694 - DNA, 22 bp, Homo sapiens
ggaggggcgcccacctccccac

SEQ ID NO: 144695 - DNA, 14 bp, Homo sapiens
ggagggtcaggaag

SEQ ID NO: 144696 - DNA, 20 bp, Homo sapiens
ggaggtcaaggctgcagtga

SEQ ID NO: 144697 - DNA, 22 bp, Homo sapiens
ggaggtcgaccccaaagcccct

SEQ ID NO: 144698 - DNA, 19 bp, Homo sapiens
ggaggtgggagcaggagat

SEQ ID NO: 144699 - DNA, 20 bp, Homo sapiens
ggaggttgcagtgagctgag

SEQ ID NO: 144700 - DNA, 15 bp, Homo sapiens
ggagtatctgggaac

SEQ ID NO: 144701 - DNA, 14 bp, Homo sapiens
ggagtcagagagaa

SEQ ID NO: 144702 - DNA, 15 bp, Homo sapiens
ggagtcccgtcagga

SEQ ID NO: 144703 - DNA, 16 bp, Homo sapiens
ggagtcccgtcaggac

SEQ ID NO: 144704 - DNA, 14 bp, Homo sapiens
ggagtctgaagcag

SEQ ID NO: 144705 - DNA, 16 bp, Homo sapiens
ggagttagaggccagc

SEQ ID NO: 144706 - DNA, 18 bp, Homo sapiens
ggagttagaggccagcct

SEQ ID NO: 144707 - DNA, 16 bp, Homo sapiens
ggatactgcagggcca

SEQ ID NO: 144708 - DNA, 16 bp, Homo sapiens
ggatcacagcctctga

SEQ ID NO: 144709 - DNA, 17 bp, Homo sapiens
ggatctcattggaccct

SEQ ID NO: 144710 - DNA, 24 bp, Homo sapiens
ggatctcattggacccttccatgg

SEQ ID NO: 144711 - DNA, 18 bp, Homo sapiens
ggatctggggctctggga

SEQ ID NO: 144712 - DNA, 23 bp, Homo sapiens
ggatctgttgtgtacgtggagag

SEQ ID NO: 144713 - DNA, 16 bp, Homo sapiens
ggatgacatgtcccta

SEQ ID NO: 144714 - DNA, 20 bp, Homo sapiens
ggatgacatgtccctacacc

SEQ ID NO: 144715 - DNA, 19 bp, Homo sapiens
ggatgccatctgtgggcac

SEQ ID NO: 144716 - DNA, 22 bp, Homo sapiens
ggatgcccagggccactctgcc

SEQ ID NO: 144717 - DNA, 12 bp, Homo sapiens
ggatgggaagga

SEQ ID NO: 144718 - DNA, 16 bp, Homo sapiens
ggatgtaaacagtgcc

SEQ ID NO: 144719 - DNA, 21 bp, Homo sapiens
ggatgtaaacagtgcctgctg

SEQ ID NO: 144720 - DNA, 23 bp, Homo sapiens
ggatgtatccatgggggcagggc

SEQ ID NO: 144721 - DNA, 18 bp, Homo sapiens
ggatgtccacagatgcct

SEQ ID NO: 144722 - DNA, 17 bp, Homo sapiens
ggattaacctctgcact

SEQ ID NO: 144723 - DNA, 15 bp, Homo sapiens
ggattattcatttaa

SEQ ID NO: 144724 - DNA, 20 bp, Homo sapiens
ggattctactttaagcacta

SEQ ID NO: 144725 - DNA, 23 bp, Homo sapiens
ggattctactttaagcactacat

SEQ ID NO: 144726 - DNA, 20 bp, Homo sapiens
ggattgatcggagcctcctc

SEQ ID NO: 144727 - DNA, 15 bp, Homo sapiens
ggattgcacgtggcc

SEQ ID NO: 144728 - DNA, 12 bp, Homo sapiens
ggattggggaag

SEQ ID NO: 144729 - DNA, 15 bp, Homo sapiens
ggattgtaaaatggt

SEQ ID NO: 144730 - DNA, 20 bp, Homo sapiens
ggatttcatgatttcatttc

SEQ ID NO: 144731 - DNA, 15 bp, Homo sapiens
ggcaaaaaggcagga

SEQ ID NO: 144732 - DNA, 20 bp, Homo sapiens
ggcaacacagcgagactccg

SEQ ID NO: 144733 - DNA, 21 bp, Homo sapiens
ggcaacacagcgagactccgt

SEQ ID NO: 144734 - DNA, 21 bp, Homo sapiens
ggcaaccacaggcagcattta

SEQ ID NO: 144735 - DNA, 15 bp, Homo sapiens
ggcaactgaggcaga

SEQ ID NO: 144736 - DNA, 19 bp, Homo sapiens
ggcaactgaggcagacagc

SEQ ID NO: 144737 - DNA, 23 bp, Homo sapiens
ggcaactgaggcagacagcagct

SEQ ID NO: 144738 - DNA, 18 bp, Homo sapiens
ggcaactgcattggcttt

SEQ ID NO: 144739 - DNA, 19 bp, Homo sapiens
ggcaagagcccccttgaca

SEQ ID NO: 144740 - DNA, 22 bp, Homo sapiens
ggcaagctgtgacttctccagg

SEQ ID NO: 144741 - DNA, 12 bp, Homo sapiens
ggcacagggtct

SEQ ID NO: 144742 - DNA, 18 bp, Homo sapiens
ggcacagggtctgctctt

SEQ ID NO: 144743 - DNA, 19 bp, Homo sapiens
ggcacagggtctgctcttt

SEQ ID NO: 144744 - DNA, 16 bp, Homo sapiens
ggcacatttccccaga

SEQ ID NO: 144745 - DNA, 15 bp, Homo sapiens
ggcaccagcagcctg

SEQ ID NO: 144746 - DNA, 17 bp, Homo sapiens
ggcaccagcagcctgga

SEQ ID NO: 144747 - DNA, 20 bp, Homo sapiens
ggcacgaacccacctgctga

SEQ ID NO: 144748 - DNA, 18 bp, Homo sapiens
ggcacgctgtgggcaggt

SEQ ID NO: 144749 - DNA, 14 bp, Homo sapiens
ggcactgctgtgct

SEQ ID NO: 144750 - DNA, 21 bp, Homo sapiens
ggcactgggatgagccgctgt

SEQ ID NO: 144751 - DNA, 22 bp, Homo sapiens
ggcagaagaattgaacccagga

SEQ ID NO: 144752 - DNA, 22 bp, Homo sapiens
ggccctgtccctcccacctctg

SEQ ID NO: 144753 - DNA, 23 bp, Homo sapiens
ggccctgtccctcccacctctgt

SEQ ID NO: 144754 - DNA, 15 bp, Homo sapiens
ggcccttcctctcca

SEQ ID NO: 144755 - DNA, 22 bp, Homo sapiens
ggcccttcctctccactgcctt

SEQ ID NO: 144756 - DNA, 15 bp, Homo sapiens
ggccgagaagcaaga

SEQ ID NO: 144757 - DNA, 18 bp, Homo sapiens
ggccgccccagcctctga

SEQ ID NO: 144758 - DNA, 15 bp, Homo sapiens
ggccggcgagccctg

SEQ ID NO: 144759 - DNA, 18 bp, Homo sapiens
ggccggcgagccctgtgg

SEQ ID NO: 144760 - DNA, 24 bp, Homo sapiens
ggcctactagagtctgaacagctg

SEQ ID NO: 144761 - DNA, 19 bp, Homo sapiens
ggcctcggagcctcatccg

SEQ ID NO: 144762 - DNA, 22 bp, Homo sapiens
ggcctcggagcctcatccgagg

SEQ ID NO: 144763 - DNA, 23 bp, Homo sapiens
ggcctctgccccgtctcatgagg

SEQ ID NO: 144764 - DNA, 20 bp, Homo sapiens
ggcctctgtgtccttccctg

SEQ ID NO: 144765 - DNA, 13 bp, Homo sapiens
ggcctcttgagca

SEQ ID NO: 144766 - DNA, 16 bp, Homo sapiens
ggcctcttgagcagtg

SEQ ID NO: 144767 - DNA, 17 bp, Homo sapiens
ggcctgaaagaggctga

SEQ ID NO: 144768 - DNA, 23 bp, Homo sapiens
ggcctgaaagaggctgaggcctg

SEQ ID NO: 144769 - DNA, 20 bp, Homo sapiens
ggcctgcaggacctgcctgt

SEQ ID NO: 144770 - DNA, 11 bp, Homo sapiens
ggcctgcctgt

SEQ ID NO: 144771 - DNA, 17 bp, Homo sapiens
ggcctgctgggctctcc

SEQ ID NO: 144772 - DNA, 18 bp, Homo sapiens
ggcctggactttcctgca

SEQ ID NO: 144773 - DNA, 22 bp, Homo sapiens
ggcctgtgtgtgaaaggaagct

SEQ ID NO: 144774 - DNA, 15 bp, Homo sapiens
ggccttccccagcct

SEQ ID NO: 144775 - DNA, 16 bp, Homo sapiens
ggccttgcccagagat

SEQ ID NO: 144776 - DNA, 21 bp, Homo sapiens
ggcgagccctgtggatgagcc

SEQ ID NO: 144777 - DNA, 17 bp, Homo sapiens
ggcgatccacctgtctc

SEQ ID NO: 144778 - DNA, 14 bp, Homo sapiens
ggcgcaagcctgta

SEQ ID NO: 144779 - DNA, 12 bp, Homo sapiens
ggcgcccacctc

SEQ ID NO: 144780 - DNA, 15 bp, Homo sapiens
ggcgcggtggctcac

SEQ ID NO: 144781 - DNA, 19 bp, Homo sapiens
ggcgcggtggctcacgcct

SEQ ID NO: 144782 - DNA, 21 bp, Homo sapiens
ggcggctactcagcagccctc

SEQ ID NO: 144783 - DNA, 15 bp, Homo sapiens
ggcgtgactcaccca

SEQ ID NO: 144784 - DNA, 14 bp, Homo sapiens
ggctaactggaagc

SEQ ID NO: 144785 - DNA, 20 bp, Homo sapiens
ggctaagagctagcgctgcc

SEQ ID NO: 144786 - DNA, 15 bp, Homo sapiens
ggctaattaaataaa

SEQ ID NO: 144787 - DNA, 20 bp, Homo sapiens
ggctactcagcagccctcct

SEQ ID NO: 144788 - DNA, 15 bp, Homo sapiens
ggctactgcagcttt

SEQ ID NO: 144789 - DNA, 20 bp, Homo sapiens
ggctagtatcaaaagaaaga

SEQ ID NO: 144790 - DNA, 18 bp, Homo sapiens
ggctagtcagagagagtg

SEQ ID NO: 144791 - DNA, 19 bp, Homo sapiens
ggctatgtatggaatacag

SEQ ID NO: 144792 - DNA, 14 bp, Homo sapiens
ggctcaagcagtct

SEQ ID NO: 144793 - DNA, 23 bp, Homo sapiens
ggctcaagcagtctacccacctc

SEQ ID NO: 144794 - DNA, 22 bp, Homo sapiens
ggctcacgcctgtaatcccagc

SEQ ID NO: 144795 - DNA, 19 bp, Homo sapiens
ggctcagcaaaagatgctt

SEQ ID NO: 144796 - DNA, 23 bp, Homo sapiens
ggctcagcaaaagatgcttctca

SEQ ID NO: 144797 - DNA, 20 bp, Homo sapiens
ggctcatagggaagacctgc

SEQ ID NO: 144798 - DNA, 16 bp, Homo sapiens
ggctccagagggcact

SEQ ID NO: 144799 - DNA, 17 bp, Homo sapiens
ggctccctgactgggag

SEQ ID NO: 144800 - DNA, 15 bp, Homo sapiens
ggctccgaacaccct

SEQ ID NO: 144801 - DNA, 18 bp, Homo sapiens
ggctccgtcagtatcagg

SEQ ID NO: 144802 - DNA, 22 bp, Homo sapiens
ggctccgtcagtatcaggcctg

SEQ ID NO: 144803 - DNA, 21 bp, Homo sapiens
ggctcgagcagtcctgcctca

SEQ ID NO: 144804 - DNA, 18 bp, Homo sapiens
ggctctccacctcagcct

SEQ ID NO: 144805 - DNA, 19 bp, Homo sapiens
ggctctccacctcagcctt

SEQ ID NO: 144806 - DNA, 20 bp, Homo sapiens
ggctctccacctcagccttg

SEQ ID NO: 144807 - DNA, 21 bp, Homo sapiens
ggctctccacctcagccttgg

SEQ ID NO: 144808 - DNA, 15 bp, Homo sapiens
ggctctggagacagc

SEQ ID NO: 144809 - DNA, 12 bp, Homo sapiens
ggctcttctcct

SEQ ID NO: 144810 - DNA, 15 bp, Homo sapiens
ggctcttctcctttc

SEQ ID NO: 144811 - DNA, 23 bp, Homo sapiens
ggctcttctcctttcacaacctt

SEQ ID NO: 144812 - DNA, 18 bp, Homo sapiens
ggctgacccagtccctgg

SEQ ID NO: 144813 - DNA, 22 bp, Homo sapiens
ggctgacccagtccctggggga

SEQ ID NO: 144814 - DNA, 21 bp, Homo sapiens
ggctgaccttgaactcctggg

SEQ ID NO: 144815 - DNA, 17 bp, Homo sapiens
ggctgaggaaaggccag

SEQ ID NO: 144816 - DNA, 15 bp, Homo sapiens
ggctgagggagcctg

SEQ ID NO: 144817 - DNA, 17 bp, Homo sapiens
ggctgcccacacacccc

SEQ ID NO: 144818 - DNA, 19 bp, Homo sapiens
ggctgcccacacaccccaa

SEQ ID NO: 144819 - DNA, 12 bp, Homo sapiens
ggctgccctggt

SEQ ID NO: 144820 - DNA, 13 bp, Homo sapiens
ggctgccctggtg

SEQ ID NO: 144821 - DNA, 16 bp, Homo sapiens
ggctgcctggccccca

SEQ ID NO: 144822 - DNA, 15 bp, Homo sapiens
ggctgctcctccagg

SEQ ID NO: 144823 - DNA, 18 bp, Homo sapiens
ggctgctcctccagggcc

SEQ ID NO: 144824 - DNA, 12 bp, Homo sapiens
ggctgctggagg

SEQ ID NO: 144825 - DNA, 15 bp, Homo sapiens
ggctgctggaggaaa

SEQ ID NO: 144826 - DNA, 17 bp, Homo sapiens
ggctggaggcagggcct

SEQ ID NO: 144827 - DNA, 19 bp, Homo sapiens
ggctggagtggagtggcgt

SEQ ID NO: 144828 - DNA, 20 bp, Homo sapiens
ggctggcggctactcagcag

SEQ ID NO: 144829 - DNA, 19 bp, Homo sapiens
ggctgggtggcaccagcag

SEQ ID NO: 144830 - DNA, 13 bp, Homo sapiens
ggctggtgggagg

SEQ ID NO: 144831 - DNA, 18 bp, Homo sapiens
ggctgtcagcaggaagca

SEQ ID NO: 144832 - DNA, 13 bp, Homo sapiens
ggctgtcctgtac

SEQ ID NO: 144833 - DNA, 18 bp, Homo sapiens
ggctgtcttctcaggctc

SEQ ID NO: 144834 - DNA, 22 bp, Homo sapiens
ggctgtcttctcaggctctgcc

SEQ ID NO: 144835 - DNA, 16 bp, Homo sapiens
ggctgtgcctctgcct

SEQ ID NO: 144836 - DNA, 12 bp, Homo sapiens
ggcttaatgttt

SEQ ID NO: 144837 - DNA, 18 bp, Homo sapiens
ctgcaagagccttggtgt

SEQ ID NO: 144838 - DNA, 21 bp, Homo sapiens
ctgcaagagccttggtgtcca

SEQ ID NO: 144839 - DNA, 16 bp, Homo sapiens
ctgcaagggctcccca

SEQ ID NO: 144840 - DNA, 22 bp, Homo sapiens
ctgcaagggctccccactgcct

SEQ ID NO: 144841 - DNA, 19 bp, Homo sapiens
ctgcaagtcagtccaggat

SEQ ID NO: 144842 - DNA, 19 bp, Homo sapiens
ctgcaagtgacatctcttt

SEQ ID NO: 144843 - DNA, 17 bp, Homo sapiens
ctgcaatgggcactggg

SEQ ID NO: 144844 - DNA, 21 bp, Homo sapiens
ctgcaatgggcactgggatga

SEQ ID NO: 144845 - DNA, 18 bp, Homo sapiens
ctgcacaaagcccttcca

SEQ ID NO: 144846 - DNA, 20 bp, Homo sapiens
ctgcacaaagcccttccatg

SEQ ID NO: 144847 - DNA, 21 bp, Homo sapiens
ctgcacaaagcccttccatgt

SEQ ID NO: 144848 - DNA, 13 bp, Homo sapiens
ctgcacaagctgc

SEQ ID NO: 144849 - DNA, 14 bp, Homo sapiens
ctgcacaagctgca

SEQ ID NO: 144850 - DNA, 18 bp, Homo sapiens
ctgcacaagctgcaccct

SEQ ID NO: 144851 - DNA, 17 bp, Homo sapiens
ctgcacccccctgggct

SEQ ID NO: 144852 - DNA, 17 bp, Homo sapiens
ctgcaccctcaggcagg

SEQ ID NO: 144853 - DNA, 18 bp, Homo sapiens
ctgcacctccccccactg

SEQ ID NO: 144854 - DNA, 19 bp, Homo sapiens
ctgcacctccccccactgc

SEQ ID NO: 144855 - DNA, 21 bp, Homo sapiens
ctgcacctccccccactgcag

SEQ ID NO: 144856 - DNA, 13 bp, Homo sapiens
ctgcacctgtgca

SEQ ID NO: 144857 - DNA, 15 bp, Homo sapiens
ctgcactccagcctg

SEQ ID NO: 144858 - DNA, 16 bp, Homo sapiens
ggtcaggccacggcag

SEQ ID NO: 144859 - DNA, 14 bp, Homo sapiens
ggtccaccccatgt

SEQ ID NO: 144860 - DNA, 18 bp, Homo sapiens
ggtccagcttgctcttca

SEQ ID NO: 144861 - DNA, 17 bp, Homo sapiens
ggtccatgggcagagcc

SEQ ID NO: 144862 - DNA, 22 bp, Homo sapiens
ggtcccacgaatttgctgggga

SEQ ID NO: 144863 - DNA, 21 bp, Homo sapiens
ggtcccttcttactcacacac

SEQ ID NO: 144864 - DNA, 23 bp, Homo sapiens
ggtcctagaaattccccaccctg

SEQ ID NO: 144865 - DNA, 12 bp, Homo sapiens
ggtcctggggcc

SEQ ID NO: 144866 - DNA, 15 bp, Homo sapiens
ggtccttccctctcc

SEQ ID NO: 144867 - DNA, 19 bp, Homo sapiens
ggtccttccctctccccaa

SEQ ID NO: 144868 - DNA, 16 bp, Homo sapiens
ggtccttgcacccctc

SEQ ID NO: 144869 - DNA, 18 bp, Homo sapiens
ggtctcaggctggtggga

SEQ ID NO: 144870 - DNA, 15 bp, Homo sapiens
ggtctccctctcctg

SEQ ID NO: 144871 - DNA, 19 bp, Homo sapiens
ggtctccctctcctgccta

SEQ ID NO: 144872 - DNA, 20 bp, Homo sapiens
ggtctcgctttgttgcccag

SEQ ID NO: 144873 - DNA, 13 bp, Homo sapiens
ggtctgcaggcag

SEQ ID NO: 144874 - DNA, 23 bp, Homo sapiens
ggtctgcaggcagggctgactct

SEQ ID NO: 144875 - DNA, 16 bp, Homo sapiens
ggtctgctctttctct

SEQ ID NO: 144876 - DNA, 20 bp, Homo sapiens
ggtctgctctttctctgcca

SEQ ID NO: 144877 - DNA, 22 bp, Homo sapiens
ggtctggagaagcagtgagccg

SEQ ID NO: 144878 - DNA, 19 bp, Homo sapiens
ggtcttcagggggccaggt

SEQ ID NO: 144879 - DNA, 14 bp, Homo sapiens
ggtgaaggaatata

SEQ ID NO: 144880 - DNA, 14 bp, Homo sapiens
ggtgagatgctgga

SEQ ID NO: 144881 - DNA, 18 bp, Homo sapiens
ggtgagcagactggtggg

SEQ ID NO: 144882 - DNA, 19 bp, Homo sapiens
ggtgcagagtgcccagaac

SEQ ID NO: 144883 - DNA, 23 bp, Homo sapiens
ggtgccaaacaaaaaggttctca

SEQ ID NO: 144884 - DNA, 15 bp, Homo sapiens
ggtgccagttatggc

SEQ ID NO: 144885 - DNA, 22 bp, Homo sapiens
ggtgcccagctatacctgtgcc

SEQ ID NO: 144886 - DNA, 17 bp, Homo sapiens
ggtgcccttggaggcca

SEQ ID NO: 144887 - DNA, 18 bp, Homo sapiens
ggtgcccttggaggccag

SEQ ID NO: 144888 - DNA, 21 bp, Homo sapiens
ggtgcctgtgaggcaggggcg

SEQ ID NO: 144889 - DNA, 19 bp, Homo sapiens
ggtgctacaaaaacacagc

SEQ ID NO: 144890 - DNA, 23 bp, Homo sapiens
ggtgctacaaaaacacagcaagg

SEQ ID NO: 144891 - DNA, 23 bp, Homo sapiens
ggtgctacacccttttccagctg

SEQ ID NO: 144892 - DNA, 15 bp, Homo sapiens
ggtgctcagggctga

SEQ ID NO: 144893 - DNA, 13 bp, Homo sapiens
ggtggaagccctc

SEQ ID NO: 144894 - DNA, 18 bp, Homo sapiens
ggtggaagccctccttcc

SEQ ID NO: 144895 - DNA, 20 bp, Homo sapiens
ggtggaagccctccttccac

SEQ ID NO: 144896 - DNA, 14 bp, Homo sapiens
ggtggacccaggga

SEQ ID NO: 144897 - DNA, 17 bp, Homo sapiens
ggtggacttagaaagca

SEQ ID NO: 144898 - DNA, 20 bp, Homo sapiens
ggtggacttagaaagcaggg

SEQ ID NO: 144899 - DNA, 23 bp, Homo sapiens
ggtggagggccacatgggaggct

SEQ ID NO: 144900 - DNA, 20 bp, Homo sapiens
ggtggccactccagacccct

SEQ ID NO: 144901 - DNA, 21 bp, Homo sapiens
ggtggccactccagacccctg

SEQ ID NO: 144902 - DNA, 23 bp, Homo sapiens
ggtggccactccagacccctggc

SEQ ID NO: 144903 - DNA, 16 bp, Homo sapiens
ggtggcccgacagcct

SEQ ID NO: 144904 - DNA, 17 bp, Homo sapiens
ggtggcccgacagcctg

SEQ ID NO: 144905 - DNA, 21 bp, Homo sapiens
ggtggcgactctatagactct

SEQ ID NO: 144906 - DNA, 13 bp, Homo sapiens
ggtgggagcagga

SEQ ID NO: 144907 - DNA, 16 bp, Homo sapiens
ggtgggatggaggaga

SEQ ID NO: 144908 - DNA, 13 bp, Homo sapiens
ggtggggctgctc

SEQ ID NO: 144909 - DNA, 13 bp, Homo sapiens
ggtgggggcctcg

SEQ ID NO: 144910 - DNA, 14 bp, Homo sapiens
ggtgggtccatggg

SEQ ID NO: 144911 - DNA, 20 bp, Homo sapiens
ggtgggtccatgggcagagc

SEQ ID NO: 144912 - DNA, 20 bp, Homo sapiens
ggtggtgggaaccatgaaga

SEQ ID NO: 144913 - DNA, 21 bp, Homo sapiens
ggtggttatggagagggtgtc

SEQ ID NO: 144914 - DNA, 17 bp, Homo sapiens
ggtgtgcaccagggttg

SEQ ID NO: 144915 - DNA, 21 bp, Homo sapiens
ggtgtgcggcctttggcttca

SEQ ID NO: 144916 - DNA, 12 bp, Homo sapiens
ggtgtggagaag

SEQ ID NO: 144917 - DNA, 11 bp, Homo sapiens
ggtgtggggga

SEQ ID NO: 144918 - DNA, 13 bp, Homo sapiens
ggtgtgggggaag

SEQ ID NO: 144919 - DNA, 21 bp, Homo sapiens
ggttacccagttagctctcaa

SEQ ID NO: 144920 - DNA, 13 bp, Homo sapiens
ggttagggagggg

SEQ ID NO: 144921 - DNA, 15 bp, Homo sapiens
ggttagggaggggta

SEQ ID NO: 144922 - DNA, 12 bp, Homo sapiens
ggttcaccagcc

SEQ ID NO: 144923 - DNA, 15 bp, Homo sapiens
ggttcaccagcctct

SEQ ID NO: 144924 - DNA, 21 bp, Homo sapiens
ggttcacgcctgtaatcccag

SEQ ID NO: 144925 - DNA, 15 bp, Homo sapiens
ggttcactaaagcag

SEQ ID NO: 144926 - DNA, 16 bp, Homo sapiens
ggttcagagactcagg

SEQ ID NO: 144927 - DNA, 19 bp, Homo sapiens
ggttcagcccctcctctgc

SEQ ID NO: 144928 - DNA, 15 bp, Homo sapiens
ggttcccctgttcac

SEQ ID NO: 144929 - DNA, 21 bp, Homo sapiens
ggttccgcttggagcagaggg

SEQ ID NO: 144930 - DNA, 13 bp, Homo sapiens
ggttgaggtttca

SEQ ID NO: 144931 - DNA, 13 bp, Homo sapiens
ggtttaagctgtt

SEQ ID NO: 144932 - DNA, 23 bp, Homo sapiens
ggtttactctgtggccaaaggag

SEQ ID NO: 144933 - DNA, 18 bp, Homo sapiens
ggtttgcagatgacaaaa

SEQ ID NO: 144934 - DNA, 15 bp, Homo sapiens
ggtttggctgtgtct

SEQ ID NO: 144935 - DNA, 19 bp, Homo sapiens
ggtttgtgtttgagtttta

SEQ ID NO: 144936 - DNA, 16 bp, Homo sapiens
ggtttttaaaacccag

SEQ ID NO: 144937 - DNA, 13 bp, Homo sapiens
gtaaaaataaaat

SEQ ID NO: 144938 - DNA, 20 bp, Homo sapiens
gtaaaacaaaaatgtaatga

SEQ ID NO: 144939 - DNA, 14 bp, Homo sapiens
gtaaaaccacagca

SEQ ID NO: 144940 - DNA, 21 bp, Homo sapiens
gtaaaactacacatccctaat

SEQ ID NO: 144941 - DNA, 15 bp, Homo sapiens
gtaaaatatagctgt

SEQ ID NO: 144942 - DNA, 22 bp, Homo sapiens
gtaaacacgcctgcaaacgctg

SEQ ID NO: 144943 - DNA, 14 bp, Homo sapiens
gtaaacagtgcctg

SEQ ID NO: 144944 - DNA, 15 bp, Homo sapiens
gtaaacagtgcctgc

SEQ ID NO: 144945 - DNA, 23 bp, Homo sapiens
gtaaacataattcttgtatatta

SEQ ID NO: 144946 - DNA, 21 bp, Homo sapiens
gtaaactcaaaacttaacata

SEQ ID NO: 144947 - DNA, 16 bp, Homo sapiens
gtaaagtatgtaaaca

SEQ ID NO: 144948 - DNA, 17 bp, Homo sapiens
gtaaagtgataatttct

SEQ ID NO: 144949 - DNA, 23 bp, Homo sapiens
gtaaagtgataatttctggaatt

SEQ ID NO: 144950 - DNA, 19 bp, Homo sapiens
gtaaatatataaatatata

SEQ ID NO: 144951 - DNA, 20 bp, Homo sapiens
gtaaatatataaatatatat

SEQ ID NO: 144952 - DNA, 12 bp, Homo sapiens
gtaaatatttat

SEQ ID NO: 144953 - DNA, 17 bp, Homo sapiens
gtaaatgtttaggtttt

SEQ ID NO: 144954 - DNA, 17 bp, Homo sapiens
gtaacaatgaagataaa

SEQ ID NO: 144955 - DNA, 19 bp, Homo sapiens
gtaacaattttaatgctat

SEQ ID NO: 144956 - DNA, 22 bp, Homo sapiens
gtaacacagctgagagactttt

SEQ ID NO: 144957 - DNA, 16 bp, Homo sapiens
gtaacactttacaatg

SEQ ID NO: 144958 - DNA, 16 bp, Homo sapiens
gtaacaggtctcctct

SEQ ID NO: 144959 - DNA, 20 bp, Homo sapiens
gtaacaggtctcctcttaaa

SEQ ID NO: 144960 - DNA, 21 bp, Homo sapiens
gtaacaggtctcctcttaaaa

SEQ ID NO: 144961 - DNA, 23 bp, Homo sapiens
gtaacatgtgttaagtattttca

SEQ ID NO: 144962 - DNA, 17 bp, Homo sapiens
gtaacgcgtcttcctga

SEQ ID NO: 144963 - DNA, 12 bp, Homo sapiens
gtaactccacca

SEQ ID NO: 144964 - DNA, 17 bp, Homo sapiens
gtaagggaaactgccag

SEQ ID NO: 144965 - DNA, 18 bp, Homo sapiens
gtaagggaaactgccagc

SEQ ID NO: 144966 - DNA, 15 bp, Homo sapiens
gtaatagaaaactga

SEQ ID NO: 144967 - DNA, 19 bp, Homo sapiens
gtaatagaaaactgaaaat

SEQ ID NO: 144968 - DNA, 20 bp, Homo sapiens
gtaatcccagcactttggga

SEQ ID NO: 144969 - DNA, 13 bp, Homo sapiens
gtaatcccagcag

SEQ ID NO: 144970 - DNA, 17 bp, Homo sapiens
gtaatcccagctactca

SEQ ID NO: 144971 - DNA, 20 bp, Homo sapiens
gtaatcccagctacttggga

SEQ ID NO: 144972 - DNA, 21 bp, Homo sapiens
gtaattcctctcactaaactt

SEQ ID NO: 144973 - DNA, 23 bp, Homo sapiens
gtaattgcttacatttttacaat

SEQ ID NO: 144974 - DNA, 23 bp, Homo sapiens
gtacaaatataagaataaaatgt

SEQ ID NO: 144975 - DNA, 20 bp, Homo sapiens
gtacagaattctgctacctc

SEQ ID NO: 144976 - DNA, 18 bp, Homo sapiens
gtacagctgtttaagatg

SEQ ID NO: 144977 - DNA, 17 bp, Homo sapiens
gtacaggcagcacagag

SEQ ID NO: 144978 - DNA, 21 bp, Homo sapiens
gtacagttatttatgcctctg

SEQ ID NO: 144979 - DNA, 14 bp, Homo sapiens
gtaccaatcatttt

SEQ ID NO: 144980 - DNA, 14 bp, Homo sapiens
gtacctataaagta

SEQ ID NO: 144981 - DNA, 17 bp, Homo sapiens
gtacctgcccccaatcc

SEQ ID NO: 144982 - DNA, 14 bp, Homo sapiens
gtaccttgaacact

SEQ ID NO: 144983 - DNA, 13 bp, Homo sapiens
gtactattctgat

SEQ ID NO: 144984 - DNA, 16 bp, Homo sapiens
gtactgagccttgtaa

SEQ ID NO: 144985 - DNA, 19 bp, Homo sapiens
gtacttagcagctatctct

SEQ ID NO: 144986 - DNA, 22 bp, Homo sapiens
gtacttgccttattagagtgtc

SEQ ID NO: 144987 - DNA, 19 bp, Homo sapiens
gtagaaactgcagggaaaa

SEQ ID NO: 144988 - DNA, 13 bp, Homo sapiens
gtagaaggagaca

SEQ ID NO: 144989 - DNA, 15 bp, Homo sapiens
gtagaaggagacaga

SEQ ID NO: 144990 - DNA, 15 bp, Homo sapiens
gtagagatggaggag

SEQ ID NO: 144991 - DNA, 13 bp, Homo sapiens
gtagagtgggagc

SEQ ID NO: 144992 - DNA, 15 bp, Homo sapiens
gtagagtgtgcctga

SEQ ID NO: 144993 - DNA, 17 bp, Homo sapiens
gtagcaggtaccactga

SEQ ID NO: 144994 - DNA, 17 bp, Homo sapiens
gtagccctggccagagg

SEQ ID NO: 144995 - DNA, 17 bp, Homo sapiens
gtagctttcccaaataa

SEQ ID NO: 144996 - DNA, 15 bp, Homo sapiens
gtaggaagtaggaag

SEQ ID NO: 144997 - DNA, 11 bp, Homo sapiens
gtaggcagaca

SEQ ID NO: 144998 - DNA, 13 bp, Homo sapiens
gtaggcagacaca

SEQ ID NO: 144999 - DNA, 17 bp, Homo sapiens
gtagggtaaggtgcctt

SEQ ID NO: 145000 - DNA, 17 bp, Homo sapiens
gtagtagccctttctgt

SEQ ID NO: 145001 - DNA, 20 bp, Homo sapiens
gtagtagccctttctgtgtg

SEQ ID NO: 145002 - DNA, 11 bp, Homo sapiens
gtagttaggaa

SEQ ID NO: 145003 - DNA, 13 bp, Homo sapiens
gtagttaggaaat

SEQ ID NO: 145004 - DNA, 17 bp, Homo sapiens
gtagttccctgaaaacc

SEQ ID NO: 145005 - DNA, 23 bp, Homo sapiens
gtagttccctgaaaacccagaga

SEQ ID NO: 145006 - DNA, 18 bp, Homo sapiens
gtataaaactttcctcgc

SEQ ID NO: 145007 - DNA, 20 bp, Homo sapiens
gtataacttcttaaaagttg

SEQ ID NO: 145008 - DNA, 15 bp, Homo sapiens
gtataagtaagaaaa

SEQ ID NO: 145009 - DNA, 16 bp, Homo sapiens
gtataagtaagaaaat

SEQ ID NO: 145010 - DNA, 16 bp, Homo sapiens
gtatagtgtaaaataa

SEQ ID NO: 145011 - DNA, 14 bp, Homo sapiens
gtatatcagaaaag

SEQ ID NO: 145012 - DNA, 21 bp, Homo sapiens
gtatatgtctcaggtccctgc

SEQ ID NO: 145013 - DNA, 16 bp, Homo sapiens
gtatatgttgggtgca

SEQ ID NO: 145014 - DNA, 15 bp, Homo sapiens
gtatattcatatatt

SEQ ID NO: 145015 - DNA, 16 bp, Homo sapiens
gtatattcatttcaaa

SEQ ID NO: 145016 - DNA, 17 bp, Homo sapiens
gtatatttaaaagaaag

SEQ ID NO: 145017 - DNA, 16 bp, Homo sapiens
gtatattttatatcaa

SEQ ID NO: 145018 - DNA, 18 bp, Homo sapiens
gtatcaggacccagagga

SEQ ID NO: 145019 - DNA, 15 bp, Homo sapiens
gtatcaggtctccca

SEQ ID NO: 145020 - DNA, 18 bp, Homo sapiens
gtatccatgggggcaggg

SEQ ID NO: 145021 - DNA, 19 bp, Homo sapiens
gtatctgcaggcagacacg

SEQ ID NO: 145022 - DNA, 14 bp, Homo sapiens
gtatctgggaactg

SEQ ID NO: 145023 - DNA, 22 bp, Homo sapiens
gtatgaaagatggctgtgcctc

SEQ ID NO: 145024 - DNA, 19 bp, Homo sapiens
gtatgaataaagacaccta

SEQ ID NO: 145025 - DNA, 17 bp, Homo sapiens
gtatggaatacagtgtt

SEQ ID NO: 145026 - DNA, 12 bp, Homo sapiens
gtatgtaaatgt

SEQ ID NO: 145027 - DNA, 14 bp, Homo sapiens
gtatgtaaatgtgc

SEQ ID NO: 145028 - DNA, 15 bp, Homo sapiens
gtatgtaaatgtgca

SEQ ID NO: 145029 - DNA, 16 bp, Homo sapiens
gtatgttgtcaaagag

SEQ ID NO: 145030 - DNA, 17 bp, Homo sapiens
gtatgttgtcaaagaga

SEQ ID NO: 145031 - DNA, 18 bp, Homo sapiens
gtattaagaaaatctatt

SEQ ID NO: 145032 - DNA, 13 bp, Homo sapiens
gtattgcacattg

SEQ ID NO: 145033 - DNA, 16 bp, Homo sapiens
gtattgcacattgtaa

SEQ ID NO: 145034 - DNA, 23 bp, Homo sapiens
gtattgcatctgtataagtaaga

SEQ ID NO: 145035 - DNA, 13 bp, Homo sapiens
gtatttcaaattg

SEQ ID NO: 145036 - DNA, 17 bp, Homo sapiens
gtattttggagaaatta

SEQ ID NO: 145037 - DNA, 17 bp, Homo sapiens
gtcaaacaaagccagaa

SEQ ID NO: 145038 - DNA, 15 bp, Homo sapiens
gtcaaacatgaagtg

SEQ ID NO: 145039 - DNA, 14 bp, Homo sapiens
gtcaaacgtgaaaa

SEQ ID NO: 145040 - DNA, 21 bp, Homo sapiens
gtcaacaagtatgaataaaga

SEQ ID NO: 145041 - DNA, 22 bp, Homo sapiens
gtcaacagagaaggcaggaatg

SEQ ID NO: 145042 - DNA, 14 bp, Homo sapiens
gtcaagtctctgct

SEQ ID NO: 145043 - DNA, 21 bp, Homo sapiens
gtcaagtctctgctggcccag

SEQ ID NO: 145044 - DNA, 15 bp, Homo sapiens
gtcaagtgaaaaagg

SEQ ID NO: 145045 - DNA, 19 bp, Homo sapiens
gtcaagtgaaaaaggagga

SEQ ID NO: 145046 - DNA, 19 bp, Homo sapiens
gtcaatacagtacaggcag

SEQ ID NO: 145047 - DNA, 20 bp, Homo sapiens
gtcaatacagtacaggcagc

SEQ ID NO: 145048 - DNA, 16 bp, Homo sapiens
gtcaatcccctcattc

SEQ ID NO: 145049 - DNA, 22 bp, Homo sapiens
gtcaatcccctcattcaggaaa

SEQ ID NO: 145050 - DNA, 15 bp, Homo sapiens
gtcaatgcagccccc

SEQ ID NO: 145051 - DNA, 17 bp, Homo sapiens
gtcacaggactctgcct

SEQ ID NO: 145052 - DNA, 13 bp, Homo sapiens
gtcacagggccaa

SEQ ID NO: 145053 - DNA, 15 bp, Homo sapiens
gtcacagggccaact

SEQ ID NO: 145054 - DNA, 11 bp, Homo sapiens
gtcaccacctt

SEQ ID NO: 145055 - DNA, 14 bp, Homo sapiens
gtcaccaccttccc

SEQ ID NO: 145056 - DNA, 15 bp, Homo sapiens
gtcaccaccttccca

SEQ ID NO: 145057 - DNA, 19 bp, Homo sapiens
gtcaccaccttcccagctc

SEQ ID NO: 145058 - DNA, 16 bp, Homo sapiens
gtcaccctccacctct

SEQ ID NO: 145059 - DNA, 17 bp, Homo sapiens
gtcaccggatcctgggt

SEQ ID NO: 145060 - DNA, 23 bp, Homo sapiens
gtcaccggatcctgggtggtctg

SEQ ID NO: 145061 - DNA, 23 bp, Homo sapiens
gtcactgcacagtgcatctcagc

SEQ ID NO: 145062 - DNA, 20 bp, Homo sapiens
gtcactgccatggaggcaca

SEQ ID NO: 145063 - DNA, 12 bp, Homo sapiens
gtcactgcctct

SEQ ID NO: 145064 - DNA, 20 bp, Homo sapiens
gtcactgcctctccctggcc

SEQ ID NO: 145065 - DNA, 23 bp, Homo sapiens
gtcactgcctctccctggccctc

SEQ ID NO: 145066 - DNA, 20 bp, Homo sapiens
gtcagaataataagaggtgc

SEQ ID NO: 145067 - DNA, 13 bp, Homo sapiens
gtcagcaggaagc

SEQ ID NO: 145068 - DNA, 13 bp, Homo sapiens
gtcagccctaggg

SEQ ID NO: 145069 - DNA, 21 bp, Homo sapiens
gtcagctcccctcggagaaga

SEQ ID NO: 145070 - DNA, 22 bp, Homo sapiens
gtcagctcccctcggagaagag

SEQ ID NO: 145071 - DNA, 16 bp, Homo sapiens
gtcagcttgctgccct

SEQ ID NO: 145072 - DNA, 12 bp, Homo sapiens
gtcaggccacgg

SEQ ID NO: 145073 - DNA, 13 bp, Homo sapiens
gtcaggcctgtgt

SEQ ID NO: 145074 - DNA, 13 bp, Homo sapiens
cagcctctgaccc

SEQ ID NO: 145075 - DNA, 15 bp, Homo sapiens
cagcctctgacccct

SEQ ID NO: 145076 - DNA, 23 bp, Homo sapiens
cagcctctgacccctcctcactg

SEQ ID NO: 145077 - DNA, 18 bp, Homo sapiens
cagcctcttggccccaga

SEQ ID NO: 145078 - DNA, 17 bp, Homo sapiens
cagcctctttctgtccc

SEQ ID NO: 145079 - DNA, 19 bp, Homo sapiens
cagcctgctccagctgttc

SEQ ID NO: 145080 - DNA, 20 bp, Homo sapiens
cagcctgctccagctgttca

SEQ ID NO: 145081 - DNA, 13 bp, Homo sapiens
cagcctggcacag

SEQ ID NO: 145082 - DNA, 20 bp, Homo sapiens
cagcctggcacagggcagtg

SEQ ID NO: 145083 - DNA, 20 bp, Homo sapiens
cagcctggtcaacatggtga

SEQ ID NO: 145084 - DNA, 15 bp, Homo sapiens
cagcctggtgggcct

SEQ ID NO: 145085 - DNA, 15 bp, Homo sapiens
cagcctgtctcttcc

SEQ ID NO: 145086 - DNA, 20 bp, Homo sapiens
cagcctgtggcggtgcctgg

SEQ ID NO: 145087 - DNA, 23 bp, Homo sapiens
cagccttccccttgcccagggct

SEQ ID NO: 145088 - DNA, 16 bp, Homo sapiens
cagccttcttccatcc

SEQ ID NO: 145089 - DNA, 23 bp, Homo sapiens
cagccttcttccatcccaggaca

SEQ ID NO: 145090 - DNA, 21 bp, Homo sapiens
cagccttggataatgctgttg

SEQ ID NO: 145091 - DNA, 22 bp, Homo sapiens
cagcctttgatcaggtggggag

SEQ ID NO: 145092 - DNA, 23 bp, Homo sapiens
cagcctttgatcaggtggggagt

SEQ ID NO: 145093 - DNA, 20 bp, Homo sapiens
cagcgacatagcccatccct

SEQ ID NO: 145094 - DNA, 14 bp, Homo sapiens
cagcggcccctgca

SEQ ID NO: 145095 - DNA, 18 bp, Homo sapiens
cagcggggccccagggct

SEQ ID NO: 145096 - DNA, 15 bp, Homo sapiens
cagcgtcctcctctg

SEQ ID NO: 145097 - DNA, 16 bp, Homo sapiens
cagcgtcctcctctgt

SEQ ID NO: 145098 - DNA, 18 bp, Homo sapiens
cagcgtcctcctctgtga

SEQ ID NO: 145099 - DNA, 19 bp, Homo sapiens
cagctaaagcaatatgcat

SEQ ID NO: 145100 - DNA, 16 bp, Homo sapiens
cagctactcaggaggc

SEQ ID NO: 145101 - DNA, 15 bp, Homo sapiens
cagctacttgggagg

SEQ ID NO: 145102 - DNA, 16 bp, Homo sapiens
cagctacttgggaggc

SEQ ID NO: 145103 - DNA, 15 bp, Homo sapiens
cagctatacctgtgc

SEQ ID NO: 145104 - DNA, 19 bp, Homo sapiens
cagctatacctgtgcctcg

SEQ ID NO: 145105 - DNA, 21 bp, Homo sapiens
cagctatgttatattgaaaaa

SEQ ID NO: 145106 - DNA, 15 bp, Homo sapiens
cagctcaaaggcaca

SEQ ID NO: 145107 - DNA, 19 bp, Homo sapiens
cagctcaaggaaaggcctg

SEQ ID NO: 145108 - DNA, 17 bp, Homo sapiens
cagctcagcgccagcct

SEQ ID NO: 145109 - DNA, 15 bp, Homo sapiens
cagctcccaccccac

SEQ ID NO: 145110 - DNA, 19 bp, Homo sapiens
cagctcccaccccaccccc

SEQ ID NO: 145111 - DNA, 23 bp, Homo sapiens
cagctcccaccccacccccttca

SEQ ID NO: 145112 - DNA, 18 bp, Homo sapiens
cagctcccctcggagaag

SEQ ID NO: 145113 - DNA, 20 bp, Homo sapiens
cagctcccctcggagaagag

SEQ ID NO: 145114 - DNA, 22 bp, Homo sapiens
cagctcccctcggagaagagct

SEQ ID NO: 145115 - DNA, 16 bp, Homo sapiens
cagctccttcctggag

SEQ ID NO: 145116 - DNA, 18 bp, Homo sapiens
cagctctccctctggccc

SEQ ID NO: 145117 - DNA, 23 bp, Homo sapiens
cagctctccctctggccctgcct

SEQ ID NO: 145118 - DNA, 17 bp, Homo sapiens
cagctgagagaaaataa

SEQ ID NO: 145119 - DNA, 19 bp, Homo sapiens
cagctgagggtgagtgggt

SEQ ID NO: 145120 - DNA, 13 bp, Homo sapiens
cagctgctcccct

SEQ ID NO: 145121 - DNA, 16 bp, Homo sapiens
cagctgctcccctccc

SEQ ID NO: 145122 - DNA, 20 bp, Homo sapiens
cagctgctcccctccctcct

SEQ ID NO: 145123 - DNA, 14 bp, Homo sapiens
cagctgtccctgtc

SEQ ID NO: 145124 - DNA, 16 bp, Homo sapiens
cagctgtccctgtcac

SEQ ID NO: 145125 - DNA, 18 bp, Homo sapiens
cagctgtccctgtcacca

SEQ ID NO: 145126 - DNA, 16 bp, Homo sapiens
cagctgtgagccttgg

SEQ ID NO: 145127 - DNA, 17 bp, Homo sapiens
cagctgtgagccttggc

SEQ ID NO: 145128 - DNA, 22 bp, Homo sapiens
cagctgttagagtccaacgtgg

SEQ ID NO: 145129 - DNA, 19 bp, Homo sapiens
cagctgttcagctggttga

SEQ ID NO: 145130 - DNA, 18 bp, Homo sapiens
cagcttcccctctctcct

SEQ ID NO: 145131 - DNA, 22 bp, Homo sapiens
cagcttcttaatataactgcct

SEQ ID NO: 145132 - DNA, 18 bp, Homo sapiens
cagcttgaaactgagatg

SEQ ID NO: 145133 - DNA, 15 bp, Homo sapiens
cagcttgctcttcag

SEQ ID NO: 145134 - DNA, 23 bp, Homo sapiens
cagcttgctcttcagtgggagaa

SEQ ID NO: 145135 - DNA, 17 bp, Homo sapiens
cagctttaaactcaggg

SEQ ID NO: 145136 - DNA, 19 bp, Homo sapiens
cagctttaaactcagggac

SEQ ID NO: 145137 - DNA, 19 bp, Homo sapiens
cagctttacatgcaattta

SEQ ID NO: 145138 - DNA, 17 bp, Homo sapiens
cagctttttaccaagtt

SEQ ID NO: 145139 - DNA, 19 bp, Homo sapiens
cagctttttgtcttttctg

SEQ ID NO: 145140 - DNA, 15 bp, Homo sapiens
caggaaaggaatcat

SEQ ID NO: 145141 - DNA, 19 bp, Homo sapiens
caggaaaggaatcatttct

SEQ ID NO: 145142 - DNA, 20 bp, Homo sapiens
caggaaatgaaaatgtcttg

SEQ ID NO: 145143 - DNA, 20 bp, Homo sapiens
caggaagcattcagagagca

SEQ ID NO: 145144 - DNA, 21 bp, Homo sapiens
caggaagccgtgccctgcccc

SEQ ID NO: 145145 - DNA, 17 bp, Homo sapiens
caggaagctcagactgg

SEQ ID NO: 145146 - DNA, 19 bp, Homo sapiens
caggacaacgaggaagccc

SEQ ID NO: 145147 - DNA, 14 bp, Homo sapiens
caggacaccacacc

SEQ ID NO: 145148 - DNA, 16 bp, Homo sapiens
caggacccagaggaag

SEQ ID NO: 145149 - DNA, 20 bp, Homo sapiens
caggactctgcccagaccac

SEQ ID NO: 145150 - DNA, 13 bp, Homo sapiens
caggactctgcct

SEQ ID NO: 145151 - DNA, 18 bp, Homo sapiens
caggactgaattgtcccc

SEQ ID NO: 145152 - DNA, 20 bp, Homo sapiens
caggactgaattgtccccag

SEQ ID NO: 145153 - DNA, 21 bp, Homo sapiens
caggactgaattgtccccagt

SEQ ID NO: 145154 - DNA, 18 bp, Homo sapiens
caggactgagccccgcag

SEQ ID NO: 145155 - DNA, 19 bp, Homo sapiens
caggagaaggccaattcct

SEQ ID NO: 145156 - DNA, 21 bp, Homo sapiens
caggagaaggccaattcctat

SEQ ID NO: 145157 - DNA, 12 bp, Homo sapiens
caggagagagaa

SEQ ID NO: 145158 - DNA, 18 bp, Homo sapiens
caggagagagaaagccag

SEQ ID NO: 145159 - DNA, 20 bp, Homo sapiens
caggagagagaaagccaggc

SEQ ID NO: 145160 - DNA, 23 bp, Homo sapiens
caggagagagaaagccaggcagg

SEQ ID NO: 145161 - DNA, 23 bp, Homo sapiens
caggagagccagccctccctgtc

SEQ ID NO: 145162 - DNA, 15 bp, Homo sapiens
caggagaggggcaga

SEQ ID NO: 145163 - DNA, 20 bp, Homo sapiens
caggagatggaagttgcagt

SEQ ID NO: 145164 - DNA, 19 bp, Homo sapiens
caggagattgagaaggaga

SEQ ID NO: 145165 - DNA, 21 bp, Homo sapiens
caggagattgagaaggagaga

SEQ ID NO: 145166 - DNA, 21 bp, Homo sapiens
caggaggactgccccgtgcag

SEQ ID NO: 145167 - DNA, 18 bp, Homo sapiens
caggaggccaggccggcg

SEQ ID NO: 145168 - DNA, 15 bp, Homo sapiens
caggaggctgaggca

SEQ ID NO: 145169 - DNA, 15 bp, Homo sapiens
caggaggtggaggtt

SEQ ID NO: 145170 - DNA, 15 bp, Homo sapiens
caggagtccctggta

SEQ ID NO: 145171 - DNA, 16 bp, Homo sapiens
caggagttagaggcca

SEQ ID NO: 145172 - DNA, 19 bp, Homo sapiens
caggagttagaggccagcc

SEQ ID NO: 145173 - DNA, 20 bp, Homo sapiens
caggagttagaggccagcct

SEQ ID NO: 145174 - DNA, 21 bp, Homo sapiens
caggagttagaggccagcctg

SEQ ID NO: 145175 - DNA, 16 bp, Homo sapiens
caggagttggaagtgt

SEQ ID NO: 145176 - DNA, 14 bp, Homo sapiens
caggatgcccaggg

SEQ ID NO: 145177 - DNA, 23 bp, Homo sapiens
caggatggccgggcgcggtggct

SEQ ID NO: 145178 - DNA, 16 bp, Homo sapiens
caggattttaatcttt

SEQ ID NO: 145179 - DNA, 20 bp, Homo sapiens
caggcacgaacccacctgct

SEQ ID NO: 145180 - DNA, 16 bp, Homo sapiens
caggcactagcctttg

SEQ ID NO: 145181 - DNA, 12 bp, Homo sapiens
caggcagcgatg

SEQ ID NO: 145182 - DNA, 23 bp, Homo sapiens
caggcagggctgactctaggtgc

SEQ ID NO: 145183 - DNA, 12 bp, Homo sapiens
caggcatcctcc

SEQ ID NO: 145184 - DNA, 15 bp, Homo sapiens
caggccacttgatga

SEQ ID NO: 145185 - DNA, 16 bp, Homo sapiens
caggccagtaagggaa

SEQ ID NO: 145186 - DNA, 15 bp, Homo sapiens
caggccccaggaagc

SEQ ID NO: 145187 - DNA, 15 bp, Homo sapiens
caggcccccaagcct

SEQ ID NO: 145188 - DNA, 17 bp, Homo sapiens
caggcccccaagcctgc

SEQ ID NO: 145189 - DNA, 19 bp, Homo sapiens
caggcccccaagcctgcag

SEQ ID NO: 145190 - DNA, 20 bp, Homo sapiens
caggcccccaggtgccagtt

SEQ ID NO: 145191 - DNA, 17 bp, Homo sapiens
caggccccgcttgtcca

SEQ ID NO: 145192 - DNA, 23 bp, Homo sapiens
caggccccgcttgtccagcgcct

SEQ ID NO: 145193 - DNA, 14 bp, Homo sapiens
caggcccggggctg

SEQ ID NO: 145194 - DNA, 16 bp, Homo sapiens
caggcccggggctggc

SEQ ID NO: 145195 - DNA, 17 bp, Homo sapiens
caggcccttcctctcca

SEQ ID NO: 145196 - DNA, 20 bp, Homo sapiens
caggcccttcctctccactg

SEQ ID NO: 145197 - DNA, 23 bp, Homo sapiens
caggcccttcctctccactgcct

SEQ ID NO: 145198 - DNA, 14 bp, Homo sapiens
caggccgccccagc

SEQ ID NO: 145199 - DNA, 19 bp, Homo sapiens
caggccgtggctgcccaca

SEQ ID NO: 145200 - DNA, 13 bp, Homo sapiens
caggcctctgtgt

SEQ ID NO: 145201 - DNA, 22 bp, Homo sapiens
caggcctctgtgtccttccctg

SEQ ID NO: 145202 - DNA, 20 bp, Homo sapiens
caggcctgaaagaggctgag

SEQ ID NO: 145203 - DNA, 23 bp, Homo sapiens
caggcctgaaagaggctgaggcc

SEQ ID NO: 145204 - DNA, 14 bp, Homo sapiens
caggcctgccagac

SEQ ID NO: 145205 - DNA, 20 bp, Homo sapiens
caggcctgcctgttcccatt

SEQ ID NO: 145206 - DNA, 15 bp, Homo sapiens
caggcgccccttccc

SEQ ID NO: 145207 - DNA, 15 bp, Homo sapiens
caggctactctcctc

SEQ ID NO: 145208 - DNA, 16 bp, Homo sapiens
caggctactctcctcg

SEQ ID NO: 145209 - DNA, 18 bp, Homo sapiens
caggctactctcctcggc

SEQ ID NO: 145210 - DNA, 15 bp, Homo sapiens
ctccagacccctggc

SEQ ID NO: 145211 - DNA, 18 bp, Homo sapiens
ctccagacccctggcttt

SEQ ID NO: 145212 - DNA, 19 bp, Homo sapiens
ctccagacccctggctttt

SEQ ID NO: 145213 - DNA, 23 bp, Homo sapiens
ctccagccccttctcagaatcta

SEQ ID NO: 145214 - DNA, 23 bp, Homo sapiens
ctccagggccacgtgccaggccc

SEQ ID NO: 145215 - DNA, 16 bp, Homo sapiens
ctccaggtctcacggg

SEQ ID NO: 145216 - DNA, 18 bp, Homo sapiens
ctccaggtctcacgggca

SEQ ID NO: 145217 - DNA, 18 bp, Homo sapiens
ctccagtgccagcaatga

SEQ ID NO: 145218 - DNA, 13 bp, Homo sapiens
ctccatgctgcct

SEQ ID NO: 145219 - DNA, 14 bp, Homo sapiens
ctccatgctgcctc

SEQ ID NO: 145220 - DNA, 17 bp, Homo sapiens
ctcccaagtctacagag

SEQ ID NO: 145221 - DNA, 20 bp, Homo sapiens
ctcccacaggcccttcctct

SEQ ID NO: 145222 - DNA, 12 bp, Homo sapiens
ctcccaccccac

SEQ ID NO: 145223 - DNA, 13 bp, Homo sapiens
ctcccaccccacc

SEQ ID NO: 145224 - DNA, 19 bp, Homo sapiens
ctcccaccccacccccttc

SEQ ID NO: 145225 - DNA, 15 bp, Homo sapiens
ctcccacccccatct

SEQ ID NO: 145226 - DNA, 13 bp, Homo sapiens
ctcccacctctgt

SEQ ID NO: 145227 - DNA, 17 bp, Homo sapiens
ctcccacctctgtgacc

SEQ ID NO: 145228 - DNA, 18 bp, Homo sapiens
ctcccacctctgtgacct

SEQ ID NO: 145229 - DNA, 20 bp, Homo sapiens
ctcccacctctgtgacctca

SEQ ID NO: 145230 - DNA, 16 bp, Homo sapiens
ctcccagaacacactc

SEQ ID NO: 145231 - DNA, 22 bp, Homo sapiens
ctcccaggccagtaagggaaat

SEQ ID NO: 145232 - DNA, 14 bp, Homo sapiens
ctcccaggcgcccc

SEQ ID NO: 145233 - DNA, 13 bp, Homo sapiens
ctcccatcccctg

SEQ ID NO: 145234 - DNA, 23 bp, Homo sapiens
ctcccatcccctggactgggagg

SEQ ID NO: 145235 - DNA, 15 bp, Homo sapiens
ctccccagcccctag

SEQ ID NO: 145236 - DNA, 21 bp, Homo sapiens
ctccccagcccctagcccagg

SEQ ID NO: 145237 - DNA, 15 bp, Homo sapiens
ctccccagccctggc

SEQ ID NO: 145238 - DNA, 21 bp, Homo sapiens
ctccccaggccgtggctgccc

SEQ ID NO: 145239 - DNA, 15 bp, Homo sapiens
ctccccatcccatgt

SEQ ID NO: 145240 - DNA, 15 bp, Homo sapiens
ctcccccgccactcc

SEQ ID NO: 145241 - DNA, 16 bp, Homo sapiens
ctccccctgccagtgc

SEQ ID NO: 145242 - DNA, 18 bp, Homo sapiens
ctccccctgccagtgcct

SEQ ID NO: 145243 - DNA, 17 bp, Homo sapiens
ctcccctatccacccag

SEQ ID NO: 145244 - DNA, 13 bp, Homo sapiens
ctcccctcacagc

SEQ ID NO: 145245 - DNA, 20 bp, Homo sapiens
ctcccctcacagcctctgac

SEQ ID NO: 145246 - DNA, 13 bp, Homo sapiens
ctcccctcccctg

SEQ ID NO: 145247 - DNA, 15 bp, Homo sapiens
ctcccctcccctgct

SEQ ID NO: 145248 - DNA, 16 bp, Homo sapiens
ctcccctcccctgctg

SEQ ID NO: 145249 - DNA, 18 bp, Homo sapiens
ctcccctcccctgctgca

SEQ ID NO: 145250 - DNA, 14 bp, Homo sapiens
ctcccctccctcct

SEQ ID NO: 145251 - DNA, 21 bp, Homo sapiens
ctcccctgcactggagtccag

SEQ ID NO: 145252 - DNA, 14 bp, Homo sapiens
ctcccctgccattt

SEQ ID NO: 145253 - DNA, 16 bp, Homo sapiens
ctcccctgctgaaggt

SEQ ID NO: 145254 - DNA, 21 bp, Homo sapiens
ctcccggtgcccaagaataga

SEQ ID NO: 145255 - DNA, 15 bp, Homo sapiens
ctccctaccacctcc

SEQ ID NO: 145256 - DNA, 15 bp, Homo sapiens
ctccctcaaagcaca

SEQ ID NO: 145257 - DNA, 13 bp, Homo sapiens
ctccctcattcca

SEQ ID NO: 145258 - DNA, 22 bp, Homo sapiens
ctccctctgcctgaaccttcca

SEQ ID NO: 145259 - DNA, 15 bp, Homo sapiens
ctccctctggccctg

SEQ ID NO: 145260 - DNA, 17 bp, Homo sapiens
ctccctctggccctgcc

SEQ ID NO: 145261 - DNA, 18 bp, Homo sapiens
ctccctctggccctgcct

SEQ ID NO: 145262 - DNA, 14 bp, Homo sapiens
ctccctgaagccag

SEQ ID NO: 145263 - DNA, 16 bp, Homo sapiens
ctccctgtcctcctcg

SEQ ID NO: 145264 - DNA, 18 bp, Homo sapiens
ctccctgtcctcctcgga

SEQ ID NO: 145265 - DNA, 19 bp, Homo sapiens
ctccctgttgaagctctgg

SEQ ID NO: 145266 - DNA, 15 bp, Homo sapiens
ctccgcagttcctgt

SEQ ID NO: 145267 - DNA, 23 bp, Homo sapiens
ctccgccaggcgagatggggtgg

SEQ ID NO: 145268 - DNA, 18 bp, Homo sapiens
tcccctatccacccagcc

SEQ ID NO: 145269 - DNA, 21 bp, Homo sapiens
tcccctatccacccagcccat

SEQ ID NO: 145270 - DNA, 19 bp, Homo sapiens
tcccctatggggatggtcc

SEQ ID NO: 145271 - DNA, 12 bp, Homo sapiens
tcccctccactg

SEQ ID NO: 145272 - DNA, 16 bp, Homo sapiens
tcccctcccctgctgc

SEQ ID NO: 145273 - DNA, 17 bp, Homo sapiens
tcccctcccctgctgca

SEQ ID NO: 145274 - DNA, 14 bp, Homo sapiens
tcccctccctcctc

SEQ ID NO: 145275 - DNA, 22 bp, Homo sapiens
tcctttctaacaaaaaaatata

SEQ ID NO: 145276 - DNA, 11 bp, Homo sapiens
tcctttctatc

SEQ ID NO: 145277 - DNA, 15 bp, Homo sapiens
tcctttctttctaac

SEQ ID NO: 145278 - DNA, 15 bp, Homo sapiens
tcctttgcaggctca

SEQ ID NO: 145279 - DNA, 19 bp, Homo sapiens
tccttttaaaacacttcca

SEQ ID NO: 145280 - DNA, 17 bp, Homo sapiens
tcgaccaattcaaccct

SEQ ID NO: 145281 - DNA, 13 bp, Homo sapiens
tcgcaagctgggt

SEQ ID NO: 145282 - DNA, 21 bp, Homo sapiens
tcgcaccactgtgtatttaac

SEQ ID NO: 145283 - DNA, 11 bp, Homo sapiens
tcgcctgacaa

SEQ ID NO: 145284 - DNA, 20 bp, Homo sapiens
tcgctggactctcagtctct

SEQ ID NO: 145285 - DNA, 16 bp, Homo sapiens
tcgctgtggttgtttt

SEQ ID NO: 145286 - DNA, 19 bp, Homo sapiens
tcgcttcccccatagccac

SEQ ID NO: 145287 - DNA, 14 bp, Homo sapiens
tcggagaagagctg

SEQ ID NO: 145288 - DNA, 22 bp, Homo sapiens
tcggagcctcatccgaggcagg

SEQ ID NO: 145289 - DNA, 16 bp, Homo sapiens
tcgggacacctgccct

SEQ ID NO: 145290 - DNA, 17 bp, Homo sapiens
tcgggaggtcgaggcag

SEQ ID NO: 145291 - DNA, 19 bp, Homo sapiens
tcgggaggtcgaggcagga

SEQ ID NO: 145292 - DNA, 21 bp, Homo sapiens
tcgggaggtcgaggcaggagg

SEQ ID NO: 145293 - DNA, 22 bp, Homo sapiens
tcgggttttattgtttaaaatc

SEQ ID NO: 145294 - DNA, 23 bp, Homo sapiens
tcggttccacgtccccctggggc

SEQ ID NO: 145295 - DNA, 22 bp, Homo sapiens
tcgtagctttcccaaataaact

SEQ ID NO: 145296 - DNA, 13 bp, Homo sapiens
tcgtcctccccct

SEQ ID NO: 145297 - DNA, 16 bp, Homo sapiens
tcgtcctccccctgcc

SEQ ID NO: 145298 - DNA, 21 bp, Homo sapiens
tcgtctccagccccttctcag

SEQ ID NO: 145299 - DNA, 22 bp, Homo sapiens
tcgtggtccccaacagcgacat

SEQ ID NO: 145300 - DNA, 21 bp, Homo sapiens
tctaaaatgcctcagtgtatt

SEQ ID NO: 145301 - DNA, 14 bp, Homo sapiens
tctaaacattaatc

SEQ ID NO: 145302 - DNA, 17 bp, Homo sapiens
tctaaatttgaatgtta

SEQ ID NO: 145303 - DNA, 22 bp, Homo sapiens
tctaaatttgaatgttaagcag

SEQ ID NO: 145304 - DNA, 23 bp, Homo sapiens
tctaaatttgaatgttaagcaga

SEQ ID NO: 145305 - DNA, 21 bp, Homo sapiens
tctaagatagtaacaatgaag

SEQ ID NO: 145306 - DNA, 19 bp, Homo sapiens
tctaagtaaaaccacagca

SEQ ID NO: 145307 - DNA, 20 bp, Homo sapiens
tctaagtaaaaccacagcag

SEQ ID NO: 145308 - DNA, 13 bp, Homo sapiens
tctaagtgatata

SEQ ID NO: 145309 - DNA, 22 bp, Homo sapiens
tctaatagaactcagttttaac

SEQ ID NO: 145310 - DNA, 20 bp, Homo sapiens
tctaatgggtatttaaacaa

SEQ ID NO: 145311 - DNA, 14 bp, Homo sapiens
tctaatgtgtgaat

SEQ ID NO: 145312 - DNA, 17 bp, Homo sapiens
tctacagagcttccctg

SEQ ID NO: 145313 - DNA, 19 bp, Homo sapiens
tctacagagcttccctgac

SEQ ID NO: 145314 - DNA, 17 bp, Homo sapiens
tctacataagtaattca

SEQ ID NO: 145315 - DNA, 20 bp, Homo sapiens
tctacataagtaattcaaga

SEQ ID NO: 145316 - DNA, 16 bp, Homo sapiens
tctacatactatggaa

SEQ ID NO: 145317 - DNA, 15 bp, Homo sapiens
tctacatattcttta

SEQ ID NO: 145318 - DNA, 13 bp, Homo sapiens
tctaccagactgt

SEQ ID NO: 145319 - DNA, 13 bp, Homo sapiens
tctacccaaagga

SEQ ID NO: 145320 - DNA, 13 bp, Homo sapiens
tctacccagggcc

SEQ ID NO: 145321 - DNA, 15 bp, Homo sapiens
tctacccatattaca

SEQ ID NO: 145322 - DNA, 21 bp, Homo sapiens
tctaccctcttagaaaaacca

SEQ ID NO: 145323 - DNA, 13 bp, Homo sapiens
tctagactttctg

SEQ ID NO: 145324 - DNA, 15 bp, Homo sapiens
tctagactttctgtt

SEQ ID NO: 145325 - DNA, 15 bp, Homo sapiens
tctagagcagggatt

SEQ ID NO: 145326 - DNA, 21 bp, Homo sapiens
tctagctagaaatatgatttt

SEQ ID NO: 145327 - DNA, 23 bp, Homo sapiens
tctagctagaaatatgattttat

SEQ ID NO: 145328 - DNA, 23 bp, Homo sapiens
taagaaaatattttgtctaaaat

SEQ ID NO: 145329 - DNA, 20 bp, Homo sapiens
taagaaacaactctttgaga

SEQ ID NO: 145330 - DNA, 19 bp, Homo sapiens
taagaagggatggattcca

SEQ ID NO: 145331 - DNA, 16 bp, Homo sapiens
taagaataaaatgttg

SEQ ID NO: 145332 - DNA, 21 bp, Homo sapiens
taagaataaaatgttgaaaag

SEQ ID NO: 145333 - DNA, 19 bp, Homo sapiens
tcaacagagaaggcaggaa

SEQ ID NO: 145334 - DNA, 20 bp, Homo sapiens
tcaaccccaccacttctttt

SEQ ID NO: 145335 - DNA, 18 bp, Homo sapiens
tcaacccccatttctatt

SEQ ID NO: 145336 - DNA, 24 bp, Homo sapiens
tcaactgaccagcctccatgctgc

SEQ ID NO: 145337 - DNA, 15 bp, Homo sapiens
tcaagatcatgtacc

SEQ ID NO: 145338 - DNA, 15 bp, Homo sapiens
tcaagccaagcagcc

SEQ ID NO: 145339 - DNA, 19 bp, Homo sapiens
tcaagcccaggaggactgc

SEQ ID NO: 145340 - DNA, 19 bp, Homo sapiens
tcaagcttcagtttcctgg

SEQ ID NO: 145341 - DNA, 18 bp, Homo sapiens
tcaaggcgtgaggatggg

SEQ ID NO: 145342 - DNA, 17 bp, Homo sapiens
tcaagtctctgctggcc

SEQ ID NO: 145343 - DNA, 21 bp, Homo sapiens
tcaagtgtctcagtccacctg

SEQ ID NO: 145344 - DNA, 13 bp, Homo sapiens
tcaagttattgta

SEQ ID NO: 145345 - DNA, 17 bp, Homo sapiens
tcaagttattgtacagc

SEQ ID NO: 145346 - DNA, 17 bp, Homo sapiens
tcaatacagtacaggca

SEQ ID NO: 145347 - DNA, 18 bp, Homo sapiens
tcaatacagtacaggcag

SEQ ID NO: 145348 - DNA, 20 bp, Homo sapiens
tcaatacagtacaggcagca

SEQ ID NO: 145349 - DNA, 17 bp, Homo sapiens
tcaatattgtcattcct

SEQ ID NO: 145350 - DNA, 10 bp, Homo sapiens
tcaatattta

SEQ ID NO: 145351 - DNA, 13 bp, Homo sapiens
tcaatgcagcccc

SEQ ID NO: 145352 - DNA, 15 bp, Homo sapiens
tcaattcctctggga

SEQ ID NO: 145353 - DNA, 22 bp, Homo sapiens
tcaattgcatctcccagataat

SEQ ID NO: 145354 - DNA, 20 bp, Homo sapiens
tcaatttgtaattgcttaca

SEQ ID NO: 145355 - DNA, 16 bp, Homo sapiens
tcaattttatccctca

SEQ ID NO: 145356 - DNA, 23 bp, Homo sapiens
tcaatttttcttatttcatttct

SEQ ID NO: 145357 - DNA, 20 bp, Homo sapiens
tcacaaatcctaaaagaagc

SEQ ID NO: 145358 - DNA, 16 bp, Homo sapiens
tcacaacaacctggtc

SEQ ID NO: 145359 - DNA, 12 bp, Homo sapiens
tcacaacagatc

SEQ ID NO: 145360 - DNA, 21 bp, Homo sapiens
tcacaacagattattacctta

SEQ ID NO: 145361 - DNA, 13 bp, Homo sapiens
tcacaagacccaa

SEQ ID NO: 145362 - DNA, 14 bp, Homo sapiens
tcacaatagaaact

SEQ ID NO: 145363 - DNA, 10 bp, Homo sapiens
tcacacacac

SEQ ID NO: 145364 - DNA, 21 bp, Homo sapiens
tcacacacaggcaactgaggc

SEQ ID NO: 145365 - DNA, 22 bp, Homo sapiens
tcacacgtctggcttcacagat

SEQ ID NO: 145366 - DNA, 11 bp, Homo sapiens
tcacagaagaa

SEQ ID NO: 145367 - DNA, 12 bp, Homo sapiens
tcacagaggctt

SEQ ID NO: 145368 - DNA, 21 bp, Homo sapiens
tcacagatgtgtgattcacag

SEQ ID NO: 145369 - DNA, 17 bp, Homo sapiens
tcacagccagactggca

SEQ ID NO: 145370 - DNA, 13 bp, Homo sapiens
tcacagcctctga

SEQ ID NO: 145371 - DNA, 18 bp, Homo sapiens
tcacagcctctgacccct

SEQ ID NO: 145372 - DNA, 19 bp, Homo sapiens
tcacagcctctgacccctc

SEQ ID NO: 145373 - DNA, 22 bp, Homo sapiens
tcacagcctctgacccctcctc

SEQ ID NO: 145374 - DNA, 16 bp, Homo sapiens
tcacaggactctgcct

SEQ ID NO: 145375 - DNA, 17 bp, Homo sapiens
tcacaggactctgcctc

SEQ ID NO: 145376 - DNA, 23 bp, Homo sapiens
tcacaggactctgcctcctcttc

SEQ ID NO: 145377 - DNA, 20 bp, Homo sapiens
tcacagggcatgccccggcc

SEQ ID NO: 145378 - DNA, 12 bp, Homo sapiens
tcacagggccaa

SEQ ID NO: 145379 - DNA, 13 bp, Homo sapiens
tcacagtgtgttt

SEQ ID NO: 145380 - DNA, 14 bp, Homo sapiens
tcacagtgtttcga

SEQ ID NO: 145381 - DNA, 13 bp, Homo sapiens
tcacagttcctcg

SEQ ID NO: 145382 - DNA, 14 bp, Homo sapiens
tcacagttcctcgc

SEQ ID NO: 145383 - DNA, 16 bp, Homo sapiens
tcacagttcctcgccc

SEQ ID NO: 145384 - DNA, 18 bp, Homo sapiens
tcacagttcctcgccctg

SEQ ID NO: 145385 - DNA, 19 bp, Homo sapiens
tcacagttcctcgccctgg

SEQ ID NO: 145386 - DNA, 20 bp, Homo sapiens
tcacagttcctcgccctggg

SEQ ID NO: 145387 - DNA, 22 bp, Homo sapiens
tcacagttcctcgccctgggtc

SEQ ID NO: 145388 - DNA, 18 bp, Homo sapiens
tcacatagagatcatcct

SEQ ID NO: 145389 - DNA, 20 bp, Homo sapiens
tcacatctttcacacttcca

SEQ ID NO: 145390 - DNA, 22 bp, Homo sapiens
tcacatctttcacacttccacc

SEQ ID NO: 145391 - DNA, 23 bp, Homo sapiens
tcacattgtaactgaacttcagg

SEQ ID NO: 145392 - DNA, 12 bp, Homo sapiens
tcaccaagctca

SEQ ID NO: 145393 - DNA, 16 bp, Homo sapiens
tcaccaagctcacagt

SEQ ID NO: 145394 - DNA, 20 bp, Homo sapiens
tcaccaagctcacagttcct

SEQ ID NO: 145395 - DNA, 14 bp, Homo sapiens
tcaccaccttccca

SEQ ID NO: 145396 - DNA, 21 bp, Homo sapiens
tcaccacttcaatagatcaaa

SEQ ID NO: 145397 - DNA, 13 bp, Homo sapiens
tcaccagtgtccc

SEQ ID NO: 145398 - DNA, 20 bp, Homo sapiens
tcaccagtgtcccctccact

SEQ ID NO: 145399 - DNA, 15 bp, Homo sapiens
tcaccatcttggcca

SEQ ID NO: 145400 - DNA, 17 bp, Homo sapiens
tcacccagacagctccc

SEQ ID NO: 145401 - DNA, 13 bp, Homo sapiens
tcaccccagggcc

SEQ ID NO: 145402 - DNA, 16 bp, Homo sapiens
tcaccccagggcctga

SEQ ID NO: 145403 - DNA, 19 bp, Homo sapiens
tcaccccagggcctgagcc

SEQ ID NO: 145404 - DNA, 21 bp, Homo sapiens
tcaccccagggcctgagcctg

SEQ ID NO: 145405 - DNA, 13 bp, Homo sapiens
tcaccccatccca

SEQ ID NO: 145406 - DNA, 19 bp, Homo sapiens
tcacccccaaggggcagtc

SEQ ID NO: 145407 - DNA, 13 bp, Homo sapiens
tcacccccttctc

SEQ ID NO: 145408 - DNA, 13 bp, Homo sapiens
tcacccctgccct

SEQ ID NO: 145409 - DNA, 16 bp, Homo sapiens
tcacccctgccctggg

SEQ ID NO: 145410 - DNA, 13 bp, Homo sapiens
tcaccgtgggctc

SEQ ID NO: 145411 - DNA, 18 bp, Homo sapiens
tcaccgtgggctccctga

SEQ ID NO: 145412 - DNA, 12 bp, Homo sapiens
tcacctctgcct

SEQ ID NO: 145413 - DNA, 15 bp, Homo sapiens
tcacctgaggtcggg

SEQ ID NO: 145414 - DNA, 19 bp, Homo sapiens
tcacgcctgtaatcccagc

SEQ ID NO: 145415 - DNA, 16 bp, Homo sapiens
tcacgcctgtgcagtg

SEQ ID NO: 145416 - DNA, 17 bp, Homo sapiens
tcacgtgcagctcaagg

SEQ ID NO: 145417 - DNA, 14 bp, Homo sapiens
tcactagccatgat

SEQ ID NO: 145418 - DNA, 14 bp, Homo sapiens
tcactcagatggaa

SEQ ID NO: 145419 - DNA, 13 bp, Homo sapiens
tcactccaccacc

SEQ ID NO: 145420 - DNA, 15 bp, Homo sapiens
tcactccaccaccca

SEQ ID NO: 145421 - DNA, 17 bp, Homo sapiens
tcactcggcaccctgca

SEQ ID NO: 145422 - DNA, 14 bp, Homo sapiens
tcactctggcctca

SEQ ID NO: 145423 - DNA, 15 bp, Homo sapiens
tcactgcacagtgca

SEQ ID NO: 145424 - DNA, 21 bp, Homo sapiens
tcactgcctctccctggccct

SEQ ID NO: 145425 - DNA, 18 bp, Homo sapiens
tcactgctccctgaagcc

SEQ ID NO: 145426 - DNA, 19 bp, Homo sapiens
tcactgctccctgaagcca

SEQ ID NO: 145427 - DNA, 12 bp, Homo sapiens
tcactgctggct

SEQ ID NO: 145428 - DNA, 14 bp, Homo sapiens
tcactgctggctgc

SEQ ID NO: 145429 - DNA, 15 bp, Homo sapiens
tcactgctggctgcc

SEQ ID NO: 145430 - DNA, 17 bp, Homo sapiens
tcactgctggctgcctt

SEQ ID NO: 145431 - DNA, 22 bp, Homo sapiens
tcactggagcaccaggcacgaa

SEQ ID NO: 145432 - DNA, 21 bp, Homo sapiens
tcactggagttacattaatgt

SEQ ID NO: 145433 - DNA, 20 bp, Homo sapiens
tcactgttgaaaattatttt

SEQ ID NO: 145434 - DNA, 14 bp, Homo sapiens
tcactgtttctctg

SEQ ID NO: 145435 - DNA, 16 bp, Homo sapiens
tcacttaattgctaca

SEQ ID NO: 145436 - DNA, 14 bp, Homo sapiens
tctcttctccactg

SEQ ID NO: 145437 - DNA, 16 bp, Homo sapiens
tctcttctccactgga

SEQ ID NO: 145438 - DNA, 13 bp, Homo sapiens
tctcttctttaaa

SEQ ID NO: 145439 - DNA, 15 bp, Homo sapiens
tctcttgagcctggg

SEQ ID NO: 145440 - DNA, 12 bp, Homo sapiens
tctcttgatttt

SEQ ID NO: 145441 - DNA, 22 bp, Homo sapiens
tctcttttgaatccatgcttgg

SEQ ID NO: 145442 - DNA, 17 bp, Homo sapiens
tctgacccctcctcact

SEQ ID NO: 145443 - DNA, 14 bp, Homo sapiens
tctgaccctctcca

SEQ ID NO: 145444 - DNA, 14 bp, Homo sapiens
tctgacctccatga

SEQ ID NO: 145445 - DNA, 15 bp, Homo sapiens
tctgactcagggctc

SEQ ID NO: 145446 - DNA, 12 bp, Homo sapiens
tctgactctcaa

SEQ ID NO: 145447 - DNA, 14 bp, Homo sapiens
tctgagaaagacta

SEQ ID NO: 145448 - DNA, 15 bp, Homo sapiens
tctgagaaagactat

SEQ ID NO: 145449 - DNA, 19 bp, Homo sapiens
tctgagaaagactattcaa

SEQ ID NO: 145450 - DNA, 23 bp, Homo sapiens
tctgagaaagactattcaaacag

SEQ ID NO: 145451 - DNA, 17 bp, Homo sapiens
tctgagaaggtccttaa

SEQ ID NO: 145452 - DNA, 23 bp, Homo sapiens
tctgagtatctcctcgcaagctg

SEQ ID NO: 145453 - DNA, 20 bp, Homo sapiens
tctgagtttcattctcctgc

SEQ ID NO: 145454 - DNA, 15 bp, Homo sapiens
tctgataggccaagt

SEQ ID NO: 145455 - DNA, 21 bp, Homo sapiens
tctgatgcaagcaagaaacac

SEQ ID NO: 145456 - DNA, 23 bp, Homo sapiens
tctgatgcaagcaagaaacactg

SEQ ID NO: 145457 - DNA, 13 bp, Homo sapiens
tctgattccactt

SEQ ID NO: 145458 - DNA, 21 bp, Homo sapiens
tctgcaaaatgaggaatgtat

SEQ ID NO: 145459 - DNA, 16 bp, Homo sapiens
tctgcaatgggcactg

SEQ ID NO: 145460 - DNA, 19 bp, Homo sapiens
tctgcaatgggcactggga

SEQ ID NO: 145461 - DNA, 14 bp, Homo sapiens
tctgcacaagctgc

SEQ ID NO: 145462 - DNA, 19 bp, Homo sapiens
tctgcacaagctgcaccct

SEQ ID NO: 145463 - DNA, 18 bp, Homo sapiens
tctgcacccccctgggct

SEQ ID NO: 145464 - DNA, 20 bp, Homo sapiens
tctgcactactgacatgtgg

SEQ ID NO: 145465 - DNA, 21 bp, Homo sapiens
tctgcactactgacatgtggg

SEQ ID NO: 145466 - DNA, 13 bp, Homo sapiens
tctgcagaaggaa

SEQ ID NO: 145467 - DNA, 22 bp, Homo sapiens
tctgcagaaggaaaaatgtgta

SEQ ID NO: 145468 - DNA, 15 bp, Homo sapiens
tctgcagataaacag

SEQ ID NO: 145469 - DNA, 13 bp, Homo sapiens
tctgcaggcagac

SEQ ID NO: 145470 - DNA, 14 bp, Homo sapiens
tctgcaggcagaca

SEQ ID NO: 145471 - DNA, 15 bp, Homo sapiens
tctgcaggcagacac

SEQ ID NO: 145472 - DNA, 21 bp, Homo sapiens
tctgcattttcaccccaccct

SEQ ID NO: 145473 - DNA, 15 bp, Homo sapiens
tctgccaccagagac

SEQ ID NO: 145474 - DNA, 20 bp, Homo sapiens
tctgccacctcccctatcca

SEQ ID NO: 145475 - DNA, 13 bp, Homo sapiens
tctgccagccagc

SEQ ID NO: 145476 - DNA, 23 bp, Homo sapiens
tctgccaggcccccaagcctgca

SEQ ID NO: 145477 - DNA, 23 bp, Homo sapiens
tctgccagtgacagacaggctct

SEQ ID NO: 145478 - DNA, 18 bp, Homo sapiens
tctgccctgccctagctc

SEQ ID NO: 145479 - DNA, 18 bp, Homo sapiens
tctgcccttgccaacgga

SEQ ID NO: 145480 - DNA, 16 bp, Homo sapiens
tgctggtcactgccat

SEQ ID NO: 145481 - DNA, 13 bp, Homo sapiens
tgctgtgaggctg

SEQ ID NO: 145482 - DNA, 19 bp, Homo sapiens
tgctgtgaggctgtcctgt

SEQ ID NO: 145483 - DNA, 11 bp, Homo sapiens
tgctgtttcct

SEQ ID NO: 145484 - DNA, 19 bp, Homo sapiens
tgctgtttgtttgacaaag

SEQ ID NO: 145485 - DNA, 22 bp, Homo sapiens
tgcttacaattccctgctgtcg

SEQ ID NO: 145486 - DNA, 20 bp, Homo sapiens
tgcttacatttttacaataa

SEQ ID NO: 145487 - DNA, 16 bp, Homo sapiens
tgcttcaattaataaa

SEQ ID NO: 145488 - DNA, 18 bp, Homo sapiens
tgcttcagtggagaatta

SEQ ID NO: 145489 - DNA, 13 bp, Homo sapiens
tgcttcgggccct

SEQ ID NO: 145490 - DNA, 18 bp, Homo sapiens
tgcttcgggcccttccca

SEQ ID NO: 145491 - DNA, 17 bp, Homo sapiens
tgcttctccatgagaca

SEQ ID NO: 145492 - DNA, 14 bp, Homo sapiens
tgcttgaaagaaaa

SEQ ID NO: 145493 - DNA, 12 bp, Homo sapiens
tgcttgaggaaa

SEQ ID NO: 145494 - DNA, 13 bp, Homo sapiens
tgcttgaggaaaa

SEQ ID NO: 145495 - DNA, 16 bp, Homo sapiens
tgcttgaggaaaacaa

SEQ ID NO: 145496 - DNA, 21 bp, Homo sapiens
tgcttgaggcaactcatctta

SEQ ID NO: 145497 - DNA, 20 bp, Homo sapiens
tgctttgactgagcagactg

SEQ ID NO: 145498 - DNA, 14 bp, Homo sapiens
tgctttgggctgcc

SEQ ID NO: 145499 - DNA, 15 bp, Homo sapiens
tgctttgggctgccc

SEQ ID NO: 145500 - DNA, 16 bp, Homo sapiens
tgctttgggctgccct

SEQ ID NO: 145501 - DNA, 19 bp, Homo sapiens
tgctttgggctgccctggt

SEQ ID NO: 145502 - DNA, 23 bp, Homo sapiens
tggaaaaacatctgaaagccacg

SEQ ID NO: 145503 - DNA, 15 bp, Homo sapiens
tggaaaataaatcaa

SEQ ID NO: 145504 - DNA, 16 bp, Homo sapiens
tggaaaataaattatt

SEQ ID NO: 145505 - DNA, 15 bp, Homo sapiens
tggaaacctgaaaaa

SEQ ID NO: 145506 - DNA, 17 bp, Homo sapiens
tggaaaggagaggaaag

SEQ ID NO: 145507 - DNA, 21 bp, Homo sapiens
tggaaatttgttataatgaat

SEQ ID NO: 145508 - DNA, 23 bp, Homo sapiens
tggaaatttgttataatgaatga

SEQ ID NO: 145509 - DNA, 18 bp, Homo sapiens
tggaacttctaatatatt

SEQ ID NO: 145510 - DNA, 23 bp, Homo sapiens
tggaagagcctgcaggtgctgct

SEQ ID NO: 145511 - DNA, 12 bp, Homo sapiens
tggaagccctcc

SEQ ID NO: 145512 - DNA, 17 bp, Homo sapiens
tggaagccctccttcca

SEQ ID NO: 145513 - DNA, 15 bp, Homo sapiens
tggaaggtgctgtta

SEQ ID NO: 145514 - DNA, 19 bp, Homo sapiens
tggaagtgagggtcagaga

SEQ ID NO: 145515 - DNA, 21 bp, Homo sapiens
tggaagtgtgtgatctgtggg

SEQ ID NO: 145516 - DNA, 14 bp, Homo sapiens
tggaatacagtgtt

SEQ ID NO: 145517 - DNA, 15 bp, Homo sapiens
tggaatacagtgtta

SEQ ID NO: 145518 - DNA, 16 bp, Homo sapiens
tggaatgctgtgttaa

SEQ ID NO: 145519 - DNA, 13 bp, Homo sapiens
tggaattctaaca

SEQ ID NO: 145520 - DNA, 17 bp, Homo sapiens
tggacactccagtgcca

SEQ ID NO: 145521 - DNA, 19 bp, Homo sapiens
tggacactccagtgccagc

SEQ ID NO: 145522 - DNA, 21 bp, Homo sapiens
tggacactccagtgccagcaa

SEQ ID NO: 145523 - DNA, 22 bp, Homo sapiens
tggacagacagaggatgagctc

SEQ ID NO: 145524 - DNA, 21 bp, Homo sapiens
tggacatgaagattctttccc

SEQ ID NO: 145525 - DNA, 17 bp, Homo sapiens
tggacatttgccttgct

SEQ ID NO: 145526 - DNA, 18 bp, Homo sapiens
tggacatttgccttgctg

SEQ ID NO: 145527 - DNA, 19 bp, Homo sapiens
tggacatttgccttgctgg

SEQ ID NO: 145528 - DNA, 22 bp, Homo sapiens
tggacatttgccttgctggacg

SEQ ID NO: 145529 - DNA, 19 bp, Homo sapiens
tggaccaggacaggaccag

SEQ ID NO: 145530 - DNA, 23 bp, Homo sapiens
tggaccctgtggatgataaaaca

SEQ ID NO: 145531 - DNA, 13 bp, Homo sapiens
tggacccttccat

SEQ ID NO: 145532 - DNA, 16 bp, Homo sapiens
tggacggggactgggg

SEQ ID NO: 145533 - DNA, 15 bp, Homo sapiens
tggactctcagtctc

SEQ ID NO: 145534 - DNA, 22 bp, Homo sapiens
tggagaaactgtagtctcagga

SEQ ID NO: 145535 - DNA, 11 bp, Homo sapiens
tggagaaatta

SEQ ID NO: 145536 - DNA, 15 bp, Homo sapiens
tggagaaattattta

SEQ ID NO: 145537 - DNA, 21 bp, Homo sapiens
tggagaaattatttaataaaa

SEQ ID NO: 145538 - DNA, 17 bp, Homo sapiens
tggagacagccccagag

SEQ ID NO: 145539 - DNA, 21 bp, Homo sapiens
tggagacagccccagagcagg

SEQ ID NO: 145540 - DNA, 22 bp, Homo sapiens
tggagacagccccagagcaggg

SEQ ID NO: 145541 - DNA, 14 bp, Homo sapiens
tggagactgtctca

SEQ ID NO: 145542 - DNA, 19 bp, Homo sapiens
tggagagggatgaggtgct

SEQ ID NO: 145543 - DNA, 15 bp, Homo sapiens
tggagagtaaaaact

SEQ ID NO: 145544 - DNA, 20 bp, Homo sapiens
tggagagtgcaacagtagca

SEQ ID NO: 145545 - DNA, 23 bp, Homo sapiens
tggagatatttatggggggagaa

SEQ ID NO: 145546 - DNA, 17 bp, Homo sapiens
tggagcaccaggcacga

SEQ ID NO: 145547 - DNA, 12 bp, Homo sapiens
tggagcagaggg

SEQ ID NO: 145548 - DNA, 17 bp, Homo sapiens
tggagcagaggggctga

SEQ ID NO: 145549 - DNA, 12 bp, Homo sapiens
tggaggaggagg

SEQ ID NO: 145550 - DNA, 15 bp, Homo sapiens
tggaggaggaggcaa

SEQ ID NO: 145551 - DNA, 18 bp, Homo sapiens
tggaggcacacagctgca

SEQ ID NO: 145552 - DNA, 13 bp, Homo sapiens
tggaggctgtctt

SEQ ID NO: 145553 - DNA, 14 bp, Homo sapiens
tggaggtacactct

SEQ ID NO: 145554 - DNA, 12 bp, Homo sapiens
tggaggtgggag

SEQ ID NO: 145555 - DNA, 18 bp, Homo sapiens
tggagttacattaatgtt

SEQ ID NO: 145556 - DNA, 21 bp, Homo sapiens
tggataacttaggtggcaagc

SEQ ID NO: 145557 - DNA, 18 bp, Homo sapiens
tggataatgctgttgcct

SEQ ID NO: 145558 - DNA, 18 bp, Homo sapiens
tggatgaaattttctaga

SEQ ID NO: 145559 - DNA, 23 bp, Homo sapiens
tggatgaagattctcctgtgcta

SEQ ID NO: 145560 - DNA, 15 bp, Homo sapiens
tggatggagcccagg

SEQ ID NO: 145561 - DNA, 13 bp, Homo sapiens
tggattattcatt

SEQ ID NO: 145562 - DNA, 17 bp, Homo sapiens
tggattgcacgtggcct

SEQ ID NO: 145563 - DNA, 21 bp, Homo sapiens
tggattgcacgtggcctcttg

SEQ ID NO: 145564 - DNA, 14 bp, Homo sapiens
tggatttcagaaag

SEQ ID NO: 145565 - DNA, 12 bp, Homo sapiens
tggcaaaaaggc

SEQ ID NO: 145566 - DNA, 17 bp, Homo sapiens
tggcaaagacagaagcc

SEQ ID NO: 145567 - DNA, 15 bp, Homo sapiens
tggcaagaaagctgg

SEQ ID NO: 145568 - DNA, 15 bp, Homo sapiens
tggcaagcccctgcc

SEQ ID NO: 145569 - DNA, 21 bp, Homo sapiens
tggcaagcccctgcccatctg

SEQ ID NO: 145570 - DNA, 19 bp, Homo sapiens
tggcaatgccatcatctcc

SEQ ID NO: 145571 - DNA, 14 bp, Homo sapiens
tggcacagaaacac

SEQ ID NO: 145572 - DNA, 15 bp, Homo sapiens
tggcacagggcagtg

SEQ ID NO: 145573 - DNA, 18 bp, Homo sapiens
tggcacagggcagtggga

SEQ ID NO: 145574 - DNA, 19 bp, Homo sapiens
tggcacagttttctgagaa

SEQ ID NO: 145575 - DNA, 22 bp, Homo sapiens
tggcacagttttctgagaaaga

SEQ ID NO: 145576 - DNA, 12 bp, Homo sapiens
tggcacctccta

SEQ ID NO: 145577 - DNA, 12 bp, Homo sapiens
tggcactgctgt

SEQ ID NO: 145578 - DNA, 15 bp, Homo sapiens
tggcagagttgtaaa

SEQ ID NO: 145579 - DNA, 23 bp, Homo sapiens
tggcagagttgtaaatatataaa

SEQ ID NO: 145580 - DNA, 20 bp, Homo sapiens
tggcagataatcagcctctt

SEQ ID NO: 145581 - DNA, 22 bp, Homo sapiens
tggcagatttagtgaaagctag

SEQ ID NO: 145582 - DNA, 14 bp, Homo sapiens
tggcagcagagtgt

SEQ ID NO: 145583 - DNA, 19 bp, Homo sapiens
tggcagccgtgccttcagc

SEQ ID NO: 145584 - DNA, 23 bp, Homo sapiens
tggcagccgtgccttcagctcta

SEQ ID NO: 145585 - DNA, 17 bp, Homo sapiens
tggcagggtgggatgga

SEQ ID NO: 145586 - DNA, 14 bp, Homo sapiens
tggcagtgagtgag

SEQ ID NO: 145587 - DNA, 19 bp, Homo sapiens
tggcagtgagtgagcctgg

SEQ ID NO: 145588 - DNA, 19 bp, Homo sapiens
tggcatagcccagacacag

SEQ ID NO: 145589 - DNA, 15 bp, Homo sapiens
tggccagagctggga

SEQ ID NO: 145590 - DNA, 23 bp, Homo sapiens
tggccagagctgggaggcatggc

SEQ ID NO: 145591 - DNA, 24 bp, Homo sapiens
tggccagagctgggaggcatggcc

SEQ ID NO: 145592 - DNA, 19 bp, Homo sapiens
tggccaggtggccactcca

SEQ ID NO: 145593 - DNA, 19 bp, Homo sapiens
tggcccacgcacttcggga

SEQ ID NO: 145594 - DNA, 20 bp, Homo sapiens
tggccccaagggcaaaattc

SEQ ID NO: 145595 - DNA, 19 bp, Homo sapiens
tggccccatgtctctcaga

SEQ ID NO: 145596 - DNA, 15 bp, Homo sapiens
tggcccgacagcctg

SEQ ID NO: 145597 - DNA, 18 bp, Homo sapiens
tggcccgacagcctggca

SEQ ID NO: 145598 - DNA, 15 bp, Homo sapiens
tggccctggcctgct

SEQ ID NO: 145599 - DNA, 16 bp, Homo sapiens
tggccctggcctgctg

SEQ ID NO: 145600 - DNA, 17 bp, Homo sapiens
tggccctggcctgctgg

SEQ ID NO: 145601 - DNA, 19 bp, Homo sapiens
tggccctggggtcccacga

SEQ ID NO: 145602 - DNA, 15 bp, Homo sapiens
tggccctgtccctcc

SEQ ID NO: 145603 - DNA, 14 bp, Homo sapiens
tgtaaactgtgcac

SEQ ID NO: 145604 - DNA, 15 bp, Homo sapiens
tgtaaactgtgcacc

SEQ ID NO: 145605 - DNA, 21 bp, Homo sapiens
tgtaaatactgtttttaacaa

SEQ ID NO: 145606 - DNA, 13 bp, Homo sapiens
tgtaaatatataa

SEQ ID NO: 145607 - DNA, 15 bp, Homo sapiens
tgtaaatatataaat

SEQ ID NO: 145608 - DNA, 17 bp, Homo sapiens
tgtaaatatataaatat

SEQ ID NO: 145609 - DNA, 18 bp, Homo sapiens
tgtaaatatataaatata

SEQ ID NO: 145610 - DNA, 19 bp, Homo sapiens
tgtaaatatataaatatat

SEQ ID NO: 145611 - DNA, 20 bp, Homo sapiens
tgtaacacagctgagagact

SEQ ID NO: 145612 - DNA, 21 bp, Homo sapiens
tgtaacacagctgagagactt

SEQ ID NO: 145613 - DNA, 18 bp, Homo sapiens
tgtaacactttacaatgt

SEQ ID NO: 145614 - DNA, 22 bp, Homo sapiens
tgtaacaggtctcctcttaaaa

SEQ ID NO: 145615 - DNA, 12 bp, Homo sapiens
tgtaactccacc

SEQ ID NO: 145616 - DNA, 22 bp, Homo sapiens
tgtaagaaacacactgaggcag

SEQ ID NO: 145617 - DNA, 16 bp, Homo sapiens
tgtaatcccagctact

SEQ ID NO: 145618 - DNA, 20 bp, Homo sapiens
tgtaatcccagctactcagg

SEQ ID NO: 145619 - DNA, 13 bp, Homo sapiens
tgtaatgtcacca

SEQ ID NO: 145620 - DNA, 16 bp, Homo sapiens
tgtaatgtcaccacct

SEQ ID NO: 145621 - DNA, 20 bp, Homo sapiens
tgtaatgtcaccaccttccc

SEQ ID NO: 145622 - DNA, 23 bp, Homo sapiens
tgtaatgtcaccaccttcccagc

SEQ ID NO: 145623 - DNA, 15 bp, Homo sapiens
tgtaattctaaatga

SEQ ID NO: 145624 - DNA, 16 bp, Homo sapiens
tgtaattctaaatgaa

SEQ ID NO: 145625 - DNA, 21 bp, Homo sapiens
tgtacagaattctgctacctc

SEQ ID NO: 145626 - DNA, 13 bp, Homo sapiens
tgtacatatgtaa

SEQ ID NO: 145627 - DNA, 19 bp, Homo sapiens
tgtacatatgtaaaataaa

SEQ ID NO: 145628 - DNA, 15 bp, Homo sapiens
tgtacatatgtgctg

SEQ ID NO: 145629 - DNA, 17 bp, Homo sapiens
tgtacatatgtgctgga

SEQ ID NO: 145630 - DNA, 22 bp, Homo sapiens
tgtacatgaagaagctaaatcc

SEQ ID NO: 145631 - DNA, 14 bp, Homo sapiens
tgtacattaattac

SEQ ID NO: 145632 - DNA, 21 bp, Homo sapiens
tgtacccagtattctaggtag

SEQ ID NO: 145633 - DNA, 12 bp, Homo sapiens
tgtacgtggaga

SEQ ID NO: 145634 - DNA, 14 bp, Homo sapiens
tgtacgtggagagg

SEQ ID NO: 145635 - DNA, 19 bp, Homo sapiens
tgtactgagccttgtaatt

SEQ ID NO: 145636 - DNA, 20 bp, Homo sapiens
tgtactgagccttgtaattc

SEQ ID NO: 145637 - DNA, 21 bp, Homo sapiens
ttcgccgtggctgcggcaccc

SEQ ID NO: 145638 - DNA, 13 bp, Homo sapiens
ttcggtgtgcacc

SEQ ID NO: 145639 - DNA, 19 bp, Homo sapiens
ttcgtagctttcccaaata

SEQ ID NO: 145640 - DNA, 19 bp, Homo sapiens
ttcgtctgtttataaacat

SEQ ID NO: 145641 - DNA, 14 bp, Homo sapiens
ttctaaatgaagtg

SEQ ID NO: 145642 - DNA, 19 bp, Homo sapiens
ttctaacaaaaaaatatat

SEQ ID NO: 145643 - DNA, 15 bp, Homo sapiens
ttctaagtaaaacca

SEQ ID NO: 145644 - DNA, 16 bp, Homo sapiens
ttctaagtaaaaccac

SEQ ID NO: 145645 - DNA, 21 bp, Homo sapiens
ttctaagtaaaaccacagcag

SEQ ID NO: 145646 - DNA, 24 bp, Homo sapiens
ttctaagtaaaaccacagcagttg

SEQ ID NO: 145647 - DNA, 22 bp, Homo sapiens
ttctacataagtaattcaagaa

SEQ ID NO: 145648 - DNA, 13 bp, Homo sapiens
ttctacgccaggg

SEQ ID NO: 145649 - DNA, 18 bp, Homo sapiens
ttctagctagaaatatga

SEQ ID NO: 145650 - DNA, 15 bp, Homo sapiens
ttctaggttctaaaa

SEQ ID NO: 145651 - DNA, 23 bp, Homo sapiens
ttctatagcagattgtgtaacaa

SEQ ID NO: 145652 - DNA, 14 bp, Homo sapiens
ttctattgaaaaat

SEQ ID NO: 145653 - DNA, 15 bp, Homo sapiens
ttctatttatttact

SEQ ID NO: 145654 - DNA, 14 bp, Homo sapiens
ttctcactccacca

SEQ ID NO: 145655 - DNA, 16 bp, Homo sapiens
ttctcactcctacctg

SEQ ID NO: 145656 - DNA, 18 bp, Homo sapiens
ttctcactcctacctggt

SEQ ID NO: 145657 - DNA, 21 bp, Homo sapiens
ttctcactgccatgccagctt

SEQ ID NO: 145658 - DNA, 23 bp, Homo sapiens
ttctcagaatctacccaaaggat

SEQ ID NO: 145659 - DNA, 20 bp, Homo sapiens
ttctcaggctctgccctgcc

SEQ ID NO: 145660 - DNA, 17 bp, Homo sapiens
ttctcaggtgttgccaa

SEQ ID NO: 145661 - DNA, 22 bp, Homo sapiens
ttctcataggaaaagtacattt

SEQ ID NO: 145662 - DNA, 24 bp, Homo sapiens
ttctcataggaaaagtacatttaa

SEQ ID NO: 145663 - DNA, 17 bp, Homo sapiens
ttctcatgtgatccttt

SEQ ID NO: 145664 - DNA, 21 bp, Homo sapiens
ttctctaacttcaaggcccat

SEQ ID NO: 145665 - DNA, 19 bp, Homo sapiens
ttctctaagagaacaatgt

SEQ ID NO: 145666 - DNA, 20 bp, Homo sapiens
ttctctcggagtatctggga

SEQ ID NO: 145667 - DNA, 13 bp, Homo sapiens
ttctctgccagtg

SEQ ID NO: 145668 - DNA, 14 bp, Homo sapiens
ttctctgtatagta

SEQ ID NO: 145669 - DNA, 12 bp, Homo sapiens
ttctctgtctca

SEQ ID NO: 145670 - DNA, 13 bp, Homo sapiens
ttctctgtctcat

SEQ ID NO: 145671 - DNA, 15 bp, Homo sapiens
ttctgagaaagacta

SEQ ID NO: 145672 - DNA, 16 bp, Homo sapiens
ttctgagaaagactat

SEQ ID NO: 145673 - DNA, 20 bp, Homo sapiens
ttctgagtttcattctcctg

SEQ ID NO: 145674 - DNA, 16 bp, Homo sapiens
ttctgccgtgtgccct

SEQ ID NO: 145675 - DNA, 15 bp, Homo sapiens
ttctgctacctcact

SEQ ID NO: 145676 - DNA, 20 bp, Homo sapiens
ttctgctcatcattctctgt

SEQ ID NO: 145677 - DNA, 16 bp, Homo sapiens
ttctggaatgtaatca

SEQ ID NO: 145678 - DNA, 20 bp, Homo sapiens
ttctggaatgtaatcaatgt

SEQ ID NO: 145679 - DNA, 21 bp, Homo sapiens
ttctgggagggcagcagggct

SEQ ID NO: 145680 - DNA, 14 bp, Homo sapiens
ttctgggtggcctc

SEQ ID NO: 145681 - DNA, 18 bp, Homo sapiens
ttctgggtggcctcggga

SEQ ID NO: 145682 - DNA, 23 bp, Homo sapiens
ttctgtaaactcaaaacttaaca

SEQ ID NO: 145683 - DNA, 18 bp, Homo sapiens
ttctgtactcaaatgtag

SEQ ID NO: 145684 - DNA, 17 bp, Homo sapiens
ttctgtccgagctttga

SEQ ID NO: 145685 - DNA, 12 bp, Homo sapiens
ttctgtggctca

SEQ ID NO: 145686 - DNA, 13 bp, Homo sapiens
ttctgtgtgaaga

SEQ ID NO: 145687 - DNA, 23 bp, Homo sapiens
ttctgtgtgcaccttaccaactt

SEQ ID NO: 145688 - DNA, 13 bp, Homo sapiens
ttcttaaagagtt

SEQ ID NO: 145689 - DNA, 17 bp, Homo sapiens
ttcttatgttgcccagt

SEQ ID NO: 145690 - DNA, 17 bp, Homo sapiens
ttcttcagatcagtgct

SEQ ID NO: 145691 - DNA, 20 bp, Homo sapiens
ttcttcattcaatacaagtg

SEQ ID NO: 145692 - DNA, 19 bp, Homo sapiens
ttcttccaggtgcccagct

SEQ ID NO: 145693 - DNA, 11 bp, Homo sapiens
ttcttcctctg

SEQ ID NO: 145694 - DNA, 21 bp, Homo sapiens
ttcttctaggttctaaaaatt

SEQ ID NO: 145695 - DNA, 21 bp, Homo sapiens
ttcttgaatttaataatctgt

SEQ ID NO: 145696 - DNA, 14 bp, Homo sapiens
ttctttaacttaat

SEQ ID NO: 145697 - DNA, 18 bp, Homo sapiens
ttctttataattctactt

SEQ ID NO: 145698 - DNA, 13 bp, Homo sapiens
ttctttcttcctc

SEQ ID NO: 145699 - DNA, 22 bp, Homo sapiens
ttcttttgcccttcacagtgtt

SEQ ID NO: 145700 - DNA, 23 bp, Homo sapiens
ttcttttgcccttcacagtgttt

SEQ ID NO: 145701 - DNA, 18 bp, Homo sapiens
ttcttttgtatgtaaatg

SEQ ID NO: 145702 - DNA, 15 bp, Homo sapiens
ttctttttattttct

SEQ ID NO: 145703 - DNA, 13 bp, Homo sapiens
ttgaaaagacatc

SEQ ID NO: 145704 - DNA, 19 bp, Homo sapiens
ttgaaaattattttaaaca

SEQ ID NO: 145705 - DNA, 20 bp, Homo sapiens
ttgaaaattattttaaacaa

SEQ ID NO: 145706 - DNA, 22 bp, Homo sapiens
ttgaaagctgtggccagcttgt

SEQ ID NO: 145707 - DNA, 18 bp, Homo sapiens
ttgaaattaacctctcac

SEQ ID NO: 145708 - DNA, 21 bp, Homo sapiens
ttgaaattatgtatgtttaca

SEQ ID NO: 145709 - DNA, 21 bp, Homo sapiens
ttgaaatttttattaaattat

SEQ ID NO: 145710 - DNA, 13 bp, Homo sapiens
ttgaacccaggag

SEQ ID NO: 145711 - DNA, 13 bp, Homo sapiens
ttgaagaatgaac

SEQ ID NO: 145712 - DNA, 15 bp, Homo sapiens
ttgaagaatgaacaa

SEQ ID NO: 145713 - DNA, 16 bp, Homo sapiens
ttgaagaatgaacaaa

SEQ ID NO: 145714 - DNA, 21 bp, Homo sapiens
ttgaagaggaaaatgaataat

SEQ ID NO: 145715 - DNA, 22 bp, Homo sapiens
ttgaagaggaaaatgaataata

SEQ ID NO: 145716 - DNA, 13 bp, Homo sapiens
ttgaagctctggt

SEQ ID NO: 145717 - DNA, 19 bp, Homo sapiens
ttgaagttgttactaacta

SEQ ID NO: 145718 - DNA, 17 bp, Homo sapiens
tgagaaagactattcaa

SEQ ID NO: 145719 - DNA, 20 bp, Homo sapiens
tgagaaagactattcaaaca

SEQ ID NO: 145720 - DNA, 13 bp, Homo sapiens
tgagaaagagcac

SEQ ID NO: 145721 - DNA, 21 bp, Homo sapiens
tgagaaagagcacttaagaga

SEQ ID NO: 145722 - DNA, 21 bp, Homo sapiens
tgagaaagtcttatttattca

SEQ ID NO: 145723 - DNA, 18 bp, Homo sapiens
tgagaagagagatcaaat

SEQ ID NO: 145724 - DNA, 13 bp, Homo sapiens
tgagaaggagaga

SEQ ID NO: 145725 - DNA, 15 bp, Homo sapiens
tgagaaggagagaaa

SEQ ID NO: 145726 - DNA, 16 bp, Homo sapiens
tgagaaggtccttaat

SEQ ID NO: 145727 - DNA, 23 bp, Homo sapiens
tgagaattttaaattataactta

SEQ ID NO: 145728 - DNA, 14 bp, Homo sapiens
tgagacagctctgc

SEQ ID NO: 145729 - DNA, 21 bp, Homo sapiens
tgagacccattcctatttctt

SEQ ID NO: 145730 - DNA, 14 bp, Homo sapiens
tgagacctcagcca

SEQ ID NO: 145731 - DNA, 19 bp, Homo sapiens
tgagagtatcaggtctccc

SEQ ID NO: 145732 - DNA, 20 bp, Homo sapiens
tgagataccagcgaggaggc

SEQ ID NO: 145733 - DNA, 15 bp, Homo sapiens
tgagatcaaaacggt

SEQ ID NO: 145734 - DNA, 18 bp, Homo sapiens
tgagatgctggagaagag

SEQ ID NO: 145735 - DNA, 19 bp, Homo sapiens
tgagatgctggagaagaga

SEQ ID NO: 145736 - DNA, 23 bp, Homo sapiens
tgagatgctggagaagagaggag

SEQ ID NO: 145737 - DNA, 23 bp, Homo sapiens
tgcaaacacacaaaggtataatt

SEQ ID NO: 145738 - DNA, 17 bp, Homo sapiens
tgcaaacgctgcctgcc

SEQ ID NO: 145739 - DNA, 21 bp, Homo sapiens
tgcaaacgctgcctgccggta

SEQ ID NO: 145740 - DNA, 12 bp, Homo sapiens
tgcaaagaaaat

SEQ ID NO: 145741 - DNA, 13 bp, Homo sapiens
tgcaaagaggcaa

SEQ ID NO: 145742 - DNA, 18 bp, Homo sapiens
tgcaaagcactgacttct

SEQ ID NO: 145743 - DNA, 13 bp, Homo sapiens
tgcaacaaaattc

SEQ ID NO: 145744 - DNA, 14 bp, Homo sapiens
tgcaacagtagcat

SEQ ID NO: 145745 - DNA, 14 bp, Homo sapiens
tgcaacctcgctgg

SEQ ID NO: 145746 - DNA, 11 bp, Homo sapiens
tgcaagggaaa

SEQ ID NO: 145747 - DNA, 16 bp, Homo sapiens
tgcaagggctccccac

SEQ ID NO: 145748 - DNA, 19 bp, Homo sapiens
tgcaagtactgctgtaaat

SEQ ID NO: 145749 - DNA, 23 bp, Homo sapiens
tgcaagtcagtccaggatgctaa

SEQ ID NO: 145750 - DNA, 13 bp, Homo sapiens
tgcaagtgaaggt

SEQ ID NO: 145751 - DNA, 23 bp, Homo sapiens
tgcaagtgtgtgcacatgtgtgc

SEQ ID NO: 145752 - DNA, 23 bp, Homo sapiens
tgcaagtgtgtgcatgtgtgcga

SEQ ID NO: 145753 - DNA, 22 bp, Homo sapiens
tgcaatcgtaatgtacagatgg

SEQ ID NO: 145754 - DNA, 15 bp, Homo sapiens
tgcaatgggcactgg

SEQ ID NO: 145755 - DNA, 20 bp, Homo sapiens
tgcaatttcatatgctgtat

SEQ ID NO: 145756 - DNA, 17 bp, Homo sapiens
tgcacaaagcccttcca

SEQ ID NO: 145757 - DNA, 14 bp, Homo sapiens
tgcacaagctgcac

SEQ ID NO: 145758 - DNA, 14 bp, Homo sapiens
tgcacacccactca

SEQ ID NO: 145759 - DNA, 18 bp, Homo sapiens
tgcacactcccctgcact

SEQ ID NO: 145760 - DNA, 14 bp, Homo sapiens
tgcacactttgcca

SEQ ID NO: 145761 - DNA, 19 bp, Homo sapiens
tgcacagacgtccctccac

SEQ ID NO: 145762 - DNA, 16 bp, Homo sapiens
tgcacagcggcccctg

SEQ ID NO: 145763 - DNA, 16 bp, Homo sapiens
tgcacagtgcatctca

SEQ ID NO: 145764 - DNA, 18 bp, Homo sapiens
tgcacagtgcatctcagc

SEQ ID NO: 145765 - DNA, 20 bp, Homo sapiens
tgcacagtgcatctcagccc

SEQ ID NO: 145766 - DNA, 18 bp, Homo sapiens
tgcacatctgtgtcttgt

SEQ ID NO: 145767 - DNA, 14 bp, Homo sapiens
tgcaccaagcagga

SEQ ID NO: 145768 - DNA, 15 bp, Homo sapiens
tgcaccactgcactc

SEQ ID NO: 145769 - DNA, 15 bp, Homo sapiens
tgcaccatccctttt

SEQ ID NO: 145770 - DNA, 22 bp, Homo sapiens
tgcaccatccctttttgaagtg

SEQ ID NO: 145771 - DNA, 18 bp, Homo sapiens
tgcaccccaaagctttcc

SEQ ID NO: 145772 - DNA, 14 bp, Homo sapiens
tgcacccccctggg

SEQ ID NO: 145773 - DNA, 15 bp, Homo sapiens
tgcacccccctgggc

SEQ ID NO: 145774 - DNA, 17 bp, Homo sapiens
tgcaccctcaggcaggt

SEQ ID NO: 145775 - DNA, 17 bp, Homo sapiens
tgcacctccccccactg

SEQ ID NO: 145776 - DNA, 18 bp, Homo sapiens
tgcacctgcatccgtagt

SEQ ID NO: 145777 - DNA, 12 bp, Homo sapiens
tgcacctgtgca

SEQ ID NO: 145778 - DNA, 13 bp, Homo sapiens
tgcaccttaccaa

SEQ ID NO: 145779 - DNA, 17 bp, Homo sapiens
tgcacgcccatgtgtga

SEQ ID NO: 145780 - DNA, 16 bp, Homo sapiens
tgcacgtggcctcttg

SEQ ID NO: 145781 - DNA, 22 bp, Homo sapiens
tgcacgtggcctcttgagcagt

SEQ ID NO: 145782 - DNA, 16 bp, Homo sapiens
tgcactactgacatgt

SEQ ID NO: 145783 - DNA, 18 bp, Homo sapiens
tgcactactgacatgtgg

SEQ ID NO: 145784 - DNA, 14 bp, Homo sapiens
tgcactccagcctg

SEQ ID NO: 145785 - DNA, 15 bp, Homo sapiens
tgcactccagcctga

SEQ ID NO: 145786 - DNA, 17 bp, Homo sapiens
tgcactccagcctgagc

SEQ ID NO: 145787 - DNA, 16 bp, Homo sapiens
tgcactccagcctggg

SEQ ID NO: 145788 - DNA, 18 bp, Homo sapiens
tgcactggagtccagtct

SEQ ID NO: 145789 - DNA, 16 bp, Homo sapiens
tgcactgtcaagatga

SEQ ID NO: 145790 - DNA, 14 bp, Homo sapiens
tgcacttggcctct

SEQ ID NO: 145791 - DNA, 15 bp, Homo sapiens
tgcacttggcctctg

SEQ ID NO: 145792 - DNA, 16 bp, Homo sapiens
tgcagaaaagcacctg

SEQ ID NO: 145793 - DNA, 22 bp, Homo sapiens
tgcagaagacagtatggcagct

SEQ ID NO: 145794 - DNA, 21 bp, Homo sapiens
tgcagaaggaaaaatgtgtaa

SEQ ID NO: 145795 - DNA, 16 bp, Homo sapiens
tgcagactggagggga

SEQ ID NO: 145796 - DNA, 17 bp, Homo sapiens
tgcagagacaggacctg

SEQ ID NO: 145797 - DNA, 13 bp, Homo sapiens
tgcagagtcagca

SEQ ID NO: 145798 - DNA, 17 bp, Homo sapiens
tgcagagtcagcagaac

SEQ ID NO: 145799 - DNA, 19 bp, Homo sapiens
tgcagataaacagtagtga

SEQ ID NO: 145800 - DNA, 15 bp, Homo sapiens
tgcagatgacaaaaa

SEQ ID NO: 145801 - DNA, 13 bp, Homo sapiens
tgcagattcattt

SEQ ID NO: 145802 - DNA, 20 bp, Homo sapiens
tgcagcatatgaggatgcag

SEQ ID NO: 145803 - DNA, 21 bp, Homo sapiens
tgcagccagcccagcccagct

SEQ ID NO: 145804 - DNA, 22 bp, Homo sapiens
tgcagcccggcgccaccatcct

SEQ ID NO: 145805 - DNA, 17 bp, Homo sapiens
tgcagccggcacagggt

SEQ ID NO: 145806 - DNA, 14 bp, Homo sapiens
tgcagcctcctcct

SEQ ID NO: 145807 - DNA, 21 bp, Homo sapiens
tgcagctcaaggaaaggcctg

SEQ ID NO: 145808 - DNA, 15 bp, Homo sapiens
tgcagctttacatgc

SEQ ID NO: 145809 - DNA, 16 bp, Homo sapiens
tgcagctttacatgca

SEQ ID NO: 145810 - DNA, 13 bp, Homo sapiens
tgcaggcagacac

SEQ ID NO: 145811 - DNA, 19 bp, Homo sapiens
tgcaggccccgcttgtcca

SEQ ID NO: 145812 - DNA, 21 bp, Homo sapiens
tgcagggaaaattatttgcat

SEQ ID NO: 145813 - DNA, 18 bp, Homo sapiens
tgcaggggctctggagag

SEQ ID NO: 145814 - DNA, 16 bp, Homo sapiens
tgcaggtgctgctgcg

SEQ ID NO: 145815 - DNA, 15 bp, Homo sapiens
tgcagtgagccaaga

SEQ ID NO: 145816 - DNA, 18 bp, Homo sapiens
tgcataacaattcctcta

SEQ ID NO: 145817 - DNA, 14 bp, Homo sapiens
tgcataagttaact

SEQ ID NO: 145818 - DNA, 19 bp, Homo sapiens
tgcatactcattaggatgg

SEQ ID NO: 145819 - DNA, 19 bp, Homo sapiens
tgcatcagctgctgaaaca

SEQ ID NO: 145820 - DNA, 22 bp, Homo sapiens
tgcatcagctgctgaaacaaca

SEQ ID NO: 145821 - DNA, 19 bp, Homo sapiens
tgcatccattcctcaggga

SEQ ID NO: 145822 - DNA, 21 bp, Homo sapiens
tgcatccattcctcagggaca

SEQ ID NO: 145823 - DNA, 15 bp, Homo sapiens
tgcatcgtttcatct

SEQ ID NO: 145824 - DNA, 15 bp, Homo sapiens
tgcatctcagcccac

SEQ ID NO: 145825 - DNA, 21 bp, Homo sapiens
tgcatctgtataagtaagaaa

SEQ ID NO: 145826 - DNA, 22 bp, Homo sapiens
tgcatctgtataagtaagaaaa

SEQ ID NO: 145827 - DNA, 22 bp, Homo sapiens
tgcatgcactgttccccctgtg

SEQ ID NO: 145828 - DNA, 16 bp, Homo sapiens
tgcatgctctctgcag

SEQ ID NO: 145829 - DNA, 20 bp, Homo sapiens
tgcatgtaaacacgcctgca

SEQ ID NO: 145830 - DNA, 12 bp, Homo sapiens
tgcatgtgtgcg

SEQ ID NO: 145831 - DNA, 23 bp, Homo sapiens
tgcattaccgcgttgtaaaatat

SEQ ID NO: 145832 - DNA, 14 bp, Homo sapiens
tgcattcacccaga

SEQ ID NO: 145833 - DNA, 16 bp, Homo sapiens
tgcattcttttaaaag

SEQ ID NO: 145834 - DNA, 13 bp, Homo sapiens
tgcattgaatata

SEQ ID NO: 145835 - DNA, 14 bp, Homo sapiens
tgcattgaatatat

SEQ ID NO: 145836 - DNA, 16 bp, Homo sapiens
tgcattgaatatatta

SEQ ID NO: 145837 - DNA, 13 bp, Homo sapiens
tgcatttcctgac

SEQ ID NO: 145838 - DNA, 17 bp, Homo sapiens
tgcattttcaccccacc

SEQ ID NO: 145839 - DNA, 17 bp, Homo sapiens
tgccaaacaaaaaggtt

SEQ ID NO: 145840 - DNA, 15 bp, Homo sapiens
tgccaaaggatgtga

SEQ ID NO: 145841 - DNA, 15 bp, Homo sapiens
tgccaagcacagtgc

SEQ ID NO: 145842 - DNA, 13 bp, Homo sapiens
tgccacacttcag

SEQ ID NO: 145843 - DNA, 23 bp, Homo sapiens
tgccacacttcaggctcttctcc

SEQ ID NO: 145844 - DNA, 13 bp, Homo sapiens
tgccacagcctcc

SEQ ID NO: 145845 - DNA, 18 bp, Homo sapiens
tgccaccatggccagcca

SEQ ID NO: 145846 - DNA, 10 bp, Homo sapiens
tgccacctgc

SEQ ID NO: 145847 - DNA, 13 bp, Homo sapiens
tgccactgcctct

SEQ ID NO: 145848 - DNA, 17 bp, Homo sapiens
tgccactgcctcttcct

SEQ ID NO: 145849 - DNA, 18 bp, Homo sapiens
tgccactgcctcttcctc

SEQ ID NO: 145850 - DNA, 21 bp, Homo sapiens
tgccagagacggaagcctttt

SEQ ID NO: 145851 - DNA, 15 bp, Homo sapiens
tgccagagatggagg

SEQ ID NO: 145852 - DNA, 21 bp, Homo sapiens
tgccagagatggaggttctct

SEQ ID NO: 145853 - DNA, 22 bp, Homo sapiens
tgccagcaatgacatctcaggg

SEQ ID NO: 145854 - DNA, 23 bp, Homo sapiens
tgccagccagcagccagctctca

SEQ ID NO: 145855 - DNA, 12 bp, Homo sapiens
tgccagggcagg

SEQ ID NO: 145856 - DNA, 21 bp, Homo sapiens
tgccagtaacgcgtcttcctg

SEQ ID NO: 145857 - DNA, 16 bp, Homo sapiens
tgccagtgacagacag

SEQ ID NO: 145858 - DNA, 13 bp, Homo sapiens
tgccagtgcctta

SEQ ID NO: 145859 - DNA, 20 bp, Homo sapiens
tgccagtgccttacctcctg

SEQ ID NO: 145860 - DNA, 21 bp, Homo sapiens
tgccagtgccttacctcctgc

SEQ ID NO: 145861 - DNA, 13 bp, Homo sapiens
tgccatagagttt

SEQ ID NO: 145862 - DNA, 21 bp, Homo sapiens
tgccatagagtttaacacaag

SEQ ID NO: 145863 - DNA, 13 bp, Homo sapiens
tgccatattttca

SEQ ID NO: 145864 - DNA, 17 bp, Homo sapiens
tgccatattttcaccat

SEQ ID NO: 145865 - DNA, 16 bp, Homo sapiens
tgccatcatctcctgc

SEQ ID NO: 145866 - DNA, 18 bp, Homo sapiens
tgccatctgtgggcacgc

SEQ ID NO: 145867 - DNA, 17 bp, Homo sapiens
tgccatggaggcacaca

SEQ ID NO: 145868 - DNA, 23 bp, Homo sapiens
tgccatggaggcacacagctgca

SEQ ID NO: 145869 - DNA, 20 bp, Homo sapiens
tgccatgtagggttccctta

SEQ ID NO: 145870 - DNA, 22 bp, Homo sapiens
tgcccaacctgctctcctcttg

SEQ ID NO: 145871 - DNA, 23 bp, Homo sapiens
tgcccaccaacatcccattgccc

SEQ ID NO: 145872 - DNA, 11 bp, Homo sapiens
tgcccacctgt

SEQ ID NO: 145873 - DNA, 15 bp, Homo sapiens
tgcccagaccacacg

SEQ ID NO: 145874 - DNA, 17 bp, Homo sapiens
tgcccagagatgcctcc

SEQ ID NO: 145875 - DNA, 20 bp, Homo sapiens
tgcccagagatgcctccacc

SEQ ID NO: 145876 - DNA, 18 bp, Homo sapiens
tgcccagctatacctgtg

SEQ ID NO: 145877 - DNA, 22 bp, Homo sapiens
tgcccagctatacctgtgcctc

SEQ ID NO: 145878 - DNA, 17 bp, Homo sapiens
tgcccagctcagagggt

SEQ ID NO: 145879 - DNA, 16 bp, Homo sapiens
tgcccaggagagccag

SEQ ID NO: 145880 - DNA, 18 bp, Homo sapiens
tgtctgagccctcaaagt

SEQ ID NO: 145881 - DNA, 20 bp, Homo sapiens
tgtctgagccctcaaagtga

SEQ ID NO: 145882 - DNA, 15 bp, Homo sapiens
tgtctgccagccagc

SEQ ID NO: 145883 - DNA, 14 bp, Homo sapiens
tgtctgcctcttag

SEQ ID NO: 145884 - DNA, 22 bp, Homo sapiens
tgtctggttttaacaatttcct

SEQ ID NO: 145885 - DNA, 18 bp, Homo sapiens
tgtcttcctgcattcacc

SEQ ID NO: 145886 - DNA, 23 bp, Homo sapiens
tgtcttgctatggggagaaaaga

SEQ ID NO: 145887 - DNA, 19 bp, Homo sapiens
tgtctttgttggaaaagaa

SEQ ID NO: 145888 - DNA, 21 bp, Homo sapiens
tgtgaaaagaaaaatgagcct

SEQ ID NO: 145889 - DNA, 23 bp, Homo sapiens
tgtgaaaagaaaaatgagcctgg

SEQ ID NO: 145890 - DNA, 18 bp, Homo sapiens
tgtgaaaatggtccagga

SEQ ID NO: 145891 - DNA, 14 bp, Homo sapiens
tgtgaattcagatt

SEQ ID NO: 145892 - DNA, 17 bp, Homo sapiens
tgtgacatgcgggctgg

SEQ ID NO: 145893 - DNA, 21 bp, Homo sapiens
tgtgacatgcgggctgggcag

SEQ ID NO: 145894 - DNA, 17 bp, Homo sapiens
tgtgacatttatatatt

SEQ ID NO: 145895 - DNA, 18 bp, Homo sapiens
tgtgacatttatatattg

SEQ ID NO: 145896 - DNA, 15 bp, Homo sapiens
tgtgaccaatgtctt

SEQ ID NO: 145897 - DNA, 22 bp, Homo sapiens
tgtgaccactgcagaagacagt

SEQ ID NO: 145898 - DNA, 14 bp, Homo sapiens
tgtgagaatcaaaa

SEQ ID NO: 145899 - DNA, 22 bp, Homo sapiens
tgtgagcccctggtcctgaggg

SEQ ID NO: 145900 - DNA, 15 bp, Homo sapiens
tgtgaggccagggca

SEQ ID NO: 145901 - DNA, 21 bp, Homo sapiens
tgtgagtttaccttgtatact

SEQ ID NO: 145902 - DNA, 15 bp, Homo sapiens
tgtgatatataagtg

SEQ ID NO: 145903 - DNA, 16 bp, Homo sapiens
tgtgatatataagtgt

SEQ ID NO: 145904 - DNA, 14 bp, Homo sapiens
tgtgatattaacag

SEQ ID NO: 145905 - DNA, 15 bp, Homo sapiens
tgtgatcagaccata

SEQ ID NO: 145906 - DNA, 20 bp, Homo sapiens
tgtgatctatcaatagtcaa

SEQ ID NO: 145907 - DNA, 14 bp, Homo sapiens
tgtgatgtattcta

SEQ ID NO: 145908 - DNA, 19 bp, Homo sapiens
tgtgattcctttgaagagg

SEQ ID NO: 145909 - DNA, 21 bp, Homo sapiens
tgtgattcctttgaagaggaa

SEQ ID NO: 145910 - DNA, 23 bp, Homo sapiens
tgtgatttagaactgtatgtcag

SEQ ID NO: 145911 - DNA, 17 bp, Homo sapiens
tgtgcaagtatgtgagt

SEQ ID NO: 145912 - DNA, 15 bp, Homo sapiens
tgtgcaagtgtctgt

SEQ ID NO: 145913 - DNA, 22 bp, Homo sapiens
tgtgcacacacaccacacatac

SEQ ID NO: 145914 - DNA, 22 bp, Homo sapiens
tgtgcaccttaccaactttctg

SEQ ID NO: 145915 - DNA, 21 bp, Homo sapiens
tgtgcattcttttaaaagaca

SEQ ID NO: 145916 - DNA, 22 bp, Homo sapiens
tgtgcattcttttaaaagacaa

SEQ ID NO: 145917 - DNA, 18 bp, Homo sapiens
tgtgccatagagtttaac

SEQ ID NO: 145918 - DNA, 20 bp, Homo sapiens
tgtgccatagagtttaacac

SEQ ID NO: 145919 - DNA, 22 bp, Homo sapiens
tgtgccatagagtttaacacaa

SEQ ID NO: 145920 - DNA, 12 bp, Homo sapiens
tgtgcccaagtt

SEQ ID NO: 145921 - DNA, 16 bp, Homo sapiens
tgtgcccccagacgca

SEQ ID NO: 145922 - DNA, 22 bp, Homo sapiens
tgtgcccccagacgcacgtggg

SEQ ID NO: 145923 - DNA, 13 bp, Homo sapiens
tgggggcagaggg

SEQ ID NO: 145924 - DNA, 18 bp, Homo sapiens
tgggggcagagggcagag

SEQ ID NO: 145925 - DNA, 17 bp, Homo sapiens
tgggggcagggcatgac

SEQ ID NO: 145926 - DNA, 21 bp, Homo sapiens
tggggtctccctctcctgcct

SEQ ID NO: 145927 - DNA, 15 bp, Homo sapiens
tggggtgtgggaggc

SEQ ID NO: 145928 - DNA, 14 bp, Homo sapiens
tggggttcagcccc

SEQ ID NO: 145929 - DNA, 16 bp, Homo sapiens
tgggtaactagggaag

SEQ ID NO: 145930 - DNA, 15 bp, Homo sapiens
tgggtccaggggatg

SEQ ID NO: 145931 - DNA, 20 bp, Homo sapiens
tgggtccaggggatgggagg

SEQ ID NO: 145932 - DNA, 14 bp, Homo sapiens
tgggtccatgggca

SEQ ID NO: 145933 - DNA, 22 bp, Homo sapiens
tgggtcttgttttttttttcca

SEQ ID NO: 145934 - DNA, 17 bp, Homo sapiens
tgggtgacagagcaaga

SEQ ID NO: 145935 - DNA, 23 bp, Homo sapiens
tgggtgaccagttgcacttggcc

SEQ ID NO: 145936 - DNA, 19 bp, Homo sapiens
tgggtggaaccaggaacct

SEQ ID NO: 145937 - DNA, 13 bp, Homo sapiens
tgggtggggctgc

SEQ ID NO: 145938 - DNA, 14 bp, Homo sapiens
tgggttttcttccc

SEQ ID NO: 145939 - DNA, 24 bp, Homo sapiens
tgggttttcttcccatcactggag

SEQ ID NO: 145940 - DNA, 15 bp, Homo sapiens
tgtccttgcacctgc

SEQ ID NO: 145941 - DNA, 17 bp, Homo sapiens
tgtcctttccctccact

SEQ ID NO: 145942 - DNA, 18 bp, Homo sapiens
tgtcctttccctccactc

SEQ ID NO: 145943 - DNA, 22 bp, Homo sapiens
tgtctaaaatgcctcagtgtat

SEQ ID NO: 145944 - DNA, 15 bp, Homo sapiens
tgtctaagatagtaa

SEQ ID NO: 145945 - DNA, 19 bp, Homo sapiens
tgtctacagagaacctgga

SEQ ID NO: 145946 - DNA, 20 bp, Homo sapiens
tgtctcaagagggcactggt

SEQ ID NO: 145947 - DNA, 16 bp, Homo sapiens
tgtctcatccatcatc

SEQ ID NO: 145948 - DNA, 21 bp, Homo sapiens
tgtctcatccatcatcatgtg

SEQ ID NO: 145949 - DNA, 21 bp, Homo sapiens
tgtctcctttcaccccagggc

SEQ ID NO: 145950 - DNA, 19 bp, Homo sapiens
tgtctcctttgcaggctca

SEQ ID NO: 145951 - DNA, 16 bp, Homo sapiens
tgtctgaagtcactgc

SEQ ID NO: 145952 - DNA, 20 bp, Homo sapiens
tgtctgaagtcactgcacag

SEQ ID NO: 145953 - DNA, 16 bp, Homo sapiens
tgtctgccagccagca

SEQ ID NO: 145954 - DNA, 18 bp, Homo sapiens
tgtctgccagccagcagc

SEQ ID NO: 145955 - DNA, 15 bp, Homo sapiens
tgtctgcctcttaga

SEQ ID NO: 145956 - DNA, 16 bp, Homo sapiens
tgtctggttttaacaa

SEQ ID NO: 145957 - DNA, 12 bp, Homo sapiens
tgtctgtgtgca

SEQ ID NO: 145958 - DNA, 12 bp, Homo sapiens
tgtcttaattaa

SEQ ID NO: 145959 - DNA, 14 bp, Homo sapiens
tgtcttaattaaaa

SEQ ID NO: 145960 - DNA, 14 bp, Homo sapiens
tgtcttcacaacag

SEQ ID NO: 145961 - DNA, 13 bp, Homo sapiens
tgtcttcctgcat

SEQ ID NO: 145962 - DNA, 16 bp, Homo sapiens
tgtcttctcaggctct

SEQ ID NO: 145963 - DNA, 21 bp, Homo sapiens
tgtcttctcaggctctgccct

SEQ ID NO: 145964 - DNA, 22 bp, Homo sapiens
tgtcttctcaggctctgccctg

SEQ ID NO: 145965 - DNA, 13 bp, Homo sapiens
tgtgaaaatgggt

SEQ ID NO: 145966 - DNA, 14 bp, Homo sapiens
tgtgaaatgctggc

SEQ ID NO: 145967 - DNA, 14 bp, Homo sapiens
tgtgaagagaacca

SEQ ID NO: 145968 - DNA, 21 bp, Homo sapiens
tgtgaatgttgtgatgtattc

SEQ ID NO: 145969 - DNA, 19 bp, Homo sapiens
tgtgaccagtctgaccctt

SEQ ID NO: 145970 - DNA, 21 bp, Homo sapiens
tgtgacctcaggcactagcct

SEQ ID NO: 145971 - DNA, 19 bp, Homo sapiens
tgtgacttcagctctgttt

SEQ ID NO: 145972 - DNA, 14 bp, Homo sapiens
tgtgagcaagaagt

SEQ ID NO: 145973 - DNA, 14 bp, Homo sapiens
tgtgagcccctggt

SEQ ID NO: 145974 - DNA, 17 bp, Homo sapiens
tgtgagcccctggtcct

SEQ ID NO: 145975 - DNA, 12 bp, Homo sapiens
tgtgaggcaggg

SEQ ID NO: 145976 - DNA, 14 bp, Homo sapiens
tgtgaggccagggc

SEQ ID NO: 145977 - DNA, 22 bp, Homo sapiens
tgtgaggcccctggacaagcag

SEQ ID NO: 145978 - DNA, 14 bp, Homo sapiens
tgtgaggctgtcct

SEQ ID NO: 145979 - DNA, 14 bp, Homo sapiens
tgtgagtgtgtgca

SEQ ID NO: 145980 - DNA, 19 bp, Homo sapiens
tgtgagtttaccttgtata

SEQ ID NO: 145981 - DNA, 22 bp, Homo sapiens
tgtgagtttaccttgtatactg

SEQ ID NO: 145982 - DNA, 13 bp, Homo sapiens
tgtgatatataag

SEQ ID NO: 145983 - DNA, 20 bp, Homo sapiens
tgtgatcaggctatgtatgg

SEQ ID NO: 145984 - DNA, 21 bp, Homo sapiens
tgtgatccttttatgttattt

SEQ ID NO: 145985 - DNA, 15 bp, Homo sapiens
tgtgatgaactttct

SEQ ID NO: 145986 - DNA, 14 bp, Homo sapiens
tgtgatgaatactg

SEQ ID NO: 145987 - DNA, 16 bp, Homo sapiens
tgtgatgaatactgta

SEQ ID NO: 145988 - DNA, 16 bp, Homo sapiens
tgtgatgtattctagc

SEQ ID NO: 145989 - DNA, 17 bp, Homo sapiens
tgtgatttagaactgta

SEQ ID NO: 145990 - DNA, 18 bp, Homo sapiens
tgtgcaagtatgtgagtg

SEQ ID NO: 145991 - DNA, 12 bp, Homo sapiens
tgtgcaagtgtg

SEQ ID NO: 145992 - DNA, 21 bp, Homo sapiens
tgtgcaagtgtgtgcatgtgt

SEQ ID NO: 145993 - DNA, 17 bp, Homo sapiens
tgtgcacatctgtgtct

SEQ ID NO: 145994 - DNA, 21 bp, Homo sapiens
tgtgcacatctgtgtcttgtt

SEQ ID NO: 145995 - DNA, 19 bp, Homo sapiens
tgtgcagccgctgagcgag

SEQ ID NO: 145996 - DNA, 22 bp, Homo sapiens
tgtgcatgtgtgcgagtgtgtg

SEQ ID NO: 145997 - DNA, 14 bp, Homo sapiens
tgtgcatgtgtgtg

SEQ ID NO: 145998 - DNA, 12 bp, Homo sapiens
tgtgcctctgcc

SEQ ID NO: 145999 - DNA, 15 bp, Homo sapiens
tgtgcctctgcctgt

SEQ ID NO: 146000 - DNA, 17 bp, Homo sapiens
tgtgcctctgggactgg

SEQ ID NO: 146001 - DNA, 16 bp, Homo sapiens
tgtgccttttatagct

SEQ ID NO: 146002 - DNA, 18 bp, Homo sapiens
tgtgctggaattctaaca

SEQ ID NO: 146003 - DNA, 20 bp, Homo sapiens
tgtgctggatggagcccagg

SEQ ID NO: 146004 - DNA, 21 bp, Homo sapiens
tgtgctggatggagcccaggc

SEQ ID NO: 146005 - DNA, 17 bp, Homo sapiens
tgtgctgtgcccaagtt

SEQ ID NO: 146006 - DNA, 13 bp, Homo sapiens
tgtgcttatgttt

SEQ ID NO: 146007 - DNA, 23 bp, Homo sapiens
tgtggagaaactgtagtctcagg

SEQ ID NO: 146008 - DNA, 21 bp, Homo sapiens
tgtggagaagcggctggcagc

SEQ ID NO: 146009 - DNA, 23 bp, Homo sapiens
tgtggatgagccctcagaaccct

SEQ ID NO: 146010 - DNA, 16 bp, Homo sapiens
tgtggccaaaggaggg

SEQ ID NO: 146011 - DNA, 12 bp, Homo sapiens
tgtggccctggc

SEQ ID NO: 146012 - DNA, 20 bp, Homo sapiens
tgtggccctggcctgctggg

SEQ ID NO: 146013 - DNA, 13 bp, Homo sapiens
tgtggcggtgcct

SEQ ID NO: 146014 - DNA, 14 bp, Homo sapiens
tgtggctgctagca

SEQ ID NO: 146015 - DNA, 15 bp, Homo sapiens
tgtgggaagggagag

SEQ ID NO: 146016 - DNA, 22 bp, Homo sapiens
tgtggtagggacttaaaaaact

SEQ ID NO: 146017 - DNA, 16 bp, Homo sapiens
tgtggtgctgacaaag

SEQ ID NO: 146018 - DNA, 16 bp, Homo sapiens
tgtgtaatagaaaact

SEQ ID NO: 146019 - DNA, 18 bp, Homo sapiens
tgtgtaatagaaaactga

SEQ ID NO: 146020 - DNA, 21 bp, Homo sapiens
tgtgtaatagaaaactgaaaa

SEQ ID NO: 146021 - DNA, 21 bp, Homo sapiens
tgtgtacagaattctgctacc

SEQ ID NO: 146022 - DNA, 14 bp, Homo sapiens
tgtgtatgtgcgtg

SEQ ID NO: 146023 - DNA, 19 bp, Homo sapiens
tgtgtatgtgcgtgtgtgc

SEQ ID NO: 146024 - DNA, 19 bp, Homo sapiens
tgtgtcagcatagaagtaa

SEQ ID NO: 146025 - DNA, 19 bp, Homo sapiens
tgtgtccacgactgtctcc

SEQ ID NO: 146026 - DNA, 19 bp, Homo sapiens
tgtgtcccatgatccctgt

SEQ ID NO: 146027 - DNA, 18 bp, Homo sapiens
tgtgtccccctctgtcca

SEQ ID NO: 146028 - DNA, 21 bp, Homo sapiens
tgtgtccccctctgtccaggc

SEQ ID NO: 146029 - DNA, 14 bp, Homo sapiens
tgtgtccttgcacc

SEQ ID NO: 146030 - DNA, 18 bp, Homo sapiens
tgtgtccttgcacctgca

SEQ ID NO: 146031 - DNA, 15 bp, Homo sapiens
tgtgtctaaactgca

SEQ ID NO: 146032 - DNA, 17 bp, Homo sapiens
tgtgtctaaactgcatt

SEQ ID NO: 146033 - DNA, 21 bp, Homo sapiens
tgtgtctaaactgcattaccg

SEQ ID NO: 146034 - DNA, 21 bp, Homo sapiens
tgtgtctacagagaacctgga

SEQ ID NO: 146035 - DNA, 22 bp, Homo sapiens
tgtgtgaaaggaagctccactg

SEQ ID NO: 146036 - DNA, 21 bp, Homo sapiens
tgtgtgccatagagtttaaca

SEQ ID NO: 146037 - DNA, 13 bp, Homo sapiens
tgtgttatttaaa

SEQ ID NO: 146038 - DNA, 13 bp, Homo sapiens
tgtgttgtgaatg

SEQ ID NO: 146039 - DNA, 21 bp, Homo sapiens
tgttaaaagatgaaaatattt

SEQ ID NO: 146040 - DNA, 22 bp, Homo sapiens
tgttaagttgatggtgatgaaa

SEQ ID NO: 146041 - DNA, 15 bp, Homo sapiens
tgttaattcagcact

SEQ ID NO: 146042 - DNA, 22 bp, Homo sapiens
tgttaattcagcactgatttca

SEQ ID NO: 146043 - DNA, 19 bp, Homo sapiens
tgttatcaccgtgggctcc

SEQ ID NO: 146044 - DNA, 14 bp, Homo sapiens
tgttatttatatat

SEQ ID NO: 146045 - DNA, 16 bp, Homo sapiens
tgttcaatgtttaatg

SEQ ID NO: 146046 - DNA, 15 bp, Homo sapiens
tgttcacactctcac

SEQ ID NO: 146047 - DNA, 19 bp, Homo sapiens
tgttcacactctcacatgt

SEQ ID NO: 146048 - DNA, 16 bp, Homo sapiens
tgttcacagccagact

SEQ ID NO: 146049 - DNA, 17 bp, Homo sapiens
tgttcacttttgacaaa

SEQ ID NO: 146050 - DNA, 20 bp, Homo sapiens
tgttccacaagttaaataaa

SEQ ID NO: 146051 - DNA, 22 bp, Homo sapiens
tgttccccactgacagcctccc

SEQ ID NO: 146052 - DNA, 16 bp, Homo sapiens
tgttccccctgtgcag

SEQ ID NO: 146053 - DNA, 21 bp, Homo sapiens
tgttccccttccactgagggc

SEQ ID NO: 146054 - DNA, 14 bp, Homo sapiens
tgttcctagtgaaa

SEQ ID NO: 146055 - DNA, 18 bp, Homo sapiens
tgttcctagtgaaagagg

SEQ ID NO: 146056 - DNA, 16 bp, Homo sapiens
tgttctctcttctcca

SEQ ID NO: 146057 - DNA, 23 bp, Homo sapiens
tgttgaaaaaaaagtttcagaga

SEQ ID NO: 146058 - DNA, 21 bp, Homo sapiens
tgttgaaaattattttaaaca

SEQ ID NO: 146059 - DNA, 19 bp, Homo sapiens
tgttgacatccaagcttcc

SEQ ID NO: 146060 - DNA, 18 bp, Homo sapiens
tgttgagaattgtgctca

SEQ ID NO: 146061 - DNA, 19 bp, Homo sapiens
tgttgcaagtactgctgta

SEQ ID NO: 146062 - DNA, 22 bp, Homo sapiens
tgttgccaaatatgtcctgggg

SEQ ID NO: 146063 - DNA, 14 bp, Homo sapiens
tgttgcttggacta

SEQ ID NO: 146064 - DNA, 13 bp, Homo sapiens
tgttggaaaagaa

SEQ ID NO: 146065 - DNA, 21 bp, Homo sapiens
tgttggaaaagaatacagaaa

SEQ ID NO: 146066 - DNA, 21 bp, Homo sapiens
tgttggcagtgagtgagcctg

SEQ ID NO: 146067 - DNA, 15 bp, Homo sapiens
tgttggctaatgaag

SEQ ID NO: 146068 - DNA, 18 bp, Homo sapiens
tgttgggatactgcaggg

SEQ ID NO: 146069 - DNA, 14 bp, Homo sapiens
tgttgtcagctgaa

SEQ ID NO: 146070 - DNA, 23 bp, Homo sapiens
ttcctgtccttctctcacctcct

SEQ ID NO: 146071 - DNA, 24 bp, Homo sapiens
ttcctgtccttctctcacctccta

SEQ ID NO: 146072 - DNA, 22 bp, Homo sapiens
ttcctgttgttatggaaactgt

SEQ ID NO: 146073 - DNA, 20 bp, Homo sapiens
ttccttagcttagacctcag

SEQ ID NO: 146074 - DNA, 21 bp, Homo sapiens
ttccttagcttagacctcagc

SEQ ID NO: 146075 - DNA, 15 bp, Homo sapiens
ttccttcagcttcca

SEQ ID NO: 146076 - DNA, 13 bp, Homo sapiens
ttccttccctggc

SEQ ID NO: 146077 - DNA, 14 bp, Homo sapiens
ttccttccctggct

SEQ ID NO: 146078 - DNA, 17 bp, Homo sapiens
ttccttgagaaaaacaa

SEQ ID NO: 146079 - DNA, 20 bp, Homo sapiens
ttccttggactcattttaaa

SEQ ID NO: 146080 - DNA, 21 bp, Homo sapiens
ttccttggcatgccttccagc

SEQ ID NO: 146081 - DNA, 14 bp, Homo sapiens
ttccttggggcagg

SEQ ID NO: 146082 - DNA, 17 bp, Homo sapiens
ttccttggggcaggcag

SEQ ID NO: 146083 - DNA, 18 bp, Homo sapiens
ttccttggggcaggcagt

SEQ ID NO: 146084 - DNA, 21 bp, Homo sapiens
ttcctttgtttttttttcctg

SEQ ID NO: 146085 - DNA, 21 bp, Homo sapiens
ttccttttaaaacacttccat

SEQ ID NO: 146086 - DNA, 22 bp, Homo sapiens
ttccttttaaaacacttccata

SEQ ID NO: 146087 - DNA, 20 bp, Homo sapiens
ttcgatacaccgggcctgga

SEQ ID NO: 146088 - DNA, 14 bp, Homo sapiens
ttcgccgtggctgc

SEQ ID NO: 146089 - DNA, 20 bp, Homo sapiens
ttcgggaggtcgaggcagga

SEQ ID NO: 146090 - DNA, 17 bp, Homo sapiens
ttcggggaactcctgga

SEQ ID NO: 146091 - DNA, 20 bp, Homo sapiens
ttcgtgcggaatcagcttct

SEQ ID NO: 146092 - DNA, 12 bp, Homo sapiens
ttctaaatgaat

SEQ ID NO: 146093 - DNA, 21 bp, Homo sapiens
ttctaaatgaatgtttacact

SEQ ID NO: 146094 - DNA, 15 bp, Homo sapiens
ttctaactccagtga

SEQ ID NO: 146095 - DNA, 13 bp, Homo sapiens
ttctaagaagtga

SEQ ID NO: 146096 - DNA, 17 bp, Homo sapiens
ttctaagtaaaaccaca

SEQ ID NO: 146097 - DNA, 17 bp, Homo sapiens
ttctaagtctttccatt

SEQ ID NO: 146098 - DNA, 22 bp, Homo sapiens
ttctaatatatttttatattta

SEQ ID NO: 146099 - DNA, 18 bp, Homo sapiens
ttctactttaagcactac

SEQ ID NO: 146100 - DNA, 15 bp, Homo sapiens
ttctagactttctgt

SEQ ID NO: 146101 - DNA, 22 bp, Homo sapiens
ttctagctagaaatatgatttt

SEQ ID NO: 146102 - DNA, 12 bp, Homo sapiens
ttctagctgttg

SEQ ID NO: 146103 - DNA, 17 bp, Homo sapiens
ttctattgtttattctt

SEQ ID NO: 146104 - DNA, 17 bp, Homo sapiens
ttctatttctcctccat

SEQ ID NO: 146105 - DNA, 15 bp, Homo sapiens
ttctcactccaccac

SEQ ID NO: 146106 - DNA, 19 bp, Homo sapiens
ttctcagaatctacccaaa

SEQ ID NO: 146107 - DNA, 19 bp, Homo sapiens
ttctcaggtgttgccaaat

SEQ ID NO: 146108 - DNA, 18 bp, Homo sapiens
ttctcatgtgatcctttt

SEQ ID NO: 146109 - DNA, 18 bp, Homo sapiens
ttctcattccaacagtga

SEQ ID NO: 146110 - DNA, 20 bp, Homo sapiens
ttctccaggtctcacgggca

SEQ ID NO: 146111 - DNA, 18 bp, Homo sapiens
ttctccatctggcagggt

SEQ ID NO: 146112 - DNA, 18 bp, Homo sapiens
ttctcctgacccagtccc

SEQ ID NO: 146113 - DNA, 17 bp, Homo sapiens
ttctcctttcacaacct

SEQ ID NO: 146114 - DNA, 18 bp, Homo sapiens
ttctcctttcacaacctt

SEQ ID NO: 146115 - DNA, 22 bp, Homo sapiens
ttctcctttcacaaccttctgt

SEQ ID NO: 146116 - DNA, 24 bp, Homo sapiens
ttctctaagagaacaatgtgctat

SEQ ID NO: 146117 - DNA, 17 bp, Homo sapiens
ttctctactctagggaa

SEQ ID NO: 146118 - DNA, 16 bp, Homo sapiens
ttctctgagctgtgca

SEQ ID NO: 146119 - DNA, 17 bp, Homo sapiens
ttctctgagctgtgcag

SEQ ID NO: 146120 - DNA, 10 bp, Homo sapiens
ttctctgcca

SEQ ID NO: 146121 - DNA, 19 bp, Homo sapiens
ttctctggtaatattgact

SEQ ID NO: 146122 - DNA, 15 bp, Homo sapiens
ttctcttaatttaat

SEQ ID NO: 146123 - DNA, 14 bp, Homo sapiens
ttctcttactgcaa

SEQ ID NO: 146124 - DNA, 23 bp, Homo sapiens
ttctgacatcttagtatttgcat

SEQ ID NO: 146125 - DNA, 22 bp, Homo sapiens
ttctgacttcatagatttcctt

SEQ ID NO: 146126 - DNA, 12 bp, Homo sapiens
ttctgacttgac

SEQ ID NO: 146127 - DNA, 21 bp, Homo sapiens
ttctgagaaagactattcaaa

SEQ ID NO: 146128 - DNA, 20 bp, Homo sapiens
ttctgagtgtttttactaca

SEQ ID NO: 146129 - DNA, 12 bp, Homo sapiens
ttctgattccac

SEQ ID NO: 146130 - DNA, 16 bp, Homo sapiens
ttctgcatcagctgct

SEQ ID NO: 146131 - DNA, 23 bp, Homo sapiens
ttctgcatcagctgctgaaacaa

SEQ ID NO: 146132 - DNA, 18 bp, Homo sapiens
ttctgccggccctggggc

SEQ ID NO: 146133 - DNA, 13 bp, Homo sapiens
ttctgctcatcat

SEQ ID NO: 146134 - DNA, 21 bp, Homo sapiens
ttctgctcatcattctctgtc

SEQ ID NO: 146135 - DNA, 18 bp, Homo sapiens
ttctgcttgtgttaagta

SEQ ID NO: 146136 - DNA, 15 bp, Homo sapiens
ttctggaatgtaatc

SEQ ID NO: 146137 - DNA, 21 bp, Homo sapiens
ttctgtccgagctttgaaaat

SEQ ID NO: 146138 - DNA, 20 bp, Homo sapiens
ttctgtttttctaggcctgg

SEQ ID NO: 146139 - DNA, 17 bp, Homo sapiens
ttcttaaagtcaagatt

SEQ ID NO: 146140 - DNA, 18 bp, Homo sapiens
ttcttaagacatgtatca

SEQ ID NO: 146141 - DNA, 20 bp, Homo sapiens
ttcttaaggattgtgatatt

SEQ ID NO: 146142 - DNA, 21 bp, Homo sapiens
ttcttatacatttgataaagt

SEQ ID NO: 146143 - DNA, 15 bp, Homo sapiens
ttcttatttcatttc

SEQ ID NO: 146144 - DNA, 14 bp, Homo sapiens
ttcttcagccacct

SEQ ID NO: 146145 - DNA, 23 bp, Homo sapiens
ttcttcagccacctctctttttc

SEQ ID NO: 146146 - DNA, 21 bp, Homo sapiens
ttcttcataacaattttagga

SEQ ID NO: 146147 - DNA, 14 bp, Homo sapiens
ttcttccatcccag

SEQ ID NO: 146148 - DNA, 13 bp, Homo sapiens
ttcttcctctgct

SEQ ID NO: 146149 - DNA, 20 bp, Homo sapiens
ttcttcggggaactcctgga

SEQ ID NO: 146150 - DNA, 15 bp, Homo sapiens
ttcttctcctatgtg

SEQ ID NO: 146151 - DNA, 15 bp, Homo sapiens
ttcttgaaagctgtg

SEQ ID NO: 146152 - DNA, 16 bp, Homo sapiens
ttcttggttgaggaaa

SEQ ID NO: 146153 - DNA, 22 bp, Homo sapiens
ttcttggttgaggaaacaaaca

SEQ ID NO: 146154 - DNA, 13 bp, Homo sapiens
ttcttgtcaaaaa

SEQ ID NO: 146155 - DNA, 14 bp, Homo sapiens
ttcttgtcaaaaaa

SEQ ID NO: 146156 - DNA, 12 bp, Homo sapiens
ttcttttatcac

SEQ ID NO: 146157 - DNA, 16 bp, Homo sapiens
ttctttttattttctt

SEQ ID NO: 146158 - DNA, 18 bp, Homo sapiens
ttcttttttttcattata

SEQ ID NO: 146159 - DNA, 16 bp, Homo sapiens
ttgaaaacctgacaaa

SEQ ID NO: 146160 - DNA, 15 bp, Homo sapiens
ttgaaagaaaatatg

SEQ ID NO: 146161 - DNA, 12 bp, Homo sapiens
ttgaaagctgtg

SEQ ID NO: 146162 - DNA, 19 bp, Homo sapiens
ttgaaattatgtatgttta

SEQ ID NO: 146163 - DNA, 20 bp, Homo sapiens
ttgaacaagttgtttcattg

SEQ ID NO: 146164 - DNA, 12 bp, Homo sapiens
ttgaacccagga

SEQ ID NO: 146165 - DNA, 19 bp, Homo sapiens
ttgaacccgggaggcagag

SEQ ID NO: 146166 - DNA, 19 bp, Homo sapiens
ttgaactcttcaatctctt

SEQ ID NO: 146167 - DNA, 19 bp, Homo sapiens
ttgaagtgtaggcagacac

SEQ ID NO: 146168 - DNA, 20 bp, Homo sapiens
ttgaagtgtaggcagacaca

SEQ ID NO: 146169 - DNA, 22 bp, Homo sapiens
ttgaagtgtaggcagacacagg

SEQ ID NO: 146170 - DNA, 16 bp, Homo sapiens
ttgaatatcccctccc

SEQ ID NO: 146171 - DNA, 18 bp, Homo sapiens
ttgaattgtaactgttct

SEQ ID NO: 146172 - DNA, 18 bp, Homo sapiens
ttgaattttgatgaacaa

SEQ ID NO: 146173 - DNA, 16 bp, Homo sapiens
ttgacaaaatttgttg

SEQ ID NO: 146174 - DNA, 13 bp, Homo sapiens
ttgacaaactctc

SEQ ID NO: 146175 - DNA, 19 bp, Homo sapiens
ttgacacttaaaaatggtt

SEQ ID NO: 146176 - DNA, 20 bp, Homo sapiens
ttgacataacactataaagg

SEQ ID NO: 146177 - DNA, 17 bp, Homo sapiens
ttgacccacaagaaatg

SEQ ID NO: 146178 - DNA, 17 bp, Homo sapiens
ttgactatcaaactgaa

SEQ ID NO: 146179 - DNA, 15 bp, Homo sapiens
ttgactcttttgcca

SEQ ID NO: 146180 - DNA, 21 bp, Homo sapiens
ttgactcttttgccattaaac

SEQ ID NO: 146181 - DNA, 23 bp, Homo sapiens
ttgactgggtttctctgtatagt

SEQ ID NO: 146182 - DNA, 21 bp, Homo sapiens
ttgactttcaggtactaaata

SEQ ID NO: 146183 - DNA, 10 bp, Homo sapiens
ttgagaaacc

SEQ ID NO: 146184 - DNA, 22 bp, Homo sapiens
ttgagaaaccttattgtacctc

SEQ ID NO: 146185 - DNA, 23 bp, Homo sapiens
ttgagaaaccttattgtacctct

SEQ ID NO: 146186 - DNA, 22 bp, Homo sapiens
ttgagaattgtgctcaaaattt

SEQ ID NO: 146187 - DNA, 14 bp, Homo sapiens
ttgagacctcagcc

SEQ ID NO: 146188 - DNA, 16 bp, Homo sapiens
ttgagatcagcctggg

SEQ ID NO: 146189 - DNA, 19 bp, Homo sapiens
ttgagcagtggctggtcca

SEQ ID NO: 146190 - DNA, 11 bp, Homo sapiens
ttgagcctggg

SEQ ID NO: 146191 - DNA, 14 bp, Homo sapiens
ttgagcctgggagg

SEQ ID NO: 146192 - DNA, 13 bp, Homo sapiens
ttgaggagtgtga

SEQ ID NO: 146193 - DNA, 15 bp, Homo sapiens
ttgagggcccagagc

SEQ ID NO: 146194 - DNA, 19 bp, Homo sapiens
ttgagggcccagagcagga

SEQ ID NO: 146195 - DNA, 21 bp, Homo sapiens
ttgagtgctgtctccatgttt

SEQ ID NO: 146196 - DNA, 14 bp, Homo sapiens
ttgatagctttatt

SEQ ID NO: 146197 - DNA, 22 bp, Homo sapiens
ttgatattttcaacgcagccct

SEQ ID NO: 146198 - DNA, 11 bp, Homo sapiens
ttgatgtgttt

SEQ ID NO: 146199 - DNA, 20 bp, Homo sapiens
ttgatgtgtttatttataga

SEQ ID NO: 146200 - DNA, 13 bp, Homo sapiens
ttgcaagggaaaa

SEQ ID NO: 146201 - DNA, 19 bp, Homo sapiens
ttgcaagggaaaagtctct

SEQ ID NO: 146202 - DNA, 19 bp, Homo sapiens
ttgcacacccactcagctc

SEQ ID NO: 146203 - DNA, 22 bp, Homo sapiens
ttgcaccccaaagctttcctgc

SEQ ID NO: 146204 - DNA, 16 bp, Homo sapiens
ttgcactccagcctgg

SEQ ID NO: 146205 - DNA, 17 bp, Homo sapiens
ttgcagaaaagcacctg

SEQ ID NO: 146206 - DNA, 19 bp, Homo sapiens
ttgcagaaaagcacctgcc

SEQ ID NO: 146207 - DNA, 14 bp, Homo sapiens
ttgcagagacagga

SEQ ID NO: 146208 - DNA, 19 bp, Homo sapiens
ttgcagagacaggacctga

SEQ ID NO: 146209 - DNA, 14 bp, Homo sapiens
ttgcagatgacaaa

SEQ ID NO: 146210 - DNA, 18 bp, Homo sapiens
ttgcagattcatttttct

SEQ ID NO: 146211 - DNA, 22 bp, Homo sapiens
ttgcatagtaccaatcatttta

SEQ ID NO: 146212 - DNA, 19 bp, Homo sapiens
ttgcatctgtataagtaag

SEQ ID NO: 146213 - DNA, 23 bp, Homo sapiens
ttgcatctgtataagtaagaaaa

SEQ ID NO: 146214 - DNA, 14 bp, Homo sapiens
ttgcatgatgtatt

SEQ ID NO: 146215 - DNA, 17 bp, Homo sapiens
ttgccaaatatgtcctg

SEQ ID NO: 146216 - DNA, 22 bp, Homo sapiens
ttgccagacatgtggtgggaca

SEQ ID NO: 146217 - DNA, 14 bp, Homo sapiens
tctcactccaccac

SEQ ID NO: 146218 - DNA, 12 bp, Homo sapiens
tctcagaatcta

SEQ ID NO: 146219 - DNA, 19 bp, Homo sapiens
tctcagaatctacccaaag

SEQ ID NO: 146220 - DNA, 21 bp, Homo sapiens
tctcaggaaatcaaatatgca

SEQ ID NO: 146221 - DNA, 23 bp, Homo sapiens
tctcaggaaatcaaatatgcaaa

SEQ ID NO: 146222 - DNA, 23 bp, Homo sapiens
tctcaggaccaaagctttcatgt

SEQ ID NO: 146223 - DNA, 16 bp, Homo sapiens
tctcaggacctaggga

SEQ ID NO: 146224 - DNA, 20 bp, Homo sapiens
tctcaggatcaagaaagtgt

SEQ ID NO: 146225 - DNA, 12 bp, Homo sapiens
tctcagggcctg

SEQ ID NO: 146226 - DNA, 15 bp, Homo sapiens
tctcagggcctggtc

SEQ ID NO: 146227 - DNA, 17 bp, Homo sapiens
tctcaggggccagagga

SEQ ID NO: 146228 - DNA, 20 bp, Homo sapiens
tctcaggggccagaggaact

SEQ ID NO: 146229 - DNA, 13 bp, Homo sapiens
tctcatccatcat

SEQ ID NO: 146230 - DNA, 14 bp, Homo sapiens
tctcatgtgatcct

SEQ ID NO: 146231 - DNA, 16 bp, Homo sapiens
tctcatgtgatccttt

SEQ ID NO: 146232 - DNA, 14 bp, Homo sapiens
tctcattccccagg

SEQ ID NO: 146233 - DNA, 15 bp, Homo sapiens
tctcattgcttacaa

SEQ ID NO: 146234 - DNA, 19 bp, Homo sapiens
tctcattggacccttccat

SEQ ID NO: 146235 - DNA, 12 bp, Homo sapiens
tctccacctcag

SEQ ID NO: 146236 - DNA, 13 bp, Homo sapiens
tctccacctcagc

SEQ ID NO: 146237 - DNA, 14 bp, Homo sapiens
tctccacctcagcc

SEQ ID NO: 146238 - DNA, 16 bp, Homo sapiens
tctccacctcagcctt

SEQ ID NO: 146239 - DNA, 13 bp, Homo sapiens
tctccacctgctc

SEQ ID NO: 146240 - DNA, 13 bp, Homo sapiens
tctccactccaga

SEQ ID NO: 146241 - DNA, 14 bp, Homo sapiens
tctccactgccttc

SEQ ID NO: 146242 - DNA, 15 bp, Homo sapiens
tctccagttttcagt

SEQ ID NO: 146243 - DNA, 13 bp, Homo sapiens
tctccatccacat

SEQ ID NO: 146244 - DNA, 17 bp, Homo sapiens
tctccatctggcagggt

SEQ ID NO: 146245 - DNA, 14 bp, Homo sapiens
tctcccacgtggga

SEQ ID NO: 146246 - DNA, 16 bp, Homo sapiens
tctcccagataatgtg

SEQ ID NO: 146247 - DNA, 13 bp, Homo sapiens
tctcccaggccag

SEQ ID NO: 146248 - DNA, 14 bp, Homo sapiens
tctcccaggccagg

SEQ ID NO: 146249 - DNA, 14 bp, Homo sapiens
tctcccctgccctg

SEQ ID NO: 146250 - DNA, 15 bp, Homo sapiens
tctcccctgccctgc

SEQ ID NO: 146251 - DNA, 14 bp, Homo sapiens
tctccctgccgcct

SEQ ID NO: 146252 - DNA, 19 bp, Homo sapiens
tctcctatgtgtaaggtga

SEQ ID NO: 146253 - DNA, 16 bp, Homo sapiens
tctcctccatgggaga

SEQ ID NO: 146254 - DNA, 20 bp, Homo sapiens
tctcctccatgggagaaaat

SEQ ID NO: 146255 - DNA, 14 bp, Homo sapiens
tctcctcggccccc

SEQ ID NO: 146256 - DNA, 21 bp, Homo sapiens
tctcctcggccccctccatcg

SEQ ID NO: 146257 - DNA, 13 bp, Homo sapiens
tctcctctcccct

SEQ ID NO: 146258 - DNA, 16 bp, Homo sapiens
tctcctgacccagtcc

SEQ ID NO: 146259 - DNA, 17 bp, Homo sapiens
tctcctgacccagtccc

SEQ ID NO: 146260 - DNA, 11 bp, Homo sapiens
tctcctgccta

SEQ ID NO: 146261 - DNA, 12 bp, Homo sapiens
tctcctgcctac

SEQ ID NO: 146262 - DNA, 17 bp, Homo sapiens
tctcctgcctactcacg

SEQ ID NO: 146263 - DNA, 13 bp, Homo sapiens
tctcctgcctgta

SEQ ID NO: 146264 - DNA, 20 bp, Homo sapiens
tctcctgcctgtagcagtga

SEQ ID NO: 146265 - DNA, 17 bp, Homo sapiens
tctcctgccttcctcct

SEQ ID NO: 146266 - DNA, 14 bp, Homo sapiens
tctcctgtttttct

SEQ ID NO: 146267 - DNA, 23 bp, Homo sapiens
tctcgaacatggaactcattcct

SEQ ID NO: 146268 - DNA, 19 bp, Homo sapiens
tctcggagtatctgggaac

SEQ ID NO: 146269 - DNA, 13 bp, Homo sapiens
tctctcctgtcca

SEQ ID NO: 146270 - DNA, 14 bp, Homo sapiens
tctctcctgtccaa

SEQ ID NO: 146271 - DNA, 23 bp, Homo sapiens
tctctcggagtatctgggaactg

SEQ ID NO: 146272 - DNA, 11 bp, Homo sapiens
tctctctcctg

SEQ ID NO: 146273 - DNA, 17 bp, Homo sapiens
tctctgcagccagccca

SEQ ID NO: 146274 - DNA, 23 bp, Homo sapiens
tctctgctctgcgtgtcacctgt

SEQ ID NO: 146275 - DNA, 14 bp, Homo sapiens
tctctgctggccca

SEQ ID NO: 146276 - DNA, 15 bp, Homo sapiens
tctctggccccaagg

SEQ ID NO: 146277 - DNA, 14 bp, Homo sapiens
tctctgtctcatcc

SEQ ID NO: 146278 - DNA, 15 bp, Homo sapiens
tctctgtctcatcca

SEQ ID NO: 146279 - DNA, 23 bp, Homo sapiens
tctctgtgaacgatttagaaaga

SEQ ID NO: 146280 - DNA, 19 bp, Homo sapiens
tctctgtgcttcaattaat

SEQ ID NO: 146281 - DNA, 13 bp, Homo sapiens
tctcttactgcaa

SEQ ID NO: 146282 - DNA, 19 bp, Homo sapiens
tctcttactgcaaatgtca

SEQ ID NO: 146283 - DNA, 15 bp, Homo sapiens
tctcttatagaatat

SEQ ID NO: 146284 - DNA, 20 bp, Homo sapiens
tctcttatagaatatttatt

SEQ ID NO: 146285 - DNA, 18 bp, Homo sapiens
tctcttcacagtcacatt

SEQ ID NO: 146286 - DNA, 17 bp, Homo sapiens
tctcttccatatgacct

SEQ ID NO: 146287 - DNA, 21 bp, Homo sapiens
tctcttccatatgacctcatg

SEQ ID NO: 146288 - DNA, 13 bp, Homo sapiens
tctcttctccact

SEQ ID NO: 146289 - DNA, 15 bp, Homo sapiens
tctcttctccactgg

SEQ ID NO: 146290 - DNA, 17 bp, Homo sapiens
tctcttggtttccttcc

SEQ ID NO: 146291 - DNA, 16 bp, Homo sapiens
tctctttgggaatgtt

SEQ ID NO: 146292 - DNA, 20 bp, Homo sapiens
tctcttttgaatccatgctt

SEQ ID NO: 146293 - DNA, 13 bp, Homo sapiens
tctctttttcagt

SEQ ID NO: 146294 - DNA, 18 bp, Homo sapiens
tctctttttgctttcgaa

SEQ ID NO: 146295 - DNA, 12 bp, Homo sapiens
tctgaaagccac

SEQ ID NO: 146296 - DNA, 15 bp, Homo sapiens
tctgaagtcactgca

SEQ ID NO: 146297 - DNA, 14 bp, Homo sapiens
tctgacccagtgag

SEQ ID NO: 146298 - DNA, 23 bp, Homo sapiens
tctgacccttacagcctctgact

SEQ ID NO: 146299 - DNA, 15 bp, Homo sapiens
tctgactctcaaatc

SEQ ID NO: 146300 - DNA, 21 bp, Homo sapiens
tctgagaaagactattcaaac

SEQ ID NO: 146301 - DNA, 12 bp, Homo sapiens
tctgagaatctt

SEQ ID NO: 146302 - DNA, 23 bp, Homo sapiens
tctgagaatctttattgagaaag

SEQ ID NO: 146303 - DNA, 17 bp, Homo sapiens
tctgagccctcaaagtg

SEQ ID NO: 146304 - DNA, 18 bp, Homo sapiens
tctgagccctcaaagtga

SEQ ID NO: 146305 - DNA, 15 bp, Homo sapiens
tctgagtttcattct

SEQ ID NO: 146306 - DNA, 11 bp, Homo sapiens
tctgattccac

SEQ ID NO: 146307 - DNA, 22 bp, Homo sapiens
tctgcaaaatgaggaatgtata

SEQ ID NO: 146308 - DNA, 20 bp, Homo sapiens
tctgcaagaattgaagcagg

SEQ ID NO: 146309 - DNA, 21 bp, Homo sapiens
tctgcaatgggcactgggatg

SEQ ID NO: 146310 - DNA, 15 bp, Homo sapiens
tctgcacccccctgg

SEQ ID NO: 146311 - DNA, 17 bp, Homo sapiens
tctgcacccccctgggc

SEQ ID NO: 146312 - DNA, 15 bp, Homo sapiens
tctgcagaaggaaaa

SEQ ID NO: 146313 - DNA, 21 bp, Homo sapiens
tctgcagaaggaaaaatgtgt

SEQ ID NO: 146314 - DNA, 23 bp, Homo sapiens
tctgcagaaggaaaaatgtgtaa

SEQ ID NO: 146315 - DNA, 16 bp, Homo sapiens
tctgcagccagcccag

SEQ ID NO: 146316 - DNA, 18 bp, Homo sapiens
tctgcagccagcccagcc

SEQ ID NO: 146317 - DNA, 16 bp, Homo sapiens
tctgcaggcagacacg

SEQ ID NO: 146318 - DNA, 14 bp, Homo sapiens
tctgcaggcagggc

SEQ ID NO: 146319 - DNA, 19 bp, Homo sapiens
tctgcatcagctgctgaaa

SEQ ID NO: 146320 - DNA, 17 bp, Homo sapiens
tctgcattcaggatcaa

SEQ ID NO: 146321 - DNA, 17 bp, Homo sapiens
tctgcattttcacccca

SEQ ID NO: 146322 - DNA, 14 bp, Homo sapiens
tctgccacctcccc

SEQ ID NO: 146323 - DNA, 15 bp, Homo sapiens
tctgccacctcccct

SEQ ID NO: 146324 - DNA, 23 bp, Homo sapiens
tctgccacctcccctatccaccc

SEQ ID NO: 146325 - DNA, 14 bp, Homo sapiens
tctgccaggccccc

SEQ ID NO: 146326 - DNA, 13 bp, Homo sapiens
tctgccagtgaca

SEQ ID NO: 146327 - DNA, 15 bp, Homo sapiens
tctgcctcctcttca

SEQ ID NO: 146328 - DNA, 14 bp, Homo sapiens
tctgcctctgcctg

SEQ ID NO: 146329 - DNA, 16 bp, Homo sapiens
tctgcggaccccagct

SEQ ID NO: 146330 - DNA, 19 bp, Homo sapiens
tctgcgtgtcacctgtgct

SEQ ID NO: 146331 - DNA, 22 bp, Homo sapiens
tctgctaacttggagccccagt

SEQ ID NO: 146332 - DNA, 22 bp, Homo sapiens
tctgctaagctcaaggcgtgag

SEQ ID NO: 146333 - DNA, 14 bp, Homo sapiens
tctgctctttctct

SEQ ID NO: 146334 - DNA, 16 bp, Homo sapiens
tctgctctttctctgc

SEQ ID NO: 146335 - DNA, 17 bp, Homo sapiens
tctgctctttctctgcc

SEQ ID NO: 146336 - DNA, 12 bp, Homo sapiens
tctgctggccca

SEQ ID NO: 146337 - DNA, 13 bp, Homo sapiens
tctgcttcagtgg

SEQ ID NO: 146338 - DNA, 14 bp, Homo sapiens
tctgcttgtgttaa

SEQ ID NO: 146339 - DNA, 13 bp, Homo sapiens
tctggaagagagg

SEQ ID NO: 146340 - DNA, 18 bp, Homo sapiens
tctggaatgtaatcaatg

SEQ ID NO: 146341 - DNA, 15 bp, Homo sapiens
tctggactcctctgt

SEQ ID NO: 146342 - DNA, 18 bp, Homo sapiens
tctggactcctctgtcca

SEQ ID NO: 146343 - DNA, 19 bp, Homo sapiens
tctggactgccccagaaaa

SEQ ID NO: 146344 - DNA, 15 bp, Homo sapiens
tctggagaagcagtg

SEQ ID NO: 146345 - DNA, 20 bp, Homo sapiens
tctggcagggtgggatggag

SEQ ID NO: 146346 - DNA, 23 bp, Homo sapiens
tctggccctcacccctgccctgg

SEQ ID NO: 146347 - DNA, 13 bp, Homo sapiens
tctggccctgcct

SEQ ID NO: 146348 - DNA, 13 bp, Homo sapiens
tctggctctgtct

SEQ ID NO: 146349 - DNA, 18 bp, Homo sapiens
tctgggaaataagagaga

SEQ ID NO: 146350 - DNA, 18 bp, Homo sapiens
tctgggaactgtgccttt

SEQ ID NO: 146351 - DNA, 15 bp, Homo sapiens
tctgggaccctttcc

SEQ ID NO: 146352 - DNA, 19 bp, Homo sapiens
tctgggaccctttccttcc

SEQ ID NO: 146353 - DNA, 16 bp, Homo sapiens
tctgggacctcagttt

SEQ ID NO: 146354 - DNA, 19 bp, Homo sapiens
tctgggctgtctattctag

SEQ ID NO: 146355 - DNA, 19 bp, Homo sapiens
tctgggcttggggcttcct

SEQ ID NO: 146356 - DNA, 21 bp, Homo sapiens
tctgggcttggggcttcctaa

SEQ ID NO: 146357 - DNA, 15 bp, Homo sapiens
tctggggctctggga

SEQ ID NO: 146358 - DNA, 16 bp, Homo sapiens
tctggggctctgggat

SEQ ID NO: 146359 - DNA, 16 bp, Homo sapiens
tctggggttcagcccc

SEQ ID NO: 146360 - DNA, 23 bp, Homo sapiens
tctggggttcagcccctcctctg

SEQ ID NO: 146361 - DNA, 13 bp, Homo sapiens
tctgggtggcctc

SEQ ID NO: 146362 - DNA, 15 bp, Homo sapiens
tctgtaaactcaaaa

SEQ ID NO: 146363 - DNA, 21 bp, Homo sapiens
tctgtataagtaagaaaatat

SEQ ID NO: 146364 - DNA, 14 bp, Homo sapiens
tctgtatactgtgg

SEQ ID NO: 146365 - DNA, 23 bp, Homo sapiens
tctgtatttccccaacatgtaat

SEQ ID NO: 146366 - DNA, 13 bp, Homo sapiens
tctgtccagggcc

SEQ ID NO: 146367 - DNA, 14 bp, Homo sapiens
tgaagttaacagag

SEQ ID NO: 146368 - DNA, 18 bp, Homo sapiens
tgaagttgttactaacta

SEQ ID NO: 146369 - DNA, 14 bp, Homo sapiens
tgaagtttacattg

SEQ ID NO: 146370 - DNA, 20 bp, Homo sapiens
tgaagtttacattgtaaata

SEQ ID NO: 146371 - DNA, 20 bp, Homo sapiens
tgaataaagcctgcttttta

SEQ ID NO: 146372 - DNA, 13 bp, Homo sapiens
tgaataaatgtct

SEQ ID NO: 146373 - DNA, 15 bp, Homo sapiens
tgaataaatgtcttg

SEQ ID NO: 146374 - DNA, 12 bp, Homo sapiens
tgaataatacag

SEQ ID NO: 146375 - DNA, 16 bp, Homo sapiens
tgaatactgtattttg

SEQ ID NO: 146376 - DNA, 16 bp, Homo sapiens
tgaatatcccctccca

SEQ ID NO: 146377 - DNA, 18 bp, Homo sapiens
tgaatattgttcatattg

SEQ ID NO: 146378 - DNA, 16 bp, Homo sapiens
tgaatcagaccctacc

SEQ ID NO: 146379 - DNA, 20 bp, Homo sapiens
tgaatgaatggctaagcaaa

SEQ ID NO: 146380 - DNA, 15 bp, Homo sapiens
tgaatgacaacagaa

SEQ ID NO: 146381 - DNA, 17 bp, Homo sapiens
tgaatgacaacagaagc

SEQ ID NO: 146382 - DNA, 16 bp, Homo sapiens
tgaatgattcagtgtt

SEQ ID NO: 146383 - DNA, 14 bp, Homo sapiens
tgaatgcataaaat

SEQ ID NO: 146384 - DNA, 16 bp, Homo sapiens
tgaatgcataaaatgt

SEQ ID NO: 146385 - DNA, 12 bp, Homo sapiens
tgaatgcttttt

SEQ ID NO: 146386 - DNA, 23 bp, Homo sapiens
tgaatgctttttgaatgttattt

SEQ ID NO: 146387 - DNA, 15 bp, Homo sapiens
tgaatgttatttgtt

SEQ ID NO: 146388 - DNA, 22 bp, Homo sapiens
tgaattaatatccctacatgta

SEQ ID NO: 146389 - DNA, 23 bp, Homo sapiens
tgaattagaaacataaataaaat

SEQ ID NO: 146390 - DNA, 18 bp, Homo sapiens
tgacaaaatttgttgaaa

SEQ ID NO: 146391 - DNA, 23 bp, Homo sapiens
tgacaaatgtgtatcggatgctt

SEQ ID NO: 146392 - DNA, 16 bp, Homo sapiens
tgacaaccactggtct

SEQ ID NO: 146393 - DNA, 17 bp, Homo sapiens
tgacaaccactggtctg

SEQ ID NO: 146394 - DNA, 22 bp, Homo sapiens
tgacaacttcccagtgaattct

SEQ ID NO: 146395 - DNA, 22 bp, Homo sapiens
tgacactcccttgggctccctg

SEQ ID NO: 146396 - DNA, 14 bp, Homo sapiens
tgacagacaggctc

SEQ ID NO: 146397 - DNA, 18 bp, Homo sapiens
tgacagagcaagactctg

SEQ ID NO: 146398 - DNA, 19 bp, Homo sapiens
tgacagcctcccaccccca

SEQ ID NO: 146399 - DNA, 12 bp, Homo sapiens
tgacagctgtcc

SEQ ID NO: 146400 - DNA, 14 bp, Homo sapiens
tgacagctgtccct

SEQ ID NO: 146401 - DNA, 16 bp, Homo sapiens
tgacagctgtccctgt

SEQ ID NO: 146402 - DNA, 18 bp, Homo sapiens
tgacagctgtccctgtca

SEQ ID NO: 146403 - DNA, 13 bp, Homo sapiens
tgacatccaagct

SEQ ID NO: 146404 - DNA, 14 bp, Homo sapiens
tgacatctcagggg

SEQ ID NO: 146405 - DNA, 18 bp, Homo sapiens
tgacatctcaggggccag

SEQ ID NO: 146406 - DNA, 12 bp, Homo sapiens
tgacatctcttt

SEQ ID NO: 146407 - DNA, 14 bp, Homo sapiens
tgacatctctttga

SEQ ID NO: 146408 - DNA, 19 bp, Homo sapiens
tgacatgcgggctgggcag

SEQ ID NO: 146409 - DNA, 20 bp, Homo sapiens
tgacatgcgggctgggcagc

SEQ ID NO: 146410 - DNA, 21 bp, Homo sapiens
tgacatgcgggctgggcagct

SEQ ID NO: 146411 - DNA, 22 bp, Homo sapiens
tgacatgcgggctgggcagctg

SEQ ID NO: 146412 - DNA, 18 bp, Homo sapiens
tgacatgtggggccaggt

SEQ ID NO: 146413 - DNA, 19 bp, Homo sapiens
tgacatgtggggccaggtc

SEQ ID NO: 146414 - DNA, 20 bp, Homo sapiens
tgacatttatatattgaatt

SEQ ID NO: 146415 - DNA, 18 bp, Homo sapiens
tgacatttatttttcatt

SEQ ID NO: 146416 - DNA, 21 bp, Homo sapiens
tgacatttatttttcatttag

SEQ ID NO: 146417 - DNA, 17 bp, Homo sapiens
tgaccaacatggagaaa

SEQ ID NO: 146418 - DNA, 18 bp, Homo sapiens
tgaccaacatggagaaac

SEQ ID NO: 146419 - DNA, 15 bp, Homo sapiens
tgaccaagcaggaag

SEQ ID NO: 146420 - DNA, 18 bp, Homo sapiens
tgaccaagcaggaagctc

SEQ ID NO: 146421 - DNA, 21 bp, Homo sapiens
tgaccaagcaggaagctcaga

SEQ ID NO: 146422 - DNA, 15 bp, Homo sapiens
tgaccaatgtcttga

SEQ ID NO: 146423 - DNA, 22 bp, Homo sapiens
tgaccacgctttctagctgttg

SEQ ID NO: 146424 - DNA, 15 bp, Homo sapiens
tgaccactctgtctt

SEQ ID NO: 146425 - DNA, 20 bp, Homo sapiens
tgaccactgcagaagacagt

SEQ ID NO: 146426 - DNA, 22 bp, Homo sapiens
tgaccagcctccatgctgcctc

SEQ ID NO: 146427 - DNA, 16 bp, Homo sapiens
tgaccagtctgaccct

SEQ ID NO: 146428 - DNA, 17 bp, Homo sapiens
tgacccacaagaaatga

SEQ ID NO: 146429 - DNA, 21 bp, Homo sapiens
tgacccagtccccgtgccccg

SEQ ID NO: 146430 - DNA, 14 bp, Homo sapiens
tgacccagtccctg

SEQ ID NO: 146431 - DNA, 21 bp, Homo sapiens
tgacccctcctcactggccat

SEQ ID NO: 146432 - DNA, 18 bp, Homo sapiens
tgaccctctccaccccat

SEQ ID NO: 146433 - DNA, 22 bp, Homo sapiens
tgacctcatgcatctccacctg

SEQ ID NO: 146434 - DNA, 14 bp, Homo sapiens
tgacctccctctaa

SEQ ID NO: 146435 - DNA, 15 bp, Homo sapiens
tgacctgaggaagcg

SEQ ID NO: 146436 - DNA, 21 bp, Homo sapiens
tgacctgctgggtaaactgtg

SEQ ID NO: 146437 - DNA, 20 bp, Homo sapiens
tgaccttgaactcctgggct

SEQ ID NO: 146438 - DNA, 15 bp, Homo sapiens
tgacgacaagtgctg

SEQ ID NO: 146439 - DNA, 19 bp, Homo sapiens
tgacggatgattggattat

SEQ ID NO: 146440 - DNA, 13 bp, Homo sapiens
tgactcacccaag

SEQ ID NO: 146441 - DNA, 13 bp, Homo sapiens
tgactcagggctc

SEQ ID NO: 146442 - DNA, 21 bp, Homo sapiens
tgactcgtatatgtctcaggt

SEQ ID NO: 146443 - DNA, 20 bp, Homo sapiens
tgactcttgttttcagtttc

SEQ ID NO: 146444 - DNA, 22 bp, Homo sapiens
tgactctttttagggccaggca

SEQ ID NO: 146445 - DNA, 19 bp, Homo sapiens
tgactgccccaactcctgg

SEQ ID NO: 146446 - DNA, 21 bp, Homo sapiens
tgactgctccccagccctggc

SEQ ID NO: 146447 - DNA, 23 bp, Homo sapiens
tgactgctccccagccctggctc

SEQ ID NO: 146448 - DNA, 22 bp, Homo sapiens
tgactgtactcctcccaggcgc

SEQ ID NO: 146449 - DNA, 14 bp, Homo sapiens
tgacttccacacct

SEQ ID NO: 146450 - DNA, 15 bp, Homo sapiens
tgacttctaagtaaa

SEQ ID NO: 146451 - DNA, 22 bp, Homo sapiens
tgacttctaagtaaaaccacag

SEQ ID NO: 146452 - DNA, 24 bp, Homo sapiens
tgacttctaagtaaaaccacagca

SEQ ID NO: 146453 - DNA, 23 bp, Homo sapiens
tgacttctccaggtctcacgggc

SEQ ID NO: 146454 - DNA, 19 bp, Homo sapiens
tgacttgtatattttaaga

SEQ ID NO: 146455 - DNA, 15 bp, Homo sapiens
tgacttgtgtcccat

SEQ ID NO: 146456 - DNA, 19 bp, Homo sapiens
tgactttagtctgcaaaat

SEQ ID NO: 146457 - DNA, 16 bp, Homo sapiens
tgactttgctctttct

SEQ ID NO: 146458 - DNA, 16 bp, Homo sapiens
tgagaaaaagctcctg

SEQ ID NO: 146459 - DNA, 17 bp, Homo sapiens
tgagaaaaagctcctgt

SEQ ID NO: 146460 - DNA, 12 bp, Homo sapiens
tgagaaaacatg

SEQ ID NO: 146461 - DNA, 23 bp, Homo sapiens
tgagaaaccttattgtacctctc

SEQ ID NO: 146462 - DNA, 18 bp, Homo sapiens
tgagaaagactattcaaa

SEQ ID NO: 146463 - DNA, 14 bp, Homo sapiens
tgagaaagagcact

SEQ ID NO: 146464 - DNA, 19 bp, Homo sapiens
tgagaactactcagggaat

SEQ ID NO: 146465 - DNA, 12 bp, Homo sapiens
tgagaaggagag

SEQ ID NO: 146466 - DNA, 16 bp, Homo sapiens
tgagaatcaaaactct

SEQ ID NO: 146467 - DNA, 20 bp, Homo sapiens
tgagaatctttattgagaaa

SEQ ID NO: 146468 - DNA, 15 bp, Homo sapiens
tgagaattttaaatt

SEQ ID NO: 146469 - DNA, 12 bp, Homo sapiens
tgagacagctct

SEQ ID NO: 146470 - DNA, 14 bp, Homo sapiens
tgagaccaacctgg

SEQ ID NO: 146471 - DNA, 14 bp, Homo sapiens
tgagaccactgtta

SEQ ID NO: 146472 - DNA, 20 bp, Homo sapiens
tgagacccagccctcatccc

SEQ ID NO: 146473 - DNA, 23 bp, Homo sapiens
tgagacgtttttggaagagtagt

SEQ ID NO: 146474 - DNA, 20 bp, Homo sapiens
tgagactctgtctcagtcca

SEQ ID NO: 146475 - DNA, 18 bp, Homo sapiens
tgagagaataagtcatgt

SEQ ID NO: 146476 - DNA, 20 bp, Homo sapiens
tgagagacccaaggaggaaa

SEQ ID NO: 146477 - DNA, 21 bp, Homo sapiens
tgagataccagcgaggaggct

SEQ ID NO: 146478 - DNA, 17 bp, Homo sapiens
tgagatgctggagaaga

SEQ ID NO: 146479 - DNA, 19 bp, Homo sapiens
tgagattacagaggaagtt

SEQ ID NO: 146480 - DNA, 15 bp, Homo sapiens
tgagcaaatgtggct

SEQ ID NO: 146481 - DNA, 16 bp, Homo sapiens
tgagcaaatgtggctc

SEQ ID NO: 146482 - DNA, 13 bp, Homo sapiens
tgagcaccagggg

SEQ ID NO: 146483 - DNA, 14 bp, Homo sapiens
tgagcaccagggga

SEQ ID NO: 146484 - DNA, 17 bp, Homo sapiens
tgagcaccgtcatggct

SEQ ID NO: 146485 - DNA, 23 bp, Homo sapiens
tgagcactcccaagtctacagag

SEQ ID NO: 146486 - DNA, 17 bp, Homo sapiens
tgagcagactggtgagc

SEQ ID NO: 146487 - DNA, 23 bp, Homo sapiens
tgagcagactggtgagcagactg

SEQ ID NO: 146488 - DNA, 15 bp, Homo sapiens
tgagcaggattttaa

SEQ ID NO: 146489 - DNA, 12 bp, Homo sapiens
tgagccaccacg

SEQ ID NO: 146490 - DNA, 22 bp, Homo sapiens
tgagccccgcagacctccccag

SEQ ID NO: 146491 - DNA, 13 bp, Homo sapiens
tgagcccctggga

SEQ ID NO: 146492 - DNA, 15 bp, Homo sapiens
tgagcccctggtcct

SEQ ID NO: 146493 - DNA, 17 bp, Homo sapiens
tgagcccggatgcttct

SEQ ID NO: 146494 - DNA, 16 bp, Homo sapiens
tgagccctcaaagtga

SEQ ID NO: 146495 - DNA, 12 bp, Homo sapiens
tgagccctcaga

SEQ ID NO: 146496 - DNA, 17 bp, Homo sapiens
tgagccgcatcttctcc

SEQ ID NO: 146497 - DNA, 21 bp, Homo sapiens
tgagccgcatcttctccatct

SEQ ID NO: 146498 - DNA, 13 bp, Homo sapiens
tgagcgacagtga

SEQ ID NO: 146499 - DNA, 14 bp, Homo sapiens
tgagcgacagtgag

SEQ ID NO: 146500 - DNA, 20 bp, Homo sapiens
tgagcgacagtgagactctg

SEQ ID NO: 146501 - DNA, 22 bp, Homo sapiens
tgagcgaggagatgctccttgg

SEQ ID NO: 146502 - DNA, 21 bp, Homo sapiens
tgagctatttccattccagaa

SEQ ID NO: 146503 - DNA, 15 bp, Homo sapiens
tgagctccccaccac

SEQ ID NO: 146504 - DNA, 20 bp, Homo sapiens
tgagctccccaccaccccag

SEQ ID NO: 146505 - DNA, 14 bp, Homo sapiens
tgagctcggtggac

SEQ ID NO: 146506 - DNA, 21 bp, Homo sapiens
tgagctcggtggacccaggga

SEQ ID NO: 146507 - DNA, 17 bp, Homo sapiens
tgagctctacccagggc

SEQ ID NO: 146508 - DNA, 17 bp, Homo sapiens
tgagctgagatcgtgcc

SEQ ID NO: 146509 - DNA, 17 bp, Homo sapiens
tgaggaagcgtgaaggc

SEQ ID NO: 146510 - DNA, 14 bp, Homo sapiens
tggaggaggaggca

SEQ ID NO: 146511 - DNA, 17 bp, Homo sapiens
tggaggcacacagctgc

SEQ ID NO: 146512 - DNA, 19 bp, Homo sapiens
tggaggcacacagctgcag

SEQ ID NO: 146513 - DNA, 22 bp, Homo sapiens
tggaggcacacagctgcagaga

SEQ ID NO: 146514 - DNA, 22 bp, Homo sapiens
tggaggcagggccttgcccaga

SEQ ID NO: 146515 - DNA, 15 bp, Homo sapiens
tggaggccagccagt

SEQ ID NO: 146516 - DNA, 19 bp, Homo sapiens
tggaggccgggtgctcagg

SEQ ID NO: 146517 - DNA, 23 bp, Homo sapiens
tggaggctgtcttctcaggctct

SEQ ID NO: 146518 - DNA, 13 bp, Homo sapiens
tggaggtgggagc

SEQ ID NO: 146519 - DNA, 18 bp, Homo sapiens
tggaggtgggagcaggag

SEQ ID NO: 146520 - DNA, 20 bp, Homo sapiens
tggaggtgggagcaggagat

SEQ ID NO: 146521 - DNA, 19 bp, Homo sapiens
tggaggttaaggctgagga

SEQ ID NO: 146522 - DNA, 21 bp, Homo sapiens
tggaggttgcagtgagccaag

SEQ ID NO: 146523 - DNA, 19 bp, Homo sapiens
tgggttttgtattctctga

SEQ ID NO: 146524 - DNA, 21 bp, Homo sapiens
tggtaattatcattttagaag

SEQ ID NO: 146525 - DNA, 18 bp, Homo sapiens
tggtacggagatgtttca

SEQ ID NO: 146526 - DNA, 20 bp, Homo sapiens
tggtagaattggagagtaaa

SEQ ID NO: 146527 - DNA, 19 bp, Homo sapiens
tggtcacaggactctgcct

SEQ ID NO: 146528 - DNA, 23 bp, Homo sapiens
tggtcacaggactctgcctcctc

SEQ ID NO: 146529 - DNA, 13 bp, Homo sapiens
tggtcactgccat

SEQ ID NO: 146530 - DNA, 22 bp, Homo sapiens
tggtccagcttgctcttcagtg

SEQ ID NO: 146531 - DNA, 16 bp, Homo sapiens
tggtccaggagaaggc

SEQ ID NO: 146532 - DNA, 15 bp, Homo sapiens
tggtccggtgtcctt

SEQ ID NO: 146533 - DNA, 17 bp, Homo sapiens
tggtcttggcagcacct

SEQ ID NO: 146534 - DNA, 13 bp, Homo sapiens
tggtgaatattgt

SEQ ID NO: 146535 - DNA, 16 bp, Homo sapiens
tggtgctacgcctgca

SEQ ID NO: 146536 - DNA, 16 bp, Homo sapiens
tggtggcaagagcccc

SEQ ID NO: 146537 - DNA, 16 bp, Homo sapiens
tggtggcgcaagcctg

SEQ ID NO: 146538 - DNA, 17 bp, Homo sapiens
tggtggcgcaagcctgt

SEQ ID NO: 146539 - DNA, 22 bp, Homo sapiens
tggtgggaggggcgcccacctc

SEQ ID NO: 146540 - DNA, 14 bp, Homo sapiens
tggttatggagagg

SEQ ID NO: 146541 - DNA, 19 bp, Homo sapiens
tggttcccctgttcactct

SEQ ID NO: 146542 - DNA, 20 bp, Homo sapiens
tggttcccctgttcactcta

SEQ ID NO: 146543 - DNA, 23 bp, Homo sapiens
tggttcccctgttcactctactt

SEQ ID NO: 146544 - DNA, 15 bp, Homo sapiens
tggttgggtcctcac

SEQ ID NO: 146545 - DNA, 15 bp, Homo sapiens
tggtttgcagagctt

SEQ ID NO: 146546 - DNA, 19 bp, Homo sapiens
tggtttgcagatgacaaaa

SEQ ID NO: 146547 - DNA, 15 bp, Homo sapiens
tgtaaaactgaggca

SEQ ID NO: 146548 - DNA, 16 bp, Homo sapiens
tgtaaaactgaggcac

SEQ ID NO: 146549 - DNA, 14 bp, Homo sapiens
tgtaaaataaaatt

SEQ ID NO: 146550 - DNA, 17 bp, Homo sapiens
tgtaaaatagcttgtat

SEQ ID NO: 146551 - DNA, 21 bp, Homo sapiens
tgtaaaatagcttgtatagtg

SEQ ID NO: 146552 - DNA, 21 bp, Homo sapiens
tgtaaaatatagctgtacaaa

SEQ ID NO: 146553 - DNA, 22 bp, Homo sapiens
tgtaaaatcttggcacagaaac

SEQ ID NO: 146554 - DNA, 11 bp, Homo sapiens
tgtaaaatggt

SEQ ID NO: 146555 - DNA, 12 bp, Homo sapiens
tgtaaaatggtg

SEQ ID NO: 146556 - DNA, 12 bp, Homo sapiens
tgtaaacagtgc

SEQ ID NO: 146557 - DNA, 19 bp, Homo sapiens
tgtaaacagtgcctgctga

SEQ ID NO: 146558 - DNA, 22 bp, Homo sapiens
tgtaaactcaaaacttaacata

SEQ ID NO: 146559 - DNA, 18 bp, Homo sapiens
tgtaaagccaacaccctg

SEQ ID NO: 146560 - DNA, 16 bp, Homo sapiens
tgtaaatagtatttga

SEQ ID NO: 146561 - DNA, 12 bp, Homo sapiens
tgtaaatatata

SEQ ID NO: 146562 - DNA, 13 bp, Homo sapiens
tgtaaatatttat

SEQ ID NO: 146563 - DNA, 22 bp, Homo sapiens
tgtaaatgctgtcaactatgat

SEQ ID NO: 146564 - DNA, 23 bp, Homo sapiens
tgtaacacagctgagagactttt

SEQ ID NO: 146565 - DNA, 16 bp, Homo sapiens
tgtaacactttacaat

SEQ ID NO: 146566 - DNA, 21 bp, Homo sapiens
tgtaacaggtctcctcttaaa

SEQ ID NO: 146567 - DNA, 19 bp, Homo sapiens
tgtaacctcttcagaggcc

SEQ ID NO: 146568 - DNA, 19 bp, Homo sapiens
tgtaactatagtccagctt

SEQ ID NO: 146569 - DNA, 13 bp, Homo sapiens
tgtaactccacca

SEQ ID NO: 146570 - DNA, 17 bp, Homo sapiens
tgtaactttctctatga

SEQ ID NO: 146571 - DNA, 18 bp, Homo sapiens
tgtaactttctctatgaa

SEQ ID NO: 146572 - DNA, 17 bp, Homo sapiens
tgtaagaaacacactga

SEQ ID NO: 146573 - DNA, 19 bp, Homo sapiens
tgtaagggaaactgccagc

SEQ ID NO: 146574 - DNA, 22 bp, Homo sapiens
tgtaataactgtgaagtttaca

SEQ ID NO: 146575 - DNA, 20 bp, Homo sapiens
tgtaatagaaaactgaaaat

SEQ ID NO: 146576 - DNA, 14 bp, Homo sapiens
tgtaatcaatgttt

SEQ ID NO: 146577 - DNA, 20 bp, Homo sapiens
tgtaatcaatgtttcttcta

SEQ ID NO: 146578 - DNA, 22 bp, Homo sapiens
tgtaatcccagctacttgggag

SEQ ID NO: 146579 - DNA, 15 bp, Homo sapiens
tgtaatcttgaattg

SEQ ID NO: 146580 - DNA, 16 bp, Homo sapiens
tgtaattgcttacatt

SEQ ID NO: 146581 - DNA, 17 bp, Homo sapiens
tgtaattgcttacattt

SEQ ID NO: 146582 - DNA, 18 bp, Homo sapiens
tgtacaaatataagaata

SEQ ID NO: 146583 - DNA, 18 bp, Homo sapiens
tgtacagaattctgctac

SEQ ID NO: 146584 - DNA, 15 bp, Homo sapiens
tgtacatatgtaaaa

SEQ ID NO: 146585 - DNA, 16 bp, Homo sapiens
tgtacatatgtaaaat

SEQ ID NO: 146586 - DNA, 21 bp, Homo sapiens
tgtacatatgtaaaataaaat

SEQ ID NO: 146587 - DNA, 14 bp, Homo sapiens
tgtacatctggcct

SEQ ID NO: 146588 - DNA, 17 bp, Homo sapiens
tgtaccatgtacatgaa

SEQ ID NO: 146589 - DNA, 16 bp, Homo sapiens
tgtacccttcctacag

SEQ ID NO: 146590 - DNA, 18 bp, Homo sapiens
tgtacctgcccccaatcc

SEQ ID NO: 146591 - DNA, 15 bp, Homo sapiens
tgtacgtggagaggg

SEQ ID NO: 146592 - DNA, 17 bp, Homo sapiens
tgtagaaggagacagag

SEQ ID NO: 146593 - DNA, 18 bp, Homo sapiens
tgtagaggagaaactgga

SEQ ID NO: 146594 - DNA, 13 bp, Homo sapiens
tgtagagtgggag

SEQ ID NO: 146595 - DNA, 11 bp, Homo sapiens
tgtaggcagac

SEQ ID NO: 146596 - DNA, 13 bp, Homo sapiens
tgtaggcagacac

SEQ ID NO: 146597 - DNA, 14 bp, Homo sapiens
tgtaggcagacaca

SEQ ID NO: 146598 - DNA, 15 bp, Homo sapiens
tgtaggtatcatttt

SEQ ID NO: 146599 - DNA, 17 bp, Homo sapiens
tgtagtcccagctactc

SEQ ID NO: 146600 - DNA, 21 bp, Homo sapiens
tgtatagtactggcatggtac

SEQ ID NO: 146601 - DNA, 15 bp, Homo sapiens
tgtatagtgtaaaat

SEQ ID NO: 146602 - DNA, 16 bp, Homo sapiens
tgtatagtgtaaaata

SEQ ID NO: 146603 - DNA, 13 bp, Homo sapiens
tgtatatcagaaa

SEQ ID NO: 146604 - DNA, 20 bp, Homo sapiens
tgtatcccccccctgtatag

SEQ ID NO: 146605 - DNA, 17 bp, Homo sapiens
tgtatctgcaggcagac

SEQ ID NO: 146606 - DNA, 18 bp, Homo sapiens
tgtatctgcaggcagaca

SEQ ID NO: 146607 - DNA, 19 bp, Homo sapiens
tgtatctgcaggcagacac

SEQ ID NO: 146608 - DNA, 21 bp, Homo sapiens
tgtatctgcaggcagacacgg

SEQ ID NO: 146609 - DNA, 16 bp, Homo sapiens
tgtatggaatacagtg

SEQ ID NO: 146610 - DNA, 17 bp, Homo sapiens
tgtatgtgcgtgtgtgc

SEQ ID NO: 146611 - DNA, 11 bp, Homo sapiens
tgtatgtttac

SEQ ID NO: 146612 - DNA, 19 bp, Homo sapiens
tgtattaaaaaaaacaaaa

SEQ ID NO: 146613 - DNA, 20 bp, Homo sapiens
tgtattaaaaaaaacaaaaa

SEQ ID NO: 146614 - DNA, 22 bp, Homo sapiens
tgtattaaaaaaaacaaaaaga

SEQ ID NO: 146615 - DNA, 14 bp, Homo sapiens
tgtattaagccact

SEQ ID NO: 146616 - DNA, 21 bp, Homo sapiens
tgtattaggtgtcatttccat

SEQ ID NO: 146617 - DNA, 15 bp, Homo sapiens
tgtattagtcacaga

SEQ ID NO: 146618 - DNA, 20 bp, Homo sapiens
tgtattctagctaatgtaat

SEQ ID NO: 146619 - DNA, 19 bp, Homo sapiens
tgtattctctgagctgtgc

SEQ ID NO: 146620 - DNA, 20 bp, Homo sapiens
tgtattctctgagctgtgca

SEQ ID NO: 146621 - DNA, 14 bp, Homo sapiens
tgtattgcacattg

SEQ ID NO: 146622 - DNA, 15 bp, Homo sapiens
tgtattgcacattgt

SEQ ID NO: 146623 - DNA, 19 bp, Homo sapiens
tgtattgcacattgtaaaa

SEQ ID NO: 146624 - DNA, 13 bp, Homo sapiens
tgtatttaaatat

SEQ ID NO: 146625 - DNA, 21 bp, Homo sapiens
tgtatttataaatatatttaa

SEQ ID NO: 146626 - DNA, 17 bp, Homo sapiens
tgtatttttttgcaagt

SEQ ID NO: 146627 - DNA, 16 bp, Homo sapiens
tgtcaaacaaagccag

SEQ ID NO: 146628 - DNA, 17 bp, Homo sapiens
tgtcaaacaaagccaga

SEQ ID NO: 146629 - DNA, 21 bp, Homo sapiens
tgtcaaacaaagccagaagct

SEQ ID NO: 146630 - DNA, 22 bp, Homo sapiens
tgtcaaacaaagccagaagctg

SEQ ID NO: 146631 - DNA, 14 bp, Homo sapiens
tgtcaagaaagagc

SEQ ID NO: 146632 - DNA, 11 bp, Homo sapiens
tgtcacagggc

SEQ ID NO: 146633 - DNA, 18 bp, Homo sapiens
tgtcaccaccttcccagc

SEQ ID NO: 146634 - DNA, 23 bp, Homo sapiens
tgtcaccaccttcccagctctcc

SEQ ID NO: 146635 - DNA, 18 bp, Homo sapiens
tgtcaccggatcctgggt

SEQ ID NO: 146636 - DNA, 20 bp, Homo sapiens
tgtcagacctatttgacata

SEQ ID NO: 146637 - DNA, 16 bp, Homo sapiens
tgtcagagttctgctc

SEQ ID NO: 146638 - DNA, 23 bp, Homo sapiens
tgtcagatattttttcagaaata

SEQ ID NO: 146639 - DNA, 18 bp, Homo sapiens
tgtcagcaaaaagcaaaa

SEQ ID NO: 146640 - DNA, 15 bp, Homo sapiens
tgtcagcatagaagt

SEQ ID NO: 146641 - DNA, 23 bp, Homo sapiens
tgtcagctcccctcggagaagag

SEQ ID NO: 146642 - DNA, 19 bp, Homo sapiens
tgtcagctgaacctgggta

SEQ ID NO: 146643 - DNA, 20 bp, Homo sapiens
tgtcagtaccttcaaactag

SEQ ID NO: 146644 - DNA, 17 bp, Homo sapiens
tgtcatcagaagataac

SEQ ID NO: 146645 - DNA, 19 bp, Homo sapiens
tgtcatcagaagataactt

SEQ ID NO: 146646 - DNA, 13 bp, Homo sapiens
tgtcatctcagct

SEQ ID NO: 146647 - DNA, 15 bp, Homo sapiens
tgtcattcagaaaaa

SEQ ID NO: 146648 - DNA, 21 bp, Homo sapiens
tgtccaacctaacccctttcc

SEQ ID NO: 146649 - DNA, 11 bp, Homo sapiens
tgtccacctgg

SEQ ID NO: 146650 - DNA, 16 bp, Homo sapiens
tttacactctttgtaa

SEQ ID NO: 146651 - DNA, 15 bp, Homo sapiens
tttacagctgcctgc

SEQ ID NO: 146652 - DNA, 16 bp, Homo sapiens
tttacagctgcctgca

SEQ ID NO: 146653 - DNA, 21 bp, Homo sapiens
tttactaagccacaagaaatt

SEQ ID NO: 146654 - DNA, 23 bp, Homo sapiens
tttactagggatccctcatctgt

SEQ ID NO: 146655 - DNA, 15 bp, Homo sapiens
tttactatgcctgtg

SEQ ID NO: 146656 - DNA, 17 bp, Homo sapiens
tttactgagcttctctg

SEQ ID NO: 146657 - DNA, 22 bp, Homo sapiens
tttactgccaaagggaaatatc

SEQ ID NO: 146658 - DNA, 15 bp, Homo sapiens
tttacttcttataca

SEQ ID NO: 146659 - DNA, 18 bp, Homo sapiens
tttacttgccattactca

SEQ ID NO: 146660 - DNA, 14 bp, Homo sapiens
tttagaagactcta

SEQ ID NO: 146661 - DNA, 15 bp, Homo sapiens
tttagaagactctac

SEQ ID NO: 146662 - DNA, 16 bp, Homo sapiens
tttagggccaggcagg

SEQ ID NO: 146663 - DNA, 16 bp, Homo sapiens
tttagtctgcaaaatg

SEQ ID NO: 146664 - DNA, 21 bp, Homo sapiens
tttataactcatcataaaata

SEQ ID NO: 146665 - DNA, 16 bp, Homo sapiens
tttatacaatatcatc

SEQ ID NO: 146666 - DNA, 23 bp, Homo sapiens
tttatatattggtaacatccttt

SEQ ID NO: 146667 - DNA, 23 bp, Homo sapiens
tttatcatgacatgttatatatt

SEQ ID NO: 146668 - DNA, 14 bp, Homo sapiens
tttatctctattta

SEQ ID NO: 146669 - DNA, 17 bp, Homo sapiens
tttatctctatttaata

SEQ ID NO: 146670 - DNA, 19 bp, Homo sapiens
tttatgaaaggtttacatt

SEQ ID NO: 146671 - DNA, 20 bp, Homo sapiens
tttatgaatgaaaaaacagt

SEQ ID NO: 146672 - DNA, 22 bp, Homo sapiens
tttatgtaaactgcattagaaa

SEQ ID NO: 146673 - DNA, 15 bp, Homo sapiens
tttattaaaatctta

SEQ ID NO: 146674 - DNA, 22 bp, Homo sapiens
tttattaaaatgattgtaaaat

SEQ ID NO: 146675 - DNA, 12 bp, Homo sapiens
tttattaacaaa

SEQ ID NO: 146676 - DNA, 14 bp, Homo sapiens
tttattacctctga

SEQ ID NO: 146677 - DNA, 17 bp, Homo sapiens
tttattattttcacctg

SEQ ID NO: 146678 - DNA, 14 bp, Homo sapiens
tttattgagaaaga

SEQ ID NO: 146679 - DNA, 16 bp, Homo sapiens
tttattgagaaagagc

SEQ ID NO: 146680 - DNA, 16 bp, Homo sapiens
ctgaaccttccatctc

SEQ ID NO: 146681 - DNA, 17 bp, Homo sapiens
ctgaacggggagaaaag

SEQ ID NO: 146682 - DNA, 13 bp, Homo sapiens
ctgaagccagcct

SEQ ID NO: 146683 - DNA, 12 bp, Homo sapiens
ctgaaggagccc

SEQ ID NO: 146684 - DNA, 14 bp, Homo sapiens
ctgaagtcactgca

SEQ ID NO: 146685 - DNA, 17 bp, Homo sapiens
ctgaagtcactgcacag

SEQ ID NO: 146686 - DNA, 22 bp, Homo sapiens
ctgaagtcactgcacagtgcat

SEQ ID NO: 146687 - DNA, 12 bp, Homo sapiens
ctgaatgctctg

SEQ ID NO: 146688 - DNA, 17 bp, Homo sapiens
ctgaatgctctgtgcga

SEQ ID NO: 146689 - DNA, 13 bp, Homo sapiens
ctgacacccatgt

SEQ ID NO: 146690 - DNA, 14 bp, Homo sapiens
ctgacacgtccacc

SEQ ID NO: 146691 - DNA, 17 bp, Homo sapiens
ctgacacgtccacccca

SEQ ID NO: 146692 - DNA, 12 bp, Homo sapiens
ctgacagaggag

SEQ ID NO: 146693 - DNA, 13 bp, Homo sapiens
ctgacagcctccc

SEQ ID NO: 146694 - DNA, 17 bp, Homo sapiens
ctgacagcctcccaccc

SEQ ID NO: 146695 - DNA, 14 bp, Homo sapiens
ctgacatgtggggc

SEQ ID NO: 146696 - DNA, 19 bp, Homo sapiens
ctgaccaacagttccttca

SEQ ID NO: 146697 - DNA, 16 bp, Homo sapiens
ctgaccaacatggaga

SEQ ID NO: 146698 - DNA, 23 bp, Homo sapiens
ctgaccagcctccatgctgcctc

SEQ ID NO: 146699 - DNA, 12 bp, Homo sapiens
ctgacccagtcc

SEQ ID NO: 146700 - DNA, 23 bp, Homo sapiens
ctgacccttacagcctctgactt

SEQ ID NO: 146701 - DNA, 22 bp, Homo sapiens
ctgaccttgaactcctgggctc

SEQ ID NO: 146702 - DNA, 18 bp, Homo sapiens
ctgacctttgtcatcttt

SEQ ID NO: 146703 - DNA, 21 bp, Homo sapiens
ctgacctttgtcatctttctt

SEQ ID NO: 146704 - DNA, 16 bp, Homo sapiens
ctgactcattctgaag

SEQ ID NO: 146705 - DNA, 15 bp, Homo sapiens
ctgacttctaagtaa

SEQ ID NO: 146706 - DNA, 16 bp, Homo sapiens
ctgacttctaagtaaa

SEQ ID NO: 146707 - DNA, 20 bp, Homo sapiens
ctgagaaagactattcaaac

SEQ ID NO: 146708 - DNA, 22 bp, Homo sapiens
ctgagaaagactattcaaacag

SEQ ID NO: 146709 - DNA, 23 bp, Homo sapiens
ctgagaaagactattcaaacagt

SEQ ID NO: 146710 - DNA, 17 bp, Homo sapiens
ctgagaaggtccttaat

SEQ ID NO: 146711 - DNA, 23 bp, Homo sapiens
ctgagaaggtccttaatgatccg

SEQ ID NO: 146712 - DNA, 14 bp, Homo sapiens
ctgagagaaaataa

SEQ ID NO: 146713 - DNA, 20 bp, Homo sapiens
ctgagagacccaaggaggaa

SEQ ID NO: 146714 - DNA, 18 bp, Homo sapiens
ctgagagacttttaatca

SEQ ID NO: 146715 - DNA, 18 bp, Homo sapiens
ctgagataccagcgagga

SEQ ID NO: 146716 - DNA, 20 bp, Homo sapiens
ctgagcaaatgtggctcctg

SEQ ID NO: 146717 - DNA, 16 bp, Homo sapiens
ctgagcagactggtga

SEQ ID NO: 146718 - DNA, 22 bp, Homo sapiens
ctgagcagactggtgagcagac

SEQ ID NO: 146719 - DNA, 16 bp, Homo sapiens
ctgagcaggattttaa

SEQ ID NO: 146720 - DNA, 18 bp, Homo sapiens
ctgagccccgcagacctc

SEQ ID NO: 146721 - DNA, 22 bp, Homo sapiens
ctgagcccctgggactgctgct

SEQ ID NO: 146722 - DNA, 16 bp, Homo sapiens
ctgagccctcaaagtg

SEQ ID NO: 146723 - DNA, 14 bp, Homo sapiens
ctgagcctggccag

SEQ ID NO: 146724 - DNA, 16 bp, Homo sapiens
ctgagccttgtaattc

SEQ ID NO: 146725 - DNA, 20 bp, Homo sapiens
ctgagcgaggagatgctcct

SEQ ID NO: 146726 - DNA, 18 bp, Homo sapiens
ctgagctccccaccaccc

SEQ ID NO: 146727 - DNA, 15 bp, Homo sapiens
ctgagcttctctgtg

SEQ ID NO: 146728 - DNA, 17 bp, Homo sapiens
ctgaggaaaggccagct

SEQ ID NO: 146729 - DNA, 20 bp, Homo sapiens
ctgaggaagcacagcagcat

SEQ ID NO: 146730 - DNA, 16 bp, Homo sapiens
ctgaggcaagagaatt

SEQ ID NO: 146731 - DNA, 23 bp, Homo sapiens
ctgaggcagcagtgtgaggccag

SEQ ID NO: 146732 - DNA, 14 bp, Homo sapiens
ctgaggcagggaag

SEQ ID NO: 146733 - DNA, 20 bp, Homo sapiens
ctgaggcagggaagtcccca

SEQ ID NO: 146734 - DNA, 12 bp, Homo sapiens
ctgagggagcct

SEQ ID NO: 146735 - DNA, 14 bp, Homo sapiens
ctgagtcaccagga

SEQ ID NO: 146736 - DNA, 15 bp, Homo sapiens
ctgagtcaccaggaa

SEQ ID NO: 146737 - DNA, 17 bp, Homo sapiens
ctgagtcaccaggaatg

SEQ ID NO: 146738 - DNA, 19 bp, Homo sapiens
ctgagtcatgatctccctg

SEQ ID NO: 146739 - DNA, 21 bp, Homo sapiens
ctgagtcatgatctccctgcc

SEQ ID NO: 146740 - DNA, 22 bp, Homo sapiens
ctgagtcatgatctccctgccg

SEQ ID NO: 146741 - DNA, 17 bp, Homo sapiens
ctgagtttcattctcct

SEQ ID NO: 146742 - DNA, 19 bp, Homo sapiens
ctgagtttcattctcctgc

SEQ ID NO: 146743 - DNA, 12 bp, Homo sapiens
ctgatacctcaa

SEQ ID NO: 146744 - DNA, 22 bp, Homo sapiens
ctgatagctctttggcagtcta

SEQ ID NO: 146745 - DNA, 17 bp, Homo sapiens
ctgataggccaagtttg

SEQ ID NO: 146746 - DNA, 18 bp, Homo sapiens
ctgatccagcctctcccc

SEQ ID NO: 146747 - DNA, 16 bp, Homo sapiens
ctgatggtacaggaaa

SEQ ID NO: 146748 - DNA, 22 bp, Homo sapiens
ctgatgttgagggaacagacag

SEQ ID NO: 146749 - DNA, 17 bp, Homo sapiens
ctgcaaaaggactctca

SEQ ID NO: 146750 - DNA, 15 bp, Homo sapiens
ctgcaaacgctgcct

SEQ ID NO: 146751 - DNA, 16 bp, Homo sapiens
ctgcaaacgctgcctg

SEQ ID NO: 146752 - DNA, 20 bp, Homo sapiens
ctgcaaacgctgcctgccca

SEQ ID NO: 146753 - DNA, 19 bp, Homo sapiens
ctgcaaacgctgcctgccg

SEQ ID NO: 146754 - DNA, 15 bp, Homo sapiens
ctgcaaatgtcatca

SEQ ID NO: 146755 - DNA, 23 bp, Homo sapiens
ctgcaactcaaggactttgcagc

SEQ ID NO: 146756 - DNA, 13 bp, Homo sapiens
ctgcaagagcctt

SEQ ID NO: 146757 - DNA, 14 bp, Homo sapiens
ctgcaagagccttg

SEQ ID NO: 146758 - DNA, 19 bp, Homo sapiens
ctgcaagagccttggtgtc

SEQ ID NO: 146759 - DNA, 13 bp, Homo sapiens
ctgcacagcggcc

SEQ ID NO: 146760 - DNA, 22 bp, Homo sapiens
ctgcacagtgcatctcagccca

SEQ ID NO: 146761 - DNA, 15 bp, Homo sapiens
ctgcacccccctggg

SEQ ID NO: 146762 - DNA, 14 bp, Homo sapiens
ctgcaccctcaggc

SEQ ID NO: 146763 - DNA, 18 bp, Homo sapiens
ctgcaccctcaggcaggt

SEQ ID NO: 146764 - DNA, 11 bp, Homo sapiens
ctgcacctccc

SEQ ID NO: 146765 - DNA, 14 bp, Homo sapiens
ctgcacctcccccc

SEQ ID NO: 146766 - DNA, 17 bp, Homo sapiens
ctgcacctccccccact

SEQ ID NO: 146767 - DNA, 20 bp, Homo sapiens
ctgcacctccccccactgca

SEQ ID NO: 146768 - DNA, 16 bp, Homo sapiens
ctgcactccagcctga

SEQ ID NO: 146769 - DNA, 17 bp, Homo sapiens
ctgcactccagcctggg

SEQ ID NO: 146770 - DNA, 19 bp, Homo sapiens
ctgcactccagcctgggtg

SEQ ID NO: 146771 - DNA, 16 bp, Homo sapiens
ctgcactggagtccag

SEQ ID NO: 146772 - DNA, 21 bp, Homo sapiens
ctgcactggagtccagtctct

SEQ ID NO: 146773 - DNA, 23 bp, Homo sapiens
ctgcagaagacagtatggcagct

SEQ ID NO: 146774 - DNA, 14 bp, Homo sapiens
ctgcagaaggaaaa

SEQ ID NO: 146775 - DNA, 15 bp, Homo sapiens
ctgcagaaggaaaaa

SEQ ID NO: 146776 - DNA, 22 bp, Homo sapiens
ctgcagaaggaaaaatgtgtaa

SEQ ID NO: 146777 - DNA, 14 bp, Homo sapiens
ctgcagccagccca

SEQ ID NO: 146778 - DNA, 11 bp, Homo sapiens
ctgcagcctgg

SEQ ID NO: 146779 - DNA, 12 bp, Homo sapiens
ctgcagctttgt

SEQ ID NO: 146780 - DNA, 15 bp, Homo sapiens
ctgcaggacctgcct

SEQ ID NO: 146781 - DNA, 12 bp, Homo sapiens
ctgcaggcagac

SEQ ID NO: 146782 - DNA, 13 bp, Homo sapiens
ctgcaggcagaca

SEQ ID NO: 146783 - DNA, 17 bp, Homo sapiens
ctgcaggcagacacgga

SEQ ID NO: 146784 - DNA, 11 bp, Homo sapiens
ctgcaggcccc

SEQ ID NO: 146785 - DNA, 22 bp, Homo sapiens
ctgcaggccccgcttgtccagc

SEQ ID NO: 146786 - DNA, 23 bp, Homo sapiens
ctgcaggccccgcttgtccagcg

SEQ ID NO: 146787 - DNA, 23 bp, Homo sapiens
ctgcagggaaaattatttgcata

SEQ ID NO: 146788 - DNA, 17 bp, Homo sapiens
ctgcagggactgccagt

SEQ ID NO: 146789 - DNA, 15 bp, Homo sapiens
ctgcagggccaggac

SEQ ID NO: 146790 - DNA, 16 bp, Homo sapiens
ctgcagggccaggact

SEQ ID NO: 146791 - DNA, 14 bp, Homo sapiens
ctgcaggggctctg

SEQ ID NO: 146792 - DNA, 15 bp, Homo sapiens
ctgcaggggctctgg

SEQ ID NO: 146793 - DNA, 22 bp, Homo sapiens
ctgcaggggctctggagagaaa

SEQ ID NO: 146794 - DNA, 19 bp, Homo sapiens
ctgcaggtgctgctgcgtg

SEQ ID NO: 146795 - DNA, 17 bp, Homo sapiens
ctgcagtatgaaaataa

SEQ ID NO: 146796 - DNA, 22 bp, Homo sapiens
ctgcagtcatcttgaccaagca

SEQ ID NO: 146797 - DNA, 15 bp, Homo sapiens
ctgcatccccttggc

SEQ ID NO: 146798 - DNA, 16 bp, Homo sapiens
ctgcatccccttggct

SEQ ID NO: 146799 - DNA, 19 bp, Homo sapiens
ctgcatccgtagttccctg

SEQ ID NO: 146800 - DNA, 20 bp, Homo sapiens
ctgcattaccgcgttgtaaa

SEQ ID NO: 146801 - DNA, 21 bp, Homo sapiens
ctgcattaccgcgttgtaaaa

SEQ ID NO: 146802 - DNA, 15 bp, Homo sapiens
ctgcattagaaatta

SEQ ID NO: 146803 - DNA, 22 bp, Homo sapiens
ctgcattcacccagacagctcc

SEQ ID NO: 146804 - DNA, 19 bp, Homo sapiens
ctgcattctgccgtgtgcc

SEQ ID NO: 146805 - DNA, 18 bp, Homo sapiens
ctgcattttcaccccacc

SEQ ID NO: 146806 - DNA, 14 bp, Homo sapiens
ctgccaaaggatgt

SEQ ID NO: 146807 - DNA, 18 bp, Homo sapiens
ctgccaaaggatgtgata

SEQ ID NO: 146808 - DNA, 22 bp, Homo sapiens
ctgccaaaggatgtgatatata

SEQ ID NO: 146809 - DNA, 23 bp, Homo sapiens
ctgccacacgtctgaccctctcc

SEQ ID NO: 146810 - DNA, 13 bp, Homo sapiens
ctgccacacttca

SEQ ID NO: 146811 - DNA, 13 bp, Homo sapiens
ctgccacctcccc

SEQ ID NO: 146812 - DNA, 22 bp, Homo sapiens
ctgccacctcccctatccaccc

SEQ ID NO: 146813 - DNA, 16 bp, Homo sapiens
ctgccacctggggcag

SEQ ID NO: 146814 - DNA, 13 bp, Homo sapiens
ctgccagccagca

SEQ ID NO: 146815 - DNA, 15 bp, Homo sapiens
ctgccagccagcagc

SEQ ID NO: 146816 - DNA, 21 bp, Homo sapiens
ctgccaggcccccaagcctgc

SEQ ID NO: 146817 - DNA, 11 bp, Homo sapiens
ctgccagggca

SEQ ID NO: 146818 - DNA, 15 bp, Homo sapiens
ctgccagggcagggc

SEQ ID NO: 146819 - DNA, 22 bp, Homo sapiens
ctgccagtccccctgccccagg

SEQ ID NO: 146820 - DNA, 19 bp, Homo sapiens
ctgccagtgacagacaggc

SEQ ID NO: 146821 - DNA, 14 bp, Homo sapiens
ctgccagtgcctta

SEQ ID NO: 146822 - DNA, 20 bp, Homo sapiens
ctgccataaaacattaagaa

SEQ ID NO: 146823 - DNA, 17 bp, Homo sapiens
ctgccatggaggcacac

SEQ ID NO: 146824 - DNA, 17 bp, Homo sapiens
ctgcccaacctgctctc

SEQ ID NO: 146825 - DNA, 19 bp, Homo sapiens
ctggccccatgtctctcag

SEQ ID NO: 146826 - DNA, 22 bp, Homo sapiens
ctggccctcacccctgccctgg

SEQ ID NO: 146827 - DNA, 17 bp, Homo sapiens
ctggcctctggctctca

SEQ ID NO: 146828 - DNA, 22 bp, Homo sapiens
ctggcgacacgtagcagcttag

SEQ ID NO: 146829 - DNA, 22 bp, Homo sapiens
ctggcggctactcagcagccct

SEQ ID NO: 146830 - DNA, 16 bp, Homo sapiens
ctggctaactggaagc

SEQ ID NO: 146831 - DNA, 17 bp, Homo sapiens
ctggctctcatggggtc

SEQ ID NO: 146832 - DNA, 24 bp, Homo sapiens
ctggctctgcaatgggcactggga

SEQ ID NO: 146833 - DNA, 14 bp, Homo sapiens
ctggcttcacagat

SEQ ID NO: 146834 - DNA, 15 bp, Homo sapiens
ctggcttttcactgc

SEQ ID NO: 146835 - DNA, 17 bp, Homo sapiens
ctggcttttcactgctg

SEQ ID NO: 146836 - DNA, 20 bp, Homo sapiens
ctggcttttcactgctggct

SEQ ID NO: 146837 - DNA, 22 bp, Homo sapiens
ctggcttttcactgctggctgc

SEQ ID NO: 146838 - DNA, 16 bp, Homo sapiens
ctgggaaataagagag

SEQ ID NO: 146839 - DNA, 23 bp, Homo sapiens
ctgggaccctttccttccttccc

SEQ ID NO: 146840 - DNA, 13 bp, Homo sapiens
ctgggagctctgc

SEQ ID NO: 146841 - DNA, 14 bp, Homo sapiens
ctgggagctctgca

SEQ ID NO: 146842 - DNA, 22 bp, Homo sapiens
ctgggaggaatggacagacaga

SEQ ID NO: 146843 - DNA, 23 bp, Homo sapiens
ctgggagggatagaggggggctg

SEQ ID NO: 146844 - DNA, 15 bp, Homo sapiens
ctgggagggcagcag

SEQ ID NO: 146845 - DNA, 17 bp, Homo sapiens
ctgggagggcagcaggg

SEQ ID NO: 146846 - DNA, 22 bp, Homo sapiens
ctgggagggcagcagggctacc

SEQ ID NO: 146847 - DNA, 18 bp, Homo sapiens
ctgggaggtcaaggctgc

SEQ ID NO: 146848 - DNA, 21 bp, Homo sapiens
ctgggaggtcaaggctgcagt

SEQ ID NO: 146849 - DNA, 17 bp, Homo sapiens
ctgggattctactttaa

SEQ ID NO: 146850 - DNA, 23 bp, Homo sapiens
ctgggattctactttaagcacta

SEQ ID NO: 146851 - DNA, 15 bp, Homo sapiens
ctgggcaaagcctag

SEQ ID NO: 146852 - DNA, 20 bp, Homo sapiens
ctgggcaatgtgataaaacc

SEQ ID NO: 146853 - DNA, 20 bp, Homo sapiens
ctgggcaggttggtgggggc

SEQ ID NO: 146854 - DNA, 14 bp, Homo sapiens
ctgggccccaccac

SEQ ID NO: 146855 - DNA, 14 bp, Homo sapiens
ctgggccctctctg

SEQ ID NO: 146856 - DNA, 18 bp, Homo sapiens
ctgggccctctctgctct

SEQ ID NO: 146857 - DNA, 13 bp, Homo sapiens
ctgggctcaagca

SEQ ID NO: 146858 - DNA, 17 bp, Homo sapiens
ctgggctcaagcagtct

SEQ ID NO: 146859 - DNA, 12 bp, Homo sapiens
ctgggctctcca

SEQ ID NO: 146860 - DNA, 13 bp, Homo sapiens
ctgggctctccac

SEQ ID NO: 146861 - DNA, 14 bp, Homo sapiens
ctgggctctccacc

SEQ ID NO: 146862 - DNA, 16 bp, Homo sapiens
ctgggctctccacctc

SEQ ID NO: 146863 - DNA, 18 bp, Homo sapiens
ctgggctctccacctcag

SEQ ID NO: 146864 - DNA, 17 bp, Homo sapiens
ctggggaaataacagct

SEQ ID NO: 146865 - DNA, 19 bp, Homo sapiens
ctggggaaataacagctgt

SEQ ID NO: 146866 - DNA, 22 bp, Homo sapiens
ctggggaaataacagctgtggc

SEQ ID NO: 146867 - DNA, 22 bp, Homo sapiens
ctggggatgtgggagggagcag

SEQ ID NO: 146868 - DNA, 20 bp, Homo sapiens
ctggggcctcggagcctcat

SEQ ID NO: 146869 - DNA, 15 bp, Homo sapiens
ctggggcttctcctg

SEQ ID NO: 146870 - DNA, 19 bp, Homo sapiens
ctggggcttctcctgaccc

SEQ ID NO: 146871 - DNA, 20 bp, Homo sapiens
ctggggcttctcctgaccca

SEQ ID NO: 146872 - DNA, 13 bp, Homo sapiens
ctgggggaagaag

SEQ ID NO: 146873 - DNA, 20 bp, Homo sapiens
ctggggtataaaactttcct

SEQ ID NO: 146874 - DNA, 15 bp, Homo sapiens
ctggggtcctggggc

SEQ ID NO: 146875 - DNA, 13 bp, Homo sapiens
ctggggttcagcc

SEQ ID NO: 146876 - DNA, 17 bp, Homo sapiens
ctggggttcagcccctc

SEQ ID NO: 146877 - DNA, 12 bp, Homo sapiens
ctgggtcagtgg

SEQ ID NO: 146878 - DNA, 21 bp, Homo sapiens
ctgggtccaggggatgggagg

SEQ ID NO: 146879 - DNA, 23 bp, Homo sapiens
ctgggtccttgcacccctcactc

SEQ ID NO: 146880 - DNA, 13 bp, Homo sapiens
ctgggtgacagag

SEQ ID NO: 146881 - DNA, 23 bp, Homo sapiens
ctgggtgacagagcaagactctg

SEQ ID NO: 146882 - DNA, 14 bp, Homo sapiens
ctgggtgacatttg

SEQ ID NO: 146883 - DNA, 14 bp, Homo sapiens
ctgggtgctcccta

SEQ ID NO: 146884 - DNA, 13 bp, Homo sapiens
ctgggtggcctcg

SEQ ID NO: 146885 - DNA, 20 bp, Homo sapiens
ctgggtggggctgctcctcc

SEQ ID NO: 146886 - DNA, 19 bp, Homo sapiens
ctgggtggtctgcaggcag

SEQ ID NO: 146887 - DNA, 18 bp, Homo sapiens
ctgggttggaaaacagta

SEQ ID NO: 146888 - DNA, 18 bp, Homo sapiens
ctgggtttctctgtatag

SEQ ID NO: 146889 - DNA, 16 bp, Homo sapiens
ctggtaaactatttgt

SEQ ID NO: 146890 - DNA, 19 bp, Homo sapiens
ctggtaaactatttgtctt

SEQ ID NO: 146891 - DNA, 14 bp, Homo sapiens
ctggtagagatgga

SEQ ID NO: 146892 - DNA, 23 bp, Homo sapiens
ctggtcacaggactctgcctcct

SEQ ID NO: 146893 - DNA, 23 bp, Homo sapiens
ctggtcacagggcatgccccggc

SEQ ID NO: 146894 - DNA, 14 bp, Homo sapiens
ctggtcactgccat

SEQ ID NO: 146895 - DNA, 22 bp, Homo sapiens
ctggtcactgccatggaggcac

SEQ ID NO: 146896 - DNA, 13 bp, Homo sapiens
ctggtccagggct

SEQ ID NO: 146897 - DNA, 14 bp, Homo sapiens
ctggtcctgtgtgc

SEQ ID NO: 146898 - DNA, 14 bp, Homo sapiens
ctggtctgtaggga

SEQ ID NO: 146899 - DNA, 15 bp, Homo sapiens
ctggtgacaccagcc

SEQ ID NO: 146900 - DNA, 16 bp, Homo sapiens
ctggtgagcagactgg

SEQ ID NO: 146901 - DNA, 15 bp, Homo sapiens
ctggtggcctctgcc

SEQ ID NO: 146902 - DNA, 21 bp, Homo sapiens
ctgtaacacagctgagagact

SEQ ID NO: 146903 - DNA, 19 bp, Homo sapiens
ctgtaatcccagctactca

SEQ ID NO: 146904 - DNA, 14 bp, Homo sapiens
ctgtaatctatgaa

SEQ ID NO: 146905 - DNA, 21 bp, Homo sapiens
ctgtactcctcccaggcgccc

SEQ ID NO: 146906 - DNA, 20 bp, Homo sapiens
cttattagagtgtctttcca

SEQ ID NO: 146907 - DNA, 13 bp, Homo sapiens
cttattgtacctc

SEQ ID NO: 146908 - DNA, 22 bp, Homo sapiens
cttcaaacagaactgcagtcag

SEQ ID NO: 146909 - DNA, 23 bp, Homo sapiens
cttcaaactagggccaagcccag

SEQ ID NO: 146910 - DNA, 16 bp, Homo sapiens
cttcaaccattcccca

SEQ ID NO: 146911 - DNA, 20 bp, Homo sapiens
cttcaaccattccccatggg

SEQ ID NO: 146912 - DNA, 15 bp, Homo sapiens
cttcacaaattctca

SEQ ID NO: 146913 - DNA, 21 bp, Homo sapiens
cttcactttaattctcatgtg

SEQ ID NO: 146914 - DNA, 23 bp, Homo sapiens
cttcagaggccctcgctgccagc

SEQ ID NO: 146915 - DNA, 21 bp, Homo sapiens
cttcagcagtacctataaagt

SEQ ID NO: 146916 - DNA, 15 bp, Homo sapiens
cttcagccacctctc

SEQ ID NO: 146917 - DNA, 11 bp, Homo sapiens
cttcagctgac

SEQ ID NO: 146918 - DNA, 14 bp, Homo sapiens
cttcaggctcttct

SEQ ID NO: 146919 - DNA, 15 bp, Homo sapiens
cttcagggggccagg

SEQ ID NO: 146920 - DNA, 20 bp, Homo sapiens
cttcagggttctcctctccc

SEQ ID NO: 146921 - DNA, 23 bp, Homo sapiens
cttcagtaagccgtgattttcat

SEQ ID NO: 146922 - DNA, 22 bp, Homo sapiens
cttcagtatgttgtcaaagaga

SEQ ID NO: 146923 - DNA, 11 bp, Homo sapiens
cttcagtgccc

SEQ ID NO: 146924 - DNA, 19 bp, Homo sapiens
cttcatccggcagcctgga

SEQ ID NO: 146925 - DNA, 20 bp, Homo sapiens
cttcattaagccctcttcca

SEQ ID NO: 146926 - DNA, 21 bp, Homo sapiens
cttcattcttgaaagctgtgg

SEQ ID NO: 146927 - DNA, 12 bp, Homo sapiens
cttccaccagcc

SEQ ID NO: 146928 - DNA, 13 bp, Homo sapiens
cttccaccagcct

SEQ ID NO: 146929 - DNA, 16 bp, Homo sapiens
cttccaccagcctgca

SEQ ID NO: 146930 - DNA, 14 bp, Homo sapiens
cttccactgagggc

SEQ ID NO: 146931 - DNA, 11 bp, Homo sapiens
cttccataatc

SEQ ID NO: 146932 - DNA, 21 bp, Homo sapiens
cttccataatctggactcctc

SEQ ID NO: 146933 - DNA, 16 bp, Homo sapiens
cttccatatgacctca

SEQ ID NO: 146934 - DNA, 21 bp, Homo sapiens
cttccatatgacctcatgcat

SEQ ID NO: 146935 - DNA, 12 bp, Homo sapiens
cttccatcatgt

SEQ ID NO: 146936 - DNA, 20 bp, Homo sapiens
cttccatgtcgcctctgcat

SEQ ID NO: 146937 - DNA, 13 bp, Homo sapiens
cttccatttgcaa

SEQ ID NO: 146938 - DNA, 20 bp, Homo sapiens
cttcccagctctccctctgg

SEQ ID NO: 146939 - DNA, 22 bp, Homo sapiens
cttcccagctctccctctggcc

SEQ ID NO: 146940 - DNA, 13 bp, Homo sapiens
cttccccagcctc

SEQ ID NO: 146941 - DNA, 16 bp, Homo sapiens
cttccctctccccaag

SEQ ID NO: 146942 - DNA, 10 bp, Homo sapiens
cttccctggc

SEQ ID NO: 146943 - DNA, 11 bp, Homo sapiens
cttccctggct

SEQ ID NO: 146944 - DNA, 12 bp, Homo sapiens
cttccctggctt

SEQ ID NO: 146945 - DNA, 17 bp, Homo sapiens
cttccgtaacccaactc

SEQ ID NO: 146946 - DNA, 14 bp, Homo sapiens
cttcctcctgggcc

SEQ ID NO: 146947 - DNA, 15 bp, Homo sapiens
cttcctcctgggccc

SEQ ID NO: 146948 - DNA, 16 bp, Homo sapiens
cttcctctccactgcc

SEQ ID NO: 146949 - DNA, 19 bp, Homo sapiens
cttcctctccactgccttc

SEQ ID NO: 146950 - DNA, 12 bp, Homo sapiens
cttcctctgctg

SEQ ID NO: 146951 - DNA, 15 bp, Homo sapiens
cttccttccctggct

SEQ ID NO: 146952 - DNA, 15 bp, Homo sapiens
cttccttgaccagca

SEQ ID NO: 146953 - DNA, 22 bp, Homo sapiens
cttccttgaccagcagatccca

SEQ ID NO: 146954 - DNA, 22 bp, Homo sapiens
cttcctttgtttttttttcctg

SEQ ID NO: 146955 - DNA, 21 bp, Homo sapiens
cttcgatacaccgggcctgga

SEQ ID NO: 146956 - DNA, 21 bp, Homo sapiens
cttcgggaggtcgaggcagga

SEQ ID NO: 146957 - DNA, 16 bp, Homo sapiens
cttcgggcccttccca

SEQ ID NO: 146958 - DNA, 19 bp, Homo sapiens
cttcggggaactcctggaa

SEQ ID NO: 146959 - DNA, 23 bp, Homo sapiens
cttctaagtaaaaccacagcagt

SEQ ID NO: 146960 - DNA, 17 bp, Homo sapiens
cttctaccttaaaatgt

SEQ ID NO: 146961 - DNA, 13 bp, Homo sapiens
cttctacttctgc

SEQ ID NO: 146962 - DNA, 21 bp, Homo sapiens
cttctacttctgcccttgcca

SEQ ID NO: 146963 - DNA, 13 bp, Homo sapiens
cttctattttatt

SEQ ID NO: 146964 - DNA, 16 bp, Homo sapiens
cttctcactgccatgc

SEQ ID NO: 146965 - DNA, 13 bp, Homo sapiens
cttctcaggctct

SEQ ID NO: 146966 - DNA, 19 bp, Homo sapiens
cttctcaggctctgccctg

SEQ ID NO: 146967 - DNA, 21 bp, Homo sapiens
cttctcaggctctgccctgcc

SEQ ID NO: 146968 - DNA, 16 bp, Homo sapiens
cttctcatacgtccac

SEQ ID NO: 146969 - DNA, 17 bp, Homo sapiens
cttctccagacaaacca

SEQ ID NO: 146970 - DNA, 14 bp, Homo sapiens
cttctccatctggc

SEQ ID NO: 146971 - DNA, 14 bp, Homo sapiens
cttctcctttcaca

SEQ ID NO: 146972 - DNA, 16 bp, Homo sapiens
cttctctctgtgggat

SEQ ID NO: 146973 - DNA, 17 bp, Homo sapiens
cttctggcacttggaga

SEQ ID NO: 146974 - DNA, 15 bp, Homo sapiens
cttctgggagggcag

SEQ ID NO: 146975 - DNA, 14 bp, Homo sapiens
cttctgtccctcac

SEQ ID NO: 146976 - DNA, 15 bp, Homo sapiens
cttctgtggctcaca

SEQ ID NO: 146977 - DNA, 22 bp, Homo sapiens
cttctgtggctcacagaaccct

SEQ ID NO: 146978 - DNA, 18 bp, Homo sapiens
cttcttcagatcagtgct

SEQ ID NO: 146979 - DNA, 21 bp, Homo sapiens
cttcttcagccacctctcttt

SEQ ID NO: 146980 - DNA, 12 bp, Homo sapiens
cttcttctccta

SEQ ID NO: 146981 - DNA, 23 bp, Homo sapiens
cttctttttattttcttttgtaa

SEQ ID NO: 146982 - DNA, 17 bp, Homo sapiens
cttctttttttgtgatg

SEQ ID NO: 146983 - DNA, 16 bp, Homo sapiens
cttcttttttttcatt

SEQ ID NO: 146984 - DNA, 10 bp, Homo sapiens
cttgaagttg

SEQ ID NO: 146985 - DNA, 21 bp, Homo sapiens
cttgaattgtaactgttcttg

SEQ ID NO: 146986 - DNA, 17 bp, Homo sapiens
cttgaccaagcaggaag

SEQ ID NO: 146987 - DNA, 18 bp, Homo sapiens
cttgaccaagcaggaagc

SEQ ID NO: 146988 - DNA, 12 bp, Homo sapiens
cttgacctccta

SEQ ID NO: 146989 - DNA, 12 bp, Homo sapiens
cttgagaaacct

SEQ ID NO: 146990 - DNA, 18 bp, Homo sapiens
cttgagacctcagccatg

SEQ ID NO: 146991 - DNA, 13 bp, Homo sapiens
cttgagccagtaa

SEQ ID NO: 146992 - DNA, 16 bp, Homo sapiens
cttgagggcccagagc

SEQ ID NO: 146993 - DNA, 18 bp, Homo sapiens
cttgagttgattcagctc

SEQ ID NO: 146994 - DNA, 20 bp, Homo sapiens
cttgagttgattcagctctg

SEQ ID NO: 146995 - DNA, 21 bp, Homo sapiens
cttgagttgattcagctctgc

SEQ ID NO: 146996 - DNA, 15 bp, Homo sapiens
cttgatctgtatata

SEQ ID NO: 146997 - DNA, 21 bp, Homo sapiens
cttgatgcatgcactgttccc

SEQ ID NO: 146998 - DNA, 15 bp, Homo sapiens
cttgatgtgttatct

SEQ ID NO: 146999 - DNA, 18 bp, Homo sapiens
cttgatgtgttatctctt

SEQ ID NO: 147000 - DNA, 23 bp, Homo sapiens
cttgcaccccaaagctttcctgc

SEQ ID NO: 147001 - DNA, 14 bp, Homo sapiens
cttgcacccctcac

SEQ ID NO: 147002 - DNA, 16 bp, Homo sapiens
cttgcacccctcactc

SEQ ID NO: 147003 - DNA, 14 bp, Homo sapiens
cttgcacctgcatc

SEQ ID NO: 147004 - DNA, 21 bp, Homo sapiens
cttgcatggtttagaaagctt

SEQ ID NO: 147005 - DNA, 15 bp, Homo sapiens
cttgccactgcctct

SEQ ID NO: 147006 - DNA, 19 bp, Homo sapiens
cttgcccagagatgcctcc

SEQ ID NO: 147007 - DNA, 13 bp, Homo sapiens
cttgcccagggct

SEQ ID NO: 147008 - DNA, 20 bp, Homo sapiens
cttgcccagggctcagcctg

SEQ ID NO: 147009 - DNA, 17 bp, Homo sapiens
cttgcctcaatgccagt

SEQ ID NO: 147010 - DNA, 20 bp, Homo sapiens
cttgccttattagagtgtct

SEQ ID NO: 147011 - DNA, 20 bp, Homo sapiens
cttgctcgctgtaaaatctt

SEQ ID NO: 147012 - DNA, 21 bp, Homo sapiens
cttgctggacggggactgggg

SEQ ID NO: 147013 - DNA, 15 bp, Homo sapiens
cttggaagagcctgc

SEQ ID NO: 147014 - DNA, 22 bp, Homo sapiens
cttggactattataatttaatg

SEQ ID NO: 147015 - DNA, 22 bp, Homo sapiens
cttggagccaatggagactgtc

SEQ ID NO: 147016 - DNA, 14 bp, Homo sapiens
cttggagggaccaa

SEQ ID NO: 147017 - DNA, 18 bp, Homo sapiens
cttggataatgctgttgc

SEQ ID NO: 147018 - DNA, 22 bp, Homo sapiens
cttggataatgctgttgcctca

SEQ ID NO: 147019 - DNA, 23 bp, Homo sapiens
cttggataatgctgttgcctcat

SEQ ID NO: 147020 - DNA, 18 bp, Homo sapiens
cttggcagcacctgtctc

SEQ ID NO: 147021 - DNA, 16 bp, Homo sapiens
cttggcatgccttcca

SEQ ID NO: 147022 - DNA, 17 bp, Homo sapiens
cttggcatgccttccag

SEQ ID NO: 147023 - DNA, 16 bp, Homo sapiens
cttggcttctcatacg

SEQ ID NO: 147024 - DNA, 22 bp, Homo sapiens
cttgggaggccccactggggaa

SEQ ID NO: 147025 - DNA, 20 bp, Homo sapiens
cttgggatgatgcctcatga

SEQ ID NO: 147026 - DNA, 14 bp, Homo sapiens
cttgggccactgtg

SEQ ID NO: 147027 - DNA, 18 bp, Homo sapiens
cttgggccactgtgaaga

SEQ ID NO: 147028 - DNA, 16 bp, Homo sapiens
cttgggccctttgagt

SEQ ID NO: 147029 - DNA, 19 bp, Homo sapiens
cttgggccctttgagtgca

SEQ ID NO: 147030 - DNA, 13 bp, Homo sapiens
cttgggctccctg

SEQ ID NO: 147031 - DNA, 15 bp, Homo sapiens
cttggggcaggcagt

SEQ ID NO: 147032 - DNA, 14 bp, Homo sapiens
cttggggcttccta

SEQ ID NO: 147033 - DNA, 16 bp, Homo sapiens
cttggggggctgaggt

SEQ ID NO: 147034 - DNA, 22 bp, Homo sapiens
cttggggggctgaggtgggagg

SEQ ID NO: 147035 - DNA, 15 bp, Homo sapiens
cttggtgtccacctg

SEQ ID NO: 147036 - DNA, 16 bp, Homo sapiens
cttggtgtccacctgg

SEQ ID NO: 147037 - DNA, 19 bp, Homo sapiens
cttggtgtccacctggccc

SEQ ID NO: 147038 - DNA, 13 bp, Homo sapiens
cttggttccccca

SEQ ID NO: 147039 - DNA, 16 bp, Homo sapiens
cttggttcccccactg

SEQ ID NO: 147040 - DNA, 17 bp, Homo sapiens
cttgtaactccaccaac

SEQ ID NO: 147041 - DNA, 15 bp, Homo sapiens
cttgtaattctaaat

SEQ ID NO: 147042 - DNA, 15 bp, Homo sapiens
cttgtatagtgtaaa

SEQ ID NO: 147043 - DNA, 17 bp, Homo sapiens
cttgtatattttaagaa

SEQ ID NO: 147044 - DNA, 12 bp, Homo sapiens
cttgtatttaaa

SEQ ID NO: 147045 - DNA, 20 bp, Homo sapiens
cttgtatttaaatattaaat

SEQ ID NO: 147046 - DNA, 14 bp, Homo sapiens
cttgtctctgggct

SEQ ID NO: 147047 - DNA, 14 bp, Homo sapiens
cttgtcttgttcac

SEQ ID NO: 147048 - DNA, 22 bp, Homo sapiens
cttgtgctggatggagcccagg

SEQ ID NO: 147049 - DNA, 14 bp, Homo sapiens
cttgtggcctggga

SEQ ID NO: 147050 - DNA, 14 bp, Homo sapiens
cttgtggtttatgt

SEQ ID NO: 147051 - DNA, 16 bp, Homo sapiens
cttgttcacactctca

SEQ ID NO: 147052 - DNA, 21 bp, Homo sapiens
cttgttccccactgacagcct

SEQ ID NO: 147053 - DNA, 12 bp, Homo sapiens
cttgtttcaatt

SEQ ID NO: 147054 - DNA, 22 bp, Homo sapiens
cttgtttcaattccacctgcaa

SEQ ID NO: 147055 - DNA, 14 bp, Homo sapiens
gatggagcccaggc

SEQ ID NO: 147056 - DNA, 12 bp, Homo sapiens
gatggaggagga

SEQ ID NO: 147057 - DNA, 18 bp, Homo sapiens
gatggctgtgcctctgcc

SEQ ID NO: 147058 - DNA, 19 bp, Homo sapiens
gatggctgtgcctctgcct

SEQ ID NO: 147059 - DNA, 17 bp, Homo sapiens
gatgggactgggagggc

SEQ ID NO: 147060 - DNA, 14 bp, Homo sapiens
gatggtggagggcc

SEQ ID NO: 147061 - DNA, 16 bp, Homo sapiens
gatgtaaacagtgcct

SEQ ID NO: 147062 - DNA, 19 bp, Homo sapiens
gatgtaccatgaaacaaag

SEQ ID NO: 147063 - DNA, 18 bp, Homo sapiens
gatgtatttttgtaccct

SEQ ID NO: 147064 - DNA, 15 bp, Homo sapiens
gatgtcacagggcca

SEQ ID NO: 147065 - DNA, 14 bp, Homo sapiens
gatgttaaccagaa

SEQ ID NO: 147066 - DNA, 19 bp, Homo sapiens
gatgttcagcactgtccct

SEQ ID NO: 147067 - DNA, 19 bp, Homo sapiens
gatgttctaagtctttcca

SEQ ID NO: 147068 - DNA, 19 bp, Homo sapiens
gatgttgaaaaagttctgc

SEQ ID NO: 147069 - DNA, 23 bp, Homo sapiens
gatgttgaatgcccacaggcaaa

SEQ ID NO: 147070 - DNA, 18 bp, Homo sapiens
gatgtttcttttgtatgt

SEQ ID NO: 147071 - DNA, 14 bp, Homo sapiens
gattaacctctgca

SEQ ID NO: 147072 - DNA, 14 bp, Homo sapiens
gattaccagggact

SEQ ID NO: 147073 - DNA, 14 bp, Homo sapiens
gattacctcctgag

SEQ ID NO: 147074 - DNA, 17 bp, Homo sapiens
gattacctcctgagaaa

SEQ ID NO: 147075 - DNA, 15 bp, Homo sapiens
gattagtaaagaaat

SEQ ID NO: 147076 - DNA, 20 bp, Homo sapiens
gattatagattggagccacc

SEQ ID NO: 147077 - DNA, 13 bp, Homo sapiens
gattattcagtgt

SEQ ID NO: 147078 - DNA, 15 bp, Homo sapiens
gattattcagtgtca

SEQ ID NO: 147079 - DNA, 19 bp, Homo sapiens
gattattctgattccactt

SEQ ID NO: 147080 - DNA, 12 bp, Homo sapiens
gattattggaaa

SEQ ID NO: 147081 - DNA, 18 bp, Homo sapiens
gattcacaatgaaatgct

SEQ ID NO: 147082 - DNA, 17 bp, Homo sapiens
gattcatatttacttct

SEQ ID NO: 147083 - DNA, 18 bp, Homo sapiens
gattcatatttacttctt

SEQ ID NO: 147084 - DNA, 17 bp, Homo sapiens
gattccaaccccaactc

SEQ ID NO: 147085 - DNA, 22 bp, Homo sapiens
gattccaaccccaactccagta

SEQ ID NO: 147086 - DNA, 20 bp, Homo sapiens
gattccagagagtggctcct

SEQ ID NO: 147087 - DNA, 17 bp, Homo sapiens
gattcctttgaagagga

SEQ ID NO: 147088 - DNA, 14 bp, Homo sapiens
gattctcctgtgct

SEQ ID NO: 147089 - DNA, 16 bp, Homo sapiens
gattcttcaaaagcat

SEQ ID NO: 147090 - DNA, 13 bp, Homo sapiens
gattgagaaggag

SEQ ID NO: 147091 - DNA, 16 bp, Homo sapiens
gattgagaaggagaga

SEQ ID NO: 147092 - DNA, 17 bp, Homo sapiens
gattgagaaggagagaa

SEQ ID NO: 147093 - DNA, 19 bp, Homo sapiens
gattgcacgtggcctcttg

SEQ ID NO: 147094 - DNA, 20 bp, Homo sapiens
gattgcacgtggcctcttga

SEQ ID NO: 147095 - DNA, 16 bp, Homo sapiens
gattgctgccccatca

SEQ ID NO: 147096 - DNA, 17 bp, Homo sapiens
gattgcttaaaatagca

SEQ ID NO: 147097 - DNA, 15 bp, Homo sapiens
gattggattattcat

SEQ ID NO: 147098 - DNA, 13 bp, Homo sapiens
gattgtgcccctg

SEQ ID NO: 147099 - DNA, 17 bp, Homo sapiens
gatttaacagtcattta

SEQ ID NO: 147100 - DNA, 19 bp, Homo sapiens
gatttaacagtcatttaaa

SEQ ID NO: 147101 - DNA, 13 bp, Homo sapiens
gatttcatgattt

SEQ ID NO: 147102 - DNA, 21 bp, Homo sapiens
gatttcatttcaactgtttgc

SEQ ID NO: 147103 - DNA, 21 bp, Homo sapiens
gattttaaattcacaatagaa

SEQ ID NO: 147104 - DNA, 20 bp, Homo sapiens
gattttatctgtgaattcag

SEQ ID NO: 147105 - DNA, 23 bp, Homo sapiens
gattttgtatctgcaggcagaca

SEQ ID NO: 147106 - DNA, 17 bp, Homo sapiens
gcaaaagatgcttctca

SEQ ID NO: 147107 - DNA, 17 bp, Homo sapiens
gcaaaagggtgtctgag

SEQ ID NO: 147108 - DNA, 21 bp, Homo sapiens
gcaaaaggttcactaaagcag

SEQ ID NO: 147109 - DNA, 18 bp, Homo sapiens
gcaaaagttctgacttga

SEQ ID NO: 147110 - DNA, 17 bp, Homo sapiens
gcaaaatgaggaatgta

SEQ ID NO: 147111 - DNA, 21 bp, Homo sapiens
gcaaaatttgatgccaggaca

SEQ ID NO: 147112 - DNA, 14 bp, Homo sapiens
gcaaacgctgcctg

SEQ ID NO: 147113 - DNA, 16 bp, Homo sapiens
gcaaagacagaagcct

SEQ ID NO: 147114 - DNA, 18 bp, Homo sapiens
gcaaagaggcaagaggct

SEQ ID NO: 147115 - DNA, 23 bp, Homo sapiens
gcaaagcactgacttctaagtaa

SEQ ID NO: 147116 - DNA, 18 bp, Homo sapiens
gcaaagggagcactgggt

SEQ ID NO: 147117 - DNA, 20 bp, Homo sapiens
gcaaagggagcactgggttg

SEQ ID NO: 147118 - DNA, 20 bp, Homo sapiens
gcaaagtgaagacactggct

SEQ ID NO: 147119 - DNA, 23 bp, Homo sapiens
gcaaagttccctacttcctgtga

SEQ ID NO: 147120 - DNA, 18 bp, Homo sapiens
gcaaatgtcatcagaact

SEQ ID NO: 147121 - DNA, 22 bp, Homo sapiens
gcaactcaaggactttgcagcc

SEQ ID NO: 147122 - DNA, 17 bp, Homo sapiens
gcaagaattgaagcagg

SEQ ID NO: 147123 - DNA, 19 bp, Homo sapiens
gcaagagaattgcttgaac

SEQ ID NO: 147124 - DNA, 22 bp, Homo sapiens
gcaagagccttggtgtccacct

SEQ ID NO: 147125 - DNA, 23 bp, Homo sapiens
gcaagagccttggtgtccacctg

SEQ ID NO: 147126 - DNA, 12 bp, Homo sapiens
gcaagatgtggg

SEQ ID NO: 147127 - DNA, 16 bp, Homo sapiens
gcaagatgtgggcagt

SEQ ID NO: 147128 - DNA, 13 bp, Homo sapiens
gcaagattgctta

SEQ ID NO: 147129 - DNA, 14 bp, Homo sapiens
gcaagattgcttaa

SEQ ID NO: 147130 - DNA, 18 bp, Homo sapiens
gcaagcaagaaacactgg

SEQ ID NO: 147131 - DNA, 19 bp, Homo sapiens
gcaagcctgtaatcccagc

SEQ ID NO: 147132 - DNA, 21 bp, Homo sapiens
gcaaggccgctgttcacccac

SEQ ID NO: 147133 - DNA, 14 bp, Homo sapiens
gcaagggctcccca

SEQ ID NO: 147134 - DNA, 17 bp, Homo sapiens
gcaagtctggatctggg

SEQ ID NO: 147135 - DNA, 18 bp, Homo sapiens
gcaagtgaaggtttacaa

SEQ ID NO: 147136 - DNA, 21 bp, Homo sapiens
gcaagtgaaggtttacaattt

SEQ ID NO: 147137 - DNA, 13 bp, Homo sapiens
gcaagtgtgtgca

SEQ ID NO: 147138 - DNA, 21 bp, Homo sapiens
gcaagtgtgtgcatgtgtgcg

SEQ ID NO: 147139 - DNA, 22 bp, Homo sapiens
gcaagtttctagctagaaatat

SEQ ID NO: 147140 - DNA, 16 bp, Homo sapiens
gcaatgaaaaattctc

SEQ ID NO: 147141 - DNA, 23 bp, Homo sapiens
gcacaaaatgatggacccaatgc

SEQ ID NO: 147142 - DNA, 22 bp, Homo sapiens
gcacaagctgcaccctcaggca

SEQ ID NO: 147143 - DNA, 18 bp, Homo sapiens
gcacacccactcagctcc

SEQ ID NO: 147144 - DNA, 13 bp, Homo sapiens
gcacactttgcca

SEQ ID NO: 147145 - DNA, 12 bp, Homo sapiens
gcacagaaggag

SEQ ID NO: 147146 - DNA, 15 bp, Homo sapiens
gcacagagagggggc

SEQ ID NO: 147147 - DNA, 13 bp, Homo sapiens
gcacagcagcatc

SEQ ID NO: 147148 - DNA, 18 bp, Homo sapiens
gcacagggtctgctcttt

SEQ ID NO: 147149 - DNA, 19 bp, Homo sapiens
gcacagtgcatctcagccc

SEQ ID NO: 147150 - DNA, 20 bp, Homo sapiens
gcacagtgcatctcagccca

SEQ ID NO: 147151 - DNA, 21 bp, Homo sapiens
gcacagtgcatctcagcccac

SEQ ID NO: 147152 - DNA, 14 bp, Homo sapiens
gcacagtgcctgca

SEQ ID NO: 147153 - DNA, 17 bp, Homo sapiens
gcacagttttctgagaa

SEQ ID NO: 147154 - DNA, 20 bp, Homo sapiens
gcacagttttctgagaaaga

SEQ ID NO: 147155 - DNA, 22 bp, Homo sapiens
gcacagttttctgagaaagact

SEQ ID NO: 147156 - DNA, 23 bp, Homo sapiens
gcacagttttctgagaaagacta

SEQ ID NO: 147157 - DNA, 12 bp, Homo sapiens
gcacatgtgtgc

SEQ ID NO: 147158 - DNA, 16 bp, Homo sapiens
gcacatttccccagac

SEQ ID NO: 147159 - DNA, 19 bp, Homo sapiens
gcacatttccccagacctg

SEQ ID NO: 147160 - DNA, 15 bp, Homo sapiens
gcaccaagcaggaaa

SEQ ID NO: 147161 - DNA, 20 bp, Homo sapiens
gcaccactgcactccagcct

SEQ ID NO: 147162 - DNA, 21 bp, Homo sapiens
gcaccactgcactccagcctg

SEQ ID NO: 147163 - DNA, 13 bp, Homo sapiens
gcaccagcagcct

SEQ ID NO: 147164 - DNA, 23 bp, Homo sapiens
gcaccaggcacgaacccacctgc

SEQ ID NO: 147165 - DNA, 21 bp, Homo sapiens
gcaccatccctttttgaagtg

SEQ ID NO: 147166 - DNA, 21 bp, Homo sapiens
gcacccagtgagcactcccaa

SEQ ID NO: 147167 - DNA, 21 bp, Homo sapiens
gcacccccctgggctgagaga

SEQ ID NO: 147168 - DNA, 23 bp, Homo sapiens
gcacctaaaccaccagtgcccaa

SEQ ID NO: 147169 - DNA, 21 bp, Homo sapiens
gcacctactacatcgccctcc

SEQ ID NO: 147170 - DNA, 11 bp, Homo sapiens
gcacctcccat

SEQ ID NO: 147171 - DNA, 23 bp, Homo sapiens
gcacctgcatccgtagttccctg

SEQ ID NO: 147172 - DNA, 18 bp, Homo sapiens
gcaccttaccaactttct

SEQ ID NO: 147173 - DNA, 16 bp, Homo sapiens
gcacgaacccacctgc

SEQ ID NO: 147174 - DNA, 17 bp, Homo sapiens
gcacgaacccacctgct

SEQ ID NO: 147175 - DNA, 20 bp, Homo sapiens
gcacgctgtgggcaggtggg

SEQ ID NO: 147176 - DNA, 19 bp, Homo sapiens
gcactaaagtatgtaaagt

SEQ ID NO: 147177 - DNA, 22 bp, Homo sapiens
gcactaaagtatgtaaagtatg

SEQ ID NO: 147178 - DNA, 13 bp, Homo sapiens
gcactacatgtgg

SEQ ID NO: 147179 - DNA, 18 bp, Homo sapiens
gcactagcctttggctct

SEQ ID NO: 147180 - DNA, 14 bp, Homo sapiens
gcactccagcctgg

SEQ ID NO: 147181 - DNA, 18 bp, Homo sapiens
gcactgacttctaagtaa

SEQ ID NO: 147182 - DNA, 12 bp, Homo sapiens
gcactgctgccc

SEQ ID NO: 147183 - DNA, 14 bp, Homo sapiens
gcactgctgcccag

SEQ ID NO: 147184 - DNA, 11 bp, Homo sapiens
gcactgctgtg

SEQ ID NO: 147185 - DNA, 15 bp, Homo sapiens
gcactgctgtgctgt

SEQ ID NO: 147186 - DNA, 14 bp, Homo sapiens
gcactggtggcccg

SEQ ID NO: 147187 - DNA, 19 bp, Homo sapiens
gcactggtggcccgacagc

SEQ ID NO: 147188 - DNA, 17 bp, Homo sapiens
gcactgtcccttgcctc

SEQ ID NO: 147189 - DNA, 18 bp, Homo sapiens
gcactgtcccttgcctca

SEQ ID NO: 147190 - DNA, 22 bp, Homo sapiens
gcacttcgggaggtcgaggcag

SEQ ID NO: 147191 - DNA, 21 bp, Homo sapiens
gcacttgcacgcccatgtgtg

SEQ ID NO: 147192 - DNA, 13 bp, Homo sapiens
gcacttggagcca

SEQ ID NO: 147193 - DNA, 20 bp, Homo sapiens
gcagaaaagcacctgccgac

SEQ ID NO: 147194 - DNA, 18 bp, Homo sapiens
gcagaacagccgctcctg

SEQ ID NO: 147195 - DNA, 21 bp, Homo sapiens
gcagaacagccgctcctgtct

SEQ ID NO: 147196 - DNA, 12 bp, Homo sapiens
gcagaacagtga

SEQ ID NO: 147197 - DNA, 24 bp, Homo sapiens
gcagaacggagccccaggcctctg

SEQ ID NO: 147198 - DNA, 21 bp, Homo sapiens
gcagaagaattgaacccagga

SEQ ID NO: 147199 - DNA, 14 bp, Homo sapiens
gcagaagacagtat

SEQ ID NO: 147200 - DNA, 21 bp, Homo sapiens
gcagaaggaaaaatgtgtaat

SEQ ID NO: 147201 - DNA, 16 bp, Homo sapiens
gcagacacggatctga

SEQ ID NO: 147202 - DNA, 19 bp, Homo sapiens
gcagacagcagctcaggca

SEQ ID NO: 147203 - DNA, 22 bp, Homo sapiens
gcagacctccccagcccctagc

SEQ ID NO: 147204 - DNA, 13 bp, Homo sapiens
gcagactggtggg

SEQ ID NO: 147205 - DNA, 19 bp, Homo sapiens
gcagagagcggtctcaggc

SEQ ID NO: 147206 - DNA, 22 bp, Homo sapiens
gcagagcttcttccaggtgccc

SEQ ID NO: 147207 - DNA, 19 bp, Homo sapiens
gcagaggctggaggcaggg

SEQ ID NO: 147208 - DNA, 22 bp, Homo sapiens
gcagaggctggaggcagggcct

SEQ ID NO: 147209 - DNA, 18 bp, Homo sapiens
gcagagggcagaggctgg

SEQ ID NO: 147210 - DNA, 23 bp, Homo sapiens
gcagaggtggccagagctgggag

SEQ ID NO: 147211 - DNA, 12 bp, Homo sapiens
gcagagtcagca

SEQ ID NO: 147212 - DNA, 20 bp, Homo sapiens
gcagagttgtaaatatataa

SEQ ID NO: 147213 - DNA, 14 bp, Homo sapiens
gcagatcccagctc

SEQ ID NO: 147214 - DNA, 16 bp, Homo sapiens
gcagatgacccctccc

SEQ ID NO: 147215 - DNA, 16 bp, Homo sapiens
gcagatgcaaagaggc

SEQ ID NO: 147216 - DNA, 18 bp, Homo sapiens
gcagatgcaaagaggcaa

SEQ ID NO: 147217 - DNA, 19 bp, Homo sapiens
gcagatgcaaagaggcaag

SEQ ID NO: 147218 - DNA, 20 bp, Homo sapiens
gcagattgtgtaacaatttt

SEQ ID NO: 147219 - DNA, 19 bp, Homo sapiens
gcagcagtgtgaggccagg

SEQ ID NO: 147220 - DNA, 20 bp, Homo sapiens
gcagcagtgtgaggccaggg

SEQ ID NO: 147221 - DNA, 23 bp, Homo sapiens
gcagcagtgtgaggccagggcag

SEQ ID NO: 147222 - DNA, 14 bp, Homo sapiens
gcagcatatgagga

SEQ ID NO: 147223 - DNA, 20 bp, Homo sapiens
gcagccaagctccttgggag

SEQ ID NO: 147224 - DNA, 21 bp, Homo sapiens
gcagccagcccagcccagctg

SEQ ID NO: 147225 - DNA, 23 bp, Homo sapiens
gcagccagcccagcccagctggt

SEQ ID NO: 147226 - DNA, 18 bp, Homo sapiens
gcagcccacccctcaaca

SEQ ID NO: 147227 - DNA, 13 bp, Homo sapiens
gcagccctcctca

SEQ ID NO: 147228 - DNA, 15 bp, Homo sapiens
gcagccctcctcacc

SEQ ID NO: 147229 - DNA, 13 bp, Homo sapiens
gcagccctgcttt

SEQ ID NO: 147230 - DNA, 24 bp, Homo sapiens
gcagccctgctttgggctgccctg

SEQ ID NO: 147231 - DNA, 19 bp, Homo sapiens
gcagccggcacagggtctg

SEQ ID NO: 147232 - DNA, 15 bp, Homo sapiens
gcagcctcctcctga

SEQ ID NO: 147233 - DNA, 18 bp, Homo sapiens
gcagcctttgcctccccg

SEQ ID NO: 147234 - DNA, 17 bp, Homo sapiens
gcagctcaaaggcacag

SEQ ID NO: 147235 - DNA, 21 bp, Homo sapiens
gcagcttgcgttagaatgagg

SEQ ID NO: 147236 - DNA, 21 bp, Homo sapiens
gcaggaagcattcagagagca

SEQ ID NO: 147237 - DNA, 17 bp, Homo sapiens
gcaggaagctcagactg

SEQ ID NO: 147238 - DNA, 20 bp, Homo sapiens
gcaggacctctgaaaccctg

SEQ ID NO: 147239 - DNA, 14 bp, Homo sapiens
gcaggagattgaga

SEQ ID NO: 147240 - DNA, 22 bp, Homo sapiens
gcaggagattgagaaggagaga

SEQ ID NO: 147241 - DNA, 14 bp, Homo sapiens
gcaggagcctgagc

SEQ ID NO: 147242 - DNA, 20 bp, Homo sapiens
gcaggaggatcacttgagtc

SEQ ID NO: 147243 - DNA, 15 bp, Homo sapiens
gcaggaggccaggcc

SEQ ID NO: 147244 - DNA, 17 bp, Homo sapiens
gcaggaggccaggccgg

SEQ ID NO: 147245 - DNA, 13 bp, Homo sapiens
gcaggcagacacg

SEQ ID NO: 147246 - DNA, 20 bp, Homo sapiens
gcaggcagacacggatctga

SEQ ID NO: 147247 - DNA, 19 bp, Homo sapiens
gcagggacttgaacccata

SEQ ID NO: 147248 - DNA, 16 bp, Homo sapiens
gcagggagggcttctg

SEQ ID NO: 147249 - DNA, 22 bp, Homo sapiens
gcagggattaacctctgcacta

SEQ ID NO: 147250 - DNA, 14 bp, Homo sapiens
gcagggccaggact

SEQ ID NO: 147251 - DNA, 22 bp, Homo sapiens
gcagggctaccctgagctgagg

SEQ ID NO: 147252 - DNA, 17 bp, Homo sapiens
gcaggggctacaagagg

SEQ ID NO: 147253 - DNA, 19 bp, Homo sapiens
gcaggggctacaagaggga

SEQ ID NO: 147254 - DNA, 13 bp, Homo sapiens
ggccctggctccc

SEQ ID NO: 147255 - DNA, 15 bp, Homo sapiens
ggccctggggtccca

SEQ ID NO: 147256 - DNA, 15 bp, Homo sapiens
ggccctgtccctccc

SEQ ID NO: 147257 - DNA, 17 bp, Homo sapiens
ggccctgtccctcccac

SEQ ID NO: 147258 - DNA, 18 bp, Homo sapiens
ggccctgtccctcccacc

SEQ ID NO: 147259 - DNA, 20 bp, Homo sapiens
ggccctgtccctcccacctc

SEQ ID NO: 147260 - DNA, 21 bp, Homo sapiens
ggccctgtccctcccacctct

SEQ ID NO: 147261 - DNA, 17 bp, Homo sapiens
ggccgcattccctgagt

SEQ ID NO: 147262 - DNA, 13 bp, Homo sapiens
ggccgtggctgcc

SEQ ID NO: 147263 - DNA, 16 bp, Homo sapiens
ggccgtggctgcccac

SEQ ID NO: 147264 - DNA, 15 bp, Homo sapiens
ggcctcggagcctca

SEQ ID NO: 147265 - DNA, 16 bp, Homo sapiens
ggcctcgggacacctg

SEQ ID NO: 147266 - DNA, 22 bp, Homo sapiens
ggcctcgggacacctgccctgc

SEQ ID NO: 147267 - DNA, 14 bp, Homo sapiens
ggcctctgtgtcct

SEQ ID NO: 147268 - DNA, 22 bp, Homo sapiens
ggcctgaaaggagcccttatct

SEQ ID NO: 147269 - DNA, 23 bp, Homo sapiens
ggcctgctgggctctccacctca

SEQ ID NO: 147270 - DNA, 21 bp, Homo sapiens
ggcctggactttcctgcaact

SEQ ID NO: 147271 - DNA, 15 bp, Homo sapiens
ggcctggcagccgtg

SEQ ID NO: 147272 - DNA, 16 bp, Homo sapiens
ggccttccccagcctc

SEQ ID NO: 147273 - DNA, 17 bp, Homo sapiens
ggccttccccagcctct

SEQ ID NO: 147274 - DNA, 13 bp, Homo sapiens
ggccttgcccaga

SEQ ID NO: 147275 - DNA, 13 bp, Homo sapiens
ggcctttggcttc

SEQ ID NO: 147276 - DNA, 18 bp, Homo sapiens
ggcgatccacctgtctca

SEQ ID NO: 147277 - DNA, 22 bp, Homo sapiens
ggcgcaagcctgtaatcccagc

SEQ ID NO: 147278 - DNA, 15 bp, Homo sapiens
ggcgccaccatcctg

SEQ ID NO: 147279 - DNA, 24 bp, Homo sapiens
ggcgcccacctccccacgccctcc

SEQ ID NO: 147280 - DNA, 20 bp, Homo sapiens
ggcggctactcagcagccct

SEQ ID NO: 147281 - DNA, 16 bp, Homo sapiens
ggctaatgtactgcat

SEQ ID NO: 147282 - DNA, 19 bp, Homo sapiens
ggctaccctgagctgaggc

SEQ ID NO: 147283 - DNA, 16 bp, Homo sapiens
ggctactcagcagccc

SEQ ID NO: 147284 - DNA, 21 bp, Homo sapiens
ggctactcagcagccctcctc

SEQ ID NO: 147285 - DNA, 14 bp, Homo sapiens
ggctagtcagagag

SEQ ID NO: 147286 - DNA, 20 bp, Homo sapiens
ggctagtgacttgtgtccca

SEQ ID NO: 147287 - DNA, 23 bp, Homo sapiens
ggctagtgacttgtgtcccatga

SEQ ID NO: 147288 - DNA, 23 bp, Homo sapiens
ggctataggtgctacaaaaacac

SEQ ID NO: 147289 - DNA, 22 bp, Homo sapiens
ggctcacccccttctccatcca

SEQ ID NO: 147290 - DNA, 24 bp, Homo sapiens
ggctcacgcctgtaatcccagcag

SEQ ID NO: 147291 - DNA, 22 bp, Homo sapiens
ggctcatattcctgcagcctgg

SEQ ID NO: 147292 - DNA, 13 bp, Homo sapiens
ggctccagagggc

SEQ ID NO: 147293 - DNA, 20 bp, Homo sapiens
ggctccctgtaacctcttca

SEQ ID NO: 147294 - DNA, 20 bp, Homo sapiens
ggctcgattttgtatctgca

SEQ ID NO: 147295 - DNA, 16 bp, Homo sapiens
ggctctccacctcagc

SEQ ID NO: 147296 - DNA, 17 bp, Homo sapiens
ggctctccacctcagcc

SEQ ID NO: 147297 - DNA, 22 bp, Homo sapiens
ggctctccacctcagccttgga

SEQ ID NO: 147298 - DNA, 20 bp, Homo sapiens
ggctctgcaatgggcactgg

SEQ ID NO: 147299 - DNA, 17 bp, Homo sapiens
ggctctggagacagccc

SEQ ID NO: 147300 - DNA, 19 bp, Homo sapiens
ggctctggagacagcccca

SEQ ID NO: 147301 - DNA, 15 bp, Homo sapiens
ggctctggagagaaa

SEQ ID NO: 147302 - DNA, 16 bp, Homo sapiens
ggctcttctcctttca

SEQ ID NO: 147303 - DNA, 23 bp, Homo sapiens
ggctcttgtgctggatggagccc

SEQ ID NO: 147304 - DNA, 17 bp, Homo sapiens
ggctgaacggggagaaa

SEQ ID NO: 147305 - DNA, 24 bp, Homo sapiens
ggctgacacgtccaccccagtgca

SEQ ID NO: 147306 - DNA, 19 bp, Homo sapiens
ggctgacccagtccctggg

SEQ ID NO: 147307 - DNA, 22 bp, Homo sapiens
ggctgagtcatgatctccctgc

SEQ ID NO: 147308 - DNA, 23 bp, Homo sapiens
ggctgagtcatgatctccctgcc

SEQ ID NO: 147309 - DNA, 20 bp, Homo sapiens
ggctgcccacacaccccaat

SEQ ID NO: 147310 - DNA, 16 bp, Homo sapiens
ggctgccctggtgctg

SEQ ID NO: 147311 - DNA, 13 bp, Homo sapiens
ggctggaggcagg

SEQ ID NO: 147312 - DNA, 21 bp, Homo sapiens
ggctggattttgaattttctt

SEQ ID NO: 147313 - DNA, 13 bp, Homo sapiens
ggctggtccaggg

SEQ ID NO: 147314 - DNA, 16 bp, Homo sapiens
ggctgtcagcaggaag

SEQ ID NO: 147315 - DNA, 22 bp, Homo sapiens
ggctgtcctgtacattgtggga

SEQ ID NO: 147316 - DNA, 19 bp, Homo sapiens
ggctgtcttctcaggctct

SEQ ID NO: 147317 - DNA, 14 bp, Homo sapiens
ggctgtgtctaaac

SEQ ID NO: 147318 - DNA, 15 bp, Homo sapiens
ggctgtgtctaaact

SEQ ID NO: 147319 - DNA, 15 bp, Homo sapiens
ggctgttggcagtga

SEQ ID NO: 147320 - DNA, 17 bp, Homo sapiens
ggctgttggcagtgagt

SEQ ID NO: 147321 - DNA, 14 bp, Homo sapiens
ggcttaatgtttat

SEQ ID NO: 147322 - DNA, 17 bp, Homo sapiens
ggcttccatttgtgtgt

SEQ ID NO: 147323 - DNA, 15 bp, Homo sapiens
ggcttcccgctcagc

SEQ ID NO: 147324 - DNA, 21 bp, Homo sapiens
ggcttcccgctcagccctccc

SEQ ID NO: 147325 - DNA, 22 bp, Homo sapiens
ggcttcccgctcagccctccct

SEQ ID NO: 147326 - DNA, 15 bp, Homo sapiens
ggcttctcctgaccc

SEQ ID NO: 147327 - DNA, 14 bp, Homo sapiens
ggcttctctctgtg

SEQ ID NO: 147328 - DNA, 15 bp, Homo sapiens
ggcttggggcttcct

SEQ ID NO: 147329 - DNA, 15 bp, Homo sapiens
ggcttttcactgctg

SEQ ID NO: 147330 - DNA, 17 bp, Homo sapiens
gggaaaattatttgcat

SEQ ID NO: 147331 - DNA, 15 bp, Homo sapiens
gggaacagacaggag

SEQ ID NO: 147332 - DNA, 19 bp, Homo sapiens
gggaaccatgaagacagga

SEQ ID NO: 147333 - DNA, 13 bp, Homo sapiens
gggaactcctgga

SEQ ID NO: 147334 - DNA, 19 bp, Homo sapiens
gggaagaaaagagctttct

SEQ ID NO: 147335 - DNA, 12 bp, Homo sapiens
gggaagccctgg

SEQ ID NO: 147336 - DNA, 16 bp, Homo sapiens
gggaagggagagcggg

SEQ ID NO: 147337 - DNA, 11 bp, Homo sapiens
gggaatgtttg

SEQ ID NO: 147338 - DNA, 16 bp, Homo sapiens
gggaccctttccttcc

SEQ ID NO: 147339 - DNA, 21 bp, Homo sapiens
gggactgaggggaggggagca

SEQ ID NO: 147340 - DNA, 13 bp, Homo sapiens
gggactgggaggg

SEQ ID NO: 147341 - DNA, 14 bp, Homo sapiens
gggactgggagggc

SEQ ID NO: 147342 - DNA, 17 bp, Homo sapiens
gggactgggagggccca

SEQ ID NO: 147343 - DNA, 14 bp, Homo sapiens
gggagactgggctg

SEQ ID NO: 147344 - DNA, 19 bp, Homo sapiens
gggagactgggctgaggga

SEQ ID NO: 147345 - DNA, 18 bp, Homo sapiens
gggagcaggagattgaga

SEQ ID NO: 147346 - DNA, 16 bp, Homo sapiens
gggaggaaaagaaaag

SEQ ID NO: 147347 - DNA, 13 bp, Homo sapiens
gggaggccaagga

SEQ ID NO: 147348 - DNA, 16 bp, Homo sapiens
gggaggccccactggg

SEQ ID NO: 147349 - DNA, 11 bp, Homo sapiens
gggagggcagc

SEQ ID NO: 147350 - DNA, 15 bp, Homo sapiens
gggaggtcgaggtag

SEQ ID NO: 147351 - DNA, 21 bp, Homo sapiens
gggagtatgcaaaagttctga

SEQ ID NO: 147352 - DNA, 21 bp, Homo sapiens
gggagtcatctcaaccatccc

SEQ ID NO: 147353 - DNA, 15 bp, Homo sapiens
gggagtcccgtcagg

SEQ ID NO: 147354 - DNA, 22 bp, Homo sapiens
gggagttgtcaagtctctgctg

SEQ ID NO: 147355 - DNA, 17 bp, Homo sapiens
gggatgccatctgtggg

SEQ ID NO: 147356 - DNA, 15 bp, Homo sapiens
gggatggaggagaag

SEQ ID NO: 147357 - DNA, 23 bp, Homo sapiens
gggatgtatccatgggggcaggg

SEQ ID NO: 147358 - DNA, 13 bp, Homo sapiens
gggcacagggtct

SEQ ID NO: 147359 - DNA, 16 bp, Homo sapiens
gggcacagggtctcta

SEQ ID NO: 147360 - DNA, 17 bp, Homo sapiens
gggcacgctgtgggcag

SEQ ID NO: 147361 - DNA, 11 bp, Homo sapiens
gggcaggcagt

SEQ ID NO: 147362 - DNA, 17 bp, Homo sapiens
gggcaggtgggagcttg

SEQ ID NO: 147363 - DNA, 20 bp, Homo sapiens
gggcatgccccggccacctc

SEQ ID NO: 147364 - DNA, 22 bp, Homo sapiens
gggcatgccccggccacctctg

SEQ ID NO: 147365 - DNA, 23 bp, Homo sapiens
gggcatgccccggccacctctgc

SEQ ID NO: 147366 - DNA, 18 bp, Homo sapiens
gggccacgtgccaggccc

SEQ ID NO: 147367 - DNA, 22 bp, Homo sapiens
gggccagaggaactgtccagag

SEQ ID NO: 147368 - DNA, 12 bp, Homo sapiens
gggccaggcagg

SEQ ID NO: 147369 - DNA, 16 bp, Homo sapiens
gggccctctctgctct

SEQ ID NO: 147370 - DNA, 13 bp, Homo sapiens
gggccctgagctc

SEQ ID NO: 147371 - DNA, 17 bp, Homo sapiens
gggcctcggagcctcat

SEQ ID NO: 147372 - DNA, 9 bp, Homo sapiens
gaggagaaa

SEQ ID NO: 147373 - DNA, 14 bp, Homo sapiens
gaggagaaactgga

SEQ ID NO: 147374 - DNA, 12 bp, Homo sapiens
gaggagaagaat

SEQ ID NO: 147375 - DNA, 11 bp, Homo sapiens
gaggagagagg

SEQ ID NO: 147376 - DNA, 14 bp, Homo sapiens
gaggagagaggcag

SEQ ID NO: 147377 - DNA, 17 bp, Homo sapiens
gaggagagaggcagaga

SEQ ID NO: 147378 - DNA, 16 bp, Homo sapiens
gaggagaggagagagg

SEQ ID NO: 147379 - DNA, 17 bp, Homo sapiens
gaggagaggagagaggc

SEQ ID NO: 147380 - DNA, 18 bp, Homo sapiens
gaggaggcaattgggatg

SEQ ID NO: 147381 - DNA, 22 bp, Homo sapiens
gaggatgagctctacccagggc

SEQ ID NO: 147382 - DNA, 15 bp, Homo sapiens
gaggatgggaaggag

SEQ ID NO: 147383 - DNA, 20 bp, Homo sapiens
gaggatgtcactcagatgga

SEQ ID NO: 147384 - DNA, 17 bp, Homo sapiens
gaggattctatgaggca

SEQ ID NO: 147385 - DNA, 12 bp, Homo sapiens
gaggcagagagc

SEQ ID NO: 147386 - DNA, 13 bp, Homo sapiens
gaggcagagagcg

SEQ ID NO: 147387 - DNA, 21 bp, Homo sapiens
gaggcagcagtgtgaggccag

SEQ ID NO: 147388 - DNA, 22 bp, Homo sapiens
gaggcagggaagtccccaggcc

SEQ ID NO: 147389 - DNA, 21 bp, Homo sapiens
gaggcagggccttgcccagag

SEQ ID NO: 147390 - DNA, 23 bp, Homo sapiens
gaggcagggccttgcccagagat

SEQ ID NO: 147391 - DNA, 15 bp, Homo sapiens
gaggcatggccctgg

SEQ ID NO: 147392 - DNA, 17 bp, Homo sapiens
gaggcatggccctgggg

SEQ ID NO: 147393 - DNA, 22 bp, Homo sapiens
gaggccaaggtgggaggattgc

SEQ ID NO: 147394 - DNA, 15 bp, Homo sapiens
gaggccagggcagag

SEQ ID NO: 147395 - DNA, 14 bp, Homo sapiens
gaggccccactggg

SEQ ID NO: 147396 - DNA, 19 bp, Homo sapiens
gaggccgggtgctcagggc

SEQ ID NO: 147397 - DNA, 16 bp, Homo sapiens
gaggctgaggcaagag

SEQ ID NO: 147398 - DNA, 13 bp, Homo sapiens
gaggctgaggcag

SEQ ID NO: 147399 - DNA, 17 bp, Homo sapiens
gaggctggaggcagggc

SEQ ID NO: 147400 - DNA, 21 bp, Homo sapiens
gaggctgtcttctcaggctct

SEQ ID NO: 147401 - DNA, 22 bp, Homo sapiens
gaggcttcttcagatcagtgct

SEQ ID NO: 147402 - DNA, 15 bp, Homo sapiens
gagggaacagacagg

SEQ ID NO: 147403 - DNA, 19 bp, Homo sapiens
gagggaacagacaggagaa

SEQ ID NO: 147404 - DNA, 12 bp, Homo sapiens
gagggaccagcc

SEQ ID NO: 147405 - DNA, 12 bp, Homo sapiens
gagggagcagac

SEQ ID NO: 147406 - DNA, 14 bp, Homo sapiens
gagggcagaggctg

SEQ ID NO: 147407 - DNA, 13 bp, Homo sapiens
gagggcccagagc

SEQ ID NO: 147408 - DNA, 22 bp, Homo sapiens
gagggcccagagcaggaagcat

SEQ ID NO: 147409 - DNA, 19 bp, Homo sapiens
gaggggcatggccagcagc

SEQ ID NO: 147410 - DNA, 20 bp, Homo sapiens
gaggggcctggcagccgtgc

SEQ ID NO: 147411 - DNA, 18 bp, Homo sapiens
gaggggtctccaggagga

SEQ ID NO: 147412 - DNA, 17 bp, Homo sapiens
gagggttgttctcctag

SEQ ID NO: 147413 - DNA, 15 bp, Homo sapiens
gaggtcaagcccagg

SEQ ID NO: 147414 - DNA, 17 bp, Homo sapiens
gaggtcaaggctgcagt

SEQ ID NO: 147415 - DNA, 20 bp, Homo sapiens
gaggtcgggagttcgagacc

SEQ ID NO: 147416 - DNA, 18 bp, Homo sapiens
gaggtgcagagtgcccag

SEQ ID NO: 147417 - DNA, 21 bp, Homo sapiens
gaggtgcagagtgcccagaac

SEQ ID NO: 147418 - DNA, 15 bp, Homo sapiens
gaggtggaagccctc

SEQ ID NO: 147419 - DNA, 19 bp, Homo sapiens
gaggtggaggttgcagtga

SEQ ID NO: 147420 - DNA, 17 bp, Homo sapiens
gaggtggccagagctgg

SEQ ID NO: 147421 - DNA, 19 bp, Homo sapiens
gaggtggccagagctggga

SEQ ID NO: 147422 - DNA, 23 bp, Homo sapiens
gaggtggccagagctgggaggca

SEQ ID NO: 147423 - DNA, 14 bp, Homo sapiens
gaggtgggagcagg

SEQ ID NO: 147424 - DNA, 17 bp, Homo sapiens
gaggtgggagcaggaga

SEQ ID NO: 147425 - DNA, 19 bp, Homo sapiens
gaggttgcagtgagccaag

SEQ ID NO: 147426 - DNA, 14 bp, Homo sapiens
gagtaatttattgt

SEQ ID NO: 147427 - DNA, 16 bp, Homo sapiens
gagtaatttattgttt

SEQ ID NO: 147428 - DNA, 17 bp, Homo sapiens
gagtagccgagagcctg

SEQ ID NO: 147429 - DNA, 19 bp, Homo sapiens
gagtagccgagagcctgct

SEQ ID NO: 147430 - DNA, 14 bp, Homo sapiens
gagtatatgcactt

SEQ ID NO: 147431 - DNA, 16 bp, Homo sapiens
gccactgcctcttcct

SEQ ID NO: 147432 - DNA, 19 bp, Homo sapiens
gccactgtgaagagaacca

SEQ ID NO: 147433 - DNA, 18 bp, Homo sapiens
gccagaacgtggctctgc

SEQ ID NO: 147434 - DNA, 22 bp, Homo sapiens
gccagacatcaacagataaata

SEQ ID NO: 147435 - DNA, 19 bp, Homo sapiens
gccagactggcacagtttt

SEQ ID NO: 147436 - DNA, 20 bp, Homo sapiens
gccagagacggaagcctttt

SEQ ID NO: 147437 - DNA, 21 bp, Homo sapiens
gccagaggaactgtccagaga

SEQ ID NO: 147438 - DNA, 23 bp, Homo sapiens
gccagaggaactgtccagagagc

SEQ ID NO: 147439 - DNA, 13 bp, Homo sapiens
gccagcaatgaca

SEQ ID NO: 147440 - DNA, 20 bp, Homo sapiens
gccagcaatgacatctcagg

SEQ ID NO: 147441 - DNA, 12 bp, Homo sapiens
gccagcagccag

SEQ ID NO: 147442 - DNA, 16 bp, Homo sapiens
gccagcagccagctct

SEQ ID NO: 147443 - DNA, 17 bp, Homo sapiens
gccagcagccagctctc

SEQ ID NO: 147444 - DNA, 14 bp, Homo sapiens
gccagccagcagcc

SEQ ID NO: 147445 - DNA, 13 bp, Homo sapiens
gccagcccagccc

SEQ ID NO: 147446 - DNA, 14 bp, Homo sapiens
gccagcccagccca

SEQ ID NO: 147447 - DNA, 14 bp, Homo sapiens
gccagccctccctg

SEQ ID NO: 147448 - DNA, 22 bp, Homo sapiens
gccagcgtcctcctctgtgacc

SEQ ID NO: 147449 - DNA, 13 bp, Homo sapiens
gccagctctcagc

SEQ ID NO: 147450 - DNA, 14 bp, Homo sapiens
gccagctctcagcc

SEQ ID NO: 147451 - DNA, 13 bp, Homo sapiens
gccagctctgtat

SEQ ID NO: 147452 - DNA, 15 bp, Homo sapiens
gccaggacaggcccg

SEQ ID NO: 147453 - DNA, 17 bp, Homo sapiens
gccaggactgagccccg

SEQ ID NO: 147454 - DNA, 19 bp, Homo sapiens
gccaggcccccaagcctgc

SEQ ID NO: 147455 - DNA, 19 bp, Homo sapiens
gccaggctccttcctgtct

SEQ ID NO: 147456 - DNA, 19 bp, Homo sapiens
gccagggcagggccccagg

SEQ ID NO: 147457 - DNA, 21 bp, Homo sapiens
gccaggggaaaatcagcctgc

SEQ ID NO: 147458 - DNA, 21 bp, Homo sapiens
gccagggggactagcccctgt

SEQ ID NO: 147459 - DNA, 21 bp, Homo sapiens
gccaggtcaccctttgctgtg

SEQ ID NO: 147460 - DNA, 22 bp, Homo sapiens
gccaggtcaccctttgctgtga

SEQ ID NO: 147461 - DNA, 18 bp, Homo sapiens
gccaggtggccactccag

SEQ ID NO: 147462 - DNA, 21 bp, Homo sapiens
gccagtaacgcgtcttcctga

SEQ ID NO: 147463 - DNA, 23 bp, Homo sapiens
gccagtaagggaaatagaaaaac

SEQ ID NO: 147464 - DNA, 13 bp, Homo sapiens
gccagtgacagac

SEQ ID NO: 147465 - DNA, 14 bp, Homo sapiens
gccagtgacagaca

SEQ ID NO: 147466 - DNA, 20 bp, Homo sapiens
gccagtgacctgaggaagcg

SEQ ID NO: 147467 - DNA, 11 bp, Homo sapiens
gccagtgcctt

SEQ ID NO: 147468 - DNA, 23 bp, Homo sapiens
gccagtgccttacctcctgccca

SEQ ID NO: 147469 - DNA, 14 bp, Homo sapiens
gccatccctcgtgg

SEQ ID NO: 147470 - DNA, 19 bp, Homo sapiens
gccatgccagcttatctca

SEQ ID NO: 147471 - DNA, 24 bp, Homo sapiens
gccatgctcctggcccactgcatc

SEQ ID NO: 147472 - DNA, 15 bp, Homo sapiens
gccatggaggcacac

SEQ ID NO: 147473 - DNA, 14 bp, Homo sapiens
gccattgcactcca

SEQ ID NO: 147474 - DNA, 14 bp, Homo sapiens
gcccaacctgctct

SEQ ID NO: 147475 - DNA, 22 bp, Homo sapiens
gcccaagaatagatgctgactg

SEQ ID NO: 147476 - DNA, 13 bp, Homo sapiens
gcccacagctccc

SEQ ID NO: 147477 - DNA, 19 bp, Homo sapiens
gcccacagctcccacccca

SEQ ID NO: 147478 - DNA, 20 bp, Homo sapiens
gcccacatagtgatggttcc

SEQ ID NO: 147479 - DNA, 17 bp, Homo sapiens
gcccaccaacatcccat

SEQ ID NO: 147480 - DNA, 15 bp, Homo sapiens
gcccacccctcaaca

SEQ ID NO: 147481 - DNA, 14 bp, Homo sapiens
gctggagaagagag

SEQ ID NO: 147482 - DNA, 15 bp, Homo sapiens
gctggagaagagagg

SEQ ID NO: 147483 - DNA, 20 bp, Homo sapiens
gctggagaagagaggagagg

SEQ ID NO: 147484 - DNA, 21 bp, Homo sapiens
gctggagaagagaggagagga

SEQ ID NO: 147485 - DNA, 14 bp, Homo sapiens
gctggagctctgcc

SEQ ID NO: 147486 - DNA, 17 bp, Homo sapiens
gctggagctctgcccat

SEQ ID NO: 147487 - DNA, 14 bp, Homo sapiens
gctggaggcagggc

SEQ ID NO: 147488 - DNA, 15 bp, Homo sapiens
gctggaggcagggcc

SEQ ID NO: 147489 - DNA, 19 bp, Homo sapiens
gctggaggtgggagcagga

SEQ ID NO: 147490 - DNA, 15 bp, Homo sapiens
gctggatgatggtct

SEQ ID NO: 147491 - DNA, 19 bp, Homo sapiens
gctggcaaagacagaagcc

SEQ ID NO: 147492 - DNA, 23 bp, Homo sapiens
gctggcacatttccccagacctg

SEQ ID NO: 147493 - DNA, 18 bp, Homo sapiens
gctggcctctggctctca

SEQ ID NO: 147494 - DNA, 19 bp, Homo sapiens
gctgggagggatagagggg

SEQ ID NO: 147495 - DNA, 12 bp, Homo sapiens
gctgggcagctg

SEQ ID NO: 147496 - DNA, 13 bp, Homo sapiens
gctgggcagctgt

SEQ ID NO: 147497 - DNA, 21 bp, Homo sapiens
gctgggctctccacctcagcc

SEQ ID NO: 147498 - DNA, 14 bp, Homo sapiens
gctgggctgggcgc

SEQ ID NO: 147499 - DNA, 21 bp, Homo sapiens
gctgggtggcaccagcagcct

SEQ ID NO: 147500 - DNA, 22 bp, Homo sapiens
gctgggtggcaccagcagcctg

SEQ ID NO: 147501 - DNA, 23 bp, Homo sapiens
gctgggtggcaccagcagcctgg

SEQ ID NO: 147502 - DNA, 21 bp, Homo sapiens
gctggtagagatggaggagga

SEQ ID NO: 147503 - DNA, 23 bp, Homo sapiens
gctggtagagatggaggaggagg

SEQ ID NO: 147504 - DNA, 18 bp, Homo sapiens
gctggtcactgccatgga

SEQ ID NO: 147505 - DNA, 19 bp, Homo sapiens
gctggtccagggctagtga

SEQ ID NO: 147506 - DNA, 12 bp, Homo sapiens
gctggtgggagg

SEQ ID NO: 147507 - DNA, 14 bp, Homo sapiens
gctgtaaaatcttg

SEQ ID NO: 147508 - DNA, 15 bp, Homo sapiens
gctgtaaataaatgc

SEQ ID NO: 147509 - DNA, 21 bp, Homo sapiens
gctgtacaaatataagaataa

SEQ ID NO: 147510 - DNA, 20 bp, Homo sapiens
gctgtagtagccctttctgt

SEQ ID NO: 147511 - DNA, 21 bp, Homo sapiens
gctgtagtagccctttctgtg

SEQ ID NO: 147512 - DNA, 17 bp, Homo sapiens
gctgtattaagccactt

SEQ ID NO: 147513 - DNA, 19 bp, Homo sapiens
gctgtattagtcacagaga

SEQ ID NO: 147514 - DNA, 14 bp, Homo sapiens
gctgtccctgtcac

SEQ ID NO: 147515 - DNA, 17 bp, Homo sapiens
gctgtctccatgtttga

SEQ ID NO: 147516 - DNA, 16 bp, Homo sapiens
gctgtgacttctccag

SEQ ID NO: 147517 - DNA, 15 bp, Homo sapiens
gctgtgagcccctgg

SEQ ID NO: 147518 - DNA, 21 bp, Homo sapiens
ggagagggtctggagaagcag

SEQ ID NO: 147519 - DNA, 11 bp, Homo sapiens
ggagaggtctt

SEQ ID NO: 147520 - DNA, 23 bp, Homo sapiens
ggagaggtcttttttaaaaggaa

SEQ ID NO: 147521 - DNA, 22 bp, Homo sapiens
ggagatatttatggggggagaa

SEQ ID NO: 147522 - DNA, 19 bp, Homo sapiens
ggagatggaggaaagtgat

SEQ ID NO: 147523 - DNA, 12 bp, Homo sapiens
ggagcagagggg

SEQ ID NO: 147524 - DNA, 15 bp, Homo sapiens
ggagcaggagattga

SEQ ID NO: 147525 - DNA, 21 bp, Homo sapiens
ggagcaggagattgagaagga

SEQ ID NO: 147526 - DNA, 16 bp, Homo sapiens
ggagccactcctctga

SEQ ID NO: 147527 - DNA, 13 bp, Homo sapiens
ggagccgcagcag

SEQ ID NO: 147528 - DNA, 21 bp, Homo sapiens
ggagcctcatccgaggcaggg

SEQ ID NO: 147529 - DNA, 20 bp, Homo sapiens
ggagcttcatggcagaaggc

SEQ ID NO: 147530 - DNA, 20 bp, Homo sapiens
ggaggaaaaccaagccgtgg

SEQ ID NO: 147531 - DNA, 22 bp, Homo sapiens
ggaggaaaaccaagccgtggct

SEQ ID NO: 147532 - DNA, 12 bp, Homo sapiens
ggaggaagagaa

SEQ ID NO: 147533 - DNA, 13 bp, Homo sapiens
ggaggaaggagag

SEQ ID NO: 147534 - DNA, 21 bp, Homo sapiens
ggaggactgccccgtgcagac

SEQ ID NO: 147535 - DNA, 13 bp, Homo sapiens
ggaggaggaggca

SEQ ID NO: 147536 - DNA, 17 bp, Homo sapiens
ggaggattctatgaggc

SEQ ID NO: 147537 - DNA, 16 bp, Homo sapiens
ggaggcacacagctgc

SEQ ID NO: 147538 - DNA, 15 bp, Homo sapiens
ggaggcatggccctg

SEQ ID NO: 147539 - DNA, 16 bp, Homo sapiens
ggaggccagccagtga

SEQ ID NO: 147540 - DNA, 18 bp, Homo sapiens
ggaggctccagagggcac

SEQ ID NO: 147541 - DNA, 19 bp, Homo sapiens
ggaggctgagatgggagaa

SEQ ID NO: 147542 - DNA, 16 bp, Homo sapiens
ggaggctgaggcagaa

SEQ ID NO: 147543 - DNA, 16 bp, Homo sapiens
ggagggcagcagggct

SEQ ID NO: 147544 - DNA, 13 bp, Homo sapiens
ggaggggcctggc

SEQ ID NO: 147545 - DNA, 16 bp, Homo sapiens
ggagggtcaggaagga

SEQ ID NO: 147546 - DNA, 14 bp, Homo sapiens
ggaggtcgaggcag

SEQ ID NO: 147547 - DNA, 15 bp, Homo sapiens
ggaggtcgaggcagg

SEQ ID NO: 147548 - DNA, 16 bp, Homo sapiens
ggaggtcgaggcagga

SEQ ID NO: 147549 - DNA, 19 bp, Homo sapiens
ggaggttaaggctgaggaa

SEQ ID NO: 147550 - DNA, 13 bp, Homo sapiens
ggagtatctggga

SEQ ID NO: 147551 - DNA, 15 bp, Homo sapiens
ggagtctgaagcaga

SEQ ID NO: 147552 - DNA, 12 bp, Homo sapiens
ggagtgttcccc

SEQ ID NO: 147553 - DNA, 20 bp, Homo sapiens
ggagtgttccccttccactg

SEQ ID NO: 147554 - DNA, 22 bp, Homo sapiens
ggagttacattaatgttaattc

SEQ ID NO: 147555 - DNA, 19 bp, Homo sapiens
ggagttagaggccagcctg

SEQ ID NO: 147556 - DNA, 21 bp, Homo sapiens
ggagttggaagtgtgtgatct

SEQ ID NO: 147557 - DNA, 14 bp, Homo sapiens
ggataacctatatg

SEQ ID NO: 147558 - DNA, 15 bp, Homo sapiens
ggatactgcagggcc

SEQ ID NO: 147559 - DNA, 18 bp, Homo sapiens
ggatagttgctccgcctc

SEQ ID NO: 147560 - DNA, 13 bp, Homo sapiens
ggatccctcatct

SEQ ID NO: 147561 - DNA, 22 bp, Homo sapiens
ggatccctcatctgtccctccg

SEQ ID NO: 147562 - DNA, 18 bp, Homo sapiens
ggatctcttgagcctggg

SEQ ID NO: 147563 - DNA, 16 bp, Homo sapiens
ggatctgtgcccagag

SEQ ID NO: 147564 - DNA, 17 bp, Homo sapiens
ggatgaaattttctaga

SEQ ID NO: 147565 - DNA, 13 bp, Homo sapiens
ggatgagcattta

SEQ ID NO: 147566 - DNA, 17 bp, Homo sapiens
ggatgattggattattc

SEQ ID NO: 147567 - DNA, 16 bp, Homo sapiens
ggatgcagagtcagca

SEQ ID NO: 147568 - DNA, 23 bp, Homo sapiens
ggatgcccagggccactctgcct

SEQ ID NO: 147569 - DNA, 12 bp, Homo sapiens
ggatggcaagat

SEQ ID NO: 147570 - DNA, 15 bp, Homo sapiens
ggatgggaaggaggg

SEQ ID NO: 147571 - DNA, 17 bp, Homo sapiens
ggatgggaaggagggag

SEQ ID NO: 147572 - DNA, 19 bp, Homo sapiens
ggatgtaaacagtgcctgc

SEQ ID NO: 147573 - DNA, 15 bp, Homo sapiens
ggatgtcacagggcc

SEQ ID NO: 147574 - DNA, 15 bp, Homo sapiens
ggatgtgggagggag

SEQ ID NO: 147575 - DNA, 23 bp, Homo sapiens
ggatgtgggagggagcagacagg

SEQ ID NO: 147576 - DNA, 15 bp, Homo sapiens
ggattaacctctgca

SEQ ID NO: 147577 - DNA, 18 bp, Homo sapiens
ggattaacctctgcacta

SEQ ID NO: 147578 - DNA, 17 bp, Homo sapiens
ggattattcatttaaaa

SEQ ID NO: 147579 - DNA, 19 bp, Homo sapiens
ggattggggaagactgtgg

SEQ ID NO: 147580 - DNA, 14 bp, Homo sapiens
ggatttatttttcc

SEQ ID NO: 147581 - DNA, 13 bp, Homo sapiens
ggcaaacccatca

SEQ ID NO: 147582 - DNA, 22 bp, Homo sapiens
ggcaaagcacgaaatgttattt

SEQ ID NO: 147583 - DNA, 20 bp, Homo sapiens
ggcaaccacaggcagcattt

SEQ ID NO: 147584 - DNA, 19 bp, Homo sapiens
ggcaactgcattggctttg

SEQ ID NO: 147585 - DNA, 19 bp, Homo sapiens
ggcaagcccctgcccatct

SEQ ID NO: 147586 - DNA, 23 bp, Homo sapiens
ggcaagctgtgacttctccaggt

SEQ ID NO: 147587 - DNA, 18 bp, Homo sapiens
ggcacagcggggccccag

SEQ ID NO: 147588 - DNA, 17 bp, Homo sapiens
ggcacagggtctgctct

SEQ ID NO: 147589 - DNA, 20 bp, Homo sapiens
ggcacatttccccagacctg

SEQ ID NO: 147590 - DNA, 17 bp, Homo sapiens
ggcacctataaaacagg

SEQ ID NO: 147591 - DNA, 17 bp, Homo sapiens
ggcacgaacccacctgc

SEQ ID NO: 147592 - DNA, 18 bp, Homo sapiens
ggcacgaacccacctgct

SEQ ID NO: 147593 - DNA, 15 bp, Homo sapiens
ggcactagcctttgg

SEQ ID NO: 147594 - DNA, 20 bp, Homo sapiens
ggcactagcctttggctctg

SEQ ID NO: 147595 - DNA, 18 bp, Homo sapiens
ggcagaacagccgctcct

SEQ ID NO: 147596 - DNA, 20 bp, Homo sapiens
ggcagaacagccgctcctgt

SEQ ID NO: 147597 - DNA, 17 bp, Homo sapiens
ggcagaagaattgaacc

SEQ ID NO: 147598 - DNA, 14 bp, Homo sapiens
ggcagacagcagct

SEQ ID NO: 147599 - DNA, 13 bp, Homo sapiens
ggcagagcttctt

SEQ ID NO: 147600 - DNA, 19 bp, Homo sapiens
ggcagaggctggaggcagg

SEQ ID NO: 147601 - DNA, 19 bp, Homo sapiens
ggcagagggcagaggctgg

SEQ ID NO: 147602 - DNA, 14 bp, Homo sapiens
ggcagagttgtaaa

SEQ ID NO: 147603 - DNA, 16 bp, Homo sapiens
ggcagagttgtaaata

SEQ ID NO: 147604 - DNA, 18 bp, Homo sapiens
ggcagagttgtaaatata

SEQ ID NO: 147605 - DNA, 22 bp, Homo sapiens
ggcagagttgtaaatatataaa

SEQ ID NO: 147606 - DNA, 19 bp, Homo sapiens
ggcagataatcagcctctt

SEQ ID NO: 147607 - DNA, 21 bp, Homo sapiens
ggcagcacagagacccccgga

SEQ ID NO: 147608 - DNA, 20 bp, Homo sapiens
ggcagcagtgtgaggccagg

SEQ ID NO: 147609 - DNA, 22 bp, Homo sapiens
ggcagcagtgtgaggccagggc

SEQ ID NO: 147610 - DNA, 19 bp, Homo sapiens
ggcagccgtgccttcagct

SEQ ID NO: 147611 - DNA, 21 bp, Homo sapiens
ggcagccgtgccttcagctct

SEQ ID NO: 147612 - DNA, 22 bp, Homo sapiens
ggcagccgtgccttcagctcta

SEQ ID NO: 147613 - DNA, 17 bp, Homo sapiens
ggcagggtcaggagagg

SEQ ID NO: 147614 - DNA, 13 bp, Homo sapiens
ggcagtctggagg

SEQ ID NO: 147615 - DNA, 21 bp, Homo sapiens
ggcagttctgggtgctcccta

SEQ ID NO: 147616 - DNA, 15 bp, Homo sapiens
ggcatagcccagaca

SEQ ID NO: 147617 - DNA, 22 bp, Homo sapiens
ggcatatccaccacctccctca

SEQ ID NO: 147618 - DNA, 18 bp, Homo sapiens
ggcatcaccttaggcagg

SEQ ID NO: 147619 - DNA, 15 bp, Homo sapiens
ggcatgccccggcca

SEQ ID NO: 147620 - DNA, 19 bp, Homo sapiens
ggcatgccccggccacctc

SEQ ID NO: 147621 - DNA, 20 bp, Homo sapiens
ggcatgccccggccacctct

SEQ ID NO: 147622 - DNA, 18 bp, Homo sapiens
ggcatggccaggtggcca

SEQ ID NO: 147623 - DNA, 12 bp, Homo sapiens
ggcatggccctg

SEQ ID NO: 147624 - DNA, 19 bp, Homo sapiens
ggcatggtacggagatgtt

SEQ ID NO: 147625 - DNA, 21 bp, Homo sapiens
ggcatggtggcgcaagcctgt

SEQ ID NO: 147626 - DNA, 22 bp, Homo sapiens
ggccaaaggagggtcaggaagg

SEQ ID NO: 147627 - DNA, 21 bp, Homo sapiens
ggccaacttgagggcccagag

SEQ ID NO: 147628 - DNA, 22 bp, Homo sapiens
ggccaacttgagggcccagagc

SEQ ID NO: 147629 - DNA, 23 bp, Homo sapiens
ggccaacttgagggcccagagca

SEQ ID NO: 147630 - DNA, 15 bp, Homo sapiens
gggcctgagcctggc

SEQ ID NO: 147631 - DNA, 21 bp, Homo sapiens
gggcctgcaggacctgcctgt

SEQ ID NO: 147632 - DNA, 24 bp, Homo sapiens
gggcctgcaggacctgcctgtagc

SEQ ID NO: 147633 - DNA, 16 bp, Homo sapiens
gggcgcggtggctcac

SEQ ID NO: 147634 - DNA, 13 bp, Homo sapiens
gggctaccctgag

SEQ ID NO: 147635 - DNA, 20 bp, Homo sapiens
gggctaccctgagctgaggc

SEQ ID NO: 147636 - DNA, 21 bp, Homo sapiens
gggctaccctgagctgaggca

SEQ ID NO: 147637 - DNA, 16 bp, Homo sapiens
gggctcagcctggtgg

SEQ ID NO: 147638 - DNA, 13 bp, Homo sapiens
gggctctcagctc

SEQ ID NO: 147639 - DNA, 13 bp, Homo sapiens
gggctctccacct

SEQ ID NO: 147640 - DNA, 18 bp, Homo sapiens
gggctctccacctcagcc

SEQ ID NO: 147641 - DNA, 18 bp, Homo sapiens
gggctgaacggggagaaa

SEQ ID NO: 147642 - DNA, 21 bp, Homo sapiens
gggctgccctggtgctgccac

SEQ ID NO: 147643 - DNA, 16 bp, Homo sapiens
gggctgctcctccagg

SEQ ID NO: 147644 - DNA, 17 bp, Homo sapiens
gggctgctgacctccac

SEQ ID NO: 147645 - DNA, 18 bp, Homo sapiens
gggctgggagctctgcag

SEQ ID NO: 147646 - DNA, 23 bp, Homo sapiens
gggcttccatttgtgtgtgtgca

SEQ ID NO: 147647 - DNA, 13 bp, Homo sapiens
gggcttctcctga

SEQ ID NO: 147648 - DNA, 21 bp, Homo sapiens
ggggaaaatcagcctgctcca

SEQ ID NO: 147649 - DNA, 17 bp, Homo sapiens
ggggagactgggctgag

SEQ ID NO: 147650 - DNA, 17 bp, Homo sapiens
ggggagtctgaagcaga

SEQ ID NO: 147651 - DNA, 17 bp, Homo sapiens
ggggatcacagcctctg

SEQ ID NO: 147652 - DNA, 16 bp, Homo sapiens
ggggcagagggcagag

SEQ ID NO: 147653 - DNA, 10 bp, Homo sapiens
ggggcaggca

SEQ ID NO: 147654 - DNA, 11 bp, Homo sapiens
ggggcagtctg

SEQ ID NO: 147655 - DNA, 12 bp, Homo sapiens
ggggccagagga

SEQ ID NO: 147656 - DNA, 23 bp, Homo sapiens
ggggccagaggaactgtccagag

SEQ ID NO: 147657 - DNA, 12 bp, Homo sapiens
ggggcctccctg

SEQ ID NO: 147658 - DNA, 11 bp, Homo sapiens
ggggcctggca

SEQ ID NO: 147659 - DNA, 12 bp, Homo sapiens
ggggcctggcag

SEQ ID NO: 147660 - DNA, 15 bp, Homo sapiens
ggggctacaagaggg

SEQ ID NO: 147661 - DNA, 16 bp, Homo sapiens
ggggctacaagaggga

SEQ ID NO: 147662 - DNA, 13 bp, Homo sapiens
ggggctctggaga

SEQ ID NO: 147663 - DNA, 16 bp, Homo sapiens
ggggctctggagagaa

SEQ ID NO: 147664 - DNA, 22 bp, Homo sapiens
gggggagtctgaagcagatgca

SEQ ID NO: 147665 - DNA, 17 bp, Homo sapiens
gggggatcacagcctct

SEQ ID NO: 147666 - DNA, 17 bp, Homo sapiens
gggggccacctccccag

SEQ ID NO: 147667 - DNA, 20 bp, Homo sapiens
gggggctgcctggcccccag

SEQ ID NO: 147668 - DNA, 15 bp, Homo sapiens
ggggtctccaggagg

SEQ ID NO: 147669 - DNA, 22 bp, Homo sapiens
ggggttctttcttcctctgctg

SEQ ID NO: 147670 - DNA, 19 bp, Homo sapiens
gggtcaggaaggatgagca

SEQ ID NO: 147671 - DNA, 16 bp, Homo sapiens
gggtccttccctctcc

SEQ ID NO: 147672 - DNA, 15 bp, Homo sapiens
gggtgagatgctgga

SEQ ID NO: 147673 - DNA, 20 bp, Homo sapiens
gggtgagatgctggagaaga

SEQ ID NO: 147674 - DNA, 23 bp, Homo sapiens
gggtggggacgtcctgccacctg

SEQ ID NO: 147675 - DNA, 14 bp, Homo sapiens
gggtggggctgctc

SEQ ID NO: 147676 - DNA, 18 bp, Homo sapiens
gggtgtaacaggtctcct

SEQ ID NO: 147677 - DNA, 19 bp, Homo sapiens
gggtgtaacaggtctcctc

SEQ ID NO: 147678 - DNA, 17 bp, Homo sapiens
gggttcagcccctcctc

SEQ ID NO: 147679 - DNA, 19 bp, Homo sapiens
gggttcagcccctcctctg

SEQ ID NO: 147680 - DNA, 19 bp, Homo sapiens
gggttctttcttcctctgc

SEQ ID NO: 147681 - DNA, 16 bp, Homo sapiens
ggtaaacacgcctgca

SEQ ID NO: 147682 - DNA, 13 bp, Homo sapiens
ggtaaggtgcctt

SEQ ID NO: 147683 - DNA, 14 bp, Homo sapiens
ggtaccactgattt

SEQ ID NO: 147684 - DNA, 12 bp, Homo sapiens
ggtaccttgaac

SEQ ID NO: 147685 - DNA, 17 bp, Homo sapiens
ggtagagatggaggagg

SEQ ID NO: 147686 - DNA, 17 bp, Homo sapiens
ggtagaggatgaggaaa

SEQ ID NO: 147687 - DNA, 17 bp, Homo sapiens
ggtagctagaggaacca

SEQ ID NO: 147688 - DNA, 15 bp, Homo sapiens
ggtagctgcccctgg

SEQ ID NO: 147689 - DNA, 21 bp, Homo sapiens
ggtataaaactttcctcgcct

SEQ ID NO: 147690 - DNA, 22 bp, Homo sapiens
ggtatatcattataactgaagg

SEQ ID NO: 147691 - DNA, 13 bp, Homo sapiens
ggtcaagcccagg

SEQ ID NO: 147692 - DNA, 16 bp, Homo sapiens
ggtcacaggactctgc

SEQ ID NO: 147693 - DNA, 21 bp, Homo sapiens
ggtcaggagttcctaaccagc

SEQ ID NO: 147694 - DNA, 12 bp, Homo sapiens
ggtccagggcta

SEQ ID NO: 147695 - DNA, 14 bp, Homo sapiens
ggtccatgggcaga

SEQ ID NO: 147696 - DNA, 21 bp, Homo sapiens
ggtcccttgagacctcagcca

SEQ ID NO: 147697 - DNA, 22 bp, Homo sapiens
ggtcctaccaatagattcccca

SEQ ID NO: 147698 - DNA, 17 bp, Homo sapiens
ggtcctgagggtcccca

SEQ ID NO: 147699 - DNA, 15 bp, Homo sapiens
ggtcctttggggtga

SEQ ID NO: 147700 - DNA, 18 bp, Homo sapiens
ggtctcacagtgttgccc

SEQ ID NO: 147701 - DNA, 19 bp, Homo sapiens
ggtctcacagtgttgccca

SEQ ID NO: 147702 - DNA, 22 bp, Homo sapiens
ggtctccctctcctgcctactc

SEQ ID NO: 147703 - DNA, 23 bp, Homo sapiens
ggtctgcctcttctgggagggca

SEQ ID NO: 147704 - DNA, 18 bp, Homo sapiens
ggtctgctctttctctgc

SEQ ID NO: 147705 - DNA, 21 bp, Homo sapiens
ggtctgggaggaatggacaga

SEQ ID NO: 147706 - DNA, 23 bp, Homo sapiens
ggtgagatgctggagaagagagg

SEQ ID NO: 147707 - DNA, 18 bp, Homo sapiens
ggtgcaaagttccctact

SEQ ID NO: 147708 - DNA, 16 bp, Homo sapiens
ggtgcagagctgaaga

SEQ ID NO: 147709 - DNA, 16 bp, Homo sapiens
ggtgcagagtgcccag

SEQ ID NO: 147710 - DNA, 22 bp, Homo sapiens
ggtgccccccttgccagacatg

SEQ ID NO: 147711 - DNA, 22 bp, Homo sapiens
ggtgcccttggaggccagccag

SEQ ID NO: 147712 - DNA, 17 bp, Homo sapiens
ggtgcctgtgaggcagg

SEQ ID NO: 147713 - DNA, 19 bp, Homo sapiens
ggtgcctgtgaggcagggg

SEQ ID NO: 147714 - DNA, 22 bp, Homo sapiens
ggtgctacacccttttccagct

SEQ ID NO: 147715 - DNA, 16 bp, Homo sapiens
ggtgctggaggtggga

SEQ ID NO: 147716 - DNA, 21 bp, Homo sapiens
ggtgcttgttccctctccctg

SEQ ID NO: 147717 - DNA, 12 bp, Homo sapiens
ggtggacccagg

SEQ ID NO: 147718 - DNA, 18 bp, Homo sapiens
ggtggacttagaaagcag

SEQ ID NO: 147719 - DNA, 13 bp, Homo sapiens
ggtggagggccac

SEQ ID NO: 147720 - DNA, 13 bp, Homo sapiens
ggtggcaagagcc

SEQ ID NO: 147721 - DNA, 14 bp, Homo sapiens
ggtggcaccagcag

SEQ ID NO: 147722 - DNA, 20 bp, Homo sapiens
ggtggcaccagcagcctgga

SEQ ID NO: 147723 - DNA, 18 bp, Homo sapiens
ggtggcccgacagcctgg

SEQ ID NO: 147724 - DNA, 22 bp, Homo sapiens
ggtggcctcgggacacctgccc

SEQ ID NO: 147725 - DNA, 15 bp, Homo sapiens
ggtggctagtcagag

SEQ ID NO: 147726 - DNA, 16 bp, Homo sapiens
ggtggctagtcagaga

SEQ ID NO: 147727 - DNA, 17 bp, Homo sapiens
ggtggctagtcagagag

SEQ ID NO: 147728 - DNA, 15 bp, Homo sapiens
ggtggctgacccagt

SEQ ID NO: 147729 - DNA, 21 bp, Homo sapiens
ggtggctgacccagtccctgg

SEQ ID NO: 147730 - DNA, 23 bp, Homo sapiens
ggtggctgacccagtccctgggg

SEQ ID NO: 147731 - DNA, 21 bp, Homo sapiens
ggtgggaaccatgaagacagg

SEQ ID NO: 147732 - DNA, 16 bp, Homo sapiens
ggtgggttttcttccc

SEQ ID NO: 147733 - DNA, 16 bp, Homo sapiens
ggtggtctgcaggcag

SEQ ID NO: 147734 - DNA, 17 bp, Homo sapiens
ggtggtctgcaggcagg

SEQ ID NO: 147735 - DNA, 17 bp, Homo sapiens
ggtgtcctttccctcca

SEQ ID NO: 147736 - DNA, 23 bp, Homo sapiens
ggtgtggagaagcggctggcagc

SEQ ID NO: 147737 - DNA, 17 bp, Homo sapiens
ggtgttttaaaaaatct

SEQ ID NO: 147738 - DNA, 13 bp, Homo sapiens
ggttaaaactgtc

SEQ ID NO: 147739 - DNA, 15 bp, Homo sapiens
ggttaaggctgagga

SEQ ID NO: 147740 - DNA, 22 bp, Homo sapiens
ggttaaggctgaggaaaggcca

SEQ ID NO: 147741 - DNA, 13 bp, Homo sapiens
ggttaataagttt

SEQ ID NO: 147742 - DNA, 13 bp, Homo sapiens
ggttatggagagg

SEQ ID NO: 147743 - DNA, 20 bp, Homo sapiens
ggttcacgtgcagctcaagg

SEQ ID NO: 147744 - DNA, 20 bp, Homo sapiens
ggttcagcccctcctctgcc

SEQ ID NO: 147745 - DNA, 22 bp, Homo sapiens
ggttcagcccctcctctgccac

SEQ ID NO: 147746 - DNA, 15 bp, Homo sapiens
ggttccgcttggagc

SEQ ID NO: 147747 - DNA, 22 bp, Homo sapiens
ggttccgcttggagcagagggg

SEQ ID NO: 147748 - DNA, 17 bp, Homo sapiens
ggttctcctctcccctc

SEQ ID NO: 147749 - DNA, 16 bp, Homo sapiens
ggttgactttcaggta

SEQ ID NO: 147750 - DNA, 18 bp, Homo sapiens
ggttgcagtgagccaaga

SEQ ID NO: 147751 - DNA, 22 bp, Homo sapiens
ggttggaagtgagggtcagaga

SEQ ID NO: 147752 - DNA, 21 bp, Homo sapiens
ggtttggctgtgtctaaactg

SEQ ID NO: 147753 - DNA, 13 bp, Homo sapiens
ggtttgtatattg

SEQ ID NO: 147754 - DNA, 20 bp, Homo sapiens
gtaaaatatagctgtacaaa

SEQ ID NO: 147755 - DNA, 20 bp, Homo sapiens
gtaaacagtgcctgctgaat

SEQ ID NO: 147756 - DNA, 15 bp, Homo sapiens
gtaaatagtatttga

SEQ ID NO: 147757 - DNA, 16 bp, Homo sapiens
gtaaatagtatttgag

SEQ ID NO: 147758 - DNA, 17 bp, Homo sapiens
gtaaatagtatttgaga

SEQ ID NO: 147759 - DNA, 16 bp, Homo sapiens
gtaaatatataaatat

SEQ ID NO: 147760 - DNA, 11 bp, Homo sapiens
gtaaatattta

SEQ ID NO: 147761 - DNA, 14 bp, Homo sapiens
gtaacaggtctcct

SEQ ID NO: 147762 - DNA, 13 bp, Homo sapiens
gtaacatcctttc

SEQ ID NO: 147763 - DNA, 18 bp, Homo sapiens
gtaacccaactctcctgg

SEQ ID NO: 147764 - DNA, 18 bp, Homo sapiens
gtaacctcttcagaggcc

SEQ ID NO: 147765 - DNA, 16 bp, Homo sapiens
gtaacgcgtcttcctg

SEQ ID NO: 147766 - DNA, 14 bp, Homo sapiens
gtaagaaaatattt

SEQ ID NO: 147767 - DNA, 23 bp, Homo sapiens
gtaagaaaatattttgtctaaaa

SEQ ID NO: 147768 - DNA, 22 bp, Homo sapiens
gtaataactgtgaagtttacat

SEQ ID NO: 147769 - DNA, 15 bp, Homo sapiens
gtaatagagcaaaat

SEQ ID NO: 147770 - DNA, 22 bp, Homo sapiens
gtaatctccacagtcaaagaag

SEQ ID NO: 147771 - DNA, 18 bp, Homo sapiens
gtaatgatgtcgtttgaa

SEQ ID NO: 147772 - DNA, 12 bp, Homo sapiens
gtaatgtcacca

SEQ ID NO: 147773 - DNA, 13 bp, Homo sapiens
gtaattcaagaaa

SEQ ID NO: 147774 - DNA, 15 bp, Homo sapiens
gtaattgcttacatt

SEQ ID NO: 147775 - DNA, 16 bp, Homo sapiens
gtaattgcttacattt

SEQ ID NO: 147776 - DNA, 12 bp, Homo sapiens
gtacaggcagca

SEQ ID NO: 147777 - DNA, 15 bp, Homo sapiens
gtaccaatcatttta

SEQ ID NO: 147778 - DNA, 14 bp, Homo sapiens
taagggagaaaaaa

SEQ ID NO: 147779 - DNA, 13 bp, Homo sapiens
taaggtgccttct

SEQ ID NO: 147780 - DNA, 14 bp, Homo sapiens
taagtaagaaaata

SEQ ID NO: 147781 - DNA, 15 bp, Homo sapiens
taagtaagaaaatat

SEQ ID NO: 147782 - DNA, 20 bp, Homo sapiens
taagtaagaaaatattttgt

SEQ ID NO: 147783 - DNA, 18 bp, Homo sapiens
taagtattgcatctgtat

SEQ ID NO: 147784 - DNA, 13 bp, Homo sapiens
taagtggctgctg

SEQ ID NO: 147785 - DNA, 14 bp, Homo sapiens
taagtgtacatatg

SEQ ID NO: 147786 - DNA, 22 bp, Homo sapiens
taagttcatattccatatttat

SEQ ID NO: 147787 - DNA, 17 bp, Homo sapiens
taagtttatttcttaaa

SEQ ID NO: 147788 - DNA, 15 bp, Homo sapiens
taataaaaaatggaa

SEQ ID NO: 147789 - DNA, 19 bp, Homo sapiens
taataaaaaatggaaagaa

SEQ ID NO: 147790 - DNA, 20 bp, Homo sapiens
taataaaaaatggaaagaat

SEQ ID NO: 147791 - DNA, 21 bp, Homo sapiens
taataaaaaatggaaagaatc

SEQ ID NO: 147792 - DNA, 13 bp, Homo sapiens
taataaaaaggca

SEQ ID NO: 147793 - DNA, 14 bp, Homo sapiens
taataaagatgctc

SEQ ID NO: 147794 - DNA, 17 bp, Homo sapiens
taataaatgtacattaa

SEQ ID NO: 147795 - DNA, 19 bp, Homo sapiens
taataaatgtacattaatt

SEQ ID NO: 147796 - DNA, 19 bp, Homo sapiens
taataagaatggttgcctt

SEQ ID NO: 147797 - DNA, 17 bp, Homo sapiens
taataattattattaaa

SEQ ID NO: 147798 - DNA, 15 bp, Homo sapiens
taatacacacagtta

SEQ ID NO: 147799 - DNA, 22 bp, Homo sapiens
taatacactaattcctttctat

SEQ ID NO: 147800 - DNA, 19 bp, Homo sapiens
taatacagcagtgtcatca

SEQ ID NO: 147801 - DNA, 15 bp, Homo sapiens
taatagaaaactgaa

SEQ ID NO: 147802 - DNA, 18 bp, Homo sapiens
taatagcttttattgtat

SEQ ID NO: 147803 - DNA, 21 bp, Homo sapiens
taatataactgccttaaaact

SEQ ID NO: 147804 - DNA, 18 bp, Homo sapiens
taatatccctacatgtat

SEQ ID NO: 147805 - DNA, 14 bp, Homo sapiens
taatattaaaaata

SEQ ID NO: 147806 - DNA, 18 bp, Homo sapiens
taatattaaaaatatgga

SEQ ID NO: 147807 - DNA, 16 bp, Homo sapiens
taatattcctcagttc

SEQ ID NO: 147808 - DNA, 18 bp, Homo sapiens
taatattgacttgtatat

SEQ ID NO: 147809 - DNA, 21 bp, Homo sapiens
taatattgatatgcttataca

SEQ ID NO: 147810 - DNA, 21 bp, Homo sapiens
taatatttaaacagcagtgtt

SEQ ID NO: 147811 - DNA, 21 bp, Homo sapiens
taatatttatgtctatttaag

SEQ ID NO: 147812 - DNA, 17 bp, Homo sapiens
taatcaatcatctgtgt

SEQ ID NO: 147813 - DNA, 15 bp, Homo sapiens
taatcagcctcttaa

SEQ ID NO: 147814 - DNA, 15 bp, Homo sapiens
taatcatataataaa

SEQ ID NO: 147815 - DNA, 20 bp, Homo sapiens
taatcatataataaatgtac

SEQ ID NO: 147816 - DNA, 20 bp, Homo sapiens
taatcccagctactcaggag

SEQ ID NO: 147817 - DNA, 22 bp, Homo sapiens
taatcttgaattgtaactgttc

SEQ ID NO: 147818 - DNA, 15 bp, Homo sapiens
taatgacagagccag

SEQ ID NO: 147819 - DNA, 17 bp, Homo sapiens
taatgatgtcgtttgaa

SEQ ID NO: 147820 - DNA, 20 bp, Homo sapiens
taatgctaaagaaaaagtca

SEQ ID NO: 147821 - DNA, 15 bp, Homo sapiens
taatgtacatctggc

SEQ ID NO: 147822 - DNA, 23 bp, Homo sapiens
taattaaattttgagttctacat

SEQ ID NO: 147823 - DNA, 12 bp, Homo sapiens
taattagagcag

SEQ ID NO: 147824 - DNA, 23 bp, Homo sapiens
taattagttcctcattagcattt

SEQ ID NO: 147825 - DNA, 12 bp, Homo sapiens
taattattattc

SEQ ID NO: 147826 - DNA, 17 bp, Homo sapiens
taattattatttatata

SEQ ID NO: 147827 - DNA, 22 bp, Homo sapiens
taattattatttatatatgtat

SEQ ID NO: 147828 - DNA, 18 bp, Homo sapiens
taattcagcactgatttc

SEQ ID NO: 147829 - DNA, 19 bp, Homo sapiens
taattcagcactgatttca

SEQ ID NO: 147830 - DNA, 18 bp, Homo sapiens
taattctaaatgaatgtt

SEQ ID NO: 147831 - DNA, 16 bp, Homo sapiens
taattcttgtatatta

SEQ ID NO: 147832 - DNA, 20 bp, Homo sapiens
taattgacaggattattgga

SEQ ID NO: 147833 - DNA, 15 bp, Homo sapiens
taattgcttacattt

SEQ ID NO: 147834 - DNA, 21 bp, Homo sapiens
taattgcttacatttttacaa

SEQ ID NO: 147835 - DNA, 18 bp, Homo sapiens
taattggtccgatctttg

SEQ ID NO: 147836 - DNA, 21 bp, Homo sapiens
taatttataaaagaataaaat

SEQ ID NO: 147837 - DNA, 18 bp, Homo sapiens
taattttatgaatgtctt

SEQ ID NO: 147838 - DNA, 13 bp, Homo sapiens
taatttttaaagt

SEQ ID NO: 147839 - DNA, 22 bp, Homo sapiens
taatttttttaaccaaaggtga

SEQ ID NO: 147840 - DNA, 22 bp, Homo sapiens
taattttttttttccttttaaa

SEQ ID NO: 147841 - DNA, 17 bp, Homo sapiens
tacaaaaacacagcaag

SEQ ID NO: 147842 - DNA, 15 bp, Homo sapiens
tacaaaaagcataaa

SEQ ID NO: 147843 - DNA, 13 bp, Homo sapiens
tacaaagtgtgta

SEQ ID NO: 147844 - DNA, 18 bp, Homo sapiens
tacaaagtgtgtattaaa

SEQ ID NO: 147845 - DNA, 23 bp, Homo sapiens
tacaaatactcttaggaagagaa

SEQ ID NO: 147846 - DNA, 12 bp, Homo sapiens
tacaaatataag

SEQ ID NO: 147847 - DNA, 18 bp, Homo sapiens
tacaaatataagaataaa

SEQ ID NO: 147848 - DNA, 16 bp, Homo sapiens
tacaaattgcttgaaa

SEQ ID NO: 147849 - DNA, 19 bp, Homo sapiens
tacaacaagagtttatttc

SEQ ID NO: 147850 - DNA, 22 bp, Homo sapiens
tacaacaagagtttatttccaa

SEQ ID NO: 147851 - DNA, 14 bp, Homo sapiens
tacaacttcaagtg

SEQ ID NO: 147852 - DNA, 15 bp, Homo sapiens
tacaataaataatct

SEQ ID NO: 147853 - DNA, 15 bp, Homo sapiens
tacaatgttcatccc

SEQ ID NO: 147854 - DNA, 22 bp, Homo sapiens
tacaatgttcatcccatgatgt

SEQ ID NO: 147855 - DNA, 21 bp, Homo sapiens
tacaattgtaaaactgaggca

SEQ ID NO: 147856 - DNA, 17 bp, Homo sapiens
tacaatttacaaagtgt

SEQ ID NO: 147857 - DNA, 18 bp, Homo sapiens
tacacagaaatacagtta

SEQ ID NO: 147858 - DNA, 11 bp, Homo sapiens
tacacagttgc

SEQ ID NO: 147859 - DNA, 14 bp, Homo sapiens
tacactccagtgag

SEQ ID NO: 147860 - DNA, 16 bp, Homo sapiens
tacacttacactttat

SEQ ID NO: 147861 - DNA, 21 bp, Homo sapiens
tacagaaagatggatgtgctt

SEQ ID NO: 147862 - DNA, 16 bp, Homo sapiens
tacagaactctttcaa

SEQ ID NO: 147863 - DNA, 17 bp, Homo sapiens
tacagaactctttcaaa

SEQ ID NO: 147864 - DNA, 21 bp, Homo sapiens
tacagaattctgctacctcac

SEQ ID NO: 147865 - DNA, 22 bp, Homo sapiens
tacagagaggtcaagcccagga

SEQ ID NO: 147866 - DNA, 15 bp, Homo sapiens
tacagagcttccctg

SEQ ID NO: 147867 - DNA, 19 bp, Homo sapiens
tacagatagtcaaaccata

SEQ ID NO: 147868 - DNA, 16 bp, Homo sapiens
tacagctaatcagcat

SEQ ID NO: 147869 - DNA, 14 bp, Homo sapiens
tacaggcacaaaat

SEQ ID NO: 147870 - DNA, 15 bp, Homo sapiens
tacaggcagcacaga

SEQ ID NO: 147871 - DNA, 15 bp, Homo sapiens
tacaggcatagagtt

SEQ ID NO: 147872 - DNA, 13 bp, Homo sapiens
tacagtaggagcc

SEQ ID NO: 147873 - DNA, 15 bp, Homo sapiens
tacagtatctcaggg

SEQ ID NO: 147874 - DNA, 19 bp, Homo sapiens
tacagtcttccatttgcaa

SEQ ID NO: 147875 - DNA, 20 bp, Homo sapiens
tacagtcttccatttgcaag

SEQ ID NO: 147876 - DNA, 22 bp, Homo sapiens
tacagtcttccatttgcaaggg

SEQ ID NO: 147877 - DNA, 13 bp, Homo sapiens
tacagttaagttt

SEQ ID NO: 147878 - DNA, 16 bp, Homo sapiens
tacataagtaattcaa

SEQ ID NO: 147879 - DNA, 19 bp, Homo sapiens
tacataagtaattcaagaa

SEQ ID NO: 147880 - DNA, 18 bp, Homo sapiens
tacatatcacctcatggc

SEQ ID NO: 147881 - DNA, 14 bp, Homo sapiens
tacatattctttaa

SEQ ID NO: 147882 - DNA, 15 bp, Homo sapiens
tacatattctttaaa

SEQ ID NO: 147883 - DNA, 18 bp, Homo sapiens
tacatgaattgcatttta

SEQ ID NO: 147884 - DNA, 21 bp, Homo sapiens
tacatgacatttatttttcat

SEQ ID NO: 147885 - DNA, 12 bp, Homo sapiens
tacatgctgcta

SEQ ID NO: 147886 - DNA, 19 bp, Homo sapiens
tacatgtaaaacattatct

SEQ ID NO: 147887 - DNA, 22 bp, Homo sapiens
tacatgtattgcacattgtaaa

SEQ ID NO: 147888 - DNA, 13 bp, Homo sapiens
tacatgtgggagc

SEQ ID NO: 147889 - DNA, 12 bp, Homo sapiens
tacattaatgtt

SEQ ID NO: 147890 - DNA, 15 bp, Homo sapiens
tacattaattatcta

SEQ ID NO: 147891 - DNA, 17 bp, Homo sapiens
tacattgaattagaaac

SEQ ID NO: 147892 - DNA, 23 bp, Homo sapiens
tacattgtgggatgttcagcact

SEQ ID NO: 147893 - DNA, 19 bp, Homo sapiens
tacattgtttgtctgtctt

SEQ ID NO: 147894 - DNA, 23 bp, Homo sapiens
tacattgtttgtctgtcttcata

SEQ ID NO: 147895 - DNA, 15 bp, Homo sapiens
tacatttaatacagc

SEQ ID NO: 147896 - DNA, 15 bp, Homo sapiens
tacatttttacaata

SEQ ID NO: 147897 - DNA, 19 bp, Homo sapiens
tacatttttacaataaata

SEQ ID NO: 147898 - DNA, 13 bp, Homo sapiens
taccaactttctg

SEQ ID NO: 147899 - DNA, 14 bp, Homo sapiens
taccaactttctgt

SEQ ID NO: 147900 - DNA, 15 bp, Homo sapiens
taccaactttctgta

SEQ ID NO: 147901 - DNA, 19 bp, Homo sapiens
taccaactttctgtaaact

SEQ ID NO: 147902 - DNA, 10 bp, Homo sapiens
taccacctcc

SEQ ID NO: 147903 - DNA, 13 bp, Homo sapiens
taccactcctgcc

SEQ ID NO: 147904 - DNA, 15 bp, Homo sapiens
taccagactgtgtat

SEQ ID NO: 147905 - DNA, 23 bp, Homo sapiens
taccagactgtgtattcattgaa

SEQ ID NO: 147906 - DNA, 20 bp, Homo sapiens
taccagcgaggaggctccag

SEQ ID NO: 147907 - DNA, 15 bp, Homo sapiens
taccatgaaacaaag

SEQ ID NO: 147908 - DNA, 16 bp, Homo sapiens
taccatgccatttaaa

SEQ ID NO: 147909 - DNA, 16 bp, Homo sapiens
taccatgtgcctgatc

SEQ ID NO: 147910 - DNA, 15 bp, Homo sapiens
tacccacctcagcct

SEQ ID NO: 147911 - DNA, 15 bp, Homo sapiens
taccccatcattcat

SEQ ID NO: 147912 - DNA, 11 bp, Homo sapiens
taccctccccc

SEQ ID NO: 147913 - DNA, 18 bp, Homo sapiens
taccctgagctgaggcag

SEQ ID NO: 147914 - DNA, 14 bp, Homo sapiens
taccgcgttgtaaa

SEQ ID NO: 147915 - DNA, 23 bp, Homo sapiens
tacctaaaaggaaatctcacccc

SEQ ID NO: 147916 - DNA, 15 bp, Homo sapiens
tacctaattagagca

SEQ ID NO: 147917 - DNA, 16 bp, Homo sapiens
tacctatcatcttaag

SEQ ID NO: 147918 - DNA, 15 bp, Homo sapiens
tacctcactggggtc

SEQ ID NO: 147919 - DNA, 13 bp, Homo sapiens
tacctcctgccca

SEQ ID NO: 147920 - DNA, 15 bp, Homo sapiens
tacctcctgcccagg

SEQ ID NO: 147921 - DNA, 16 bp, Homo sapiens
tacctcctgcccagga

SEQ ID NO: 147922 - DNA, 17 bp, Homo sapiens
tacctctcttatagaat

SEQ ID NO: 147923 - DNA, 14 bp, Homo sapiens
tacctctgatacct

SEQ ID NO: 147924 - DNA, 15 bp, Homo sapiens
tacctctgatacctc

SEQ ID NO: 147925 - DNA, 20 bp, Homo sapiens
tacctgacactcccttgggc

SEQ ID NO: 147926 - DNA, 16 bp, Homo sapiens
taccttgtatactgta

SEQ ID NO: 147927 - DNA, 21 bp, Homo sapiens
gtaccaatcattttaattatt

SEQ ID NO: 147928 - DNA, 19 bp, Homo sapiens
gtacctataaagtaaagct

SEQ ID NO: 147929 - DNA, 23 bp, Homo sapiens
gtaccttgaacactgggggaggg

SEQ ID NO: 147930 - DNA, 15 bp, Homo sapiens
gtacgtggagaggga

SEQ ID NO: 147931 - DNA, 22 bp, Homo sapiens
gtactaactcctaggaaaatac

SEQ ID NO: 147932 - DNA, 15 bp, Homo sapiens
gtactcaaatgtagc

SEQ ID NO: 147933 - DNA, 16 bp, Homo sapiens
gtactggcatggtacg

SEQ ID NO: 147934 - DNA, 16 bp, Homo sapiens
gtacttagcagctatc

SEQ ID NO: 147935 - DNA, 13 bp, Homo sapiens
gtagaagagggat

SEQ ID NO: 147936 - DNA, 15 bp, Homo sapiens
gtagacatttctctt

SEQ ID NO: 147937 - DNA, 14 bp, Homo sapiens
gtagaggttttgtt

SEQ ID NO: 147938 - DNA, 19 bp, Homo sapiens
gtagccagggggactagcc

SEQ ID NO: 147939 - DNA, 22 bp, Homo sapiens
gtagccagggggactagcccct

SEQ ID NO: 147940 - DNA, 15 bp, Homo sapiens
gtagccctggccaga

SEQ ID NO: 147941 - DNA, 19 bp, Homo sapiens
gtagccgagagcctgctcc

SEQ ID NO: 147942 - DNA, 15 bp, Homo sapiens
gtagctagaggaacc

SEQ ID NO: 147943 - DNA, 12 bp, Homo sapiens
gtagctgcccct

SEQ ID NO: 147944 - DNA, 16 bp, Homo sapiens
gtagctgcccctggct

SEQ ID NO: 147945 - DNA, 23 bp, Homo sapiens
gtaggcagacacagggacttgaa

SEQ ID NO: 147946 - DNA, 15 bp, Homo sapiens
gtagttaggaaataa

SEQ ID NO: 147947 - DNA, 16 bp, Homo sapiens
gtagttaggaaataaa

SEQ ID NO: 147948 - DNA, 22 bp, Homo sapiens
gtagttaggaaataaaaccttt

SEQ ID NO: 147949 - DNA, 16 bp, Homo sapiens
gtataaaactttcctc

SEQ ID NO: 147950 - DNA, 19 bp, Homo sapiens
gtataaaactttcctcgcc

SEQ ID NO: 147951 - DNA, 21 bp, Homo sapiens
gtataatggttgactgggttt

SEQ ID NO: 147952 - DNA, 15 bp, Homo sapiens
gtatactgtaggcac

SEQ ID NO: 147953 - DNA, 16 bp, Homo sapiens
gtatagactcctgaaa

SEQ ID NO: 147954 - DNA, 14 bp, Homo sapiens
gtatagtgtaaaat

SEQ ID NO: 147955 - DNA, 19 bp, Homo sapiens
gtatatcagaaaagggaag

SEQ ID NO: 147956 - DNA, 13 bp, Homo sapiens
gtatatgtctcag

SEQ ID NO: 147957 - DNA, 14 bp, Homo sapiens
gtatattcatttca

SEQ ID NO: 147958 - DNA, 20 bp, Homo sapiens
gtatccatgggggcagggca

SEQ ID NO: 147959 - DNA, 22 bp, Homo sapiens
gtatcctcatttggggtagcta

SEQ ID NO: 147960 - DNA, 12 bp, Homo sapiens
gtatctgagcag

SEQ ID NO: 147961 - DNA, 16 bp, Homo sapiens
gtatctgcaggcagac

SEQ ID NO: 147962 - DNA, 18 bp, Homo sapiens
gtatctgcaggcagacac

SEQ ID NO: 147963 - DNA, 15 bp, Homo sapiens
gtatgaatgcagtgg

SEQ ID NO: 147964 - DNA, 22 bp, Homo sapiens
gtattaaaaaaaacaaaaagaa

SEQ ID NO: 147965 - DNA, 18 bp, Homo sapiens
gtattgcacattgtaaaa

SEQ ID NO: 147966 - DNA, 21 bp, Homo sapiens
gtattgcacattgtaaaaagt

SEQ ID NO: 147967 - DNA, 15 bp, Homo sapiens
gtattgcatctgtat

SEQ ID NO: 147968 - DNA, 13 bp, Homo sapiens
gtatttatatatt

SEQ ID NO: 147969 - DNA, 15 bp, Homo sapiens
gtatttatatattta

SEQ ID NO: 147970 - DNA, 16 bp, Homo sapiens
gtatttatatatttat

SEQ ID NO: 147971 - DNA, 17 bp, Homo sapiens
gtatttatatatttata

SEQ ID NO: 147972 - DNA, 21 bp, Homo sapiens
gtatttgagagttctaaattt

SEQ ID NO: 147973 - DNA, 13 bp, Homo sapiens
gtattttaatcac

SEQ ID NO: 147974 - DNA, 14 bp, Homo sapiens
gtattttggagaaa

SEQ ID NO: 147975 - DNA, 22 bp, Homo sapiens
gtattttgtttttgtcttaaaa

SEQ ID NO: 147976 - DNA, 16 bp, Homo sapiens
gtatttttttgcaagt

SEQ ID NO: 147977 - DNA, 14 bp, Homo sapiens
gtcaaaaggtgcct

SEQ ID NO: 147978 - DNA, 16 bp, Homo sapiens
gtcaaacaaagccaga

SEQ ID NO: 147979 - DNA, 17 bp, Homo sapiens
gtcaaacgtgaaaatgc

SEQ ID NO: 147980 - DNA, 14 bp, Homo sapiens
gtcaacctgggcaa

SEQ ID NO: 147981 - DNA, 15 bp, Homo sapiens
gtcaaggagtggctt

SEQ ID NO: 147982 - DNA, 13 bp, Homo sapiens
gtcaagtcaacca

SEQ ID NO: 147983 - DNA, 17 bp, Homo sapiens
gtcaagtctctgctggc

SEQ ID NO: 147984 - DNA, 16 bp, Homo sapiens
gtcaagtgaaaaagga

SEQ ID NO: 147985 - DNA, 18 bp, Homo sapiens
gtcacaggactctgcctc

SEQ ID NO: 147986 - DNA, 19 bp, Homo sapiens
gtcacaggactctgcctcc

SEQ ID NO: 147987 - DNA, 18 bp, Homo sapiens
gtcacagggcctggggag

SEQ ID NO: 147988 - DNA, 16 bp, Homo sapiens
gtcaccaccttcccag

SEQ ID NO: 147989 - DNA, 18 bp, Homo sapiens
gtcaccaggaatgttaaa

SEQ ID NO: 147990 - DNA, 23 bp, Homo sapiens
gtcacctgcccagatcccagaag

SEQ ID NO: 147991 - DNA, 15 bp, Homo sapiens
gtcactgtttctctg

SEQ ID NO: 147992 - DNA, 18 bp, Homo sapiens
gtcagacatccatgtttg

SEQ ID NO: 147993 - DNA, 20 bp, Homo sapiens
gtcagacatccatgtttgta

SEQ ID NO: 147994 - DNA, 18 bp, Homo sapiens
gtcagacgcctgaggaac

SEQ ID NO: 147995 - DNA, 12 bp, Homo sapiens
gtcagagagaat

SEQ ID NO: 147996 - DNA, 21 bp, Homo sapiens
gtcagagaggagtcagagaga

SEQ ID NO: 147997 - DNA, 15 bp, Homo sapiens
gtcagcaaaaagcaa

SEQ ID NO: 147998 - DNA, 18 bp, Homo sapiens
gtcaggaaggatgagcat

SEQ ID NO: 147999 - DNA, 19 bp, Homo sapiens
gtcaggagttagaggccag

SEQ ID NO: 148000 - DNA, 22 bp, Homo sapiens
gtcaggagttagaggccagcct

SEQ ID NO: 148001 - DNA, 23 bp, Homo sapiens
gtcaggagttagaggccagcctg

SEQ ID NO: 148002 - DNA, 16 bp, Homo sapiens
gtcaggccacggcagc

SEQ ID NO: 148003 - DNA, 18 bp, Homo sapiens
gtcaggccacggcagcct

SEQ ID NO: 148004 - DNA, 15 bp, Homo sapiens
gtcaggcctgtgtgt

SEQ ID NO: 148005 - DNA, 23 bp, Homo sapiens
gtcaggcctgtgtgtgaaaggaa

SEQ ID NO: 148006 - DNA, 16 bp, Homo sapiens
gtcagtaccttcaaac

SEQ ID NO: 148007 - DNA, 16 bp, Homo sapiens
gtcataccaggccgcc

SEQ ID NO: 148008 - DNA, 16 bp, Homo sapiens
gtcatgatctccctgc

SEQ ID NO: 148009 - DNA, 20 bp, Homo sapiens
gtcatgatctccctgccgcc

SEQ ID NO: 148010 - DNA, 20 bp, Homo sapiens
gtcatgtaagctgaaaatat

SEQ ID NO: 148011 - DNA, 11 bp, Homo sapiens
gtcatgtgacc

SEQ ID NO: 148012 - DNA, 15 bp, Homo sapiens
gtcatgtttaagaaa

SEQ ID NO: 148013 - DNA, 22 bp, Homo sapiens
gtcattatagatcccccagact

SEQ ID NO: 148014 - DNA, 24 bp, Homo sapiens
gtccaagcataccaacacgagcag

SEQ ID NO: 148015 - DNA, 16 bp, Homo sapiens
gtccaagtgtgtgtgc

SEQ ID NO: 148016 - DNA, 17 bp, Homo sapiens
gtccaagtgtgtgtgcg

SEQ ID NO: 148017 - DNA, 12 bp, Homo sapiens
gtccaatcctat

SEQ ID NO: 148018 - DNA, 21 bp, Homo sapiens
gtccaccatggggtcctacca

SEQ ID NO: 148019 - DNA, 15 bp, Homo sapiens
gtccacgactgtctc

SEQ ID NO: 148020 - DNA, 12 bp, Homo sapiens
gtccactgtcac

SEQ ID NO: 148021 - DNA, 15 bp, Homo sapiens
gtccaggcactgaga

SEQ ID NO: 148022 - DNA, 15 bp, Homo sapiens
gtccagggccctgag

SEQ ID NO: 148023 - DNA, 16 bp, Homo sapiens
gtccagtctcttctgc

SEQ ID NO: 148024 - DNA, 17 bp, Homo sapiens
gtccagtgacctgctgg

SEQ ID NO: 148025 - DNA, 14 bp, Homo sapiens
gtccatgggcagag

SEQ ID NO: 148026 - DNA, 18 bp, Homo sapiens
gtccatgggcagagccca

SEQ ID NO: 148027 - DNA, 14 bp, Homo sapiens
gtccatgtgtgtgc

SEQ ID NO: 148028 - DNA, 22 bp, Homo sapiens
gtcccactcaagccaagcagcc

SEQ ID NO: 148029 - DNA, 12 bp, Homo sapiens
gtcccagtgccg

SEQ ID NO: 148030 - DNA, 14 bp, Homo sapiens
gtccccacctggga

SEQ ID NO: 148031 - DNA, 20 bp, Homo sapiens
gtccccaggccccaggaagc

SEQ ID NO: 148032 - DNA, 13 bp, Homo sapiens
gtccccctctgtc

SEQ ID NO: 148033 - DNA, 19 bp, Homo sapiens
gtccccctctgtccaggca

SEQ ID NO: 148034 - DNA, 13 bp, Homo sapiens
gtccctcccacct

SEQ ID NO: 148035 - DNA, 15 bp, Homo sapiens
gtccctcccacctct

SEQ ID NO: 148036 - DNA, 22 bp, Homo sapiens
gtccctgggggaagccctggat

SEQ ID NO: 148037 - DNA, 16 bp, Homo sapiens
gtcccttgagacctca

SEQ ID NO: 148038 - DNA, 18 bp, Homo sapiens
gtcccttgagacctcagc

SEQ ID NO: 148039 - DNA, 19 bp, Homo sapiens
gtcccttgcctcaatgcca

SEQ ID NO: 148040 - DNA, 21 bp, Homo sapiens
gtccggtccctgtcccagtgc

SEQ ID NO: 148041 - DNA, 17 bp, Homo sapiens
gtccggtgtccttttca

SEQ ID NO: 148042 - DNA, 24 bp, Homo sapiens
gtccggtgtccttttcactacacc

SEQ ID NO: 148043 - DNA, 19 bp, Homo sapiens
gtcctaggagtatcctcat

SEQ ID NO: 148044 - DNA, 17 bp, Homo sapiens
gtcctcacccctgtcct

SEQ ID NO: 148045 - DNA, 20 bp, Homo sapiens
gtcctcacccctgtcctcac

SEQ ID NO: 148046 - DNA, 23 bp, Homo sapiens
gtcctcacccctgtcctcactgc

SEQ ID NO: 148047 - DNA, 19 bp, Homo sapiens
gtcctcactgctccctgaa

SEQ ID NO: 148048 - DNA, 11 bp, Homo sapiens
gtcctcccctc

SEQ ID NO: 148049 - DNA, 16 bp, Homo sapiens
gtcctcccctcacagc

SEQ ID NO: 148050 - DNA, 17 bp, Homo sapiens
gtcctcccctcacagcc

SEQ ID NO: 148051 - DNA, 18 bp, Homo sapiens
gtcctcccctcacagcct

SEQ ID NO: 148052 - DNA, 12 bp, Homo sapiens
gtcctcctctgt

SEQ ID NO: 148053 - DNA, 18 bp, Homo sapiens
gtcctgagggtccccacc

SEQ ID NO: 148054 - DNA, 14 bp, Homo sapiens
gtcctggggcctcg

SEQ ID NO: 148055 - DNA, 15 bp, Homo sapiens
gtcctgtacattgtg

SEQ ID NO: 148056 - DNA, 15 bp, Homo sapiens
gtcctgtgaatttct

SEQ ID NO: 148057 - DNA, 20 bp, Homo sapiens
gtccttaatgatccgttcca

SEQ ID NO: 148058 - DNA, 17 bp, Homo sapiens
gtccttctctcacctcc

SEQ ID NO: 148059 - DNA, 22 bp, Homo sapiens
gtccttgcacactcccctgcac

SEQ ID NO: 148060 - DNA, 16 bp, Homo sapiens
gtccttgcacctgcat

SEQ ID NO: 148061 - DNA, 13 bp, Homo sapiens
gtcctttccctcc

SEQ ID NO: 148062 - DNA, 15 bp, Homo sapiens
gtccttttcactaca

SEQ ID NO: 148063 - DNA, 12 bp, Homo sapiens
gtcgaggcagga

SEQ ID NO: 148064 - DNA, 14 bp, Homo sapiens
gtcgatagagctgt

SEQ ID NO: 148065 - DNA, 21 bp, Homo sapiens
gtctaagatagtaacaatgaa

SEQ ID NO: 148066 - DNA, 23 bp, Homo sapiens
gtctaagatagtaacaatgaaga

SEQ ID NO: 148067 - DNA, 14 bp, Homo sapiens
gtctagggagagac

SEQ ID NO: 148068 - DNA, 21 bp, Homo sapiens
gtctcaacccttttgtctgcc

SEQ ID NO: 148069 - DNA, 15 bp, Homo sapiens
gtctcaagagggcac

SEQ ID NO: 148070 - DNA, 13 bp, Homo sapiens
gtctcagcctccc

SEQ ID NO: 148071 - DNA, 22 bp, Homo sapiens
gtctccagccccttctcagaat

SEQ ID NO: 148072 - DNA, 17 bp, Homo sapiens
gtctcccacgtgggaga

SEQ ID NO: 148073 - DNA, 16 bp, Homo sapiens
gtctccctctcctgcc

SEQ ID NO: 148074 - DNA, 17 bp, Homo sapiens
gtctccctctcctgcct

SEQ ID NO: 148075 - DNA, 19 bp, Homo sapiens
gtctccctctcctgcctac

SEQ ID NO: 148076 - DNA, 20 bp, Homo sapiens
taccttgtatactgtaggca

SEQ ID NO: 148077 - DNA, 17 bp, Homo sapiens
tacgcctgcatgtaaac

SEQ ID NO: 148078 - DNA, 19 bp, Homo sapiens
tacgctctcctttctttct

SEQ ID NO: 148079 - DNA, 21 bp, Homo sapiens
tacgctctcctttctttctaa

SEQ ID NO: 148080 - DNA, 23 bp, Homo sapiens
tactaacaatcagctccttcctg

SEQ ID NO: 148081 - DNA, 15 bp, Homo sapiens
tactaactaaactct

SEQ ID NO: 148082 - DNA, 21 bp, Homo sapiens
tactagggatccctcatctgt

SEQ ID NO: 148083 - DNA, 14 bp, Homo sapiens
tactatatttatgg

SEQ ID NO: 148084 - DNA, 13 bp, Homo sapiens
tactatgcctgtg

SEQ ID NO: 148085 - DNA, 14 bp, Homo sapiens
tactcagaattaag

SEQ ID NO: 148086 - DNA, 14 bp, Homo sapiens
tactcagcagccct

SEQ ID NO: 148087 - DNA, 15 bp, Homo sapiens
tactcagccctgggc

SEQ ID NO: 148088 - DNA, 22 bp, Homo sapiens
tactcagccctgggccccacca

SEQ ID NO: 148089 - DNA, 22 bp, Homo sapiens
tactcaggaggctgaggcagaa

SEQ ID NO: 148090 - DNA, 14 bp, Homo sapiens
tactcattcaggga

SEQ ID NO: 148091 - DNA, 12 bp, Homo sapiens
tactcctcccag

SEQ ID NO: 148092 - DNA, 22 bp, Homo sapiens
tactctaccctcttagaaaaac

SEQ ID NO: 148093 - DNA, 20 bp, Homo sapiens
tactctcctcggccccctcc

SEQ ID NO: 148094 - DNA, 21 bp, Homo sapiens
tactcttaggaagagaaacca

SEQ ID NO: 148095 - DNA, 13 bp, Homo sapiens
tactgacatgtgg

SEQ ID NO: 148096 - DNA, 19 bp, Homo sapiens
tactgagagtgaacaaatt

SEQ ID NO: 148097 - DNA, 18 bp, Homo sapiens
tactgagccttgtaattc

SEQ ID NO: 148098 - DNA, 19 bp, Homo sapiens
tactgagccttgtaattct

SEQ ID NO: 148099 - DNA, 14 bp, Homo sapiens
tactgagcttctct

SEQ ID NO: 148100 - DNA, 23 bp, Homo sapiens
tactgatgttcctagtgaaagag

SEQ ID NO: 148101 - DNA, 17 bp, Homo sapiens
tactgatttttgtgatt

SEQ ID NO: 148102 - DNA, 12 bp, Homo sapiens
tactgcagggcc

SEQ ID NO: 148103 - DNA, 18 bp, Homo sapiens
tactgcagggccaggact

SEQ ID NO: 148104 - DNA, 11 bp, Homo sapiens
tactgtaacac

SEQ ID NO: 148105 - DNA, 18 bp, Homo sapiens
tactgtaacactttacaa

SEQ ID NO: 148106 - DNA, 21 bp, Homo sapiens
tactgtctggttttaacaatt

SEQ ID NO: 148107 - DNA, 22 bp, Homo sapiens
tactgtctggttttaacaattt

SEQ ID NO: 148108 - DNA, 13 bp, Homo sapiens
tacttattccaga

SEQ ID NO: 148109 - DNA, 23 bp, Homo sapiens
tacttcctgtgacttcagctctg

SEQ ID NO: 148110 - DNA, 15 bp, Homo sapiens
tacttcttatacatt

SEQ ID NO: 148111 - DNA, 16 bp, Homo sapiens
tacttcttatacattt

SEQ ID NO: 148112 - DNA, 21 bp, Homo sapiens
tacttgggagacctgtaatca

SEQ ID NO: 148113 - DNA, 12 bp, Homo sapiens
tacttgggaggc

SEQ ID NO: 148114 - DNA, 14 bp, Homo sapiens
tactttgaagtcat

SEQ ID NO: 148115 - DNA, 18 bp, Homo sapiens
tactttgaagtcatacca

SEQ ID NO: 148116 - DNA, 16 bp, Homo sapiens
tactttttcattcttt

SEQ ID NO: 148117 - DNA, 16 bp, Homo sapiens
tagaaaaaccctgccc

SEQ ID NO: 148118 - DNA, 22 bp, Homo sapiens
tagaaaactgaaaatctaatat

SEQ ID NO: 148119 - DNA, 22 bp, Homo sapiens
tagaaaatttgttattttgcaa

SEQ ID NO: 148120 - DNA, 18 bp, Homo sapiens
tagaaacataaataaaat

SEQ ID NO: 148121 - DNA, 19 bp, Homo sapiens
tagaaactcaccatgtaaa

SEQ ID NO: 148122 - DNA, 21 bp, Homo sapiens
tagaaagaagcccaatattat

SEQ ID NO: 148123 - DNA, 18 bp, Homo sapiens
tagaacatccctgccagc

SEQ ID NO: 148124 - DNA, 22 bp, Homo sapiens
tagaactcagttttaactagaa

SEQ ID NO: 148125 - DNA, 20 bp, Homo sapiens
tagaactgtatgtcagacat

SEQ ID NO: 148126 - DNA, 22 bp, Homo sapiens
tagaagccccgttataactcct

SEQ ID NO: 148127 - DNA, 15 bp, Homo sapiens
tagaaggagacagag

SEQ ID NO: 148128 - DNA, 20 bp, Homo sapiens
tagaagtgggccaggacagg

SEQ ID NO: 148129 - DNA, 15 bp, Homo sapiens
tagaattaacacatg

SEQ ID NO: 148130 - DNA, 17 bp, Homo sapiens
tagacacccattttcac

SEQ ID NO: 148131 - DNA, 18 bp, Homo sapiens
tagacacccattttcaca

SEQ ID NO: 148132 - DNA, 18 bp, Homo sapiens
tagacatttctcttactg

SEQ ID NO: 148133 - DNA, 16 bp, Homo sapiens
tagacctcagcctgtg

SEQ ID NO: 148134 - DNA, 21 bp, Homo sapiens
tagacctcagcctgtgctgcc

SEQ ID NO: 148135 - DNA, 22 bp, Homo sapiens
tagacttctgctttccacacct

SEQ ID NO: 148136 - DNA, 19 bp, Homo sapiens
tagagaagtatacataagt

SEQ ID NO: 148137 - DNA, 17 bp, Homo sapiens
tagagattacctcctga

SEQ ID NO: 148138 - DNA, 14 bp, Homo sapiens
tagagcaaaattga

SEQ ID NO: 148139 - DNA, 17 bp, Homo sapiens
tagagcacactgtagca

SEQ ID NO: 148140 - DNA, 17 bp, Homo sapiens
tagaggaaaaaaatgac

SEQ ID NO: 148141 - DNA, 19 bp, Homo sapiens
tagaggagaaactggaact

SEQ ID NO: 148142 - DNA, 12 bp, Homo sapiens
tagagtgggagc

SEQ ID NO: 148143 - DNA, 15 bp, Homo sapiens
tagagtgtctttcca

SEQ ID NO: 148144 - DNA, 16 bp, Homo sapiens
tagagtgttgttgaga

SEQ ID NO: 148145 - DNA, 13 bp, Homo sapiens
tagagtttaacac

SEQ ID NO: 148146 - DNA, 18 bp, Homo sapiens
tagatacatgctttttaa

SEQ ID NO: 148147 - DNA, 14 bp, Homo sapiens
tagatgctgactgt

SEQ ID NO: 148148 - DNA, 16 bp, Homo sapiens
tagcactaccactcct

SEQ ID NO: 148149 - DNA, 13 bp, Homo sapiens
tagcactgagcaa

SEQ ID NO: 148150 - DNA, 16 bp, Homo sapiens
tagcactttgggaggc

SEQ ID NO: 148151 - DNA, 23 bp, Homo sapiens
tagcagaaggttgcacctccccc

SEQ ID NO: 148152 - DNA, 14 bp, Homo sapiens
tagcagctatctct

SEQ ID NO: 148153 - DNA, 14 bp, Homo sapiens
tagcagcttccaga

SEQ ID NO: 148154 - DNA, 20 bp, Homo sapiens
tagcatttttgatttatgca

SEQ ID NO: 148155 - DNA, 18 bp, Homo sapiens
tagccaatatttttctta

SEQ ID NO: 148156 - DNA, 19 bp, Homo sapiens
tagccaccccagaaatggt

SEQ ID NO: 148157 - DNA, 14 bp, Homo sapiens
tagcccaaaaccaa

SEQ ID NO: 148158 - DNA, 15 bp, Homo sapiens
tagcccactctgctc

SEQ ID NO: 148159 - DNA, 13 bp, Homo sapiens
tagcccaggagag

SEQ ID NO: 148160 - DNA, 16 bp, Homo sapiens
tagcccaggagagaga

SEQ ID NO: 148161 - DNA, 18 bp, Homo sapiens
tagcccatccctgcctgg

SEQ ID NO: 148162 - DNA, 19 bp, Homo sapiens
tagcccccaggctgctgga

SEQ ID NO: 148163 - DNA, 13 bp, Homo sapiens
tagctagaggaac

SEQ ID NO: 148164 - DNA, 15 bp, Homo sapiens
tagctatcagaagac

SEQ ID NO: 148165 - DNA, 16 bp, Homo sapiens
tagctatcagaagacc

SEQ ID NO: 148166 - DNA, 21 bp, Homo sapiens
tagctatcagaagaccacaaa

SEQ ID NO: 148167 - DNA, 15 bp, Homo sapiens
tagctattactgtct

SEQ ID NO: 148168 - DNA, 21 bp, Homo sapiens
tagctctaggagggctggcaa

SEQ ID NO: 148169 - DNA, 11 bp, Homo sapiens
tagctgcagaa

SEQ ID NO: 148170 - DNA, 12 bp, Homo sapiens
tagctgcagaac

SEQ ID NO: 148171 - DNA, 13 bp, Homo sapiens
tagctgttgagct

SEQ ID NO: 148172 - DNA, 16 bp, Homo sapiens
tagctgttgagctgtt

SEQ ID NO: 148173 - DNA, 17 bp, Homo sapiens
tagctgttgagctgttt

SEQ ID NO: 148174 - DNA, 19 bp, Homo sapiens
tagcttagacctcagcctg

SEQ ID NO: 148175 - DNA, 18 bp, Homo sapiens
tagcttgggacaaatcaa

SEQ ID NO: 148176 - DNA, 17 bp, Homo sapiens
tagcttgtatagtgtaa

SEQ ID NO: 148177 - DNA, 19 bp, Homo sapiens
taggaaagaccatttttcc

SEQ ID NO: 148178 - DNA, 16 bp, Homo sapiens
taggaaataaaacctt

SEQ ID NO: 148179 - DNA, 14 bp, Homo sapiens
taggaagagaaacc

SEQ ID NO: 148180 - DNA, 16 bp, Homo sapiens
taggaagtaaattata

SEQ ID NO: 148181 - DNA, 14 bp, Homo sapiens
taggagctgggagg

SEQ ID NO: 148182 - DNA, 20 bp, Homo sapiens
taggaggaccagagctactg

SEQ ID NO: 148183 - DNA, 14 bp, Homo sapiens
taggcagacacagg

SEQ ID NO: 148184 - DNA, 13 bp, Homo sapiens
taggccactcctc

SEQ ID NO: 148185 - DNA, 15 bp, Homo sapiens
taggccactcctcca

SEQ ID NO: 148186 - DNA, 16 bp, Homo sapiens
taggcgggaaggaggg

SEQ ID NO: 148187 - DNA, 20 bp, Homo sapiens
tagggaaaaaccagcgtgtg

SEQ ID NO: 148188 - DNA, 13 bp, Homo sapiens
tagggacttaaaa

SEQ ID NO: 148189 - DNA, 15 bp, Homo sapiens
tagggtaaggtgcct

SEQ ID NO: 148190 - DNA, 18 bp, Homo sapiens
tagggtaaggtgccttct

SEQ ID NO: 148191 - DNA, 21 bp, Homo sapiens
taggtcttaatacacacagtt

SEQ ID NO: 148192 - DNA, 19 bp, Homo sapiens
taggtgcccttggaggcca

SEQ ID NO: 148193 - DNA, 20 bp, Homo sapiens
taggtgctacaaaaacacag

SEQ ID NO: 148194 - DNA, 16 bp, Homo sapiens
taggtggatcacctga

SEQ ID NO: 148195 - DNA, 13 bp, Homo sapiens
tagtaaaaataaa

SEQ ID NO: 148196 - DNA, 12 bp, Homo sapiens
tagtaaagaaat

SEQ ID NO: 148197 - DNA, 16 bp, Homo sapiens
tagtaccaatcatttt

SEQ ID NO: 148198 - DNA, 13 bp, Homo sapiens
tagtatcaaaaga

SEQ ID NO: 148199 - DNA, 13 bp, Homo sapiens
tagtcatgtgacc

SEQ ID NO: 148200 - DNA, 22 bp, Homo sapiens
tagtccagctttgttcttctta

SEQ ID NO: 148201 - DNA, 15 bp, Homo sapiens
tagtcccagctactc

SEQ ID NO: 148202 - DNA, 23 bp, Homo sapiens
tagtctgcaaaatgaggaatgta

SEQ ID NO: 148203 - DNA, 17 bp, Homo sapiens
tagtcttcaagcagatt

SEQ ID NO: 148204 - DNA, 19 bp, Homo sapiens
tagtgaaggcttctctctg

SEQ ID NO: 148205 - DNA, 16 bp, Homo sapiens
tagtgacttgtgtccc

SEQ ID NO: 148206 - DNA, 17 bp, Homo sapiens
tagtgatctgaacagaa

SEQ ID NO: 148207 - DNA, 14 bp, Homo sapiens
tagtgcaaatcata

SEQ ID NO: 148208 - DNA, 20 bp, Homo sapiens
tagtggggtctccctctcct

SEQ ID NO: 148209 - DNA, 21 bp, Homo sapiens
tagtggggtctccctctcctg

SEQ ID NO: 148210 - DNA, 23 bp, Homo sapiens
tagtggggtctccctctcctgcc

SEQ ID NO: 148211 - DNA, 20 bp, Homo sapiens
tagtgtttgggtatattcat

SEQ ID NO: 148212 - DNA, 14 bp, Homo sapiens
tagttactcattca

SEQ ID NO: 148213 - DNA, 18 bp, Homo sapiens
tagttaggaaataaaacc

SEQ ID NO: 148214 - DNA, 22 bp, Homo sapiens
tagttaggaaataaaacctttc

SEQ ID NO: 148215 - DNA, 16 bp, Homo sapiens
tagttatagtttcaga

SEQ ID NO: 148216 - DNA, 23 bp, Homo sapiens
tagttccctgaaaacccagagag

SEQ ID NO: 148217 - DNA, 20 bp, Homo sapiens
tagttcctcattagcatttt

SEQ ID NO: 148218 - DNA, 12 bp, Homo sapiens
tagttcctgcta

SEQ ID NO: 148219 - DNA, 18 bp, Homo sapiens
tagtttcagatatatatc

SEQ ID NO: 148220 - DNA, 17 bp, Homo sapiens
tagtttgtataacttct

SEQ ID NO: 148221 - DNA, 23 bp, Homo sapiens
tagttttcatacacagcctgggc

SEQ ID NO: 148222 - DNA, 19 bp, Homo sapiens
tataaaaagaaaagataaa

SEQ ID NO: 148223 - DNA, 15 bp, Homo sapiens
tataaaactttcctc

SEQ ID NO: 148224 - DNA, 16 bp, Homo sapiens
tataactagctagaag

SEQ ID NO: 148225 - DNA, 19 bp, Homo sapiens
tataactgccttaaaactt

SEQ ID NO: 148226 - DNA, 20 bp, Homo sapiens
tataactgccttaaaacttt

SEQ ID NO: 148227 - DNA, 18 bp, Homo sapiens
tataacttaaaatatttt

SEQ ID NO: 148228 - DNA, 16 bp, Homo sapiens
tataagtaagaaaata

SEQ ID NO: 148229 - DNA, 20 bp, Homo sapiens
tataatgaatgaaacatttt

SEQ ID NO: 148230 - DNA, 18 bp, Homo sapiens
tataatgaatgagagaat

SEQ ID NO: 148231 - DNA, 17 bp, Homo sapiens
tataatgttgttattta

SEQ ID NO: 148232 - DNA, 19 bp, Homo sapiens
tataatgttgttatttaaa

SEQ ID NO: 148233 - DNA, 19 bp, Homo sapiens
tataatttttaaagtatat

SEQ ID NO: 148234 - DNA, 18 bp, Homo sapiens
tataatttttttcaatat

SEQ ID NO: 148235 - DNA, 15 bp, Homo sapiens
tatacaataacataa

SEQ ID NO: 148236 - DNA, 19 bp, Homo sapiens
tatacccgtacaacgtgtc

SEQ ID NO: 148237 - DNA, 22 bp, Homo sapiens
tatacctgggcatactaataaa

SEQ ID NO: 148238 - DNA, 13 bp, Homo sapiens
tatacctgtgcct

SEQ ID NO: 148239 - DNA, 14 bp, Homo sapiens
tatacctgtgcctc

SEQ ID NO: 148240 - DNA, 15 bp, Homo sapiens
tatacctgtgcctcg

SEQ ID NO: 148241 - DNA, 19 bp, Homo sapiens
tatacctgtgcctcggctt

SEQ ID NO: 148242 - DNA, 16 bp, Homo sapiens
tatactatatttatgg

SEQ ID NO: 148243 - DNA, 21 bp, Homo sapiens
tatagaatatttattacctct

SEQ ID NO: 148244 - DNA, 15 bp, Homo sapiens
tatagatcccccaga

SEQ ID NO: 148245 - DNA, 22 bp, Homo sapiens
tatagctattactgtctggttt

SEQ ID NO: 148246 - DNA, 22 bp, Homo sapiens
tatagctgtacaaatataagaa

SEQ ID NO: 148247 - DNA, 21 bp, Homo sapiens
tataggtgctacaaaaacaca

SEQ ID NO: 148248 - DNA, 15 bp, Homo sapiens
tataggttgtgcaaa

SEQ ID NO: 148249 - DNA, 22 bp, Homo sapiens
tataggttgtgcaaattaacag

SEQ ID NO: 148250 - DNA, 18 bp, Homo sapiens
tatagttaggatagcatt

SEQ ID NO: 148251 - DNA, 19 bp, Homo sapiens
tatagtttattgacaataa

SEQ ID NO: 148252 - DNA, 19 bp, Homo sapiens
tatataaaaagaaaagata

SEQ ID NO: 148253 - DNA, 23 bp, Homo sapiens
tatataaaaagaaaagataaaga

SEQ ID NO: 148254 - DNA, 12 bp, Homo sapiens
tatataaatata

SEQ ID NO: 148255 - DNA, 19 bp, Homo sapiens
tatataagtgtacatatgt

SEQ ID NO: 148256 - DNA, 16 bp, Homo sapiens
tatatacaataacata

SEQ ID NO: 148257 - DNA, 20 bp, Homo sapiens
tatatacccgtacaacgtgt

SEQ ID NO: 148258 - DNA, 12 bp, Homo sapiens
tatatataaaat

SEQ ID NO: 148259 - DNA, 13 bp, Homo sapiens
tatatataaacct

SEQ ID NO: 148260 - DNA, 13 bp, Homo sapiens
tatatatagaatc

SEQ ID NO: 148261 - DNA, 14 bp, Homo sapiens
tatatatataaaat

SEQ ID NO: 148262 - DNA, 19 bp, Homo sapiens
tatatatctgcttcagtgg

SEQ ID NO: 148263 - DNA, 13 bp, Homo sapiens
tatatatttataa

SEQ ID NO: 148264 - DNA, 18 bp, Homo sapiens
tatatcagaaaagggaag

SEQ ID NO: 148265 - DNA, 16 bp, Homo sapiens
tatatcctttctaaca

SEQ ID NO: 148266 - DNA, 17 bp, Homo sapiens
tatatctgcttcagtgg

SEQ ID NO: 148267 - DNA, 19 bp, Homo sapiens
tatattaaaaatataaaac

SEQ ID NO: 148268 - DNA, 23 bp, Homo sapiens
tatattaaaaatataaaactgcg

SEQ ID NO: 148269 - DNA, 14 bp, Homo sapiens
tatattcatatatt

SEQ ID NO: 148270 - DNA, 17 bp, Homo sapiens
tatattggtaacatcct

SEQ ID NO: 148271 - DNA, 21 bp, Homo sapiens
tatattggtaacatcctttct

SEQ ID NO: 148272 - DNA, 15 bp, Homo sapiens
tatatttaatgataa

SEQ ID NO: 148273 - DNA, 16 bp, Homo sapiens
tatatttagttatagt

SEQ ID NO: 148274 - DNA, 22 bp, Homo sapiens
tatatttataactcatcataaa

SEQ ID NO: 148275 - DNA, 18 bp, Homo sapiens
tatatttttatatttagt

SEQ ID NO: 148276 - DNA, 19 bp, Homo sapiens
tatattttttgttaaatga

SEQ ID NO: 148277 - DNA, 16 bp, Homo sapiens
tatcaaactgaagcca

SEQ ID NO: 148278 - DNA, 20 bp, Homo sapiens
tatcacaaatcttaacttga

SEQ ID NO: 148279 - DNA, 18 bp, Homo sapiens
tatcaccagagagggact

SEQ ID NO: 148280 - DNA, 14 bp, Homo sapiens
tatcacctcatggc

SEQ ID NO: 148281 - DNA, 21 bp, Homo sapiens
tatcaggacccagaggaaggg

SEQ ID NO: 148282 - DNA, 23 bp, Homo sapiens
tatcaggtgcccatccctggaag

SEQ ID NO: 148283 - DNA, 17 bp, Homo sapiens
tatcagttactcagccc

SEQ ID NO: 148284 - DNA, 19 bp, Homo sapiens
tatcagttactcagccctg

SEQ ID NO: 148285 - DNA, 21 bp, Homo sapiens
tatcagttactcagccctggg

SEQ ID NO: 148286 - DNA, 16 bp, Homo sapiens
tatcatgagtgaataa

SEQ ID NO: 148287 - DNA, 18 bp, Homo sapiens
tatcatgcccctgtactc

SEQ ID NO: 148288 - DNA, 16 bp, Homo sapiens
tatcatgtcaaacgtg

SEQ ID NO: 148289 - DNA, 21 bp, Homo sapiens
tatcatgtcaaacgtgaaaat

SEQ ID NO: 148290 - DNA, 21 bp, Homo sapiens
tatcattttctgcatttaacc

SEQ ID NO: 148291 - DNA, 19 bp, Homo sapiens
tatccaaaccaaataaaaa

SEQ ID NO: 148292 - DNA, 13 bp, Homo sapiens
tatccacccagcc

SEQ ID NO: 148293 - DNA, 19 bp, Homo sapiens
tatccacccagcccattct

SEQ ID NO: 148294 - DNA, 18 bp, Homo sapiens
tatccatggggaagggat

SEQ ID NO: 148295 - DNA, 15 bp, Homo sapiens
tatccctcacctgta

SEQ ID NO: 148296 - DNA, 19 bp, Homo sapiens
tatcctacaacaagagttt

SEQ ID NO: 148297 - DNA, 14 bp, Homo sapiens
tatccttcagcctg

SEQ ID NO: 148298 - DNA, 17 bp, Homo sapiens
tatcctttctaacaaaa

SEQ ID NO: 148299 - DNA, 17 bp, Homo sapiens
tatctcaaaactgcact

SEQ ID NO: 148300 - DNA, 18 bp, Homo sapiens
tatctcctcgcaagctgg

SEQ ID NO: 148301 - DNA, 16 bp, Homo sapiens
tatctctatttaatat

SEQ ID NO: 148302 - DNA, 17 bp, Homo sapiens
tatctctatttaatatt

SEQ ID NO: 148303 - DNA, 15 bp, Homo sapiens
tatctgcaggcagac

SEQ ID NO: 148304 - DNA, 17 bp, Homo sapiens
tatctgcaggcagacac

SEQ ID NO: 148305 - DNA, 19 bp, Homo sapiens
tatctgggattctacttta

SEQ ID NO: 148306 - DNA, 14 bp, Homo sapiens
tatctgtgctcagg

SEQ ID NO: 148307 - DNA, 23 bp, Homo sapiens
tatcttttctattgtttattctt

SEQ ID NO: 148308 - DNA, 19 bp, Homo sapiens
tatgaggtctaggaacata

SEQ ID NO: 148309 - DNA, 21 bp, Homo sapiens
tatgagtttttgatagcttta

SEQ ID NO: 148310 - DNA, 22 bp, Homo sapiens
tatgagtttttgatagctttat

SEQ ID NO: 148311 - DNA, 16 bp, Homo sapiens
tatgattagtaaagaa

SEQ ID NO: 148312 - DNA, 14 bp, Homo sapiens
tatgatttatagtt

SEQ ID NO: 148313 - DNA, 17 bp, Homo sapiens
tatgatttggaaaataa

SEQ ID NO: 148314 - DNA, 13 bp, Homo sapiens
tatgcaaagcact

SEQ ID NO: 148315 - DNA, 14 bp, Homo sapiens
tatgcaaagcactg

SEQ ID NO: 148316 - DNA, 22 bp, Homo sapiens
tatgcacttataattttcctaa

SEQ ID NO: 148317 - DNA, 21 bp, Homo sapiens
tatgcatttaaatacagtctt

SEQ ID NO: 148318 - DNA, 16 bp, Homo sapiens
tatgcctctgtattta

SEQ ID NO: 148319 - DNA, 10 bp, Homo sapiens
tatgcctgtg

SEQ ID NO: 148320 - DNA, 15 bp, Homo sapiens
tatgcttatacactt

SEQ ID NO: 148321 - DNA, 22 bp, Homo sapiens
tatgcttatacacttacacttt

SEQ ID NO: 148322 - DNA, 14 bp, Homo sapiens
tatggaatacagtg

SEQ ID NO: 148323 - DNA, 14 bp, Homo sapiens
tatggaattacatg

SEQ ID NO: 148324 - DNA, 19 bp, Homo sapiens
tatggcagagttgtaaata

SEQ ID NO: 148325 - DNA, 20 bp, Homo sapiens
tatggcagagttgtaaatat

SEQ ID NO: 148326 - DNA, 21 bp, Homo sapiens
tatggcagagttgtaaatata

SEQ ID NO: 148327 - DNA, 16 bp, Homo sapiens
tatggctataggtgct

SEQ ID NO: 148328 - DNA, 12 bp, Homo sapiens
tatgtaaaataa

SEQ ID NO: 148329 - DNA, 18 bp, Homo sapiens
tatgtaaagtatgtaaac

SEQ ID NO: 148330 - DNA, 13 bp, Homo sapiens
tatgtaaatgtgc

SEQ ID NO: 148331 - DNA, 20 bp, Homo sapiens
tatgtactcctctttacact

SEQ ID NO: 148332 - DNA, 19 bp, Homo sapiens
tatgtatatttaaaagaaa

SEQ ID NO: 148333 - DNA, 22 bp, Homo sapiens
tatgtgaatatggactcagttt

SEQ ID NO: 148334 - DNA, 15 bp, Homo sapiens
tatgttgatgaaaaa

SEQ ID NO: 148335 - DNA, 16 bp, Homo sapiens
tatgtttttgttcaaa

SEQ ID NO: 148336 - DNA, 14 bp, Homo sapiens
tattaaaaatataa

SEQ ID NO: 148337 - DNA, 13 bp, Homo sapiens
tattaaaatctta

SEQ ID NO: 148338 - DNA, 20 bp, Homo sapiens
tattaaaatgattgtaaaat

SEQ ID NO: 148339 - DNA, 22 bp, Homo sapiens
tattaaaatgattgtaaaatag

SEQ ID NO: 148340 - DNA, 14 bp, Homo sapiens
tattaaggaagaca

SEQ ID NO: 148341 - DNA, 11 bp, Homo sapiens
tattacctctg

SEQ ID NO: 148342 - DNA, 18 bp, Homo sapiens
tattactgtctggtttta

SEQ ID NO: 148343 - DNA, 23 bp, Homo sapiens
tattactgtctggttttaacaat

SEQ ID NO: 148344 - DNA, 16 bp, Homo sapiens
tattataacttaaaaa

SEQ ID NO: 148345 - DNA, 20 bp, Homo sapiens
tattcaagttattgtacagc

SEQ ID NO: 148346 - DNA, 17 bp, Homo sapiens
tattcaattcctctggg

SEQ ID NO: 148347 - DNA, 19 bp, Homo sapiens
tattcagctttagtagata

SEQ ID NO: 148348 - DNA, 23 bp, Homo sapiens
tattcatagcagcttattcacaa

SEQ ID NO: 148349 - DNA, 14 bp, Homo sapiens
tattcatttaaaat

SEQ ID NO: 148350 - DNA, 16 bp, Homo sapiens
tattcatttaaaatga

SEQ ID NO: 148351 - DNA, 20 bp, Homo sapiens
tattcctatatagtttattg

SEQ ID NO: 148352 - DNA, 19 bp, Homo sapiens
tattctagctaatgtaata

SEQ ID NO: 148353 - DNA, 13 bp, Homo sapiens
tattctcactcca

SEQ ID NO: 148354 - DNA, 14 bp, Homo sapiens
tattctcactccac

SEQ ID NO: 148355 - DNA, 12 bp, Homo sapiens
tattctctgagc

SEQ ID NO: 148356 - DNA, 19 bp, Homo sapiens
tattctctgagctgtgcag

SEQ ID NO: 148357 - DNA, 22 bp, Homo sapiens
tattctgattacacaaaacaaa

SEQ ID NO: 148358 - DNA, 18 bp, Homo sapiens
tattgaacttggaaagaa

SEQ ID NO: 148359 - DNA, 15 bp, Homo sapiens
tattgacaaactctc

SEQ ID NO: 148360 - DNA, 17 bp, Homo sapiens
tattgacaataatttca

SEQ ID NO: 148361 - DNA, 18 bp, Homo sapiens
tattgacaataatttcag

SEQ ID NO: 148362 - DNA, 18 bp, Homo sapiens
tattgagaattttaaatt

SEQ ID NO: 148363 - DNA, 17 bp, Homo sapiens
tattgcacattgtaaaa

SEQ ID NO: 148364 - DNA, 17 bp, Homo sapiens
tattgcatctgtataag

SEQ ID NO: 148365 - DNA, 21 bp, Homo sapiens
tattgcatctgtataagtaag

SEQ ID NO: 148366 - DNA, 23 bp, Homo sapiens
tattgcttcttctcctatgtgta

SEQ ID NO: 148367 - DNA, 22 bp, Homo sapiens
tattggaaatttgttataatga

SEQ ID NO: 148368 - DNA, 20 bp, Homo sapiens
tattgtacagctgtttaaga

SEQ ID NO: 148369 - DNA, 11 bp, Homo sapiens
tattgtacctc

SEQ ID NO: 148370 - DNA, 13 bp, Homo sapiens
tattgtacctctc

SEQ ID NO: 148371 - DNA, 20 bp, Homo sapiens
tcatggcctattatattaaa

SEQ ID NO: 148372 - DNA, 13 bp, Homo sapiens
tcatgtaaactgt

SEQ ID NO: 148373 - DNA, 18 bp, Homo sapiens
tcatgtaagctgaaaata

SEQ ID NO: 148374 - DNA, 19 bp, Homo sapiens
tcatgtaagctgaaaatat

SEQ ID NO: 148375 - DNA, 16 bp, Homo sapiens
tcatgtcaggcctgtg

SEQ ID NO: 148376 - DNA, 20 bp, Homo sapiens
tcatgtccccaaacctgcaa

SEQ ID NO: 148377 - DNA, 16 bp, Homo sapiens
tcatgtgtgtccacga

SEQ ID NO: 148378 - DNA, 21 bp, Homo sapiens
tcatgtgtgtccacgactgtc

SEQ ID NO: 148379 - DNA, 14 bp, Homo sapiens
tcatgtttaagaaa

SEQ ID NO: 148380 - DNA, 18 bp, Homo sapiens
tcattaagccctcttcca

SEQ ID NO: 148381 - DNA, 19 bp, Homo sapiens
tcattatctcaaaactgca

SEQ ID NO: 148382 - DNA, 16 bp, Homo sapiens
tcattatttgcagaga

SEQ ID NO: 148383 - DNA, 13 bp, Homo sapiens
tcattcagaaaaa

SEQ ID NO: 148384 - DNA, 12 bp, Homo sapiens
tcattcaggaaa

SEQ ID NO: 148385 - DNA, 12 bp, Homo sapiens
tcattccccagg

SEQ ID NO: 148386 - DNA, 13 bp, Homo sapiens
tcattcctgcctg

SEQ ID NO: 148387 - DNA, 15 bp, Homo sapiens
tcattctctgtctca

SEQ ID NO: 148388 - DNA, 19 bp, Homo sapiens
tcattctctgtctcatcca

SEQ ID NO: 148389 - DNA, 18 bp, Homo sapiens
tcattctgaaggagcccc

SEQ ID NO: 148390 - DNA, 18 bp, Homo sapiens
tcattcttatttcatgaa

SEQ ID NO: 148391 - DNA, 18 bp, Homo sapiens
tcattcttgaaagctgtg

SEQ ID NO: 148392 - DNA, 13 bp, Homo sapiens
tcattgcttacaa

SEQ ID NO: 148393 - DNA, 23 bp, Homo sapiens
tcattgtttattaacaaattatg

SEQ ID NO: 148394 - DNA, 14 bp, Homo sapiens
tcatttaaaatgat

SEQ ID NO: 148395 - DNA, 15 bp, Homo sapiens
tcatttaaaatgatt

SEQ ID NO: 148396 - DNA, 13 bp, Homo sapiens
tcatttctatttc

SEQ ID NO: 148397 - DNA, 22 bp, Homo sapiens
tcatttctgcatcagctgctga

SEQ ID NO: 148398 - DNA, 21 bp, Homo sapiens
tcatttgcccttaaggacaaa

SEQ ID NO: 148399 - DNA, 14 bp, Homo sapiens
tcattttaattatt

SEQ ID NO: 148400 - DNA, 17 bp, Homo sapiens
tcattttatatgtcaaa

SEQ ID NO: 148401 - DNA, 18 bp, Homo sapiens
tcattttatatgtcaaag

SEQ ID NO: 148402 - DNA, 15 bp, Homo sapiens
tccaaaataatttta

SEQ ID NO: 148403 - DNA, 16 bp, Homo sapiens
tccaaaccaaataaaa

SEQ ID NO: 148404 - DNA, 13 bp, Homo sapiens
tccaaagagaaaa

SEQ ID NO: 148405 - DNA, 16 bp, Homo sapiens
tccaaatgaatgacct

SEQ ID NO: 148406 - DNA, 13 bp, Homo sapiens
tccaacagtgagt

SEQ ID NO: 148407 - DNA, 15 bp, Homo sapiens
tccaacccatgatga

SEQ ID NO: 148408 - DNA, 16 bp, Homo sapiens
tccaaccccaactcca

SEQ ID NO: 148409 - DNA, 18 bp, Homo sapiens
tccaacctaacccctttc

SEQ ID NO: 148410 - DNA, 20 bp, Homo sapiens
tccaacctaacccctttcct

SEQ ID NO: 148411 - DNA, 21 bp, Homo sapiens
tccaacctaacccctttcctg

SEQ ID NO: 148412 - DNA, 17 bp, Homo sapiens
tccaacgtggggcagca

SEQ ID NO: 148413 - DNA, 18 bp, Homo sapiens
tccaacgtggggcagcac

SEQ ID NO: 148414 - DNA, 19 bp, Homo sapiens
tccaacgtggggcagcaca

SEQ ID NO: 148415 - DNA, 11 bp, Homo sapiens
tccaagcaaag

SEQ ID NO: 148416 - DNA, 18 bp, Homo sapiens
tccaagctccatctccac

SEQ ID NO: 148417 - DNA, 14 bp, Homo sapiens
tccaagtgtgtgtg

SEQ ID NO: 148418 - DNA, 23 bp, Homo sapiens
tccaataaatgtgaaattctgtc

SEQ ID NO: 148419 - DNA, 18 bp, Homo sapiens
tccaatcccaccaaccct

SEQ ID NO: 148420 - DNA, 19 bp, Homo sapiens
tccaatctaaccacatcaa

SEQ ID NO: 148421 - DNA, 17 bp, Homo sapiens
tccacaagattcccaga

SEQ ID NO: 148422 - DNA, 19 bp, Homo sapiens
tccacaagattcccagaga

SEQ ID NO: 148423 - DNA, 18 bp, Homo sapiens
tccacaagttaaataaat

SEQ ID NO: 148424 - DNA, 17 bp, Homo sapiens
tccacagatgcctccac

SEQ ID NO: 148425 - DNA, 15 bp, Homo sapiens
tccacagcctgcaag

SEQ ID NO: 148426 - DNA, 18 bp, Homo sapiens
tccacagcctgcaagtca

SEQ ID NO: 148427 - DNA, 23 bp, Homo sapiens
tccacagcttcccctctctcctc

SEQ ID NO: 148428 - DNA, 19 bp, Homo sapiens
tccacatcctccacgttct

SEQ ID NO: 148429 - DNA, 15 bp, Homo sapiens
tccacatgggagccg

SEQ ID NO: 148430 - DNA, 13 bp, Homo sapiens
tccaccacccaaa

SEQ ID NO: 148431 - DNA, 16 bp, Homo sapiens
tccaccacctccctca

SEQ ID NO: 148432 - DNA, 15 bp, Homo sapiens
tccaccagcctgcac

SEQ ID NO: 148433 - DNA, 22 bp, Homo sapiens
tccaccccccagaacctgtcct

SEQ ID NO: 148434 - DNA, 14 bp, Homo sapiens
tccaccgctgccta

SEQ ID NO: 148435 - DNA, 14 bp, Homo sapiens
tccacctcagcctt

SEQ ID NO: 148436 - DNA, 16 bp, Homo sapiens
tccacctcagccttgg

SEQ ID NO: 148437 - DNA, 16 bp, Homo sapiens
tccacctgctcccagg

SEQ ID NO: 148438 - DNA, 17 bp, Homo sapiens
tccacctgctcccaggc

SEQ ID NO: 148439 - DNA, 16 bp, Homo sapiens
tccacctgtctcagcc

SEQ ID NO: 148440 - DNA, 17 bp, Homo sapiens
tccacctgtctcagcct

SEQ ID NO: 148441 - DNA, 15 bp, Homo sapiens
tccacgactgtctcc

SEQ ID NO: 148442 - DNA, 19 bp, Homo sapiens
tccacgactgtctccatgg

SEQ ID NO: 148443 - DNA, 21 bp, Homo sapiens
tccacggagccactcctctga

SEQ ID NO: 148444 - DNA, 16 bp, Homo sapiens
tccacgtccccctggg

SEQ ID NO: 148445 - DNA, 17 bp, Homo sapiens
tccacgtccccctgggg

SEQ ID NO: 148446 - DNA, 17 bp, Homo sapiens
tccacgttcacccctcc

SEQ ID NO: 148447 - DNA, 19 bp, Homo sapiens
tccacgttctgctcatcat

SEQ ID NO: 148448 - DNA, 14 bp, Homo sapiens
tccactccttcctg

SEQ ID NO: 148449 - DNA, 12 bp, Homo sapiens
tccactgtcacc

SEQ ID NO: 148450 - DNA, 19 bp, Homo sapiens
tccactgtcaccctccacc

SEQ ID NO: 148451 - DNA, 23 bp, Homo sapiens
tccacttagaaattgcatttcct

SEQ ID NO: 148452 - DNA, 12 bp, Homo sapiens
tccagaatatct

SEQ ID NO: 148453 - DNA, 23 bp, Homo sapiens
tccagaatatctgggattctact

SEQ ID NO: 148454 - DNA, 18 bp, Homo sapiens
tccagaatggtctttcta

SEQ ID NO: 148455 - DNA, 13 bp, Homo sapiens
tccagacccctgg

SEQ ID NO: 148456 - DNA, 21 bp, Homo sapiens
tccagaccttgttcacactct

SEQ ID NO: 148457 - DNA, 12 bp, Homo sapiens
tccagagggcac

SEQ ID NO: 148458 - DNA, 17 bp, Homo sapiens
tccagagggcactctgc

SEQ ID NO: 148459 - DNA, 21 bp, Homo sapiens
tccagatgccttctccagaca

SEQ ID NO: 148460 - DNA, 23 bp, Homo sapiens
tccagccaaagcctcctccagcc

SEQ ID NO: 148461 - DNA, 22 bp, Homo sapiens
tccagccccttctcagaatcta

SEQ ID NO: 148462 - DNA, 19 bp, Homo sapiens
tccagctgggttggaaaac

SEQ ID NO: 148463 - DNA, 16 bp, Homo sapiens
tccaggagaaggccaa

SEQ ID NO: 148464 - DNA, 20 bp, Homo sapiens
tccaggagaaggccaattcc

SEQ ID NO: 148465 - DNA, 20 bp, Homo sapiens
tccagggatgccatctgtgg

SEQ ID NO: 148466 - DNA, 17 bp, Homo sapiens
tccagggccacgtgcca

SEQ ID NO: 148467 - DNA, 16 bp, Homo sapiens
tccaggtctcacgggc

SEQ ID NO: 148468 - DNA, 18 bp, Homo sapiens
tccaggtttaagctgtta

SEQ ID NO: 148469 - DNA, 23 bp, Homo sapiens
tccagtagcttgggacaaatcaa

SEQ ID NO: 148470 - DNA, 17 bp, Homo sapiens
tccagtgccagcaatga

SEQ ID NO: 148471 - DNA, 22 bp, Homo sapiens
tccagttaaaaaaaattttaat

SEQ ID NO: 148472 - DNA, 22 bp, Homo sapiens
tccataatctggactcctctgt

SEQ ID NO: 148473 - DNA, 23 bp, Homo sapiens
tccataatctggactcctctgtc

SEQ ID NO: 148474 - DNA, 13 bp, Homo sapiens
tccatactcagga

SEQ ID NO: 148475 - DNA, 17 bp, Homo sapiens
tccatatgacctcatgc

SEQ ID NO: 148476 - DNA, 18 bp, Homo sapiens
tccatatgacctcatgca

SEQ ID NO: 148477 - DNA, 19 bp, Homo sapiens
tccatatgacctcatgcat

SEQ ID NO: 148478 - DNA, 14 bp, Homo sapiens
tccatatttattca

SEQ ID NO: 148479 - DNA, 14 bp, Homo sapiens
tccatcaggccact

SEQ ID NO: 148480 - DNA, 13 bp, Homo sapiens
tccatcatcatgt

SEQ ID NO: 148481 - DNA, 12 bp, Homo sapiens
tccatcatgtcc

SEQ ID NO: 148482 - DNA, 20 bp, Homo sapiens
tccatcccgaaaatctctcg

SEQ ID NO: 148483 - DNA, 14 bp, Homo sapiens
tccatctcgccacc

SEQ ID NO: 148484 - DNA, 15 bp, Homo sapiens
tccatctggcagggt

SEQ ID NO: 148485 - DNA, 14 bp, Homo sapiens
tccatgctgcctcc

SEQ ID NO: 148486 - DNA, 18 bp, Homo sapiens
tccatgggagaaaataga

SEQ ID NO: 148487 - DNA, 17 bp, Homo sapiens
tccatgtcgcctctgca

SEQ ID NO: 148488 - DNA, 18 bp, Homo sapiens
tccatgtgtgtgcaagtg

SEQ ID NO: 148489 - DNA, 19 bp, Homo sapiens
tccatgtttgtaaaactac

SEQ ID NO: 148490 - DNA, 11 bp, Homo sapiens
tccattattta

SEQ ID NO: 148491 - DNA, 15 bp, Homo sapiens
tccattatttatatt

SEQ ID NO: 148492 - DNA, 12 bp, Homo sapiens
tccattccagaa

SEQ ID NO: 148493 - DNA, 14 bp, Homo sapiens
tccattgtgtgagt

SEQ ID NO: 148494 - DNA, 14 bp, Homo sapiens
tccatttgtgtgtg

SEQ ID NO: 148495 - DNA, 14 bp, Homo sapiens
tcccaacttgtaaa

SEQ ID NO: 148496 - DNA, 15 bp, Homo sapiens
tcccaagtctacaga

SEQ ID NO: 148497 - DNA, 15 bp, Homo sapiens
tcccaattcacatct

SEQ ID NO: 148498 - DNA, 14 bp, Homo sapiens
tcccacaaaggaga

SEQ ID NO: 148499 - DNA, 17 bp, Homo sapiens
tcccacaggacatttct

SEQ ID NO: 148500 - DNA, 17 bp, Homo sapiens
tcccacaggcccttcct

SEQ ID NO: 148501 - DNA, 12 bp, Homo sapiens
tcccaccccacc

SEQ ID NO: 148502 - DNA, 18 bp, Homo sapiens
tcccaccccacccccttc

SEQ ID NO: 148503 - DNA, 13 bp, Homo sapiens
tcccacctctgtg

SEQ ID NO: 148504 - DNA, 18 bp, Homo sapiens
tcccacctctgtgacctc

SEQ ID NO: 148505 - DNA, 18 bp, Homo sapiens
tatttcaaattggagctt

SEQ ID NO: 148506 - DNA, 13 bp, Homo sapiens
tatttcatttctt

SEQ ID NO: 148507 - DNA, 11 bp, Homo sapiens
tatttctgaga

SEQ ID NO: 148508 - DNA, 16 bp, Homo sapiens
tatttctgagaaggtc

SEQ ID NO: 148509 - DNA, 19 bp, Homo sapiens
tatttcttaaatctagtaa

SEQ ID NO: 148510 - DNA, 18 bp, Homo sapiens
tatttgagagttctaaat

SEQ ID NO: 148511 - DNA, 15 bp, Homo sapiens
tatttgtctttcagg

SEQ ID NO: 148512 - DNA, 13 bp, Homo sapiens
tatttgtgtaata

SEQ ID NO: 148513 - DNA, 14 bp, Homo sapiens
tatttgtgtaatag

SEQ ID NO: 148514 - DNA, 17 bp, Homo sapiens
tatttgttattttcagt

SEQ ID NO: 148515 - DNA, 19 bp, Homo sapiens
tattttaaacaaaatagaa

SEQ ID NO: 148516 - DNA, 19 bp, Homo sapiens
tattttaatttatgagttt

SEQ ID NO: 148517 - DNA, 16 bp, Homo sapiens
tattttggagaaatta

SEQ ID NO: 148518 - DNA, 15 bp, Homo sapiens
tattttgtatatatc

SEQ ID NO: 148519 - DNA, 12 bp, Homo sapiens
tattttgtctaa

SEQ ID NO: 148520 - DNA, 14 bp, Homo sapiens
tattttgtctaaaa

SEQ ID NO: 148521 - DNA, 18 bp, Homo sapiens
tatttttacattctgaat

SEQ ID NO: 148522 - DNA, 21 bp, Homo sapiens
tattttttaagtatttatata

SEQ ID NO: 148523 - DNA, 15 bp, Homo sapiens
tattttttaattatt

SEQ ID NO: 148524 - DNA, 17 bp, Homo sapiens
tatttttttgcaagtga

SEQ ID NO: 148525 - DNA, 14 bp, Homo sapiens
tcaaaaaaagaaaa

SEQ ID NO: 148526 - DNA, 13 bp, Homo sapiens
tcaaaactgcact

SEQ ID NO: 148527 - DNA, 16 bp, Homo sapiens
tcaaaagctgggcagg

SEQ ID NO: 148528 - DNA, 23 bp, Homo sapiens
tcaaaaggtgcctgtgaggcagg

SEQ ID NO: 148529 - DNA, 21 bp, Homo sapiens
tcaaaataccatgccatttaa

SEQ ID NO: 148530 - DNA, 23 bp, Homo sapiens
tcaaaataccatgccatttaaag

SEQ ID NO: 148531 - DNA, 16 bp, Homo sapiens
tcaaaatttgaagaat

SEQ ID NO: 148532 - DNA, 16 bp, Homo sapiens
tcaaacaaagccagaa

SEQ ID NO: 148533 - DNA, 22 bp, Homo sapiens
tcaaacagtacactatcttaat

SEQ ID NO: 148534 - DNA, 13 bp, Homo sapiens
tcaaacagtctca

SEQ ID NO: 148535 - DNA, 21 bp, Homo sapiens
tcaaaccataaacttcatggt

SEQ ID NO: 148536 - DNA, 23 bp, Homo sapiens
tcaaaccccgaccacctgcccaa

SEQ ID NO: 148537 - DNA, 19 bp, Homo sapiens
tcaaactggggcctccctg

SEQ ID NO: 148538 - DNA, 12 bp, Homo sapiens
tcaaagaaatgc

SEQ ID NO: 148539 - DNA, 22 bp, Homo sapiens
tcaaagaaggatggcacctaaa

SEQ ID NO: 148540 - DNA, 12 bp, Homo sapiens
tcaaagaggttt

SEQ ID NO: 148541 - DNA, 20 bp, Homo sapiens
tcaaagcaaggaaactatgt

SEQ ID NO: 148542 - DNA, 19 bp, Homo sapiens
tcaaagcaggggagtatgc

SEQ ID NO: 148543 - DNA, 22 bp, Homo sapiens
tcaaagccagcgtcctcctctg

SEQ ID NO: 148544 - DNA, 23 bp, Homo sapiens
tcaaagccagcgtcctcctctgt

SEQ ID NO: 148545 - DNA, 14 bp, Homo sapiens
tcaaagtaaaactt

SEQ ID NO: 148546 - DNA, 17 bp, Homo sapiens
tcaaatatgcaaagcac

SEQ ID NO: 148547 - DNA, 18 bp, Homo sapiens
tcaaatatgcaaagcact

SEQ ID NO: 148548 - DNA, 15 bp, Homo sapiens
tcaaatggaaaggag

SEQ ID NO: 148549 - DNA, 23 bp, Homo sapiens
tcaaatggaaaggagaggaaaga

SEQ ID NO: 148550 - DNA, 18 bp, Homo sapiens
tcaacaaaaattgtccct

SEQ ID NO: 148551 - DNA, 14 bp, Homo sapiens
tcaaccagcagatg

SEQ ID NO: 148552 - DNA, 17 bp, Homo sapiens
tcaacctgggcaaagcc

SEQ ID NO: 148553 - DNA, 23 bp, Homo sapiens
tcaactgaaaagactcagtgttc

SEQ ID NO: 148554 - DNA, 18 bp, Homo sapiens
tcaactgaccagcctcca

SEQ ID NO: 148555 - DNA, 21 bp, Homo sapiens
tcaagaaaaattattgtataa

SEQ ID NO: 148556 - DNA, 23 bp, Homo sapiens
tcaagaagaagatggattggtgt

SEQ ID NO: 148557 - DNA, 21 bp, Homo sapiens
tcaagagggcactggtggccc

SEQ ID NO: 148558 - DNA, 21 bp, Homo sapiens
tcaagcaaacagcttcacaaa

SEQ ID NO: 148559 - DNA, 16 bp, Homo sapiens
tcaagccaagcagcca

SEQ ID NO: 148560 - DNA, 16 bp, Homo sapiens
tcaagcccaggaggac

SEQ ID NO: 148561 - DNA, 19 bp, Homo sapiens
tcaagtctctgctggccca

SEQ ID NO: 148562 - DNA, 15 bp, Homo sapiens
tcaagtgaaaaagga

SEQ ID NO: 148563 - DNA, 21 bp, Homo sapiens
tcaagtgcatgctctctgcag

SEQ ID NO: 148564 - DNA, 16 bp, Homo sapiens
tcaagtgtctcagtcc

SEQ ID NO: 148565 - DNA, 16 bp, Homo sapiens
tcaagtttttcagaaa

SEQ ID NO: 148566 - DNA, 20 bp, Homo sapiens
tcaataagcatcaaactctt

SEQ ID NO: 148567 - DNA, 14 bp, Homo sapiens
tcaatagtcaagaa

SEQ ID NO: 148568 - DNA, 22 bp, Homo sapiens
tcaatatcttttttttaataaa

SEQ ID NO: 148569 - DNA, 18 bp, Homo sapiens
tcaatattgtcattcctg

SEQ ID NO: 148570 - DNA, 20 bp, Homo sapiens
tcaatatttattattttcac

SEQ ID NO: 148571 - DNA, 15 bp, Homo sapiens
tcaatcatctgtgtg

SEQ ID NO: 148572 - DNA, 16 bp, Homo sapiens
tcaatcatctgtgtga

SEQ ID NO: 148573 - DNA, 20 bp, Homo sapiens
tcaatcatctgtgtgaaaat

SEQ ID NO: 148574 - DNA, 15 bp, Homo sapiens
tcaatccagctatgt

SEQ ID NO: 148575 - DNA, 22 bp, Homo sapiens
tcaatcccctcattcaggaaaa

SEQ ID NO: 148576 - DNA, 11 bp, Homo sapiens
tcaattaataa

SEQ ID NO: 148577 - DNA, 17 bp, Homo sapiens
tcaattgcatctcccag

SEQ ID NO: 148578 - DNA, 18 bp, Homo sapiens
tcaattgcatctcccaga

SEQ ID NO: 148579 - DNA, 20 bp, Homo sapiens
tcaatttttcttatttcatt

SEQ ID NO: 148580 - DNA, 14 bp, Homo sapiens
tcacaaaattttat

SEQ ID NO: 148581 - DNA, 14 bp, Homo sapiens
tcacaaccttctgt

SEQ ID NO: 148582 - DNA, 18 bp, Homo sapiens
tcacaagacccaaaaggc

SEQ ID NO: 148583 - DNA, 22 bp, Homo sapiens
tcacaatgaaatgctctccttt

SEQ ID NO: 148584 - DNA, 16 bp, Homo sapiens
tcacactctcacatgt

SEQ ID NO: 148585 - DNA, 18 bp, Homo sapiens
tcacactgcaagagcctt

SEQ ID NO: 148586 - DNA, 17 bp, Homo sapiens
tcacagcctctgacccc

SEQ ID NO: 148587 - DNA, 21 bp, Homo sapiens
tcacagcctctgacccctcct

SEQ ID NO: 148588 - DNA, 19 bp, Homo sapiens
tcacaggaagtagaggagg

SEQ ID NO: 148589 - DNA, 18 bp, Homo sapiens
tcacaggactctgcctcc

SEQ ID NO: 148590 - DNA, 14 bp, Homo sapiens
tcacagggccaact

SEQ ID NO: 148591 - DNA, 11 bp, Homo sapiens
tcacagtgttt

SEQ ID NO: 148592 - DNA, 21 bp, Homo sapiens
tcacagttcctcgccctgggt

SEQ ID NO: 148593 - DNA, 14 bp, Homo sapiens
tcacatctttcaca

SEQ ID NO: 148594 - DNA, 17 bp, Homo sapiens
tcacatctttcacactt

SEQ ID NO: 148595 - DNA, 23 bp, Homo sapiens
tcacatgagctatttccattcca

SEQ ID NO: 148596 - DNA, 19 bp, Homo sapiens
tcacattaatatttgctga

SEQ ID NO: 148597 - DNA, 20 bp, Homo sapiens
tcacattaatatttgctgac

SEQ ID NO: 148598 - DNA, 14 bp, Homo sapiens
tcaccaaggctgat

SEQ ID NO: 148599 - DNA, 17 bp, Homo sapiens
tcaccagtgtcccctcc

SEQ ID NO: 148600 - DNA, 17 bp, Homo sapiens
tcaccatttgattatgt

SEQ ID NO: 148601 - DNA, 12 bp, Homo sapiens
tcacccacaggg

SEQ ID NO: 148602 - DNA, 14 bp, Homo sapiens
tcacccacagggct

SEQ ID NO: 148603 - DNA, 14 bp, Homo sapiens
tcaccccccactca

SEQ ID NO: 148604 - DNA, 18 bp, Homo sapiens
tcaccccccactcaccag

SEQ ID NO: 148605 - DNA, 22 bp, Homo sapiens
tcacccccttctccatccacat

SEQ ID NO: 148606 - DNA, 17 bp, Homo sapiens
tcacccctccacccttg

SEQ ID NO: 148607 - DNA, 17 bp, Homo sapiens
tcacccctgccctggga

SEQ ID NO: 148608 - DNA, 14 bp, Homo sapiens
tcacccctgtcctc

SEQ ID NO: 148609 - DNA, 14 bp, Homo sapiens
tcaccctccacctc

SEQ ID NO: 148610 - DNA, 13 bp, Homo sapiens
tcaccctgcctta

SEQ ID NO: 148611 - DNA, 15 bp, Homo sapiens
tcaccctttgctgtg

SEQ ID NO: 148612 - DNA, 22 bp, Homo sapiens
tcaccctttgctgtgaggctgt

SEQ ID NO: 148613 - DNA, 17 bp, Homo sapiens
tcaccgacgcgtctcct

SEQ ID NO: 148614 - DNA, 17 bp, Homo sapiens
tcaccgtgggctccctg

SEQ ID NO: 148615 - DNA, 20 bp, Homo sapiens
tcacctgtgcttcgggccct

SEQ ID NO: 148616 - DNA, 21 bp, Homo sapiens
tcacctgtgcttcgggccctt

SEQ ID NO: 148617 - DNA, 18 bp, Homo sapiens
tcacctgtttttaagctg

SEQ ID NO: 148618 - DNA, 19 bp, Homo sapiens
tcacgcctgtaatcctagc

SEQ ID NO: 148619 - DNA, 14 bp, Homo sapiens
tcacggaagagcct

SEQ ID NO: 148620 - DNA, 16 bp, Homo sapiens
tcacggaagagccttg

SEQ ID NO: 148621 - DNA, 15 bp, Homo sapiens
tcacggaagttttca

SEQ ID NO: 148622 - DNA, 14 bp, Homo sapiens
tcactccaccaccc

SEQ ID NO: 148623 - DNA, 13 bp, Homo sapiens
tcactctggcctc

SEQ ID NO: 148624 - DNA, 23 bp, Homo sapiens
tcactgaatgcttctgacttcat

SEQ ID NO: 148625 - DNA, 18 bp, Homo sapiens
tcactgcaagctccgcct

SEQ ID NO: 148626 - DNA, 22 bp, Homo sapiens
tcactgcacagtgcatctcagc

SEQ ID NO: 148627 - DNA, 24 bp, Homo sapiens
tcactgcacagtgcatctcagccc

SEQ ID NO: 148628 - DNA, 20 bp, Homo sapiens
tcactgctccctgaagccag

SEQ ID NO: 148629 - DNA, 21 bp, Homo sapiens
tcactgctccctgaagccagc

SEQ ID NO: 148630 - DNA, 18 bp, Homo sapiens
tcactgctggctgcctta

SEQ ID NO: 148631 - DNA, 18 bp, Homo sapiens
tcactggagcaccaggca

SEQ ID NO: 148632 - DNA, 14 bp, Homo sapiens
tcactggatgaaga

SEQ ID NO: 148633 - DNA, 19 bp, Homo sapiens
tcactggatgaagattctc

SEQ ID NO: 148634 - DNA, 20 bp, Homo sapiens
tcactggcgacacgtagcag

SEQ ID NO: 148635 - DNA, 22 bp, Homo sapiens
tcactggcgacacgtagcagct

SEQ ID NO: 148636 - DNA, 17 bp, Homo sapiens
tcactggggtcctgggg

SEQ ID NO: 148637 - DNA, 22 bp, Homo sapiens
tcccatcccagctgaaatactg

SEQ ID NO: 148638 - DNA, 16 bp, Homo sapiens
tcccatgatccctgtg

SEQ ID NO: 148639 - DNA, 19 bp, Homo sapiens
tcccatgatccctgtgttg

SEQ ID NO: 148640 - DNA, 12 bp, Homo sapiens
tcccatgatgta

SEQ ID NO: 148641 - DNA, 21 bp, Homo sapiens
tcccatggacactccagtgcc

SEQ ID NO: 148642 - DNA, 22 bp, Homo sapiens
tcccatgtatttatctctattt

SEQ ID NO: 148643 - DNA, 13 bp, Homo sapiens
tcccattgccctg

SEQ ID NO: 148644 - DNA, 18 bp, Homo sapiens
tccccaaagtcttaaaat

SEQ ID NO: 148645 - DNA, 18 bp, Homo sapiens
tccccaacatgtaataag

SEQ ID NO: 148646 - DNA, 19 bp, Homo sapiens
tccccacgccctcccctcc

SEQ ID NO: 148647 - DNA, 16 bp, Homo sapiens
tccccactgacagcct

SEQ ID NO: 148648 - DNA, 19 bp, Homo sapiens
tccccactgacagcctccc

SEQ ID NO: 148649 - DNA, 12 bp, Homo sapiens
tccccagcccag

SEQ ID NO: 148650 - DNA, 13 bp, Homo sapiens
tccccagccccta

SEQ ID NO: 148651 - DNA, 16 bp, Homo sapiens
tccccagcccctagcc

SEQ ID NO: 148652 - DNA, 21 bp, Homo sapiens
tccccagcccctagcccagga

SEQ ID NO: 148653 - DNA, 18 bp, Homo sapiens
tccccagccctggctctg

SEQ ID NO: 148654 - DNA, 12 bp, Homo sapiens
tccccagcctct

SEQ ID NO: 148655 - DNA, 11 bp, Homo sapiens
tccccaggccc

SEQ ID NO: 148656 - DNA, 20 bp, Homo sapiens
tccccaggccccaggaagcc

SEQ ID NO: 148657 - DNA, 21 bp, Homo sapiens
tccccaggccccaggaagccg

SEQ ID NO: 148658 - DNA, 14 bp, Homo sapiens
tccccaggggagag

SEQ ID NO: 148659 - DNA, 23 bp, Homo sapiens
tccccaggggagagggtctggag

SEQ ID NO: 148660 - DNA, 22 bp, Homo sapiens
tccccaggtggctgacccagtc

SEQ ID NO: 148661 - DNA, 14 bp, Homo sapiens
tccccatctgggtc

SEQ ID NO: 148662 - DNA, 18 bp, Homo sapiens
tcccccaccccctcccca

SEQ ID NO: 148663 - DNA, 13 bp, Homo sapiens
tcccccagacttt

SEQ ID NO: 148664 - DNA, 17 bp, Homo sapiens
tccccctgccagtgcct

SEQ ID NO: 148665 - DNA, 13 bp, Homo sapiens
tccccctgcccca

SEQ ID NO: 148666 - DNA, 22 bp, Homo sapiens
tccccggtcccttgagacctca

SEQ ID NO: 148667 - DNA, 20 bp, Homo sapiens
tcccctaagcagaccactga

SEQ ID NO: 148668 - DNA, 20 bp, Homo sapiens
tcccctatccacccagccca

SEQ ID NO: 148669 - DNA, 16 bp, Homo sapiens
tcccctcacagcctct

SEQ ID NO: 148670 - DNA, 18 bp, Homo sapiens
tcccctcacagcctctga

SEQ ID NO: 148671 - DNA, 21 bp, Homo sapiens
tcccctcacagcctctgaccc

SEQ ID NO: 148672 - DNA, 13 bp, Homo sapiens
tcccctcattcag

SEQ ID NO: 148673 - DNA, 15 bp, Homo sapiens
tcccctccactgtca

SEQ ID NO: 148674 - DNA, 13 bp, Homo sapiens
tcccctcccctgc

SEQ ID NO: 148675 - DNA, 16 bp, Homo sapiens
tcccctcggagaagag

SEQ ID NO: 148676 - DNA, 17 bp, Homo sapiens
tcccctcggagaagagc

SEQ ID NO: 148677 - DNA, 13 bp, Homo sapiens
tcccctgccattt

SEQ ID NO: 148678 - DNA, 12 bp, Homo sapiens
tcccctgccctg

SEQ ID NO: 148679 - DNA, 23 bp, Homo sapiens
tcccctgctgcaggggctctgga

SEQ ID NO: 148680 - DNA, 19 bp, Homo sapiens
tcccctgtagagtgggagc

SEQ ID NO: 148681 - DNA, 15 bp, Homo sapiens
tcccctgttcactct

SEQ ID NO: 148682 - DNA, 13 bp, Homo sapiens
tccccttccactg

SEQ ID NO: 148683 - DNA, 17 bp, Homo sapiens
tccccttccactgaggg

SEQ ID NO: 148684 - DNA, 18 bp, Homo sapiens
tccctaccacctccccag

SEQ ID NO: 148685 - DNA, 22 bp, Homo sapiens
tccctaccgagtctcttctcca

SEQ ID NO: 148686 - DNA, 15 bp, Homo sapiens
tccctacttcctgtg

SEQ ID NO: 148687 - DNA, 18 bp, Homo sapiens
tccctattagagaagaga

SEQ ID NO: 148688 - DNA, 12 bp, Homo sapiens
tccctcacctgt

SEQ ID NO: 148689 - DNA, 14 bp, Homo sapiens
tccctcacctgtag

SEQ ID NO: 148690 - DNA, 14 bp, Homo sapiens
tccctcccacctct

SEQ ID NO: 148691 - DNA, 15 bp, Homo sapiens
tccctcccacctctg

SEQ ID NO: 148692 - DNA, 21 bp, Homo sapiens
tccctcccacctctgtgacct

SEQ ID NO: 148693 - DNA, 16 bp, Homo sapiens
tccctcccctgccatt

SEQ ID NO: 148694 - DNA, 14 bp, Homo sapiens
tccctccgggacct

SEQ ID NO: 148695 - DNA, 16 bp, Homo sapiens
tccctctaatttatct

SEQ ID NO: 148696 - DNA, 21 bp, Homo sapiens
tccctctacagagcttccctg

SEQ ID NO: 148697 - DNA, 15 bp, Homo sapiens
tccctctctctgact

SEQ ID NO: 148698 - DNA, 22 bp, Homo sapiens
tccctctctctgactctcaaat

SEQ ID NO: 148699 - DNA, 16 bp, Homo sapiens
tccctctggccctgcc

SEQ ID NO: 148700 - DNA, 17 bp, Homo sapiens
tccctctggccctgcct

SEQ ID NO: 148701 - DNA, 19 bp, Homo sapiens
tccctctggccctgccttc

SEQ ID NO: 148702 - DNA, 20 bp, Homo sapiens
tccctctggccctgccttct

SEQ ID NO: 148703 - DNA, 16 bp, Homo sapiens
tccctgaaaacccaga

SEQ ID NO: 148704 - DNA, 12 bp, Homo sapiens
tccctgaagcca

SEQ ID NO: 148705 - DNA, 17 bp, Homo sapiens
tccctgacctccctcta

SEQ ID NO: 148706 - DNA, 14 bp, Homo sapiens
tccctgactcattc

SEQ ID NO: 148707 - DNA, 19 bp, Homo sapiens
tccctgactcattctgaag

SEQ ID NO: 148708 - DNA, 22 bp, Homo sapiens
tccctgactcattctgaaggag

SEQ ID NO: 148709 - DNA, 14 bp, Homo sapiens
tccctgactgggag

SEQ ID NO: 148710 - DNA, 11 bp, Homo sapiens
tccctgagcag

SEQ ID NO: 148711 - DNA, 21 bp, Homo sapiens
tccctgagtcaccaggaatgt

SEQ ID NO: 148712 - DNA, 14 bp, Homo sapiens
tccctgcatttctg

SEQ ID NO: 148713 - DNA, 14 bp, Homo sapiens
tccctgcccctccc

SEQ ID NO: 148714 - DNA, 14 bp, Homo sapiens
tccctgccgcctca

SEQ ID NO: 148715 - DNA, 11 bp, Homo sapiens
tccctgcctgg

SEQ ID NO: 148716 - DNA, 15 bp, Homo sapiens
tccctgcctggtcac

SEQ ID NO: 148717 - DNA, 13 bp, Homo sapiens
tccctggaaggtg

SEQ ID NO: 148718 - DNA, 19 bp, Homo sapiens
tccctggcttgtaactcca

SEQ ID NO: 148719 - DNA, 22 bp, Homo sapiens
tccctggcttgtaactccacca

SEQ ID NO: 148720 - DNA, 19 bp, Homo sapiens
tccctgggggaagccctgg

SEQ ID NO: 148721 - DNA, 21 bp, Homo sapiens
tccctggtaataagtactgtg

SEQ ID NO: 148722 - DNA, 19 bp, Homo sapiens
tccctggtcccttggagac

SEQ ID NO: 148723 - DNA, 22 bp, Homo sapiens
tccctgtaacctcttcagaggc

SEQ ID NO: 148724 - DNA, 15 bp, Homo sapiens
tccctgtcaccaagc

SEQ ID NO: 148725 - DNA, 22 bp, Homo sapiens
tccctgtcaccaagctcacagt

SEQ ID NO: 148726 - DNA, 12 bp, Homo sapiens
tccctgtcccag

SEQ ID NO: 148727 - DNA, 14 bp, Homo sapiens
tccctgtttaatat

SEQ ID NO: 148728 - DNA, 22 bp, Homo sapiens
tccctgtttaatatttaaacag

SEQ ID NO: 148729 - DNA, 21 bp, Homo sapiens
tcccttcaaccattccccatg

SEQ ID NO: 148730 - DNA, 17 bp, Homo sapiens
tcccttctttttcttct

SEQ ID NO: 148731 - DNA, 16 bp, Homo sapiens
tcccttgagacctcag

SEQ ID NO: 148732 - DNA, 19 bp, Homo sapiens
tcccttgagacctcagcca

SEQ ID NO: 148733 - DNA, 21 bp, Homo sapiens
tccctttcacaaaattttatt

SEQ ID NO: 148734 - DNA, 22 bp, Homo sapiens
tccctttccaaatgcccagctt

SEQ ID NO: 148735 - DNA, 19 bp, Homo sapiens
tccctttctgcttgtgtta

SEQ ID NO: 148736 - DNA, 21 bp, Homo sapiens
tccgaagtatgagggaaaatg

SEQ ID NO: 148737 - DNA, 17 bp, Homo sapiens
tccgcctctgctggcac

SEQ ID NO: 148738 - DNA, 15 bp, Homo sapiens
tccggaatcctgtcc

SEQ ID NO: 148739 - DNA, 18 bp, Homo sapiens
tccggaatcctgtcctca

SEQ ID NO: 148740 - DNA, 22 bp, Homo sapiens
tccggaatcctgtcctcagctt

SEQ ID NO: 148741 - DNA, 15 bp, Homo sapiens
tccgtagttccctga

SEQ ID NO: 148742 - DNA, 22 bp, Homo sapiens
tccgtctaagtcatgagctgag

SEQ ID NO: 148743 - DNA, 24 bp, Homo sapiens
tccgtgcttgtttgctcacctggg

SEQ ID NO: 148744 - DNA, 15 bp, Homo sapiens
tcctaaaacaaatag

SEQ ID NO: 148745 - DNA, 14 bp, Homo sapiens
tcctacaaagatgt

SEQ ID NO: 148746 - DNA, 16 bp, Homo sapiens
tcctacagatagtcaa

SEQ ID NO: 148747 - DNA, 20 bp, Homo sapiens
tcctaccaatagattcccca

SEQ ID NO: 148748 - DNA, 22 bp, Homo sapiens
tcctagaaattccccaccctga

SEQ ID NO: 148749 - DNA, 13 bp, Homo sapiens
tcctagatgctct

SEQ ID NO: 148750 - DNA, 14 bp, Homo sapiens
tcctaggcatttgc

SEQ ID NO: 148751 - DNA, 19 bp, Homo sapiens
tcctaggcatttgctgaat

SEQ ID NO: 148752 - DNA, 20 bp, Homo sapiens
tcctcaccccgtctggggtt

SEQ ID NO: 148753 - DNA, 12 bp, Homo sapiens
tcctcacccctg

SEQ ID NO: 148754 - DNA, 15 bp, Homo sapiens
tcctcacccctgtcc

SEQ ID NO: 148755 - DNA, 21 bp, Homo sapiens
tcctcacccctgtcctcactg

SEQ ID NO: 148756 - DNA, 19 bp, Homo sapiens
tcctcactcccttcccata

SEQ ID NO: 148757 - DNA, 17 bp, Homo sapiens
tcctcactgctccctga

SEQ ID NO: 148758 - DNA, 20 bp, Homo sapiens
tcctcactgctccctgaagc

SEQ ID NO: 148759 - DNA, 18 bp, Homo sapiens
tcctcagggacagagaca

SEQ ID NO: 148760 - DNA, 19 bp, Homo sapiens
tcctcatttggggtagcta

SEQ ID NO: 148761 - DNA, 13 bp, Homo sapiens
tcctcccatcccc

SEQ ID NO: 148762 - DNA, 23 bp, Homo sapiens
tcctccccctgccagtgccttac

SEQ ID NO: 148763 - DNA, 17 bp, Homo sapiens
tcctcccctcacagcct

SEQ ID NO: 148764 - DNA, 18 bp, Homo sapiens
tcctcccctcacagcctc

SEQ ID NO: 148765 - DNA, 21 bp, Homo sapiens
tcctcccctcacagcctctga

SEQ ID NO: 148766 - DNA, 23 bp, Homo sapiens
tcctcccctcacagcctctgacc

SEQ ID NO: 148767 - DNA, 11 bp, Homo sapiens
tcctcctctgt

SEQ ID NO: 148768 - DNA, 16 bp, Homo sapiens
tcctcctgggccctct

SEQ ID NO: 148769 - DNA, 14 bp, Homo sapiens
tcctcgcaagctgg

SEQ ID NO: 148770 - DNA, 13 bp, Homo sapiens
tcctctgtccagg

SEQ ID NO: 148771 - DNA, 17 bp, Homo sapiens
tcctctgtccaggcact

SEQ ID NO: 148772 - DNA, 14 bp, Homo sapiens
tcctctgtccaggg

SEQ ID NO: 148773 - DNA, 16 bp, Homo sapiens
tcctctgtccagggcc

SEQ ID NO: 148774 - DNA, 20 bp, Homo sapiens
tcctcttaaaaaataaaaac

SEQ ID NO: 148775 - DNA, 16 bp, Homo sapiens
tcctgaaagacaatat

SEQ ID NO: 148776 - DNA, 16 bp, Homo sapiens
tcctgaacctgatgct

SEQ ID NO: 148777 - DNA, 14 bp, Homo sapiens
tcctgacccagtcc

SEQ ID NO: 148778 - DNA, 15 bp, Homo sapiens
tcctgacccagtccc

SEQ ID NO: 148779 - DNA, 16 bp, Homo sapiens
tcctgacccagtcccc

SEQ ID NO: 148780 - DNA, 15 bp, Homo sapiens
tcctgatcagagccg

SEQ ID NO: 148781 - DNA, 15 bp, Homo sapiens
tcctgcagcctcctc

SEQ ID NO: 148782 - DNA, 19 bp, Homo sapiens
tcctgcagcctcctcctga

SEQ ID NO: 148783 - DNA, 14 bp, Homo sapiens
tcctgcagcctgga

SEQ ID NO: 148784 - DNA, 14 bp, Homo sapiens
tcctgccaggcatg

SEQ ID NO: 148785 - DNA, 18 bp, Homo sapiens
tcctgcccctgagcccat

SEQ ID NO: 148786 - DNA, 17 bp, Homo sapiens
tcctgcctcagcctccg

SEQ ID NO: 148787 - DNA, 16 bp, Homo sapiens
tcctgccttcctcctg

SEQ ID NO: 148788 - DNA, 21 bp, Homo sapiens
tcctggaagctgtgtccttgc

SEQ ID NO: 148789 - DNA, 14 bp, Homo sapiens
tcctgggaaatatt

SEQ ID NO: 148790 - DNA, 20 bp, Homo sapiens
tcctgggaaatattccctag

SEQ ID NO: 148791 - DNA, 21 bp, Homo sapiens
tcctgggaaatattccctaga

SEQ ID NO: 148792 - DNA, 23 bp, Homo sapiens
tcctgggccctctctgctctgcg

SEQ ID NO: 148793 - DNA, 12 bp, Homo sapiens
tcctgggctcag

SEQ ID NO: 148794 - DNA, 22 bp, Homo sapiens
tcctgggtggtctgcaggcagg

SEQ ID NO: 148795 - DNA, 17 bp, Homo sapiens
tcctgggttttgtattc

SEQ ID NO: 148796 - DNA, 20 bp, Homo sapiens
tcctgggttttgtattctct

SEQ ID NO: 148797 - DNA, 23 bp, Homo sapiens
tcctgggttttgtattctctgag

SEQ ID NO: 148798 - DNA, 13 bp, Homo sapiens
tcctggtagaata

SEQ ID NO: 148799 - DNA, 21 bp, Homo sapiens
tcctgtagaggttttgttgtt

SEQ ID NO: 148800 - DNA, 18 bp, Homo sapiens
tcctgtccaacctaaccc

SEQ ID NO: 148801 - DNA, 11 bp, Homo sapiens
tcctgtcctcc

SEQ ID NO: 148802 - DNA, 21 bp, Homo sapiens
tcctgtcctcccatcccctgg

SEQ ID NO: 148803 - DNA, 12 bp, Homo sapiens
tcctgtctgcca

SEQ ID NO: 148804 - DNA, 17 bp, Homo sapiens
tcctgtctgccagccag

SEQ ID NO: 148805 - DNA, 21 bp, Homo sapiens
tcctgtctttaaagcctgcct

SEQ ID NO: 148806 - DNA, 18 bp, Homo sapiens
tcctgtgacttcagctct

SEQ ID NO: 148807 - DNA, 22 bp, Homo sapiens
tccttaaaggcaccatctaata

SEQ ID NO: 148808 - DNA, 19 bp, Homo sapiens
tccttagcttagacctcag

SEQ ID NO: 148809 - DNA, 22 bp, Homo sapiens
tccttatgtatatttaaaagaa

SEQ ID NO: 148810 - DNA, 18 bp, Homo sapiens
tccttcagcttccatttc

SEQ ID NO: 148811 - DNA, 14 bp, Homo sapiens
tccttccaacagga

SEQ ID NO: 148812 - DNA, 21 bp, Homo sapiens
tccttccaacaggagctggga

SEQ ID NO: 148813 - DNA, 12 bp, Homo sapiens
tccttccctctc

SEQ ID NO: 148814 - DNA, 15 bp, Homo sapiens
tccttccctggcttg

SEQ ID NO: 148815 - DNA, 13 bp, Homo sapiens
tccttcctgtctt

SEQ ID NO: 148816 - DNA, 15 bp, Homo sapiens
tccttccttccctgg

SEQ ID NO: 148817 - DNA, 13 bp, Homo sapiens
tccttctcctcct

SEQ ID NO: 148818 - DNA, 20 bp, Homo sapiens
tccttctctcacctcctaaa

SEQ ID NO: 148819 - DNA, 22 bp, Homo sapiens
tccttctttctagttcagctgc

SEQ ID NO: 148820 - DNA, 13 bp, Homo sapiens
tccttgaccagca

SEQ ID NO: 148821 - DNA, 16 bp, Homo sapiens
tccttgatctgtatat

SEQ ID NO: 148822 - DNA, 22 bp, Homo sapiens
tccttgcacccctcactctggc

SEQ ID NO: 148823 - DNA, 17 bp, Homo sapiens
tccttgcatcaattttt

SEQ ID NO: 148824 - DNA, 20 bp, Homo sapiens
tccttgggaggccccactgg

SEQ ID NO: 148825 - DNA, 13 bp, Homo sapiens
tccttgggccctt

SEQ ID NO: 148826 - DNA, 16 bp, Homo sapiens
tccttggggcaggcag

SEQ ID NO: 148827 - DNA, 18 bp, Homo sapiens
tcctttcacaaccttctg

SEQ ID NO: 148828 - DNA, 19 bp, Homo sapiens
tcctttcaccccagggcct

SEQ ID NO: 148829 - DNA, 13 bp, Homo sapiens
tcctttccccagc

SEQ ID NO: 148830 - DNA, 15 bp, Homo sapiens
tcctttccccagccc

SEQ ID NO: 148831 - DNA, 17 bp, Homo sapiens
tcctttccccagcccag

SEQ ID NO: 148832 - DNA, 20 bp, Homo sapiens
tcctttgaagaggaaaatga

SEQ ID NO: 148833 - DNA, 15 bp, Homo sapiens
tcgaattaatagctt

SEQ ID NO: 148834 - DNA, 16 bp, Homo sapiens
tcgaattaatagcttt

SEQ ID NO: 148835 - DNA, 14 bp, Homo sapiens
tcgaccccaaagcc

SEQ ID NO: 148836 - DNA, 22 bp, Homo sapiens
tcgagcagtcctgcctcagcct

SEQ ID NO: 148837 - DNA, 16 bp, Homo sapiens
tcgaggggctctcagc

SEQ ID NO: 148838 - DNA, 18 bp, Homo sapiens
tcgaggggctctcagctc

SEQ ID NO: 148839 - DNA, 20 bp, Homo sapiens
tcgaggggctctcagctcag

SEQ ID NO: 148840 - DNA, 23 bp, Homo sapiens
tcgaggtaggtggatcacctgag

SEQ ID NO: 148841 - DNA, 21 bp, Homo sapiens
tcgcctgacaaccactggtct

SEQ ID NO: 148842 - DNA, 22 bp, Homo sapiens
tcgcctgacaaccactggtctg

SEQ ID NO: 148843 - DNA, 23 bp, Homo sapiens
tcgcctttcccaggtgctacacc

SEQ ID NO: 148844 - DNA, 18 bp, Homo sapiens
tcgctcaatcaagaaaat

SEQ ID NO: 148845 - DNA, 19 bp, Homo sapiens
tcgctgccagctctgtatc

SEQ ID NO: 148846 - DNA, 15 bp, Homo sapiens
tcgcttcccccatag

SEQ ID NO: 148847 - DNA, 12 bp, Homo sapiens
tcggcccacagc

SEQ ID NO: 148848 - DNA, 19 bp, Homo sapiens
tcggcccacagctcccacc

SEQ ID NO: 148849 - DNA, 20 bp, Homo sapiens
tcgggacacctgccctgccc

SEQ ID NO: 148850 - DNA, 13 bp, Homo sapiens
tcgggcccttccc

SEQ ID NO: 148851 - DNA, 15 bp, Homo sapiens
tcggggaactcctgg

SEQ ID NO: 148852 - DNA, 19 bp, Homo sapiens
tcggggagaggctgaggac

SEQ ID NO: 148853 - DNA, 12 bp, Homo sapiens
tcgtagctttcc

SEQ ID NO: 148854 - DNA, 17 bp, Homo sapiens
tcgtcctccccctgcca

SEQ ID NO: 148855 - DNA, 18 bp, Homo sapiens
tcgtcctccccctgccag

SEQ ID NO: 148856 - DNA, 23 bp, Homo sapiens
tcgtgccgttactctccaacctg

SEQ ID NO: 148857 - DNA, 22 bp, Homo sapiens
tcgtggcagataatcagcctct

SEQ ID NO: 148858 - DNA, 17 bp, Homo sapiens
tctaaacattaatcaat

SEQ ID NO: 148859 - DNA, 17 bp, Homo sapiens
tctaaccacatcaatat

SEQ ID NO: 148860 - DNA, 20 bp, Homo sapiens
tctaacctcatcttcttcac

SEQ ID NO: 148861 - DNA, 15 bp, Homo sapiens
tctaacctgatggca

SEQ ID NO: 148862 - DNA, 14 bp, Homo sapiens
tctaacctgtgacc

SEQ ID NO: 148863 - DNA, 21 bp, Homo sapiens
tctaagattcatccatttatt

SEQ ID NO: 148864 - DNA, 14 bp, Homo sapiens
tctaaggttctcat

SEQ ID NO: 148865 - DNA, 18 bp, Homo sapiens
tctaaggttctcatagga

SEQ ID NO: 148866 - DNA, 22 bp, Homo sapiens
tctaagtaaaaccacagcagtt

SEQ ID NO: 148867 - DNA, 14 bp, Homo sapiens
tctaagtctttcca

SEQ ID NO: 148868 - DNA, 21 bp, Homo sapiens
tctaatagcgggttactttca

SEQ ID NO: 148869 - DNA, 18 bp, Homo sapiens
tctaatattaaaaatatg

SEQ ID NO: 148870 - DNA, 22 bp, Homo sapiens
tctaatttatcttgtctctggg

SEQ ID NO: 148871 - DNA, 18 bp, Homo sapiens
tctacagagcttccctga

SEQ ID NO: 148872 - DNA, 20 bp, Homo sapiens
tctacagctaatcagcattc

SEQ ID NO: 148873 - DNA, 22 bp, Homo sapiens
tctacataagtaattcaagaaa

SEQ ID NO: 148874 - DNA, 14 bp, Homo sapiens
tctactcagaaatt

SEQ ID NO: 148875 - DNA, 21 bp, Homo sapiens
tctactcagaaatttttattt

SEQ ID NO: 148876 - DNA, 19 bp, Homo sapiens
tctacttctgcccttgcca

SEQ ID NO: 148877 - DNA, 16 bp, Homo sapiens
tctactttaagcacta

SEQ ID NO: 148878 - DNA, 20 bp, Homo sapiens
tctactttgaagtcatacca

SEQ ID NO: 148879 - DNA, 20 bp, Homo sapiens
tctagaacatccctgccagc

SEQ ID NO: 148880 - DNA, 18 bp, Homo sapiens
tctagaacttgaccccct

SEQ ID NO: 148881 - DNA, 20 bp, Homo sapiens
tctagagccgtgatgcctcc

SEQ ID NO: 148882 - DNA, 23 bp, Homo sapiens
tctagattaccccctcattgttt

SEQ ID NO: 148883 - DNA, 19 bp, Homo sapiens
tctagctgttgagctgttt

SEQ ID NO: 148884 - DNA, 19 bp, Homo sapiens
tctagggaaaaaccagcgt

SEQ ID NO: 148885 - DNA, 23 bp, Homo sapiens
tctaggttctaaaaattgtgatc

SEQ ID NO: 148886 - DNA, 12 bp, Homo sapiens
tctagttttcag

SEQ ID NO: 148887 - DNA, 14 bp, Homo sapiens
tctagttttcagtt

SEQ ID NO: 148888 - DNA, 18 bp, Homo sapiens
tctagttttcagtttgta

SEQ ID NO: 148889 - DNA, 20 bp, Homo sapiens
tctagttttcagtttgtata

SEQ ID NO: 148890 - DNA, 23 bp, Homo sapiens
tctatgaactctgttttctttct

SEQ ID NO: 148891 - DNA, 17 bp, Homo sapiens
tctattaagatttccaa

SEQ ID NO: 148892 - DNA, 16 bp, Homo sapiens
tctattgtttattctt

SEQ ID NO: 148893 - DNA, 14 bp, Homo sapiens
tctatttctcctcc

SEQ ID NO: 148894 - DNA, 12 bp, Homo sapiens
tctatttctgag

SEQ ID NO: 148895 - DNA, 15 bp, Homo sapiens
tctatttctgagaag

SEQ ID NO: 148896 - DNA, 20 bp, Homo sapiens
tctatttctgagaaggtcct

SEQ ID NO: 148897 - DNA, 24 bp, Homo sapiens
tctattttgtaactttctctatga

SEQ ID NO: 148898 - DNA, 16 bp, Homo sapiens
tctcaaaaaaagaaaa

SEQ ID NO: 148899 - DNA, 22 bp, Homo sapiens
tctcacatggtgctacgcctgc

SEQ ID NO: 148900 - DNA, 23 bp, Homo sapiens
tctcacatggtgctacgcctgca

SEQ ID NO: 148901 - DNA, 19 bp, Homo sapiens
tctcaccccatcccacacc

SEQ ID NO: 148902 - DNA, 21 bp, Homo sapiens
tctcaccccatcccacaccct

SEQ ID NO: 148903 - DNA, 20 bp, Homo sapiens
tctcacgggcagtagctgtg

SEQ ID NO: 148904 - DNA, 23 bp, Homo sapiens
tctcacgggcatgggcactccct

SEQ ID NO: 148905 - DNA, 13 bp, Homo sapiens
tctcactaaactt

SEQ ID NO: 148906 - DNA, 16 bp, Homo sapiens
tctcactataccagta

SEQ ID NO: 148907 - DNA, 14 bp, Homo sapiens
tctgtccctcacag

SEQ ID NO: 148908 - DNA, 20 bp, Homo sapiens
tctgtcccttctgtccctca

SEQ ID NO: 148909 - DNA, 22 bp, Homo sapiens
tctgtcccttctgtccctcaca

SEQ ID NO: 148910 - DNA, 23 bp, Homo sapiens
tctgtcccttctgtccctcacag

SEQ ID NO: 148911 - DNA, 14 bp, Homo sapiens
tctgtctcagtcca

SEQ ID NO: 148912 - DNA, 15 bp, Homo sapiens
tctgtctcatatgat

SEQ ID NO: 148913 - DNA, 21 bp, Homo sapiens
tctgtctcatccatcatcatg

SEQ ID NO: 148914 - DNA, 16 bp, Homo sapiens
tctgtgaaagtacatt

SEQ ID NO: 148915 - DNA, 13 bp, Homo sapiens
tctgtgctcagga

SEQ ID NO: 148916 - DNA, 11 bp, Homo sapiens
tctgtgtcctt

SEQ ID NO: 148917 - DNA, 22 bp, Homo sapiens
tctgtgtgcaagtgtgtgcaca

SEQ ID NO: 148918 - DNA, 18 bp, Homo sapiens
tctgtgtgcaccttacca

SEQ ID NO: 148919 - DNA, 13 bp, Homo sapiens
tcttaaaaagtgg

SEQ ID NO: 148920 - DNA, 21 bp, Homo sapiens
tcttaaaataacttatatcat

SEQ ID NO: 148921 - DNA, 16 bp, Homo sapiens
tcttaaagctgcctgt

SEQ ID NO: 148922 - DNA, 19 bp, Homo sapiens
tcttaaagctgcctgtagt

SEQ ID NO: 148923 - DNA, 23 bp, Homo sapiens
tcttaaagctgcctgtagttagg

SEQ ID NO: 148924 - DNA, 22 bp, Homo sapiens
tcttaacgttagaccacaaata

SEQ ID NO: 148925 - DNA, 21 bp, Homo sapiens
tcttaattaaaagaatatttt

SEQ ID NO: 148926 - DNA, 22 bp, Homo sapiens
tcttactgcaaatgtcatcaga

SEQ ID NO: 148927 - DNA, 19 bp, Homo sapiens
tcttagaagtggaccagga

SEQ ID NO: 148928 - DNA, 21 bp, Homo sapiens
tcttagaagtggaccaggaca

SEQ ID NO: 148929 - DNA, 15 bp, Homo sapiens
tcttagacttctgct

SEQ ID NO: 148930 - DNA, 23 bp, Homo sapiens
tcttaggttggcaaaaaggcagg

SEQ ID NO: 148931 - DNA, 13 bp, Homo sapiens
tcttatagaaagt

SEQ ID NO: 148932 - DNA, 14 bp, Homo sapiens
tcttatttcatgaa

SEQ ID NO: 148933 - DNA, 16 bp, Homo sapiens
tcttatttcatttctt

SEQ ID NO: 148934 - DNA, 11 bp, Homo sapiens
tcttcagccta

SEQ ID NO: 148935 - DNA, 13 bp, Homo sapiens
tcttcagggcact

SEQ ID NO: 148936 - DNA, 23 bp, Homo sapiens
tcttcaggtggaaaaacatctga

SEQ ID NO: 148937 - DNA, 19 bp, Homo sapiens
tcttcagtgggagaaaaca

SEQ ID NO: 148938 - DNA, 13 bp, Homo sapiens
tcttcatactttt

SEQ ID NO: 148939 - DNA, 15 bp, Homo sapiens
tcttcatactttttt

SEQ ID NO: 148940 - DNA, 18 bp, Homo sapiens
tcttccaagcaaaggtga

SEQ ID NO: 148941 - DNA, 18 bp, Homo sapiens
tcttccaggtgcccagct

SEQ ID NO: 148942 - DNA, 19 bp, Homo sapiens
tcttccatatgacctcatg

SEQ ID NO: 148943 - DNA, 19 bp, Homo sapiens
tcttccatcatgtccccaa

SEQ ID NO: 148944 - DNA, 15 bp, Homo sapiens
tcttccatcccagga

SEQ ID NO: 148945 - DNA, 13 bp, Homo sapiens
tcttccatttgca

SEQ ID NO: 148946 - DNA, 16 bp, Homo sapiens
tcttcccatcactgga

SEQ ID NO: 148947 - DNA, 11 bp, Homo sapiens
tcttcctctgc

SEQ ID NO: 148948 - DNA, 13 bp, Homo sapiens
tcttcgaggtgga

SEQ ID NO: 148949 - DNA, 14 bp, Homo sapiens
tcttctcaggctct

SEQ ID NO: 148950 - DNA, 13 bp, Homo sapiens
tcttctccactgg

SEQ ID NO: 148951 - DNA, 14 bp, Homo sapiens
tcttctccccaggt

SEQ ID NO: 148952 - DNA, 22 bp, Homo sapiens
tcttctgggagggcagcagggc

SEQ ID NO: 148953 - DNA, 15 bp, Homo sapiens
tcttcttcaccattt

SEQ ID NO: 148954 - DNA, 16 bp, Homo sapiens
tcttctttttttgtga

SEQ ID NO: 148955 - DNA, 16 bp, Homo sapiens
tcttgactacagtcag

SEQ ID NO: 148956 - DNA, 14 bp, Homo sapiens
tcttgagcagtggc

SEQ ID NO: 148957 - DNA, 13 bp, Homo sapiens
tcttgcaggtctc

SEQ ID NO: 148958 - DNA, 18 bp, Homo sapiens
tcttggcagcacctgtct

SEQ ID NO: 148959 - DNA, 16 bp, Homo sapiens
tcttgggtaggcggga

SEQ ID NO: 148960 - DNA, 17 bp, Homo sapiens
tcttggtcagatttgaa

SEQ ID NO: 148961 - DNA, 12 bp, Homo sapiens
tcttgtctctgg

SEQ ID NO: 148962 - DNA, 15 bp, Homo sapiens
tcttgtctctgggct

SEQ ID NO: 148963 - DNA, 14 bp, Homo sapiens
tcttgttttcagtt

SEQ ID NO: 148964 - DNA, 18 bp, Homo sapiens
tcttgttttttttttcca

SEQ ID NO: 148965 - DNA, 17 bp, Homo sapiens
tctttaaaatacacact

SEQ ID NO: 148966 - DNA, 16 bp, Homo sapiens
tctttattgagaaaga

SEQ ID NO: 148967 - DNA, 19 bp, Homo sapiens
tctttattgagaaagagca

SEQ ID NO: 148968 - DNA, 21 bp, Homo sapiens
tctttcatccactagtgcaaa

SEQ ID NO: 148969 - DNA, 22 bp, Homo sapiens
tctttccacggagccactcctc

SEQ ID NO: 148970 - DNA, 20 bp, Homo sapiens
tctttccattggatctcatt

SEQ ID NO: 148971 - DNA, 19 bp, Homo sapiens
tctttctaatgtgtgaatc

SEQ ID NO: 148972 - DNA, 22 bp, Homo sapiens
tctttctagttcagctgcccca

SEQ ID NO: 148973 - DNA, 11 bp, Homo sapiens
tctttctctgc

SEQ ID NO: 148974 - DNA, 12 bp, Homo sapiens
tctttctctgcc

SEQ ID NO: 148975 - DNA, 13 bp, Homo sapiens
tctttctctgcca

SEQ ID NO: 148976 - DNA, 15 bp, Homo sapiens
tctttctctgccagt

SEQ ID NO: 148977 - DNA, 16 bp, Homo sapiens
tctttctctgccagtg

SEQ ID NO: 148978 - DNA, 14 bp, Homo sapiens
tctttcttcctctg

SEQ ID NO: 148979 - DNA, 15 bp, Homo sapiens
tctttgaatgacaaa

SEQ ID NO: 148980 - DNA, 17 bp, Homo sapiens
tctttggacactcacac

SEQ ID NO: 148981 - DNA, 18 bp, Homo sapiens
tctttgttggaaaagaat

SEQ ID NO: 148982 - DNA, 21 bp, Homo sapiens
tcttttaaaagacaagacttc

SEQ ID NO: 148983 - DNA, 19 bp, Homo sapiens
tcttttctggaatgtaatc

SEQ ID NO: 148984 - DNA, 22 bp, Homo sapiens
tcttttgtatgtaaatgtgcat

SEQ ID NO: 148985 - DNA, 15 bp, Homo sapiens
tctttttaataaaaa

SEQ ID NO: 148986 - DNA, 13 bp, Homo sapiens
tcttttttatgtg

SEQ ID NO: 148987 - DNA, 16 bp, Homo sapiens
tgaaaaaaaagtttca

SEQ ID NO: 148988 - DNA, 18 bp, Homo sapiens
tgaaaaaatgtatatgca

SEQ ID NO: 148989 - DNA, 12 bp, Homo sapiens
tgaaaaacttcc

SEQ ID NO: 148990 - DNA, 22 bp, Homo sapiens
tgaaaaagacctttggagcaaa

SEQ ID NO: 148991 - DNA, 15 bp, Homo sapiens
tgaaaacccagagag

SEQ ID NO: 148992 - DNA, 19 bp, Homo sapiens
tgaaaactttatgctaagt

SEQ ID NO: 148993 - DNA, 19 bp, Homo sapiens
tgaaaagaaaaatgagcct

SEQ ID NO: 148994 - DNA, 19 bp, Homo sapiens
tgaaaagactccaaagaaa

SEQ ID NO: 148995 - DNA, 14 bp, Homo sapiens
tgaaaagtcaaact

SEQ ID NO: 148996 - DNA, 17 bp, Homo sapiens
tgaaaatctaatattaa

SEQ ID NO: 148997 - DNA, 20 bp, Homo sapiens
tgaaaattaggatttcatga

SEQ ID NO: 148998 - DNA, 14 bp, Homo sapiens
tgaaacaaagctgc

SEQ ID NO: 148999 - DNA, 20 bp, Homo sapiens
tgaaacaggagagaaagggg

SEQ ID NO: 149000 - DNA, 20 bp, Homo sapiens
tgaaagaaaatatgcatcta

SEQ ID NO: 149001 - DNA, 18 bp, Homo sapiens
tgaaagaggaatgaagta

SEQ ID NO: 149002 - DNA, 22 bp, Homo sapiens
tgaaagatggctgtgcctctgc

SEQ ID NO: 149003 - DNA, 18 bp, Homo sapiens
tgaaagcagggacttgaa

SEQ ID NO: 149004 - DNA, 13 bp, Homo sapiens
tgaaagctagaga

SEQ ID NO: 149005 - DNA, 19 bp, Homo sapiens
tgaaaggttaccctgtaac

SEQ ID NO: 149006 - DNA, 17 bp, Homo sapiens
tgaaataagccagacat

SEQ ID NO: 149007 - DNA, 20 bp, Homo sapiens
tgaaataagccagacatcaa

SEQ ID NO: 149008 - DNA, 14 bp, Homo sapiens
tgaaataccagtgt

SEQ ID NO: 149009 - DNA, 12 bp, Homo sapiens
tgaaatatgcat

SEQ ID NO: 149010 - DNA, 19 bp, Homo sapiens
tgaaatctcagaattcctt

SEQ ID NO: 149011 - DNA, 17 bp, Homo sapiens
tgaaatgctctcctttc

SEQ ID NO: 149012 - DNA, 16 bp, Homo sapiens
tgaaatgctggcattt

SEQ ID NO: 149013 - DNA, 14 bp, Homo sapiens
tgaaattaacctct

SEQ ID NO: 149014 - DNA, 18 bp, Homo sapiens
tgaaattatgtatgttta

SEQ ID NO: 149015 - DNA, 19 bp, Homo sapiens
tgaaattatgtatgtttac

SEQ ID NO: 149016 - DNA, 23 bp, Homo sapiens
tgaaattatgtatgtttacatat

SEQ ID NO: 149017 - DNA, 20 bp, Homo sapiens
tgaaattttctagactttct

SEQ ID NO: 149018 - DNA, 20 bp, Homo sapiens
tgaaatttttattaaattat

SEQ ID NO: 149019 - DNA, 20 bp, Homo sapiens
tgaacaagttgtttcattga

SEQ ID NO: 149020 - DNA, 18 bp, Homo sapiens
tgaacactggcaacaaca

SEQ ID NO: 149021 - DNA, 16 bp, Homo sapiens
tgaacactgggggagg

SEQ ID NO: 149022 - DNA, 17 bp, Homo sapiens
tgaacactgggggaggg

SEQ ID NO: 149023 - DNA, 12 bp, Homo sapiens
tgaacagtggag

SEQ ID NO: 149024 - DNA, 13 bp, Homo sapiens
tgaacccaggagg

SEQ ID NO: 149025 - DNA, 18 bp, Homo sapiens
tgaacccgggaggcagag

SEQ ID NO: 149026 - DNA, 15 bp, Homo sapiens
tgaacggtgagcatt

SEQ ID NO: 149027 - DNA, 14 bp, Homo sapiens
tgaactcttaatca

SEQ ID NO: 149028 - DNA, 21 bp, Homo sapiens
tgaactcttaatcaaatagca

SEQ ID NO: 149029 - DNA, 15 bp, Homo sapiens
tgaactcttcaatct

SEQ ID NO: 149030 - DNA, 18 bp, Homo sapiens
tgaactcttcaatctctt

SEQ ID NO: 149031 - DNA, 19 bp, Homo sapiens
tgaactctttgaatgacaa

SEQ ID NO: 149032 - DNA, 20 bp, Homo sapiens
tgaactctttgaatgacaaa

SEQ ID NO: 149033 - DNA, 12 bp, Homo sapiens
tgaactgaagtt

SEQ ID NO: 149034 - DNA, 11 bp, Homo sapiens
tgaactttctc

SEQ ID NO: 149035 - DNA, 22 bp, Homo sapiens
tgaagaagctaaatcctttact

SEQ ID NO: 149036 - DNA, 14 bp, Homo sapiens
tgaagacaggatgg

SEQ ID NO: 149037 - DNA, 16 bp, Homo sapiens
tgaagagatccttctg

SEQ ID NO: 149038 - DNA, 22 bp, Homo sapiens
tgaagaggaaaatgaataatac

SEQ ID NO: 149039 - DNA, 23 bp, Homo sapiens
tgaagcagatgcaaagaggcaag

SEQ ID NO: 149040 - DNA, 12 bp, Homo sapiens
tgaagccagcct

SEQ ID NO: 149041 - DNA, 13 bp, Homo sapiens
tgaaggaatatat

SEQ ID NO: 149042 - DNA, 14 bp, Homo sapiens
tgaaggaatatatg

SEQ ID NO: 149043 - DNA, 15 bp, Homo sapiens
tgaaggaatatatgg

SEQ ID NO: 149044 - DNA, 20 bp, Homo sapiens
tgaaggaatatatggcagag

SEQ ID NO: 149045 - DNA, 23 bp, Homo sapiens
tgaaggaatatatggcagagttg

SEQ ID NO: 149046 - DNA, 20 bp, Homo sapiens
tgaaggagagcccttcattt

SEQ ID NO: 149047 - DNA, 22 bp, Homo sapiens
tgaaggagccccattcctggga

SEQ ID NO: 149048 - DNA, 15 bp, Homo sapiens
tgaaggcttctctct

SEQ ID NO: 149049 - DNA, 15 bp, Homo sapiens
tgaaggtgtcagaat

SEQ ID NO: 149050 - DNA, 22 bp, Homo sapiens
tgaaggtttacaatttacaaag

SEQ ID NO: 149051 - DNA, 17 bp, Homo sapiens
tgaagtactcatacatg

SEQ ID NO: 149052 - DNA, 14 bp, Homo sapiens
tgaagtcactgcac

SEQ ID NO: 149053 - DNA, 14 bp, Homo sapiens
tgaagtcagatgtg

SEQ ID NO: 149054 - DNA, 19 bp, Homo sapiens
tgaagtgtaggcagacaca

SEQ ID NO: 149055 - DNA, 16 bp, Homo sapiens
tgaagtgtgtttcctt

SEQ ID NO: 149056 - DNA, 22 bp, Homo sapiens
actgccgcaagtctgcagcccg

SEQ ID NO: 149057 - DNA, 14 bp, Homo sapiens
actgcctactgcat

SEQ ID NO: 149058 - DNA, 17 bp, Homo sapiens
actgcctctccctggcc

SEQ ID NO: 149059 - DNA, 19 bp, Homo sapiens
actgcctctccctggccct

SEQ ID NO: 149060 - DNA, 15 bp, Homo sapiens
actgcctcttcctcc

SEQ ID NO: 149061 - DNA, 16 bp, Homo sapiens
actgccttaaaacttt

SEQ ID NO: 149062 - DNA, 23 bp, Homo sapiens
actgctcatcattccttgagaaa

SEQ ID NO: 149063 - DNA, 19 bp, Homo sapiens
actgctccccagccctggc

SEQ ID NO: 149064 - DNA, 21 bp, Homo sapiens
actgctccccagccctggctc

SEQ ID NO: 149065 - DNA, 15 bp, Homo sapiens
actgctccctgaagc

SEQ ID NO: 149066 - DNA, 21 bp, Homo sapiens
actgctccctgaagccagcct

SEQ ID NO: 149067 - DNA, 21 bp, Homo sapiens
actgctgcccagcctccaagc

SEQ ID NO: 149068 - DNA, 15 bp, Homo sapiens
actgctggctgcctt

SEQ ID NO: 149069 - DNA, 19 bp, Homo sapiens
actggaagcatgtaggaga

SEQ ID NO: 149070 - DNA, 22 bp, Homo sapiens
actggaggggacgctggtagag

SEQ ID NO: 149071 - DNA, 12 bp, Homo sapiens
actggagtccag

SEQ ID NO: 149072 - DNA, 20 bp, Homo sapiens
actggcacagttttctgaga

SEQ ID NO: 149073 - DNA, 22 bp, Homo sapiens
actggcacagttttctgagaaa

SEQ ID NO: 149074 - DNA, 14 bp, Homo sapiens
actgggctgaggga

SEQ ID NO: 149075 - DNA, 18 bp, Homo sapiens
actggggatgtgggaggg

SEQ ID NO: 149076 - DNA, 13 bp, Homo sapiens
actgggggagggg

SEQ ID NO: 149077 - DNA, 13 bp, Homo sapiens
actggggggcttg

SEQ ID NO: 149078 - DNA, 16 bp, Homo sapiens
actgggttcccatgct

SEQ ID NO: 149079 - DNA, 12 bp, Homo sapiens
actggtggcccg

SEQ ID NO: 149080 - DNA, 23 bp, Homo sapiens
actggtggcccgacagcctggca

SEQ ID NO: 149081 - DNA, 20 bp, Homo sapiens
actggttgttgccaaacagc

SEQ ID NO: 149082 - DNA, 14 bp, Homo sapiens
actgtactcctccc

SEQ ID NO: 149083 - DNA, 22 bp, Homo sapiens
actgtagcctcgccgtctgtga

SEQ ID NO: 149084 - DNA, 21 bp, Homo sapiens
actgtattttgtattgtttca

SEQ ID NO: 149085 - DNA, 15 bp, Homo sapiens
actgtcaccctccac

SEQ ID NO: 149086 - DNA, 23 bp, Homo sapiens
actgtctcaagagggcactggtg

SEQ ID NO: 149087 - DNA, 22 bp, Homo sapiens
actgtctccatggccctgcaaa

SEQ ID NO: 149088 - DNA, 22 bp, Homo sapiens
actgtgaagtttacattgtaaa

SEQ ID NO: 149089 - DNA, 19 bp, Homo sapiens
actgtgcacatctgtgtct

SEQ ID NO: 149090 - DNA, 20 bp, Homo sapiens
actgtgcacatctgtgtctt

SEQ ID NO: 149091 - DNA, 18 bp, Homo sapiens
actgtgcaccaagcagga

SEQ ID NO: 149092 - DNA, 23 bp, Homo sapiens
actgtgcctttgagtttcctcag

SEQ ID NO: 149093 - DNA, 16 bp, Homo sapiens
actgttccccctgtgc

SEQ ID NO: 149094 - DNA, 14 bp, Homo sapiens
actgttgaaaatta

SEQ ID NO: 149095 - DNA, 14 bp, Homo sapiens
actgttgccagaga

SEQ ID NO: 149096 - DNA, 12 bp, Homo sapiens
actgtttctctg

SEQ ID NO: 149097 - DNA, 21 bp, Homo sapiens
actgtttgccttctactttta

SEQ ID NO: 149098 - DNA, 13 bp, Homo sapiens
acttaaaaaaatg

SEQ ID NO: 149099 - DNA, 17 bp, Homo sapiens
acttaaaaaaatgacag

SEQ ID NO: 149100 - DNA, 13 bp, Homo sapiens
acttaaaaatggt

SEQ ID NO: 149101 - DNA, 14 bp, Homo sapiens
acttaaaaatggtt

SEQ ID NO: 149102 - DNA, 20 bp, Homo sapiens
acttaaaatattcctgcatt

SEQ ID NO: 149103 - DNA, 22 bp, Homo sapiens
acttaaaatattcctgcatttg

SEQ ID NO: 149104 - DNA, 13 bp, Homo sapiens
acttaaaatattt

SEQ ID NO: 149105 - DNA, 14 bp, Homo sapiens
acttaagagaatat

SEQ ID NO: 149106 - DNA, 16 bp, Homo sapiens
acttagctatcagaag

SEQ ID NO: 149107 - DNA, 13 bp, Homo sapiens
acttcaaggccca

SEQ ID NO: 149108 - DNA, 22 bp, Homo sapiens
acttcaagtgcatgctctctgc

SEQ ID NO: 149109 - DNA, 15 bp, Homo sapiens
acttcacactgcaag

SEQ ID NO: 149110 - DNA, 21 bp, Homo sapiens
acttcagacatagaattaaca

SEQ ID NO: 149111 - DNA, 16 bp, Homo sapiens
acttcagctgactttt

SEQ ID NO: 149112 - DNA, 19 bp, Homo sapiens
acttccaaatcccctaagc

SEQ ID NO: 149113 - DNA, 17 bp, Homo sapiens
acttcccagtgaattct

SEQ ID NO: 149114 - DNA, 13 bp, Homo sapiens
acttctaagtaaa

SEQ ID NO: 149115 - DNA, 11 bp, Homo sapiens
acttctaatat

SEQ ID NO: 149116 - DNA, 15 bp, Homo sapiens
acttctaatatattt

SEQ ID NO: 149117 - DNA, 16 bp, Homo sapiens
acttctccaggtctca

SEQ ID NO: 149118 - DNA, 22 bp, Homo sapiens
acttctgctttccacacctggc

SEQ ID NO: 149119 - DNA, 21 bp, Homo sapiens
acttctgtcttcacaacagat

SEQ ID NO: 149120 - DNA, 16 bp, Homo sapiens
acttcttaaaagttgt

SEQ ID NO: 149121 - DNA, 21 bp, Homo sapiens
acttgaacccgggaggcagag

SEQ ID NO: 149122 - DNA, 11 bp, Homo sapiens
acttgaagttg

SEQ ID NO: 149123 - DNA, 22 bp, Homo sapiens
acttgaagttgttactaactaa

SEQ ID NO: 149124 - DNA, 18 bp, Homo sapiens
acttgagggcccagagca

SEQ ID NO: 149125 - DNA, 21 bp, Homo sapiens
acttgagggcccagagcagga

SEQ ID NO: 149126 - DNA, 17 bp, Homo sapiens
acttgctgcctgaagaa

SEQ ID NO: 149127 - DNA, 23 bp, Homo sapiens
acttgctgcctgaagaacagtaa

SEQ ID NO: 149128 - DNA, 11 bp, Homo sapiens
acttggagcca

SEQ ID NO: 149129 - DNA, 19 bp, Homo sapiens
acttggagccccagtgcca

SEQ ID NO: 149130 - DNA, 20 bp, Homo sapiens
acttgggagacctgtaatca

SEQ ID NO: 149131 - DNA, 22 bp, Homo sapiens
acttgggaggctgagatgggag

SEQ ID NO: 149132 - DNA, 22 bp, Homo sapiens
acttggtgtcctttccctccac

SEQ ID NO: 149133 - DNA, 16 bp, Homo sapiens
acttggtttttaaaaa

SEQ ID NO: 149134 - DNA, 20 bp, Homo sapiens
acttgtaaatgtggtaaaga

SEQ ID NO: 149135 - DNA, 20 bp, Homo sapiens
acttgtatattttaagaaat

SEQ ID NO: 149136 - DNA, 14 bp, Homo sapiens
acttgtatgaaaga

SEQ ID NO: 149137 - DNA, 13 bp, Homo sapiens
acttgtttccaat

SEQ ID NO: 149138 - DNA, 17 bp, Homo sapiens
acttgttttatgctcag

SEQ ID NO: 149139 - DNA, 23 bp, Homo sapiens
actttaattctcatgtgatcctt

SEQ ID NO: 149140 - DNA, 18 bp, Homo sapiens
actttacatgacacagct

SEQ ID NO: 149141 - DNA, 20 bp, Homo sapiens
actttacatgacacagcttt

SEQ ID NO: 149142 - DNA, 12 bp, Homo sapiens
actttatgctaa

SEQ ID NO: 149143 - DNA, 17 bp, Homo sapiens
actttatgctaagtgaa

SEQ ID NO: 149144 - DNA, 17 bp, Homo sapiens
actttcctttccccagc

SEQ ID NO: 149145 - DNA, 15 bp, Homo sapiens
actttcttttctgga

SEQ ID NO: 149146 - DNA, 17 bp, Homo sapiens
actttgcactgatatat

SEQ ID NO: 149147 - DNA, 17 bp, Homo sapiens
actttgctctttcttga

SEQ ID NO: 149148 - DNA, 12 bp, Homo sapiens
actttgggaggc

SEQ ID NO: 149149 - DNA, 14 bp, Homo sapiens
actttgggaggcca

SEQ ID NO: 149150 - DNA, 16 bp, Homo sapiens
actttgggaggccaag

SEQ ID NO: 149151 - DNA, 14 bp, Homo sapiens
acttttaaggcagt

SEQ ID NO: 149152 - DNA, 12 bp, Homo sapiens
acttttcagtga

SEQ ID NO: 149153 - DNA, 15 bp, Homo sapiens
acttttgccctttga

SEQ ID NO: 149154 - DNA, 21 bp, Homo sapiens
acttttttgaaataataaatc

SEQ ID NO: 149155 - DNA, 18 bp, Homo sapiens
agaaaaaataacacacat

SEQ ID NO: 149156 - DNA, 17 bp, Homo sapiens
agaaaaaatattttcct

SEQ ID NO: 149157 - DNA, 18 bp, Homo sapiens
agaaaaatgagcctggca

SEQ ID NO: 149158 - DNA, 19 bp, Homo sapiens
agaaaatattttgtctaaa

SEQ ID NO: 149159 - DNA, 21 bp, Homo sapiens
agaaaatattttgtctaaaat

SEQ ID NO: 149160 - DNA, 16 bp, Homo sapiens
agaaaatcaggctggc

SEQ ID NO: 149161 - DNA, 19 bp, Homo sapiens
agaaaatcatattgcttct

SEQ ID NO: 149162 - DNA, 18 bp, Homo sapiens
agaaacaacaatttctac

SEQ ID NO: 149163 - DNA, 14 bp, Homo sapiens
agaaacaataaaga

SEQ ID NO: 149164 - DNA, 16 bp, Homo sapiens
agaaacaataaagaga

SEQ ID NO: 149165 - DNA, 20 bp, Homo sapiens
agaaacacactgaggcaggg

SEQ ID NO: 149166 - DNA, 16 bp, Homo sapiens
agaaacataaataaaa

SEQ ID NO: 149167 - DNA, 22 bp, Homo sapiens
agaaacataaataaaatgacca

SEQ ID NO: 149168 - DNA, 15 bp, Homo sapiens
ctgtagaagagggat

SEQ ID NO: 149169 - DNA, 15 bp, Homo sapiens
ctgtagagtgggagc

SEQ ID NO: 149170 - DNA, 20 bp, Homo sapiens
ctgtagcagtgagaaaaagc

SEQ ID NO: 149171 - DNA, 18 bp, Homo sapiens
ctgtagcattacagtggg

SEQ ID NO: 149172 - DNA, 16 bp, Homo sapiens
ctgtagcccactctgc

SEQ ID NO: 149173 - DNA, 20 bp, Homo sapiens
ctgtagcccactctgctcgc

SEQ ID NO: 149174 - DNA, 21 bp, Homo sapiens
ctgtagcccactctgctcgcc

SEQ ID NO: 149175 - DNA, 24 bp, Homo sapiens
ctgtagggtaattagtaacatgtg

SEQ ID NO: 149176 - DNA, 19 bp, Homo sapiens
ctgtagtagccctttctgt

SEQ ID NO: 149177 - DNA, 14 bp, Homo sapiens
ctgtagtcccagct

SEQ ID NO: 149178 - DNA, 13 bp, Homo sapiens
ctgtagttaggaa

SEQ ID NO: 149179 - DNA, 14 bp, Homo sapiens
ctgtagttaggaaa

SEQ ID NO: 149180 - DNA, 17 bp, Homo sapiens
ctgtagttaggaaataa

SEQ ID NO: 149181 - DNA, 12 bp, Homo sapiens
ctgtataagtaa

SEQ ID NO: 149182 - DNA, 15 bp, Homo sapiens
ctgtattaagccact

SEQ ID NO: 149183 - DNA, 14 bp, Homo sapiens
ctgtcaaacaaagc

SEQ ID NO: 149184 - DNA, 19 bp, Homo sapiens
ctgtcaaacaaagccagaa

SEQ ID NO: 149185 - DNA, 20 bp, Homo sapiens
ctgtcactgtttctctgctg

SEQ ID NO: 149186 - DNA, 17 bp, Homo sapiens
ctgtcagcgcaggttta

SEQ ID NO: 149187 - DNA, 16 bp, Homo sapiens
ctgtcattcagaaaaa

SEQ ID NO: 149188 - DNA, 20 bp, Homo sapiens
ctgtccaacctaaccccttt

SEQ ID NO: 149189 - DNA, 23 bp, Homo sapiens
ctgtccaacctaacccctttcct

SEQ ID NO: 149190 - DNA, 17 bp, Homo sapiens
ctgtccaggcactgctg

SEQ ID NO: 149191 - DNA, 18 bp, Homo sapiens
ctgtccaggcactgctgc

SEQ ID NO: 149192 - DNA, 21 bp, Homo sapiens
ctgtccaggcactgctgccca

SEQ ID NO: 149193 - DNA, 20 bp, Homo sapiens
ctgtccagggccctgagctc

SEQ ID NO: 149194 - DNA, 22 bp, Homo sapiens
ctgtccagggccctgagctcgg

SEQ ID NO: 149195 - DNA, 22 bp, Homo sapiens
ctgtcccagtgccgagaaggaa

SEQ ID NO: 149196 - DNA, 17 bp, Homo sapiens
ctgtcccatggacactc

SEQ ID NO: 149197 - DNA, 16 bp, Homo sapiens
ctgtccctcacagcac

SEQ ID NO: 149198 - DNA, 12 bp, Homo sapiens
ctgtccctcact

SEQ ID NO: 149199 - DNA, 21 bp, Homo sapiens
ctgtccctccgggacctggtg

SEQ ID NO: 149200 - DNA, 12 bp, Homo sapiens
ctgtccctgtca

SEQ ID NO: 149201 - DNA, 15 bp, Homo sapiens
ctgtccctgtcacca

SEQ ID NO: 149202 - DNA, 16 bp, Homo sapiens
ctgtcccttctcttaa

SEQ ID NO: 149203 - DNA, 17 bp, Homo sapiens
ctgtcccttctgtccct

SEQ ID NO: 149204 - DNA, 19 bp, Homo sapiens
ctgtcccttctgtccctca

SEQ ID NO: 149205 - DNA, 19 bp, Homo sapiens
ctgtcctcactgctccctg

SEQ ID NO: 149206 - DNA, 18 bp, Homo sapiens
ctgtcctcccatcccctg

SEQ ID NO: 149207 - DNA, 17 bp, Homo sapiens
ctgtccttacccatctg

SEQ ID NO: 149208 - DNA, 19 bp, Homo sapiens
ctgtccttacccatctgca

SEQ ID NO: 149209 - DNA, 20 bp, Homo sapiens
ctgtccttctctcacctcct

SEQ ID NO: 149210 - DNA, 16 bp, Homo sapiens
ctgtccttgcacactc

SEQ ID NO: 149211 - DNA, 19 bp, Homo sapiens
ctgtctcaagagggcactg

SEQ ID NO: 149212 - DNA, 21 bp, Homo sapiens
ctgtctcaagagggcactggt

SEQ ID NO: 149213 - DNA, 12 bp, Homo sapiens
ctgtctcagcct

SEQ ID NO: 149214 - DNA, 20 bp, Homo sapiens
ctgtctccatggccctgcaa

SEQ ID NO: 149215 - DNA, 22 bp, Homo sapiens
ctgtctcctttcaccccagggc

SEQ ID NO: 149216 - DNA, 21 bp, Homo sapiens
ctgtctgccagccagcagcca

SEQ ID NO: 149217 - DNA, 19 bp, Homo sapiens
ctgtcttcatagcagattt

SEQ ID NO: 149218 - DNA, 18 bp, Homo sapiens
ctgtgaaagtacatttgg

SEQ ID NO: 149219 - DNA, 18 bp, Homo sapiens
ctgtgaacgatttagaaa

SEQ ID NO: 149220 - DNA, 22 bp, Homo sapiens
ctgtgaacgatttagaaagaag

SEQ ID NO: 149221 - DNA, 14 bp, Homo sapiens
ctgtgaattcagat

SEQ ID NO: 149222 - DNA, 15 bp, Homo sapiens
ctgtgaattcagatt

SEQ ID NO: 149223 - DNA, 23 bp, Homo sapiens
ctgtgaccagtctgacccttaca

SEQ ID NO: 149224 - DNA, 17 bp, Homo sapiens
ctgtgacttcagctctg

SEQ ID NO: 149225 - DNA, 21 bp, Homo sapiens
ctgtgacttctccaggtctca

SEQ ID NO: 149226 - DNA, 13 bp, Homo sapiens
ctgtgagcccctg

SEQ ID NO: 149227 - DNA, 14 bp, Homo sapiens
ctgtgagcccctgg

SEQ ID NO: 149228 - DNA, 17 bp, Homo sapiens
ctgtgaggcccctggac

SEQ ID NO: 149229 - DNA, 15 bp, Homo sapiens
ctgtgaggctgtcct

SEQ ID NO: 149230 - DNA, 17 bp, Homo sapiens
ctgtgaggctgtcctgt

SEQ ID NO: 149231 - DNA, 22 bp, Homo sapiens
ctgtgaggtgcagagtgcccag

SEQ ID NO: 149232 - DNA, 18 bp, Homo sapiens
ctgtgcacatctgtgtct

SEQ ID NO: 149233 - DNA, 20 bp, Homo sapiens
ctgtgcacatctgtgtcttg

SEQ ID NO: 149234 - DNA, 17 bp, Homo sapiens
ctgtgcagccgctgagc

SEQ ID NO: 149235 - DNA, 19 bp, Homo sapiens
ctgtgcagccgctgagcga

SEQ ID NO: 149236 - DNA, 17 bp, Homo sapiens
ctgtgcccagagatggg

SEQ ID NO: 149237 - DNA, 13 bp, Homo sapiens
ctgtgcctctgcc

SEQ ID NO: 149238 - DNA, 16 bp, Homo sapiens
ctgtgcctctgcctgt

SEQ ID NO: 149239 - DNA, 17 bp, Homo sapiens
ctgtgcctctgcctgtc

SEQ ID NO: 149240 - DNA, 15 bp, Homo sapiens
ctgtgctcaggactc

SEQ ID NO: 149241 - DNA, 23 bp, Homo sapiens
ctgtgctcaggactcagaagcct

SEQ ID NO: 149242 - DNA, 17 bp, Homo sapiens
ctgtgcttcaattaata

SEQ ID NO: 149243 - DNA, 20 bp, Homo sapiens
ctgtgcttcgggcccttccc

SEQ ID NO: 149244 - DNA, 22 bp, Homo sapiens
ctgtggccagcttgttatttat

SEQ ID NO: 149245 - DNA, 20 bp, Homo sapiens
ctgtgggcaggtgggagctt

SEQ ID NO: 149246 - DNA, 17 bp, Homo sapiens
ctgtgtcagcatagaag

SEQ ID NO: 149247 - DNA, 19 bp, Homo sapiens
ctgtgtcagcatagaagta

SEQ ID NO: 149248 - DNA, 16 bp, Homo sapiens
ctgtgtccttgcacct

SEQ ID NO: 149249 - DNA, 22 bp, Homo sapiens
ctgtgtccttgcacctgcatcc

SEQ ID NO: 149250 - DNA, 12 bp, Homo sapiens
ctgtgtctaaac

SEQ ID NO: 149251 - DNA, 13 bp, Homo sapiens
ctgtgtctaaact

SEQ ID NO: 149252 - DNA, 14 bp, Homo sapiens
ctgtgtctaaactg

SEQ ID NO: 149253 - DNA, 16 bp, Homo sapiens
ctgtgtctaaactgca

SEQ ID NO: 149254 - DNA, 12 bp, Homo sapiens
ctgtgtgaaata

SEQ ID NO: 149255 - DNA, 15 bp, Homo sapiens
ctgtgtgatgaactt

SEQ ID NO: 149256 - DNA, 18 bp, Homo sapiens
ctgtgtgatgaactttct

SEQ ID NO: 149257 - DNA, 15 bp, Homo sapiens
ctgttaaaagatgaa

SEQ ID NO: 149258 - DNA, 19 bp, Homo sapiens
ctgttaaattgctgtgtat

SEQ ID NO: 149259 - DNA, 17 bp, Homo sapiens
ctgttactgtcttcagt

SEQ ID NO: 149260 - DNA, 22 bp, Homo sapiens
ctgttcacagccagactggcac

SEQ ID NO: 149261 - DNA, 14 bp, Homo sapiens
ctgttcacccacag

SEQ ID NO: 149262 - DNA, 21 bp, Homo sapiens
ctgttcagctggttgaggttt

SEQ ID NO: 149263 - DNA, 15 bp, Homo sapiens
ctgttgagctgtttt

SEQ ID NO: 149264 - DNA, 17 bp, Homo sapiens
ctgttgccagagatgga

SEQ ID NO: 149265 - DNA, 12 bp, Homo sapiens
ctgttgcctcat

SEQ ID NO: 149266 - DNA, 14 bp, Homo sapiens
ctgttgcctcatct

SEQ ID NO: 149267 - DNA, 22 bp, Homo sapiens
ctgttgtgtacgtggagaggga

SEQ ID NO: 149268 - DNA, 16 bp, Homo sapiens
ctgttgttttgtttta

SEQ ID NO: 149269 - DNA, 17 bp, Homo sapiens
ctgtttcaacacagacc

SEQ ID NO: 149270 - DNA, 14 bp, Homo sapiens
ctgtttctctgctg

SEQ ID NO: 149271 - DNA, 14 bp, Homo sapiens
ctgttttctcttga

SEQ ID NO: 149272 - DNA, 16 bp, Homo sapiens
ctgtttttaagctgtt

SEQ ID NO: 149273 - DNA, 18 bp, Homo sapiens
ctgtttttaagctgtttc

SEQ ID NO: 149274 - DNA, 23 bp, Homo sapiens
ctgtttttaagctgtttccatag

SEQ ID NO: 149275 - DNA, 13 bp, Homo sapiens
cttaaaaatggtt

SEQ ID NO: 149276 - DNA, 21 bp, Homo sapiens
cttaaaaatggtttaaatggt

SEQ ID NO: 149277 - DNA, 13 bp, Homo sapiens
cttaaaatatttt

SEQ ID NO: 149278 - DNA, 14 bp, Homo sapiens
cttaaaatatttta

SEQ ID NO: 149279 - DNA, 24 bp, Homo sapiens
cttaaaatgttcacttttgacaaa

SEQ ID NO: 149280 - DNA, 12 bp, Homo sapiens
cttaaagaaagt

SEQ ID NO: 149281 - DNA, 21 bp, Homo sapiens
cttaaagaaagtcgaattaat

SEQ ID NO: 149282 - DNA, 22 bp, Homo sapiens
cttaaagaaagtcgaattaata

SEQ ID NO: 149283 - DNA, 16 bp, Homo sapiens
cttaaattttaattta

SEQ ID NO: 149284 - DNA, 17 bp, Homo sapiens
cttaaattttaatttat

SEQ ID NO: 149285 - DNA, 11 bp, Homo sapiens
cttaactattc

SEQ ID NO: 149286 - DNA, 18 bp, Homo sapiens
cttaagagaatattttaa

SEQ ID NO: 149287 - DNA, 20 bp, Homo sapiens
cttaaggacaaaaatgaact

SEQ ID NO: 149288 - DNA, 16 bp, Homo sapiens
cttaatgtttattcct

SEQ ID NO: 149289 - DNA, 17 bp, Homo sapiens
cttaattaaaagaatat

SEQ ID NO: 149290 - DNA, 20 bp, Homo sapiens
cttaattaaaagaatatttt

SEQ ID NO: 149291 - DNA, 20 bp, Homo sapiens
cttacaattccctgctgtcg

SEQ ID NO: 149292 - DNA, 15 bp, Homo sapiens
cttacagcctctgac

SEQ ID NO: 149293 - DNA, 21 bp, Homo sapiens
cttacattagcagtttgcttt

SEQ ID NO: 149294 - DNA, 14 bp, Homo sapiens
cttaccatgtgcct

SEQ ID NO: 149295 - DNA, 23 bp, Homo sapiens
cttacccatctgcacccccctgg

SEQ ID NO: 149296 - DNA, 15 bp, Homo sapiens
cttacctcctgccca

SEQ ID NO: 149297 - DNA, 16 bp, Homo sapiens
cttacctcctgcccag

SEQ ID NO: 149298 - DNA, 18 bp, Homo sapiens
cttacctcctgcccagga

SEQ ID NO: 149299 - DNA, 13 bp, Homo sapiens
cttacctcggtgc

SEQ ID NO: 149300 - DNA, 19 bp, Homo sapiens
cttacctcggtgccttcct

SEQ ID NO: 149301 - DNA, 19 bp, Homo sapiens
cttacctgggcattcttgt

SEQ ID NO: 149302 - DNA, 20 bp, Homo sapiens
cttactacatgtgggagctt

SEQ ID NO: 149303 - DNA, 17 bp, Homo sapiens
cttagaaagcaggggct

SEQ ID NO: 149304 - DNA, 16 bp, Homo sapiens
cttagacctcagcctg

SEQ ID NO: 149305 - DNA, 18 bp, Homo sapiens
cttagcttagacctcagc

SEQ ID NO: 149306 - DNA, 22 bp, Homo sapiens
cttagcttagacctcagcctgt

SEQ ID NO: 149307 - DNA, 14 bp, Homo sapiens
cttaggcagggaag

SEQ ID NO: 149308 - DNA, 21 bp, Homo sapiens
cttaggtggcaagctgtgact

SEQ ID NO: 149309 - DNA, 21 bp, Homo sapiens
cttaggttggcaaaaaggcag

SEQ ID NO: 149310 - DNA, 23 bp, Homo sapiens
cttaggttggcaaaaaggcagga

SEQ ID NO: 149311 - DNA, 16 bp, Homo sapiens
cttatctgtgctcagg

SEQ ID NO: 149312 - DNA, 22 bp, Homo sapiens
cttatctgtgctcaggactcag

SEQ ID NO: 149313 - DNA, 17 bp, Homo sapiens
cttattagaacaggcaa

SEQ ID NO: 149314 - DNA, 17 bp, Homo sapiens
cttattagagtgtcttt

SEQ ID NO: 149315 - DNA, 14 bp, Homo sapiens
aaagactaatttaa

SEQ ID NO: 149316 - DNA, 15 bp, Homo sapiens
aaagactattcaaac

SEQ ID NO: 149317 - DNA, 23 bp, Homo sapiens
aaagactattcaaacagtctcag

SEQ ID NO: 149318 - DNA, 15 bp, Homo sapiens
aaagactcagtgttc

SEQ ID NO: 149319 - DNA, 13 bp, Homo sapiens
aaagactccaaag

SEQ ID NO: 149320 - DNA, 15 bp, Homo sapiens
aaagagcaagtctgg

SEQ ID NO: 149321 - DNA, 21 bp, Homo sapiens
aaagagcacttaagagaatat

SEQ ID NO: 149322 - DNA, 22 bp, Homo sapiens
aaagagctttcttcccgaaccc

SEQ ID NO: 149323 - DNA, 12 bp, Homo sapiens
aaagaggctgag

SEQ ID NO: 149324 - DNA, 21 bp, Homo sapiens
aaagaggctgaggcctggact

SEQ ID NO: 149325 - DNA, 13 bp, Homo sapiens
aaagataaagatg

SEQ ID NO: 149326 - DNA, 21 bp, Homo sapiens
aaagatatattaaaaatataa

SEQ ID NO: 149327 - DNA, 16 bp, Homo sapiens
aaagatgaaaatattt

SEQ ID NO: 149328 - DNA, 14 bp, Homo sapiens
aaagatgcttctca

SEQ ID NO: 149329 - DNA, 21 bp, Homo sapiens
aaagatggctgtgcctctgcc

SEQ ID NO: 149330 - DNA, 20 bp, Homo sapiens
aaagatgtttgtcagatatg

SEQ ID NO: 149331 - DNA, 21 bp, Homo sapiens
aaagatgtttgtcagatatga

SEQ ID NO: 149332 - DNA, 12 bp, Homo sapiens
aaagcacctgcc

SEQ ID NO: 149333 - DNA, 19 bp, Homo sapiens
aaagcacgaaatgttattt

SEQ ID NO: 149334 - DNA, 21 bp, Homo sapiens
aaagcactgacttctaagtaa

SEQ ID NO: 149335 - DNA, 19 bp, Homo sapiens
aaagcagctcaaaggcaca

SEQ ID NO: 149336 - DNA, 22 bp, Homo sapiens
aaagcaggggctacaagaggga

SEQ ID NO: 149337 - DNA, 23 bp, Homo sapiens
aaagcccttccatgtcgcctctg

SEQ ID NO: 149338 - DNA, 13 bp, Homo sapiens
aaagcctgcaatt

SEQ ID NO: 149339 - DNA, 18 bp, Homo sapiens
aaagcctgcaatttcata

SEQ ID NO: 149340 - DNA, 17 bp, Homo sapiens
aaagctaaaatgatttt

SEQ ID NO: 149341 - DNA, 23 bp, Homo sapiens
aaagctaaaatgattttatctgt

SEQ ID NO: 149342 - DNA, 12 bp, Homo sapiens
aaagctgaaaac

SEQ ID NO: 149343 - DNA, 21 bp, Homo sapiens
aaagctgcctgtagttaggaa

SEQ ID NO: 149344 - DNA, 14 bp, Homo sapiens
aaagctttcctgcc

SEQ ID NO: 149345 - DNA, 22 bp, Homo sapiens
aaagctttcctgccccaggcct

SEQ ID NO: 149346 - DNA, 23 bp, Homo sapiens
aaaggagcccttatctgtgctca

SEQ ID NO: 149347 - DNA, 16 bp, Homo sapiens
aaaggatactgtaaca

SEQ ID NO: 149348 - DNA, 18 bp, Homo sapiens
aaaggatactgtaacact

SEQ ID NO: 149349 - DNA, 12 bp, Homo sapiens
aaaggatatttt

SEQ ID NO: 149350 - DNA, 19 bp, Homo sapiens
aaaggatgtgatatataag

SEQ ID NO: 149351 - DNA, 19 bp, Homo sapiens
aaaggcagaagcaacccaa

SEQ ID NO: 149352 - DNA, 19 bp, Homo sapiens
aaaggctcgattttgtatc

SEQ ID NO: 149353 - DNA, 18 bp, Homo sapiens
aaaggggtcccatagagg

SEQ ID NO: 149354 - DNA, 18 bp, Homo sapiens
aagacttggcaacagaag

SEQ ID NO: 149355 - DNA, 20 bp, Homo sapiens
aagacttggcaacagaagca

SEQ ID NO: 149356 - DNA, 12 bp, Homo sapiens
aagagaatattt

SEQ ID NO: 149357 - DNA, 18 bp, Homo sapiens
aagagaggagaggagaga

SEQ ID NO: 149358 - DNA, 19 bp, Homo sapiens
aagagaggagaggagagag

SEQ ID NO: 149359 - DNA, 15 bp, Homo sapiens
aagagatttttcatg

SEQ ID NO: 149360 - DNA, 17 bp, Homo sapiens
aagagatttttcatgat

SEQ ID NO: 149361 - DNA, 17 bp, Homo sapiens
aagagcacttaagagaa

SEQ ID NO: 149362 - DNA, 21 bp, Homo sapiens
aagagcacttaagagaatatt

SEQ ID NO: 149363 - DNA, 20 bp, Homo sapiens
aagagcctgcaggtgctgct

SEQ ID NO: 149364 - DNA, 21 bp, Homo sapiens
aagagccttggtgtccacctg

SEQ ID NO: 149365 - DNA, 22 bp, Homo sapiens
aagagccttggtgtccacctgg

SEQ ID NO: 149366 - DNA, 16 bp, Homo sapiens
aagagctagcgctgcc

SEQ ID NO: 149367 - DNA, 19 bp, Homo sapiens
aagagctagcgctgccgca

SEQ ID NO: 149368 - DNA, 23 bp, Homo sapiens
aagaggccctgtctgtacctaac

SEQ ID NO: 149369 - DNA, 15 bp, Homo sapiens
aagaggctgaggcct

SEQ ID NO: 149370 - DNA, 18 bp, Homo sapiens
aagagggagatggagact

SEQ ID NO: 149371 - DNA, 16 bp, Homo sapiens
aagagtagtaatagag

SEQ ID NO: 149372 - DNA, 19 bp, Homo sapiens
aagagtagttgatgttgca

SEQ ID NO: 149373 - DNA, 23 bp, Homo sapiens
aagagtagttgatgttgcatttt

SEQ ID NO: 149374 - DNA, 22 bp, Homo sapiens
aagatacagaactctttcaaaa

SEQ ID NO: 149375 - DNA, 14 bp, Homo sapiens
aagatatattaaaa

SEQ ID NO: 149376 - DNA, 20 bp, Homo sapiens
aagatatattaaaaatataa

SEQ ID NO: 149377 - DNA, 16 bp, Homo sapiens
aagatcatgtacccca

SEQ ID NO: 149378 - DNA, 13 bp, Homo sapiens
aagatgaaaatat

SEQ ID NO: 149379 - DNA, 17 bp, Homo sapiens
aagatgcttctcactgc

SEQ ID NO: 149380 - DNA, 15 bp, Homo sapiens
aagatggatgtgctt

SEQ ID NO: 149381 - DNA, 19 bp, Homo sapiens
aagatgtagaggagaaact

SEQ ID NO: 149382 - DNA, 16 bp, Homo sapiens
aagatgtttgtcagat

SEQ ID NO: 149383 - DNA, 18 bp, Homo sapiens
aagattagaatgaaaatt

SEQ ID NO: 149384 - DNA, 20 bp, Homo sapiens
aagattcatatttacttctt

SEQ ID NO: 149385 - DNA, 12 bp, Homo sapiens
aagattcccaga

SEQ ID NO: 149386 - DNA, 19 bp, Homo sapiens
aagattcccagagacagga

SEQ ID NO: 149387 - DNA, 20 bp, Homo sapiens
aagattcccagagacaggaa

SEQ ID NO: 149388 - DNA, 17 bp, Homo sapiens
aagattctcctgtgcta

SEQ ID NO: 149389 - DNA, 16 bp, Homo sapiens
aagattgcttaaaata

SEQ ID NO: 149390 - DNA, 23 bp, Homo sapiens
aagattttggagggtcctccaca

SEQ ID NO: 149391 - DNA, 23 bp, Homo sapiens
aagcaaaatcattttatatgtca

SEQ ID NO: 149392 - DNA, 19 bp, Homo sapiens
aagcacagaaggaggagga

SEQ ID NO: 149393 - DNA, 16 bp, Homo sapiens
aagcacatctgcattt

SEQ ID NO: 149394 - DNA, 16 bp, Homo sapiens
aagcactgacttctaa

SEQ ID NO: 149395 - DNA, 12 bp, Homo sapiens
aagcagaaatac

SEQ ID NO: 149396 - DNA, 21 bp, Homo sapiens
aagcagaccactgataaaacc

SEQ ID NO: 149397 - DNA, 23 bp, Homo sapiens
aagcagatgcaaagaggcaagag

SEQ ID NO: 149398 - DNA, 17 bp, Homo sapiens
aagcagatggaatgctg

SEQ ID NO: 149399 - DNA, 21 bp, Homo sapiens
aagcagccaagctccttggga

SEQ ID NO: 149400 - DNA, 18 bp, Homo sapiens
aagcagctcaaaggcaca

SEQ ID NO: 149401 - DNA, 13 bp, Homo sapiens
aagcaggaagctc

SEQ ID NO: 149402 - DNA, 16 bp, Homo sapiens
aagcaggaagctcaga

SEQ ID NO: 149403 - DNA, 20 bp, Homo sapiens
aagcagtagaaataatatgc

SEQ ID NO: 149404 - DNA, 15 bp, Homo sapiens
aagcatcaaactctt

SEQ ID NO: 149405 - DNA, 12 bp, Homo sapiens
aagcattcacaa

SEQ ID NO: 149406 - DNA, 13 bp, Homo sapiens
aagcattcacaac

SEQ ID NO: 149407 - DNA, 15 bp, Homo sapiens
aagcattcagagagc

SEQ ID NO: 149408 - DNA, 17 bp, Homo sapiens
aagcattcagagagcag

SEQ ID NO: 149409 - DNA, 19 bp, Homo sapiens
aagcattgtaaatgtgctt

SEQ ID NO: 149410 - DNA, 14 bp, Homo sapiens
aagccaagcagcca

SEQ ID NO: 149411 - DNA, 16 bp, Homo sapiens
aagccaagcagccaag

SEQ ID NO: 149412 - DNA, 15 bp, Homo sapiens
aagccacaagaaatt

SEQ ID NO: 149413 - DNA, 12 bp, Homo sapiens
aagccagaagct

SEQ ID NO: 149414 - DNA, 13 bp, Homo sapiens
aagccagaagctg

SEQ ID NO: 149415 - DNA, 14 bp, Homo sapiens
aagccagaagctga

SEQ ID NO: 149416 - DNA, 17 bp, Homo sapiens
aagccagaagctgagca

SEQ ID NO: 149417 - DNA, 20 bp, Homo sapiens
aagccagcgtcctcctctgt

SEQ ID NO: 149418 - DNA, 20 bp, Homo sapiens
aagccattctaaggaaatta

SEQ ID NO: 149419 - DNA, 13 bp, Homo sapiens
aagccctccttcc

SEQ ID NO: 149420 - DNA, 14 bp, Homo sapiens
aagccctccttcca

SEQ ID NO: 149421 - DNA, 21 bp, Homo sapiens
aagccgtgattttcattgctg

SEQ ID NO: 149422 - DNA, 14 bp, Homo sapiens
aagcctcatattta

SEQ ID NO: 149423 - DNA, 15 bp, Homo sapiens
aagcctcctccagcc

SEQ ID NO: 149424 - DNA, 17 bp, Homo sapiens
aagcctgcaatttcata

SEQ ID NO: 149425 - DNA, 16 bp, Homo sapiens
aagcctttttccccaa

SEQ ID NO: 149426 - DNA, 14 bp, Homo sapiens
aagcggctggcagc

SEQ ID NO: 149427 - DNA, 21 bp, Homo sapiens
aagctaaatcctttactgtta

SEQ ID NO: 149428 - DNA, 10 bp, Homo sapiens
aagctagaat

SEQ ID NO: 149429 - DNA, 14 bp, Homo sapiens
aagctagagatatg

SEQ ID NO: 149430 - DNA, 20 bp, Homo sapiens
aagctcacagttcctcgccc

SEQ ID NO: 149431 - DNA, 22 bp, Homo sapiens
aagctcacagttcctcgccctg

SEQ ID NO: 149432 - DNA, 23 bp, Homo sapiens
aagctcacagttcctcgccctgg

SEQ ID NO: 149433 - DNA, 22 bp, Homo sapiens
aagctcatattttgtatatatc

SEQ ID NO: 149434 - DNA, 15 bp, Homo sapiens
aagctcctgtcctcc

SEQ ID NO: 149435 - DNA, 20 bp, Homo sapiens
aagctcctgtcctcccatcc

SEQ ID NO: 149436 - DNA, 19 bp, Homo sapiens
aagctgcaccctcaggcag

SEQ ID NO: 149437 - DNA, 21 bp, Homo sapiens
aagctgcaccctcaggcaggt

SEQ ID NO: 149438 - DNA, 16 bp, Homo sapiens
aagctgcctgtagtta

SEQ ID NO: 149439 - DNA, 21 bp, Homo sapiens
aagctgcctgtagttaggaaa

SEQ ID NO: 149440 - DNA, 22 bp, Homo sapiens
aagctgtgtccttgcacctgca

SEQ ID NO: 149441 - DNA, 23 bp, Homo sapiens
aagctgtttccatagggtgacac

SEQ ID NO: 149442 - DNA, 18 bp, Homo sapiens
aagcttattaaaactcat

SEQ ID NO: 149443 - DNA, 15 bp, Homo sapiens
aagcttcagtttcct

SEQ ID NO: 149444 - DNA, 22 bp, Homo sapiens
aagcttcttaaatgagaaggaa

SEQ ID NO: 149445 - DNA, 23 bp, Homo sapiens
aagctttcatgtaaactgtgcac

SEQ ID NO: 149446 - DNA, 14 bp, Homo sapiens
aaggaaaaatgtgt

SEQ ID NO: 149447 - DNA, 17 bp, Homo sapiens
aaggaaaaatgtgtaat

SEQ ID NO: 149448 - DNA, 21 bp, Homo sapiens
aaggaaaaatgtgtaattttg

SEQ ID NO: 149449 - DNA, 16 bp, Homo sapiens
aaggaagctccactgt

SEQ ID NO: 149450 - DNA, 22 bp, Homo sapiens
aaggaaggagactcacctctgc

SEQ ID NO: 149451 - DNA, 21 bp, Homo sapiens
aaggaagtcaaagcaaggaaa

SEQ ID NO: 149452 - DNA, 21 bp, Homo sapiens
aaggaataaattgctccttga

SEQ ID NO: 149453 - DNA, 13 bp, Homo sapiens
aaggaatatatgg

SEQ ID NO: 149454 - DNA, 17 bp, Homo sapiens
aaggaatatatggcaga

SEQ ID NO: 149455 - DNA, 18 bp, Homo sapiens
aaggaatatatggcagag

SEQ ID NO: 149456 - DNA, 22 bp, Homo sapiens
aaggaatatatggcagagttgt

SEQ ID NO: 149457 - DNA, 13 bp, Homo sapiens
aaggacactagaa

SEQ ID NO: 149458 - DNA, 15 bp, Homo sapiens
aaggagaaggaagga

SEQ ID NO: 149459 - DNA, 16 bp, Homo sapiens
aaggagagaaagtggg

SEQ ID NO: 149460 - DNA, 11 bp, Homo sapiens
aaggagagcta

SEQ ID NO: 149461 - DNA, 17 bp, Homo sapiens
aaggagaggaaagaact

SEQ ID NO: 149462 - DNA, 23 bp, Homo sapiens
aaggaggattccatttggcagag

SEQ ID NO: 149463 - DNA, 15 bp, Homo sapiens
aaggagggagatgga

SEQ ID NO: 149464 - DNA, 18 bp, Homo sapiens
aaggagggttagggaggg

SEQ ID NO: 149465 - DNA, 23 bp, Homo sapiens
aaggatactgtaacactttacaa

SEQ ID NO: 149466 - DNA, 20 bp, Homo sapiens
aaggatgtaaacagtgcctg

SEQ ID NO: 149467 - DNA, 23 bp, Homo sapiens
aaggatgtaaacagtgcctgctg

SEQ ID NO: 149468 - DNA, 16 bp, Homo sapiens
aaggattcatgtggaa

SEQ ID NO: 149469 - DNA, 15 bp, Homo sapiens
aaggcaaacccatca

SEQ ID NO: 149470 - DNA, 20 bp, Homo sapiens
aaggcaaagcacgaaatgtt

SEQ ID NO: 149471 - DNA, 20 bp, Homo sapiens
aaggcaagtttctagctaga

SEQ ID NO: 149472 - DNA, 19 bp, Homo sapiens
aaggcaggaatgtgtggca

SEQ ID NO: 149473 - DNA, 17 bp, Homo sapiens
aaggccagctggcagca

SEQ ID NO: 149474 - DNA, 22 bp, Homo sapiens
aaggccgaagaagggtccttcc

SEQ ID NO: 149475 - DNA, 23 bp, Homo sapiens
aaggctcgattttgtatctgcag

SEQ ID NO: 149476 - DNA, 16 bp, Homo sapiens
aaggctgggggaagaa

SEQ ID NO: 149477 - DNA, 22 bp, Homo sapiens
aaggctgggggaagaagctctc

SEQ ID NO: 149478 - DNA, 22 bp, Homo sapiens
aaggctgtccttacccatctgc

SEQ ID NO: 149479 - DNA, 18 bp, Homo sapiens
aaggcttctctctgtggg

SEQ ID NO: 149480 - DNA, 17 bp, Homo sapiens
aagggaaactgccagca

SEQ ID NO: 149481 - DNA, 15 bp, Homo sapiens
aagggaaatatcatt

SEQ ID NO: 149482 - DNA, 16 bp, Homo sapiens
aagggaaatatcattt

SEQ ID NO: 149483 - DNA, 23 bp, Homo sapiens
aagggaaggccccacagacaagg

SEQ ID NO: 149484 - DNA, 17 bp, Homo sapiens
aagggagagcggggcag

SEQ ID NO: 149485 - DNA, 17 bp, Homo sapiens
aagggatggcaagatgt

SEQ ID NO: 149486 - DNA, 18 bp, Homo sapiens
aagggcaaaattcccagg

SEQ ID NO: 149487 - DNA, 18 bp, Homo sapiens
aagggctttgttttgcac

SEQ ID NO: 149488 - DNA, 15 bp, Homo sapiens
aaggggaggagggcg

SEQ ID NO: 149489 - DNA, 19 bp, Homo sapiens
aaggggcagtctggagggg

SEQ ID NO: 149490 - DNA, 20 bp, Homo sapiens
aaggggttggttgaggtgga

SEQ ID NO: 149491 - DNA, 16 bp, Homo sapiens
aagggtctagggagag

SEQ ID NO: 149492 - DNA, 17 bp, Homo sapiens
aagggtctagggagaga

SEQ ID NO: 149493 - DNA, 18 bp, Homo sapiens
aagggtctagggagagac

SEQ ID NO: 149494 - DNA, 20 bp, Homo sapiens
aagggtctagggagagaccc

SEQ ID NO: 149495 - DNA, 21 bp, Homo sapiens
aagggtgatgggaaagcattg

SEQ ID NO: 149496 - DNA, 13 bp, Homo sapiens
aaggtcatcatcg

SEQ ID NO: 149497 - DNA, 16 bp, Homo sapiens
aaggtgaaggaatata

SEQ ID NO: 149498 - DNA, 22 bp, Homo sapiens
aaggtgttcattcacttgcatt

SEQ ID NO: 149499 - DNA, 22 bp, Homo sapiens
aaggttccaatcagatctttat

SEQ ID NO: 149500 - DNA, 16 bp, Homo sapiens
acccccaaggggcagt

SEQ ID NO: 149501 - DNA, 13 bp, Homo sapiens
acccccactctca

SEQ ID NO: 149502 - DNA, 18 bp, Homo sapiens
acccccatttctatttat

SEQ ID NO: 149503 - DNA, 18 bp, Homo sapiens
accccccagaacctgtcc

SEQ ID NO: 149504 - DNA, 15 bp, Homo sapiens
acccccctgggctga

SEQ ID NO: 149505 - DNA, 16 bp, Homo sapiens
accccctccccagggg

SEQ ID NO: 149506 - DNA, 22 bp, Homo sapiens
accccgtctggggttcagcccc

SEQ ID NO: 149507 - DNA, 18 bp, Homo sapiens
acccctcccctaatgcct

SEQ ID NO: 149508 - DNA, 13 bp, Homo sapiens
acccctcctcact

SEQ ID NO: 149509 - DNA, 16 bp, Homo sapiens
acccctcctcactggc

SEQ ID NO: 149510 - DNA, 19 bp, Homo sapiens
acccctcctcactggccat

SEQ ID NO: 149511 - DNA, 21 bp, Homo sapiens
acccctcctcactggccatcc

SEQ ID NO: 149512 - DNA, 17 bp, Homo sapiens
acccctccttccttgac

SEQ ID NO: 149513 - DNA, 22 bp, Homo sapiens
acccctccttccttgaccagca

SEQ ID NO: 149514 - DNA, 13 bp, Homo sapiens
acccctgccctgg

SEQ ID NO: 149515 - DNA, 15 bp, Homo sapiens
acccctgccctggga

SEQ ID NO: 149516 - DNA, 16 bp, Homo sapiens
acccctgcccttgtcc

SEQ ID NO: 149517 - DNA, 14 bp, Homo sapiens
acccctgcttctga

SEQ ID NO: 149518 - DNA, 17 bp, Homo sapiens
acccctgtcctcactgc

SEQ ID NO: 149519 - DNA, 15 bp, Homo sapiens
acccgggaggcagag

SEQ ID NO: 149520 - DNA, 16 bp, Homo sapiens
accctaaatcttgact

SEQ ID NO: 149521 - DNA, 13 bp, Homo sapiens
accctattgctgc

SEQ ID NO: 149522 - DNA, 11 bp, Homo sapiens
accctcagagc

SEQ ID NO: 149523 - DNA, 15 bp, Homo sapiens
accctcaggcaggtg

SEQ ID NO: 149524 - DNA, 23 bp, Homo sapiens
accctcccccaggaggtcgaccc

SEQ ID NO: 149525 - DNA, 17 bp, Homo sapiens
acagtcaaaacagagat

SEQ ID NO: 149526 - DNA, 18 bp, Homo sapiens
acagtcaaaacagagatg

SEQ ID NO: 149527 - DNA, 18 bp, Homo sapiens
acagtcaaggagtggctt

SEQ ID NO: 149528 - DNA, 13 bp, Homo sapiens
acagtcatttaaa

SEQ ID NO: 149529 - DNA, 18 bp, Homo sapiens
acagtcctaactggtata

SEQ ID NO: 149530 - DNA, 14 bp, Homo sapiens
acagtctcaggaaa

SEQ ID NO: 149531 - DNA, 16 bp, Homo sapiens
acagtctcaggaaatc

SEQ ID NO: 149532 - DNA, 21 bp, Homo sapiens
acagtgattaccagggactga

SEQ ID NO: 149533 - DNA, 11 bp, Homo sapiens
acagtgcctgc

SEQ ID NO: 149534 - DNA, 14 bp, Homo sapiens
acagtgcctgctga

SEQ ID NO: 149535 - DNA, 21 bp, Homo sapiens
acagtgggtgccccccttgcc

SEQ ID NO: 149536 - DNA, 16 bp, Homo sapiens
acagtgttattttctt

SEQ ID NO: 149537 - DNA, 9 bp, Homo sapiens
acagtgttt

SEQ ID NO: 149538 - DNA, 21 bp, Homo sapiens
acagttaaatgagaacatgaa

SEQ ID NO: 149539 - DNA, 19 bp, Homo sapiens
acagttcctcgccctgggt

SEQ ID NO: 149540 - DNA, 20 bp, Homo sapiens
acagttgaaaaacagctgag

SEQ ID NO: 149541 - DNA, 16 bp, Homo sapiens
acagttttctgagaaa

SEQ ID NO: 149542 - DNA, 21 bp, Homo sapiens
acagttttctgagaaagacta

SEQ ID NO: 149543 - DNA, 13 bp, Homo sapiens
acataaactgact

SEQ ID NO: 149544 - DNA, 15 bp, Homo sapiens
acataaataaaatga

SEQ ID NO: 149545 - DNA, 19 bp, Homo sapiens
acataaataaaatgaccag

SEQ ID NO: 149546 - DNA, 13 bp, Homo sapiens
acataaattagag

SEQ ID NO: 149547 - DNA, 20 bp, Homo sapiens
acataagtaattcaagaaaa

SEQ ID NO: 149548 - DNA, 19 bp, Homo sapiens
acataattaaattttgagt

SEQ ID NO: 149549 - DNA, 13 bp, Homo sapiens
acatatgtaaaat

SEQ ID NO: 149550 - DNA, 20 bp, Homo sapiens
acatattcatttggaaataa

SEQ ID NO: 149551 - DNA, 14 bp, Homo sapiens
acatcaagcacaga

SEQ ID NO: 149552 - DNA, 18 bp, Homo sapiens
acatcaatattgtcattc

SEQ ID NO: 149553 - DNA, 23 bp, Homo sapiens
acatcaatattgtcattcctgta

SEQ ID NO: 149554 - DNA, 20 bp, Homo sapiens
acatccatgtttgtaaaact

SEQ ID NO: 149555 - DNA, 16 bp, Homo sapiens
acatcccattgccctg

SEQ ID NO: 149556 - DNA, 14 bp, Homo sapiens
acatccccaccctt

SEQ ID NO: 149557 - DNA, 15 bp, Homo sapiens
acatccctgccagct

SEQ ID NO: 149558 - DNA, 17 bp, Homo sapiens
acatctaacctcatctt

SEQ ID NO: 149559 - DNA, 19 bp, Homo sapiens
acatctcaggggccagagg

SEQ ID NO: 149560 - DNA, 16 bp, Homo sapiens
acatctgtgtcttgtt

SEQ ID NO: 149561 - DNA, 14 bp, Homo sapiens
acatctttcacact

SEQ ID NO: 149562 - DNA, 16 bp, Homo sapiens
acatgaagaagctaaa

SEQ ID NO: 149563 - DNA, 19 bp, Homo sapiens
acatgaccctaaatcttga

SEQ ID NO: 149564 - DNA, 21 bp, Homo sapiens
acatgaccctaaatcttgact

SEQ ID NO: 149565 - DNA, 22 bp, Homo sapiens
acatgagctatttccattccag

SEQ ID NO: 149566 - DNA, 23 bp, Homo sapiens
acatgaggtactgagagtgaaca

SEQ ID NO: 149567 - DNA, 19 bp, Homo sapiens
acatgatcctgcaattcca

SEQ ID NO: 149568 - DNA, 19 bp, Homo sapiens
acatgcgggctgggcagct

SEQ ID NO: 149569 - DNA, 14 bp, Homo sapiens
acatggcttagttt

SEQ ID NO: 149570 - DNA, 23 bp, Homo sapiens
acatgggagccgggtctgcctct

SEQ ID NO: 149571 - DNA, 17 bp, Homo sapiens
acatggtttgactcccg

SEQ ID NO: 149572 - DNA, 18 bp, Homo sapiens
acatgtattgcacattgt

SEQ ID NO: 149573 - DNA, 19 bp, Homo sapiens
acatgtattgcacattgta

SEQ ID NO: 149574 - DNA, 15 bp, Homo sapiens
acatgtgacatttat

SEQ ID NO: 149575 - DNA, 16 bp, Homo sapiens
acatgtggggccaggt

SEQ ID NO: 149576 - DNA, 23 bp, Homo sapiens
acatgtggtgggacagggaccca

SEQ ID NO: 149577 - DNA, 15 bp, Homo sapiens
acatgttatatattt

SEQ ID NO: 149578 - DNA, 23 bp, Homo sapiens
acatgtttttgttttctttgaat

SEQ ID NO: 149579 - DNA, 14 bp, Homo sapiens
acattaagaaaatc

SEQ ID NO: 149580 - DNA, 21 bp, Homo sapiens
acattaatgttaattcagcac

SEQ ID NO: 149581 - DNA, 22 bp, Homo sapiens
acattagcagtttgctttgtat

SEQ ID NO: 149582 - DNA, 17 bp, Homo sapiens
acattgtaaatagtatt

SEQ ID NO: 149583 - DNA, 16 bp, Homo sapiens
acatttaatacagcag

SEQ ID NO: 149584 - DNA, 17 bp, Homo sapiens
acatttaatacagcagt

SEQ ID NO: 149585 - DNA, 20 bp, Homo sapiens
acatttgggagacatgtgac

SEQ ID NO: 149586 - DNA, 16 bp, Homo sapiens
accaaataaaaatatt

SEQ ID NO: 149587 - DNA, 14 bp, Homo sapiens
accaaattccttgg

SEQ ID NO: 149588 - DNA, 14 bp, Homo sapiens
accaacacgagcag

SEQ ID NO: 149589 - DNA, 19 bp, Homo sapiens
accaacacgagcaggctac

SEQ ID NO: 149590 - DNA, 16 bp, Homo sapiens
accaacagttccttca

SEQ ID NO: 149591 - DNA, 23 bp, Homo sapiens
accaacatggagaaaccctgtct

SEQ ID NO: 149592 - DNA, 12 bp, Homo sapiens
accaactttctg

SEQ ID NO: 149593 - DNA, 13 bp, Homo sapiens
accaactttctgt

SEQ ID NO: 149594 - DNA, 19 bp, Homo sapiens
accaactttctgtaaactc

SEQ ID NO: 149595 - DNA, 11 bp, Homo sapiens
accaagaagat

SEQ ID NO: 149596 - DNA, 13 bp, Homo sapiens
accaagcaggaaa

SEQ ID NO: 149597 - DNA, 15 bp, Homo sapiens
accaagcaggaagct

SEQ ID NO: 149598 - DNA, 16 bp, Homo sapiens
accaagcaggaagctc

SEQ ID NO: 149599 - DNA, 17 bp, Homo sapiens
accaagcaggaagctca

SEQ ID NO: 149600 - DNA, 24 bp, Homo sapiens
accaagcaggaagctcagactggt

SEQ ID NO: 149601 - DNA, 15 bp, Homo sapiens
accaagtatttatta

SEQ ID NO: 149602 - DNA, 13 bp, Homo sapiens
accaatcatttta

SEQ ID NO: 149603 - DNA, 13 bp, Homo sapiens
accaatcctggac

SEQ ID NO: 149604 - DNA, 14 bp, Homo sapiens
accaatgaaaaaat

SEQ ID NO: 149605 - DNA, 16 bp, Homo sapiens
accaattcaacccttt

SEQ ID NO: 149606 - DNA, 12 bp, Homo sapiens
accacacccagc

SEQ ID NO: 149607 - DNA, 16 bp, Homo sapiens
accacacccagcctca

SEQ ID NO: 149608 - DNA, 22 bp, Homo sapiens
accacaggttcatgccaccatg

SEQ ID NO: 149609 - DNA, 16 bp, Homo sapiens
accacctaggccactc

SEQ ID NO: 149610 - DNA, 20 bp, Homo sapiens
accacctaggccactcctcc

SEQ ID NO: 149611 - DNA, 15 bp, Homo sapiens
accaccttcccagct

SEQ ID NO: 149612 - DNA, 21 bp, Homo sapiens
accaccttcccagctctccct

SEQ ID NO: 149613 - DNA, 20 bp, Homo sapiens
accacggacgtttccatcag

SEQ ID NO: 149614 - DNA, 17 bp, Homo sapiens
accactgcactccagcc

SEQ ID NO: 149615 - DNA, 21 bp, Homo sapiens
accactgcactccagcctggg

SEQ ID NO: 149616 - DNA, 14 bp, Homo sapiens
accactgcagaaga

SEQ ID NO: 149617 - DNA, 14 bp, Homo sapiens
accacttcagctga

SEQ ID NO: 149618 - DNA, 17 bp, Homo sapiens
accacttcttttataac

SEQ ID NO: 149619 - DNA, 19 bp, Homo sapiens
accagacggttcaccagcc

SEQ ID NO: 149620 - DNA, 18 bp, Homo sapiens
accagagaccgtcctcac

SEQ ID NO: 149621 - DNA, 13 bp, Homo sapiens
accagcagcctgg

SEQ ID NO: 149622 - DNA, 21 bp, Homo sapiens
accagcctccatgctgcctcc

SEQ ID NO: 149623 - DNA, 20 bp, Homo sapiens
accagcctccgtatttcaga

SEQ ID NO: 149624 - DNA, 20 bp, Homo sapiens
accagcctggtcaacatggt

SEQ ID NO: 149625 - DNA, 17 bp, Homo sapiens
accagcctttctcccag

SEQ ID NO: 149626 - DNA, 19 bp, Homo sapiens
accagcctttctcccaggc

SEQ ID NO: 149627 - DNA, 17 bp, Homo sapiens
accagctgtaacacagc

SEQ ID NO: 149628 - DNA, 20 bp, Homo sapiens
accaggaatgttaaagtcag

SEQ ID NO: 149629 - DNA, 15 bp, Homo sapiens
accaggacaggacca

SEQ ID NO: 149630 - DNA, 17 bp, Homo sapiens
accaggacaggaccaga

SEQ ID NO: 149631 - DNA, 22 bp, Homo sapiens
accaggagtccctggtaataag

SEQ ID NO: 149632 - DNA, 21 bp, Homo sapiens
accaggcacgaacccacctgc

SEQ ID NO: 149633 - DNA, 20 bp, Homo sapiens
accagggttgaccccagagg

SEQ ID NO: 149634 - DNA, 21 bp, Homo sapiens
accagggttgaccccagagga

SEQ ID NO: 149635 - DNA, 22 bp, Homo sapiens
accagtgcccaaagtctgtgtg

SEQ ID NO: 149636 - DNA, 18 bp, Homo sapiens
accagtgtcccctccact

SEQ ID NO: 149637 - DNA, 20 bp, Homo sapiens
accagtgtcccctccactgt

SEQ ID NO: 149638 - DNA, 15 bp, Homo sapiens
accataatgttacat

SEQ ID NO: 149639 - DNA, 18 bp, Homo sapiens
accataatgttacattat

SEQ ID NO: 149640 - DNA, 14 bp, Homo sapiens
accatcagggacag

SEQ ID NO: 149641 - DNA, 19 bp, Homo sapiens
accatccctttttgaagtg

SEQ ID NO: 149642 - DNA, 14 bp, Homo sapiens
accatgaaacaaag

SEQ ID NO: 149643 - DNA, 23 bp, Homo sapiens
accatgattaaccacttcagctg

SEQ ID NO: 149644 - DNA, 15 bp, Homo sapiens
accatggccagccaa

SEQ ID NO: 149645 - DNA, 17 bp, Homo sapiens
accatgtacatgaagaa

SEQ ID NO: 149646 - DNA, 15 bp, Homo sapiens
accatgtcagcaaaa

SEQ ID NO: 149647 - DNA, 21 bp, Homo sapiens
accatgtcagcaaaaagcaaa

SEQ ID NO: 149648 - DNA, 12 bp, Homo sapiens
accattccccat

SEQ ID NO: 149649 - DNA, 18 bp, Homo sapiens
acccaaaaggcagaagca

SEQ ID NO: 149650 - DNA, 15 bp, Homo sapiens
acccaactctcctgg

SEQ ID NO: 149651 - DNA, 15 bp, Homo sapiens
acccaaggaggaaaa

SEQ ID NO: 149652 - DNA, 17 bp, Homo sapiens
acccacaagaaatgaaa

SEQ ID NO: 149653 - DNA, 13 bp, Homo sapiens
acccacagggcta

SEQ ID NO: 149654 - DNA, 19 bp, Homo sapiens
acccacctggtggcctctg

SEQ ID NO: 149655 - DNA, 21 bp, Homo sapiens
acccagccccttgagaaacct

SEQ ID NO: 149656 - DNA, 15 bp, Homo sapiens
acccagccctcatcc

SEQ ID NO: 149657 - DNA, 16 bp, Homo sapiens
acccagccctcatccc

SEQ ID NO: 149658 - DNA, 13 bp, Homo sapiens
acccagcctcagt

SEQ ID NO: 149659 - DNA, 14 bp, Homo sapiens
acccaggaggtgga

SEQ ID NO: 149660 - DNA, 21 bp, Homo sapiens
acccagtccccgtgccccgcc

SEQ ID NO: 149661 - DNA, 23 bp, Homo sapiens
aatctcataggttgccaataata

SEQ ID NO: 149662 - DNA, 15 bp, Homo sapiens
aatctccagtattct

SEQ ID NO: 149663 - DNA, 20 bp, Homo sapiens
aatctctttttgctttcgaa

SEQ ID NO: 149664 - DNA, 22 bp, Homo sapiens
aatctgatttgttttcctctta

SEQ ID NO: 149665 - DNA, 22 bp, Homo sapiens
aatctgtcacgtagaacttgga

SEQ ID NO: 149666 - DNA, 18 bp, Homo sapiens
aatctttattgagaaaga

SEQ ID NO: 149667 - DNA, 14 bp, Homo sapiens
aatgaaaaattctc

SEQ ID NO: 149668 - DNA, 17 bp, Homo sapiens
aatgaaaaattctcagt

SEQ ID NO: 149669 - DNA, 20 bp, Homo sapiens
aatgaaaattgtatgttaag

SEQ ID NO: 149670 - DNA, 19 bp, Homo sapiens
aatgaaatgctctcctttc

SEQ ID NO: 149671 - DNA, 15 bp, Homo sapiens
aatgaataataatta

SEQ ID NO: 149672 - DNA, 17 bp, Homo sapiens
aatgaatgcataaaatg

SEQ ID NO: 149673 - DNA, 19 bp, Homo sapiens
aatgaatggactcaaactg

SEQ ID NO: 149674 - DNA, 14 bp, Homo sapiens
aatgacaacagaag

SEQ ID NO: 149675 - DNA, 16 bp, Homo sapiens
aatgacaacagaagct

SEQ ID NO: 149676 - DNA, 16 bp, Homo sapiens
aatgacagagccagtg

SEQ ID NO: 149677 - DNA, 23 bp, Homo sapiens
aatgagagaataagtcatgttcc

SEQ ID NO: 149678 - DNA, 18 bp, Homo sapiens
aatgaggaggaaggagag

SEQ ID NO: 149679 - DNA, 15 bp, Homo sapiens
aatgatggacccaat

SEQ ID NO: 149680 - DNA, 21 bp, Homo sapiens
aatgattcagtgttaaatgtg

SEQ ID NO: 149681 - DNA, 23 bp, Homo sapiens
aatgattcagtgttaaatgtgat

SEQ ID NO: 149682 - DNA, 14 bp, Homo sapiens
aatgattgtaaaat

SEQ ID NO: 149683 - DNA, 20 bp, Homo sapiens
aatgatttccaaagagaaaa

SEQ ID NO: 149684 - DNA, 14 bp, Homo sapiens
aatgcacacaaaac

SEQ ID NO: 149685 - DNA, 18 bp, Homo sapiens
aatgcatgttaggaaaat

SEQ ID NO: 149686 - DNA, 22 bp, Homo sapiens
aatgccagagacggaagccttt

SEQ ID NO: 149687 - DNA, 15 bp, Homo sapiens
aatgccatcatctcc

SEQ ID NO: 149688 - DNA, 15 bp, Homo sapiens
aatgcctcagtgtat

SEQ ID NO: 149689 - DNA, 20 bp, Homo sapiens
aatgcctcagtgtatttgta

SEQ ID NO: 149690 - DNA, 18 bp, Homo sapiens
aatgctaaagaaaaagtc

SEQ ID NO: 149691 - DNA, 18 bp, Homo sapiens
aatgctaggttaattcca

SEQ ID NO: 149692 - DNA, 23 bp, Homo sapiens
aatgctataactatgttgataaa

SEQ ID NO: 149693 - DNA, 14 bp, Homo sapiens
aatgctctcctttc

SEQ ID NO: 149694 - DNA, 19 bp, Homo sapiens
aatgctgcgcccttcccca

SEQ ID NO: 149695 - DNA, 20 bp, Homo sapiens
aatgcttatcatctaaagat

SEQ ID NO: 149696 - DNA, 21 bp, Homo sapiens
aatgcttggcttctcatacgt

SEQ ID NO: 149697 - DNA, 18 bp, Homo sapiens
aatggaaggtttgtatat

SEQ ID NO: 149698 - DNA, 14 bp, Homo sapiens
aatgggaaaagaga

SEQ ID NO: 149699 - DNA, 14 bp, Homo sapiens
aatggtccaggaga

SEQ ID NO: 149700 - DNA, 20 bp, Homo sapiens
aatgtaagggaaactgccag

SEQ ID NO: 149701 - DNA, 21 bp, Homo sapiens
aatgtaatgatcataagtcta

SEQ ID NO: 149702 - DNA, 14 bp, Homo sapiens
aatgtactgcatat

SEQ ID NO: 149703 - DNA, 17 bp, Homo sapiens
aatgtatcttattcaca

SEQ ID NO: 149704 - DNA, 18 bp, Homo sapiens
aatgtatcttattcacat

SEQ ID NO: 149705 - DNA, 19 bp, Homo sapiens
aatgtattgaacttggaaa

SEQ ID NO: 149706 - DNA, 19 bp, Homo sapiens
aatgtcaccaccttcccag

SEQ ID NO: 149707 - DNA, 23 bp, Homo sapiens
aatgtcaccaccttcccagctct

SEQ ID NO: 149708 - DNA, 20 bp, Homo sapiens
aatgtcttgatgcatgcact

SEQ ID NO: 149709 - DNA, 13 bp, Homo sapiens
aatgtcttgtgtt

SEQ ID NO: 149710 - DNA, 22 bp, Homo sapiens
aatgtgaaaatggtccaggaga

SEQ ID NO: 149711 - DNA, 16 bp, Homo sapiens
aatgtgatgaatactg

SEQ ID NO: 149712 - DNA, 23 bp, Homo sapiens
aatgtgcattcttttaaaagaca

SEQ ID NO: 149713 - DNA, 14 bp, Homo sapiens
aatgtggctcctgg

SEQ ID NO: 149714 - DNA, 19 bp, Homo sapiens
aatgtgtatcggatgcttt

SEQ ID NO: 149715 - DNA, 22 bp, Homo sapiens
aatgtgtattacaaatattttg

SEQ ID NO: 149716 - DNA, 13 bp, Homo sapiens
aatgttaagcaga

SEQ ID NO: 149717 - DNA, 15 bp, Homo sapiens
aatgttacattatta

SEQ ID NO: 149718 - DNA, 16 bp, Homo sapiens
aatgttacattattat

SEQ ID NO: 149719 - DNA, 19 bp, Homo sapiens
aatgttattttttaattat

SEQ ID NO: 149720 - DNA, 20 bp, Homo sapiens
aatgttattttttaattatt

SEQ ID NO: 149721 - DNA, 13 bp, Homo sapiens
aatgttcatcaat

SEQ ID NO: 149722 - DNA, 20 bp, Homo sapiens
aatgttcatcaatgaatgaa

SEQ ID NO: 149723 - DNA, 12 bp, Homo sapiens
aatgttcatcat

SEQ ID NO: 149724 - DNA, 22 bp, Homo sapiens
aatgttcatcccatgatgtagt

SEQ ID NO: 149725 - DNA, 13 bp, Homo sapiens
aatgttgaaaagt

SEQ ID NO: 149726 - DNA, 14 bp, Homo sapiens
aatgttgaattttg

SEQ ID NO: 149727 - DNA, 23 bp, Homo sapiens
aatgtttacactctttgtaagag

SEQ ID NO: 149728 - DNA, 21 bp, Homo sapiens
aattaccttgagccagtaatt

SEQ ID NO: 149729 - DNA, 15 bp, Homo sapiens
aattagccaagtgtg

SEQ ID NO: 149730 - DNA, 17 bp, Homo sapiens
aattagtaacatgtgtt

SEQ ID NO: 149731 - DNA, 22 bp, Homo sapiens
aattatagtgatgtaatcttga

SEQ ID NO: 149732 - DNA, 20 bp, Homo sapiens
aattatataggttgtgcaaa

SEQ ID NO: 149733 - DNA, 21 bp, Homo sapiens
aattatataggttgtgcaaat

SEQ ID NO: 149734 - DNA, 22 bp, Homo sapiens
aattatgtctgctgaataataa

SEQ ID NO: 149735 - DNA, 21 bp, Homo sapiens
aattattattcttcataacaa

SEQ ID NO: 149736 - DNA, 16 bp, Homo sapiens
aattattatttatata

SEQ ID NO: 149737 - DNA, 21 bp, Homo sapiens
aattattatttatatatgtat

SEQ ID NO: 149738 - DNA, 13 bp, Homo sapiens
aattatttcagaa

SEQ ID NO: 149739 - DNA, 14 bp, Homo sapiens
aattcaaagctcta

SEQ ID NO: 149740 - DNA, 12 bp, Homo sapiens
aattcaagaaaa

SEQ ID NO: 149741 - DNA, 21 bp, Homo sapiens
aattcacatctaacctcatct

SEQ ID NO: 149742 - DNA, 20 bp, Homo sapiens
aattcagcactgatttcaca

SEQ ID NO: 149743 - DNA, 14 bp, Homo sapiens
aattccaaaggaat

SEQ ID NO: 149744 - DNA, 14 bp, Homo sapiens
aattccccaccctg

SEQ ID NO: 149745 - DNA, 17 bp, Homo sapiens
aattccctctctctgac

SEQ ID NO: 149746 - DNA, 23 bp, Homo sapiens
aattccctctctctgactctcaa

SEQ ID NO: 149747 - DNA, 14 bp, Homo sapiens
aattccctgctgtc

SEQ ID NO: 149748 - DNA, 13 bp, Homo sapiens
aattccttagctt

SEQ ID NO: 149749 - DNA, 21 bp, Homo sapiens
aattccttggcatgccttcca

SEQ ID NO: 149750 - DNA, 15 bp, Homo sapiens
aattcggtgtgcacc

SEQ ID NO: 149751 - DNA, 14 bp, Homo sapiens
aattctactttgag

SEQ ID NO: 149752 - DNA, 21 bp, Homo sapiens
aattctcatgtgatcctttta

SEQ ID NO: 149753 - DNA, 19 bp, Homo sapiens
aattctgtcactcaccact

SEQ ID NO: 149754 - DNA, 14 bp, Homo sapiens
aattctgtttttct

SEQ ID NO: 149755 - DNA, 15 bp, Homo sapiens
aattcttggaatact

SEQ ID NO: 149756 - DNA, 20 bp, Homo sapiens
aattcttggttgaggaaaca

SEQ ID NO: 149757 - DNA, 21 bp, Homo sapiens
aattgacccacaagaaatgaa

SEQ ID NO: 149758 - DNA, 13 bp, Homo sapiens
aattgatgtgttt

SEQ ID NO: 149759 - DNA, 14 bp, Homo sapiens
aattgccaaagctg

SEQ ID NO: 149760 - DNA, 22 bp, Homo sapiens
aattgctttaccttttttctta

SEQ ID NO: 149761 - DNA, 18 bp, Homo sapiens
aattggaccatcctattt

SEQ ID NO: 149762 - DNA, 16 bp, Homo sapiens
aattgtaactgttctt

SEQ ID NO: 149763 - DNA, 13 bp, Homo sapiens
aattgtccccagt

SEQ ID NO: 149764 - DNA, 15 bp, Homo sapiens
aattgtttaagtgtt

SEQ ID NO: 149765 - DNA, 13 bp, Homo sapiens
aatttaaaaaata

SEQ ID NO: 149766 - DNA, 13 bp, Homo sapiens
aatttacaaagtg

SEQ ID NO: 149767 - DNA, 14 bp, Homo sapiens
aatttacaaagtgt

SEQ ID NO: 149768 - DNA, 16 bp, Homo sapiens
aatttacaaagtgtgt

SEQ ID NO: 149769 - DNA, 18 bp, Homo sapiens
aatttacaaagtgtgtat

SEQ ID NO: 149770 - DNA, 19 bp, Homo sapiens
aatttacaaagtgtgtatt

SEQ ID NO: 149771 - DNA, 18 bp, Homo sapiens
aatttacagagacagaaa

SEQ ID NO: 149772 - DNA, 15 bp, Homo sapiens
aatttacatactctg

SEQ ID NO: 149773 - DNA, 14 bp, Homo sapiens
aatttacttgccat

SEQ ID NO: 149774 - DNA, 17 bp, Homo sapiens
aatttagaaatataatt

SEQ ID NO: 149775 - DNA, 20 bp, Homo sapiens
aatttatcttgtctctgggc

SEQ ID NO: 149776 - DNA, 18 bp, Homo sapiens
aatttattagttaatata

SEQ ID NO: 149777 - DNA, 19 bp, Homo sapiens
aatttattagttaatatat

SEQ ID NO: 149778 - DNA, 20 bp, Homo sapiens
aatttcaggttttgtaaaga

SEQ ID NO: 149779 - DNA, 22 bp, Homo sapiens
aatttcaggttttgtaaagatg

SEQ ID NO: 149780 - DNA, 18 bp, Homo sapiens
aatttcatatgctgtata

SEQ ID NO: 149781 - DNA, 20 bp, Homo sapiens
aatttctcccagtcatttaa

SEQ ID NO: 149782 - DNA, 21 bp, Homo sapiens
aatttcttcactgttgaaaat

SEQ ID NO: 149783 - DNA, 13 bp, Homo sapiens
aatttgagtgctc

SEQ ID NO: 149784 - DNA, 20 bp, Homo sapiens
aatttgagttggatcatcta

SEQ ID NO: 149785 - DNA, 20 bp, Homo sapiens
aatttgatacatatgtgaat

SEQ ID NO: 149786 - DNA, 22 bp, Homo sapiens
aatttggttctaatagaactca

SEQ ID NO: 149787 - DNA, 16 bp, Homo sapiens
aattttaatgaagaaa

SEQ ID NO: 149788 - DNA, 19 bp, Homo sapiens
aattttcctaataaagttc

SEQ ID NO: 149789 - DNA, 12 bp, Homo sapiens
aattttctagac

SEQ ID NO: 149790 - DNA, 17 bp, Homo sapiens
aattttctagactttct

SEQ ID NO: 149791 - DNA, 16 bp, Homo sapiens
aattttgatgaacaaa

SEQ ID NO: 149792 - DNA, 20 bp, Homo sapiens
aatttttaaatgtaaaacat

SEQ ID NO: 149793 - DNA, 13 bp, Homo sapiens
aatttttaagcaa

SEQ ID NO: 149794 - DNA, 19 bp, Homo sapiens
aatttttttaaccaaaggt

SEQ ID NO: 149795 - DNA, 17 bp, Homo sapiens
acaaaaaaatatattta

SEQ ID NO: 149796 - DNA, 20 bp, Homo sapiens
acaaaaaaatatatttaatg

SEQ ID NO: 149797 - DNA, 18 bp, Homo sapiens
acaaaaaaatctgcagaa

SEQ ID NO: 149798 - DNA, 19 bp, Homo sapiens
acaaaaaaatctgcagaag

SEQ ID NO: 149799 - DNA, 14 bp, Homo sapiens
acaaaaacacagca

SEQ ID NO: 149800 - DNA, 16 bp, Homo sapiens
acaaaaacacagcaag

SEQ ID NO: 149801 - DNA, 15 bp, Homo sapiens
acaaaaacagcctca

SEQ ID NO: 149802 - DNA, 19 bp, Homo sapiens
acaaaaatgaactgaagtt

SEQ ID NO: 149803 - DNA, 23 bp, Homo sapiens
acaaaaatgaactgaagtttcac

SEQ ID NO: 149804 - DNA, 15 bp, Homo sapiens
acaaaaattgactca

SEQ ID NO: 149805 - DNA, 12 bp, Homo sapiens
acaaaacaaatg

SEQ ID NO: 149806 - DNA, 15 bp, Homo sapiens
acaaaatagaagctg

SEQ ID NO: 149807 - DNA, 18 bp, Homo sapiens
acaaaatagaagctgtag

SEQ ID NO: 149808 - DNA, 21 bp, Homo sapiens
aaggttctcaggtgttgccaa

SEQ ID NO: 149809 - DNA, 22 bp, Homo sapiens
aaggttgacaataaatgtgctt

SEQ ID NO: 149810 - DNA, 21 bp, Homo sapiens
aaggtttacaatttacaaagt

SEQ ID NO: 149811 - DNA, 23 bp, Homo sapiens
aaggtttcagaaagaagtgggga

SEQ ID NO: 149812 - DNA, 17 bp, Homo sapiens
aagtaaaaccacagcag

SEQ ID NO: 149813 - DNA, 12 bp, Homo sapiens
aagtaaagctaa

SEQ ID NO: 149814 - DNA, 11 bp, Homo sapiens
aagtaagaaaa

SEQ ID NO: 149815 - DNA, 18 bp, Homo sapiens
aagtaagaaaatattttg

SEQ ID NO: 149816 - DNA, 12 bp, Homo sapiens
aagtacatttaa

SEQ ID NO: 149817 - DNA, 20 bp, Homo sapiens
aagtacccgttcacattttt

SEQ ID NO: 149818 - DNA, 20 bp, Homo sapiens
aagtactgctgtaaataaat

SEQ ID NO: 149819 - DNA, 19 bp, Homo sapiens
aagtagacttcatttttcc

SEQ ID NO: 149820 - DNA, 12 bp, Homo sapiens
aagtagtttgta

SEQ ID NO: 149821 - DNA, 20 bp, Homo sapiens
aagtagtttgtataacttct

SEQ ID NO: 149822 - DNA, 11 bp, Homo sapiens
aagtatatata

SEQ ID NO: 149823 - DNA, 13 bp, Homo sapiens
aagtatatattta

SEQ ID NO: 149824 - DNA, 12 bp, Homo sapiens
aagtatttatat

SEQ ID NO: 149825 - DNA, 13 bp, Homo sapiens
aagtatttatata

SEQ ID NO: 149826 - DNA, 14 bp, Homo sapiens
aagtatttatatat

SEQ ID NO: 149827 - DNA, 15 bp, Homo sapiens
aagtatttatatatt

SEQ ID NO: 149828 - DNA, 18 bp, Homo sapiens
aagtatttatatatttat

SEQ ID NO: 149829 - DNA, 13 bp, Homo sapiens
aagtatttcaaat

SEQ ID NO: 149830 - DNA, 21 bp, Homo sapiens
aagtatttcaaattggagctt

SEQ ID NO: 149831 - DNA, 22 bp, Homo sapiens
aagtatttcaaattggagcttc

SEQ ID NO: 149832 - DNA, 20 bp, Homo sapiens
aagtcaaagcaaggaaacta

SEQ ID NO: 149833 - DNA, 14 bp, Homo sapiens
aagtcaaagtaaaa

SEQ ID NO: 149834 - DNA, 14 bp, Homo sapiens
aagtcactgcacag

SEQ ID NO: 149835 - DNA, 22 bp, Homo sapiens
aagtcactgcacagtgcatctc

SEQ ID NO: 149836 - DNA, 15 bp, Homo sapiens
aagtcatccaatcta

SEQ ID NO: 149837 - DNA, 21 bp, Homo sapiens
aagtcatgcgtttaatcacat

SEQ ID NO: 149838 - DNA, 17 bp, Homo sapiens
aagtcctacaagctaaa

SEQ ID NO: 149839 - DNA, 22 bp, Homo sapiens
aagtctaggagctgggaggaaa

SEQ ID NO: 149840 - DNA, 16 bp, Homo sapiens
aagtctctgctggccc

SEQ ID NO: 149841 - DNA, 22 bp, Homo sapiens
aagtctgtgagattcattcatg

SEQ ID NO: 149842 - DNA, 22 bp, Homo sapiens
aagtctgtgtgatgaactttct

SEQ ID NO: 149843 - DNA, 20 bp, Homo sapiens
aagtcttcactctctgaaga

SEQ ID NO: 149844 - DNA, 18 bp, Homo sapiens
aagtgagggtcagagagg

SEQ ID NO: 149845 - DNA, 16 bp, Homo sapiens
aagtgcatgctctctg

SEQ ID NO: 149846 - DNA, 22 bp, Homo sapiens
aagtgcgtccacgagctgttta

SEQ ID NO: 149847 - DNA, 12 bp, Homo sapiens
aagtggctgctg

SEQ ID NO: 149848 - DNA, 15 bp, Homo sapiens
aagtggggacagagc

SEQ ID NO: 149849 - DNA, 19 bp, Homo sapiens
aagtgggggcagagggcag

SEQ ID NO: 149850 - DNA, 15 bp, Homo sapiens
aagtgtaggcagaca

SEQ ID NO: 149851 - DNA, 23 bp, Homo sapiens
aagtgtatatcagaaaagggaag

SEQ ID NO: 149852 - DNA, 22 bp, Homo sapiens
aagtgtgtatgtgcgtgtgtgc

SEQ ID NO: 149853 - DNA, 15 bp, Homo sapiens
aagtgtgtattaaaa

SEQ ID NO: 149854 - DNA, 20 bp, Homo sapiens
aagtgttgtaaatatttatg

SEQ ID NO: 149855 - DNA, 13 bp, Homo sapiens
aagttaacagaga

SEQ ID NO: 149856 - DNA, 12 bp, Homo sapiens
aagttattgtac

SEQ ID NO: 149857 - DNA, 21 bp, Homo sapiens
aagttcatattccatatttat

SEQ ID NO: 149858 - DNA, 22 bp, Homo sapiens
aagttcatattccatatttatt

SEQ ID NO: 149859 - DNA, 14 bp, Homo sapiens
aagttccctacttc

SEQ ID NO: 149860 - DNA, 20 bp, Homo sapiens
aagttccctacttcctgtga

SEQ ID NO: 149861 - DNA, 20 bp, Homo sapiens
aagttgtggtgctgacaaag

SEQ ID NO: 149862 - DNA, 17 bp, Homo sapiens
aagtttaaagctcgaaa

SEQ ID NO: 149863 - DNA, 19 bp, Homo sapiens
aagtttctagctagaaata

SEQ ID NO: 149864 - DNA, 14 bp, Homo sapiens
aataaaaaccaaga

SEQ ID NO: 149865 - DNA, 11 bp, Homo sapiens
aataaaaaggc

SEQ ID NO: 149866 - DNA, 12 bp, Homo sapiens
aataaaaccttt

SEQ ID NO: 149867 - DNA, 13 bp, Homo sapiens
aataaaacctttc

SEQ ID NO: 149868 - DNA, 23 bp, Homo sapiens
aataaaacctttcaaatttcaca

SEQ ID NO: 149869 - DNA, 17 bp, Homo sapiens
aataaaatgttgaaaag

SEQ ID NO: 149870 - DNA, 15 bp, Homo sapiens
aataaagcctgcttt

SEQ ID NO: 149871 - DNA, 11 bp, Homo sapiens
aataaatatat

SEQ ID NO: 149872 - DNA, 16 bp, Homo sapiens
aataaatatatataaa

SEQ ID NO: 149873 - DNA, 20 bp, Homo sapiens
aataaatctggtagaaaaat

SEQ ID NO: 149874 - DNA, 16 bp, Homo sapiens
aataaattgctccttg

SEQ ID NO: 149875 - DNA, 20 bp, Homo sapiens
aataacacacatataaacat

SEQ ID NO: 149876 - DNA, 20 bp, Homo sapiens
aataactgtgaagtttacat

SEQ ID NO: 149877 - DNA, 14 bp, Homo sapiens
aataagagaaagaa

SEQ ID NO: 149878 - DNA, 17 bp, Homo sapiens
aataagcatcaaactct

SEQ ID NO: 149879 - DNA, 14 bp, Homo sapiens
aataaggttgaaca

SEQ ID NO: 149880 - DNA, 18 bp, Homo sapiens
aataatacctaagccttc

SEQ ID NO: 149881 - DNA, 13 bp, Homo sapiens
aataatatgcatt

SEQ ID NO: 149882 - DNA, 20 bp, Homo sapiens
aatacagtatctcagggcct

SEQ ID NO: 149883 - DNA, 18 bp, Homo sapiens
aatacattgaattagaaa

SEQ ID NO: 149884 - DNA, 23 bp, Homo sapiens
aatactcttaggaagagaaacca

SEQ ID NO: 149885 - DNA, 18 bp, Homo sapiens
aatagaaaactgaaaatc

SEQ ID NO: 149886 - DNA, 16 bp, Homo sapiens
aatagatgctgactgt

SEQ ID NO: 149887 - DNA, 20 bp, Homo sapiens
aatagcctgcctcttctcta

SEQ ID NO: 149888 - DNA, 17 bp, Homo sapiens
aatagcttttattgtat

SEQ ID NO: 149889 - DNA, 13 bp, Homo sapiens
aataggcaaaggg

SEQ ID NO: 149890 - DNA, 15 bp, Homo sapiens
aatagtatttgagag

SEQ ID NO: 149891 - DNA, 22 bp, Homo sapiens
aatagtatttgagagttctaaa

SEQ ID NO: 149892 - DNA, 16 bp, Homo sapiens
aatagtcaagaaaaat

SEQ ID NO: 149893 - DNA, 22 bp, Homo sapiens
aatagtgctcgctttctatgta

SEQ ID NO: 149894 - DNA, 14 bp, Homo sapiens
aatagttgttgatt

SEQ ID NO: 149895 - DNA, 11 bp, Homo sapiens
aatataaaact

SEQ ID NO: 149896 - DNA, 14 bp, Homo sapiens
aatataaaactgcg

SEQ ID NO: 149897 - DNA, 13 bp, Homo sapiens
aatataactgcct

SEQ ID NO: 149898 - DNA, 22 bp, Homo sapiens
aatataactgccttaaaacttt

SEQ ID NO: 149899 - DNA, 22 bp, Homo sapiens
aatataagaataaaatgttgaa

SEQ ID NO: 149900 - DNA, 19 bp, Homo sapiens
aatataccccttagtgttt

SEQ ID NO: 149901 - DNA, 17 bp, Homo sapiens
aatatactatatttatg

SEQ ID NO: 149902 - DNA, 20 bp, Homo sapiens
aatatagctgtacaaatata

SEQ ID NO: 149903 - DNA, 22 bp, Homo sapiens
aatatagctgtacaaatataag

SEQ ID NO: 149904 - DNA, 19 bp, Homo sapiens
aatatatggcagagttgta

SEQ ID NO: 149905 - DNA, 22 bp, Homo sapiens
aatatatggcagagttgtaaat

SEQ ID NO: 149906 - DNA, 19 bp, Homo sapiens
aatatatttaagataatta

SEQ ID NO: 149907 - DNA, 21 bp, Homo sapiens
aatatcagttactcagccctg

SEQ ID NO: 149908 - DNA, 22 bp, Homo sapiens
aatatcagttactcagccctgg

SEQ ID NO: 149909 - DNA, 18 bp, Homo sapiens
aatatccctacatgtatt

SEQ ID NO: 149910 - DNA, 21 bp, Homo sapiens
aatatctgggattctacttta

SEQ ID NO: 149911 - DNA, 19 bp, Homo sapiens
aatatgaacggtgagcatt

SEQ ID NO: 149912 - DNA, 22 bp, Homo sapiens
aatatgacagctgtccctgtca

SEQ ID NO: 149913 - DNA, 22 bp, Homo sapiens
aatatgattagtaaagaaatga

SEQ ID NO: 149914 - DNA, 15 bp, Homo sapiens
aatatgcaaagcact

SEQ ID NO: 149915 - DNA, 24 bp, Homo sapiens
aatatgcaaagcactgacttctaa

SEQ ID NO: 149916 - DNA, 18 bp, Homo sapiens
aatatggaacttctaata

SEQ ID NO: 149917 - DNA, 15 bp, Homo sapiens
aatatggctataaat

SEQ ID NO: 149918 - DNA, 22 bp, Homo sapiens
aatatgttgatgaaaaatagca

SEQ ID NO: 149919 - DNA, 14 bp, Homo sapiens
aatattgacttgta

SEQ ID NO: 149920 - DNA, 18 bp, Homo sapiens
aatattgatatgcttata

SEQ ID NO: 149921 - DNA, 14 bp, Homo sapiens
aatatttaaacagc

SEQ ID NO: 149922 - DNA, 16 bp, Homo sapiens
aatatttaaacagcag

SEQ ID NO: 149923 - DNA, 14 bp, Homo sapiens
aatatttatatatt

SEQ ID NO: 149924 - DNA, 15 bp, Homo sapiens
aatatttattacctc

SEQ ID NO: 149925 - DNA, 18 bp, Homo sapiens
aatatttattacctctga

SEQ ID NO: 149926 - DNA, 20 bp, Homo sapiens
aatatttattattttcacct

SEQ ID NO: 149927 - DNA, 13 bp, Homo sapiens
aatatttatttat

SEQ ID NO: 149928 - DNA, 20 bp, Homo sapiens
aatattttgctagtttttga

SEQ ID NO: 149929 - DNA, 18 bp, Homo sapiens
aatattttttcttttcta

SEQ ID NO: 149930 - DNA, 10 bp, Homo sapiens
aatcaaaact

SEQ ID NO: 149931 - DNA, 18 bp, Homo sapiens
aatcaaaactctcctaca

SEQ ID NO: 149932 - DNA, 13 bp, Homo sapiens
aatcaaaatatgt

SEQ ID NO: 149933 - DNA, 15 bp, Homo sapiens
aatcaaatatgcaaa

SEQ ID NO: 149934 - DNA, 15 bp, Homo sapiens
aatcaagcttcagtt

SEQ ID NO: 149935 - DNA, 19 bp, Homo sapiens
aatcacattcgagtgtttc

SEQ ID NO: 149936 - DNA, 15 bp, Homo sapiens
aatcagatctttatt

SEQ ID NO: 149937 - DNA, 12 bp, Homo sapiens
aatcagcattct

SEQ ID NO: 149938 - DNA, 18 bp, Homo sapiens
aatcagcattctcactcc

SEQ ID NO: 149939 - DNA, 19 bp, Homo sapiens
aatcagcattctcactcct

SEQ ID NO: 149940 - DNA, 23 bp, Homo sapiens
aatcagctatttactgccaaagg

SEQ ID NO: 149941 - DNA, 17 bp, Homo sapiens
aatcatgaaatatgcat

SEQ ID NO: 149942 - DNA, 22 bp, Homo sapiens
aatcatttctgcatcagctgct

SEQ ID NO: 149943 - DNA, 17 bp, Homo sapiens
aatcattttaattatta

SEQ ID NO: 149944 - DNA, 20 bp, Homo sapiens
aatcattttaattattattc

SEQ ID NO: 149945 - DNA, 20 bp, Homo sapiens
aatcattttatatgtcaaag

SEQ ID NO: 149946 - DNA, 17 bp, Homo sapiens
aatccaacccatgatga

SEQ ID NO: 149947 - DNA, 23 bp, Homo sapiens
aatccaagcgaggtcaacagaga

SEQ ID NO: 149948 - DNA, 23 bp, Homo sapiens
aatccctgtttaatatttaaaca

SEQ ID NO: 149949 - DNA, 21 bp, Homo sapiens
aatcctgtcctcagcttctta

SEQ ID NO: 149950 - DNA, 14 bp, Homo sapiens
aatcgattggcttt

SEQ ID NO: 149951 - DNA, 23 bp, Homo sapiens
aatcggatctggggctctgggat

SEQ ID NO: 149952 - DNA, 22 bp, Homo sapiens
aatcggcccacagctcccaccc

SEQ ID NO: 149953 - DNA, 15 bp, Homo sapiens
aatctaagtgatata

SEQ ID NO: 149954 - DNA, 19 bp, Homo sapiens
aatctacactccagtgaga

SEQ ID NO: 149955 - DNA, 20 bp, Homo sapiens
acgcacgtgggtcttcaggg

SEQ ID NO: 149956 - DNA, 21 bp, Homo sapiens
acgcagcaggaggccaggccg

SEQ ID NO: 149957 - DNA, 12 bp, Homo sapiens
acgcagccctgc

SEQ ID NO: 149958 - DNA, 22 bp, Homo sapiens
acgcagccctgctttgggctgc

SEQ ID NO: 149959 - DNA, 22 bp, Homo sapiens
acgcaggcccccaggtgccagt

SEQ ID NO: 149960 - DNA, 18 bp, Homo sapiens
acgccaggggaaaatcag

SEQ ID NO: 149961 - DNA, 13 bp, Homo sapiens
acgccctcccctc

SEQ ID NO: 149962 - DNA, 18 bp, Homo sapiens
acgccctcccctcccctg

SEQ ID NO: 149963 - DNA, 23 bp, Homo sapiens
acgccctcccctcccctgctgca

SEQ ID NO: 149964 - DNA, 13 bp, Homo sapiens
acgcctgaggaac

SEQ ID NO: 149965 - DNA, 17 bp, Homo sapiens
acgcctgcaaacgctgc

SEQ ID NO: 149966 - DNA, 19 bp, Homo sapiens
acgcctgtaatcccagcag

SEQ ID NO: 149967 - DNA, 14 bp, Homo sapiens
acgccttgttcttg

SEQ ID NO: 149968 - DNA, 15 bp, Homo sapiens
acgcgtctcctgttt

SEQ ID NO: 149969 - DNA, 12 bp, Homo sapiens
acgctgcctgcc

SEQ ID NO: 149970 - DNA, 20 bp, Homo sapiens
acgctggtagagatggagga

SEQ ID NO: 149971 - DNA, 21 bp, Homo sapiens
acgctggtagagatggaggag

SEQ ID NO: 149972 - DNA, 14 bp, Homo sapiens
acgctgtgggcagg

SEQ ID NO: 149973 - DNA, 15 bp, Homo sapiens
acggaagagccttgc

SEQ ID NO: 149974 - DNA, 16 bp, Homo sapiens
acggaagagccttgcg

SEQ ID NO: 149975 - DNA, 16 bp, Homo sapiens
acggacgtttccatca

SEQ ID NO: 149976 - DNA, 21 bp, Homo sapiens
acggcaggacaacgaggaagc

SEQ ID NO: 149977 - DNA, 22 bp, Homo sapiens
acggcaggacaacgaggaagcc

SEQ ID NO: 149978 - DNA, 18 bp, Homo sapiens
acgggcatgggcactccc

SEQ ID NO: 149979 - DNA, 16 bp, Homo sapiens
acggttcaccagcctc

SEQ ID NO: 149980 - DNA, 19 bp, Homo sapiens
acggttcaccagcctctct

SEQ ID NO: 149981 - DNA, 22 bp, Homo sapiens
acgtccctccacgttcacccct

SEQ ID NO: 149982 - DNA, 16 bp, Homo sapiens
acgtcctgccacctgg

SEQ ID NO: 149983 - DNA, 19 bp, Homo sapiens
acgtcgtcttctgtatact

SEQ ID NO: 149984 - DNA, 19 bp, Homo sapiens
acgtgccaggcccggggct

SEQ ID NO: 149985 - DNA, 20 bp, Homo sapiens
acgtgggcggcagagaggac

SEQ ID NO: 149986 - DNA, 14 bp, Homo sapiens
acgtggggcagcac

SEQ ID NO: 149987 - DNA, 11 bp, Homo sapiens
acgtgtgtgac

SEQ ID NO: 149988 - DNA, 15 bp, Homo sapiens
acgttaccaggcagg

SEQ ID NO: 149989 - DNA, 18 bp, Homo sapiens
acgttagaccacaaatag

SEQ ID NO: 149990 - DNA, 19 bp, Homo sapiens
acgttccttactgcagaat

SEQ ID NO: 149991 - DNA, 20 bp, Homo sapiens
acgttccttactgcagaata

SEQ ID NO: 149992 - DNA, 21 bp, Homo sapiens
acgttccttactgcagaatag

SEQ ID NO: 149993 - DNA, 12 bp, Homo sapiens
acgtttccatca

SEQ ID NO: 149994 - DNA, 15 bp, Homo sapiens
actaaactctctttg

SEQ ID NO: 149995 - DNA, 23 bp, Homo sapiens
actaaactctctttgggaatgtt

SEQ ID NO: 149996 - DNA, 13 bp, Homo sapiens
actaactaaactc

SEQ ID NO: 149997 - DNA, 15 bp, Homo sapiens
actaagccacaagaa

SEQ ID NO: 149998 - DNA, 15 bp, Homo sapiens
actaatttaaaaaat

SEQ ID NO: 149999 - DNA, 20 bp, Homo sapiens
actacacatccctaatgtgt

SEQ ID NO: 150000 - DNA, 15 bp, Homo sapiens
actacacattcaata

SEQ ID NO: 150001 - DNA, 19 bp, Homo sapiens
actacacattcaataagca

SEQ ID NO: 150002 - DNA, 13 bp, Homo sapiens
actacataaactg

SEQ ID NO: 150003 - DNA, 17 bp, Homo sapiens
actacataaactgactt

SEQ ID NO: 150004 - DNA, 19 bp, Homo sapiens
actacatcgccctccacat

SEQ ID NO: 150005 - DNA, 21 bp, Homo sapiens
actaccaagaggccctgtctg

SEQ ID NO: 150006 - DNA, 15 bp, Homo sapiens
actacgtgactgtgg

SEQ ID NO: 150007 - DNA, 18 bp, Homo sapiens
actataaaggttgacaat

SEQ ID NO: 150008 - DNA, 16 bp, Homo sapiens
actatgcctgtgtctt

SEQ ID NO: 150009 - DNA, 15 bp, Homo sapiens
actatggtatttgag

SEQ ID NO: 150010 - DNA, 21 bp, Homo sapiens
actattataatttaatgcatg

SEQ ID NO: 150011 - DNA, 13 bp, Homo sapiens
actattcaaacag

SEQ ID NO: 150012 - DNA, 15 bp, Homo sapiens
actattctgattaca

SEQ ID NO: 150013 - DNA, 22 bp, Homo sapiens
actattctgattacacaaaaca

SEQ ID NO: 150014 - DNA, 16 bp, Homo sapiens
actcaaactcttaaaa

SEQ ID NO: 150015 - DNA, 11 bp, Homo sapiens
actcaagccaa

SEQ ID NO: 150016 - DNA, 17 bp, Homo sapiens
actcaagccaagcagcc

SEQ ID NO: 150017 - DNA, 19 bp, Homo sapiens
actcaagccaagcagccaa

SEQ ID NO: 150018 - DNA, 22 bp, Homo sapiens
actcaagccaagcagccaagct

SEQ ID NO: 150019 - DNA, 23 bp, Homo sapiens
actcaagtgtctcagtccacctg

SEQ ID NO: 150020 - DNA, 17 bp, Homo sapiens
actcaccagtgtcccct

SEQ ID NO: 150021 - DNA, 19 bp, Homo sapiens
actcaccagtgtcccctcc

SEQ ID NO: 150022 - DNA, 15 bp, Homo sapiens
actcaccatgtaaaa

SEQ ID NO: 150023 - DNA, 12 bp, Homo sapiens
actcacccaagc

SEQ ID NO: 150024 - DNA, 14 bp, Homo sapiens
actcacctctgcct

SEQ ID NO: 150025 - DNA, 15 bp, Homo sapiens
actcacctctgcctc

SEQ ID NO: 150026 - DNA, 15 bp, Homo sapiens
actcactttctagat

SEQ ID NO: 150027 - DNA, 16 bp, Homo sapiens
actcagaagcctctgg

SEQ ID NO: 150028 - DNA, 23 bp, Homo sapiens
actcagatggaaccgcaggaagc

SEQ ID NO: 150029 - DNA, 19 bp, Homo sapiens
actcagcagccctcctcac

SEQ ID NO: 150030 - DNA, 21 bp, Homo sapiens
actcagcagccctcctcaccc

SEQ ID NO: 150031 - DNA, 22 bp, Homo sapiens
actcagccctgggccccaccac

SEQ ID NO: 150032 - DNA, 14 bp, Homo sapiens
actcagctccgtga

SEQ ID NO: 150033 - DNA, 20 bp, Homo sapiens
actcaggaggctgaggcaga

SEQ ID NO: 150034 - DNA, 14 bp, Homo sapiens
actcaggatgccca

SEQ ID NO: 150035 - DNA, 18 bp, Homo sapiens
actcaggatgcccagggc

SEQ ID NO: 150036 - DNA, 13 bp, Homo sapiens
actcagggacaga

SEQ ID NO: 150037 - DNA, 13 bp, Homo sapiens
actcagggcccca

SEQ ID NO: 150038 - DNA, 18 bp, Homo sapiens
actcagggccccagcact

SEQ ID NO: 150039 - DNA, 22 bp, Homo sapiens
actcagggccccagcactaaag

SEQ ID NO: 150040 - DNA, 9 bp, Homo sapiens
actcatcat

SEQ ID NO: 150041 - DNA, 17 bp, Homo sapiens
actcatcataaaataaa

SEQ ID NO: 150042 - DNA, 15 bp, Homo sapiens
actcattctgaagga

SEQ ID NO: 150043 - DNA, 19 bp, Homo sapiens
actcattctgaaggagccc

SEQ ID NO: 150044 - DNA, 15 bp, Homo sapiens
actccaaagaaatgt

SEQ ID NO: 150045 - DNA, 15 bp, Homo sapiens
actccagacccctgg

SEQ ID NO: 150046 - DNA, 18 bp, Homo sapiens
actccagacccctggctt

SEQ ID NO: 150047 - DNA, 19 bp, Homo sapiens
actccagacccctggcttt

SEQ ID NO: 150048 - DNA, 20 bp, Homo sapiens
actccagctgggttggaaaa

SEQ ID NO: 150049 - DNA, 19 bp, Homo sapiens
actccagtgagacagctct

SEQ ID NO: 150050 - DNA, 20 bp, Homo sapiens
actccagttaaaaaaaattt

SEQ ID NO: 150051 - DNA, 14 bp, Homo sapiens
actccatgagaagc

SEQ ID NO: 150052 - DNA, 15 bp, Homo sapiens
actcccaagctggac

SEQ ID NO: 150053 - DNA, 19 bp, Homo sapiens
actcccaagtctacagagt

SEQ ID NO: 150054 - DNA, 12 bp, Homo sapiens
actcccctgcac

SEQ ID NO: 150055 - DNA, 14 bp, Homo sapiens
actcctctgtccag

SEQ ID NO: 150056 - DNA, 18 bp, Homo sapiens
actccttgtggtttatgt

SEQ ID NO: 150057 - DNA, 19 bp, Homo sapiens
actctacccatattacaga

SEQ ID NO: 150058 - DNA, 20 bp, Homo sapiens
actctacttagcatgtccct

SEQ ID NO: 150059 - DNA, 18 bp, Homo sapiens
actctatagactctagga

SEQ ID NO: 150060 - DNA, 22 bp, Homo sapiens
actctcaggatcaagaaagtgt

SEQ ID NO: 150061 - DNA, 14 bp, Homo sapiens
actctcattcccca

SEQ ID NO: 150062 - DNA, 15 bp, Homo sapiens
actctcattccccag

SEQ ID NO: 150063 - DNA, 16 bp, Homo sapiens
actctcattccccagg

SEQ ID NO: 150064 - DNA, 17 bp, Homo sapiens
actctccaacctggaca

SEQ ID NO: 150065 - DNA, 12 bp, Homo sapiens
actctgcctcct

SEQ ID NO: 150066 - DNA, 11 bp, Homo sapiens
actctgcctct

SEQ ID NO: 150067 - DNA, 16 bp, Homo sapiens
actctgcctctgcctg

SEQ ID NO: 150068 - DNA, 22 bp, Homo sapiens
actctgctgtctaacctgtgac

SEQ ID NO: 150069 - DNA, 23 bp, Homo sapiens
actctgctgtctaacctgtgacc

SEQ ID NO: 150070 - DNA, 13 bp, Homo sapiens
aaaaaaatgacta

SEQ ID NO: 150071 - DNA, 22 bp, Homo sapiens
aaaaaactgctgactgttttct

SEQ ID NO: 150072 - DNA, 13 bp, Homo sapiens
aaaaaagatatat

SEQ ID NO: 150073 - DNA, 22 bp, Homo sapiens
aaaaaccttgtatatcttgttt

SEQ ID NO: 150074 - DNA, 20 bp, Homo sapiens
aaaaactaaatctctaatat

SEQ ID NO: 150075 - DNA, 12 bp, Homo sapiens
aaaaacttgtaa

SEQ ID NO: 150076 - DNA, 18 bp, Homo sapiens
aaaaacttgtaaatgctg

SEQ ID NO: 150077 - DNA, 14 bp, Homo sapiens
aaaaagaaaagata

SEQ ID NO: 150078 - DNA, 13 bp, Homo sapiens
aaaaagatatatt

SEQ ID NO: 150079 - DNA, 20 bp, Homo sapiens
aaaaagcctgcaatttcata

SEQ ID NO: 150080 - DNA, 18 bp, Homo sapiens
aaaaagctcatattttgt

SEQ ID NO: 150081 - DNA, 12 bp, Homo sapiens
aaaaaggcagga

SEQ ID NO: 150082 - DNA, 14 bp, Homo sapiens
aaaaatacatgcat

SEQ ID NO: 150083 - DNA, 15 bp, Homo sapiens
aaaaatatatttaat

SEQ ID NO: 150084 - DNA, 19 bp, Homo sapiens
aaaaatatatttaatgata

SEQ ID NO: 150085 - DNA, 22 bp, Homo sapiens
aaaaatggaacataaaatacaa

SEQ ID NO: 150086 - DNA, 16 bp, Homo sapiens
aaaacaaaaagaacaa

SEQ ID NO: 150087 - DNA, 23 bp, Homo sapiens
aaaacacagacattctgccaggc

SEQ ID NO: 150088 - DNA, 18 bp, Homo sapiens
aaaacacagcaagggtga

SEQ ID NO: 150089 - DNA, 18 bp, Homo sapiens
aaaacaggtcaatacagt

SEQ ID NO: 150090 - DNA, 16 bp, Homo sapiens
aaaacatggtagaatt

SEQ ID NO: 150091 - DNA, 12 bp, Homo sapiens
aaaacccaagtg

SEQ ID NO: 150092 - DNA, 15 bp, Homo sapiens
aaaacccagagagga

SEQ ID NO: 150093 - DNA, 15 bp, Homo sapiens
aaaaccctgccccca

SEQ ID NO: 150094 - DNA, 19 bp, Homo sapiens
aaaactaaatctctaatat

SEQ ID NO: 150095 - DNA, 15 bp, Homo sapiens
aaaactgacagagga

SEQ ID NO: 150096 - DNA, 19 bp, Homo sapiens
aaaactgcgttaaaggctc

SEQ ID NO: 150097 - DNA, 20 bp, Homo sapiens
aaaactgctgactgttttct

SEQ ID NO: 150098 - DNA, 17 bp, Homo sapiens
aaaacttaacatattta

SEQ ID NO: 150099 - DNA, 11 bp, Homo sapiens
aaaagaaaaag

SEQ ID NO: 150100 - DNA, 16 bp, Homo sapiens
aaaagaatacagaaag

SEQ ID NO: 150101 - DNA, 12 bp, Homo sapiens
aaaagaatattt

SEQ ID NO: 150102 - DNA, 13 bp, Homo sapiens
aaaagactccaaa

SEQ ID NO: 150103 - DNA, 15 bp, Homo sapiens
aaaagaggggctggg

SEQ ID NO: 150104 - DNA, 20 bp, Homo sapiens
aaaagataaagatgatctac

SEQ ID NO: 150105 - DNA, 11 bp, Homo sapiens
aaaagatatat

SEQ ID NO: 150106 - DNA, 21 bp, Homo sapiens
aaaagattttcagaaaatatt

SEQ ID NO: 150107 - DNA, 14 bp, Homo sapiens
aaaagcaaaatcat

SEQ ID NO: 150108 - DNA, 14 bp, Homo sapiens
aaaagctgggcagg

SEQ ID NO: 150109 - DNA, 11 bp, Homo sapiens
aaaaggcagga

SEQ ID NO: 150110 - DNA, 19 bp, Homo sapiens
aaaagggaagttgtgcctt

SEQ ID NO: 150111 - DNA, 11 bp, Homo sapiens
aaaataaaaac

SEQ ID NO: 150112 - DNA, 11 bp, Homo sapiens
aaaataaatat

SEQ ID NO: 150113 - DNA, 12 bp, Homo sapiens
aaaataaatata

SEQ ID NO: 150114 - DNA, 12 bp, Homo sapiens
aaaataaattat

SEQ ID NO: 150115 - DNA, 15 bp, Homo sapiens
aaaataacttatatc

SEQ ID NO: 150116 - DNA, 23 bp, Homo sapiens
aaaatagcaacctttttatctcc

SEQ ID NO: 150117 - DNA, 19 bp, Homo sapiens
aaaatagcttgtatagtgt

SEQ ID NO: 150118 - DNA, 21 bp, Homo sapiens
aaaatagcttgtatagtgtaa

SEQ ID NO: 150119 - DNA, 16 bp, Homo sapiens
aaaatatagctgtaca

SEQ ID NO: 150120 - DNA, 16 bp, Homo sapiens
aaaatatatttaatga

SEQ ID NO: 150121 - DNA, 16 bp, Homo sapiens
aaaatatggaacttct

SEQ ID NO: 150122 - DNA, 21 bp, Homo sapiens
aaaatatggaacttctaatat

SEQ ID NO: 150123 - DNA, 16 bp, Homo sapiens
aaaatattataactta

SEQ ID NO: 150124 - DNA, 19 bp, Homo sapiens
aaaatattataacttaaaa

SEQ ID NO: 150125 - DNA, 16 bp, Homo sapiens
aaaatattttcctgcc

SEQ ID NO: 150126 - DNA, 13 bp, Homo sapiens
aaaatcagcctgc

SEQ ID NO: 150127 - DNA, 12 bp, Homo sapiens
aaaatcatgaga

SEQ ID NO: 150128 - DNA, 19 bp, Homo sapiens
aaaatcattttatatgtca

SEQ ID NO: 150129 - DNA, 15 bp, Homo sapiens
aaaatctaatattaa

SEQ ID NO: 150130 - DNA, 20 bp, Homo sapiens
aaaatctattttgtaacttt

SEQ ID NO: 150131 - DNA, 20 bp, Homo sapiens
aaaatctgtcacgtagaact

SEQ ID NO: 150132 - DNA, 14 bp, Homo sapiens
aaaatgagcctggc

SEQ ID NO: 150133 - DNA, 18 bp, Homo sapiens
aaaatgaggaatgtatat

SEQ ID NO: 150134 - DNA, 16 bp, Homo sapiens
aaaatgattgtaaaat

SEQ ID NO: 150135 - DNA, 14 bp, Homo sapiens
aaaatgattttatc

SEQ ID NO: 150136 - DNA, 21 bp, Homo sapiens
aaaatgtagggttataataat

SEQ ID NO: 150137 - DNA, 17 bp, Homo sapiens
aaaatgtatatgcactt

SEQ ID NO: 150138 - DNA, 18 bp, Homo sapiens
aaaatgtcttgtgttacc

SEQ ID NO: 150139 - DNA, 11 bp, Homo sapiens
aaaatgtgtaa

SEQ ID NO: 150140 - DNA, 17 bp, Homo sapiens
aaaatgtgtaattttgt

SEQ ID NO: 150141 - DNA, 13 bp, Homo sapiens
aaaatgttgaaaa

SEQ ID NO: 150142 - DNA, 17 bp, Homo sapiens
aaaatgttgaaaagtca

SEQ ID NO: 150143 - DNA, 19 bp, Homo sapiens
aaaattatttcagaaatgt

SEQ ID NO: 150144 - DNA, 14 bp, Homo sapiens
aaaattatttgcat

SEQ ID NO: 150145 - DNA, 18 bp, Homo sapiens
aaaattattttaaacaaa

SEQ ID NO: 150146 - DNA, 13 bp, Homo sapiens
aaaattgtgatca

SEQ ID NO: 150147 - DNA, 20 bp, Homo sapiens
aaaatttcacattaatattt

SEQ ID NO: 150148 - DNA, 22 bp, Homo sapiens
aaaatttgttttgacggatgat

SEQ ID NO: 150149 - DNA, 11 bp, Homo sapiens
aaacaaaaaga

SEQ ID NO: 150150 - DNA, 16 bp, Homo sapiens
aaacaaaaagaacaaa

SEQ ID NO: 150151 - DNA, 13 bp, Homo sapiens
aaacaaagccaga

SEQ ID NO: 150152 - DNA, 19 bp, Homo sapiens
aaacaacttcaatatccaa

SEQ ID NO: 150153 - DNA, 15 bp, Homo sapiens
aaacaataaagagat

SEQ ID NO: 150154 - DNA, 19 bp, Homo sapiens
aaacacaaacgggctcagc

SEQ ID NO: 150155 - DNA, 15 bp, Homo sapiens
aaacacactgaggca

SEQ ID NO: 150156 - DNA, 14 bp, Homo sapiens
aaacacagcaaggg

SEQ ID NO: 150157 - DNA, 15 bp, Homo sapiens
aaacagcctcacaga

SEQ ID NO: 150158 - DNA, 21 bp, Homo sapiens
aaacagcgctgggtccacccc

SEQ ID NO: 150159 - DNA, 15 bp, Homo sapiens
aaacagtctcaggaa

SEQ ID NO: 150160 - DNA, 17 bp, Homo sapiens
aaacataaataaaatga

SEQ ID NO: 150161 - DNA, 19 bp, Homo sapiens
aaacatgaccctaaatctt

SEQ ID NO: 150162 - DNA, 14 bp, Homo sapiens
aaacattaagaaaa

SEQ ID NO: 150163 - DNA, 15 bp, Homo sapiens
aaacattaagaaaat

SEQ ID NO: 150164 - DNA, 19 bp, Homo sapiens
aaacattaagaaaatcata

SEQ ID NO: 150165 - DNA, 12 bp, Homo sapiens
aaacattctatc

SEQ ID NO: 150166 - DNA, 11 bp, Homo sapiens
agcagtggctg

SEQ ID NO: 150167 - DNA, 18 bp, Homo sapiens
agcagtggctggtccagg

SEQ ID NO: 150168 - DNA, 15 bp, Homo sapiens
agcagtgtcatcaga

SEQ ID NO: 150169 - DNA, 19 bp, Homo sapiens
agcagtgtcatcagaagat

SEQ ID NO: 150170 - DNA, 15 bp, Homo sapiens
agcagtgtgaggcca

SEQ ID NO: 150171 - DNA, 23 bp, Homo sapiens
agcagttgaaaagactccaaaga

SEQ ID NO: 150172 - DNA, 17 bp, Homo sapiens
agcataagtttctggga

SEQ ID NO: 150173 - DNA, 13 bp, Homo sapiens
agcataccaacac

SEQ ID NO: 150174 - DNA, 23 bp, Homo sapiens
agcatatgaggatgcagagtcag

SEQ ID NO: 150175 - DNA, 14 bp, Homo sapiens
agcatcaaactctt

SEQ ID NO: 150176 - DNA, 14 bp, Homo sapiens
agcatctcatgagt

SEQ ID NO: 150177 - DNA, 13 bp, Homo sapiens
agcatgaggaact

SEQ ID NO: 150178 - DNA, 21 bp, Homo sapiens
agcatgtactgagccttgtaa

SEQ ID NO: 150179 - DNA, 15 bp, Homo sapiens
agcatgtaggagaat

SEQ ID NO: 150180 - DNA, 18 bp, Homo sapiens
agcattcacaacttgttt

SEQ ID NO: 150181 - DNA, 16 bp, Homo sapiens
agcattcagagagcag

SEQ ID NO: 150182 - DNA, 17 bp, Homo sapiens
agcattcagagagcagc

SEQ ID NO: 150183 - DNA, 22 bp, Homo sapiens
agcattctcactcctacctggt

SEQ ID NO: 150184 - DNA, 15 bp, Homo sapiens
agcattttgctaaat

SEQ ID NO: 150185 - DNA, 22 bp, Homo sapiens
agcattttgctaaatgtgaatg

SEQ ID NO: 150186 - DNA, 15 bp, Homo sapiens
agccaaaccctgtct

SEQ ID NO: 150187 - DNA, 23 bp, Homo sapiens
agccaacaccctgtctaaaaaac

SEQ ID NO: 150188 - DNA, 13 bp, Homo sapiens
agccaagcagcca

SEQ ID NO: 150189 - DNA, 16 bp, Homo sapiens
agccaagcagccaagc

SEQ ID NO: 150190 - DNA, 15 bp, Homo sapiens
agccaagggcctctt

SEQ ID NO: 150191 - DNA, 22 bp, Homo sapiens
agccaagggttcagagactcag

SEQ ID NO: 150192 - DNA, 17 bp, Homo sapiens
agccaccacgtccagct

SEQ ID NO: 150193 - DNA, 18 bp, Homo sapiens
agccaccccagaaatggt

SEQ ID NO: 150194 - DNA, 20 bp, Homo sapiens
agccaccccagaaatggtga

SEQ ID NO: 150195 - DNA, 17 bp, Homo sapiens
agccacgttccttactg

SEQ ID NO: 150196 - DNA, 18 bp, Homo sapiens
agccacgttccttactgc

SEQ ID NO: 150197 - DNA, 23 bp, Homo sapiens
agccacgttccttactgcagaat

SEQ ID NO: 150198 - DNA, 14 bp, Homo sapiens
agccactcctctga

SEQ ID NO: 150199 - DNA, 15 bp, Homo sapiens
agccagcccagccca

SEQ ID NO: 150200 - DNA, 15 bp, Homo sapiens
agccagccctccctg

SEQ ID NO: 150201 - DNA, 16 bp, Homo sapiens
agccagccctccctgt

SEQ ID NO: 150202 - DNA, 22 bp, Homo sapiens
agccagccctccctgtcctcct

SEQ ID NO: 150203 - DNA, 23 bp, Homo sapiens
agccagccttcttccatcccagg

SEQ ID NO: 150204 - DNA, 16 bp, Homo sapiens
agccagcgtcctcctc

SEQ ID NO: 150205 - DNA, 23 bp, Homo sapiens
agccagcgtcctcctctgtgacc

SEQ ID NO: 150206 - DNA, 13 bp, Homo sapiens
agccagctctcag

SEQ ID NO: 150207 - DNA, 16 bp, Homo sapiens
agccagctctcagcca

SEQ ID NO: 150208 - DNA, 18 bp, Homo sapiens
agccagggggactagccc

SEQ ID NO: 150209 - DNA, 23 bp, Homo sapiens
agccagggggactagcccctgtg

SEQ ID NO: 150210 - DNA, 18 bp, Homo sapiens
agccagtgacctgaggaa

SEQ ID NO: 150211 - DNA, 19 bp, Homo sapiens
agccagtgacctgaggaag

SEQ ID NO: 150212 - DNA, 18 bp, Homo sapiens
agccatgaggagttgctg

SEQ ID NO: 150213 - DNA, 19 bp, Homo sapiens
agccatgaggagttgctgt

SEQ ID NO: 150214 - DNA, 18 bp, Homo sapiens
agccatgataactgcaat

SEQ ID NO: 150215 - DNA, 16 bp, Homo sapiens
agcccaatattataat

SEQ ID NO: 150216 - DNA, 23 bp, Homo sapiens
agcccacccctcaacacctctgc

SEQ ID NO: 150217 - DNA, 14 bp, Homo sapiens
agcccactctgctc

SEQ ID NO: 150218 - DNA, 15 bp, Homo sapiens
agcccactctgctcg

SEQ ID NO: 150219 - DNA, 15 bp, Homo sapiens
agcccagcccagctg

SEQ ID NO: 150220 - DNA, 14 bp, Homo sapiens
agcccagctctgaa

SEQ ID NO: 150221 - DNA, 13 bp, Homo sapiens
agcccagctggtg

SEQ ID NO: 150222 - DNA, 14 bp, Homo sapiens
agcccaggagagag

SEQ ID NO: 150223 - DNA, 15 bp, Homo sapiens
agcccaggagagaga

SEQ ID NO: 150224 - DNA, 16 bp, Homo sapiens
agcccaggagagagaa

SEQ ID NO: 150225 - DNA, 18 bp, Homo sapiens
agcccaggagagagaaag

SEQ ID NO: 150226 - DNA, 23 bp, Homo sapiens
agcccagggagcggaaagcagct

SEQ ID NO: 150227 - DNA, 17 bp, Homo sapiens
agcccatccctgcctgg

SEQ ID NO: 150228 - DNA, 18 bp, Homo sapiens
agcccatccctgcctggt

SEQ ID NO: 150229 - DNA, 15 bp, Homo sapiens
agcccattctctctc

SEQ ID NO: 150230 - DNA, 18 bp, Homo sapiens
agcccattctctctcctg

SEQ ID NO: 150231 - DNA, 20 bp, Homo sapiens
agcccattctctctcctgtc

SEQ ID NO: 150232 - DNA, 21 bp, Homo sapiens
agcccattctctctcctgtcc

SEQ ID NO: 150233 - DNA, 22 bp, Homo sapiens
agcccattctctctcctgtcca

SEQ ID NO: 150234 - DNA, 15 bp, Homo sapiens
agccccaggcctctg

SEQ ID NO: 150235 - DNA, 21 bp, Homo sapiens
agccccaggcctctgtgtcct

SEQ ID NO: 150236 - DNA, 23 bp, Homo sapiens
agccccagtgccaagcacagtgc

SEQ ID NO: 150237 - DNA, 23 bp, Homo sapiens
agccccataattttttttttcct

SEQ ID NO: 150238 - DNA, 12 bp, Homo sapiens
agcccctagccc

SEQ ID NO: 150239 - DNA, 21 bp, Homo sapiens
agcccctagcccaggagagag

SEQ ID NO: 150240 - DNA, 12 bp, Homo sapiens
agcccctcctct

SEQ ID NO: 150241 - DNA, 13 bp, Homo sapiens
agcccctcctctg

SEQ ID NO: 150242 - DNA, 15 bp, Homo sapiens
agcccctcctctgcc

SEQ ID NO: 150243 - DNA, 17 bp, Homo sapiens
agcccctcctctgccac

SEQ ID NO: 150244 - DNA, 20 bp, Homo sapiens
agcccctcctctgccacctc

SEQ ID NO: 150245 - DNA, 21 bp, Homo sapiens
agcccctcctctgccacctcc

SEQ ID NO: 150246 - DNA, 14 bp, Homo sapiens
agcccctggtcctg

SEQ ID NO: 150247 - DNA, 18 bp, Homo sapiens
agccccttctcagaatct

SEQ ID NO: 150248 - DNA, 17 bp, Homo sapiens
agccccttgagaaacct

SEQ ID NO: 150249 - DNA, 20 bp, Homo sapiens
agccccttgctctcccctgc

SEQ ID NO: 150250 - DNA, 13 bp, Homo sapiens
agccctccctgcc

SEQ ID NO: 150251 - DNA, 16 bp, Homo sapiens
agccctccctgcccct

SEQ ID NO: 150252 - DNA, 19 bp, Homo sapiens
agccctccctgcccctccc

SEQ ID NO: 150253 - DNA, 14 bp, Homo sapiens
agccctccctgtcc

SEQ ID NO: 150254 - DNA, 17 bp, Homo sapiens
agccctccctgtcctcc

SEQ ID NO: 150255 - DNA, 20 bp, Homo sapiens
agccctccctgtcctcctcg

SEQ ID NO: 150256 - DNA, 17 bp, Homo sapiens
agccctccttccacgga

SEQ ID NO: 150257 - DNA, 17 bp, Homo sapiens
agccctcttccatcatg

SEQ ID NO: 150258 - DNA, 15 bp, Homo sapiens
agccctgagctttct

SEQ ID NO: 150259 - DNA, 22 bp, Homo sapiens
agccctgctttgggctgccctg

SEQ ID NO: 150260 - DNA, 15 bp, Homo sapiens
agccctggccagagg

SEQ ID NO: 150261 - DNA, 23 bp, Homo sapiens
agccctgggccccaccacctagg

SEQ ID NO: 150262 - DNA, 22 bp, Homo sapiens
agccctgtggatgagccctcag

SEQ ID NO: 150263 - DNA, 12 bp, Homo sapiens
agccctttctgt

SEQ ID NO: 150264 - DNA, 16 bp, Homo sapiens
agccctttctgtgtgc

SEQ ID NO: 150265 - DNA, 13 bp, Homo sapiens
agccgacctcagc

SEQ ID NO: 150266 - DNA, 15 bp, Homo sapiens
agccgacctcagcct

SEQ ID NO: 150267 - DNA, 14 bp, Homo sapiens
agccgagagcctgc

SEQ ID NO: 150268 - DNA, 18 bp, Homo sapiens
agccgagagcctgctccc

SEQ ID NO: 150269 - DNA, 21 bp, Homo sapiens
agccgagagcctgctccccca

SEQ ID NO: 150270 - DNA, 18 bp, Homo sapiens
agccgattcacctgagca

SEQ ID NO: 150271 - DNA, 16 bp, Homo sapiens
agccgctcctgtctgc

SEQ ID NO: 150272 - DNA, 22 bp, Homo sapiens
agccgctcctgtctgccagcca

SEQ ID NO: 150273 - DNA, 16 bp, Homo sapiens
agccgctgtgagcccc

SEQ ID NO: 150274 - DNA, 14 bp, Homo sapiens
agccggcacagggt

SEQ ID NO: 150275 - DNA, 20 bp, Homo sapiens
agccgggtctgcctcttctg

SEQ ID NO: 150276 - DNA, 16 bp, Homo sapiens
agccgtgccctgcccc

SEQ ID NO: 150277 - DNA, 13 bp, Homo sapiens
agccgtggcttcc

SEQ ID NO: 150278 - DNA, 23 bp, Homo sapiens
agccgtggcttcccgctcagccc

SEQ ID NO: 150279 - DNA, 18 bp, Homo sapiens
agcctagccgacctcagc

SEQ ID NO: 150280 - DNA, 14 bp, Homo sapiens
agcctagtgaaggc

SEQ ID NO: 150281 - DNA, 20 bp, Homo sapiens
agcctagtgaaggcttctct

SEQ ID NO: 150282 - DNA, 15 bp, Homo sapiens
agcctcagtcctccc

SEQ ID NO: 150283 - DNA, 16 bp, Homo sapiens
agcctcatatttaaag

SEQ ID NO: 150284 - DNA, 17 bp, Homo sapiens
agcctcatccgaggcag

SEQ ID NO: 150285 - DNA, 19 bp, Homo sapiens
agcctcatccgaggcaggg

SEQ ID NO: 150286 - DNA, 20 bp, Homo sapiens
agcctcatccgaggcagggt

SEQ ID NO: 150287 - DNA, 15 bp, Homo sapiens
agcctcatgtccact

SEQ ID NO: 150288 - DNA, 21 bp, Homo sapiens
agcctccaagctccatctcca

SEQ ID NO: 150289 - DNA, 20 bp, Homo sapiens
agcctccatgctgcctccag

SEQ ID NO: 150290 - DNA, 23 bp, Homo sapiens
agcctccggagtagctgggacca

SEQ ID NO: 150291 - DNA, 17 bp, Homo sapiens
agcctccgtatttcaga

SEQ ID NO: 150292 - DNA, 19 bp, Homo sapiens
agcctcctcctgaccacgg

SEQ ID NO: 150293 - DNA, 21 bp, Homo sapiens
agcctcctgtgtagctgggat

SEQ ID NO: 150294 - DNA, 18 bp, Homo sapiens
agcctctgacccctcctc

SEQ ID NO: 150295 - DNA, 22 bp, Homo sapiens
agcctctgacccctcctcactg

SEQ ID NO: 150296 - DNA, 20 bp, Homo sapiens
agcctcttaaagctgcctgt

SEQ ID NO: 150297 - DNA, 21 bp, Homo sapiens
agcctctttctgtcccttctg

SEQ ID NO: 150298 - DNA, 22 bp, Homo sapiens
agcctgaaagaggaatgaagta

SEQ ID NO: 150299 - DNA, 19 bp, Homo sapiens
agcctgagcgacagtgaga

SEQ ID NO: 150300 - DNA, 19 bp, Homo sapiens
agcctgcaatttcatatgc

SEQ ID NO: 150301 - DNA, 17 bp, Homo sapiens
agcctgcaggtgctgct

SEQ ID NO: 150302 - DNA, 11 bp, Homo sapiens
agcctgctccc

SEQ ID NO: 150303 - DNA, 18 bp, Homo sapiens
agcctggcacagggcagt

SEQ ID NO: 150304 - DNA, 16 bp, Homo sapiens
agcctggccccatggt

SEQ ID NO: 150305 - DNA, 20 bp, Homo sapiens
agcctgggaggtcaaggctg

SEQ ID NO: 150306 - DNA, 22 bp, Homo sapiens
agcctgggtgacagagcaagtg

SEQ ID NO: 150307 - DNA, 16 bp, Homo sapiens
ccctccttccttgacc

SEQ ID NO: 150308 - DNA, 18 bp, Homo sapiens
ccctccttccttgaccag

SEQ ID NO: 150309 - DNA, 15 bp, Homo sapiens
ccctcgtggccttcc

SEQ ID NO: 150310 - DNA, 12 bp, Homo sapiens
ccctctcctgcc

SEQ ID NO: 150311 - DNA, 13 bp, Homo sapiens
ccctctctcctcc

SEQ ID NO: 150312 - DNA, 13 bp, Homo sapiens
ccctctgccacca

SEQ ID NO: 150313 - DNA, 19 bp, Homo sapiens
ccctctgccaccagagacc

SEQ ID NO: 150314 - DNA, 16 bp, Homo sapiens
ccctgaaaacccagag

SEQ ID NO: 150315 - DNA, 18 bp, Homo sapiens
ccctgaaaacccagagag

SEQ ID NO: 150316 - DNA, 18 bp, Homo sapiens
ccctgaaagccctgagct

SEQ ID NO: 150317 - DNA, 14 bp, Homo sapiens
ccctgaagccagcc

SEQ ID NO: 150318 - DNA, 17 bp, Homo sapiens
ccctgaagccagccttc

SEQ ID NO: 150319 - DNA, 17 bp, Homo sapiens
ccctgacctccctctaa

SEQ ID NO: 150320 - DNA, 14 bp, Homo sapiens
ccctgagcaggatt

SEQ ID NO: 150321 - DNA, 12 bp, Homo sapiens
ccctgagctcgg

SEQ ID NO: 150322 - DNA, 13 bp, Homo sapiens
ccctgagctgagg

SEQ ID NO: 150323 - DNA, 21 bp, Homo sapiens
ccctgagctgaggcagcagtg

SEQ ID NO: 150324 - DNA, 16 bp, Homo sapiens
ccctgagtcaccagga

SEQ ID NO: 150325 - DNA, 23 bp, Homo sapiens
ccctgcaaaatttgatgccagga

SEQ ID NO: 150326 - DNA, 23 bp, Homo sapiens
catctttcttctattttattccc

SEQ ID NO: 150327 - DNA, 13 bp, Homo sapiens
catcttttacatt

SEQ ID NO: 150328 - DNA, 14 bp, Homo sapiens
catgaagacaggat

SEQ ID NO: 150329 - DNA, 18 bp, Homo sapiens
catgaagatgtagaggag

SEQ ID NO: 150330 - DNA, 23 bp, Homo sapiens
catgacacagctttatcaccaga

SEQ ID NO: 150331 - DNA, 12 bp, Homo sapiens
catgacatgtta

SEQ ID NO: 150332 - DNA, 15 bp, Homo sapiens
catgacatgttatat

SEQ ID NO: 150333 - DNA, 16 bp, Homo sapiens
catgacatgttatata

SEQ ID NO: 150334 - DNA, 16 bp, Homo sapiens
catgagctatttccat

SEQ ID NO: 150335 - DNA, 19 bp, Homo sapiens
catgatgagctcctcttcc

SEQ ID NO: 150336 - DNA, 23 bp, Homo sapiens
catgattaaccacttcagctgac

SEQ ID NO: 150337 - DNA, 20 bp, Homo sapiens
catgccagcttatctcaggg

SEQ ID NO: 150338 - DNA, 13 bp, Homo sapiens
catgccttccagc

SEQ ID NO: 150339 - DNA, 15 bp, Homo sapiens
catgccttccagcac

SEQ ID NO: 150340 - DNA, 13 bp, Homo sapiens
catgctcctggcc

SEQ ID NO: 150341 - DNA, 20 bp, Homo sapiens
catgctcctggcccactgca

SEQ ID NO: 150342 - DNA, 14 bp, Homo sapiens
catgctctctgcag

SEQ ID NO: 150343 - DNA, 15 bp, Homo sapiens
catgctctctgcagc

SEQ ID NO: 150344 - DNA, 13 bp, Homo sapiens
catgcttgtgtta

SEQ ID NO: 150345 - DNA, 16 bp, Homo sapiens
catggaactcattcct

SEQ ID NO: 150346 - DNA, 19 bp, Homo sapiens
catggaactcattcctgcc

SEQ ID NO: 150347 - DNA, 12 bp, Homo sapiens
catggacactcc

SEQ ID NO: 150348 - DNA, 17 bp, Homo sapiens
catggagaaaccctgtc

SEQ ID NO: 150349 - DNA, 13 bp, Homo sapiens
catggaggcacac

SEQ ID NO: 150350 - DNA, 20 bp, Homo sapiens
catggcaccaaagccaccag

SEQ ID NO: 150351 - DNA, 13 bp, Homo sapiens
catgggagccggg

SEQ ID NO: 150352 - DNA, 16 bp, Homo sapiens
catggtcagccctagg

SEQ ID NO: 150353 - DNA, 20 bp, Homo sapiens
catggtccggtgtccttttc

SEQ ID NO: 150354 - DNA, 18 bp, Homo sapiens
catggtggcgcaagcctg

SEQ ID NO: 150355 - DNA, 22 bp, Homo sapiens
catggtgggtccatgggcagag

SEQ ID NO: 150356 - DNA, 14 bp, Homo sapiens
catgtaaaagagtc

SEQ ID NO: 150357 - DNA, 16 bp, Homo sapiens
catgtaaaagagtcat

SEQ ID NO: 150358 - DNA, 23 bp, Homo sapiens
catgtactgagccttgtaattct

SEQ ID NO: 150359 - DNA, 14 bp, Homo sapiens
catgtcagcaaaaa

SEQ ID NO: 150360 - DNA, 16 bp, Homo sapiens
catgtccctaccgagt

SEQ ID NO: 150361 - DNA, 20 bp, Homo sapiens
catgtcgcctctgcattcag

SEQ ID NO: 150362 - DNA, 12 bp, Homo sapiens
catgtgacattt

SEQ ID NO: 150363 - DNA, 18 bp, Homo sapiens
catgtgaccactctgtct

SEQ ID NO: 150364 - DNA, 23 bp, Homo sapiens
catgtggggccaggtcacccttt

SEQ ID NO: 150365 - DNA, 21 bp, Homo sapiens
catgtggtgggacagggaccc

SEQ ID NO: 150366 - DNA, 21 bp, Homo sapiens
catgtgtgtgcaagtgtgtgc

SEQ ID NO: 150367 - DNA, 18 bp, Homo sapiens
catgttaggaaaatttca

SEQ ID NO: 150368 - DNA, 19 bp, Homo sapiens
catgttaggaaaatttcac

SEQ ID NO: 150369 - DNA, 14 bp, Homo sapiens
catgttatatattt

SEQ ID NO: 150370 - DNA, 23 bp, Homo sapiens
catgttccttcaagatcatgtac

SEQ ID NO: 150371 - DNA, 19 bp, Homo sapiens
catgtttgagctcagaccc

SEQ ID NO: 150372 - DNA, 17 bp, Homo sapiens
cattaagaaaatcatat

SEQ ID NO: 150373 - DNA, 16 bp, Homo sapiens
cattaagccctcttcc

SEQ ID NO: 150374 - DNA, 22 bp, Homo sapiens
cattaatcaatcatctgtgtga

SEQ ID NO: 150375 - DNA, 21 bp, Homo sapiens
cattaatgttaattcagcact

SEQ ID NO: 150376 - DNA, 20 bp, Homo sapiens
cattaattattattgctgtt

SEQ ID NO: 150377 - DNA, 21 bp, Homo sapiens
cattaattattattgctgttg

SEQ ID NO: 150378 - DNA, 21 bp, Homo sapiens
cattacagtgggtgcccccct

SEQ ID NO: 150379 - DNA, 18 bp, Homo sapiens
cattagaaattagctgtg

SEQ ID NO: 150380 - DNA, 20 bp, Homo sapiens
cattataactgaaggagaag

SEQ ID NO: 150381 - DNA, 17 bp, Homo sapiens
cattatagatcccccag

SEQ ID NO: 150382 - DNA, 20 bp, Homo sapiens
cattcacccagacagctccc

SEQ ID NO: 150383 - DNA, 13 bp, Homo sapiens
cattcagaaaaaa

SEQ ID NO: 150384 - DNA, 13 bp, Homo sapiens
cattcaggaaaac

SEQ ID NO: 150385 - DNA, 20 bp, Homo sapiens
cattcaggaaaactgacaga

SEQ ID NO: 150386 - DNA, 22 bp, Homo sapiens
cattccaccttcccatgccctg

SEQ ID NO: 150387 - DNA, 17 bp, Homo sapiens
cattccccaggtggctg

SEQ ID NO: 150388 - DNA, 23 bp, Homo sapiens
cattccccaggtggctgacccag

SEQ ID NO: 150389 - DNA, 18 bp, Homo sapiens
cattccctgagtcaccag

SEQ ID NO: 150390 - DNA, 13 bp, Homo sapiens
cattcctgcctgt

SEQ ID NO: 150391 - DNA, 16 bp, Homo sapiens
cattcctgcctgtctc

SEQ ID NO: 150392 - DNA, 14 bp, Homo sapiens
cattctcactccta

SEQ ID NO: 150393 - DNA, 20 bp, Homo sapiens
cattctctctcctgtccaac

SEQ ID NO: 150394 - DNA, 14 bp, Homo sapiens
cattctctgtctca

SEQ ID NO: 150395 - DNA, 22 bp, Homo sapiens
cattctgccaggcccccaagcc

SEQ ID NO: 150396 - DNA, 16 bp, Homo sapiens
cattcttttaaaagac

SEQ ID NO: 150397 - DNA, 18 bp, Homo sapiens
cattcttttaaaagacaa

SEQ ID NO: 150398 - DNA, 16 bp, Homo sapiens
cattgaagtcagatgt

SEQ ID NO: 150399 - DNA, 14 bp, Homo sapiens
cattgaattagaaa

SEQ ID NO: 150400 - DNA, 22 bp, Homo sapiens
cattgactatcaaactgaagcc

SEQ ID NO: 150401 - DNA, 14 bp, Homo sapiens
cattgatggggaag

SEQ ID NO: 150402 - DNA, 16 bp, Homo sapiens
cattgatggggaagga

SEQ ID NO: 150403 - DNA, 16 bp, Homo sapiens
cattgcactccagcct

SEQ ID NO: 150404 - DNA, 17 bp, Homo sapiens
cattgcactccagcctg

SEQ ID NO: 150405 - DNA, 18 bp, Homo sapiens
cattgcactccagcctgg

SEQ ID NO: 150406 - DNA, 15 bp, Homo sapiens
cattgccaagggctt

SEQ ID NO: 150407 - DNA, 18 bp, Homo sapiens
cattgcctcctccttccc

SEQ ID NO: 150408 - DNA, 21 bp, Homo sapiens
cattgtaaatgtgcttttaaa

SEQ ID NO: 150409 - DNA, 16 bp, Homo sapiens
cattgtagagcttctg

SEQ ID NO: 150410 - DNA, 19 bp, Homo sapiens
cattgtggctgtcagcagg

SEQ ID NO: 150411 - DNA, 19 bp, Homo sapiens
catttaaagcttattaaaa

SEQ ID NO: 150412 - DNA, 17 bp, Homo sapiens
catttaaatacagtctt

SEQ ID NO: 150413 - DNA, 20 bp, Homo sapiens
catttaaatacagtcttcca

SEQ ID NO: 150414 - DNA, 17 bp, Homo sapiens
catttagtcatgtgacc

SEQ ID NO: 150415 - DNA, 14 bp, Homo sapiens
catttatgtttatt

SEQ ID NO: 150416 - DNA, 21 bp, Homo sapiens
catttccaaatgaatgacctt

SEQ ID NO: 150417 - DNA, 17 bp, Homo sapiens
catttcgcccctcattt

SEQ ID NO: 150418 - DNA, 21 bp, Homo sapiens
catttcgcccctcatttatcc

SEQ ID NO: 150419 - DNA, 17 bp, Homo sapiens
catttctaaaggcctct

SEQ ID NO: 150420 - DNA, 23 bp, Homo sapiens
catttctagaacatccctgccag

SEQ ID NO: 150421 - DNA, 13 bp, Homo sapiens
catttctatttat

SEQ ID NO: 150422 - DNA, 14 bp, Homo sapiens
catttctatttatt

SEQ ID NO: 150423 - DNA, 18 bp, Homo sapiens
catttctatttatttact

SEQ ID NO: 150424 - DNA, 15 bp, Homo sapiens
catttctcttactgc

SEQ ID NO: 150425 - DNA, 18 bp, Homo sapiens
catttctcttactgcaaa

SEQ ID NO: 150426 - DNA, 23 bp, Homo sapiens
catttctgcatcagctgctgaaa

SEQ ID NO: 150427 - DNA, 22 bp, Homo sapiens
catttgagttattttaattatc

SEQ ID NO: 150428 - DNA, 20 bp, Homo sapiens
catttggcaatgccatcatc

SEQ ID NO: 150429 - DNA, 20 bp, Homo sapiens
catttgggagacatgtgaca

SEQ ID NO: 150430 - DNA, 17 bp, Homo sapiens
catttggggtagctaga

SEQ ID NO: 150431 - DNA, 17 bp, Homo sapiens
cattttaattattattc

SEQ ID NO: 150432 - DNA, 16 bp, Homo sapiens
cattttatatgtcaaa

SEQ ID NO: 150433 - DNA, 19 bp, Homo sapiens
cattttatatgtcaaagca

SEQ ID NO: 150434 - DNA, 21 bp, Homo sapiens
cattttgctaaatgtgaatga

SEQ ID NO: 150435 - DNA, 13 bp, Homo sapiens
catttttcctaac

SEQ ID NO: 150436 - DNA, 18 bp, Homo sapiens
catttttgaatacaggca

SEQ ID NO: 150437 - DNA, 20 bp, Homo sapiens
ccaaaatcataagatatttt

SEQ ID NO: 150438 - DNA, 14 bp, Homo sapiens
ccaaaccctgtctg

SEQ ID NO: 150439 - DNA, 14 bp, Homo sapiens
ccaaagctttcctg

SEQ ID NO: 150440 - DNA, 15 bp, Homo sapiens
ccaaagctttcctgc

SEQ ID NO: 150441 - DNA, 18 bp, Homo sapiens
ccaaaggaagtctaggag

SEQ ID NO: 150442 - DNA, 21 bp, Homo sapiens
ccaaaggactccacccatcct

SEQ ID NO: 150443 - DNA, 16 bp, Homo sapiens
ccaaaggatgtgatat

SEQ ID NO: 150444 - DNA, 13 bp, Homo sapiens
ccaaatatgtcct

SEQ ID NO: 150445 - DNA, 15 bp, Homo sapiens
ccaaatatgtcctgg

SEQ ID NO: 150446 - DNA, 17 bp, Homo sapiens
ccaaatgttcatcaatg

SEQ ID NO: 150447 - DNA, 12 bp, Homo sapiens
ccaaattatttg

SEQ ID NO: 150448 - DNA, 17 bp, Homo sapiens
ccaaattatttgtgtaa

SEQ ID NO: 150449 - DNA, 19 bp, Homo sapiens
cctctccactgccttcgat

SEQ ID NO: 150450 - DNA, 13 bp, Homo sapiens
cctctcccaggac

SEQ ID NO: 150451 - DNA, 13 bp, Homo sapiens
cctctccctggcc

SEQ ID NO: 150452 - DNA, 13 bp, Homo sapiens
cctctccctgttg

SEQ ID NO: 150453 - DNA, 14 bp, Homo sapiens
cctctcctgcctac

SEQ ID NO: 150454 - DNA, 17 bp, Homo sapiens
cctctcctgcctactca

SEQ ID NO: 150455 - DNA, 15 bp, Homo sapiens
cctctctctgactct

SEQ ID NO: 150456 - DNA, 17 bp, Homo sapiens
cctctctctgactctca

SEQ ID NO: 150457 - DNA, 15 bp, Homo sapiens
cctctctgctctgcg

SEQ ID NO: 150458 - DNA, 19 bp, Homo sapiens
cctctcttggtttccttcc

SEQ ID NO: 150459 - DNA, 19 bp, Homo sapiens
cctctgaaaccctggacca

SEQ ID NO: 150460 - DNA, 16 bp, Homo sapiens
cctctgacccctcctc

SEQ ID NO: 150461 - DNA, 19 bp, Homo sapiens
cctctgactcagggctcct

SEQ ID NO: 150462 - DNA, 22 bp, Homo sapiens
cctctgactcagggctcctggg

SEQ ID NO: 150463 - DNA, 15 bp, Homo sapiens
cctctgatacctcaa

SEQ ID NO: 150464 - DNA, 15 bp, Homo sapiens
cctctgcacaagctg

SEQ ID NO: 150465 - DNA, 17 bp, Homo sapiens
cctctgcacaagctgca

SEQ ID NO: 150466 - DNA, 20 bp, Homo sapiens
cctctgcactactgacatgt

SEQ ID NO: 150467 - DNA, 13 bp, Homo sapiens
cctctgccaccag

SEQ ID NO: 150468 - DNA, 13 bp, Homo sapiens
cctctgccacctc

SEQ ID NO: 150469 - DNA, 14 bp, Homo sapiens
cctctgccacctcc

SEQ ID NO: 150470 - DNA, 21 bp, Homo sapiens
cctctgcctgaaccttccatc

SEQ ID NO: 150471 - DNA, 15 bp, Homo sapiens
cctctgcctgtctcc

SEQ ID NO: 150472 - DNA, 13 bp, Homo sapiens
cctctgcggaccc

SEQ ID NO: 150473 - DNA, 18 bp, Homo sapiens
cctctgcggaccccagct

SEQ ID NO: 150474 - DNA, 18 bp, Homo sapiens
cctctggattgtgggaat

SEQ ID NO: 150475 - DNA, 17 bp, Homo sapiens
cctctggccctgccttc

SEQ ID NO: 150476 - DNA, 12 bp, Homo sapiens
cctctgggactg

SEQ ID NO: 150477 - DNA, 20 bp, Homo sapiens
cctctgggtcagtggtccac

SEQ ID NO: 150478 - DNA, 19 bp, Homo sapiens
cctctgtccaggcactgag

SEQ ID NO: 150479 - DNA, 21 bp, Homo sapiens
cctctgtccaggcactgagat

SEQ ID NO: 150480 - DNA, 21 bp, Homo sapiens
cctctgtccagggccctgagc

SEQ ID NO: 150481 - DNA, 23 bp, Homo sapiens
cctctgtccagggccctgagctc

SEQ ID NO: 150482 - DNA, 19 bp, Homo sapiens
cctctgtgaccaatgtctt

SEQ ID NO: 150483 - DNA, 21 bp, Homo sapiens
cctctgtgaccaatgtcttga

SEQ ID NO: 150484 - DNA, 13 bp, Homo sapiens
cctctgtgtcctt

SEQ ID NO: 150485 - DNA, 20 bp, Homo sapiens
cctctgtgtccttccctgca

SEQ ID NO: 150486 - DNA, 19 bp, Homo sapiens
cctcttaaagctgcctgta

SEQ ID NO: 150487 - DNA, 23 bp, Homo sapiens
cctcttaaagctgcctgtagtta

SEQ ID NO: 150488 - DNA, 14 bp, Homo sapiens
cctcttagaaaaac

SEQ ID NO: 150489 - DNA, 14 bp, Homo sapiens
cctcttcagaggcc

SEQ ID NO: 150490 - DNA, 18 bp, Homo sapiens
cctcttccatcatgtccc

SEQ ID NO: 150491 - DNA, 18 bp, Homo sapiens
cctcttctgggagggcag

SEQ ID NO: 150492 - DNA, 19 bp, Homo sapiens
ccagcagccagctctcagc

SEQ ID NO: 150493 - DNA, 20 bp, Homo sapiens
ccagcagccagctctcagcc

SEQ ID NO: 150494 - DNA, 11 bp, Homo sapiens
ccagcagcctg

SEQ ID NO: 150495 - DNA, 13 bp, Homo sapiens
ccagcagcctgga

SEQ ID NO: 150496 - DNA, 15 bp, Homo sapiens
ccagcagcctggacc

SEQ ID NO: 150497 - DNA, 19 bp, Homo sapiens
ccagcagcctggaccctgt

SEQ ID NO: 150498 - DNA, 20 bp, Homo sapiens
ccagcagcctggaccctgtg

SEQ ID NO: 150499 - DNA, 22 bp, Homo sapiens
ccagcagttgaatgacaacaga

SEQ ID NO: 150500 - DNA, 19 bp, Homo sapiens
ccagccaaaccctgtctga

SEQ ID NO: 150501 - DNA, 19 bp, Homo sapiens
ccagccaaagcctcctcca

SEQ ID NO: 150502 - DNA, 23 bp, Homo sapiens
ccagccagaacgtggctctgctg

SEQ ID NO: 150503 - DNA, 18 bp, Homo sapiens
ccagcccagcccagctgg

SEQ ID NO: 150504 - DNA, 13 bp, Homo sapiens
ccagcccagctgg

SEQ ID NO: 150505 - DNA, 19 bp, Homo sapiens
ccagcccattctctctcct

SEQ ID NO: 150506 - DNA, 22 bp, Homo sapiens
ccagcccattctctctcctgtc

SEQ ID NO: 150507 - DNA, 16 bp, Homo sapiens
ccagcccctagcccag

SEQ ID NO: 150508 - DNA, 14 bp, Homo sapiens
ccagccccttgaga

SEQ ID NO: 150509 - DNA, 18 bp, Homo sapiens
ccagccctccctgtcctc

SEQ ID NO: 150510 - DNA, 19 bp, Homo sapiens
ccagccgccatgctcctgg

SEQ ID NO: 150511 - DNA, 10 bp, Homo sapiens
ccagcctcag

SEQ ID NO: 150512 - DNA, 20 bp, Homo sapiens
ccagcctcagtcctcccctc

SEQ ID NO: 150513 - DNA, 21 bp, Homo sapiens
ccagcctcagtcctcccctca

SEQ ID NO: 150514 - DNA, 21 bp, Homo sapiens
ccagcctccaagctccatctc

SEQ ID NO: 150515 - DNA, 19 bp, Homo sapiens
ccagcctccgtatttcaga

SEQ ID NO: 150516 - DNA, 13 bp, Homo sapiens
ccagcctctcccc

SEQ ID NO: 150517 - DNA, 21 bp, Homo sapiens
ccagcctctgagcccctggga

SEQ ID NO: 150518 - DNA, 24 bp, Homo sapiens
ccagcctctgagcccctgggactg

SEQ ID NO: 150519 - DNA, 19 bp, Homo sapiens
ccagcctgagcgacagtga

SEQ ID NO: 150520 - DNA, 19 bp, Homo sapiens
ccagcctgtcccatggaca

SEQ ID NO: 150521 - DNA, 15 bp, Homo sapiens
ccagcctttctccca

SEQ ID NO: 150522 - DNA, 18 bp, Homo sapiens
ccagcctttctcccaggc

SEQ ID NO: 150523 - DNA, 16 bp, Homo sapiens
ccagcgaggaggctcc

SEQ ID NO: 150524 - DNA, 13 bp, Homo sapiens
ccagctactcagg

SEQ ID NO: 150525 - DNA, 14 bp, Homo sapiens
ccagctactcagga

SEQ ID NO: 150526 - DNA, 16 bp, Homo sapiens
ccagctatacctgtgc

SEQ ID NO: 150527 - DNA, 14 bp, Homo sapiens
ccagctctccctct

SEQ ID NO: 150528 - DNA, 18 bp, Homo sapiens
ccagctctccctctggcc

SEQ ID NO: 150529 - DNA, 22 bp, Homo sapiens
ccagctctccctctggccctgc

SEQ ID NO: 150530 - DNA, 17 bp, Homo sapiens
ccagctgctcccctccc

SEQ ID NO: 150531 - DNA, 19 bp, Homo sapiens
ccagctgctcccctccctc

SEQ ID NO: 150532 - DNA, 15 bp, Homo sapiens
ccagctggcagcaga

SEQ ID NO: 150533 - DNA, 15 bp, Homo sapiens
ccagctgtgagcctt

SEQ ID NO: 150534 - DNA, 17 bp, Homo sapiens
ccagcttgttatttata

SEQ ID NO: 150535 - DNA, 23 bp, Homo sapiens
ccaggaaactctgcattctagta

SEQ ID NO: 150536 - DNA, 23 bp, Homo sapiens
ccaggacaccacacccagcctca

SEQ ID NO: 150537 - DNA, 14 bp, Homo sapiens
ccaggacaggacca

SEQ ID NO: 150538 - DNA, 14 bp, Homo sapiens
ccaggacaggcccg

SEQ ID NO: 150539 - DNA, 16 bp, Homo sapiens
ccaggactgagccccg

SEQ ID NO: 150540 - DNA, 14 bp, Homo sapiens
ccaggagagagaaa

SEQ ID NO: 150541 - DNA, 13 bp, Homo sapiens
ccaggagagccag

SEQ ID NO: 150542 - DNA, 17 bp, Homo sapiens
ccaggagagccagccct

SEQ ID NO: 150543 - DNA, 18 bp, Homo sapiens
ccaggagagccagccctc

SEQ ID NO: 150544 - DNA, 14 bp, Homo sapiens
ccaggaggactgcc

SEQ ID NO: 150545 - DNA, 21 bp, Homo sapiens
ccaggcacgaacccacctgct

SEQ ID NO: 150546 - DNA, 18 bp, Homo sapiens
ccaggcactgctgcccag

SEQ ID NO: 150547 - DNA, 17 bp, Homo sapiens
ccaggcaggtgcctgga

SEQ ID NO: 150548 - DNA, 16 bp, Homo sapiens
ccaggccccaggaagc

SEQ ID NO: 150549 - DNA, 19 bp, Homo sapiens
ccaggcccccaagcctgca

SEQ ID NO: 150550 - DNA, 20 bp, Homo sapiens
ccaggcccccaagcctgcag

SEQ ID NO: 150551 - DNA, 20 bp, Homo sapiens
ccaggcccggggctggcggc

SEQ ID NO: 150552 - DNA, 21 bp, Homo sapiens
ccaggcccggggctggcggct

SEQ ID NO: 150553 - DNA, 18 bp, Homo sapiens
ccaggccggcgagccctg

SEQ ID NO: 150554 - DNA, 18 bp, Homo sapiens
ccaggccgtggctgccca

SEQ ID NO: 150555 - DNA, 13 bp, Homo sapiens
ccaggcctctgtg

SEQ ID NO: 150556 - DNA, 22 bp, Homo sapiens
ccaggcgggagcggtggccctg

SEQ ID NO: 150557 - DNA, 18 bp, Homo sapiens
ccagggaagtgctctgat

SEQ ID NO: 150558 - DNA, 13 bp, Homo sapiens
ccagggccacgtg

SEQ ID NO: 150559 - DNA, 21 bp, Homo sapiens
ccagggccacgtgccaggccc

SEQ ID NO: 150560 - DNA, 19 bp, Homo sapiens
ccagggccactctgcctct

SEQ ID NO: 150561 - DNA, 22 bp, Homo sapiens
ccagggcccctcaccctgcctt

SEQ ID NO: 150562 - DNA, 15 bp, Homo sapiens
ccagggccctgagct

SEQ ID NO: 150563 - DNA, 18 bp, Homo sapiens
ccagggccctgagctcgg

SEQ ID NO: 150564 - DNA, 16 bp, Homo sapiens
ccagggcctgagcctg

SEQ ID NO: 150565 - DNA, 16 bp, Homo sapiens
ccagggctagtgactt

SEQ ID NO: 150566 - DNA, 19 bp, Homo sapiens
ccagggctagtgacttgtg

SEQ ID NO: 150567 - DNA, 11 bp, Homo sapiens
ccagggctcag

SEQ ID NO: 150568 - DNA, 14 bp, Homo sapiens
ccagggctcagcct

SEQ ID NO: 150569 - DNA, 18 bp, Homo sapiens
ccaggggagagggtctgg

SEQ ID NO: 150570 - DNA, 23 bp, Homo sapiens
ccagggggactagcccctgtgga

SEQ ID NO: 150571 - DNA, 20 bp, Homo sapiens
ccagggtggacttagaaagc

SEQ ID NO: 150572 - DNA, 15 bp, Homo sapiens
ccaggtctcacgggc

SEQ ID NO: 150573 - DNA, 16 bp, Homo sapiens
ccaggtgcacagacgt

SEQ ID NO: 150574 - DNA, 15 bp, Homo sapiens
ccaggtgcccagcta

SEQ ID NO: 150575 - DNA, 22 bp, Homo sapiens
ccaggtgtgtccacctgggcat

SEQ ID NO: 150576 - DNA, 21 bp, Homo sapiens
ccagtaacgcgtcttcctgag

SEQ ID NO: 150577 - DNA, 18 bp, Homo sapiens
ccagtaagggaaatagaa

SEQ ID NO: 150578 - DNA, 21 bp, Homo sapiens
ccagtagcttgggacaaatca

SEQ ID NO: 150579 - DNA, 12 bp, Homo sapiens
ccagtattcttg

SEQ ID NO: 150580 - DNA, 14 bp, Homo sapiens
ccagtattcttgtc

SEQ ID NO: 150581 - DNA, 21 bp, Homo sapiens
ccagtccaatctcatggagaa

SEQ ID NO: 150582 - DNA, 22 bp, Homo sapiens
ccagtccaatctcatggagaag

SEQ ID NO: 150583 - DNA, 12 bp, Homo sapiens
ccagtccctggg

SEQ ID NO: 150584 - DNA, 13 bp, Homo sapiens
ccagtccctgggg

SEQ ID NO: 150585 - DNA, 19 bp, Homo sapiens
ccagtccctgggggaagcc

SEQ ID NO: 150586 - DNA, 23 bp, Homo sapiens
ccagtgaattcttgaaggaaaat

SEQ ID NO: 150587 - DNA, 19 bp, Homo sapiens
ccagtgacagacaggctct

SEQ ID NO: 150588 - DNA, 18 bp, Homo sapiens
ccagtgacctgctgggta

SEQ ID NO: 150589 - DNA, 14 bp, Homo sapiens
ccagtgcacccact

SEQ ID NO: 150590 - DNA, 19 bp, Homo sapiens
ccagtgcccaaagtctgtg

SEQ ID NO: 150591 - DNA, 14 bp, Homo sapiens
ccctggccagaggc

SEQ ID NO: 150592 - DNA, 21 bp, Homo sapiens
ccctggcctgctgggctctcc

SEQ ID NO: 150593 - DNA, 23 bp, Homo sapiens
ccctggcttgtaactccaccaac

SEQ ID NO: 150594 - DNA, 13 bp, Homo sapiens
ccctggcttttca

SEQ ID NO: 150595 - DNA, 15 bp, Homo sapiens
ccctgggatgtccac

SEQ ID NO: 150596 - DNA, 15 bp, Homo sapiens
ccctggggcttctcc

SEQ ID NO: 150597 - DNA, 19 bp, Homo sapiens
ccctggggcttctcctgac

SEQ ID NO: 150598 - DNA, 13 bp, Homo sapiens
ccctggtgctgcc

SEQ ID NO: 150599 - DNA, 17 bp, Homo sapiens
ccctggtgctgccacac

SEQ ID NO: 150600 - DNA, 18 bp, Homo sapiens
ccctggttatattctcac

SEQ ID NO: 150601 - DNA, 21 bp, Homo sapiens
ccctgtagagtgggagctgag

SEQ ID NO: 150602 - DNA, 19 bp, Homo sapiens
ccctgtcaccaagctcaca

SEQ ID NO: 150603 - DNA, 12 bp, Homo sapiens
ccctgtccctcc

SEQ ID NO: 150604 - DNA, 17 bp, Homo sapiens
ccctgtccctcccacct

SEQ ID NO: 150605 - DNA, 14 bp, Homo sapiens
ccctgtcctcactg

SEQ ID NO: 150606 - DNA, 15 bp, Homo sapiens
ccctgtcctcactgc

SEQ ID NO: 150607 - DNA, 16 bp, Homo sapiens
ccctgtcctcactgct

SEQ ID NO: 150608 - DNA, 14 bp, Homo sapiens
ccctgtcctcctcg

SEQ ID NO: 150609 - DNA, 13 bp, Homo sapiens
ccctgtgttgtct

SEQ ID NO: 150610 - DNA, 22 bp, Homo sapiens
ccctgttcactctacttagcat

SEQ ID NO: 150611 - DNA, 17 bp, Homo sapiens
cccttacagcctctgac

SEQ ID NO: 150612 - DNA, 20 bp, Homo sapiens
cccttaccatgtgcctgatc

SEQ ID NO: 150613 - DNA, 19 bp, Homo sapiens
cccttacctcggtgccttc

SEQ ID NO: 150614 - DNA, 14 bp, Homo sapiens
cccttcaaccattc

SEQ ID NO: 150615 - DNA, 11 bp, Homo sapiens
cccttcatttg

SEQ ID NO: 150616 - DNA, 16 bp, Homo sapiens
cccttccactgagggc

SEQ ID NO: 150617 - DNA, 13 bp, Homo sapiens
cccttcctctcca

SEQ ID NO: 150618 - DNA, 16 bp, Homo sapiens
cccttcctctccactg

SEQ ID NO: 150619 - DNA, 15 bp, Homo sapiens
cccttctcagaatct

SEQ ID NO: 150620 - DNA, 16 bp, Homo sapiens
cccttctcagaatcta

SEQ ID NO: 150621 - DNA, 19 bp, Homo sapiens
cccttgagacctcagccat

SEQ ID NO: 150622 - DNA, 22 bp, Homo sapiens
cccttgcactaaagtatgtaaa

SEQ ID NO: 150623 - DNA, 12 bp, Homo sapiens
cccttgcccagg

SEQ ID NO: 150624 - DNA, 19 bp, Homo sapiens
cccttgcccagggctcagc

SEQ ID NO: 150625 - DNA, 22 bp, Homo sapiens
cccttgcccagggctcagcctg

SEQ ID NO: 150626 - DNA, 23 bp, Homo sapiens
cccttgcccagggctcagcctgg

SEQ ID NO: 150627 - DNA, 18 bp, Homo sapiens
ccctttccttccttccct

SEQ ID NO: 150628 - DNA, 12 bp, Homo sapiens
ccctttgagtgc

SEQ ID NO: 150629 - DNA, 24 bp, Homo sapiens
ccgaaacaggctactctcctcggc

SEQ ID NO: 150630 - DNA, 18 bp, Homo sapiens
ccgaagaagggtccttcc

SEQ ID NO: 150631 - DNA, 15 bp, Homo sapiens
ccgaaggtgctggag

SEQ ID NO: 150632 - DNA, 13 bp, Homo sapiens
ccgacagagggaa

SEQ ID NO: 150633 - DNA, 12 bp, Homo sapiens
ccgacagcctgg

SEQ ID NO: 150634 - DNA, 12 bp, Homo sapiens
ccgacctcagcc

SEQ ID NO: 150635 - DNA, 16 bp, Homo sapiens
ccgacgcgtctcctgt

SEQ ID NO: 150636 - DNA, 13 bp, Homo sapiens
ccgagaagcaaga

SEQ ID NO: 150637 - DNA, 19 bp, Homo sapiens
ccgagaagcaagaaagaaa

SEQ ID NO: 150638 - DNA, 20 bp, Homo sapiens
ccgagagtagccgagagcct

SEQ ID NO: 150639 - DNA, 15 bp, Homo sapiens
ccgagattgcaccac

SEQ ID NO: 150640 - DNA, 14 bp, Homo sapiens
ccgaggcagggtca

SEQ ID NO: 150641 - DNA, 18 bp, Homo sapiens
ccgagtctcttctccact

SEQ ID NO: 150642 - DNA, 20 bp, Homo sapiens
ccgagtctcttctccactgg

SEQ ID NO: 150643 - DNA, 21 bp, Homo sapiens
ccgcaatgtgcccccagacgc

SEQ ID NO: 150644 - DNA, 13 bp, Homo sapiens
ccgcagacctccc

SEQ ID NO: 150645 - DNA, 16 bp, Homo sapiens
ccgcagacctccccag

SEQ ID NO: 150646 - DNA, 13 bp, Homo sapiens
ccgcaggaagctg

SEQ ID NO: 150647 - DNA, 15 bp, Homo sapiens
ccgcaggaagctgct

SEQ ID NO: 150648 - DNA, 20 bp, Homo sapiens
ccgcatcttctccatctggc

SEQ ID NO: 150649 - DNA, 14 bp, Homo sapiens
ccgcattccctgag

SEQ ID NO: 150650 - DNA, 16 bp, Homo sapiens
ccgccactcctgaacc

SEQ ID NO: 150651 - DNA, 14 bp, Homo sapiens
ccgccccagcctct

SEQ ID NO: 150652 - DNA, 12 bp, Homo sapiens
ccgctcagccct

SEQ ID NO: 150653 - DNA, 15 bp, Homo sapiens
ccgctcagccctccc

SEQ ID NO: 150654 - DNA, 19 bp, Homo sapiens
ccgctcagccctccctgcc

SEQ ID NO: 150655 - DNA, 21 bp, Homo sapiens
ccgctcagccctccctgcccc

SEQ ID NO: 150656 - DNA, 14 bp, Homo sapiens
ccgctcctgtctgc

SEQ ID NO: 150657 - DNA, 17 bp, Homo sapiens
actaacatataatgttg

SEQ ID NO: 150658 - DNA, 14 bp, Homo sapiens
actaactaaactct

SEQ ID NO: 150659 - DNA, 18 bp, Homo sapiens
actaagccacaagaaatt

SEQ ID NO: 150660 - DNA, 22 bp, Homo sapiens
actaataaaagcataaatgcaa

SEQ ID NO: 150661 - DNA, 16 bp, Homo sapiens
actacataaactgact

SEQ ID NO: 150662 - DNA, 19 bp, Homo sapiens
actacatgtggtttataga

SEQ ID NO: 150663 - DNA, 17 bp, Homo sapiens
actactcccccaggtgg

SEQ ID NO: 150664 - DNA, 23 bp, Homo sapiens
actactgacatgtggggccaggt

SEQ ID NO: 150665 - DNA, 19 bp, Homo sapiens
actagactcccaagctgga

SEQ ID NO: 150666 - DNA, 15 bp, Homo sapiens
actagccaccaactc

SEQ ID NO: 150667 - DNA, 18 bp, Homo sapiens
actagcctttggctctgg

SEQ ID NO: 150668 - DNA, 20 bp, Homo sapiens
actagcctttggctctggag

SEQ ID NO: 150669 - DNA, 17 bp, Homo sapiens
actagggaagataatat

SEQ ID NO: 150670 - DNA, 19 bp, Homo sapiens
actagggatccctcatctg

SEQ ID NO: 150671 - DNA, 16 bp, Homo sapiens
actagggccaagccca

SEQ ID NO: 150672 - DNA, 19 bp, Homo sapiens
actagtagttcctgctaca

SEQ ID NO: 150673 - DNA, 19 bp, Homo sapiens
actagtttagttaaatgag

SEQ ID NO: 150674 - DNA, 20 bp, Homo sapiens
actataaagaagtaacaaaa

SEQ ID NO: 150675 - DNA, 22 bp, Homo sapiens
actatcatgtcaaacgtgaaaa

SEQ ID NO: 150676 - DNA, 16 bp, Homo sapiens
actatgatttggaaaa

SEQ ID NO: 150677 - DNA, 18 bp, Homo sapiens
actatgcctgtgtcttct

SEQ ID NO: 150678 - DNA, 14 bp, Homo sapiens
actatgtaacatgt

SEQ ID NO: 150679 - DNA, 17 bp, Homo sapiens
actattataatttaatg

SEQ ID NO: 150680 - DNA, 21 bp, Homo sapiens
actattcaaacagtctcagga

SEQ ID NO: 150681 - DNA, 21 bp, Homo sapiens
actattctgattacacaaaac

SEQ ID NO: 150682 - DNA, 23 bp, Homo sapiens
actattctgattacacaaaacaa

SEQ ID NO: 150683 - DNA, 23 bp, Homo sapiens
actatttagtttttgtaatttat

SEQ ID NO: 150684 - DNA, 13 bp, Homo sapiens
actcaaaagctgg

SEQ ID NO: 150685 - DNA, 17 bp, Homo sapiens
actcaaactcttaaaac

SEQ ID NO: 150686 - DNA, 12 bp, Homo sapiens
actcaaatgctt

SEQ ID NO: 150687 - DNA, 19 bp, Homo sapiens
actcaaatgcttggcttct

SEQ ID NO: 150688 - DNA, 23 bp, Homo sapiens
actcaatctccccttgcactaaa

SEQ ID NO: 150689 - DNA, 17 bp, Homo sapiens
actcacctctgcctcaa

SEQ ID NO: 150690 - DNA, 20 bp, Homo sapiens
actcagaagcctctgggtca

SEQ ID NO: 150691 - DNA, 14 bp, Homo sapiens
actcagaatattgc

SEQ ID NO: 150692 - DNA, 22 bp, Homo sapiens
actcagatgtctctggcgtgtg

SEQ ID NO: 150693 - DNA, 13 bp, Homo sapiens
actcagcagccct

SEQ ID NO: 150694 - DNA, 12 bp, Homo sapiens
actcagccctgg

SEQ ID NO: 150695 - DNA, 13 bp, Homo sapiens
actcagccctggg

SEQ ID NO: 150696 - DNA, 14 bp, Homo sapiens
actcagccctgggc

SEQ ID NO: 150697 - DNA, 21 bp, Homo sapiens
actcagccctgggccccacca

SEQ ID NO: 150698 - DNA, 15 bp, Homo sapiens
actcaggatgcccag

SEQ ID NO: 150699 - DNA, 15 bp, Homo sapiens
actcagggacagagc

SEQ ID NO: 150700 - DNA, 17 bp, Homo sapiens
actcagggacagagcca

SEQ ID NO: 150701 - DNA, 14 bp, Homo sapiens
actcagggccccag

SEQ ID NO: 150702 - DNA, 21 bp, Homo sapiens
actcataaaaagcctgcaatt

SEQ ID NO: 150703 - DNA, 13 bp, Homo sapiens
actcatcataaaa

SEQ ID NO: 150704 - DNA, 15 bp, Homo sapiens
actcatcataaaata

SEQ ID NO: 150705 - DNA, 23 bp, Homo sapiens
actcattcagggatagcactgag

SEQ ID NO: 150706 - DNA, 14 bp, Homo sapiens
actccaaagaaatg

SEQ ID NO: 150707 - DNA, 21 bp, Homo sapiens
actccaaagaaatgtaaggga

SEQ ID NO: 150708 - DNA, 15 bp, Homo sapiens
actccacccatccta

SEQ ID NO: 150709 - DNA, 15 bp, Homo sapiens
actccagtgccagca

SEQ ID NO: 150710 - DNA, 18 bp, Homo sapiens
actccagttaaaaaaaat

SEQ ID NO: 150711 - DNA, 17 bp, Homo sapiens
actccatgagaagccgt

SEQ ID NO: 150712 - DNA, 15 bp, Homo sapiens
actcccttcccataa

SEQ ID NO: 150713 - DNA, 19 bp, Homo sapiens
actcccttggtggcaagag

SEQ ID NO: 150714 - DNA, 14 bp, Homo sapiens
actccggagacagg

SEQ ID NO: 150715 - DNA, 15 bp, Homo sapiens
actccggagacaggg

SEQ ID NO: 150716 - DNA, 16 bp, Homo sapiens
actccggagacagggt

SEQ ID NO: 150717 - DNA, 14 bp, Homo sapiens
actcctacctggta

SEQ ID NO: 150718 - DNA, 16 bp, Homo sapiens
actcctaggaaaatac

SEQ ID NO: 150719 - DNA, 14 bp, Homo sapiens
actcctctgactca

SEQ ID NO: 150720 - DNA, 13 bp, Homo sapiens
actcctctgtcca

SEQ ID NO: 150721 - DNA, 17 bp, Homo sapiens
actcctgccaaggagga

SEQ ID NO: 150722 - DNA, 12 bp, Homo sapiens
actcctggaaat

SEQ ID NO: 150723 - DNA, 16 bp, Homo sapiens
actcctggaagctgtg

SEQ ID NO: 150724 - DNA, 21 bp, Homo sapiens
actccttcctgccacctgctg

SEQ ID NO: 150725 - DNA, 20 bp, Homo sapiens
actccttgtggtttatgtca

SEQ ID NO: 150726 - DNA, 15 bp, Homo sapiens
actcgcttcccccat

SEQ ID NO: 150727 - DNA, 16 bp, Homo sapiens
actcggcaccctgcaa

SEQ ID NO: 150728 - DNA, 17 bp, Homo sapiens
actctacccatattaca

SEQ ID NO: 150729 - DNA, 18 bp, Homo sapiens
actctaccctcttagaaa

SEQ ID NO: 150730 - DNA, 17 bp, Homo sapiens
actctagggaaaaacca

SEQ ID NO: 150731 - DNA, 17 bp, Homo sapiens
actctaggtgcccttgg

SEQ ID NO: 150732 - DNA, 15 bp, Homo sapiens
actctatagactcta

SEQ ID NO: 150733 - DNA, 13 bp, Homo sapiens
actctcagtctct

SEQ ID NO: 150734 - DNA, 22 bp, Homo sapiens
cctgctgccgcctcccagcctg

SEQ ID NO: 150735 - DNA, 23 bp, Homo sapiens
cctgctgccgcctcccagcctgg

SEQ ID NO: 150736 - DNA, 20 bp, Homo sapiens
cctgctgggctctccacctc

SEQ ID NO: 150737 - DNA, 22 bp, Homo sapiens
cctgctgggctctccacctcag

SEQ ID NO: 150738 - DNA, 23 bp, Homo sapiens
cctgctgggctctccacctcagc

SEQ ID NO: 150739 - DNA, 15 bp, Homo sapiens
cctgctgggtaaact

SEQ ID NO: 150740 - DNA, 17 bp, Homo sapiens
cctgctgggtaaactgt

SEQ ID NO: 150741 - DNA, 20 bp, Homo sapiens
cctgctttgggctgccctgg

SEQ ID NO: 150742 - DNA, 21 bp, Homo sapiens
cctggaagctgtgtccttgca

SEQ ID NO: 150743 - DNA, 23 bp, Homo sapiens
cctggacatgaagattctttccc

SEQ ID NO: 150744 - DNA, 24 bp, Homo sapiens
cctggacatgaagattctttccca

SEQ ID NO: 150745 - DNA, 21 bp, Homo sapiens
cctggacatttgccttgctgg

SEQ ID NO: 150746 - DNA, 17 bp, Homo sapiens
cctggactgggaggtag

SEQ ID NO: 150747 - DNA, 13 bp, Homo sapiens
cctggagaactag

SEQ ID NO: 150748 - DNA, 18 bp, Homo sapiens
cctggagactgcccagct

SEQ ID NO: 150749 - DNA, 16 bp, Homo sapiens
cctggcacagggcagt

SEQ ID NO: 150750 - DNA, 17 bp, Homo sapiens
cctggcacagggcagtg

SEQ ID NO: 150751 - DNA, 17 bp, Homo sapiens
cctggcactgctgtgct

SEQ ID NO: 150752 - DNA, 18 bp, Homo sapiens
cctggcagccgtgccttc

SEQ ID NO: 150753 - DNA, 21 bp, Homo sapiens
cctggcagccgtgccttcagc

SEQ ID NO: 150754 - DNA, 14 bp, Homo sapiens
cctggccagaggct

SEQ ID NO: 150755 - DNA, 16 bp, Homo sapiens
cctggcccactgcatc

SEQ ID NO: 150756 - DNA, 15 bp, Homo sapiens
cctggccccatgtct

SEQ ID NO: 150757 - DNA, 21 bp, Homo sapiens
cctggccccatgtctctcaga

SEQ ID NO: 150758 - DNA, 12 bp, Homo sapiens
cctggcccccag

SEQ ID NO: 150759 - DNA, 22 bp, Homo sapiens
cctggcttttcactgctggctg

SEQ ID NO: 150760 - DNA, 23 bp, Homo sapiens
cctggcttttcactgctggctgc

SEQ ID NO: 150761 - DNA, 17 bp, Homo sapiens
cctgggaaatattccct

SEQ ID NO: 150762 - DNA, 17 bp, Homo sapiens
cctgggcatactaataa

SEQ ID NO: 150763 - DNA, 13 bp, Homo sapiens
cctgggccccacc

SEQ ID NO: 150764 - DNA, 11 bp, Homo sapiens
cctgggccctc

SEQ ID NO: 150765 - DNA, 18 bp, Homo sapiens
cctgggccctctctgctc

SEQ ID NO: 150766 - DNA, 19 bp, Homo sapiens
cctggggcagtcacctgcc

SEQ ID NO: 150767 - DNA, 20 bp, Homo sapiens
cctggggctaggctggagcc

SEQ ID NO: 150768 - DNA, 17 bp, Homo sapiens
cctggggcttctcctga

SEQ ID NO: 150769 - DNA, 18 bp, Homo sapiens
cctggggcttctcctgac

SEQ ID NO: 150770 - DNA, 14 bp, Homo sapiens
cctgggggtgccag

SEQ ID NO: 150771 - DNA, 22 bp, Homo sapiens
cctggggtataaaactttcctc

SEQ ID NO: 150772 - DNA, 13 bp, Homo sapiens
cctgggtgacatt

SEQ ID NO: 150773 - DNA, 15 bp, Homo sapiens
cctgggtgacatttg

SEQ ID NO: 150774 - DNA, 16 bp, Homo sapiens
cctgggtggggctgct

SEQ ID NO: 150775 - DNA, 22 bp, Homo sapiens
cctgggtggggctgctcctcca

SEQ ID NO: 150776 - DNA, 18 bp, Homo sapiens
cctgggtggtctgcaggc

SEQ ID NO: 150777 - DNA, 19 bp, Homo sapiens
cctgggtggtctgcaggca

SEQ ID NO: 150778 - DNA, 20 bp, Homo sapiens
cctgggtggtctgcaggcag

SEQ ID NO: 150779 - DNA, 22 bp, Homo sapiens
cctgggtggtctgcaggcaggg

SEQ ID NO: 150780 - DNA, 20 bp, Homo sapiens
cctgggttttgtattctctg

SEQ ID NO: 150781 - DNA, 21 bp, Homo sapiens
cctgggttttgtattctctga

SEQ ID NO: 150782 - DNA, 18 bp, Homo sapiens
cctggtgctgccacactt

SEQ ID NO: 150783 - DNA, 20 bp, Homo sapiens
cctggtgctgcctctacctg

SEQ ID NO: 150784 - DNA, 18 bp, Homo sapiens
cctggtgggcctcctctg

SEQ ID NO: 150785 - DNA, 15 bp, Homo sapiens
cctgtaatcacagct

SEQ ID NO: 150786 - DNA, 16 bp, Homo sapiens
cctgtaatcccagcac

SEQ ID NO: 150787 - DNA, 15 bp, Homo sapiens
cctgtagagtgggag

SEQ ID NO: 150788 - DNA, 16 bp, Homo sapiens
cctgtagcccactctg

SEQ ID NO: 150789 - DNA, 19 bp, Homo sapiens
cctgtagcccactctgctc

SEQ ID NO: 150790 - DNA, 22 bp, Homo sapiens
cctgtagcccactctgctcgcc

SEQ ID NO: 150791 - DNA, 15 bp, Homo sapiens
cctgtagtcccagct

SEQ ID NO: 150792 - DNA, 16 bp, Homo sapiens
cctgtagtcccagcta

SEQ ID NO: 150793 - DNA, 16 bp, Homo sapiens
cctgtagttaggaaat

SEQ ID NO: 150794 - DNA, 19 bp, Homo sapiens
cctgtagttaggaaataaa

SEQ ID NO: 150795 - DNA, 18 bp, Homo sapiens
cctgtcaaacaaagccag

SEQ ID NO: 150796 - DNA, 20 bp, Homo sapiens
cctgtcaaacaaagccagaa

SEQ ID NO: 150797 - DNA, 16 bp, Homo sapiens
cctgtcccatggacac

SEQ ID NO: 150798 - DNA, 15 bp, Homo sapiens
cctgtccctcccacc

SEQ ID NO: 150799 - DNA, 17 bp, Homo sapiens
cctgtccctcccacctc

SEQ ID NO: 150800 - DNA, 12 bp, Homo sapiens
cctgtcctcact

SEQ ID NO: 150801 - DNA, 14 bp, Homo sapiens
cctgtcctcactgc

SEQ ID NO: 150802 - DNA, 15 bp, Homo sapiens
cctgtcctcagcttc

SEQ ID NO: 150803 - DNA, 17 bp, Homo sapiens
cctgtcctcccatcccc

SEQ ID NO: 150804 - DNA, 14 bp, Homo sapiens
cctgtcctcctcgg

SEQ ID NO: 150805 - DNA, 22 bp, Homo sapiens
cctgtctcttccatatgacctc

SEQ ID NO: 150806 - DNA, 14 bp, Homo sapiens
cctgtctgccagcc

SEQ ID NO: 150807 - DNA, 21 bp, Homo sapiens
cctgtctgccagccagcagcc

SEQ ID NO: 150808 - DNA, 19 bp, Homo sapiens
cctgtgaccagtctgaccc

SEQ ID NO: 150809 - DNA, 19 bp, Homo sapiens
cctgtgaggtgcagagtgc

SEQ ID NO: 150810 - DNA, 23 bp, Homo sapiens
cctgtgaggtgcagagtgcccag

SEQ ID NO: 150811 - DNA, 17 bp, Homo sapiens
cctgtgcctctgggact

SEQ ID NO: 150812 - DNA, 21 bp, Homo sapiens
cctgtgctgcccgtcttcagc

SEQ ID NO: 150813 - DNA, 22 bp, Homo sapiens
cctgtgctgcccgtcttcagcc

SEQ ID NO: 150814 - DNA, 23 bp, Homo sapiens
cctgtgctgcccgtcttcagcct

SEQ ID NO: 150815 - DNA, 14 bp, Homo sapiens
cctgtggagactgg

SEQ ID NO: 150816 - DNA, 21 bp, Homo sapiens
cctcgtcctccccctgccagt

SEQ ID NO: 150817 - DNA, 22 bp, Homo sapiens
cctcgtggccttccccagcctc

SEQ ID NO: 150818 - DNA, 18 bp, Homo sapiens
cctcgtggtccccaacag

SEQ ID NO: 150819 - DNA, 19 bp, Homo sapiens
cctcgtggtccccaacagc

SEQ ID NO: 150820 - DNA, 24 bp, Homo sapiens
cctctacagagcttccctgactca

SEQ ID NO: 150821 - DNA, 14 bp, Homo sapiens
cctctccactgcct

SEQ ID NO: 150822 - DNA, 16 bp, Homo sapiens
cctctccactgccttc

SEQ ID NO: 150823 - DNA, 14 bp, Homo sapiens
cctctccccaagac

SEQ ID NO: 150824 - DNA, 16 bp, Homo sapiens
cctctcccctgattac

SEQ ID NO: 150825 - DNA, 15 bp, Homo sapiens
cctctcctgcctact

SEQ ID NO: 150826 - DNA, 16 bp, Homo sapiens
cctctcctgcctactc

SEQ ID NO: 150827 - DNA, 12 bp, Homo sapiens
cctctctgctct

SEQ ID NO: 150828 - DNA, 16 bp, Homo sapiens
cctctctgctctgcgt

SEQ ID NO: 150829 - DNA, 18 bp, Homo sapiens
cctctcttggtttccttc

SEQ ID NO: 150830 - DNA, 23 bp, Homo sapiens
cctctgaaaaccaatgttctctc

SEQ ID NO: 150831 - DNA, 15 bp, Homo sapiens
cctctgacccctcct

SEQ ID NO: 150832 - DNA, 20 bp, Homo sapiens
cctctgacccctcctcactg

SEQ ID NO: 150833 - DNA, 22 bp, Homo sapiens
cctctgacccctcctcactggc

SEQ ID NO: 150834 - DNA, 16 bp, Homo sapiens
cctctgactcagggct

SEQ ID NO: 150835 - DNA, 20 bp, Homo sapiens
cctctgccaaaggatgtgat

SEQ ID NO: 150836 - DNA, 19 bp, Homo sapiens
cctctgccaccagagaccg

SEQ ID NO: 150837 - DNA, 12 bp, Homo sapiens
cctctgccacct

SEQ ID NO: 150838 - DNA, 16 bp, Homo sapiens
cctctgccacctcccc

SEQ ID NO: 150839 - DNA, 20 bp, Homo sapiens
cctctgccacctcccctatc

SEQ ID NO: 150840 - DNA, 14 bp, Homo sapiens
cctctgccccgtct

SEQ ID NO: 150841 - DNA, 12 bp, Homo sapiens
cctctgcctgtc

SEQ ID NO: 150842 - DNA, 12 bp, Homo sapiens
cctctggccctg

SEQ ID NO: 150843 - DNA, 20 bp, Homo sapiens
cctctgtccaggcactgaga

SEQ ID NO: 150844 - DNA, 18 bp, Homo sapiens
cctctgtgaccaatgtct

SEQ ID NO: 150845 - DNA, 19 bp, Homo sapiens
cctctgtgtccttccctgc

SEQ ID NO: 150846 - DNA, 18 bp, Homo sapiens
cctcttaaaaaataaaaa

SEQ ID NO: 150847 - DNA, 19 bp, Homo sapiens
cctcttaaaaaataaaaac

SEQ ID NO: 150848 - DNA, 20 bp, Homo sapiens
cctcttaaagctgcctgtag

SEQ ID NO: 150849 - DNA, 21 bp, Homo sapiens
cctcttaaagctgcctgtagt

SEQ ID NO: 150850 - DNA, 22 bp, Homo sapiens
cctcttaaagctgcctgtagtt

SEQ ID NO: 150851 - DNA, 20 bp, Homo sapiens
cctcttagacttctgctttc

SEQ ID NO: 150852 - DNA, 13 bp, Homo sapiens
cctcttcaccccc

SEQ ID NO: 150853 - DNA, 17 bp, Homo sapiens
cctcttcaccccccact

SEQ ID NO: 150854 - DNA, 13 bp, Homo sapiens
cctcttcagaggc

SEQ ID NO: 150855 - DNA, 16 bp, Homo sapiens
cctcttcagaggccct

SEQ ID NO: 150856 - DNA, 15 bp, Homo sapiens
cctcttcctccctca

SEQ ID NO: 150857 - DNA, 16 bp, Homo sapiens
cctcttcctccctcat

SEQ ID NO: 150858 - DNA, 21 bp, Homo sapiens
cctcttctgggagggcagcag

SEQ ID NO: 150859 - DNA, 19 bp, Homo sapiens
cctcttgagcagtggctgg

SEQ ID NO: 150860 - DNA, 24 bp, Homo sapiens
cctcttgagcagtggctggtccag

SEQ ID NO: 150861 - DNA, 14 bp, Homo sapiens
cctcttgccactgc

SEQ ID NO: 150862 - DNA, 17 bp, Homo sapiens
cctcttgcggtcccttc

SEQ ID NO: 150863 - DNA, 15 bp, Homo sapiens
cctctttcatccact

SEQ ID NO: 150864 - DNA, 17 bp, Homo sapiens
cctgaaaacactgtgca

SEQ ID NO: 150865 - DNA, 13 bp, Homo sapiens
cctgaaaacccag

SEQ ID NO: 150866 - DNA, 13 bp, Homo sapiens
cctgaaagaggaa

SEQ ID NO: 150867 - DNA, 14 bp, Homo sapiens
cctgaagccagcct

SEQ ID NO: 150868 - DNA, 13 bp, Homo sapiens
cctgacactccct

SEQ ID NO: 150869 - DNA, 20 bp, Homo sapiens
cctgaccaacagttccttca

SEQ ID NO: 150870 - DNA, 13 bp, Homo sapiens
cctgagaagagag

SEQ ID NO: 150871 - DNA, 13 bp, Homo sapiens
cctgagcctggcc

SEQ ID NO: 150872 - DNA, 15 bp, Homo sapiens
cctgagctcggtgga

SEQ ID NO: 150873 - DNA, 16 bp, Homo sapiens
cctgagctcggtggac

SEQ ID NO: 150874 - DNA, 19 bp, Homo sapiens
cctgagctcggtggaccca

SEQ ID NO: 150875 - DNA, 14 bp, Homo sapiens
ccttctgtggctca

SEQ ID NO: 150876 - DNA, 21 bp, Homo sapiens
ccttctgtggctcacagaacc

SEQ ID NO: 150877 - DNA, 17 bp, Homo sapiens
ccttcttattctcactc

SEQ ID NO: 150878 - DNA, 16 bp, Homo sapiens
ccttcttccatcccag

SEQ ID NO: 150879 - DNA, 22 bp, Homo sapiens
ccttcttcggggaactcctgga

SEQ ID NO: 150880 - DNA, 23 bp, Homo sapiens
ccttgacattgtagagcttctgg

SEQ ID NO: 150881 - DNA, 19 bp, Homo sapiens
ccttgagacctcagccatg

SEQ ID NO: 150882 - DNA, 19 bp, Homo sapiens
ccttgcacactcccctgca

SEQ ID NO: 150883 - DNA, 13 bp, Homo sapiens
ccttgcacccctc

SEQ ID NO: 150884 - DNA, 12 bp, Homo sapiens
ccttgcacctgc

SEQ ID NO: 150885 - DNA, 13 bp, Homo sapiens
ccttgcacctgca

SEQ ID NO: 150886 - DNA, 11 bp, Homo sapiens
ccttgcccaga

SEQ ID NO: 150887 - DNA, 20 bp, Homo sapiens
ccttgcccagggctcagcct

SEQ ID NO: 150888 - DNA, 15 bp, Homo sapiens
ccttgcctcaatgcc

SEQ ID NO: 150889 - DNA, 16 bp, Homo sapiens
ccttgcctcaatgcca

SEQ ID NO: 150890 - DNA, 18 bp, Homo sapiens
ccttgctcgctgtaaaat

SEQ ID NO: 150891 - DNA, 22 bp, Homo sapiens
ccttgctctcccctgccctgct

SEQ ID NO: 150892 - DNA, 13 bp, Homo sapiens
ccttggcttgccc

SEQ ID NO: 150893 - DNA, 20 bp, Homo sapiens
ccttgggaggccccactggg

SEQ ID NO: 150894 - DNA, 12 bp, Homo sapiens
ccttgggccctt

SEQ ID NO: 150895 - DNA, 15 bp, Homo sapiens
ccttggggcaggcag

SEQ ID NO: 150896 - DNA, 15 bp, Homo sapiens
ccttggtgtccacct

SEQ ID NO: 150897 - DNA, 20 bp, Homo sapiens
ccttggtgtccacctggccc

SEQ ID NO: 150898 - DNA, 21 bp, Homo sapiens
ccttgtatttaaatattaaat

SEQ ID NO: 150899 - DNA, 23 bp, Homo sapiens
ccttgtgtctacagagaacctgg

SEQ ID NO: 150900 - DNA, 13 bp, Homo sapiens
ccttgttgcatga

SEQ ID NO: 150901 - DNA, 14 bp, Homo sapiens
cctttattaaaatc

SEQ ID NO: 150902 - DNA, 16 bp, Homo sapiens
cctttattaaaatctt

SEQ ID NO: 150903 - DNA, 12 bp, Homo sapiens
cctttccccagc

SEQ ID NO: 150904 - DNA, 13 bp, Homo sapiens
cctttccccagcc

SEQ ID NO: 150905 - DNA, 14 bp, Homo sapiens
cctttccccagccc

SEQ ID NO: 150906 - DNA, 18 bp, Homo sapiens
cctttccccagcccaggg

SEQ ID NO: 150907 - DNA, 14 bp, Homo sapiens
cctttctcccaggc

SEQ ID NO: 150908 - DNA, 11 bp, Homo sapiens
cctttctgtgt

SEQ ID NO: 150909 - DNA, 14 bp, Homo sapiens
cctttgaagaggaa

SEQ ID NO: 150910 - DNA, 21 bp, Homo sapiens
cctttgattaaagactccagt

SEQ ID NO: 150911 - DNA, 11 bp, Homo sapiens
cctttggcttc

SEQ ID NO: 150912 - DNA, 18 bp, Homo sapiens
cctttgtcatctttcttc

SEQ ID NO: 150913 - DNA, 21 bp, Homo sapiens
ccttttgaaattaacctctca

SEQ ID NO: 150914 - DNA, 23 bp, Homo sapiens
ccttttgaagtagtttgtataac

SEQ ID NO: 150915 - DNA, 13 bp, Homo sapiens
cgaaacagcgctg

SEQ ID NO: 150916 - DNA, 14 bp, Homo sapiens
cgaaatgttatttt

SEQ ID NO: 150917 - DNA, 21 bp, Homo sapiens
cgaacaccctcgaagcgcgcc

SEQ ID NO: 150918 - DNA, 14 bp, Homo sapiens
cgaattaatagctt

SEQ ID NO: 150919 - DNA, 12 bp, Homo sapiens
cgacaagtgctg

SEQ ID NO: 150920 - DNA, 15 bp, Homo sapiens
cgacagtgagactct

SEQ ID NO: 150921 - DNA, 22 bp, Homo sapiens
cgacatagcccatccctgcctg

SEQ ID NO: 150922 - DNA, 14 bp, Homo sapiens
cgacctcagccttc

SEQ ID NO: 150923 - DNA, 12 bp, Homo sapiens
cgacctcggtgg

SEQ ID NO: 150924 - DNA, 16 bp, Homo sapiens
cgactgcacagcggcc

SEQ ID NO: 150925 - DNA, 20 bp, Homo sapiens
cgactgcacagcggcccctg

SEQ ID NO: 150926 - DNA, 17 bp, Homo sapiens
cgactgcccggcagggt

SEQ ID NO: 150927 - DNA, 13 bp, Homo sapiens
cgagaagcaagaa

SEQ ID NO: 150928 - DNA, 14 bp, Homo sapiens
cgagagcctgctcc

SEQ ID NO: 150929 - DNA, 21 bp, Homo sapiens
cgagagcctgctcccccaccc

SEQ ID NO: 150930 - DNA, 17 bp, Homo sapiens
cgagcagtcctgcctca

SEQ ID NO: 150931 - DNA, 21 bp, Homo sapiens
cgagcagtcctgcctcagcct

SEQ ID NO: 150932 - DNA, 20 bp, Homo sapiens
cgaggaggctccagagggca

SEQ ID NO: 150933 - DNA, 20 bp, Homo sapiens
cgaggggctctcagctcagc

SEQ ID NO: 150934 - DNA, 23 bp, Homo sapiens
cgaggtcaacagagaaggcagga

SEQ ID NO: 150935 - DNA, 23 bp, Homo sapiens
cgaggtggatcacagaggcttct

SEQ ID NO: 150936 - DNA, 20 bp, Homo sapiens
cgagtcaatcccctcattca

SEQ ID NO: 150937 - DNA, 15 bp, Homo sapiens
cgagtcactgcctct

SEQ ID NO: 150938 - DNA, 22 bp, Homo sapiens
cgagtcactgcctctccctggc

SEQ ID NO: 150939 - DNA, 16 bp, Homo sapiens
cgagtctcttctccac

SEQ ID NO: 150940 - DNA, 20 bp, Homo sapiens
cgagtctcttctccactgga

SEQ ID NO: 150941 - DNA, 18 bp, Homo sapiens
cgagtgtgtgcatgtgtg

SEQ ID NO: 150942 - DNA, 15 bp, Homo sapiens
cgatccacctgtctc

SEQ ID NO: 150943 - DNA, 20 bp, Homo sapiens
cgcaagcctgtaatcccagc

SEQ ID NO: 150944 - DNA, 21 bp, Homo sapiens
cgcaagcctgtaatcccagct

SEQ ID NO: 150945 - DNA, 16 bp, Homo sapiens
cgcacctaccatcagg

SEQ ID NO: 150946 - DNA, 12 bp, Homo sapiens
cgcacctcccat

SEQ ID NO: 150947 - DNA, 18 bp, Homo sapiens
cgcacctcccatcctaat

SEQ ID NO: 150948 - DNA, 16 bp, Homo sapiens
cgcagcaggaggccag

SEQ ID NO: 150949 - DNA, 15 bp, Homo sapiens
cgcagccctgctttg

SEQ ID NO: 150950 - DNA, 12 bp, Homo sapiens
cgcaggaagctg

SEQ ID NO: 150951 - DNA, 16 bp, Homo sapiens
cgcatcttctccatct

SEQ ID NO: 150952 - DNA, 21 bp, Homo sapiens
cgcatcttctccatctggcag

SEQ ID NO: 150953 - DNA, 12 bp, Homo sapiens
cgcattccctga

SEQ ID NO: 150954 - DNA, 13 bp, Homo sapiens
cgcattccctgag

SEQ ID NO: 150955 - DNA, 13 bp, Homo sapiens
cgccaccatcctg

SEQ ID NO: 150956 - DNA, 17 bp, Homo sapiens
cgccacccctccttcct

SEQ ID NO: 150957 - DNA, 15 bp, Homo sapiens
cgccactcgcttccc

SEQ ID NO: 150958 - DNA, 19 bp, Homo sapiens
cgccattgcactccagcct

SEQ ID NO: 150959 - DNA, 11 bp, Homo sapiens
cgcccacctcc

SEQ ID NO: 150960 - DNA, 14 bp, Homo sapiens
cgccccagcctctg

SEQ ID NO: 150961 - DNA, 13 bp, Homo sapiens
cgccccttccccc

SEQ ID NO: 150962 - DNA, 21 bp, Homo sapiens
cgcctagtggggtctccctct

SEQ ID NO: 150963 - DNA, 15 bp, Homo sapiens
cgcctcccagcctgg

SEQ ID NO: 150964 - DNA, 19 bp, Homo sapiens
cgcctgcaaacgctgcctg

SEQ ID NO: 150965 - DNA, 20 bp, Homo sapiens
cgcctgcaaacgctgcctgc

SEQ ID NO: 150966 - DNA, 22 bp, Homo sapiens
cgcctgcaaacgctgcctgccg

SEQ ID NO: 150967 - DNA, 16 bp, Homo sapiens
cgcctgcccctcccag

SEQ ID NO: 150968 - DNA, 23 bp, Homo sapiens
cgccttaggtacttattccagat

SEQ ID NO: 150969 - DNA, 18 bp, Homo sapiens
cgcgccactcgcttcccc

SEQ ID NO: 150970 - DNA, 20 bp, Homo sapiens
cgcgccactcgcttccccca

SEQ ID NO: 150971 - DNA, 12 bp, Homo sapiens
cgcgtctcctgt

SEQ ID NO: 150972 - DNA, 14 bp, Homo sapiens
cgcgtcttcctgag

SEQ ID NO: 150973 - DNA, 21 bp, Homo sapiens
cgctcagccctccctgcccct

SEQ ID NO: 150974 - DNA, 14 bp, Homo sapiens
cgctcctgtctgcc

SEQ ID NO: 150975 - DNA, 21 bp, Homo sapiens
cgctcttggcaggtactcagc

SEQ ID NO: 150976 - DNA, 19 bp, Homo sapiens
cgctgccagctctgtatca

SEQ ID NO: 150977 - DNA, 18 bp, Homo sapiens
cgctgccgcaccccagag

SEQ ID NO: 150978 - DNA, 20 bp, Homo sapiens
cgctggactctcagtctctg

SEQ ID NO: 150979 - DNA, 23 bp, Homo sapiens
cgctggtagagatggaggaggag

SEQ ID NO: 150980 - DNA, 16 bp, Homo sapiens
cgcttcccccatagcc

SEQ ID NO: 150981 - DNA, 16 bp, Homo sapiens
cgctttctagctgttg

SEQ ID NO: 150982 - DNA, 13 bp, Homo sapiens
cgaaatgttattt

SEQ ID NO: 150983 - DNA, 22 bp, Homo sapiens
cgaacatggaactcattcctgc

SEQ ID NO: 150984 - DNA, 16 bp, Homo sapiens
cgaagcgcgccactcg

SEQ ID NO: 150985 - DNA, 19 bp, Homo sapiens
cgaatacttttgccctttg

SEQ ID NO: 150986 - DNA, 18 bp, Homo sapiens
cgaatcagctatttactg

SEQ ID NO: 150987 - DNA, 22 bp, Homo sapiens
cgaattaatagcttttattgta

SEQ ID NO: 150988 - DNA, 22 bp, Homo sapiens
cgacagagggaagaaaagagct

SEQ ID NO: 150989 - DNA, 14 bp, Homo sapiens
cgacagcctggcac

SEQ ID NO: 150990 - DNA, 16 bp, Homo sapiens
cgacagtgagactctg

SEQ ID NO: 150991 - DNA, 14 bp, Homo sapiens
cgacctcgtcctcc

SEQ ID NO: 150992 - DNA, 20 bp, Homo sapiens
cgactctatagactctagga

SEQ ID NO: 150993 - DNA, 11 bp, Homo sapiens
cgactgtctcc

SEQ ID NO: 150994 - DNA, 15 bp, Homo sapiens
cgagaagcaagaaag

SEQ ID NO: 150995 - DNA, 21 bp, Homo sapiens
cgagagacttgtggcctggga

SEQ ID NO: 150996 - DNA, 13 bp, Homo sapiens
cgagagcctgctc

SEQ ID NO: 150997 - DNA, 20 bp, Homo sapiens
cgagagcctgctcccccacc

SEQ ID NO: 150998 - DNA, 20 bp, Homo sapiens
cgagattgcaccactgcact

SEQ ID NO: 150999 - DNA, 13 bp, Homo sapiens
cgagcacctccac

SEQ ID NO: 151000 - DNA, 23 bp, Homo sapiens
cgagcagtcctgcctcagcctcc

SEQ ID NO: 151001 - DNA, 19 bp, Homo sapiens
cgaggaggctccagagggc

SEQ ID NO: 151002 - DNA, 15 bp, Homo sapiens
cgaggtcaacagaga

SEQ ID NO: 151003 - DNA, 17 bp, Homo sapiens
cgaggtcaacagagaag

SEQ ID NO: 151004 - DNA, 20 bp, Homo sapiens
cgaggtggatcacagaggct

SEQ ID NO: 151005 - DNA, 17 bp, Homo sapiens
cgagtctcttctccact

SEQ ID NO: 151006 - DNA, 19 bp, Homo sapiens
cgagtgtgtgcatgtgtgt

SEQ ID NO: 151007 - DNA, 22 bp, Homo sapiens
cgatccacctgtctcagcctcc

SEQ ID NO: 151008 - DNA, 15 bp, Homo sapiens
cgatgtggccctggc

SEQ ID NO: 151009 - DNA, 17 bp, Homo sapiens
cgatgtggccctggcct

SEQ ID NO: 151010 - DNA, 22 bp, Homo sapiens
cgatgtggccctggcctgctgg

SEQ ID NO: 151011 - DNA, 15 bp, Homo sapiens
cgattggctttaaac

SEQ ID NO: 151012 - DNA, 17 bp, Homo sapiens
cgattttgtatctgcag

SEQ ID NO: 151013 - DNA, 23 bp, Homo sapiens
cgattttgtatctgcaggcagac

SEQ ID NO: 151014 - DNA, 15 bp, Homo sapiens
cgcaagtctgcagcc

SEQ ID NO: 151015 - DNA, 18 bp, Homo sapiens
cgcaatgtgcccccagac

SEQ ID NO: 151016 - DNA, 14 bp, Homo sapiens
cgcaccccagagtg

SEQ ID NO: 151017 - DNA, 17 bp, Homo sapiens
cgcagcaggaggccagg

SEQ ID NO: 151018 - DNA, 16 bp, Homo sapiens
ctacaacttcagcagt

SEQ ID NO: 151019 - DNA, 22 bp, Homo sapiens
ctacacccctcccctgccctag

SEQ ID NO: 151020 - DNA, 17 bp, Homo sapiens
ctacactccagtgagac

SEQ ID NO: 151021 - DNA, 20 bp, Homo sapiens
ctacagagcttccctgactc

SEQ ID NO: 151022 - DNA, 14 bp, Homo sapiens
ctacagatagtcaa

SEQ ID NO: 151023 - DNA, 19 bp, Homo sapiens
ctacagctaatcagcattc

SEQ ID NO: 151024 - DNA, 22 bp, Homo sapiens
ctacagctaatcagcattctca

SEQ ID NO: 151025 - DNA, 18 bp, Homo sapiens
ctacagtcaggaaaggaa

SEQ ID NO: 151026 - DNA, 22 bp, Homo sapiens
ctacagttgttttttgaaaaca

SEQ ID NO: 151027 - DNA, 22 bp, Homo sapiens
ctacataagtaattcaagaaaa

SEQ ID NO: 151028 - DNA, 18 bp, Homo sapiens
ctacatgaggtactgaga

SEQ ID NO: 151029 - DNA, 22 bp, Homo sapiens
ctacatgatctagagccagtta

SEQ ID NO: 151030 - DNA, 13 bp, Homo sapiens
ctacatgtattgc

SEQ ID NO: 151031 - DNA, 22 bp, Homo sapiens
ctacatgtattgcacattgtaa

SEQ ID NO: 151032 - DNA, 16 bp, Homo sapiens
ctacatgtgggagctt

SEQ ID NO: 151033 - DNA, 17 bp, Homo sapiens
ctacatgtgggagcttt

SEQ ID NO: 151034 - DNA, 15 bp, Homo sapiens
ctaccacctccccag

SEQ ID NO: 151035 - DNA, 16 bp, Homo sapiens
ctaccatcagggacag

SEQ ID NO: 151036 - DNA, 18 bp, Homo sapiens
ctaccatcagggacagga

SEQ ID NO: 151037 - DNA, 12 bp, Homo sapiens
ctacccaaagga

SEQ ID NO: 151038 - DNA, 15 bp, Homo sapiens
ctacccagggcctgc

SEQ ID NO: 151039 - DNA, 19 bp, Homo sapiens
ctacccagggcctgcagga

SEQ ID NO: 151040 - DNA, 17 bp, Homo sapiens
ctaccctcttagaaaaa

SEQ ID NO: 151041 - DNA, 12 bp, Homo sapiens
ctaccctgagct

SEQ ID NO: 151042 - DNA, 17 bp, Homo sapiens
ctaccctgagctgaggc

SEQ ID NO: 151043 - DNA, 21 bp, Homo sapiens
ctaccgagtctcttctccact

SEQ ID NO: 151044 - DNA, 22 bp, Homo sapiens
ctaccgagtctcttctccactg

SEQ ID NO: 151045 - DNA, 19 bp, Homo sapiens
ctaccttaaaatgtaaaac

SEQ ID NO: 151046 - DNA, 16 bp, Homo sapiens
ctactacatcgccctc

SEQ ID NO: 151047 - DNA, 18 bp, Homo sapiens
ctactatgccagatgcct

SEQ ID NO: 151048 - DNA, 18 bp, Homo sapiens
ctactcagcagccctcct

SEQ ID NO: 151049 - DNA, 19 bp, Homo sapiens
ctactcagcagccctcctc

SEQ ID NO: 151050 - DNA, 13 bp, Homo sapiens
ctactcaggaggc

SEQ ID NO: 151051 - DNA, 16 bp, Homo sapiens
ctactcaggaggctga

SEQ ID NO: 151052 - DNA, 16 bp, Homo sapiens
ctactccggagacagg

SEQ ID NO: 151053 - DNA, 15 bp, Homo sapiens
ctactgacatgtggg

SEQ ID NO: 151054 - DNA, 14 bp, Homo sapiens
ctactgcagcttta

SEQ ID NO: 151055 - DNA, 17 bp, Homo sapiens
ctactgcagctttacat

SEQ ID NO: 151056 - DNA, 12 bp, Homo sapiens
ctacttgggagg

SEQ ID NO: 151057 - DNA, 19 bp, Homo sapiens
ctacttgggaggctgagat

SEQ ID NO: 151058 - DNA, 16 bp, Homo sapiens
ctagaaacttccaaat

SEQ ID NO: 151059 - DNA, 17 bp, Homo sapiens
ctagaaatatgatttta

SEQ ID NO: 151060 - DNA, 19 bp, Homo sapiens
ctagaaattccccaccctg

SEQ ID NO: 151061 - DNA, 17 bp, Homo sapiens
ctagaagtgggccagga

SEQ ID NO: 151062 - DNA, 19 bp, Homo sapiens
ctagaagtgggccaggaca

SEQ ID NO: 151063 - DNA, 20 bp, Homo sapiens
ctagaagtgggccaggacag

SEQ ID NO: 151064 - DNA, 21 bp, Homo sapiens
ctagaagtgggccaggacagg

SEQ ID NO: 151065 - DNA, 12 bp, Homo sapiens
ctagaatttatt

SEQ ID NO: 151066 - DNA, 14 bp, Homo sapiens
ctagaatttcttta

SEQ ID NO: 151067 - DNA, 14 bp, Homo sapiens
ctagagcagggatt

SEQ ID NO: 151068 - DNA, 15 bp, Homo sapiens
ctagagcagggatta

SEQ ID NO: 151069 - DNA, 22 bp, Homo sapiens
ctagagggatacactgaagtta

SEQ ID NO: 151070 - DNA, 17 bp, Homo sapiens
ctagagtgaacttgggc

SEQ ID NO: 151071 - DNA, 18 bp, Homo sapiens
ctagatcatgaagaacct

SEQ ID NO: 151072 - DNA, 21 bp, Homo sapiens
ctagattaccccctcattgtt

SEQ ID NO: 151073 - DNA, 16 bp, Homo sapiens
ctagcacttggagcca

SEQ ID NO: 151074 - DNA, 16 bp, Homo sapiens
ctagcatctcatgagt

SEQ ID NO: 151075 - DNA, 21 bp, Homo sapiens
ctagccaccaactcttgcagg

SEQ ID NO: 151076 - DNA, 16 bp, Homo sapiens
ctagcccaggagagag

SEQ ID NO: 151077 - DNA, 17 bp, Homo sapiens
ctagcccaggagagaga

SEQ ID NO: 151078 - DNA, 19 bp, Homo sapiens
ctagcccaggagagagaaa

SEQ ID NO: 151079 - DNA, 20 bp, Homo sapiens
ctagcccaggagagagaaag

SEQ ID NO: 151080 - DNA, 21 bp, Homo sapiens
ctagcccctgtggagactggg

SEQ ID NO: 151081 - DNA, 14 bp, Homo sapiens
ctagccgacctcag

SEQ ID NO: 151082 - DNA, 16 bp, Homo sapiens
ctagccgacctcagcc

SEQ ID NO: 151083 - DNA, 17 bp, Homo sapiens
ctagccgacctcagcct

SEQ ID NO: 151084 - DNA, 20 bp, Homo sapiens
ctagccgacctcagccttcc

SEQ ID NO: 151085 - DNA, 19 bp, Homo sapiens
ctagcctgtgcctctggga

SEQ ID NO: 151086 - DNA, 16 bp, Homo sapiens
ctagctagaaatatga

SEQ ID NO: 151087 - DNA, 17 bp, Homo sapiens
ctagctagaaatatgat

SEQ ID NO: 151088 - DNA, 12 bp, Homo sapiens
ctaggaaaatac

SEQ ID NO: 151089 - DNA, 13 bp, Homo sapiens
ctaggatttcatg

SEQ ID NO: 151090 - DNA, 15 bp, Homo sapiens
ctaggccactcctcc

SEQ ID NO: 151091 - DNA, 12 bp, Homo sapiens
ctaggccgggcg

SEQ ID NO: 151092 - DNA, 12 bp, Homo sapiens
ctaggcctgggg

SEQ ID NO: 151093 - DNA, 17 bp, Homo sapiens
ctaggctggagcccagg

SEQ ID NO: 151094 - DNA, 21 bp, Homo sapiens
ctagggaaaaaccagcgtgtg

SEQ ID NO: 151095 - DNA, 17 bp, Homo sapiens
ctagggatccctcatct

SEQ ID NO: 151096 - DNA, 18 bp, Homo sapiens
ctagggccaagcccagca

SEQ ID NO: 151097 - DNA, 18 bp, Homo sapiens
ctaggtgcccttggaggc

SEQ ID NO: 151098 - DNA, 13 bp, Homo sapiens
ctaggttctaaaa

SEQ ID NO: 151099 - DNA, 23 bp, Homo sapiens
ctagtatcaaaagaaagaaaatc

SEQ ID NO: 151100 - DNA, 18 bp, Homo sapiens
ctagtcagagagagtgtt

SEQ ID NO: 151101 - DNA, 17 bp, Homo sapiens
ctagtgaaggcttctct

SEQ ID NO: 151102 - DNA, 20 bp, Homo sapiens
ctagtgacttgtgtcccatg

SEQ ID NO: 151103 - DNA, 16 bp, Homo sapiens
ctagtgcaaatcatag

SEQ ID NO: 151104 - DNA, 17 bp, Homo sapiens
ctagtggggtctccctc

SEQ ID NO: 151105 - DNA, 20 bp, Homo sapiens
ctagtggggtctccctctcc

SEQ ID NO: 151106 - DNA, 23 bp, Homo sapiens
ctagtggggtctccctctcctgc

SEQ ID NO: 151107 - DNA, 16 bp, Homo sapiens
ctataaagtaaagcta

SEQ ID NO: 151108 - DNA, 15 bp, Homo sapiens
ctatacctgtgcctc

SEQ ID NO: 151109 - DNA, 12 bp, Homo sapiens
ctatagactcta

SEQ ID NO: 151110 - DNA, 21 bp, Homo sapiens
ctataggtgctacaaaaacac

SEQ ID NO: 151111 - DNA, 21 bp, Homo sapiens
ctatagtccagctttgttctt

SEQ ID NO: 151112 - DNA, 21 bp, Homo sapiens
ctatatactcactttctagat

SEQ ID NO: 151113 - DNA, 16 bp, Homo sapiens
ctatatagtttattga

SEQ ID NO: 151114 - DNA, 13 bp, Homo sapiens
ctatatttagatt

SEQ ID NO: 151115 - DNA, 20 bp, Homo sapiens
ctatattttttgttaaatga

SEQ ID NO: 151116 - DNA, 21 bp, Homo sapiens
ctatcaaactgaagccagaaa

SEQ ID NO: 151117 - DNA, 14 bp, Homo sapiens
ctatcaatagtcaa

SEQ ID NO: 151118 - DNA, 12 bp, Homo sapiens
ctatccacccag

SEQ ID NO: 151119 - DNA, 13 bp, Homo sapiens
ctatccacccagc

SEQ ID NO: 151120 - DNA, 14 bp, Homo sapiens
ctatccacccagcc

SEQ ID NO: 151121 - DNA, 16 bp, Homo sapiens
ctatccacccagccca

SEQ ID NO: 151122 - DNA, 15 bp, Homo sapiens
ctatgactgctcccc

SEQ ID NO: 151123 - DNA, 19 bp, Homo sapiens
ctatgctgcctaggctgac

SEQ ID NO: 151124 - DNA, 18 bp, Homo sapiens
ctatggggatggtccact

SEQ ID NO: 151125 - DNA, 14 bp, Homo sapiens
ctatgtatggaata

SEQ ID NO: 151126 - DNA, 22 bp, Homo sapiens
ctatgtatggaatacagtgtta

SEQ ID NO: 151127 - DNA, 13 bp, Homo sapiens
ctatgtcccttgc

SEQ ID NO: 151128 - DNA, 16 bp, Homo sapiens
ctatgtcccttgctgt

SEQ ID NO: 151129 - DNA, 23 bp, Homo sapiens
ctattaagatttccaagtgccaa

SEQ ID NO: 151130 - DNA, 15 bp, Homo sapiens
ctattagagaagaga

SEQ ID NO: 151131 - DNA, 14 bp, Homo sapiens
ctattatattaaaa

SEQ ID NO: 151132 - DNA, 23 bp, Homo sapiens
ctattcaaggtggccaaattatt

SEQ ID NO: 151133 - DNA, 21 bp, Homo sapiens
ctatttccccaggggaaaatg

SEQ ID NO: 151134 - DNA, 13 bp, Homo sapiens
ctatttctgagaa

SEQ ID NO: 151135 - DNA, 17 bp, Homo sapiens
ctatttgtctttcagga

SEQ ID NO: 151136 - DNA, 23 bp, Homo sapiens
ctatttgttttcttctgtatgtt

SEQ ID NO: 151137 - DNA, 17 bp, Homo sapiens
ctcaaaaaaagaaaaag

SEQ ID NO: 151138 - DNA, 23 bp, Homo sapiens
ctcaaaataccatgccatttaaa

SEQ ID NO: 151139 - DNA, 12 bp, Homo sapiens
ctcaaatttgga

SEQ ID NO: 151140 - DNA, 15 bp, Homo sapiens
ctcaaccatcccctc

SEQ ID NO: 151141 - DNA, 19 bp, Homo sapiens
ctcaacccccatttctatt

SEQ ID NO: 151142 - DNA, 22 bp, Homo sapiens
ctagcgctgccgcaccccagag

SEQ ID NO: 151143 - DNA, 21 bp, Homo sapiens
ctagctagaaatatgatttta

SEQ ID NO: 151144 - DNA, 19 bp, Homo sapiens
ctagctagaagtgggccag

SEQ ID NO: 151145 - DNA, 15 bp, Homo sapiens
ctaggagctgggagg

SEQ ID NO: 151146 - DNA, 16 bp, Homo sapiens
ctaggagctgggagga

SEQ ID NO: 151147 - DNA, 17 bp, Homo sapiens
ctaggccactcctccaa

SEQ ID NO: 151148 - DNA, 13 bp, Homo sapiens
ctaggcctgggga

SEQ ID NO: 151149 - DNA, 20 bp, Homo sapiens
ctaggctggagcccagggag

SEQ ID NO: 151150 - DNA, 14 bp, Homo sapiens
ctagggaagataat

SEQ ID NO: 151151 - DNA, 14 bp, Homo sapiens
ctagggagagaccc

SEQ ID NO: 151152 - DNA, 15 bp, Homo sapiens
ctagggagagaccct

SEQ ID NO: 151153 - DNA, 13 bp, Homo sapiens
ctagggatccctc

SEQ ID NO: 151154 - DNA, 19 bp, Homo sapiens
ctagggatgttctggccct

SEQ ID NO: 151155 - DNA, 17 bp, Homo sapiens
ctagggccaagcccagc

SEQ ID NO: 151156 - DNA, 22 bp, Homo sapiens
ctaggtgcccttggaggccagc

SEQ ID NO: 151157 - DNA, 17 bp, Homo sapiens
ctagtatcaaaagaaag

SEQ ID NO: 151158 - DNA, 13 bp, Homo sapiens
ctagtcagagaga

SEQ ID NO: 151159 - DNA, 14 bp, Homo sapiens
ctagtccagtgacc

SEQ ID NO: 151160 - DNA, 16 bp, Homo sapiens
gcctgctgggctctcc

SEQ ID NO: 151161 - DNA, 18 bp, Homo sapiens
gcctgctgggctctccac

SEQ ID NO: 151162 - DNA, 19 bp, Homo sapiens
gcctgctgggctctccacc

SEQ ID NO: 151163 - DNA, 20 bp, Homo sapiens
gcctgctgggctctccacct

SEQ ID NO: 151164 - DNA, 22 bp, Homo sapiens
gcctgctgggctctccacctca

SEQ ID NO: 151165 - DNA, 24 bp, Homo sapiens
gcctgctgggctctccacctcagc

SEQ ID NO: 151166 - DNA, 20 bp, Homo sapiens
gcctggacatttgccttgct

SEQ ID NO: 151167 - DNA, 18 bp, Homo sapiens
gcctggactttcctgcaa

SEQ ID NO: 151168 - DNA, 21 bp, Homo sapiens
gcctggcgaaaccccatctct

SEQ ID NO: 151169 - DNA, 21 bp, Homo sapiens
gcctggctcttgtgctggatg

SEQ ID NO: 151170 - DNA, 20 bp, Homo sapiens
gcctgggcaacacagcgaga

SEQ ID NO: 151171 - DNA, 17 bp, Homo sapiens
gcctgggggtgccagga

SEQ ID NO: 151172 - DNA, 21 bp, Homo sapiens
gcctgggggtgccaggaccag

SEQ ID NO: 151173 - DNA, 23 bp, Homo sapiens
gcctgggtggggctgctcctcca

SEQ ID NO: 151174 - DNA, 24 bp, Homo sapiens
gcctgggtggggctgctcctccag

SEQ ID NO: 151175 - DNA, 17 bp, Homo sapiens
gcctggtcacagggcat

SEQ ID NO: 151176 - DNA, 18 bp, Homo sapiens
gcctgtaatcccagcact

SEQ ID NO: 151177 - DNA, 18 bp, Homo sapiens
gcctgtaatcccagcagt

SEQ ID NO: 151178 - DNA, 17 bp, Homo sapiens
gcctgtaatcccagcta

SEQ ID NO: 151179 - DNA, 15 bp, Homo sapiens
gcctgtaatcctagc

SEQ ID NO: 151180 - DNA, 20 bp, Homo sapiens
gcctgtaatcctagcacttt

SEQ ID NO: 151181 - DNA, 14 bp, Homo sapiens
gcctgtagttagga

SEQ ID NO: 151182 - DNA, 17 bp, Homo sapiens
gcctgtagttaggaaat

SEQ ID NO: 151183 - DNA, 21 bp, Homo sapiens
gcctgtctcctttgcaggctc

SEQ ID NO: 151184 - DNA, 22 bp, Homo sapiens
gcctgtctcctttgcaggctca

SEQ ID NO: 151185 - DNA, 14 bp, Homo sapiens
gcctgtgaggcagg

SEQ ID NO: 151186 - DNA, 17 bp, Homo sapiens
gcctgtgcctctgggac

SEQ ID NO: 151187 - DNA, 18 bp, Homo sapiens
gcctgtgcctctgggact

SEQ ID NO: 151188 - DNA, 16 bp, Homo sapiens
gcctgtgctgcccgtc

SEQ ID NO: 151189 - DNA, 16 bp, Homo sapiens
gcctgtggcggtgcct

SEQ ID NO: 151190 - DNA, 13 bp, Homo sapiens
gccttacctcctg

SEQ ID NO: 151191 - DNA, 19 bp, Homo sapiens
gccttattagagtgtcttt

SEQ ID NO: 151192 - DNA, 13 bp, Homo sapiens
gccttcagctcta

SEQ ID NO: 151193 - DNA, 18 bp, Homo sapiens
gccttccagcaccctgca

SEQ ID NO: 151194 - DNA, 16 bp, Homo sapiens
gccttccccagcctct

SEQ ID NO: 151195 - DNA, 14 bp, Homo sapiens
gccttcctcctggg

SEQ ID NO: 151196 - DNA, 17 bp, Homo sapiens
gccttcctcctgggccc

SEQ ID NO: 151197 - DNA, 22 bp, Homo sapiens
gccttcctcctgggccctctct

SEQ ID NO: 151198 - DNA, 23 bp, Homo sapiens
gccttcgatacaccgggcctgga

SEQ ID NO: 151199 - DNA, 20 bp, Homo sapiens
gccttcttattctcactcca

SEQ ID NO: 151200 - DNA, 21 bp, Homo sapiens
gccttcttattctcactccac

SEQ ID NO: 151201 - DNA, 22 bp, Homo sapiens
gccttcttccatcccaggacac

SEQ ID NO: 151202 - DNA, 22 bp, Homo sapiens
gccttcttcggggaactcctgg

SEQ ID NO: 151203 - DNA, 20 bp, Homo sapiens
gccttgtaattctaaatgaa

SEQ ID NO: 151204 - DNA, 15 bp, Homo sapiens
gccttgtgtctacag

SEQ ID NO: 151205 - DNA, 18 bp, Homo sapiens
gcctttctcccaggccag

SEQ ID NO: 151206 - DNA, 23 bp, Homo sapiens
gccttttttcacggaagttttca

SEQ ID NO: 151207 - DNA, 21 bp, Homo sapiens
gcgacatagcccatccctgcc

SEQ ID NO: 151208 - DNA, 19 bp, Homo sapiens
gcgaggagatgctccttgg

SEQ ID NO: 151209 - DNA, 16 bp, Homo sapiens
gcgatccacctgtctc

SEQ ID NO: 151210 - DNA, 18 bp, Homo sapiens
gcgccactcgcttccccc

SEQ ID NO: 151211 - DNA, 23 bp, Homo sapiens
gcgccactcgcttcccccatagc

SEQ ID NO: 151212 - DNA, 17 bp, Homo sapiens
gcgcccacctccccacg

SEQ ID NO: 151213 - DNA, 13 bp, Homo sapiens
gcgccccttcccc

SEQ ID NO: 151214 - DNA, 18 bp, Homo sapiens
gcgcctgcccctcccaga

SEQ ID NO: 151215 - DNA, 17 bp, Homo sapiens
gcgctgccgcaccccag

SEQ ID NO: 151216 - DNA, 15 bp, Homo sapiens
gcggaaagcagctca

SEQ ID NO: 151217 - DNA, 13 bp, Homo sapiens
gcggaccccagct

SEQ ID NO: 151218 - DNA, 21 bp, Homo sapiens
gcggaccccagctgtgagcct

SEQ ID NO: 151219 - DNA, 15 bp, Homo sapiens
gcggccgcattccct

SEQ ID NO: 151220 - DNA, 22 bp, Homo sapiens
gcggctgagtcatgatctccct

SEQ ID NO: 151221 - DNA, 15 bp, Homo sapiens
gcggctggcagccca

SEQ ID NO: 151222 - DNA, 14 bp, Homo sapiens
gcgggaaggagggt

SEQ ID NO: 151223 - DNA, 21 bp, Homo sapiens
gcgggagcggtggccctgtcc

SEQ ID NO: 151224 - DNA, 14 bp, Homo sapiens
gcgggctgggcagc

SEQ ID NO: 151225 - DNA, 19 bp, Homo sapiens
gcggtcccctccgccaggc

SEQ ID NO: 151226 - DNA, 22 bp, Homo sapiens
gcggtctcaggctggtgggagg

SEQ ID NO: 151227 - DNA, 13 bp, Homo sapiens
gcgtcttcctgag

SEQ ID NO: 151228 - DNA, 14 bp, Homo sapiens
gcgtcttcctgagt

SEQ ID NO: 151229 - DNA, 13 bp, Homo sapiens
gcgtgaaggccga

SEQ ID NO: 151230 - DNA, 14 bp, Homo sapiens
gcgtgactcaccca

SEQ ID NO: 151231 - DNA, 21 bp, Homo sapiens
gcgtgtggctcacgtgtgtga

SEQ ID NO: 151232 - DNA, 17 bp, Homo sapiens
gcgtgtgtccatgtgtg

SEQ ID NO: 151233 - DNA, 23 bp, Homo sapiens
gcgtgtgtccatgtgtgtgcaag

SEQ ID NO: 151234 - DNA, 22 bp, Homo sapiens
gcgttaaaggctcgattttgta

SEQ ID NO: 151235 - DNA, 22 bp, Homo sapiens
gcgttagaatgaggaggaagga

SEQ ID NO: 151236 - DNA, 13 bp, Homo sapiens
gctaaagaaaaag

SEQ ID NO: 151237 - DNA, 17 bp, Homo sapiens
gctaaagcaatatgcat

SEQ ID NO: 151238 - DNA, 19 bp, Homo sapiens
gctaaagcaatatgcattt

SEQ ID NO: 151239 - DNA, 13 bp, Homo sapiens
gctaaatgtgaat

SEQ ID NO: 151240 - DNA, 19 bp, Homo sapiens
gctaagagtgtcctaggag

SEQ ID NO: 151241 - DNA, 22 bp, Homo sapiens
gtcaccaccttcccagctctcc

SEQ ID NO: 151242 - DNA, 23 bp, Homo sapiens
gtcaccaggaatgttaaagtcag

SEQ ID NO: 151243 - DNA, 23 bp, Homo sapiens
gtcactacgtgactgtggcacac

SEQ ID NO: 151244 - DNA, 23 bp, Homo sapiens
gtcactcagatggaaccgcagga

SEQ ID NO: 151245 - DNA, 20 bp, Homo sapiens
gtcactgcacagtgcatctc

SEQ ID NO: 151246 - DNA, 16 bp, Homo sapiens
gtcagacgcctgagga

SEQ ID NO: 151247 - DNA, 17 bp, Homo sapiens
gtcagacgcctgaggaa

SEQ ID NO: 151248 - DNA, 17 bp, Homo sapiens
gtcagagaggagtcaga

SEQ ID NO: 151249 - DNA, 22 bp, Homo sapiens
gtcagcaaaaagcaaaatcatt

SEQ ID NO: 151250 - DNA, 23 bp, Homo sapiens
gtcagcaaaaagcaaaatcattt

SEQ ID NO: 151251 - DNA, 22 bp, Homo sapiens
gtcagccctagggtggagagcc

SEQ ID NO: 151252 - DNA, 20 bp, Homo sapiens
gtcagcttgctgccctaggc

SEQ ID NO: 151253 - DNA, 17 bp, Homo sapiens
gtcaggaaggatgagca

SEQ ID NO: 151254 - DNA, 18 bp, Homo sapiens
gtcagggacccctgccct

SEQ ID NO: 151255 - DNA, 22 bp, Homo sapiens
gtcagtaccttcaaactagggc

SEQ ID NO: 151256 - DNA, 22 bp, Homo sapiens
gtcagtggtccacatcccggga

SEQ ID NO: 151257 - DNA, 16 bp, Homo sapiens
gtcataccaatgaaaa

SEQ ID NO: 151258 - DNA, 21 bp, Homo sapiens
gtcatataagattcatattta

SEQ ID NO: 151259 - DNA, 13 bp, Homo sapiens
gtcatcatacatg

SEQ ID NO: 151260 - DNA, 16 bp, Homo sapiens
gtcatctggtagattt

SEQ ID NO: 151261 - DNA, 22 bp, Homo sapiens
gtcatcttgaccaagcaggaag

SEQ ID NO: 151262 - DNA, 15 bp, Homo sapiens
gtcatgatctccctg

SEQ ID NO: 151263 - DNA, 15 bp, Homo sapiens
gtcatgcttgtgtta

SEQ ID NO: 151264 - DNA, 17 bp, Homo sapiens
gtcatgttccttcaaga

SEQ ID NO: 151265 - DNA, 21 bp, Homo sapiens
gtcatttgctgagcatgtact

SEQ ID NO: 151266 - DNA, 14 bp, Homo sapiens
gtccaacctaaccc

SEQ ID NO: 151267 - DNA, 20 bp, Homo sapiens
gtccaacctaacccctttcc

SEQ ID NO: 151268 - DNA, 18 bp, Homo sapiens
gtccaacgtggggcagca

SEQ ID NO: 151269 - DNA, 21 bp, Homo sapiens
gtccaacgtggggcagcacag

SEQ ID NO: 151270 - DNA, 15 bp, Homo sapiens
gtccaagtgtgtgtg

SEQ ID NO: 151271 - DNA, 20 bp, Homo sapiens
gtccacaaaataaccaatcc

SEQ ID NO: 151272 - DNA, 16 bp, Homo sapiens
gtccacgactgtctcc

SEQ ID NO: 151273 - DNA, 14 bp, Homo sapiens
gtccagcttgctct

SEQ ID NO: 151274 - DNA, 16 bp, Homo sapiens
gtccagggccctgagc

SEQ ID NO: 151275 - DNA, 17 bp, Homo sapiens
gtccagggccctgagct

SEQ ID NO: 151276 - DNA, 18 bp, Homo sapiens
gtccagggctagtgactt

SEQ ID NO: 151277 - DNA, 11 bp, Homo sapiens
gtccaggggat

SEQ ID NO: 151278 - DNA, 23 bp, Homo sapiens
gtccatgaagatgtagaggagaa

SEQ ID NO: 151279 - DNA, 13 bp, Homo sapiens
gtccatgggcaga

SEQ ID NO: 151280 - DNA, 23 bp, Homo sapiens
gtccatgggcagagcccaaggga

SEQ ID NO: 151281 - DNA, 16 bp, Homo sapiens
gtccattgtccaatcc

SEQ ID NO: 151282 - DNA, 21 bp, Homo sapiens
gtccattgtccaatcctatgt

SEQ ID NO: 151283 - DNA, 18 bp, Homo sapiens
gtcccactcaagccaagc

SEQ ID NO: 151284 - DNA, 21 bp, Homo sapiens
gtcccatggacactccagtgc

SEQ ID NO: 151285 - DNA, 18 bp, Homo sapiens
gtccccaaacctgcaagg

SEQ ID NO: 151286 - DNA, 21 bp, Homo sapiens
gtccccaggccccaggaagcc

SEQ ID NO: 151287 - DNA, 18 bp, Homo sapiens
gtccccagtttgcagaaa

SEQ ID NO: 151288 - DNA, 21 bp, Homo sapiens
gtccccctctgtccaggcact

SEQ ID NO: 151289 - DNA, 23 bp, Homo sapiens
gtccctaccgagtctcttctcca

SEQ ID NO: 151290 - DNA, 19 bp, Homo sapiens
gtccctccacgttcacccc

SEQ ID NO: 151291 - DNA, 12 bp, Homo sapiens
gtccctcccacc

SEQ ID NO: 151292 - DNA, 16 bp, Homo sapiens
gtccctcccacctctg

SEQ ID NO: 151293 - DNA, 19 bp, Homo sapiens
gtccctgggggaagccctg

SEQ ID NO: 151294 - DNA, 17 bp, Homo sapiens
gtcccttgagacctcag

SEQ ID NO: 151295 - DNA, 20 bp, Homo sapiens
gtcccttgagacctcagcca

SEQ ID NO: 151296 - DNA, 22 bp, Homo sapiens
gtcccttgagacctcagccatg

SEQ ID NO: 151297 - DNA, 14 bp, Homo sapiens
gtccgtttactcca

SEQ ID NO: 151298 - DNA, 12 bp, Homo sapiens
gtcctaggagta

SEQ ID NO: 151299 - DNA, 20 bp, Homo sapiens
gtcctcactgctccctgaag

SEQ ID NO: 151300 - DNA, 17 bp, Homo sapiens
gcttccatttgtgtgtg

SEQ ID NO: 151301 - DNA, 14 bp, Homo sapiens
gcttcccccatagc

SEQ ID NO: 151302 - DNA, 15 bp, Homo sapiens
gcttcccccatagcc

SEQ ID NO: 151303 - DNA, 16 bp, Homo sapiens
gcttcccgctcagccc

SEQ ID NO: 151304 - DNA, 14 bp, Homo sapiens
gcttccctgactca

SEQ ID NO: 151305 - DNA, 18 bp, Homo sapiens
gcttccctgactcattct

SEQ ID NO: 151306 - DNA, 22 bp, Homo sapiens
gcttccttctgtgaaagtacat

SEQ ID NO: 151307 - DNA, 22 bp, Homo sapiens
gcttcctttgtttttttttcct

SEQ ID NO: 151308 - DNA, 23 bp, Homo sapiens
gcttcctttgtttttttttcctg

SEQ ID NO: 151309 - DNA, 20 bp, Homo sapiens
gcttcgggcccttcccacag

SEQ ID NO: 151310 - DNA, 12 bp, Homo sapiens
gcttctcctgac

SEQ ID NO: 151311 - DNA, 19 bp, Homo sapiens
gcttctctgtgaacgattt

SEQ ID NO: 151312 - DNA, 15 bp, Homo sapiens
gcttcttaaagagtt

SEQ ID NO: 151313 - DNA, 19 bp, Homo sapiens
gcttcttaatataactgcc

SEQ ID NO: 151314 - DNA, 22 bp, Homo sapiens
gcttcttaatataactgcctta

SEQ ID NO: 151315 - DNA, 19 bp, Homo sapiens
gcttgccctggtgcctcac

SEQ ID NO: 151316 - DNA, 22 bp, Homo sapiens
gcttgcgttagaatgaggagga

SEQ ID NO: 151317 - DNA, 15 bp, Homo sapiens
gcttggaagagcctg

SEQ ID NO: 151318 - DNA, 18 bp, Homo sapiens
gcttggaagagcctgcag

SEQ ID NO: 151319 - DNA, 18 bp, Homo sapiens
gcttggagcagaggggct

SEQ ID NO: 151320 - DNA, 18 bp, Homo sapiens
gcttgtcattaccagacg

SEQ ID NO: 151321 - DNA, 12 bp, Homo sapiens
gcttgtgttaag

SEQ ID NO: 151322 - DNA, 21 bp, Homo sapiens
gctttaatttttttaaccaaa

SEQ ID NO: 151323 - DNA, 19 bp, Homo sapiens
gctttattttttaagtatt

SEQ ID NO: 151324 - DNA, 12 bp, Homo sapiens
gctttcctgccc

SEQ ID NO: 151325 - DNA, 16 bp, Homo sapiens
gctttcgaactgctag

SEQ ID NO: 151326 - DNA, 21 bp, Homo sapiens
gctttgcttatggtaataaaa

SEQ ID NO: 151327 - DNA, 15 bp, Homo sapiens
gctttgggctgccct

SEQ ID NO: 151328 - DNA, 19 bp, Homo sapiens
gctttgggctgccctggtg

SEQ ID NO: 151329 - DNA, 16 bp, Homo sapiens
gctttgtaggtgtctc

SEQ ID NO: 151330 - DNA, 15 bp, Homo sapiens
gctttgtatgcactt

SEQ ID NO: 151331 - DNA, 13 bp, Homo sapiens
gcttttcactgct

SEQ ID NO: 151332 - DNA, 22 bp, Homo sapiens
gcttttcactgctggctgcctt

SEQ ID NO: 151333 - DNA, 23 bp, Homo sapiens
gcttttccttggggcaggcagtg

SEQ ID NO: 151334 - DNA, 15 bp, Homo sapiens
gcttttgctggtcac

SEQ ID NO: 151335 - DNA, 19 bp, Homo sapiens
gcttttgctggtcactgcc

SEQ ID NO: 151336 - DNA, 12 bp, Homo sapiens
ggaaaaatgtgt

SEQ ID NO: 151337 - DNA, 21 bp, Homo sapiens
ggaaaagagatggcctgagaa

SEQ ID NO: 151338 - DNA, 12 bp, Homo sapiens
ggaaaattattt

SEQ ID NO: 151339 - DNA, 13 bp, Homo sapiens
ggaaactgccagc

SEQ ID NO: 151340 - DNA, 20 bp, Homo sapiens
ggaaaggccagctggcagca

SEQ ID NO: 151341 - DNA, 22 bp, Homo sapiens
ggaaaggccagctggcagcaga

SEQ ID NO: 151342 - DNA, 15 bp, Homo sapiens
ggaaataaaaccttt

SEQ ID NO: 151343 - DNA, 20 bp, Homo sapiens
ggaaataaaacctttcaaat

SEQ ID NO: 151344 - DNA, 20 bp, Homo sapiens
ggaaataataaagatgctct

SEQ ID NO: 151345 - DNA, 22 bp, Homo sapiens
ggaaatatcagttactcagccc

SEQ ID NO: 151346 - DNA, 15 bp, Homo sapiens
ggaaccgcaggaagc

SEQ ID NO: 151347 - DNA, 16 bp, Homo sapiens
ggaacgtgactgcccc

SEQ ID NO: 151348 - DNA, 23 bp, Homo sapiens
ggaactagactcccaagctggac

SEQ ID NO: 151349 - DNA, 21 bp, Homo sapiens
ggaactagagggatacactga

SEQ ID NO: 151350 - DNA, 15 bp, Homo sapiens
ggaactgtccagaga

SEQ ID NO: 151351 - DNA, 17 bp, Homo sapiens
ggaactgtccagagagc

SEQ ID NO: 151352 - DNA, 18 bp, Homo sapiens
ggaactgtccagagagca

SEQ ID NO: 151353 - DNA, 21 bp, Homo sapiens
ggaagaccagctttgcagtga

SEQ ID NO: 151354 - DNA, 16 bp, Homo sapiens
ggaagacgcctgagct

SEQ ID NO: 151355 - DNA, 13 bp, Homo sapiens
ggaagagaaaaaa

SEQ ID NO: 151356 - DNA, 13 bp, Homo sapiens
ggaagagccttgc

SEQ ID NO: 151357 - DNA, 15 bp, Homo sapiens
ggaagagggacagat

SEQ ID NO: 151358 - DNA, 21 bp, Homo sapiens
ggaagcatgtaggagaatcca

SEQ ID NO: 151359 - DNA, 16 bp, Homo sapiens
ggaagcattcagagag

SEQ ID NO: 151360 - DNA, 15 bp, Homo sapiens
ggaagccctggattt

SEQ ID NO: 151361 - DNA, 22 bp, Homo sapiens
ggaagcgtgaaggccgagaagc

SEQ ID NO: 151362 - DNA, 14 bp, Homo sapiens
ggaagctccactgt

SEQ ID NO: 151363 - DNA, 23 bp, Homo sapiens
ggaagctccactgtcaccctcca

SEQ ID NO: 151364 - DNA, 20 bp, Homo sapiens
ggaagcttccagtccaatct

SEQ ID NO: 151365 - DNA, 20 bp, Homo sapiens
ggaaggagactcacctctgc

SEQ ID NO: 151366 - DNA, 17 bp, Homo sapiens
ggaaggctgagaggaga

SEQ ID NO: 151367 - DNA, 18 bp, Homo sapiens
ggaaggtttgtatattgt

SEQ ID NO: 151368 - DNA, 13 bp, Homo sapiens
ggaagtcaaagca

SEQ ID NO: 151369 - DNA, 17 bp, Homo sapiens
ggaagtctaggagctgg

SEQ ID NO: 151370 - DNA, 21 bp, Homo sapiens
ggaagtgagggtcagagagga

SEQ ID NO: 151371 - DNA, 12 bp, Homo sapiens
ggaatacagtgt

SEQ ID NO: 151372 - DNA, 19 bp, Homo sapiens
ggaatcatgtcaggcctgt

SEQ ID NO: 151373 - DNA, 24 bp, Homo sapiens
ggaatcatttctatttctcctcca

SEQ ID NO: 151374 - DNA, 16 bp, Homo sapiens
ggaatgttaaagtcag

SEQ ID NO: 151375 - DNA, 22 bp, Homo sapiens
ggacaaaaatgaactgaagttt

SEQ ID NO: 151376 - DNA, 20 bp, Homo sapiens
ggacaagcagaggtggccag

SEQ ID NO: 151377 - DNA, 21 bp, Homo sapiens
ggacaatcatgaaatatgcat

SEQ ID NO: 151378 - DNA, 17 bp, Homo sapiens
ggacaccacacccagcc

SEQ ID NO: 151379 - DNA, 18 bp, Homo sapiens
ggacaccacacccagcct

SEQ ID NO: 151380 - DNA, 21 bp, Homo sapiens
ggacaccacacccagcctcag

SEQ ID NO: 151381 - DNA, 15 bp, Homo sapiens
ggacacctgccctgc

SEQ ID NO: 151382 - DNA, 18 bp, Homo sapiens
ggacactccagtgccagc

SEQ ID NO: 151383 - DNA, 14 bp, Homo sapiens
ggacagagacacct

SEQ ID NO: 151384 - DNA, 17 bp, Homo sapiens
ggacagagacacctgca

SEQ ID NO: 151385 - DNA, 21 bp, Homo sapiens
ggacatgtttttgttttcttt

SEQ ID NO: 151386 - DNA, 13 bp, Homo sapiens
ggacccctgccct

SEQ ID NO: 151387 - DNA, 12 bp, Homo sapiens
ggaccctttcct

SEQ ID NO: 151388 - DNA, 21 bp, Homo sapiens
ggaccctttccttccttccct

SEQ ID NO: 151389 - DNA, 22 bp, Homo sapiens
ggaccctttccttccttccctg

SEQ ID NO: 151390 - DNA, 23 bp, Homo sapiens
ggaccctttccttccttccctgg

SEQ ID NO: 151391 - DNA, 17 bp, Homo sapiens
ggaccggtacagaaagg

SEQ ID NO: 151392 - DNA, 19 bp, Homo sapiens
ggacctcaggtgagaagca

SEQ ID NO: 151393 - DNA, 20 bp, Homo sapiens
ggactcaggatgcccagggc

SEQ ID NO: 151394 - DNA, 20 bp, Homo sapiens
ggactctcagtctctgagca

SEQ ID NO: 151395 - DNA, 11 bp, Homo sapiens
ggactgggagg

SEQ ID NO: 151396 - DNA, 17 bp, Homo sapiens
ggactggggatgtggga

SEQ ID NO: 151397 - DNA, 23 bp, Homo sapiens
ggactgttgacatccaagcttcc

SEQ ID NO: 151398 - DNA, 15 bp, Homo sapiens
ggacttagaaagcag

SEQ ID NO: 151399 - DNA, 17 bp, Homo sapiens
ggactttgcagccggca

SEQ ID NO: 151400 - DNA, 22 bp, Homo sapiens
ggactttgcagccggcacaggg

SEQ ID NO: 151401 - DNA, 14 bp, Homo sapiens
ggagaagagaggag

SEQ ID NO: 151402 - DNA, 22 bp, Homo sapiens
ggagaagagaggagaggagaga

SEQ ID NO: 151403 - DNA, 15 bp, Homo sapiens
ggagaagcagtgagc

SEQ ID NO: 151404 - DNA, 16 bp, Homo sapiens
gtgttacctgaaaaca

SEQ ID NO: 151405 - DNA, 16 bp, Homo sapiens
gtgttagggaagggcc

SEQ ID NO: 151406 - DNA, 19 bp, Homo sapiens
gtgttccccatctgggtcc

SEQ ID NO: 151407 - DNA, 18 bp, Homo sapiens
gtgttccccttccactga

SEQ ID NO: 151408 - DNA, 19 bp, Homo sapiens
gtgttccccttccactgag

SEQ ID NO: 151409 - DNA, 21 bp, Homo sapiens
gtgttggctaatgaagggaaa

SEQ ID NO: 151410 - DNA, 21 bp, Homo sapiens
gtgttgggatactgcagggcc

SEQ ID NO: 151411 - DNA, 12 bp, Homo sapiens
gtgttgtctcta

SEQ ID NO: 151412 - DNA, 18 bp, Homo sapiens
gtgtttccacagcctgca

SEQ ID NO: 151413 - DNA, 14 bp, Homo sapiens
gtgttttcataata

SEQ ID NO: 151414 - DNA, 15 bp, Homo sapiens
gtgttttcataataa

SEQ ID NO: 151415 - DNA, 16 bp, Homo sapiens
gtgttttcataataaa

SEQ ID NO: 151416 - DNA, 16 bp, Homo sapiens
gttaaaagatgaaaat

SEQ ID NO: 151417 - DNA, 20 bp, Homo sapiens
gttaaaagatgaaaatattt

SEQ ID NO: 151418 - DNA, 15 bp, Homo sapiens
gttaaagctgccggc

SEQ ID NO: 151419 - DNA, 21 bp, Homo sapiens
gttaatatatcccagaaatta

SEQ ID NO: 151420 - DNA, 15 bp, Homo sapiens
gttaatatttaagac

SEQ ID NO: 151421 - DNA, 18 bp, Homo sapiens
gttaattcagcactgatt

SEQ ID NO: 151422 - DNA, 21 bp, Homo sapiens
gttaattcagcactgatttca

SEQ ID NO: 151423 - DNA, 14 bp, Homo sapiens
gttaatttttccta

SEQ ID NO: 151424 - DNA, 14 bp, Homo sapiens
gttacattaatgtt

SEQ ID NO: 151425 - DNA, 16 bp, Homo sapiens
gttacattaatgttaa

SEQ ID NO: 151426 - DNA, 16 bp, Homo sapiens
gttacttcactttaat

SEQ ID NO: 151427 - DNA, 14 bp, Homo sapiens
gttagaatgaggag

SEQ ID NO: 151428 - DNA, 16 bp, Homo sapiens
gttagaatgaggagga

SEQ ID NO: 151429 - DNA, 17 bp, Homo sapiens
gttagccaatatttttc

SEQ ID NO: 151430 - DNA, 14 bp, Homo sapiens
gttaggaaataaaa

SEQ ID NO: 151431 - DNA, 22 bp, Homo sapiens
gttaggaaataaaacctttcaa

SEQ ID NO: 151432 - DNA, 23 bp, Homo sapiens
gttaggaaataaaacctttcaaa

SEQ ID NO: 151433 - DNA, 15 bp, Homo sapiens
gttaggatttaacag

SEQ ID NO: 151434 - DNA, 23 bp, Homo sapiens
gttagggtgctctggaagagagg

SEQ ID NO: 151435 - DNA, 13 bp, Homo sapiens
gttatttaaatga

SEQ ID NO: 151436 - DNA, 12 bp, Homo sapiens
gttattttcagt

SEQ ID NO: 151437 - DNA, 17 bp, Homo sapiens
gttattttcagtatttt

SEQ ID NO: 151438 - DNA, 20 bp, Homo sapiens
gttatttttacattctgaat

SEQ ID NO: 151439 - DNA, 12 bp, Homo sapiens
gttcacccctcc

SEQ ID NO: 151440 - DNA, 20 bp, Homo sapiens
gttcacttttgacaaaggca

SEQ ID NO: 151441 - DNA, 14 bp, Homo sapiens
ggaggaggaggcaa

SEQ ID NO: 151442 - DNA, 23 bp, Homo sapiens
ggaggaggtttaggtcaagaaga

SEQ ID NO: 151443 - DNA, 13 bp, Homo sapiens
ggaggcagggcct

SEQ ID NO: 151444 - DNA, 18 bp, Homo sapiens
ggaggccaaggtgggagg

SEQ ID NO: 151445 - DNA, 14 bp, Homo sapiens
ggaggccaggccgg

SEQ ID NO: 151446 - DNA, 23 bp, Homo sapiens
ggaggccaggccggcgagccctg

SEQ ID NO: 151447 - DNA, 17 bp, Homo sapiens
ggaggccccactgggga

SEQ ID NO: 151448 - DNA, 17 bp, Homo sapiens
ggaggcccgtccggcag

SEQ ID NO: 151449 - DNA, 16 bp, Homo sapiens
ggaggctccagagggc

SEQ ID NO: 151450 - DNA, 18 bp, Homo sapiens
ggaggctgaggcagaaga

SEQ ID NO: 151451 - DNA, 16 bp, Homo sapiens
ggagggagcagacagg

SEQ ID NO: 151452 - DNA, 20 bp, Homo sapiens
ggagggatagaggggggctg

SEQ ID NO: 151453 - DNA, 15 bp, Homo sapiens
ggagggcagcagggc

SEQ ID NO: 151454 - DNA, 19 bp, Homo sapiens
ggagggccacatgggaggc

SEQ ID NO: 151455 - DNA, 17 bp, Homo sapiens
ggagggcgtgactcacc

SEQ ID NO: 151456 - DNA, 13 bp, Homo sapiens
ggaggggacgctg

SEQ ID NO: 151457 - DNA, 15 bp, Homo sapiens
ggagggtcaggaagg

SEQ ID NO: 151458 - DNA, 16 bp, Homo sapiens
ggaggtgggagcagga

SEQ ID NO: 151459 - DNA, 21 bp, Homo sapiens
ggaggttaaggctgaggaaag

SEQ ID NO: 151460 - DNA, 16 bp, Homo sapiens
ggaggttctctcggag

SEQ ID NO: 151461 - DNA, 14 bp, Homo sapiens
ggagtatctgggaa

SEQ ID NO: 151462 - DNA, 15 bp, Homo sapiens
ggagtatgcaaaagt

SEQ ID NO: 151463 - DNA, 23 bp, Homo sapiens
ggagtcatctcaaccatcccctc

SEQ ID NO: 151464 - DNA, 15 bp, Homo sapiens
ggagttagaggccag

SEQ ID NO: 151465 - DNA, 22 bp, Homo sapiens
ggagttgtcaagtctctgctgg

SEQ ID NO: 151466 - DNA, 21 bp, Homo sapiens
ggatactgcagggccaggact

SEQ ID NO: 151467 - DNA, 22 bp, Homo sapiens
ggatcaaaccccgaccacctgc

SEQ ID NO: 151468 - DNA, 16 bp, Homo sapiens
ggatcagaacagcaga

SEQ ID NO: 151469 - DNA, 19 bp, Homo sapiens
ggatctgggaccctttcct

SEQ ID NO: 151470 - DNA, 15 bp, Homo sapiens
ggatctgtgcccaga

SEQ ID NO: 151471 - DNA, 21 bp, Homo sapiens
ggatgaattccaaattctgct

SEQ ID NO: 151472 - DNA, 15 bp, Homo sapiens
ggatgacatgtccct

SEQ ID NO: 151473 - DNA, 21 bp, Homo sapiens
ggatgagaatttgagtgctct

SEQ ID NO: 151474 - DNA, 23 bp, Homo sapiens
ggatgagaatttgagtgctctga

SEQ ID NO: 151475 - DNA, 16 bp, Homo sapiens
ggatgaggtgctggga

SEQ ID NO: 151476 - DNA, 17 bp, Homo sapiens
ggatgaggtgctgggag

SEQ ID NO: 151477 - DNA, 18 bp, Homo sapiens
ggatgaggtgctgggagg

SEQ ID NO: 151478 - DNA, 15 bp, Homo sapiens
ggatgatgcctcatg

SEQ ID NO: 151479 - DNA, 14 bp, Homo sapiens
ggatggaggagaag

SEQ ID NO: 151480 - DNA, 17 bp, Homo sapiens
ggatgtaaacagtgcct

SEQ ID NO: 151481 - DNA, 18 bp, Homo sapiens
ggatgtaaacagtgcctg

SEQ ID NO: 151482 - DNA, 22 bp, Homo sapiens
ggatgtatccatgggggcaggg

SEQ ID NO: 151483 - DNA, 17 bp, Homo sapiens
ggatgtccacagatgcc

SEQ ID NO: 151484 - DNA, 20 bp, Homo sapiens
ggatgttcagcactgtccct

SEQ ID NO: 151485 - DNA, 15 bp, Homo sapiens
ggatgttctggccct

SEQ ID NO: 151486 - DNA, 22 bp, Homo sapiens
ggatgttgaaaaagttctgcag

SEQ ID NO: 151487 - DNA, 16 bp, Homo sapiens
ggattaacctctgcac

SEQ ID NO: 151488 - DNA, 22 bp, Homo sapiens
ggattattcatttaaaatgatt

SEQ ID NO: 151489 - DNA, 13 bp, Homo sapiens
ggattgagtctgt

SEQ ID NO: 151490 - DNA, 17 bp, Homo sapiens
ggattgcacgtggcctc

SEQ ID NO: 151491 - DNA, 21 bp, Homo sapiens
ggatttaacagtcatttaaaa

SEQ ID NO: 151492 - DNA, 19 bp, Homo sapiens
ggatttgggttggaagtga

SEQ ID NO: 151493 - DNA, 14 bp, Homo sapiens
ggcaactgaggcag

SEQ ID NO: 151494 - DNA, 20 bp, Homo sapiens
ggcaactgaggcagacagca

SEQ ID NO: 151495 - DNA, 18 bp, Homo sapiens
ggcaacttgggaactaga

SEQ ID NO: 151496 - DNA, 22 bp, Homo sapiens
ggcacaagcaaaagggtgtctg

SEQ ID NO: 151497 - DNA, 21 bp, Homo sapiens
ggcacacacctgtagtcccag

SEQ ID NO: 151498 - DNA, 21 bp, Homo sapiens
ggcacagaaacacaatatttt

SEQ ID NO: 151499 - DNA, 21 bp, Homo sapiens
ggcacagttttctgagaaaga

SEQ ID NO: 151500 - DNA, 16 bp, Homo sapiens
ggcaccagcagcctgg

SEQ ID NO: 151501 - DNA, 23 bp, Homo sapiens
ggcacctcctacgtcaaacatga

SEQ ID NO: 151502 - DNA, 20 bp, Homo sapiens
ggcacgagcaaagtgaagac

SEQ ID NO: 151503 - DNA, 19 bp, Homo sapiens
ggcactgggatgagccgct

SEQ ID NO: 151504 - DNA, 22 bp, Homo sapiens
ggcagaaagcaaatgtgacctg

SEQ ID NO: 151505 - DNA, 14 bp, Homo sapiens
ggcagaacagccgc

SEQ ID NO: 151506 - DNA, 23 bp, Homo sapiens
ggcagaagaattgaacccaggag

SEQ ID NO: 151507 - DNA, 17 bp, Homo sapiens
ggcagaaggcaaaccca

SEQ ID NO: 151508 - DNA, 17 bp, Homo sapiens
ggcagacacggatctga

SEQ ID NO: 151509 - DNA, 19 bp, Homo sapiens
ggcagacacggatctgaga

SEQ ID NO: 151510 - DNA, 21 bp, Homo sapiens
ggcagacacggatctgagaat

SEQ ID NO: 151511 - DNA, 16 bp, Homo sapiens
ggcagacagcagctca

SEQ ID NO: 151512 - DNA, 19 bp, Homo sapiens
ggcagacagcagctcaggc

SEQ ID NO: 151513 - DNA, 9 bp, Homo sapiens
ggcagagag

SEQ ID NO: 151514 - DNA, 10 bp, Homo sapiens
ggcagagagc

SEQ ID NO: 151515 - DNA, 23 bp, Homo sapiens
ggcagaggctggaggcagggcct

SEQ ID NO: 151516 - DNA, 14 bp, Homo sapiens
ggcagagggcagag

SEQ ID NO: 151517 - DNA, 16 bp, Homo sapiens
ggcagagggcagaggc

SEQ ID NO: 151518 - DNA, 20 bp, Homo sapiens
ggcagagggcagaggctgga

SEQ ID NO: 151519 - DNA, 15 bp, Homo sapiens
ggcagagttgtaaat

SEQ ID NO: 151520 - DNA, 17 bp, Homo sapiens
ggcagagttgtaaatat

SEQ ID NO: 151521 - DNA, 23 bp, Homo sapiens
ggcagagttgtaaatatataaat

SEQ ID NO: 151522 - DNA, 24 bp, Homo sapiens
ggcagatttagtgaaagctagaga

SEQ ID NO: 151523 - DNA, 14 bp, Homo sapiens
ggcagcacagagac

SEQ ID NO: 151524 - DNA, 14 bp, Homo sapiens
ggcagcagtgtgag

SEQ ID NO: 151525 - DNA, 18 bp, Homo sapiens
ggcagccgtgccttcagc

SEQ ID NO: 151526 - DNA, 14 bp, Homo sapiens
ggcaggaaggctga

SEQ ID NO: 151527 - DNA, 18 bp, Homo sapiens
ggcaggacaacgaggaag

SEQ ID NO: 151528 - DNA, 19 bp, Homo sapiens
ggcaggacaacgaggaagc

SEQ ID NO: 151529 - DNA, 20 bp, Homo sapiens
ggcaggacaacgaggaagcc

SEQ ID NO: 151530 - DNA, 21 bp, Homo sapiens
ggcaggacaacgaggaagccc

SEQ ID NO: 151531 - DNA, 16 bp, Homo sapiens
ggcagggccccaggca

SEQ ID NO: 151532 - DNA, 16 bp, Homo sapiens
ggcagggccttgccca

SEQ ID NO: 151533 - DNA, 12 bp, Homo sapiens
ggcaggggcgga

SEQ ID NO: 151534 - DNA, 12 bp, Homo sapiens
ggcagggtccta

SEQ ID NO: 151535 - DNA, 21 bp, Homo sapiens
ggcagggtgggatggaggaga

SEQ ID NO: 151536 - DNA, 15 bp, Homo sapiens
ggcaggtagccaggg

SEQ ID NO: 151537 - DNA, 17 bp, Homo sapiens
ggcaggtgggagcttga

SEQ ID NO: 151538 - DNA, 15 bp, Homo sapiens
ggcaggttggtgggg

SEQ ID NO: 151539 - DNA, 19 bp, Homo sapiens
ggcagtcgatagagctgta

SEQ ID NO: 151540 - DNA, 15 bp, Homo sapiens
ggcagtgagtgagcc

SEQ ID NO: 151541 - DNA, 16 bp, Homo sapiens
ggcagtgagtgagcct

SEQ ID NO: 151542 - DNA, 21 bp, Homo sapiens
ggcagtgggacagggcatggc

SEQ ID NO: 151543 - DNA, 19 bp, Homo sapiens
ggcatagcccagacacaga

SEQ ID NO: 151544 - DNA, 23 bp, Homo sapiens
ggcatcaccttaggcagggaagt

SEQ ID NO: 151545 - DNA, 18 bp, Homo sapiens
ggcatgccccggccacct

SEQ ID NO: 151546 - DNA, 21 bp, Homo sapiens
ggcatgccccggccacctctg

SEQ ID NO: 151547 - DNA, 22 bp, Homo sapiens
ggcatgccccggccacctctgc

SEQ ID NO: 151548 - DNA, 17 bp, Homo sapiens
ggcatggccaggtggcc

SEQ ID NO: 151549 - DNA, 21 bp, Homo sapiens
ggccaaaggagggtcaggaag

SEQ ID NO: 151550 - DNA, 21 bp, Homo sapiens
ggccaaattatttgtgtaata

SEQ ID NO: 151551 - DNA, 23 bp, Homo sapiens
ggccaagacttggcaacagaagc

SEQ ID NO: 151552 - DNA, 12 bp, Homo sapiens
ggccacctctgc

SEQ ID NO: 151553 - DNA, 23 bp, Homo sapiens
ggccacctctgcggaccccagct

SEQ ID NO: 151554 - DNA, 17 bp, Homo sapiens
ggccacgtgccaggccc

SEQ ID NO: 151555 - DNA, 20 bp, Homo sapiens
ggccactctgcctctgcctg

SEQ ID NO: 151556 - DNA, 13 bp, Homo sapiens
taaaacttgctgc

SEQ ID NO: 151557 - DNA, 17 bp, Homo sapiens
taaaactttcctcgcct

SEQ ID NO: 151558 - DNA, 15 bp, Homo sapiens
taaaactttgctgcc

SEQ ID NO: 151559 - DNA, 22 bp, Homo sapiens
taaaagaaagcctcagagaatt

SEQ ID NO: 151560 - DNA, 18 bp, Homo sapiens
taaaagcataaatgcaaa

SEQ ID NO: 151561 - DNA, 21 bp, Homo sapiens
taaaaggaaatctcaccccat

SEQ ID NO: 151562 - DNA, 15 bp, Homo sapiens
taaaagttgtgattc

SEQ ID NO: 151563 - DNA, 21 bp, Homo sapiens
taaaagttgtgattccagata

SEQ ID NO: 151564 - DNA, 13 bp, Homo sapiens
taaaataaatata

SEQ ID NO: 151565 - DNA, 23 bp, Homo sapiens
taaaataaatatatataaaccta

SEQ ID NO: 151566 - DNA, 22 bp, Homo sapiens
taaaatattcctgcatttgtga

SEQ ID NO: 151567 - DNA, 10 bp, Homo sapiens
taaaatcatt

SEQ ID NO: 151568 - DNA, 13 bp, Homo sapiens
taaaatcatttct

SEQ ID NO: 151569 - DNA, 22 bp, Homo sapiens
taaaatcatttctgcatcagct

SEQ ID NO: 151570 - DNA, 15 bp, Homo sapiens
taaaatcctcaatcc

SEQ ID NO: 151571 - DNA, 13 bp, Homo sapiens
taaaatcttaaac

SEQ ID NO: 151572 - DNA, 17 bp, Homo sapiens
taaaatgaggacatgtt

SEQ ID NO: 151573 - DNA, 14 bp, Homo sapiens
taaaatgattttat

SEQ ID NO: 151574 - DNA, 17 bp, Homo sapiens
taaaatgattttatctg

SEQ ID NO: 151575 - DNA, 20 bp, Homo sapiens
taaaatgcctcagtgtattt

SEQ ID NO: 151576 - DNA, 9 bp, Homo sapiens
taaaatggt

SEQ ID NO: 151577 - DNA, 15 bp, Homo sapiens
taaaatgttgaaaag

SEQ ID NO: 151578 - DNA, 20 bp, Homo sapiens
taaaatgttgaaaagtcaaa

SEQ ID NO: 151579 - DNA, 16 bp, Homo sapiens
taaaattaaagctgaa

SEQ ID NO: 151580 - DNA, 18 bp, Homo sapiens
taaaattaaagctgaaaa

SEQ ID NO: 151581 - DNA, 19 bp, Homo sapiens
taaaattaaagctgaaaac

SEQ ID NO: 151582 - DNA, 10 bp, Homo sapiens
ggccctgcct

SEQ ID NO: 151583 - DNA, 22 bp, Homo sapiens
ggccctggctcccacaggccct

SEQ ID NO: 151584 - DNA, 19 bp, Homo sapiens
ggcccttcccacaggacat

SEQ ID NO: 151585 - DNA, 13 bp, Homo sapiens
ggcccttcctctc

SEQ ID NO: 151586 - DNA, 18 bp, Homo sapiens
ggcccttcctctccactg

SEQ ID NO: 151587 - DNA, 23 bp, Homo sapiens
ggcccttcctctccactgccttc

SEQ ID NO: 151588 - DNA, 15 bp, Homo sapiens
ggccgcattccctga

SEQ ID NO: 151589 - DNA, 16 bp, Homo sapiens
ggccgcattccctgag

SEQ ID NO: 151590 - DNA, 19 bp, Homo sapiens
ggccgctgttcacccacag

SEQ ID NO: 151591 - DNA, 17 bp, Homo sapiens
ggccggcgagccctgtg

SEQ ID NO: 151592 - DNA, 16 bp, Homo sapiens
ggcctatctaaactgg

SEQ ID NO: 151593 - DNA, 19 bp, Homo sapiens
ggcctattatattaaaata

SEQ ID NO: 151594 - DNA, 14 bp, Homo sapiens
ggcctcccctgctg

SEQ ID NO: 151595 - DNA, 15 bp, Homo sapiens
ggcctcccctgctga

SEQ ID NO: 151596 - DNA, 18 bp, Homo sapiens
ggcctcctctgtccaggg

SEQ ID NO: 151597 - DNA, 23 bp, Homo sapiens
ggcctcgggacacctgccctgcc

SEQ ID NO: 151598 - DNA, 18 bp, Homo sapiens
ggcctcttgagcagtggc

SEQ ID NO: 151599 - DNA, 22 bp, Homo sapiens
ggcctcttgagcagtggctggt

SEQ ID NO: 151600 - DNA, 16 bp, Homo sapiens
ggcctgaaaggagccc

SEQ ID NO: 151601 - DNA, 17 bp, Homo sapiens
ggcctgcaggacctgcc

SEQ ID NO: 151602 - DNA, 13 bp, Homo sapiens
ggcctgccagacg

SEQ ID NO: 151603 - DNA, 19 bp, Homo sapiens
ggcctgctgggctctccac

SEQ ID NO: 151604 - DNA, 22 bp, Homo sapiens
ggcctgctgggctctccacctc

SEQ ID NO: 151605 - DNA, 16 bp, Homo sapiens
ggcgagtcactgcctc

SEQ ID NO: 151606 - DNA, 22 bp, Homo sapiens
ggcgatccacctgtctcagcct

SEQ ID NO: 151607 - DNA, 13 bp, Homo sapiens
ggcgcccacctcc

SEQ ID NO: 151608 - DNA, 22 bp, Homo sapiens
ggcgcgcacctgtaatcccagc

SEQ ID NO: 151609 - DNA, 23 bp, Homo sapiens
ggcggctactcagcagccctcct

SEQ ID NO: 151610 - DNA, 19 bp, Homo sapiens
ggctaagagctagcgctgc

SEQ ID NO: 151611 - DNA, 19 bp, Homo sapiens
ggctaagagtgtcctagga

SEQ ID NO: 151612 - DNA, 12 bp, Homo sapiens
ggctaccctccc

SEQ ID NO: 151613 - DNA, 15 bp, Homo sapiens
ggctactcagcagcc

SEQ ID NO: 151614 - DNA, 23 bp, Homo sapiens
ggctactgcagctttacatgcaa

SEQ ID NO: 151615 - DNA, 15 bp, Homo sapiens
ggctagatcatgaag

SEQ ID NO: 151616 - DNA, 13 bp, Homo sapiens
ggctagtcagaga

SEQ ID NO: 151617 - DNA, 19 bp, Homo sapiens
ggctatgggggcactgagg

SEQ ID NO: 151618 - DNA, 17 bp, Homo sapiens
ggctcacccccttctcc

SEQ ID NO: 151619 - DNA, 13 bp, Homo sapiens
ggctcacgtgtgt

SEQ ID NO: 151620 - DNA, 10 bp, Homo sapiens
ggctcagcct

SEQ ID NO: 151621 - DNA, 11 bp, Homo sapiens
ggctcagcctg

SEQ ID NO: 151622 - DNA, 20 bp, Homo sapiens
ggctcatattcctgcagcct

SEQ ID NO: 151623 - DNA, 21 bp, Homo sapiens
ggctcatattcctgcagcctg

SEQ ID NO: 151624 - DNA, 22 bp, Homo sapiens
ggctccagagggcactctgctt

SEQ ID NO: 151625 - DNA, 17 bp, Homo sapiens
ggctcccacaggccctt

SEQ ID NO: 151626 - DNA, 18 bp, Homo sapiens
ggctcccacaggcccttc

SEQ ID NO: 151627 - DNA, 19 bp, Homo sapiens
ggctcccacaggcccttcc

SEQ ID NO: 151628 - DNA, 18 bp, Homo sapiens
ggctccctgactgggagt

SEQ ID NO: 151629 - DNA, 21 bp, Homo sapiens
ggctccctgtaacctcttcag

SEQ ID NO: 151630 - DNA, 17 bp, Homo sapiens
ggctcctcccggtgccc

SEQ ID NO: 151631 - DNA, 19 bp, Homo sapiens
ggctcgattttgtatctgc

SEQ ID NO: 151632 - DNA, 22 bp, Homo sapiens
ggctcgattttgtatctgcagg

SEQ ID NO: 151633 - DNA, 18 bp, Homo sapiens
ggctcgttgactggctgt

SEQ ID NO: 151634 - DNA, 12 bp, Homo sapiens
ggctctcagctc

SEQ ID NO: 151635 - DNA, 13 bp, Homo sapiens
ggctctccacctc

SEQ ID NO: 151636 - DNA, 13 bp, Homo sapiens
ggctctgccctgc

SEQ ID NO: 151637 - DNA, 12 bp, Homo sapiens
ggctctggagac

SEQ ID NO: 151638 - DNA, 14 bp, Homo sapiens
ggctctggagagaa

SEQ ID NO: 151639 - DNA, 18 bp, Homo sapiens
ggctcttagcagcttcca

SEQ ID NO: 151640 - DNA, 20 bp, Homo sapiens
ggctcttagcagcttccaga

SEQ ID NO: 151641 - DNA, 14 bp, Homo sapiens
ggctcttctccttt

SEQ ID NO: 151642 - DNA, 20 bp, Homo sapiens
ggctcttgtgctggatggag

SEQ ID NO: 151643 - DNA, 16 bp, Homo sapiens
ggctgaatagcagaag

SEQ ID NO: 151644 - DNA, 17 bp, Homo sapiens
ggctgacccagtccctg

SEQ ID NO: 151645 - DNA, 14 bp, Homo sapiens
ggctgaggcagaag

SEQ ID NO: 151646 - DNA, 17 bp, Homo sapiens
ggctgaggcagaagaat

SEQ ID NO: 151647 - DNA, 14 bp, Homo sapiens
ggctgaggcctgga

SEQ ID NO: 151648 - DNA, 16 bp, Homo sapiens
ggctgaggcctggact

SEQ ID NO: 151649 - DNA, 13 bp, Homo sapiens
ggctgaggtggga

SEQ ID NO: 151650 - DNA, 15 bp, Homo sapiens
ggctgccctggtgct

SEQ ID NO: 151651 - DNA, 19 bp, Homo sapiens
ggctgccctggtgctgcca

SEQ ID NO: 151652 - DNA, 19 bp, Homo sapiens
ggctgctcctccagggcca

SEQ ID NO: 151653 - DNA, 23 bp, Homo sapiens
ggctgctcctccagggccacgtg

SEQ ID NO: 151654 - DNA, 13 bp, Homo sapiens
ggctgctggagga

SEQ ID NO: 151655 - DNA, 14 bp, Homo sapiens
ggctgctggaggaa

SEQ ID NO: 151656 - DNA, 23 bp, Homo sapiens
ggctggagcccagggagcggaaa

SEQ ID NO: 151657 - DNA, 23 bp, Homo sapiens
ggctggaggcagggccttgccca

SEQ ID NO: 151658 - DNA, 13 bp, Homo sapiens
ggctgggcagctg

SEQ ID NO: 151659 - DNA, 23 bp, Homo sapiens
ggctggtccagggctagtgactt

SEQ ID NO: 151660 - DNA, 15 bp, Homo sapiens
ggctgtagaaggaga

SEQ ID NO: 151661 - DNA, 15 bp, Homo sapiens
ggctgtcagcaggaa

SEQ ID NO: 151662 - DNA, 23 bp, Homo sapiens
ggctgtcttctcaggctctgccc

SEQ ID NO: 151663 - DNA, 13 bp, Homo sapiens
ggctgtgcctctg

SEQ ID NO: 151664 - DNA, 12 bp, Homo sapiens
ggcttcacagat

SEQ ID NO: 151665 - DNA, 20 bp, Homo sapiens
ggcttcacggaagagccttg

SEQ ID NO: 151666 - DNA, 18 bp, Homo sapiens
ggcttccatttgtgtgtg

SEQ ID NO: 151667 - DNA, 22 bp, Homo sapiens
ggcttccatttgtgtgtgtgca

SEQ ID NO: 151668 - DNA, 17 bp, Homo sapiens
ggcttcccgctcagccc

SEQ ID NO: 151669 - DNA, 18 bp, Homo sapiens
ggcttcccgctcagccct

SEQ ID NO: 151670 - DNA, 12 bp, Homo sapiens
ggcttctcctga

SEQ ID NO: 151671 - DNA, 16 bp, Homo sapiens
ggcttctcctgaccca

SEQ ID NO: 151672 - DNA, 11 bp, Homo sapiens
ggcttgctgcc

SEQ ID NO: 151673 - DNA, 17 bp, Homo sapiens
ggcttgtaactccacca

SEQ ID NO: 151674 - DNA, 22 bp, Homo sapiens
ggcttttcactgctggctgcct

SEQ ID NO: 151675 - DNA, 23 bp, Homo sapiens
gggaaaatcagcctgctccagct

SEQ ID NO: 151676 - DNA, 18 bp, Homo sapiens
gggaaaattatttgcata

SEQ ID NO: 151677 - DNA, 15 bp, Homo sapiens
gggaaaggatatttt

SEQ ID NO: 151678 - DNA, 14 bp, Homo sapiens
gggaacagacagga

SEQ ID NO: 151679 - DNA, 18 bp, Homo sapiens
gggaacagacaggagaaa

SEQ ID NO: 151680 - DNA, 18 bp, Homo sapiens
gggaaccatgaagacagg

SEQ ID NO: 151681 - DNA, 20 bp, Homo sapiens
gggaacccaagtccaagcat

SEQ ID NO: 151682 - DNA, 17 bp, Homo sapiens
gggaacgtgactgcccc

SEQ ID NO: 151683 - DNA, 17 bp, Homo sapiens
gggaaggaggctggctt

SEQ ID NO: 151684 - DNA, 12 bp, Homo sapiens
gggaatatttta

SEQ ID NO: 151685 - DNA, 17 bp, Homo sapiens
gggacagagacacctgc

SEQ ID NO: 151686 - DNA, 20 bp, Homo sapiens
gggacagagacacctgcacc

SEQ ID NO: 151687 - DNA, 13 bp, Homo sapiens
gggacagagcaga

SEQ ID NO: 151688 - DNA, 18 bp, Homo sapiens
gggaccggtacagaaagg

SEQ ID NO: 151689 - DNA, 13 bp, Homo sapiens
gggacttgaagtt

SEQ ID NO: 151690 - DNA, 10 bp, Homo sapiens
gggagaaaac

SEQ ID NO: 151691 - DNA, 15 bp, Homo sapiens
gggagaaaagacatg

SEQ ID NO: 151692 - DNA, 16 bp, Homo sapiens
gggagactgggctgag

SEQ ID NO: 151693 - DNA, 20 bp, Homo sapiens
gggagactgggctgagggag

SEQ ID NO: 151694 - DNA, 15 bp, Homo sapiens
gggagagggtctgga

SEQ ID NO: 151695 - DNA, 12 bp, Homo sapiens
gggagcaggaga

SEQ ID NO: 151696 - DNA, 21 bp, Homo sapiens
gggagcaggagattgagaagg

SEQ ID NO: 151697 - DNA, 12 bp, Homo sapiens
gggagctctgca

SEQ ID NO: 151698 - DNA, 23 bp, Homo sapiens
gggaggattgcttgagctcagga

SEQ ID NO: 151699 - DNA, 11 bp, Homo sapiens
gggaggcagag

SEQ ID NO: 151700 - DNA, 20 bp, Homo sapiens
gggaggcagaggttgcagtg

SEQ ID NO: 151701 - DNA, 22 bp, Homo sapiens
gggaggggtaaaattccttagc

SEQ ID NO: 151702 - DNA, 15 bp, Homo sapiens
gggaggtcgaggcag

SEQ ID NO: 151703 - DNA, 17 bp, Homo sapiens
gggaggtcgaggcagga

SEQ ID NO: 151704 - DNA, 16 bp, Homo sapiens
gggaggtcgaggtagg

SEQ ID NO: 151705 - DNA, 18 bp, Homo sapiens
gggatggaggagaagaat

SEQ ID NO: 151706 - DNA, 18 bp, Homo sapiens
gggatggtggagggccac

SEQ ID NO: 151707 - DNA, 16 bp, Homo sapiens
gggatgttctggccct

SEQ ID NO: 151708 - DNA, 21 bp, Homo sapiens
gggattctactttaagcacta

SEQ ID NO: 151709 - DNA, 16 bp, Homo sapiens
gggattgtaaaatggt

SEQ ID NO: 151710 - DNA, 17 bp, Homo sapiens
gggattgtaaaatggtg

SEQ ID NO: 151711 - DNA, 14 bp, Homo sapiens
taagttacttcact

SEQ ID NO: 151712 - DNA, 20 bp, Homo sapiens
taagttatttttacattctg

SEQ ID NO: 151713 - DNA, 16 bp, Homo sapiens
taagtttgatttcatt

SEQ ID NO: 151714 - DNA, 13 bp, Homo sapiens
taataaacattct

SEQ ID NO: 151715 - DNA, 16 bp, Homo sapiens
taataaagatgctctt

SEQ ID NO: 151716 - DNA, 17 bp, Homo sapiens
taataaagatgctcttt

SEQ ID NO: 151717 - DNA, 19 bp, Homo sapiens
taataaatatttttgccat

SEQ ID NO: 151718 - DNA, 15 bp, Homo sapiens
taataaggttgaaca

SEQ ID NO: 151719 - DNA, 16 bp, Homo sapiens
taatagaaaactgaaa

SEQ ID NO: 151720 - DNA, 19 bp, Homo sapiens
taatagaaaactgaaaatc

SEQ ID NO: 151721 - DNA, 21 bp, Homo sapiens
taatagagcaaaattgatgtg

SEQ ID NO: 151722 - DNA, 16 bp, Homo sapiens
taatataactgcctta

SEQ ID NO: 151723 - DNA, 22 bp, Homo sapiens
taatataactgccttaaaactt

SEQ ID NO: 151724 - DNA, 23 bp, Homo sapiens
taatataactgccttaaaacttt

SEQ ID NO: 151725 - DNA, 14 bp, Homo sapiens
gggcagtctggagg

SEQ ID NO: 151726 - DNA, 15 bp, Homo sapiens
gggcagtctggaggg

SEQ ID NO: 151727 - DNA, 15 bp, Homo sapiens
gggcatactaataaa

SEQ ID NO: 151728 - DNA, 15 bp, Homo sapiens
gggcatggccaggtg

SEQ ID NO: 151729 - DNA, 13 bp, Homo sapiens
gggccaagcccag

SEQ ID NO: 151730 - DNA, 17 bp, Homo sapiens
gggccacctccccaggc

SEQ ID NO: 151731 - DNA, 19 bp, Homo sapiens
gggccacctccccaggccg

SEQ ID NO: 151732 - DNA, 16 bp, Homo sapiens
gggccactctgcctct

SEQ ID NO: 151733 - DNA, 16 bp, Homo sapiens
gggccaggacaggccc

SEQ ID NO: 151734 - DNA, 20 bp, Homo sapiens
gggccaggcaggtgcctgga

SEQ ID NO: 151735 - DNA, 23 bp, Homo sapiens
gggccaggcaggtgcctggacat

SEQ ID NO: 151736 - DNA, 14 bp, Homo sapiens
gggcccagagcagg

SEQ ID NO: 151737 - DNA, 15 bp, Homo sapiens
gggccccaccaccta

SEQ ID NO: 151738 - DNA, 17 bp, Homo sapiens
gggcccctcaccctgcc

SEQ ID NO: 151739 - DNA, 12 bp, Homo sapiens
gggccctgagct

SEQ ID NO: 151740 - DNA, 17 bp, Homo sapiens
gggccctttgagtgcag

SEQ ID NO: 151741 - DNA, 17 bp, Homo sapiens
gggcctactagagtctg

SEQ ID NO: 151742 - DNA, 22 bp, Homo sapiens
gggcctcggtgtggagaagcgg

SEQ ID NO: 151743 - DNA, 17 bp, Homo sapiens
gggcctgagccaagcta

SEQ ID NO: 151744 - DNA, 16 bp, Homo sapiens
gggcctgagcctggcc

SEQ ID NO: 151745 - DNA, 18 bp, Homo sapiens
gggcctgcaggacctgcc

SEQ ID NO: 151746 - DNA, 22 bp, Homo sapiens
gggcctggcagccgtgccttca

SEQ ID NO: 151747 - DNA, 12 bp, Homo sapiens
gggccttgccca

SEQ ID NO: 151748 - DNA, 15 bp, Homo sapiens
gggccttgcccagag

SEQ ID NO: 151749 - DNA, 22 bp, Homo sapiens
gggccttgcccagagatgcctc

SEQ ID NO: 151750 - DNA, 23 bp, Homo sapiens
gggctaagagctagcgctgccgc

SEQ ID NO: 151751 - DNA, 22 bp, Homo sapiens
gggctaccctgagctgaggcag

SEQ ID NO: 151752 - DNA, 16 bp, Homo sapiens
gggctcaagcagtcta

SEQ ID NO: 151753 - DNA, 10 bp, Homo sapiens
gggctcagca

SEQ ID NO: 151754 - DNA, 11 bp, Homo sapiens
gggctcagcct

SEQ ID NO: 151755 - DNA, 13 bp, Homo sapiens
gggctcagcctgg

SEQ ID NO: 151756 - DNA, 14 bp, Homo sapiens
gggctctccacctc

SEQ ID NO: 151757 - DNA, 17 bp, Homo sapiens
gggctctccacctcagc

SEQ ID NO: 151758 - DNA, 19 bp, Homo sapiens
gggctctccacctcagcct

SEQ ID NO: 151759 - DNA, 21 bp, Homo sapiens
gggctctccacctcagccttg

SEQ ID NO: 151760 - DNA, 14 bp, Homo sapiens
gggctctggagaga

SEQ ID NO: 151761 - DNA, 14 bp, Homo sapiens
gggctgagggagcc

SEQ ID NO: 151762 - DNA, 16 bp, Homo sapiens
gggctgaggtgggagg

SEQ ID NO: 151763 - DNA, 13 bp, Homo sapiens
gggctgccctggt

SEQ ID NO: 151764 - DNA, 19 bp, Homo sapiens
gggctgctcctccagggcc

SEQ ID NO: 151765 - DNA, 16 bp, Homo sapiens
gggcttctcctgaccc

SEQ ID NO: 151766 - DNA, 13 bp, Homo sapiens
ggggaactcctgg

SEQ ID NO: 151767 - DNA, 23 bp, Homo sapiens
ggggacgctggtagagatggagg

SEQ ID NO: 151768 - DNA, 21 bp, Homo sapiens
ggggactagcccctgtggaga

SEQ ID NO: 151769 - DNA, 19 bp, Homo sapiens
ggggagaacttacattgtg

SEQ ID NO: 151770 - DNA, 12 bp, Homo sapiens
ggggaggagggc

SEQ ID NO: 151771 - DNA, 14 bp, Homo sapiens
ggggagtatgcaaa

SEQ ID NO: 151772 - DNA, 17 bp, Homo sapiens
ggggcagaacagccgct

SEQ ID NO: 151773 - DNA, 11 bp, Homo sapiens
ggggcaggcag

SEQ ID NO: 151774 - DNA, 12 bp, Homo sapiens
ggggcaggcagt

SEQ ID NO: 151775 - DNA, 17 bp, Homo sapiens
ggggcagtctggagggg

SEQ ID NO: 151776 - DNA, 14 bp, Homo sapiens
ggggctacaagagg

SEQ ID NO: 151777 - DNA, 17 bp, Homo sapiens
ggggctgaggtgggagg

SEQ ID NO: 151778 - DNA, 16 bp, Homo sapiens
ggggctgctcctccag

SEQ ID NO: 151779 - DNA, 19 bp, Homo sapiens
ggggctggcggctactcag

SEQ ID NO: 151780 - DNA, 17 bp, Homo sapiens
gggggagtctgaagcag

SEQ ID NO: 151781 - DNA, 12 bp, Homo sapiens
gggggcagaggg

SEQ ID NO: 151782 - DNA, 13 bp, Homo sapiens
gggggcagagggc

SEQ ID NO: 151783 - DNA, 14 bp, Homo sapiens
gggggcagggcatg

SEQ ID NO: 151784 - DNA, 14 bp, Homo sapiens
gggggccaggtgca

SEQ ID NO: 151785 - DNA, 18 bp, Homo sapiens
ggggtagctagaggaacc

SEQ ID NO: 151786 - DNA, 19 bp, Homo sapiens
ggggtagctagaggaacca

SEQ ID NO: 151787 - DNA, 19 bp, Homo sapiens
ggggtctccctctcctgcc

SEQ ID NO: 151788 - DNA, 22 bp, Homo sapiens
ggggtctccctctcctgcctac

SEQ ID NO: 151789 - DNA, 16 bp, Homo sapiens
ggggttcagcccctcc

SEQ ID NO: 151790 - DNA, 22 bp, Homo sapiens
gggtaaaattccttagcttaga

SEQ ID NO: 151791 - DNA, 13 bp, Homo sapiens
gggtaaggtgcct

SEQ ID NO: 151792 - DNA, 14 bp, Homo sapiens
gggtaaggtgcctt

SEQ ID NO: 151793 - DNA, 22 bp, Homo sapiens
gggtagcaggtaccactgattt

SEQ ID NO: 151794 - DNA, 16 bp, Homo sapiens
gggtagctagaggaac

SEQ ID NO: 151795 - DNA, 13 bp, Homo sapiens
gggtcaggaagga

SEQ ID NO: 151796 - DNA, 14 bp, Homo sapiens
gggtcaggagaggg

SEQ ID NO: 151797 - DNA, 21 bp, Homo sapiens
gggtcaggccacggcagccta

SEQ ID NO: 151798 - DNA, 12 bp, Homo sapiens
gggtccatgggc

SEQ ID NO: 151799 - DNA, 18 bp, Homo sapiens
gggtccttccctctcccc

SEQ ID NO: 151800 - DNA, 19 bp, Homo sapiens
gggtctccaggaggagact

SEQ ID NO: 151801 - DNA, 16 bp, Homo sapiens
gggtctccctctcctg

SEQ ID NO: 151802 - DNA, 18 bp, Homo sapiens
gggtctccctctcctgcc

SEQ ID NO: 151803 - DNA, 20 bp, Homo sapiens
gggtctgctctttctctgcc

SEQ ID NO: 151804 - DNA, 21 bp, Homo sapiens
gggtctgctctttctctgcca

SEQ ID NO: 151805 - DNA, 16 bp, Homo sapiens
gggtgctccctaccac

SEQ ID NO: 151806 - DNA, 11 bp, Homo sapiens
gggtggcctcg

SEQ ID NO: 151807 - DNA, 18 bp, Homo sapiens
gggtggctagtcagagag

SEQ ID NO: 151808 - DNA, 12 bp, Homo sapiens
gggtggggctgc

SEQ ID NO: 151809 - DNA, 16 bp, Homo sapiens
gggtgtgggaggcccg

SEQ ID NO: 151810 - DNA, 13 bp, Homo sapiens
gggttcagcccct

SEQ ID NO: 151811 - DNA, 21 bp, Homo sapiens
gggttcagcccctcctctgcc

SEQ ID NO: 151812 - DNA, 22 bp, Homo sapiens
gggttcagcccctcctctgcca

SEQ ID NO: 151813 - DNA, 18 bp, Homo sapiens
gggttctcctctcccctc

SEQ ID NO: 151814 - DNA, 14 bp, Homo sapiens
gggttctttcttcc

SEQ ID NO: 151815 - DNA, 16 bp, Homo sapiens
gggttctttcttcctc

SEQ ID NO: 151816 - DNA, 14 bp, Homo sapiens
gggttttatatttt

SEQ ID NO: 151817 - DNA, 22 bp, Homo sapiens
ggtaacatcctttctattgaaa

SEQ ID NO: 151818 - DNA, 19 bp, Homo sapiens
ggtaataagtactgtgtac

SEQ ID NO: 151819 - DNA, 19 bp, Homo sapiens
ggtactattctgattacac

SEQ ID NO: 151820 - DNA, 14 bp, Homo sapiens
ggtagccaggggga

SEQ ID NO: 151821 - DNA, 14 bp, Homo sapiens
ggtagcttttccct

SEQ ID NO: 151822 - DNA, 20 bp, Homo sapiens
ggtataatggttgactgggt

SEQ ID NO: 151823 - DNA, 13 bp, Homo sapiens
ggtatattcattt

SEQ ID NO: 151824 - DNA, 23 bp, Homo sapiens
ggtcaacatcttttacattctgc

SEQ ID NO: 151825 - DNA, 15 bp, Homo sapiens
ggtcaagcccaggag

SEQ ID NO: 151826 - DNA, 22 bp, Homo sapiens
ggtcacaaatcctaaaagaagc

SEQ ID NO: 151827 - DNA, 17 bp, Homo sapiens
ggtccacatcccgggac

SEQ ID NO: 151828 - DNA, 11 bp, Homo sapiens
ggtccaggaga

SEQ ID NO: 151829 - DNA, 16 bp, Homo sapiens
ggtccccacctgggac

SEQ ID NO: 151830 - DNA, 19 bp, Homo sapiens
ggtcccttgagacctcagc

SEQ ID NO: 151831 - DNA, 17 bp, Homo sapiens
ggtccggtgtccttttc

SEQ ID NO: 151832 - DNA, 14 bp, Homo sapiens
ggtcctggggcctc

SEQ ID NO: 151833 - DNA, 20 bp, Homo sapiens
ggtcgaccccaaagcccctt

SEQ ID NO: 151834 - DNA, 21 bp, Homo sapiens
ggtctcaaactcctgggctca

SEQ ID NO: 151835 - DNA, 23 bp, Homo sapiens
ggtctcaaactcctgggctcagg

SEQ ID NO: 151836 - DNA, 21 bp, Homo sapiens
ggtctcacagtgttgcccagg

SEQ ID NO: 151837 - DNA, 16 bp, Homo sapiens
ggtctcccacgtggga

SEQ ID NO: 151838 - DNA, 17 bp, Homo sapiens
ggtctccctctcctgcc

SEQ ID NO: 151839 - DNA, 18 bp, Homo sapiens
ggtctccctctcctgcct

SEQ ID NO: 151840 - DNA, 19 bp, Homo sapiens
ggtctcgctttgttgccca

SEQ ID NO: 151841 - DNA, 21 bp, Homo sapiens
ggtctcgctttgttgcccagg

SEQ ID NO: 151842 - DNA, 20 bp, Homo sapiens
ggtctcttactttcctttcc

SEQ ID NO: 151843 - DNA, 19 bp, Homo sapiens
ggtctgctctttctctgcc

SEQ ID NO: 151844 - DNA, 14 bp, Homo sapiens
ggtctgtagggatt

SEQ ID NO: 151845 - DNA, 18 bp, Homo sapiens
ggtcttcagcctctttct

SEQ ID NO: 151846 - DNA, 23 bp, Homo sapiens
ggtgaaccatgtcagcaaaaagc

SEQ ID NO: 151847 - DNA, 13 bp, Homo sapiens
ggtgacaccagcc

SEQ ID NO: 151848 - DNA, 17 bp, Homo sapiens
ggtgagatgctggagaa

SEQ ID NO: 151849 - DNA, 22 bp, Homo sapiens
ggtgagatgctggagaagagag

SEQ ID NO: 151850 - DNA, 12 bp, Homo sapiens
ggtgcaaatcct

SEQ ID NO: 151851 - DNA, 20 bp, Homo sapiens
ggtgcacagacgtccctcca

SEQ ID NO: 151852 - DNA, 17 bp, Homo sapiens
ggtgcagagtgcccaga

SEQ ID NO: 151853 - DNA, 23 bp, Homo sapiens
ggtgcctgggtggggctgctcct

SEQ ID NO: 151854 - DNA, 21 bp, Homo sapiens
ggtgctacaaaaacacagcaa

SEQ ID NO: 151855 - DNA, 15 bp, Homo sapiens
ggtgctacgcctgca

SEQ ID NO: 151856 - DNA, 21 bp, Homo sapiens
ggtggacttagaaagcagggg

SEQ ID NO: 151857 - DNA, 20 bp, Homo sapiens
ggtggaggttgcagtgagct

SEQ ID NO: 151858 - DNA, 17 bp, Homo sapiens
ggtggatcacagaggct

SEQ ID NO: 151859 - DNA, 23 bp, Homo sapiens
ggtggccctgtccctcccacctc

SEQ ID NO: 151860 - DNA, 19 bp, Homo sapiens
ggtggctgacccagtccct

SEQ ID NO: 151861 - DNA, 16 bp, Homo sapiens
ggtgggagcaggagat

SEQ ID NO: 151862 - DNA, 20 bp, Homo sapiens
ggtgggaggatctcttgagc

SEQ ID NO: 151863 - DNA, 20 bp, Homo sapiens
ggtgggaggattgcttgagc

SEQ ID NO: 151864 - DNA, 17 bp, Homo sapiens
ggtgggatggaggagaa

SEQ ID NO: 151865 - DNA, 18 bp, Homo sapiens
ggtggggctgctcctcca

SEQ ID NO: 151866 - DNA, 19 bp, Homo sapiens
tactgcagggccaggactg

SEQ ID NO: 151867 - DNA, 11 bp, Homo sapiens
tactgccaaag

SEQ ID NO: 151868 - DNA, 21 bp, Homo sapiens
tataactcatcataaaataaa

SEQ ID NO: 151869 - DNA, 16 bp, Homo sapiens
tataactgaaggagaa

SEQ ID NO: 151870 - DNA, 18 bp, Homo sapiens
tataacttaaaaaaatga

SEQ ID NO: 151871 - DNA, 19 bp, Homo sapiens
tataacttaaaaaaatgac

SEQ ID NO: 151872 - DNA, 22 bp, Homo sapiens
ggtggggctgctcctccagggc

SEQ ID NO: 151873 - DNA, 17 bp, Homo sapiens
ggtgggtccatgggcag

SEQ ID NO: 151874 - DNA, 18 bp, Homo sapiens
ggtggtctgcaggcaggg

SEQ ID NO: 151875 - DNA, 15 bp, Homo sapiens
ggtgtgatcgtctga

SEQ ID NO: 151876 - DNA, 14 bp, Homo sapiens
ggtgtggagaagcg

SEQ ID NO: 151877 - DNA, 23 bp, Homo sapiens
ggtgtgtccccctctgtccaggc

SEQ ID NO: 151878 - DNA, 21 bp, Homo sapiens
ggtgttatcaccgtgggctcc

SEQ ID NO: 151879 - DNA, 22 bp, Homo sapiens
ggtgttgccaaatatgtcctgg

SEQ ID NO: 151880 - DNA, 13 bp, Homo sapiens
ggtgtttatacag

SEQ ID NO: 151881 - DNA, 16 bp, Homo sapiens
ggttaggatttaacag

SEQ ID NO: 151882 - DNA, 14 bp, Homo sapiens
ggttcaccagcctc

SEQ ID NO: 151883 - DNA, 16 bp, Homo sapiens
ggttcagcccctcctc

SEQ ID NO: 151884 - DNA, 17 bp, Homo sapiens
ggttcagcccctcctct

SEQ ID NO: 151885 - DNA, 18 bp, Homo sapiens
ggttcagcccctcctctg

SEQ ID NO: 151886 - DNA, 23 bp, Homo sapiens
ggttccgcttggagcagaggggc

SEQ ID NO: 151887 - DNA, 18 bp, Homo sapiens
ggttctttcttcctctgc

SEQ ID NO: 151888 - DNA, 16 bp, Homo sapiens
ggttgaccccagagga

SEQ ID NO: 151889 - DNA, 11 bp, Homo sapiens
ggttgaggaaa

SEQ ID NO: 151890 - DNA, 19 bp, Homo sapiens
ggttgaggtggaagccctc

SEQ ID NO: 151891 - DNA, 13 bp, Homo sapiens
ggttggtgggggc

SEQ ID NO: 151892 - DNA, 21 bp, Homo sapiens
ggtttacaatttacaaagtgt

SEQ ID NO: 151893 - DNA, 16 bp, Homo sapiens
ggtttagaaagcttgc

SEQ ID NO: 151894 - DNA, 19 bp, Homo sapiens
ggttttattgtttaaaatc

SEQ ID NO: 151895 - DNA, 14 bp, Homo sapiens
ggttttcttcccat

SEQ ID NO: 151896 - DNA, 17 bp, Homo sapiens
ggttttgtattctctga

SEQ ID NO: 151897 - DNA, 19 bp, Homo sapiens
ggttttgtattctctgagc

SEQ ID NO: 151898 - DNA, 18 bp, Homo sapiens
gtaaaaccacagcagttg

SEQ ID NO: 151899 - DNA, 23 bp, Homo sapiens
gtaaaaccacagcagttgaaaag

SEQ ID NO: 151900 - DNA, 15 bp, Homo sapiens
gtaaaactgaggcac

SEQ ID NO: 151901 - DNA, 14 bp, Homo sapiens
gtaaaataaaatta

SEQ ID NO: 151902 - DNA, 18 bp, Homo sapiens
gtaaaatatagctgtaca

SEQ ID NO: 151903 - DNA, 19 bp, Homo sapiens
gtaaaatgtgaagtgaatg

SEQ ID NO: 151904 - DNA, 20 bp, Homo sapiens
gtaaaatgtgaagtgaatga

SEQ ID NO: 151905 - DNA, 22 bp, Homo sapiens
gtaaaatgtgaagtgaatgaaa

SEQ ID NO: 151906 - DNA, 13 bp, Homo sapiens
gtaaacagtgcct

SEQ ID NO: 151907 - DNA, 18 bp, Homo sapiens
gtaaacagtgcctgctga

SEQ ID NO: 151908 - DNA, 15 bp, Homo sapiens
gtaaactcaaaactt

SEQ ID NO: 151909 - DNA, 22 bp, Homo sapiens
gtaaagtatcaggatactatat

SEQ ID NO: 151910 - DNA, 17 bp, Homo sapiens
gtaacactttacaatgt

SEQ ID NO: 151911 - DNA, 11 bp, Homo sapiens
gtaacatcctt

SEQ ID NO: 151912 - DNA, 17 bp, Homo sapiens
gtaacatcctttctatt

SEQ ID NO: 151913 - DNA, 20 bp, Homo sapiens
gtaacctcttcagaggccct

SEQ ID NO: 151914 - DNA, 22 bp, Homo sapiens
gtaactgttaaattgctgtgta

SEQ ID NO: 151915 - DNA, 13 bp, Homo sapiens
gtaagaaaatatt

SEQ ID NO: 151916 - DNA, 15 bp, Homo sapiens
gtaagggaaatagaa

SEQ ID NO: 151917 - DNA, 14 bp, Homo sapiens
gtaaggtgagggaa

SEQ ID NO: 151918 - DNA, 12 bp, Homo sapiens
gtaaggtgcctt

SEQ ID NO: 151919 - DNA, 15 bp, Homo sapiens
gtaataactgtgaag

SEQ ID NO: 151920 - DNA, 16 bp, Homo sapiens
gtaataactgtgaagt

SEQ ID NO: 151921 - DNA, 19 bp, Homo sapiens
gtaatattgacttgtatat

SEQ ID NO: 151922 - DNA, 20 bp, Homo sapiens
gtaatattgacttgtatatt

SEQ ID NO: 151923 - DNA, 18 bp, Homo sapiens
gtaatatttatatattta

SEQ ID NO: 151924 - DNA, 14 bp, Homo sapiens
gtaatcaatgtttc

SEQ ID NO: 151925 - DNA, 17 bp, Homo sapiens
gtaatccatcactagcc

SEQ ID NO: 151926 - DNA, 18 bp, Homo sapiens
gtaatcccagctactcag

SEQ ID NO: 151927 - DNA, 16 bp, Homo sapiens
gtaatcccagctactt

SEQ ID NO: 151928 - DNA, 19 bp, Homo sapiens
gtaatgtcaccaccttccc

SEQ ID NO: 151929 - DNA, 20 bp, Homo sapiens
gtaatgtcaccaccttccca

SEQ ID NO: 151930 - DNA, 14 bp, Homo sapiens
gtaattctaaatga

SEQ ID NO: 151931 - DNA, 15 bp, Homo sapiens
gtaattgaacttatc

SEQ ID NO: 151932 - DNA, 12 bp, Homo sapiens
gtaattgcttac

SEQ ID NO: 151933 - DNA, 17 bp, Homo sapiens
gtaattgcttacatttt

SEQ ID NO: 151934 - DNA, 11 bp, Homo sapiens
gtaatttattt

SEQ ID NO: 151935 - DNA, 20 bp, Homo sapiens
gtacaaatataagaataaaa

SEQ ID NO: 151936 - DNA, 14 bp, Homo sapiens
gtacatatgtgctg

SEQ ID NO: 151937 - DNA, 14 bp, Homo sapiens
gtacatctggcctt

SEQ ID NO: 151938 - DNA, 15 bp, Homo sapiens
gtacatttggagaca

SEQ ID NO: 151939 - DNA, 20 bp, Homo sapiens
gtaccatgaaacaaagctgc

SEQ ID NO: 151940 - DNA, 20 bp, Homo sapiens
gtacctataaagtaaagcta

SEQ ID NO: 151941 - DNA, 23 bp, Homo sapiens
gtactgtgtacagaattctgcta

SEQ ID NO: 151942 - DNA, 14 bp, Homo sapiens
gtacttaactattc

SEQ ID NO: 151943 - DNA, 17 bp, Homo sapiens
gtagagatggaggagga

SEQ ID NO: 151944 - DNA, 15 bp, Homo sapiens
gtagagtgggagctg

SEQ ID NO: 151945 - DNA, 18 bp, Homo sapiens
gtagcaggtaccactgat

SEQ ID NO: 151946 - DNA, 23 bp, Homo sapiens
gtagccagggggactagcccctg

SEQ ID NO: 151947 - DNA, 20 bp, Homo sapiens
gtagcccactctgctcgcct

SEQ ID NO: 151948 - DNA, 14 bp, Homo sapiens
gtagctagaggaac

SEQ ID NO: 151949 - DNA, 17 bp, Homo sapiens
gtagctagaggaaccaa

SEQ ID NO: 151950 - DNA, 22 bp, Homo sapiens
gtagctctaggagggctggcaa

SEQ ID NO: 151951 - DNA, 18 bp, Homo sapiens
gtagctgtggtgaggtgg

SEQ ID NO: 151952 - DNA, 18 bp, Homo sapiens
gtaggagcccagctctga

SEQ ID NO: 151953 - DNA, 12 bp, Homo sapiens
gtaggcagacac

SEQ ID NO: 151954 - DNA, 22 bp, Homo sapiens
gtaggcagacacagggacttga

SEQ ID NO: 151955 - DNA, 21 bp, Homo sapiens
gtagggtcaggccacggcagc

SEQ ID NO: 151956 - DNA, 22 bp, Homo sapiens
gtagggtcaggccacggcagcc

SEQ ID NO: 151957 - DNA, 23 bp, Homo sapiens
gtaggtatcattttctgcattta

SEQ ID NO: 151958 - DNA, 17 bp, Homo sapiens
gtagtcaagattgtgtt

SEQ ID NO: 151959 - DNA, 13 bp, Homo sapiens
gtagtcccagcta

SEQ ID NO: 151960 - DNA, 13 bp, Homo sapiens
gtagttccctgaa

SEQ ID NO: 151961 - DNA, 20 bp, Homo sapiens
gtagttccctgaaaacccag

SEQ ID NO: 151962 - DNA, 15 bp, Homo sapiens
gtagttcctgctaca

SEQ ID NO: 151963 - DNA, 17 bp, Homo sapiens
gtataaactatcagttt

SEQ ID NO: 151964 - DNA, 17 bp, Homo sapiens
gtataagtaagaaaata

SEQ ID NO: 151965 - DNA, 19 bp, Homo sapiens
gtataatggttgactgggt

SEQ ID NO: 151966 - DNA, 23 bp, Homo sapiens
gtataatggttgactgggtttct

SEQ ID NO: 151967 - DNA, 13 bp, Homo sapiens
gtatagtgtaaaa

SEQ ID NO: 151968 - DNA, 15 bp, Homo sapiens
gtatagtgtaaaata

SEQ ID NO: 151969 - DNA, 19 bp, Homo sapiens
gtatagttaggatagcatt

SEQ ID NO: 151970 - DNA, 22 bp, Homo sapiens
gtatatatctgcttcagtggag

SEQ ID NO: 151971 - DNA, 15 bp, Homo sapiens
gtatatgtctcaggt

SEQ ID NO: 151972 - DNA, 22 bp, Homo sapiens
gtatcaggacccagaggaaggg

SEQ ID NO: 151973 - DNA, 20 bp, Homo sapiens
gtatcccccccctgtatagt

SEQ ID NO: 151974 - DNA, 15 bp, Homo sapiens
gtatctcctcgcaag

SEQ ID NO: 151975 - DNA, 18 bp, Homo sapiens
gtatgaataaagacacct

SEQ ID NO: 151976 - DNA, 18 bp, Homo sapiens
gtatggaatacagtgtta

SEQ ID NO: 151977 - DNA, 14 bp, Homo sapiens
gtatgtaaacagga

SEQ ID NO: 151978 - DNA, 11 bp, Homo sapiens
gtatgtaaatg

SEQ ID NO: 151979 - DNA, 13 bp, Homo sapiens
gtatgtaaatgtg

SEQ ID NO: 151980 - DNA, 12 bp, Homo sapiens
gtattctctgag

SEQ ID NO: 151981 - DNA, 13 bp, Homo sapiens
gtattctctgagc

SEQ ID NO: 151982 - DNA, 14 bp, Homo sapiens
gtattcttgtcaaa

SEQ ID NO: 151983 - DNA, 14 bp, Homo sapiens
gtattgcacattgt

SEQ ID NO: 151984 - DNA, 13 bp, Homo sapiens
gtatttataaata

SEQ ID NO: 151985 - DNA, 12 bp, Homo sapiens
gtatttatatat

SEQ ID NO: 151986 - DNA, 11 bp, Homo sapiens
gtatttcagac

SEQ ID NO: 151987 - DNA, 19 bp, Homo sapiens
gtatttgagagttctaaat

SEQ ID NO: 151988 - DNA, 14 bp, Homo sapiens
gtatttttttgcaa

SEQ ID NO: 151989 - DNA, 16 bp, Homo sapiens
gtcaaaccataaactt

SEQ ID NO: 151990 - DNA, 12 bp, Homo sapiens
gtcaaagaaatg

SEQ ID NO: 151991 - DNA, 16 bp, Homo sapiens
gtcaaagaaatgctga

SEQ ID NO: 151992 - DNA, 23 bp, Homo sapiens
gtcaaagcaggggagtatgcaaa

SEQ ID NO: 151993 - DNA, 18 bp, Homo sapiens
gtcaacagagaaggcagg

SEQ ID NO: 151994 - DNA, 19 bp, Homo sapiens
gtcaacagagaaggcagga

SEQ ID NO: 151995 - DNA, 23 bp, Homo sapiens
gtcaacagagaaggcaggaatgt

SEQ ID NO: 151996 - DNA, 19 bp, Homo sapiens
gtcaacctgggcaaagcct

SEQ ID NO: 151997 - DNA, 17 bp, Homo sapiens
gtcaagaagaagatgga

SEQ ID NO: 151998 - DNA, 14 bp, Homo sapiens
gtcaagcccaggag

SEQ ID NO: 151999 - DNA, 17 bp, Homo sapiens
gtcaagtgcgtccacga

SEQ ID NO: 152000 - DNA, 19 bp, Homo sapiens
gtcaatcctgtgggtgaag

SEQ ID NO: 152001 - DNA, 15 bp, Homo sapiens
gtcaatgttttcagt

SEQ ID NO: 152002 - DNA, 16 bp, Homo sapiens
gtcaccggatcctggg

SEQ ID NO: 152003 - DNA, 19 bp, Homo sapiens
gtcaccggatcctgggtgg

SEQ ID NO: 152004 - DNA, 13 bp, Homo sapiens
gtcacctgtgctt

SEQ ID NO: 152005 - DNA, 16 bp, Homo sapiens
gtcactgccatggagg

SEQ ID NO: 152006 - DNA, 22 bp, Homo sapiens
gtcactgcctctccctggccct

SEQ ID NO: 152007 - DNA, 13 bp, Homo sapiens
gtcactgtttctc

SEQ ID NO: 152008 - DNA, 16 bp, Homo sapiens
gtcactgtttctctgc

SEQ ID NO: 152009 - DNA, 19 bp, Homo sapiens
gtcagagaggagtcagaga

SEQ ID NO: 152010 - DNA, 16 bp, Homo sapiens
gtcagcaaaaagcaaa

SEQ ID NO: 152011 - DNA, 15 bp, Homo sapiens
tattcagtgtcactg

SEQ ID NO: 152012 - DNA, 20 bp, Homo sapiens
tattcattgaagtcagatgt

SEQ ID NO: 152013 - DNA, 13 bp, Homo sapiens
tattcatttaaaa

SEQ ID NO: 152014 - DNA, 17 bp, Homo sapiens
tattcatttaaaatgat

SEQ ID NO: 152015 - DNA, 19 bp, Homo sapiens
tattcatttaaaatgatta

SEQ ID NO: 152016 - DNA, 21 bp, Homo sapiens
tattccctagaaacttccaaa

SEQ ID NO: 152017 - DNA, 21 bp, Homo sapiens
tattcctatatagtttattga

SEQ ID NO: 152018 - DNA, 22 bp, Homo sapiens
tattcctatatagtttattgac

SEQ ID NO: 152019 - DNA, 17 bp, Homo sapiens
tattcctgcatttgtga

SEQ ID NO: 152020 - DNA, 22 bp, Homo sapiens
tattcctgtggatgtaaagtga

SEQ ID NO: 152021 - DNA, 18 bp, Homo sapiens
tattctctgagctgtgca

SEQ ID NO: 152022 - DNA, 15 bp, Homo sapiens
tattgacttgtatat

SEQ ID NO: 152023 - DNA, 21 bp, Homo sapiens
tattgatatgcttatacactt

SEQ ID NO: 152024 - DNA, 14 bp, Homo sapiens
tattgcatctgtat

SEQ ID NO: 152025 - DNA, 15 bp, Homo sapiens
tattgcatctgtata

SEQ ID NO: 152026 - DNA, 15 bp, Homo sapiens
tattgcattaatttt

SEQ ID NO: 152027 - DNA, 18 bp, Homo sapiens
gtcataactaaataaagc

SEQ ID NO: 152028 - DNA, 17 bp, Homo sapiens
gtcatcacttttcagtg

SEQ ID NO: 152029 - DNA, 16 bp, Homo sapiens
gtcatctcagctggat

SEQ ID NO: 152030 - DNA, 16 bp, Homo sapiens
gtcatgagctgagcag

SEQ ID NO: 152031 - DNA, 18 bp, Homo sapiens
gtcatgagctgagcaggg

SEQ ID NO: 152032 - DNA, 14 bp, Homo sapiens
gtcatgatctccct

SEQ ID NO: 152033 - DNA, 18 bp, Homo sapiens
gtcatgatctccctgccg

SEQ ID NO: 152034 - DNA, 19 bp, Homo sapiens
gtcatgatctccctgccgc

SEQ ID NO: 152035 - DNA, 15 bp, Homo sapiens
gtcatggcttaatgt

SEQ ID NO: 152036 - DNA, 14 bp, Homo sapiens
gtcattcagaaaaa

SEQ ID NO: 152037 - DNA, 17 bp, Homo sapiens
gtccaacctaacccctt

SEQ ID NO: 152038 - DNA, 21 bp, Homo sapiens
gtccaacctaacccctttcct

SEQ ID NO: 152039 - DNA, 17 bp, Homo sapiens
gtccaatcctatgtttt

SEQ ID NO: 152040 - DNA, 15 bp, Homo sapiens
gtccacagatgcctc

SEQ ID NO: 152041 - DNA, 16 bp, Homo sapiens
gtccacagatgcctcc

SEQ ID NO: 152042 - DNA, 17 bp, Homo sapiens
gtccacagatgcctcca

SEQ ID NO: 152043 - DNA, 22 bp, Homo sapiens
gtccacctgagctgccatccag

SEQ ID NO: 152044 - DNA, 18 bp, Homo sapiens
gtccacgactgtctccat

SEQ ID NO: 152045 - DNA, 20 bp, Homo sapiens
gtccactgtcactgtttctc

SEQ ID NO: 152046 - DNA, 16 bp, Homo sapiens
gtccagcttgctcttc

SEQ ID NO: 152047 - DNA, 20 bp, Homo sapiens
gtccagggccctgagctcgg

SEQ ID NO: 152048 - DNA, 16 bp, Homo sapiens
gtccatgggcagagcc

SEQ ID NO: 152049 - DNA, 15 bp, Homo sapiens
gtcccaacttgtaaa

SEQ ID NO: 152050 - DNA, 20 bp, Homo sapiens
gtcccacgaatttgctgggg

SEQ ID NO: 152051 - DNA, 22 bp, Homo sapiens
gtcccacgaatttgctggggaa

SEQ ID NO: 152052 - DNA, 16 bp, Homo sapiens
gtcccactcaagccaa

SEQ ID NO: 152053 - DNA, 21 bp, Homo sapiens
gtcccactcaagccaagcagc

SEQ ID NO: 152054 - DNA, 17 bp, Homo sapiens
gtcccatgatccctgtg

SEQ ID NO: 152055 - DNA, 15 bp, Homo sapiens
gtcccggggctccac

SEQ ID NO: 152056 - DNA, 21 bp, Homo sapiens
gtccctacacccctcccctgc

SEQ ID NO: 152057 - DNA, 22 bp, Homo sapiens
gtccctaccgagtctcttctcc

SEQ ID NO: 152058 - DNA, 14 bp, Homo sapiens
gtccctcccacctc

SEQ ID NO: 152059 - DNA, 21 bp, Homo sapiens
gtccctcccacctctgtgacc

SEQ ID NO: 152060 - DNA, 23 bp, Homo sapiens
gtccctccgggacctggtgctgc

SEQ ID NO: 152061 - DNA, 20 bp, Homo sapiens
gtccctgggggaagccctgg

SEQ ID NO: 152062 - DNA, 15 bp, Homo sapiens
gtccctggtaataag

SEQ ID NO: 152063 - DNA, 19 bp, Homo sapiens
gtcccttgagacctcagcc

SEQ ID NO: 152064 - DNA, 13 bp, Homo sapiens
gtcccttgcctca

SEQ ID NO: 152065 - DNA, 13 bp, Homo sapiens
gtccgagctttga

SEQ ID NO: 152066 - DNA, 15 bp, Homo sapiens
gtccgatctttgact

SEQ ID NO: 152067 - DNA, 23 bp, Homo sapiens
gtcctagaaattccccaccctga

SEQ ID NO: 152068 - DNA, 18 bp, Homo sapiens
gtcctcacatctttcaca

SEQ ID NO: 152069 - DNA, 14 bp, Homo sapiens
gtcctcacccctgt

SEQ ID NO: 152070 - DNA, 15 bp, Homo sapiens
gtcctcacccctgtc

SEQ ID NO: 152071 - DNA, 22 bp, Homo sapiens
gtcctcacccctgtcctcactg

SEQ ID NO: 152072 - DNA, 13 bp, Homo sapiens
gtcctcagcttct

SEQ ID NO: 152073 - DNA, 17 bp, Homo sapiens
gtcctcagcttcttaat

SEQ ID NO: 152074 - DNA, 14 bp, Homo sapiens
gtcctccacaataa

SEQ ID NO: 152075 - DNA, 17 bp, Homo sapiens
gtcctcccatcccctgg

SEQ ID NO: 152076 - DNA, 18 bp, Homo sapiens
gtcctcccatcccctgga

SEQ ID NO: 152077 - DNA, 20 bp, Homo sapiens
gtcctcccatcccctggact

SEQ ID NO: 152078 - DNA, 21 bp, Homo sapiens
gtcctcccatcccctggactg

SEQ ID NO: 152079 - DNA, 16 bp, Homo sapiens
gtcctccccctgccag

SEQ ID NO: 152080 - DNA, 22 bp, Homo sapiens
gtcctccccctgccagtgcctt

SEQ ID NO: 152081 - DNA, 21 bp, Homo sapiens
gtcctcccctcacagcctctg

SEQ ID NO: 152082 - DNA, 22 bp, Homo sapiens
gtcctcctcggatcaccgagag

SEQ ID NO: 152083 - DNA, 21 bp, Homo sapiens
gtcctgagggtccccacctgg

SEQ ID NO: 152084 - DNA, 14 bp, Homo sapiens
gtcctgccacctgg

SEQ ID NO: 152085 - DNA, 19 bp, Homo sapiens
gtccttctctcacctccta

SEQ ID NO: 152086 - DNA, 18 bp, Homo sapiens
gtccttgcacctgcatcc

SEQ ID NO: 152087 - DNA, 14 bp, Homo sapiens
gtcctttccctcca

SEQ ID NO: 152088 - DNA, 15 bp, Homo sapiens
gtcctttccctccac

SEQ ID NO: 152089 - DNA, 12 bp, Homo sapiens
gtcgcctctgca

SEQ ID NO: 152090 - DNA, 13 bp, Homo sapiens
gtctaaatttgaa

SEQ ID NO: 152091 - DNA, 12 bp, Homo sapiens
gtctagggagag

SEQ ID NO: 152092 - DNA, 14 bp, Homo sapiens
gtctatatgtttgt

SEQ ID NO: 152093 - DNA, 16 bp, Homo sapiens
gtctatttaagcctca

SEQ ID NO: 152094 - DNA, 17 bp, Homo sapiens
gtctcaaaaaaagaaaa

SEQ ID NO: 152095 - DNA, 19 bp, Homo sapiens
gtctcaaaaaaagaaaaag

SEQ ID NO: 152096 - DNA, 17 bp, Homo sapiens
gtctcaagagggcactg

SEQ ID NO: 152097 - DNA, 20 bp, Homo sapiens
gtctcaagagggcactggtg

SEQ ID NO: 152098 - DNA, 22 bp, Homo sapiens
gtctcaagagggcactggtggc

SEQ ID NO: 152099 - DNA, 23 bp, Homo sapiens
gtctcacagtgttgcccaggctg

SEQ ID NO: 152100 - DNA, 15 bp, Homo sapiens
gtctcaggtccctgc

SEQ ID NO: 152101 - DNA, 23 bp, Homo sapiens
gtctcagtccatgaagatgtaga

SEQ ID NO: 152102 - DNA, 15 bp, Homo sapiens
gtctcatccatcatc

SEQ ID NO: 152103 - DNA, 16 bp, Homo sapiens
gtctcatccatcatca

SEQ ID NO: 152104 - DNA, 20 bp, Homo sapiens
gtctccagccccttctcaga

SEQ ID NO: 152105 - DNA, 14 bp, Homo sapiens
gtctccctctcctg

SEQ ID NO: 152106 - DNA, 15 bp, Homo sapiens
gtctccctctcctgc

SEQ ID NO: 152107 - DNA, 21 bp, Homo sapiens
gtctccctctcctgcctactc

SEQ ID NO: 152108 - DNA, 22 bp, Homo sapiens
gtctcctcttaaaaaataaaaa

SEQ ID NO: 152109 - DNA, 20 bp, Homo sapiens
gtctcctttcaccccagggc

SEQ ID NO: 152110 - DNA, 19 bp, Homo sapiens
gtctcgctttgttgcccag

SEQ ID NO: 152111 - DNA, 12 bp, Homo sapiens
gtctctagagca

SEQ ID NO: 152112 - DNA, 18 bp, Homo sapiens
gtctctagagcagggatt

SEQ ID NO: 152113 - DNA, 15 bp, Homo sapiens
gtctctgctggccca

SEQ ID NO: 152114 - DNA, 14 bp, Homo sapiens
gtctcttctccact

SEQ ID NO: 152115 - DNA, 15 bp, Homo sapiens
gtctcttctccactg

SEQ ID NO: 152116 - DNA, 18 bp, Homo sapiens
gtctcttctccactggat

SEQ ID NO: 152117 - DNA, 13 bp, Homo sapiens
gtctcttgtaatc

SEQ ID NO: 152118 - DNA, 21 bp, Homo sapiens
gtctgcaaaatgaggaatgta

SEQ ID NO: 152119 - DNA, 23 bp, Homo sapiens
gtctgcaaaatgaggaatgtata

SEQ ID NO: 152120 - DNA, 16 bp, Homo sapiens
gtctgccagccagcag

SEQ ID NO: 152121 - DNA, 11 bp, Homo sapiens
gtctgcctctt

SEQ ID NO: 152122 - DNA, 17 bp, Homo sapiens
gtctgctctttctctgc

SEQ ID NO: 152123 - DNA, 22 bp, Homo sapiens
gtctgctctttctctgccagtg

SEQ ID NO: 152124 - DNA, 14 bp, Homo sapiens
gtctggagaagcag

SEQ ID NO: 152125 - DNA, 17 bp, Homo sapiens
gtctggggttcagcccc

SEQ ID NO: 152126 - DNA, 18 bp, Homo sapiens
gtctggttttaacaattt

SEQ ID NO: 152127 - DNA, 17 bp, Homo sapiens
gtctgtgtgcaagtgtg

SEQ ID NO: 152128 - DNA, 21 bp, Homo sapiens
gtcttaaaaagtggaaaaata

SEQ ID NO: 152129 - DNA, 15 bp, Homo sapiens
gtcttaaaataactt

SEQ ID NO: 152130 - DNA, 21 bp, Homo sapiens
gtcttaattaaaagaatattt

SEQ ID NO: 152131 - DNA, 22 bp, Homo sapiens
gtcttagaagtggaccaggaca

SEQ ID NO: 152132 - DNA, 14 bp, Homo sapiens
gtcttatttattat

SEQ ID NO: 152133 - DNA, 14 bp, Homo sapiens
gtcttcagcctctt

SEQ ID NO: 152134 - DNA, 18 bp, Homo sapiens
gtcttcagggggccaggt

SEQ ID NO: 152135 - DNA, 21 bp, Homo sapiens
gtcttcattaagccctcttcc

SEQ ID NO: 152136 - DNA, 15 bp, Homo sapiens
gtcttccatttgcaa

SEQ ID NO: 152137 - DNA, 18 bp, Homo sapiens
gtcttcctgaaatgcagt

SEQ ID NO: 152138 - DNA, 19 bp, Homo sapiens
gtcttcctgagtggtgcca

SEQ ID NO: 152139 - DNA, 19 bp, Homo sapiens
gtcttctcaggctctgccc

SEQ ID NO: 152140 - DNA, 23 bp, Homo sapiens
gtcttgtgtttccacagcctgca

SEQ ID NO: 152141 - DNA, 15 bp, Homo sapiens
gtgaaccatgtcagc

SEQ ID NO: 152142 - DNA, 19 bp, Homo sapiens
gtgaacttgggccactgtg

SEQ ID NO: 152143 - DNA, 17 bp, Homo sapiens
gtgaaggcttctctctg

SEQ ID NO: 152144 - DNA, 22 bp, Homo sapiens
gtgaaggcttctctctgtggga

SEQ ID NO: 152145 - DNA, 23 bp, Homo sapiens
gtgaataatacagtatctcaggg

SEQ ID NO: 152146 - DNA, 15 bp, Homo sapiens
gtgaatgggaaaaga

SEQ ID NO: 152147 - DNA, 19 bp, Homo sapiens
gtgaatttcttcactgttg

SEQ ID NO: 152148 - DNA, 17 bp, Homo sapiens
gtgaccactctgtcttg

SEQ ID NO: 152149 - DNA, 18 bp, Homo sapiens
gtgaccatgttttgttta

SEQ ID NO: 152150 - DNA, 15 bp, Homo sapiens
gtgacccagtcagag

SEQ ID NO: 152151 - DNA, 18 bp, Homo sapiens
gtgacctccacagctacc

SEQ ID NO: 152152 - DNA, 21 bp, Homo sapiens
gttacacactttttaagaaat

SEQ ID NO: 152153 - DNA, 10 bp, Homo sapiens
gttacctaat

SEQ ID NO: 152154 - DNA, 19 bp, Homo sapiens
gttacctaattagagcaga

SEQ ID NO: 152155 - DNA, 13 bp, Homo sapiens
gttactcagccct

SEQ ID NO: 152156 - DNA, 18 bp, Homo sapiens
gttactcagccctgggcc

SEQ ID NO: 152157 - DNA, 14 bp, Homo sapiens
gttactctccaacc

SEQ ID NO: 152158 - DNA, 17 bp, Homo sapiens
gttactctccaacctgg

SEQ ID NO: 152159 - DNA, 15 bp, Homo sapiens
gttagaatgaggagg

SEQ ID NO: 152160 - DNA, 18 bp, Homo sapiens
gttaggaaataaaacctt

SEQ ID NO: 152161 - DNA, 11 bp, Homo sapiens
gttagggaggg

SEQ ID NO: 152162 - DNA, 21 bp, Homo sapiens
gttaggtagagggagttgtca

SEQ ID NO: 152163 - DNA, 22 bp, Homo sapiens
gttagtcatttgctgagcatgt

SEQ ID NO: 152164 - DNA, 22 bp, Homo sapiens
gttatagagggtctaagattca

SEQ ID NO: 152165 - DNA, 16 bp, Homo sapiens
gttattgacaaactct

SEQ ID NO: 152166 - DNA, 17 bp, Homo sapiens
gttattgtacagctgtt

SEQ ID NO: 152167 - DNA, 13 bp, Homo sapiens
gttatttaaagaa

SEQ ID NO: 152168 - DNA, 15 bp, Homo sapiens
gttatttaaatgagt

SEQ ID NO: 152169 - DNA, 19 bp, Homo sapiens
gttatttcttacaggcaca

SEQ ID NO: 152170 - DNA, 15 bp, Homo sapiens
gttattttcagtatt

SEQ ID NO: 152171 - DNA, 23 bp, Homo sapiens
gttattttctttgaaattgttta

SEQ ID NO: 152172 - DNA, 23 bp, Homo sapiens
gttatttttatttatttaaattt

SEQ ID NO: 152173 - DNA, 16 bp, Homo sapiens
gttattttttaattat

SEQ ID NO: 152174 - DNA, 21 bp, Homo sapiens
gttattttttaattattattt

SEQ ID NO: 152175 - DNA, 18 bp, Homo sapiens
gttcaataataaatattt

SEQ ID NO: 152176 - DNA, 12 bp, Homo sapiens
gttcacattttt

SEQ ID NO: 152177 - DNA, 16 bp, Homo sapiens
gttcacccctccaccc

SEQ ID NO: 152178 - DNA, 16 bp, Homo sapiens
gttcagagactcaggg

SEQ ID NO: 152179 - DNA, 22 bp, Homo sapiens
gttcagagactcagggccccag

SEQ ID NO: 152180 - DNA, 22 bp, Homo sapiens
gttcagcactgtcccttgcctc

SEQ ID NO: 152181 - DNA, 14 bp, Homo sapiens
gttcagcccctcct

SEQ ID NO: 152182 - DNA, 18 bp, Homo sapiens
gttcagcccctcctctgc

SEQ ID NO: 152183 - DNA, 21 bp, Homo sapiens
gttcagcccctcctctgccac

SEQ ID NO: 152184 - DNA, 23 bp, Homo sapiens
gttcagcccctcctctgccacct

SEQ ID NO: 152185 - DNA, 19 bp, Homo sapiens
gttcatatgtaccatgtac

SEQ ID NO: 152186 - DNA, 18 bp, Homo sapiens
tcacgggcagtagctgtg

SEQ ID NO: 152187 - DNA, 19 bp, Homo sapiens
tcacgggcatgggcactcc

SEQ ID NO: 152188 - DNA, 16 bp, Homo sapiens
tcacgtgtgtgactca

SEQ ID NO: 152189 - DNA, 17 bp, Homo sapiens
tcacgtgtgtgactcag

SEQ ID NO: 152190 - DNA, 16 bp, Homo sapiens
tcactccaccacccaa

SEQ ID NO: 152191 - DNA, 14 bp, Homo sapiens
tcactcggcaccct

SEQ ID NO: 152192 - DNA, 20 bp, Homo sapiens
tcactctacttagcatgtcc

SEQ ID NO: 152193 - DNA, 11 bp, Homo sapiens
tcactgcctct

SEQ ID NO: 152194 - DNA, 12 bp, Homo sapiens
tcactgcctctc

SEQ ID NO: 152195 - DNA, 24 bp, Homo sapiens
tcactgctccctgaagccagcctt

SEQ ID NO: 152196 - DNA, 13 bp, Homo sapiens
tcactgctggctg

SEQ ID NO: 152197 - DNA, 17 bp, Homo sapiens
tcactggagcaccaggc

SEQ ID NO: 152198 - DNA, 19 bp, Homo sapiens
tcactggagttacattaat

SEQ ID NO: 152199 - DNA, 22 bp, Homo sapiens
tcactggagttacattaatgtt

SEQ ID NO: 152200 - DNA, 15 bp, Homo sapiens
tcactggccatccct

SEQ ID NO: 152201 - DNA, 16 bp, Homo sapiens
tcactggggtcctggg

SEQ ID NO: 152202 - DNA, 20 bp, Homo sapiens
tcactgtttctctgctgttg

SEQ ID NO: 152203 - DNA, 15 bp, Homo sapiens
tcactttaattctca

SEQ ID NO: 152204 - DNA, 20 bp, Homo sapiens
tcactttaattctcatgtga

SEQ ID NO: 152205 - DNA, 18 bp, Homo sapiens
tcacttttgacaaaggca

SEQ ID NO: 152206 - DNA, 19 bp, Homo sapiens
tcagaaaatattatgtgtt

SEQ ID NO: 152207 - DNA, 18 bp, Homo sapiens
tcagaaaccaaacagttt

SEQ ID NO: 152208 - DNA, 12 bp, Homo sapiens
tcagaaatatgt

SEQ ID NO: 152209 - DNA, 20 bp, Homo sapiens
tcagaacccttggcttgccc

SEQ ID NO: 152210 - DNA, 24 bp, Homo sapiens
tcagaacccttggcttgcccacgt

SEQ ID NO: 152211 - DNA, 12 bp, Homo sapiens
tcagaagataac

SEQ ID NO: 152212 - DNA, 14 bp, Homo sapiens
tcagaagataactt

SEQ ID NO: 152213 - DNA, 13 bp, Homo sapiens
tcagaaggagaag

SEQ ID NO: 152214 - DNA, 14 bp, Homo sapiens
tcagaaggagaagg

SEQ ID NO: 152215 - DNA, 18 bp, Homo sapiens
tcagaaggagaaggaagg

SEQ ID NO: 152216 - DNA, 22 bp, Homo sapiens
tcagacatagaattaacacatg

SEQ ID NO: 152217 - DNA, 17 bp, Homo sapiens
tcagaccccagcggctg

SEQ ID NO: 152218 - DNA, 22 bp, Homo sapiens
tcagacccccactctcattccc

SEQ ID NO: 152219 - DNA, 18 bp, Homo sapiens
tcagaccctaccccacca

SEQ ID NO: 152220 - DNA, 20 bp, Homo sapiens
tcagagactcagggccccag

SEQ ID NO: 152221 - DNA, 17 bp, Homo sapiens
tcagagaggagtcagag

SEQ ID NO: 152222 - DNA, 21 bp, Homo sapiens
tcagaggccctcgctgccagc

SEQ ID NO: 152223 - DNA, 21 bp, Homo sapiens
tcagatattttttcagaaata

SEQ ID NO: 152224 - DNA, 23 bp, Homo sapiens
tcagatattttttcagaaatatg

SEQ ID NO: 152225 - DNA, 13 bp, Homo sapiens
tcagatcagtgct

SEQ ID NO: 152226 - DNA, 21 bp, Homo sapiens
tcagatggaaccgcaggaagc

SEQ ID NO: 152227 - DNA, 23 bp, Homo sapiens
tcagatggaaccgcaggaagctg

SEQ ID NO: 152228 - DNA, 21 bp, Homo sapiens
tcagattttaaaaagtcttca

SEQ ID NO: 152229 - DNA, 20 bp, Homo sapiens
tcagcaaaaagcaaaatcat

SEQ ID NO: 152230 - DNA, 17 bp, Homo sapiens
tcagcactgatttcaca

SEQ ID NO: 152231 - DNA, 14 bp, Homo sapiens
tcagcactgtccct

SEQ ID NO: 152232 - DNA, 12 bp, Homo sapiens
tcagcagccctc

SEQ ID NO: 152233 - DNA, 16 bp, Homo sapiens
tcagcagccctcctca

SEQ ID NO: 152234 - DNA, 17 bp, Homo sapiens
tcagcagccctcctcac

SEQ ID NO: 152235 - DNA, 18 bp, Homo sapiens
tcagcagccctcctcacc

SEQ ID NO: 152236 - DNA, 17 bp, Homo sapiens
tcagcatacctttattg

SEQ ID NO: 152237 - DNA, 17 bp, Homo sapiens
tcagcattctcactcct

SEQ ID NO: 152238 - DNA, 12 bp, Homo sapiens
tcagcccctcct

SEQ ID NO: 152239 - DNA, 14 bp, Homo sapiens
tcagcccctcctct

SEQ ID NO: 152240 - DNA, 21 bp, Homo sapiens
tcagcccctcctctgccacct

SEQ ID NO: 152241 - DNA, 15 bp, Homo sapiens
tcagccctccctgcc

SEQ ID NO: 152242 - DNA, 16 bp, Homo sapiens
tcagccctccctgccc

SEQ ID NO: 152243 - DNA, 18 bp, Homo sapiens
tcagccctgggccccacc

SEQ ID NO: 152244 - DNA, 23 bp, Homo sapiens
tcagccgtgtaaccatggaccca

SEQ ID NO: 152245 - DNA, 18 bp, Homo sapiens
tcagcctagccgacctca

SEQ ID NO: 152246 - DNA, 20 bp, Homo sapiens
tcagcctagccgacctcagc

SEQ ID NO: 152247 - DNA, 23 bp, Homo sapiens
tcagcctagccgacctcagcctt

SEQ ID NO: 152248 - DNA, 20 bp, Homo sapiens
tcagcctccggagtagctgg

SEQ ID NO: 152249 - DNA, 16 bp, Homo sapiens
tcagcctcctgtgtag

SEQ ID NO: 152250 - DNA, 20 bp, Homo sapiens
tcagcctcctgtgtagctgg

SEQ ID NO: 152251 - DNA, 12 bp, Homo sapiens
tcagcctcttaa

SEQ ID NO: 152252 - DNA, 16 bp, Homo sapiens
tcagcctgctccagct

SEQ ID NO: 152253 - DNA, 19 bp, Homo sapiens
tcagcctggtgggcctcct

SEQ ID NO: 152254 - DNA, 16 bp, Homo sapiens
tcagcctgtctcttcc

SEQ ID NO: 152255 - DNA, 17 bp, Homo sapiens
tcagcctgtgctgcccg

SEQ ID NO: 152256 - DNA, 18 bp, Homo sapiens
tcagctcccctcggagaa

SEQ ID NO: 152257 - DNA, 16 bp, Homo sapiens
tcagctgctgaaacaa

SEQ ID NO: 152258 - DNA, 18 bp, Homo sapiens
tcagcttaggggctgctg

SEQ ID NO: 152259 - DNA, 13 bp, Homo sapiens
tcagcttcttaat

SEQ ID NO: 152260 - DNA, 18 bp, Homo sapiens
tcagctttttgtcttttc

SEQ ID NO: 152261 - DNA, 22 bp, Homo sapiens
tcaggaaaactgacagaggagg

SEQ ID NO: 152262 - DNA, 15 bp, Homo sapiens
tcaggaaaggaatca

SEQ ID NO: 152263 - DNA, 19 bp, Homo sapiens
tcaggacccagaggaaggg

SEQ ID NO: 152264 - DNA, 20 bp, Homo sapiens
tcaggaggctgaggcagaag

SEQ ID NO: 152265 - DNA, 22 bp, Homo sapiens
tcaggaggctgaggcagaagaa

SEQ ID NO: 152266 - DNA, 19 bp, Homo sapiens
tcaggagttagaggccagc

SEQ ID NO: 152267 - DNA, 22 bp, Homo sapiens
tcaggagttagaggccagcctg

SEQ ID NO: 152268 - DNA, 16 bp, Homo sapiens
tcaggatcaagaaagt

SEQ ID NO: 152269 - DNA, 14 bp, Homo sapiens
tcaggatgcccagg

SEQ ID NO: 152270 - DNA, 15 bp, Homo sapiens
tcaggatgcccaggg

SEQ ID NO: 152271 - DNA, 16 bp, Homo sapiens
tcaggcactagccttt

SEQ ID NO: 152272 - DNA, 21 bp, Homo sapiens
tcaggcactagcctttggctc

SEQ ID NO: 152273 - DNA, 22 bp, Homo sapiens
tcaggcactagcctttggctct

SEQ ID NO: 152274 - DNA, 14 bp, Homo sapiens
tcaggctctgccct

SEQ ID NO: 152275 - DNA, 16 bp, Homo sapiens
tcaggctcttctcctt

SEQ ID NO: 152276 - DNA, 21 bp, Homo sapiens
tcaggctcttctcctttcaca

SEQ ID NO: 152277 - DNA, 18 bp, Homo sapiens
tcagggacagagacacct

SEQ ID NO: 152278 - DNA, 17 bp, Homo sapiens
tcagggacccctgccct

SEQ ID NO: 152279 - DNA, 15 bp, Homo sapiens
tcagggaggtcattt

SEQ ID NO: 152280 - DNA, 12 bp, Homo sapiens
tcagggctgaca

SEQ ID NO: 152281 - DNA, 23 bp, Homo sapiens
tcaggggtgtgcggcctttggct

SEQ ID NO: 152282 - DNA, 15 bp, Homo sapiens
tcaggtcagggtgag

SEQ ID NO: 152283 - DNA, 21 bp, Homo sapiens
tcaggtgcccatccctggaag

SEQ ID NO: 152284 - DNA, 13 bp, Homo sapiens
tcagtaagccgtg

SEQ ID NO: 152285 - DNA, 15 bp, Homo sapiens
tcagtatgttgtcaa

SEQ ID NO: 152286 - DNA, 17 bp, Homo sapiens
tcagtatgttgtcaaag

SEQ ID NO: 152287 - DNA, 20 bp, Homo sapiens
tcagtattttggagaaatta

SEQ ID NO: 152288 - DNA, 22 bp, Homo sapiens
tcagtattttggagaaattatt

SEQ ID NO: 152289 - DNA, 18 bp, Homo sapiens
tcagtccatgaagatgta

SEQ ID NO: 152290 - DNA, 19 bp, Homo sapiens
tcagtcctcccctcacagc

SEQ ID NO: 152291 - DNA, 21 bp, Homo sapiens
tcagtcctcccctcacagcct

SEQ ID NO: 152292 - DNA, 23 bp, Homo sapiens
tcagtcctcccctcacagcctct

SEQ ID NO: 152293 - DNA, 16 bp, Homo sapiens
taaaagaatattttaa

SEQ ID NO: 152294 - DNA, 15 bp, Homo sapiens
taaaagacaagactt

SEQ ID NO: 152295 - DNA, 17 bp, Homo sapiens
taaaagcataaatgcaa

SEQ ID NO: 152296 - DNA, 14 bp, Homo sapiens
taaaagttgtgatt

SEQ ID NO: 152297 - DNA, 17 bp, Homo sapiens
taaaataaagtatatat

SEQ ID NO: 152298 - DNA, 18 bp, Homo sapiens
taaaatatggctataaat

SEQ ID NO: 152299 - DNA, 18 bp, Homo sapiens
taaaatgattgtaaaata

SEQ ID NO: 152300 - DNA, 21 bp, Homo sapiens
taaaatgcctcagtgtatttg

SEQ ID NO: 152301 - DNA, 11 bp, Homo sapiens
taaaatgtgaa

SEQ ID NO: 152302 - DNA, 17 bp, Homo sapiens
taaaatgttcacttttg

SEQ ID NO: 152303 - DNA, 14 bp, Homo sapiens
taaaattgcacttt

SEQ ID NO: 152304 - DNA, 18 bp, Homo sapiens
taaacaaaatagaagctg

SEQ ID NO: 152305 - DNA, 17 bp, Homo sapiens
taaacagcagtgttccc

SEQ ID NO: 152306 - DNA, 15 bp, Homo sapiens
taaacatcacacaca

SEQ ID NO: 152307 - DNA, 16 bp, Homo sapiens
taaaccgccaaggctg

SEQ ID NO: 152308 - DNA, 18 bp, Homo sapiens
taaaccgccaaggctggg

SEQ ID NO: 152309 - DNA, 16 bp, Homo sapiens
taaacctaaaaaagat

SEQ ID NO: 152310 - DNA, 17 bp, Homo sapiens
taaactatcagtttgtc

SEQ ID NO: 152311 - DNA, 19 bp, Homo sapiens
taaactcaaaacttaacat

SEQ ID NO: 152312 - DNA, 11 bp, Homo sapiens
taaactcaggg

SEQ ID NO: 152313 - DNA, 20 bp, Homo sapiens
taaactcagggacagagcca

SEQ ID NO: 152314 - DNA, 15 bp, Homo sapiens
taaactctaaacatt

SEQ ID NO: 152315 - DNA, 21 bp, Homo sapiens
taaagaaagtcgaattaatag

SEQ ID NO: 152316 - DNA, 13 bp, Homo sapiens
taaagatgatcta

SEQ ID NO: 152317 - DNA, 19 bp, Homo sapiens
taaagcagtggacaccagg

SEQ ID NO: 152318 - DNA, 18 bp, Homo sapiens
taaagctcgaaaacaatt

SEQ ID NO: 152319 - DNA, 21 bp, Homo sapiens
taaagctgcctgtagttagga

SEQ ID NO: 152320 - DNA, 19 bp, Homo sapiens
taaagcttgcaacaaaatt

SEQ ID NO: 152321 - DNA, 17 bp, Homo sapiens
taaaggctcgattttgt

SEQ ID NO: 152322 - DNA, 21 bp, Homo sapiens
taaagggaaaggattcatgtg

SEQ ID NO: 152323 - DNA, 15 bp, Homo sapiens
taaagtaaagctaaa

SEQ ID NO: 152324 - DNA, 17 bp, Homo sapiens
taaagtaaagctaaaat

SEQ ID NO: 152325 - DNA, 21 bp, Homo sapiens
taaagtagattagatctttta

SEQ ID NO: 152326 - DNA, 17 bp, Homo sapiens
taaagtatatatttatt

SEQ ID NO: 152327 - DNA, 16 bp, Homo sapiens
taaagtatgtaaacag

SEQ ID NO: 152328 - DNA, 22 bp, Homo sapiens
taaataaatgaagtatttctca

SEQ ID NO: 152329 - DNA, 22 bp, Homo sapiens
taaataagaaacaactctttga

SEQ ID NO: 152330 - DNA, 17 bp, Homo sapiens
taaatacagtcttccat

SEQ ID NO: 152331 - DNA, 20 bp, Homo sapiens
taaatacagtcttccatttg

SEQ ID NO: 152332 - DNA, 23 bp, Homo sapiens
taaatacagtcttccatttgcaa

SEQ ID NO: 152333 - DNA, 22 bp, Homo sapiens
taaatacctcaacctatggtat

SEQ ID NO: 152334 - DNA, 20 bp, Homo sapiens
taaatagtaaaaataaaatt

SEQ ID NO: 152335 - DNA, 18 bp, Homo sapiens
taaatagtatttgagagt

SEQ ID NO: 152336 - DNA, 17 bp, Homo sapiens
taaatatatataaacct

SEQ ID NO: 152337 - DNA, 19 bp, Homo sapiens
taaatcaagttggcttcta

SEQ ID NO: 152338 - DNA, 19 bp, Homo sapiens
taaatgtatcttattcaca

SEQ ID NO: 152339 - DNA, 20 bp, Homo sapiens
tcatggagaagcagaaatac

SEQ ID NO: 152340 - DNA, 18 bp, Homo sapiens
tcatggcttaatgtttat

SEQ ID NO: 152341 - DNA, 14 bp, Homo sapiens
tcatggggtccaag

SEQ ID NO: 152342 - DNA, 17 bp, Homo sapiens
tcatgtaaactgtgcac

SEQ ID NO: 152343 - DNA, 22 bp, Homo sapiens
tcatgttgcacacccactcagc

SEQ ID NO: 152344 - DNA, 19 bp, Homo sapiens
tcattaagccctcttccat

SEQ ID NO: 152345 - DNA, 16 bp, Homo sapiens
tcattaggatggctag

SEQ ID NO: 152346 - DNA, 16 bp, Homo sapiens
tcattcaatacaagtg

SEQ ID NO: 152347 - DNA, 14 bp, Homo sapiens
tcattcagaaaaaa

SEQ ID NO: 152348 - DNA, 15 bp, Homo sapiens
tcattcatgctactg

SEQ ID NO: 152349 - DNA, 23 bp, Homo sapiens
tcattccaccttcccatgccctg

SEQ ID NO: 152350 - DNA, 16 bp, Homo sapiens
tcattctcctgcctgt

SEQ ID NO: 152351 - DNA, 14 bp, Homo sapiens
tcattcttatttca

SEQ ID NO: 152352 - DNA, 17 bp, Homo sapiens
tcattcttgaaagctgt

SEQ ID NO: 152353 - DNA, 21 bp, Homo sapiens
tcattgactatcaaactgaag

SEQ ID NO: 152354 - DNA, 23 bp, Homo sapiens
tcatttaaaaaaaaaatttgttt

SEQ ID NO: 152355 - DNA, 17 bp, Homo sapiens
tcatttaaaatgattag

SEQ ID NO: 152356 - DNA, 18 bp, Homo sapiens
tcatttagtcatgtgacc

SEQ ID NO: 152357 - DNA, 15 bp, Homo sapiens
tcatttatccctcaa

SEQ ID NO: 152358 - DNA, 17 bp, Homo sapiens
tcatttctatttctcct

SEQ ID NO: 152359 - DNA, 21 bp, Homo sapiens
tcatttctatttctcctccat

SEQ ID NO: 152360 - DNA, 14 bp, Homo sapiens
tcatttctttgagt

SEQ ID NO: 152361 - DNA, 13 bp, Homo sapiens
tcatttgcttttt

SEQ ID NO: 152362 - DNA, 23 bp, Homo sapiens
tcatttggggtagctagaggaac

SEQ ID NO: 152363 - DNA, 15 bp, Homo sapiens
tcattttctgcattt

SEQ ID NO: 152364 - DNA, 23 bp, Homo sapiens
tccaaaggaatctccagttttca

SEQ ID NO: 152365 - DNA, 22 bp, Homo sapiens
tccaacccatgatgagctcctc

SEQ ID NO: 152366 - DNA, 14 bp, Homo sapiens
tccaaccccaactc

SEQ ID NO: 152367 - DNA, 17 bp, Homo sapiens
tccaacctggacaacaa

SEQ ID NO: 152368 - DNA, 18 bp, Homo sapiens
tccaagacagaataatga

SEQ ID NO: 152369 - DNA, 23 bp, Homo sapiens
tccaagcgaggtcaacagagaag

SEQ ID NO: 152370 - DNA, 18 bp, Homo sapiens
tccaagtgtgtgtgcgtg

SEQ ID NO: 152371 - DNA, 16 bp, Homo sapiens
tccaatcctatgtttt

SEQ ID NO: 152372 - DNA, 17 bp, Homo sapiens
tccaatttacatactct

SEQ ID NO: 152373 - DNA, 18 bp, Homo sapiens
tccaatttacatactctg

SEQ ID NO: 152374 - DNA, 16 bp, Homo sapiens
tccacaagattcccag

SEQ ID NO: 152375 - DNA, 23 bp, Homo sapiens
tccacaagattcccagagacagg

SEQ ID NO: 152376 - DNA, 19 bp, Homo sapiens
tccacacctggcactgctg

SEQ ID NO: 152377 - DNA, 20 bp, Homo sapiens
tccacacctggcactgctgt

SEQ ID NO: 152378 - DNA, 14 bp, Homo sapiens
tccacagctacctc

SEQ ID NO: 152379 - DNA, 12 bp, Homo sapiens
tccacatcctcc

SEQ ID NO: 152380 - DNA, 22 bp, Homo sapiens
tccaccacctccctcaccaaca

SEQ ID NO: 152381 - DNA, 23 bp, Homo sapiens
tccaccatggggtcctaccaata

SEQ ID NO: 152382 - DNA, 12 bp, Homo sapiens
tccacccagccc

SEQ ID NO: 152383 - DNA, 14 bp, Homo sapiens
tccacccagcccat

SEQ ID NO: 152384 - DNA, 15 bp, Homo sapiens
tccacccagcccatt

SEQ ID NO: 152385 - DNA, 23 bp, Homo sapiens
tccaccccccagaacctgtcctt

SEQ ID NO: 152386 - DNA, 11 bp, Homo sapiens
tccacctcagc

SEQ ID NO: 152387 - DNA, 18 bp, Homo sapiens
tccacctgctcccaggcc

SEQ ID NO: 152388 - DNA, 23 bp, Homo sapiens
tccacctgggcatatccaccacc

SEQ ID NO: 152389 - DNA, 15 bp, Homo sapiens
tccaccttcccatgc

SEQ ID NO: 152390 - DNA, 16 bp, Homo sapiens
tccaccttcccatgcc

SEQ ID NO: 152391 - DNA, 19 bp, Homo sapiens
tccaccttcccatgccctg

SEQ ID NO: 152392 - DNA, 14 bp, Homo sapiens
tccacgactgtctc

SEQ ID NO: 152393 - DNA, 22 bp, Homo sapiens
tccacgagctgtttactaggga

SEQ ID NO: 152394 - DNA, 20 bp, Homo sapiens
tccacggagccactcctctg

SEQ ID NO: 152395 - DNA, 15 bp, Homo sapiens
tccactgagggcagt

SEQ ID NO: 152396 - DNA, 19 bp, Homo sapiens
tccactgtcactgtttctc

SEQ ID NO: 152397 - DNA, 21 bp, Homo sapiens
tccacttagaaattgcatttc

SEQ ID NO: 152398 - DNA, 22 bp, Homo sapiens
tccagaagtttgagatcagcct

SEQ ID NO: 152399 - DNA, 15 bp, Homo sapiens
tccagacccctggct

SEQ ID NO: 152400 - DNA, 18 bp, Homo sapiens
tccagacccctggctttt

SEQ ID NO: 152401 - DNA, 23 bp, Homo sapiens
tccagacccctggcttttcactg

SEQ ID NO: 152402 - DNA, 15 bp, Homo sapiens
tccagagagtggctc

SEQ ID NO: 152403 - DNA, 16 bp, Homo sapiens
tccagagagtggctcc

SEQ ID NO: 152404 - DNA, 17 bp, Homo sapiens
tccagagagtggctcct

SEQ ID NO: 152405 - DNA, 22 bp, Homo sapiens
tccagattttttacagctgcct

SEQ ID NO: 152406 - DNA, 17 bp, Homo sapiens
tccagccccttctcaga

SEQ ID NO: 152407 - DNA, 18 bp, Homo sapiens
tccagccccttctcagaa

SEQ ID NO: 152408 - DNA, 21 bp, Homo sapiens
tccagccccttctcagaatct

SEQ ID NO: 152409 - DNA, 12 bp, Homo sapiens
tccagcctgggt

SEQ ID NO: 152410 - DNA, 13 bp, Homo sapiens
tccagcctgggtg

SEQ ID NO: 152411 - DNA, 21 bp, Homo sapiens
tccagctttgttcttcttaaa

SEQ ID NO: 152412 - DNA, 22 bp, Homo sapiens
tccaggatgctaacatctaaaa

SEQ ID NO: 152413 - DNA, 14 bp, Homo sapiens
tccaggcactgaga

SEQ ID NO: 152414 - DNA, 17 bp, Homo sapiens
tccagggccctgagctc

SEQ ID NO: 152415 - DNA, 17 bp, Homo sapiens
tccaggtttaagctgtt

SEQ ID NO: 152416 - DNA, 14 bp, Homo sapiens
tccagtgagacagc

SEQ ID NO: 152417 - DNA, 14 bp, Homo sapiens
tccagtgccagcaa

SEQ ID NO: 152418 - DNA, 21 bp, Homo sapiens
tccagttaaaaaaaattttaa

SEQ ID NO: 152419 - DNA, 12 bp, Homo sapiens
tccatataaata

SEQ ID NO: 152420 - DNA, 24 bp, Homo sapiens
tccatatgacctcatgcatctcca

SEQ ID NO: 152421 - DNA, 19 bp, Homo sapiens
tccatcaggttccatcccg

SEQ ID NO: 152422 - DNA, 16 bp, Homo sapiens
tccatcatgtccccaa

SEQ ID NO: 152423 - DNA, 13 bp, Homo sapiens
tccatgaagatgt

SEQ ID NO: 152424 - DNA, 21 bp, Homo sapiens
tccatgaagatgtagaggaga

SEQ ID NO: 152425 - DNA, 15 bp, Homo sapiens
tccatgctgcctcca

SEQ ID NO: 152426 - DNA, 15 bp, Homo sapiens
tccatgggcagagcc

SEQ ID NO: 152427 - DNA, 22 bp, Homo sapiens
tccatgggcagagcccaaggga

SEQ ID NO: 152428 - DNA, 15 bp, Homo sapiens
tccatgtagcaggac

SEQ ID NO: 152429 - DNA, 18 bp, Homo sapiens
tccatgtcgcctctgcat

SEQ ID NO: 152430 - DNA, 16 bp, Homo sapiens
tccatgtttgtaaaac

SEQ ID NO: 152431 - DNA, 20 bp, Homo sapiens
tccattaacttagcatgtgt

SEQ ID NO: 152432 - DNA, 14 bp, Homo sapiens
tccattatttatat

SEQ ID NO: 152433 - DNA, 16 bp, Homo sapiens
tccattggatctcatt

SEQ ID NO: 152434 - DNA, 17 bp, Homo sapiens
tcctcattagcattttg

SEQ ID NO: 152435 - DNA, 16 bp, Homo sapiens
tcctccatactcagga

SEQ ID NO: 152436 - DNA, 21 bp, Homo sapiens
tcctcccaggcgccccttccc

SEQ ID NO: 152437 - DNA, 19 bp, Homo sapiens
tcctcccatcccctggact

SEQ ID NO: 152438 - DNA, 23 bp, Homo sapiens
tcctcccatcccctggactggga

SEQ ID NO: 152439 - DNA, 20 bp, Homo sapiens
tcctccccctgccagtgcct

SEQ ID NO: 152440 - DNA, 14 bp, Homo sapiens
tcctcccctcacag

SEQ ID NO: 152441 - DNA, 19 bp, Homo sapiens
tcctcccctcacagcctct

SEQ ID NO: 152442 - DNA, 12 bp, Homo sapiens
tcctcctctgtg

SEQ ID NO: 152443 - DNA, 16 bp, Homo sapiens
tcctcctgcccacctg

SEQ ID NO: 152444 - DNA, 14 bp, Homo sapiens
tcctcctgggccct

SEQ ID NO: 152445 - DNA, 22 bp, Homo sapiens
tcctcctgggccctctctgctc

SEQ ID NO: 152446 - DNA, 13 bp, Homo sapiens
tcctccttcccaa

SEQ ID NO: 152447 - DNA, 13 bp, Homo sapiens
tcctcgcctgaca

SEQ ID NO: 152448 - DNA, 24 bp, Homo sapiens
tcctcgcctgacaaccactggtct

SEQ ID NO: 152449 - DNA, 15 bp, Homo sapiens
tcctcggccccctcc

SEQ ID NO: 152450 - DNA, 14 bp, Homo sapiens
tcctctccactgcc

SEQ ID NO: 152451 - DNA, 20 bp, Homo sapiens
tcctctccgcagttcctgtc

SEQ ID NO: 152452 - DNA, 9 bp, Homo sapiens
tcctctggc

SEQ ID NO: 152453 - DNA, 23 bp, Homo sapiens
tcctctggctggctaactggaag

SEQ ID NO: 152454 - DNA, 22 bp, Homo sapiens
tcctctgtccaggcactgctgc

SEQ ID NO: 152455 - DNA, 20 bp, Homo sapiens
tcctctgtgaccaatgtctt

SEQ ID NO: 152456 - DNA, 19 bp, Homo sapiens
tcctgagaaaaaaggttcc

SEQ ID NO: 152457 - DNA, 22 bp, Homo sapiens
tcctgagggtccccacctggga

SEQ ID NO: 152458 - DNA, 17 bp, Homo sapiens
tcctgataataattgat

SEQ ID NO: 152459 - DNA, 14 bp, Homo sapiens
tcctgatcagagcc

SEQ ID NO: 152460 - DNA, 23 bp, Homo sapiens
tcctgatggtacaggaaagctca

SEQ ID NO: 152461 - DNA, 18 bp, Homo sapiens
tcctgcaactcaaggact

SEQ ID NO: 152462 - DNA, 12 bp, Homo sapiens
tcctgcagcctc

SEQ ID NO: 152463 - DNA, 11 bp, Homo sapiens
tcctgccaaaa

SEQ ID NO: 152464 - DNA, 18 bp, Homo sapiens
tcctgccacctggggcag

SEQ ID NO: 152465 - DNA, 20 bp, Homo sapiens
tcctgccacctggggcagtc

SEQ ID NO: 152466 - DNA, 15 bp, Homo sapiens
tcctgccccaggcct

SEQ ID NO: 152467 - DNA, 17 bp, Homo sapiens
tcctgcccctgagccca

SEQ ID NO: 152468 - DNA, 20 bp, Homo sapiens
tcctgcctaagtgcagcccc

SEQ ID NO: 152469 - DNA, 11 bp, Homo sapiens
tcctgcctact

SEQ ID NO: 152470 - DNA, 16 bp, Homo sapiens
tcctgcctcagcctcc

SEQ ID NO: 152471 - DNA, 19 bp, Homo sapiens
tcctgccttcctcctgggc

SEQ ID NO: 152472 - DNA, 12 bp, Homo sapiens
tcctgcgggctt

SEQ ID NO: 152473 - DNA, 21 bp, Homo sapiens
tcctgctacaacttcagcagt

SEQ ID NO: 152474 - DNA, 14 bp, Homo sapiens
tcctggaagctgtg

SEQ ID NO: 152475 - DNA, 21 bp, Homo sapiens
tcctggggcctcggagcctca

SEQ ID NO: 152476 - DNA, 22 bp, Homo sapiens
tcctggggcctcggagcctcat

SEQ ID NO: 152477 - DNA, 21 bp, Homo sapiens
tcctgggggttctttcttcct

SEQ ID NO: 152478 - DNA, 22 bp, Homo sapiens
tcctgggggttctttcttcctc

SEQ ID NO: 152479 - DNA, 23 bp, Homo sapiens
tcctggggtataaaactttcctc

SEQ ID NO: 152480 - DNA, 15 bp, Homo sapiens
tcctgggtggtctgc

SEQ ID NO: 152481 - DNA, 19 bp, Homo sapiens
tcctgggtggtctgcaggc

SEQ ID NO: 152482 - DNA, 18 bp, Homo sapiens
tcctgtcccttctcttaa

SEQ ID NO: 152483 - DNA, 16 bp, Homo sapiens
tcctgtcctcagcttc

SEQ ID NO: 152484 - DNA, 13 bp, Homo sapiens
tcctgtctgccag

SEQ ID NO: 152485 - DNA, 14 bp, Homo sapiens
tcctgtctgccagc

SEQ ID NO: 152486 - DNA, 20 bp, Homo sapiens
tcctgttgttatggaaactg

SEQ ID NO: 152487 - DNA, 20 bp, Homo sapiens
tcctgtttttctgggtggcc

SEQ ID NO: 152488 - DNA, 18 bp, Homo sapiens
tccttagcttagacctca

SEQ ID NO: 152489 - DNA, 20 bp, Homo sapiens
tccttagcttagacctcagc

SEQ ID NO: 152490 - DNA, 21 bp, Homo sapiens
tccttagcttagacctcagcc

SEQ ID NO: 152491 - DNA, 13 bp, Homo sapiens
tccttccatgaaa

SEQ ID NO: 152492 - DNA, 21 bp, Homo sapiens
tccttgaccagcagatcccag

SEQ ID NO: 152493 - DNA, 22 bp, Homo sapiens
tccttgatctgtatatacaata

SEQ ID NO: 152494 - DNA, 15 bp, Homo sapiens
tccttgcacccctca

SEQ ID NO: 152495 - DNA, 24 bp, Homo sapiens
tccttgcacccctcactctggcct

SEQ ID NO: 152496 - DNA, 15 bp, Homo sapiens
tccttggcatgcctt

SEQ ID NO: 152497 - DNA, 15 bp, Homo sapiens
tccttggggcaggca

SEQ ID NO: 152498 - DNA, 22 bp, Homo sapiens
tacagtaggagcccagctctga

SEQ ID NO: 152499 - DNA, 18 bp, Homo sapiens
tacagtcttccatttgca

SEQ ID NO: 152500 - DNA, 16 bp, Homo sapiens
tacagtgttattttct

SEQ ID NO: 152501 - DNA, 20 bp, Homo sapiens
tacagttgttttttgaaaac

SEQ ID NO: 152502 - DNA, 17 bp, Homo sapiens
tacataagtaattcaag

SEQ ID NO: 152503 - DNA, 22 bp, Homo sapiens
tacataattttttattcaagtt

SEQ ID NO: 152504 - DNA, 16 bp, Homo sapiens
tacatatgtaaaataa

SEQ ID NO: 152505 - DNA, 13 bp, Homo sapiens
tacatatttccaa

SEQ ID NO: 152506 - DNA, 15 bp, Homo sapiens
tacatcgccctccac

SEQ ID NO: 152507 - DNA, 16 bp, Homo sapiens
tacatgacatttattt

SEQ ID NO: 152508 - DNA, 19 bp, Homo sapiens
tacatgactcagcatacct

SEQ ID NO: 152509 - DNA, 20 bp, Homo sapiens
tacatgcaatttattaaaat

SEQ ID NO: 152510 - DNA, 14 bp, Homo sapiens
tacatgctgctaat

SEQ ID NO: 152511 - DNA, 15 bp, Homo sapiens
tacatgtattgcaca

SEQ ID NO: 152512 - DNA, 20 bp, Homo sapiens
tacatgtattgcacattgta

SEQ ID NO: 152513 - DNA, 14 bp, Homo sapiens
tacatgtggtttat

SEQ ID NO: 152514 - DNA, 15 bp, Homo sapiens
tacattaatgttaat

SEQ ID NO: 152515 - DNA, 20 bp, Homo sapiens
tacattaatgttaattcagc

SEQ ID NO: 152516 - DNA, 19 bp, Homo sapiens
tacattagcagtttgcttt

SEQ ID NO: 152517 - DNA, 16 bp, Homo sapiens
tacatttccaaatgaa

SEQ ID NO: 152518 - DNA, 23 bp, Homo sapiens
tacatttggagacacaactattt

SEQ ID NO: 152519 - DNA, 22 bp, Homo sapiens
taccaatagattccccattgcc

SEQ ID NO: 152520 - DNA, 20 bp, Homo sapiens
taccaatcattttaattatt

SEQ ID NO: 152521 - DNA, 15 bp, Homo sapiens
taccaatgaaaaaat

SEQ ID NO: 152522 - DNA, 21 bp, Homo sapiens
taccagacggttcaccagcct

SEQ ID NO: 152523 - DNA, 23 bp, Homo sapiens
taccagacggttcaccagcctct

SEQ ID NO: 152524 - DNA, 13 bp, Homo sapiens
taccagcgaggag

SEQ ID NO: 152525 - DNA, 22 bp, Homo sapiens
taccaggccgccccagcctctg

SEQ ID NO: 152526 - DNA, 19 bp, Homo sapiens
taccagggactgaggggag

SEQ ID NO: 152527 - DNA, 18 bp, Homo sapiens
taccatcagggacaggat

SEQ ID NO: 152528 - DNA, 11 bp, Homo sapiens
tacccaaagga

SEQ ID NO: 152529 - DNA, 16 bp, Homo sapiens
tacccagggcctgcag

SEQ ID NO: 152530 - DNA, 12 bp, Homo sapiens
taccctcctcca

SEQ ID NO: 152531 - DNA, 16 bp, Homo sapiens
taccctgagctgaggc

SEQ ID NO: 152532 - DNA, 17 bp, Homo sapiens
taccgagtctcttctcc

SEQ ID NO: 152533 - DNA, 21 bp, Homo sapiens
taccgagtctcttctccactg

SEQ ID NO: 152534 - DNA, 16 bp, Homo sapiens
taccgcgttgtaaaat

SEQ ID NO: 152535 - DNA, 17 bp, Homo sapiens
tacctaattagagcaga

SEQ ID NO: 152536 - DNA, 19 bp, Homo sapiens
tacctataaagtaaagcta

SEQ ID NO: 152537 - DNA, 17 bp, Homo sapiens
tacctcaacctatggta

SEQ ID NO: 152538 - DNA, 14 bp, Homo sapiens
tacctcctgagaaa

SEQ ID NO: 152539 - DNA, 11 bp, Homo sapiens
tacctcctgcc

SEQ ID NO: 152540 - DNA, 17 bp, Homo sapiens
tacctctgatacctcaa

SEQ ID NO: 152541 - DNA, 13 bp, Homo sapiens
tacctgaaaacac

SEQ ID NO: 152542 - DNA, 17 bp, Homo sapiens
tacctgacactcccttg

SEQ ID NO: 152543 - DNA, 20 bp, Homo sapiens
tacctgggcatactaataaa

SEQ ID NO: 152544 - DNA, 16 bp, Homo sapiens
tacctgtgcctcggct

SEQ ID NO: 152545 - DNA, 14 bp, Homo sapiens
taccttgtatactg

SEQ ID NO: 152546 - DNA, 23 bp, Homo sapiens
tacctttgttcccaaatttcata

SEQ ID NO: 152547 - DNA, 23 bp, Homo sapiens
tacgcactacatgtggtttatag

SEQ ID NO: 152548 - DNA, 24 bp, Homo sapiens
tacgctccatcgctgtcatctcag

SEQ ID NO: 152549 - DNA, 23 bp, Homo sapiens
tactacagttgttttttgaaaac

SEQ ID NO: 152550 - DNA, 18 bp, Homo sapiens
tactacatgtgggagctt

SEQ ID NO: 152551 - DNA, 19 bp, Homo sapiens
tactagagtctgaacagct

SEQ ID NO: 152552 - DNA, 20 bp, Homo sapiens
tactatcatgtcaaacgtga

SEQ ID NO: 152553 - DNA, 14 bp, Homo sapiens
tactatgcctgtgt

SEQ ID NO: 152554 - DNA, 15 bp, Homo sapiens
tactcagcagccctc

SEQ ID NO: 152555 - DNA, 18 bp, Homo sapiens
tactcagcagccctcctc

SEQ ID NO: 152556 - DNA, 19 bp, Homo sapiens
tactcagcagccctcctca

SEQ ID NO: 152557 - DNA, 12 bp, Homo sapiens
tactcagccctg

SEQ ID NO: 152558 - DNA, 13 bp, Homo sapiens
tactcagccctgg

SEQ ID NO: 152559 - DNA, 12 bp, Homo sapiens
tactcaggaggc

SEQ ID NO: 152560 - DNA, 15 bp, Homo sapiens
tactcaggaggctga

SEQ ID NO: 152561 - DNA, 20 bp, Homo sapiens
tactgacatgtggggccagg

SEQ ID NO: 152562 - DNA, 22 bp, Homo sapiens
tactgacatgtggggccaggtc

SEQ ID NO: 152563 - DNA, 14 bp, Homo sapiens
tactgactttctca

SEQ ID NO: 152564 - DNA, 17 bp, Homo sapiens
tactgagagtgaacaaa

SEQ ID NO: 152565 - DNA, 17 bp, Homo sapiens
tactgagcttctctgtg

SEQ ID NO: 152566 - DNA, 15 bp, Homo sapiens
tactgatttttgtga

SEQ ID NO: 152567 - DNA, 23 bp, Homo sapiens
tactgcagctttacatgcaattt

SEQ ID NO: 152568 - DNA, 16 bp, Homo sapiens
tactgcagggccagga

SEQ ID NO: 152569 - DNA, 17 bp, Homo sapiens
tactgcatatgaaagga

SEQ ID NO: 152570 - DNA, 22 bp, Homo sapiens
tactgcccaggcctgcctgttc

SEQ ID NO: 152571 - DNA, 21 bp, Homo sapiens
tactgtcttcagtaagccgtg

SEQ ID NO: 152572 - DNA, 22 bp, Homo sapiens
tactgtgtacagaattctgcta

SEQ ID NO: 152573 - DNA, 23 bp, Homo sapiens
tactgtgtacagaattctgctac

SEQ ID NO: 152574 - DNA, 16 bp, Homo sapiens
tacttcactttaattc

SEQ ID NO: 152575 - DNA, 16 bp, Homo sapiens
tatagctgtacaaata

SEQ ID NO: 152576 - DNA, 13 bp, Homo sapiens
tataggaattgac

SEQ ID NO: 152577 - DNA, 19 bp, Homo sapiens
tataggaattgacccacaa

SEQ ID NO: 152578 - DNA, 16 bp, Homo sapiens
tataggtgctacaaaa

SEQ ID NO: 152579 - DNA, 13 bp, Homo sapiens
tatagtgtaaaat

SEQ ID NO: 152580 - DNA, 18 bp, Homo sapiens
tatagtgtaaaataagaa

SEQ ID NO: 152581 - DNA, 15 bp, Homo sapiens
tatagtttgtacatg

SEQ ID NO: 152582 - DNA, 18 bp, Homo sapiens
tatataaaaagaaaagat

SEQ ID NO: 152583 - DNA, 20 bp, Homo sapiens
tatataaaaagaaaagataa

SEQ ID NO: 152584 - DNA, 16 bp, Homo sapiens
tatataaaataaatat

SEQ ID NO: 152585 - DNA, 14 bp, Homo sapiens
tatataaacctaaa

SEQ ID NO: 152586 - DNA, 22 bp, Homo sapiens
tatataaacctaaaaaagatat

SEQ ID NO: 152587 - DNA, 17 bp, Homo sapiens
tatatacaataacataa

SEQ ID NO: 152588 - DNA, 13 bp, Homo sapiens
tatatataaaata

SEQ ID NO: 152589 - DNA, 22 bp, Homo sapiens
tatatattggtaacatcctttc

SEQ ID NO: 152590 - DNA, 15 bp, Homo sapiens
tatatatttataact

SEQ ID NO: 152591 - DNA, 12 bp, Homo sapiens
tatatcttgttt

SEQ ID NO: 152592 - DNA, 21 bp, Homo sapiens
tatatgcacttataattttcc

SEQ ID NO: 152593 - DNA, 20 bp, Homo sapiens
tatatggcagagttgtaaat

SEQ ID NO: 152594 - DNA, 12 bp, Homo sapiens
tatatgtcaaag

SEQ ID NO: 152595 - DNA, 15 bp, Homo sapiens
tatattaaaaatata

SEQ ID NO: 152596 - DNA, 21 bp, Homo sapiens
tatattaaaaatataaaactg

SEQ ID NO: 152597 - DNA, 18 bp, Homo sapiens
tatattggtaacatcctt

SEQ ID NO: 152598 - DNA, 19 bp, Homo sapiens
tatattggtaacatccttt

SEQ ID NO: 152599 - DNA, 19 bp, Homo sapiens
tatattgtcagatattttt

SEQ ID NO: 152600 - DNA, 18 bp, Homo sapiens
tatatttagttatagttt

SEQ ID NO: 152601 - DNA, 14 bp, Homo sapiens
tatatttataactc

SEQ ID NO: 152602 - DNA, 16 bp, Homo sapiens
tatatttataactcat

SEQ ID NO: 152603 - DNA, 13 bp, Homo sapiens
tatattttaagaa

SEQ ID NO: 152604 - DNA, 21 bp, Homo sapiens
tatattttttgttaaatgatt

SEQ ID NO: 152605 - DNA, 14 bp, Homo sapiens
tatcacaaatctta

SEQ ID NO: 152606 - DNA, 14 bp, Homo sapiens
tatcagaagaccac

SEQ ID NO: 152607 - DNA, 23 bp, Homo sapiens
tatcaggtctcccacgtgggaga

SEQ ID NO: 152608 - DNA, 22 bp, Homo sapiens
tatcagtcataactaaataaag

SEQ ID NO: 152609 - DNA, 16 bp, Homo sapiens
tatcagttactcagcc

SEQ ID NO: 152610 - DNA, 18 bp, Homo sapiens
tatcagttactcagccct

SEQ ID NO: 152611 - DNA, 20 bp, Homo sapiens
tatcagttactcagccctgg

SEQ ID NO: 152612 - DNA, 20 bp, Homo sapiens
tatcagtttgtcctgtagag

SEQ ID NO: 152613 - DNA, 14 bp, Homo sapiens
tatcatgacatgtt

SEQ ID NO: 152614 - DNA, 20 bp, Homo sapiens
tatccacccagcccattctc

SEQ ID NO: 152615 - DNA, 18 bp, Homo sapiens
tatccatgggggcagggc

SEQ ID NO: 152616 - DNA, 15 bp, Homo sapiens
tatcccctcccagtc

SEQ ID NO: 152617 - DNA, 18 bp, Homo sapiens
tatcctgccaaaatcatt

SEQ ID NO: 152618 - DNA, 16 bp, Homo sapiens
tatcgatctcttattt

SEQ ID NO: 152619 - DNA, 18 bp, Homo sapiens
tatcgcttcatgtaacta

SEQ ID NO: 152620 - DNA, 18 bp, Homo sapiens
tatctctatttaatattt

SEQ ID NO: 152621 - DNA, 20 bp, Homo sapiens
tatctctatttaatatttat

SEQ ID NO: 152622 - DNA, 22 bp, Homo sapiens
tatctcttttgaatccatgctt

SEQ ID NO: 152623 - DNA, 18 bp, Homo sapiens
tatctgggaactgtgcct

SEQ ID NO: 152624 - DNA, 18 bp, Homo sapiens
tatgactgctccccagcc

SEQ ID NO: 152625 - DNA, 22 bp, Homo sapiens
tatgactgctccccagccctgg

SEQ ID NO: 152626 - DNA, 18 bp, Homo sapiens
tatgagttgttttcagac

SEQ ID NO: 152627 - DNA, 18 bp, Homo sapiens
tatgatttggaaaataaa

SEQ ID NO: 152628 - DNA, 15 bp, Homo sapiens
tatgcaaagcactga

SEQ ID NO: 152629 - DNA, 17 bp, Homo sapiens
tatgcatctaataaaaa

SEQ ID NO: 152630 - DNA, 20 bp, Homo sapiens
tatgcatggaaacctgaaaa

SEQ ID NO: 152631 - DNA, 21 bp, Homo sapiens
tatggaaactgttgccagaga

SEQ ID NO: 152632 - DNA, 20 bp, Homo sapiens
tatggaacttctaatatatt

SEQ ID NO: 152633 - DNA, 24 bp, Homo sapiens
tatggaatacagtgttattttctt

SEQ ID NO: 152634 - DNA, 19 bp, Homo sapiens
tatggaggctttgcataga

SEQ ID NO: 152635 - DNA, 18 bp, Homo sapiens
tatggcagagttgtaaat

SEQ ID NO: 152636 - DNA, 22 bp, Homo sapiens
tatggggagaaaagacatgaat

SEQ ID NO: 152637 - DNA, 20 bp, Homo sapiens
tatggtataatggttgactg

SEQ ID NO: 152638 - DNA, 14 bp, Homo sapiens
tatggtatttgagt

SEQ ID NO: 152639 - DNA, 19 bp, Homo sapiens
tatgtaaaataaaattatg

SEQ ID NO: 152640 - DNA, 17 bp, Homo sapiens
tatgtaaagtatgtaaa

SEQ ID NO: 152641 - DNA, 20 bp, Homo sapiens
tatgtaaagtatgtaaacag

SEQ ID NO: 152642 - DNA, 10 bp, Homo sapiens
tatgtaaatg

SEQ ID NO: 152643 - DNA, 21 bp, Homo sapiens
tatgtactcctctttacactg

SEQ ID NO: 152644 - DNA, 16 bp, Homo sapiens
tatgtatgtgaaagtt

SEQ ID NO: 152645 - DNA, 13 bp, Homo sapiens
tatgtatgtttac

SEQ ID NO: 152646 - DNA, 16 bp, Homo sapiens
tatgtatgtttacata

SEQ ID NO: 152647 - DNA, 19 bp, Homo sapiens
tatgtcatcatacatgact

SEQ ID NO: 152648 - DNA, 15 bp, Homo sapiens
tatgtctatttaagc

SEQ ID NO: 152649 - DNA, 13 bp, Homo sapiens
tatgtgagtgtgt

SEQ ID NO: 152650 - DNA, 17 bp, Homo sapiens
tatgtgtaaaatgtgaa

SEQ ID NO: 152651 - DNA, 14 bp, Homo sapiens
tatgttgataaaag

SEQ ID NO: 152652 - DNA, 16 bp, Homo sapiens
tatgttgtcaaagaga

SEQ ID NO: 152653 - DNA, 14 bp, Homo sapiens
tatgtttacatatc

SEQ ID NO: 152654 - DNA, 22 bp, Homo sapiens
tatgtttgtataatgaatgaga

SEQ ID NO: 152655 - DNA, 15 bp, Homo sapiens
tatgtttttgttcaa

SEQ ID NO: 152656 - DNA, 13 bp, Homo sapiens
tattaaaaatata

SEQ ID NO: 152657 - DNA, 21 bp, Homo sapiens
tctctgtctcatccatcatca

SEQ ID NO: 152658 - DNA, 23 bp, Homo sapiens
tctctgtctcatccatcatcatg

SEQ ID NO: 152659 - DNA, 16 bp, Homo sapiens
tctctgtgaacgattt

SEQ ID NO: 152660 - DNA, 15 bp, Homo sapiens
tctcttactgcaaat

SEQ ID NO: 152661 - DNA, 13 bp, Homo sapiens
tctcttgagcctg

SEQ ID NO: 152662 - DNA, 16 bp, Homo sapiens
tctcttggtttccttc

SEQ ID NO: 152663 - DNA, 18 bp, Homo sapiens
tctcttggtttccttcct

SEQ ID NO: 152664 - DNA, 19 bp, Homo sapiens
tctcttggtttccttcctt

SEQ ID NO: 152665 - DNA, 23 bp, Homo sapiens
tctcttttgaatccatgcttggg

SEQ ID NO: 152666 - DNA, 23 bp, Homo sapiens
tctgaaaccctggaccagtggtc

SEQ ID NO: 152667 - DNA, 14 bp, Homo sapiens
tctgaaagccacgt

SEQ ID NO: 152668 - DNA, 16 bp, Homo sapiens
tctgaagtcactgcac

SEQ ID NO: 152669 - DNA, 18 bp, Homo sapiens
tctgaagtcactgcacag

SEQ ID NO: 152670 - DNA, 15 bp, Homo sapiens
tctgacccagtgaga

SEQ ID NO: 152671 - DNA, 21 bp, Homo sapiens
tctgacccagtgagattacag

SEQ ID NO: 152672 - DNA, 13 bp, Homo sapiens
tctgacccctcct

SEQ ID NO: 152673 - DNA, 15 bp, Homo sapiens
tctgacccctcctca

SEQ ID NO: 152674 - DNA, 16 bp, Homo sapiens
tctgacccctcctcac

SEQ ID NO: 152675 - DNA, 16 bp, Homo sapiens
tctgaccctctcccca

SEQ ID NO: 152676 - DNA, 21 bp, Homo sapiens
tctgaccgaaacagcgctggg

SEQ ID NO: 152677 - DNA, 14 bp, Homo sapiens
tctgactcagggct

SEQ ID NO: 152678 - DNA, 20 bp, Homo sapiens
tctgactcagggctcctggg

SEQ ID NO: 152679 - DNA, 18 bp, Homo sapiens
tctgagaaggtccttaat

SEQ ID NO: 152680 - DNA, 15 bp, Homo sapiens
tctgagaatctttat

SEQ ID NO: 152681 - DNA, 19 bp, Homo sapiens
tctgagaatctttattgag

SEQ ID NO: 152682 - DNA, 24 bp, Homo sapiens
tctgagatcaaaacggttttactg

SEQ ID NO: 152683 - DNA, 15 bp, Homo sapiens
tctgagcccctggga

SEQ ID NO: 152684 - DNA, 16 bp, Homo sapiens
tctgagcccctgggac

SEQ ID NO: 152685 - DNA, 18 bp, Homo sapiens
tctgagtatctcctcgca

SEQ ID NO: 152686 - DNA, 24 bp, Homo sapiens
tctgagtgtttttactacagttgt

SEQ ID NO: 152687 - DNA, 24 bp, Homo sapiens
tctgagtttcattctcctgcctgt

SEQ ID NO: 152688 - DNA, 18 bp, Homo sapiens
tctgattacacaaaacaa

SEQ ID NO: 152689 - DNA, 23 bp, Homo sapiens
tctgcaaaatgaggaatgtatat

SEQ ID NO: 152690 - DNA, 21 bp, Homo sapiens
tctgcaagaattgaagcagga

SEQ ID NO: 152691 - DNA, 18 bp, Homo sapiens
tctgcactactgacatgt

SEQ ID NO: 152692 - DNA, 10 bp, Homo sapiens
tctgcagaag

SEQ ID NO: 152693 - DNA, 12 bp, Homo sapiens
tctgcagagcag

SEQ ID NO: 152694 - DNA, 14 bp, Homo sapiens
tctgcagccagccc

SEQ ID NO: 152695 - DNA, 15 bp, Homo sapiens
tctgcagccagccca

SEQ ID NO: 152696 - DNA, 19 bp, Homo sapiens
tctgcagccagcccagccc

SEQ ID NO: 152697 - DNA, 23 bp, Homo sapiens
tctgcagcccggcgccaccatcc

SEQ ID NO: 152698 - DNA, 13 bp, Homo sapiens
tctgcaggcaggg

SEQ ID NO: 152699 - DNA, 16 bp, Homo sapiens
tctgcattctagtact

SEQ ID NO: 152700 - DNA, 19 bp, Homo sapiens
tctgccaaaggatgtgata

SEQ ID NO: 152701 - DNA, 15 bp, Homo sapiens
tctgccagccagcag

SEQ ID NO: 152702 - DNA, 19 bp, Homo sapiens
tctgccagccagcagccag

SEQ ID NO: 152703 - DNA, 19 bp, Homo sapiens
tctgccagtgacagacagg

SEQ ID NO: 152704 - DNA, 20 bp, Homo sapiens
tctgcccatcctgcccctga

SEQ ID NO: 152705 - DNA, 15 bp, Homo sapiens
tctgcctcttctggg

SEQ ID NO: 152706 - DNA, 17 bp, Homo sapiens
tctgcctcttctgggag

SEQ ID NO: 152707 - DNA, 14 bp, Homo sapiens
tctgcctgtctccc

SEQ ID NO: 152708 - DNA, 14 bp, Homo sapiens
tctgcggaccccag

SEQ ID NO: 152709 - DNA, 17 bp, Homo sapiens
tctgcggaccccagctg

SEQ ID NO: 152710 - DNA, 14 bp, Homo sapiens
tctgctacctcact

SEQ ID NO: 152711 - DNA, 12 bp, Homo sapiens
tctgctcatcat

SEQ ID NO: 152712 - DNA, 18 bp, Homo sapiens
tctgctcatcattctctg

SEQ ID NO: 152713 - DNA, 16 bp, Homo sapiens
tctgctcgccttagca

SEQ ID NO: 152714 - DNA, 14 bp, Homo sapiens
tctgctggcccagc

SEQ ID NO: 152715 - DNA, 22 bp, Homo sapiens
tctgcttacaattccctgctgt

SEQ ID NO: 152716 - DNA, 14 bp, Homo sapiens
tctgcttcagtgga

SEQ ID NO: 152717 - DNA, 16 bp, Homo sapiens
tcactggcaatgaaaa

SEQ ID NO: 152718 - DNA, 19 bp, Homo sapiens
tcactggggtcctggggcc

SEQ ID NO: 152719 - DNA, 21 bp, Homo sapiens
tcactggggtcctggggcctc

SEQ ID NO: 152720 - DNA, 15 bp, Homo sapiens
tcactgttgaaaatt

SEQ ID NO: 152721 - DNA, 19 bp, Homo sapiens
tcactgttgaaaattattt

SEQ ID NO: 152722 - DNA, 17 bp, Homo sapiens
tcactgtttctctgctg

SEQ ID NO: 152723 - DNA, 18 bp, Homo sapiens
tcactgtttctctgctgt

SEQ ID NO: 152724 - DNA, 23 bp, Homo sapiens
tcacttgaacccgggaggcagag

SEQ ID NO: 152725 - DNA, 10 bp, Homo sapiens
tcacttgagt

SEQ ID NO: 152726 - DNA, 13 bp, Homo sapiens
tcacttttcagtg

SEQ ID NO: 152727 - DNA, 23 bp, Homo sapiens
tcagaaagagcaagtctggatct

SEQ ID NO: 152728 - DNA, 17 bp, Homo sapiens
tcagaaagcattacatt

SEQ ID NO: 152729 - DNA, 18 bp, Homo sapiens
tcagaaatgtacaacttt

SEQ ID NO: 152730 - DNA, 15 bp, Homo sapiens
tcagaacccttggct

SEQ ID NO: 152731 - DNA, 12 bp, Homo sapiens
tcagaaggagaa

SEQ ID NO: 152732 - DNA, 16 bp, Homo sapiens
tcagaaggagaaggaa

SEQ ID NO: 152733 - DNA, 23 bp, Homo sapiens
tcagaaggagaaggaaggagact

SEQ ID NO: 152734 - DNA, 19 bp, Homo sapiens
tcagaagtttctcagctcc

SEQ ID NO: 152735 - DNA, 12 bp, Homo sapiens
tcagaccccagc

SEQ ID NO: 152736 - DNA, 23 bp, Homo sapiens
tcagagacaggaagtcttcaggg

SEQ ID NO: 152737 - DNA, 14 bp, Homo sapiens
tcagagactcaggg

SEQ ID NO: 152738 - DNA, 19 bp, Homo sapiens
tcagagactcagggcccca

SEQ ID NO: 152739 - DNA, 12 bp, Homo sapiens
tcagagagcagc

SEQ ID NO: 152740 - DNA, 16 bp, Homo sapiens
tcagagccgtggtcct

SEQ ID NO: 152741 - DNA, 18 bp, Homo sapiens
tcagaggccctcgctgcc

SEQ ID NO: 152742 - DNA, 18 bp, Homo sapiens
tcagatatatatcatatt

SEQ ID NO: 152743 - DNA, 21 bp, Homo sapiens
tcagatttgaactcttcaatc

SEQ ID NO: 152744 - DNA, 19 bp, Homo sapiens
tcagattttaaaaagtctt

SEQ ID NO: 152745 - DNA, 15 bp, Homo sapiens
tcagcaaaaagcaaa

SEQ ID NO: 152746 - DNA, 21 bp, Homo sapiens
tcagcaaaaagcaaaatcatt

SEQ ID NO: 152747 - DNA, 13 bp, Homo sapiens
tcagcactgtccc

SEQ ID NO: 152748 - DNA, 23 bp, Homo sapiens
tcagcacttgggggatctgttgt

SEQ ID NO: 152749 - DNA, 15 bp, Homo sapiens
tcagcagccctcctc

SEQ ID NO: 152750 - DNA, 17 bp, Homo sapiens
tcagcaggaagcaacga

SEQ ID NO: 152751 - DNA, 20 bp, Homo sapiens
tcagcagtacctataaagta

SEQ ID NO: 152752 - DNA, 20 bp, Homo sapiens
tcagcattctcactcctacc

SEQ ID NO: 152753 - DNA, 23 bp, Homo sapiens
tcagcattctcactcctacctgg

SEQ ID NO: 152754 - DNA, 21 bp, Homo sapiens
tcagccaacgagtaatttatt

SEQ ID NO: 152755 - DNA, 18 bp, Homo sapiens
tcagcccctcctctgcca

SEQ ID NO: 152756 - DNA, 22 bp, Homo sapiens
tcagcccctcctctgccacctc

SEQ ID NO: 152757 - DNA, 23 bp, Homo sapiens
tcagcccctcctctgccacctcc

SEQ ID NO: 152758 - DNA, 19 bp, Homo sapiens
tcagccctagggtggagag

SEQ ID NO: 152759 - DNA, 23 bp, Homo sapiens
tcagccctagggtggagagccac

SEQ ID NO: 152760 - DNA, 17 bp, Homo sapiens
tcagccctccctgcccc

SEQ ID NO: 152761 - DNA, 18 bp, Homo sapiens
tcagccctccctgcccct

SEQ ID NO: 152762 - DNA, 19 bp, Homo sapiens
tcagccctgggccccacca

SEQ ID NO: 152763 - DNA, 21 bp, Homo sapiens
tcagccctgggccccaccacc

SEQ ID NO: 152764 - DNA, 22 bp, Homo sapiens
tcagcctagccgacctcagcct

SEQ ID NO: 152765 - DNA, 18 bp, Homo sapiens
tcagcctgctccagctgt

SEQ ID NO: 152766 - DNA, 19 bp, Homo sapiens
tcagcctgctccagctgtt

SEQ ID NO: 152767 - DNA, 18 bp, Homo sapiens
tcagcctggtgggcctcc

SEQ ID NO: 152768 - DNA, 12 bp, Homo sapiens
tcagcctgtgct

SEQ ID NO: 152769 - DNA, 16 bp, Homo sapiens
tcagcctgtgctgccc

SEQ ID NO: 152770 - DNA, 23 bp, Homo sapiens
tcagccttccccttgcccagggc

SEQ ID NO: 152771 - DNA, 19 bp, Homo sapiens
tcagctactgatttttgtg

SEQ ID NO: 152772 - DNA, 17 bp, Homo sapiens
tcagctcccctcggaga

SEQ ID NO: 152773 - DNA, 22 bp, Homo sapiens
tcagctcccctcggagaagagc

SEQ ID NO: 152774 - DNA, 15 bp, Homo sapiens
tcagctccttcctgg

SEQ ID NO: 152775 - DNA, 16 bp, Homo sapiens
tcagctccttcctgga

SEQ ID NO: 152776 - DNA, 23 bp, Homo sapiens
tcagctctgcaagaattgaagca

SEQ ID NO: 152777 - DNA, 16 bp, Homo sapiens
tcagctgaacctgggt

SEQ ID NO: 152778 - DNA, 14 bp, Homo sapiens
tcagcttcttaata

SEQ ID NO: 152779 - DNA, 23 bp, Homo sapiens
tcaggaaatcaaatatgcaaagc

SEQ ID NO: 152780 - DNA, 20 bp, Homo sapiens
tcaggaccaaagctttcatg

SEQ ID NO: 152781 - DNA, 15 bp, Homo sapiens
tcaggacccagagga

SEQ ID NO: 152782 - DNA, 14 bp, Homo sapiens
tcaggactcagaag

SEQ ID NO: 152783 - DNA, 14 bp, Homo sapiens
tcaggactcctctc

SEQ ID NO: 152784 - DNA, 17 bp, Homo sapiens
tcaggagaggggcagaa

SEQ ID NO: 152785 - DNA, 12 bp, Homo sapiens
tcaggaggctga

SEQ ID NO: 152786 - DNA, 18 bp, Homo sapiens
tcaggaggctgaggcaga

SEQ ID NO: 152787 - DNA, 17 bp, Homo sapiens
tcaggagttagaggcca

SEQ ID NO: 152788 - DNA, 13 bp, Homo sapiens
tcaggatgcccag

SEQ ID NO: 152789 - DNA, 15 bp, Homo sapiens
tcaggcactagcctt

SEQ ID NO: 152790 - DNA, 16 bp, Homo sapiens
tcaggccacggcagcc

SEQ ID NO: 152791 - DNA, 15 bp, Homo sapiens
tcaggctcttctcct

SEQ ID NO: 152792 - DNA, 19 bp, Homo sapiens
tcaggctgctggaggaaaa

SEQ ID NO: 152793 - DNA, 14 bp, Homo sapiens
tcaggctggtggga

SEQ ID NO: 152794 - DNA, 15 bp, Homo sapiens
tcagggacagagcca

SEQ ID NO: 152795 - DNA, 16 bp, Homo sapiens
tcagggacccctgccc

SEQ ID NO: 152796 - DNA, 23 bp, Homo sapiens
tcagggatagcactgagcaaagc

SEQ ID NO: 152797 - DNA, 16 bp, Homo sapiens
tcaggggagtcccgtc

SEQ ID NO: 152798 - DNA, 20 bp, Homo sapiens
tcaggggagtcccgtcagga

SEQ ID NO: 152799 - DNA, 14 bp, Homo sapiens
tcaggggccagagg

SEQ ID NO: 152800 - DNA, 16 bp, Homo sapiens
tcaggggccagaggaa

SEQ ID NO: 152801 - DNA, 12 bp, Homo sapiens
tcaggggtgtgc

SEQ ID NO: 152802 - DNA, 19 bp, Homo sapiens
tcaggggtgtgcggccttt

SEQ ID NO: 152803 - DNA, 21 bp, Homo sapiens
tcagggttctcctctcccctc

SEQ ID NO: 152804 - DNA, 18 bp, Homo sapiens
tcaggtcagggtgaggat

SEQ ID NO: 152805 - DNA, 23 bp, Homo sapiens
tcaggtgagaagcagaggaagga

SEQ ID NO: 152806 - DNA, 14 bp, Homo sapiens
tcaggttttgtaaa

SEQ ID NO: 152807 - DNA, 14 bp, Homo sapiens
tcagtaatatttat

SEQ ID NO: 152808 - DNA, 16 bp, Homo sapiens
tcagtatgttgtcaaa

SEQ ID NO: 152809 - DNA, 18 bp, Homo sapiens
tcagtatgttgtcaaaga

SEQ ID NO: 152810 - DNA, 23 bp, Homo sapiens
tcagtattttggagaaattattt

SEQ ID NO: 152811 - DNA, 13 bp, Homo sapiens
tcagtcctcccct

SEQ ID NO: 152812 - DNA, 17 bp, Homo sapiens
tcagtcctcccctcaca

SEQ ID NO: 152813 - DNA, 15 bp, Homo sapiens
tcagtctctgagcag

SEQ ID NO: 152814 - DNA, 19 bp, Homo sapiens
tcagtgatgtaccatgaaa

SEQ ID NO: 152815 - DNA, 13 bp, Homo sapiens
tcagtgctccctc

SEQ ID NO: 152816 - DNA, 15 bp, Homo sapiens
tcagtgggaacgtga

SEQ ID NO: 152817 - DNA, 19 bp, Homo sapiens
tcagtgggaacgtgactgc

SEQ ID NO: 152818 - DNA, 14 bp, Homo sapiens
tcagtgggagaaaa

SEQ ID NO: 152819 - DNA, 21 bp, Homo sapiens
tcagtggtccacatcccggga

SEQ ID NO: 152820 - DNA, 14 bp, Homo sapiens
tcagtgtatttgta

SEQ ID NO: 152821 - DNA, 22 bp, Homo sapiens
tgacccccaaccaagtggctcc

SEQ ID NO: 152822 - DNA, 13 bp, Homo sapiens
tgacccctcctca

SEQ ID NO: 152823 - DNA, 20 bp, Homo sapiens
tgacccttacagcctctgac

SEQ ID NO: 152824 - DNA, 18 bp, Homo sapiens
tgacctcaggcactagcc

SEQ ID NO: 152825 - DNA, 13 bp, Homo sapiens
tgacctcatgcat

SEQ ID NO: 152826 - DNA, 19 bp, Homo sapiens
tgacctcatgcatctccac

SEQ ID NO: 152827 - DNA, 15 bp, Homo sapiens
tgacctccacagctt

SEQ ID NO: 152828 - DNA, 22 bp, Homo sapiens
tgacctccatgactgcacagta

SEQ ID NO: 152829 - DNA, 15 bp, Homo sapiens
tgacctgtgtcacta

SEQ ID NO: 152830 - DNA, 17 bp, Homo sapiens
tgaccttgaactcctgg

SEQ ID NO: 152831 - DNA, 18 bp, Homo sapiens
tgaccttgaactcctggg

SEQ ID NO: 152832 - DNA, 19 bp, Homo sapiens
tgaccttgaactcctgggc

SEQ ID NO: 152833 - DNA, 17 bp, Homo sapiens
tgactacagtcaggaaa

SEQ ID NO: 152834 - DNA, 16 bp, Homo sapiens
tgactcaaatctccag

SEQ ID NO: 152835 - DNA, 11 bp, Homo sapiens
tgactcaccca

SEQ ID NO: 152836 - DNA, 12 bp, Homo sapiens
tgactcacccaa

SEQ ID NO: 152837 - DNA, 15 bp, Homo sapiens
tgactcacccaagca

SEQ ID NO: 152838 - DNA, 14 bp, Homo sapiens
tgactcagggctcc

SEQ ID NO: 152839 - DNA, 15 bp, Homo sapiens
tgactcagggctcct

SEQ ID NO: 152840 - DNA, 17 bp, Homo sapiens
tgactcagggctcctgg

SEQ ID NO: 152841 - DNA, 19 bp, Homo sapiens
tgactcagggctcctgggt

SEQ ID NO: 152842 - DNA, 20 bp, Homo sapiens
tgactcattctgaaggagcc

SEQ ID NO: 152843 - DNA, 13 bp, Homo sapiens
tgactctcaaatc

SEQ ID NO: 152844 - DNA, 23 bp, Homo sapiens
tgactctttttagggccaggcag

SEQ ID NO: 152845 - DNA, 15 bp, Homo sapiens
tgactgagcagactg

SEQ ID NO: 152846 - DNA, 22 bp, Homo sapiens
tgactgctccccagccctggct

SEQ ID NO: 152847 - DNA, 15 bp, Homo sapiens
tgacttctccaggtc

SEQ ID NO: 152848 - DNA, 12 bp, Homo sapiens
tgacttgtatat

SEQ ID NO: 152849 - DNA, 12 bp, Homo sapiens
tgactttcaggt

SEQ ID NO: 152850 - DNA, 20 bp, Homo sapiens
tgagaaacaacaatttctac

SEQ ID NO: 152851 - DNA, 20 bp, Homo sapiens
tgagaagcagaggaaggaga

SEQ ID NO: 152852 - DNA, 16 bp, Homo sapiens
tgagaagccgtgggtg

SEQ ID NO: 152853 - DNA, 17 bp, Homo sapiens
tgagaagccgtgggtgg

SEQ ID NO: 152854 - DNA, 14 bp, Homo sapiens
tgagaaggagagaa

SEQ ID NO: 152855 - DNA, 22 bp, Homo sapiens
tgagaatctttattgagaaaga

SEQ ID NO: 152856 - DNA, 13 bp, Homo sapiens
tgagaattttaaa

SEQ ID NO: 152857 - DNA, 18 bp, Homo sapiens
tgagacccagccctcatc

SEQ ID NO: 152858 - DNA, 12 bp, Homo sapiens
tgagaccctgtc

SEQ ID NO: 152859 - DNA, 21 bp, Homo sapiens
ctcatattttgtatatatctg

SEQ ID NO: 152860 - DNA, 15 bp, Homo sapiens
ctcatcactggatga

SEQ ID NO: 152861 - DNA, 12 bp, Homo sapiens
ctcatcataaaa

SEQ ID NO: 152862 - DNA, 16 bp, Homo sapiens
ctcatcataaaataaa

SEQ ID NO: 152863 - DNA, 14 bp, Homo sapiens
ctcatcattctctg

SEQ ID NO: 152864 - DNA, 19 bp, Homo sapiens
ctcatcattctctgtctca

SEQ ID NO: 152865 - DNA, 22 bp, Homo sapiens
ctcatcccgagcacctccacat

SEQ ID NO: 152866 - DNA, 15 bp, Homo sapiens
ctcatccgaggcagg

SEQ ID NO: 152867 - DNA, 13 bp, Homo sapiens
ctcatctgtccct

SEQ ID NO: 152868 - DNA, 16 bp, Homo sapiens
ctcatgcatctccacc

SEQ ID NO: 152869 - DNA, 18 bp, Homo sapiens
ctcatgcatctccacctg

SEQ ID NO: 152870 - DNA, 12 bp, Homo sapiens
ctcatgtgatcc

SEQ ID NO: 152871 - DNA, 16 bp, Homo sapiens
ctcatgtgatcctttt

SEQ ID NO: 152872 - DNA, 17 bp, Homo sapiens
ctcattccaacagtgag

SEQ ID NO: 152873 - DNA, 18 bp, Homo sapiens
ctcattccaacagtgagt

SEQ ID NO: 152874 - DNA, 13 bp, Homo sapiens
ctcattccccagg

SEQ ID NO: 152875 - DNA, 12 bp, Homo sapiens
ctcattcctgcc

SEQ ID NO: 152876 - DNA, 16 bp, Homo sapiens
ctcattcctgcctgtc

SEQ ID NO: 152877 - DNA, 20 bp, Homo sapiens
ctcattcctgcctgtctcct

SEQ ID NO: 152878 - DNA, 17 bp, Homo sapiens
ctcattctgaaggagcc

SEQ ID NO: 152879 - DNA, 17 bp, Homo sapiens
ctcattgacaagaactg

SEQ ID NO: 152880 - DNA, 17 bp, Homo sapiens
ctcatttggggtagcta

SEQ ID NO: 152881 - DNA, 13 bp, Homo sapiens
ctccaaagaaatg

SEQ ID NO: 152882 - DNA, 14 bp, Homo sapiens
ctccaagctccatc

SEQ ID NO: 152883 - DNA, 15 bp, Homo sapiens
ctccaaggtggggtc

SEQ ID NO: 152884 - DNA, 22 bp, Homo sapiens
ctccaatcccaccaaccctcag

SEQ ID NO: 152885 - DNA, 15 bp, Homo sapiens
ctccacagctacctc

SEQ ID NO: 152886 - DNA, 15 bp, Homo sapiens
ctccacatcctccac

SEQ ID NO: 152887 - DNA, 17 bp, Homo sapiens
ctccacatcctccacgt

SEQ ID NO: 152888 - DNA, 16 bp, Homo sapiens
ctccaccacccaaaag

SEQ ID NO: 152889 - DNA, 16 bp, Homo sapiens
ctccaccgctgcctaa

SEQ ID NO: 152890 - DNA, 14 bp, Homo sapiens
ctccacctcagcct

SEQ ID NO: 152891 - DNA, 15 bp, Homo sapiens
ctccacctcagcctt

SEQ ID NO: 152892 - DNA, 22 bp, Homo sapiens
ctccacctcttcaccccccact

SEQ ID NO: 152893 - DNA, 22 bp, Homo sapiens
ctccacctgctcccaggccagt

SEQ ID NO: 152894 - DNA, 20 bp, Homo sapiens
ctccacgttcacccctccac

SEQ ID NO: 152895 - DNA, 15 bp, Homo sapiens
ctccacgttctgctc

SEQ ID NO: 152896 - DNA, 17 bp, Homo sapiens
ctccacgttctgctcat

SEQ ID NO: 152897 - DNA, 11 bp, Homo sapiens
ctccactgcct

SEQ ID NO: 152898 - DNA, 13 bp, Homo sapiens
ctccactgccttc

SEQ ID NO: 152899 - DNA, 14 bp, Homo sapiens
ctccagacccctgg

SEQ ID NO: 152900 - DNA, 20 bp, Homo sapiens
ctccagacccctggcttttc

SEQ ID NO: 152901 - DNA, 19 bp, Homo sapiens
ctccagccccttctcagaa

SEQ ID NO: 152902 - DNA, 21 bp, Homo sapiens
ctccagccccttctcagaatc

SEQ ID NO: 152903 - DNA, 18 bp, Homo sapiens
ctccagctgttcagctgg

SEQ ID NO: 152904 - DNA, 16 bp, Homo sapiens
ctccagggccacgtgc

SEQ ID NO: 152905 - DNA, 21 bp, Homo sapiens
ctccagtgagacagctctgca

SEQ ID NO: 152906 - DNA, 17 bp, Homo sapiens
ctccagttttcagttga

SEQ ID NO: 152907 - DNA, 13 bp, Homo sapiens
ctccatctccact

SEQ ID NO: 152908 - DNA, 21 bp, Homo sapiens
ctccatgagacacatctcctc

SEQ ID NO: 152909 - DNA, 15 bp, Homo sapiens
ctccatgctgcctcc

SEQ ID NO: 152910 - DNA, 16 bp, Homo sapiens
ctccatgctgcctcca

SEQ ID NO: 152911 - DNA, 17 bp, Homo sapiens
ctccatgctgcctccag

SEQ ID NO: 152912 - DNA, 22 bp, Homo sapiens
ctcccaccccacccccttcagt

SEQ ID NO: 152913 - DNA, 20 bp, Homo sapiens
ctcccacccccatctctccc

SEQ ID NO: 152914 - DNA, 21 bp, Homo sapiens
ctcccacctctgtgacctcag

SEQ ID NO: 152915 - DNA, 24 bp, Homo sapiens
ctcccagaacacactccatcagct

SEQ ID NO: 152916 - DNA, 17 bp, Homo sapiens
ctcccaggccaggctcc

SEQ ID NO: 152917 - DNA, 20 bp, Homo sapiens
ctcccaggcgccccttcccc

SEQ ID NO: 152918 - DNA, 22 bp, Homo sapiens
ctcccaggcgccccttccccct

SEQ ID NO: 152919 - DNA, 15 bp, Homo sapiens
ctcccatcccctgga

SEQ ID NO: 152920 - DNA, 19 bp, Homo sapiens
ctccccactgcctactgca

SEQ ID NO: 152921 - DNA, 17 bp, Homo sapiens
ctccccagcccctagcc

SEQ ID NO: 152922 - DNA, 13 bp, Homo sapiens
ctccccccactgc

SEQ ID NO: 152923 - DNA, 15 bp, Homo sapiens
ctccccccactgcag

SEQ ID NO: 152924 - DNA, 14 bp, Homo sapiens
ctcccccgccactc

SEQ ID NO: 152925 - DNA, 13 bp, Homo sapiens
ctccccctgccag

SEQ ID NO: 152926 - DNA, 19 bp, Homo sapiens
ctccccctgccagtgcctt

SEQ ID NO: 152927 - DNA, 15 bp, Homo sapiens
ctcccctaatgcctg

SEQ ID NO: 152928 - DNA, 16 bp, Homo sapiens
ctcccctaatgcctgc

SEQ ID NO: 152929 - DNA, 23 bp, Homo sapiens
ctcccctatccacccagcccatt

SEQ ID NO: 152930 - DNA, 14 bp, Homo sapiens
ctcccctcacagcc

SEQ ID NO: 152931 - DNA, 19 bp, Homo sapiens
ctcccctcacagcctctga

SEQ ID NO: 152932 - DNA, 14 bp, Homo sapiens
ctcccctcccctgc

SEQ ID NO: 152933 - DNA, 17 bp, Homo sapiens
ctcccctcccctgctgc

SEQ ID NO: 152934 - DNA, 14 bp, Homo sapiens
ctcccctcggagaa

SEQ ID NO: 152935 - DNA, 22 bp, Homo sapiens
ctcccctgattacaccagcctc

SEQ ID NO: 152936 - DNA, 15 bp, Homo sapiens
ctcccctgccagggc

SEQ ID NO: 152937 - DNA, 14 bp, Homo sapiens
ctcccctgccctgc

SEQ ID NO: 152938 - DNA, 15 bp, Homo sapiens
ctcccctgccctgct

SEQ ID NO: 152939 - DNA, 16 bp, Homo sapiens
ctcccctgccctgctg

SEQ ID NO: 152940 - DNA, 18 bp, Homo sapiens
ctcccctgctgcaggggc

SEQ ID NO: 152941 - DNA, 15 bp, Homo sapiens
ctcccggtgcccaag

SEQ ID NO: 152942 - DNA, 22 bp, Homo sapiens
ctccctaccacctccccagcct

SEQ ID NO: 152943 - DNA, 15 bp, Homo sapiens
ctccctcccctgcca

SEQ ID NO: 152944 - DNA, 18 bp, Homo sapiens
ctccctcccctgccattt

SEQ ID NO: 152945 - DNA, 17 bp, Homo sapiens
ctccctctcctgcctac

SEQ ID NO: 152946 - DNA, 14 bp, Homo sapiens
ctccctctggccct

SEQ ID NO: 152947 - DNA, 19 bp, Homo sapiens
ctccctctggccctgcctt

SEQ ID NO: 152948 - DNA, 20 bp, Homo sapiens
ctccctctggccctgccttc

SEQ ID NO: 152949 - DNA, 16 bp, Homo sapiens
ctccctgaagccagcc

SEQ ID NO: 152950 - DNA, 18 bp, Homo sapiens
ctccctgaagccagcctt

SEQ ID NO: 152951 - DNA, 19 bp, Homo sapiens
ctccctgaagccagccttc

SEQ ID NO: 152952 - DNA, 13 bp, Homo sapiens
ctccctgcccctc

SEQ ID NO: 152953 - DNA, 14 bp, Homo sapiens
ctccctgcccctcc

SEQ ID NO: 152954 - DNA, 17 bp, Homo sapiens
ctccctgcccctccctt

SEQ ID NO: 152955 - DNA, 21 bp, Homo sapiens
ctccctgcccctcccttcaac

SEQ ID NO: 152956 - DNA, 16 bp, Homo sapiens
ctccctgccgcctcaa

SEQ ID NO: 152957 - DNA, 19 bp, Homo sapiens
ctccctgccgcctcaatgt

SEQ ID NO: 152958 - DNA, 19 bp, Homo sapiens
ctccctgtaacctcttcag

SEQ ID NO: 152959 - DNA, 11 bp, Homo sapiens
ctccctgtcct

SEQ ID NO: 152960 - DNA, 15 bp, Homo sapiens
ctccctgtcctcctc

SEQ ID NO: 152961 - DNA, 18 bp, Homo sapiens
ctcccttcaaccattccc

SEQ ID NO: 152962 - DNA, 16 bp, Homo sapiens
ctcccttctcttcaca

SEQ ID NO: 152963 - DNA, 14 bp, Homo sapiens
ctcccttgggctcc

SEQ ID NO: 152964 - DNA, 17 bp, Homo sapiens
ctccctttcttccctac

SEQ ID NO: 152965 - DNA, 15 bp, Homo sapiens
ctccgcctctgctgg

SEQ ID NO: 152966 - DNA, 15 bp, Homo sapiens
ctcctcaccccgtct

SEQ ID NO: 152967 - DNA, 21 bp, Homo sapiens
ctcctcactcccttcccataa

SEQ ID NO: 152968 - DNA, 15 bp, Homo sapiens
ctcctccaaaggaag

SEQ ID NO: 152969 - DNA, 18 bp, Homo sapiens
ctcctccaaaggaagtct

SEQ ID NO: 152970 - DNA, 13 bp, Homo sapiens
ctcctccagggcc

SEQ ID NO: 152971 - DNA, 14 bp, Homo sapiens
ctcctccagggcca

SEQ ID NO: 152972 - DNA, 22 bp, Homo sapiens
ctcctccagggccacgtgccag

SEQ ID NO: 152973 - DNA, 15 bp, Homo sapiens
ctcctccatgggaga

SEQ ID NO: 152974 - DNA, 17 bp, Homo sapiens
ctcctcccaggcgcccc

SEQ ID NO: 152975 - DNA, 23 bp, Homo sapiens
ctcctcccaggcgccccttcccc

SEQ ID NO: 152976 - DNA, 14 bp, Homo sapiens
ctcctcccggtgcc

SEQ ID NO: 152977 - DNA, 17 bp, Homo sapiens
ctcctcccggtgcccaa

SEQ ID NO: 152978 - DNA, 16 bp, Homo sapiens
ctcctcgcaagctggg

SEQ ID NO: 152979 - DNA, 19 bp, Homo sapiens
ctcctcgcaagctgggtaa

SEQ ID NO: 152980 - DNA, 19 bp, Homo sapiens
ctcctcggccccctccatc

SEQ ID NO: 152981 - DNA, 16 bp, Homo sapiens
ctcctctgccacctcc

SEQ ID NO: 152982 - DNA, 15 bp, Homo sapiens
ctcctctgtccaggg

SEQ ID NO: 152983 - DNA, 17 bp, Homo sapiens
ctcctctgtccagggcc

SEQ ID NO: 152984 - DNA, 18 bp, Homo sapiens
ctcctctgtccagggccc

SEQ ID NO: 152985 - DNA, 13 bp, Homo sapiens
ctcctctgtccct

SEQ ID NO: 152986 - DNA, 22 bp, Homo sapiens
ctcctctgtgaccaatgtcttg

SEQ ID NO: 152987 - DNA, 23 bp, Homo sapiens
ctcctctgtgaccaatgtcttga

SEQ ID NO: 152988 - DNA, 23 bp, Homo sapiens
ctcctcttcaactgaccagcctc

SEQ ID NO: 152989 - DNA, 23 bp, Homo sapiens
ctcctcttcttttttttcattat

SEQ ID NO: 152990 - DNA, 19 bp, Homo sapiens
ctcctcttgccactgcctc

SEQ ID NO: 152991 - DNA, 23 bp, Homo sapiens
ctcctgacccagtccccgtgccc

SEQ ID NO: 152992 - DNA, 20 bp, Homo sapiens
ctcctgagaaaaaaggttcc

SEQ ID NO: 152993 - DNA, 14 bp, Homo sapiens
ctcctgcccacctg

SEQ ID NO: 152994 - DNA, 14 bp, Homo sapiens
ctcctgcccaggag

SEQ ID NO: 152995 - DNA, 16 bp, Homo sapiens
ctcctgcccaggagag

SEQ ID NO: 152996 - DNA, 22 bp, Homo sapiens
ctcctgcccaggagagccagcc

SEQ ID NO: 152997 - DNA, 18 bp, Homo sapiens
ctcctgcctgtagcagtg

SEQ ID NO: 152998 - DNA, 19 bp, Homo sapiens
ctcctgcctgtagcagtga

SEQ ID NO: 152999 - DNA, 18 bp, Homo sapiens
ctcctgccttcctcctgg

SEQ ID NO: 153000 - DNA, 20 bp, Homo sapiens
ctcctgccttcctcctgggc

SEQ ID NO: 153001 - DNA, 20 bp, Homo sapiens
ctcctggaagctgtgtcctt

SEQ ID NO: 153002 - DNA, 12 bp, Homo sapiens
ctctcctgtcca

SEQ ID NO: 153003 - DNA, 21 bp, Homo sapiens
ctctcggttccacgtccccct

SEQ ID NO: 153004 - DNA, 13 bp, Homo sapiens
ctctctcctccct

SEQ ID NO: 153005 - DNA, 16 bp, Homo sapiens
ctctctgcagccagcc

SEQ ID NO: 153006 - DNA, 18 bp, Homo sapiens
ctctctgcagccagccca

SEQ ID NO: 153007 - DNA, 21 bp, Homo sapiens
ctctctgcagccagcccagcc

SEQ ID NO: 153008 - DNA, 19 bp, Homo sapiens
ctctcttatagaatattta

SEQ ID NO: 153009 - DNA, 21 bp, Homo sapiens
ctctcttatagaatatttatt

SEQ ID NO: 153010 - DNA, 23 bp, Homo sapiens
ctctcttatagaatatttattac

SEQ ID NO: 153011 - DNA, 15 bp, Homo sapiens
ctctcttggtttcct

SEQ ID NO: 153012 - DNA, 17 bp, Homo sapiens
ctctctttgggaatgtt

SEQ ID NO: 153013 - DNA, 17 bp, Homo sapiens
agaactggactcaggat

SEQ ID NO: 153014 - DNA, 19 bp, Homo sapiens
agaagactctaccagactg

SEQ ID NO: 153015 - DNA, 15 bp, Homo sapiens
agaagagagaaatag

SEQ ID NO: 153016 - DNA, 13 bp, Homo sapiens
agaagagaggaga

SEQ ID NO: 153017 - DNA, 16 bp, Homo sapiens
agaagagaggagagga

SEQ ID NO: 153018 - DNA, 20 bp, Homo sapiens
agaagagaggagaggagaga

SEQ ID NO: 153019 - DNA, 18 bp, Homo sapiens
agaagattttgaaatttt

SEQ ID NO: 153020 - DNA, 19 bp, Homo sapiens
agaagcaacccaaatgttc

SEQ ID NO: 153021 - DNA, 17 bp, Homo sapiens
agaagcagtgagccgca

SEQ ID NO: 153022 - DNA, 18 bp, Homo sapiens
agaagcccaatattataa

SEQ ID NO: 153023 - DNA, 22 bp, Homo sapiens
agaagcctctgggtcagtggtc

SEQ ID NO: 153024 - DNA, 16 bp, Homo sapiens
agaagcttcagaagtt

SEQ ID NO: 153025 - DNA, 18 bp, Homo sapiens
agaagcttccattccaag

SEQ ID NO: 153026 - DNA, 16 bp, Homo sapiens
agaaggaaaaatgtgt

SEQ ID NO: 153027 - DNA, 22 bp, Homo sapiens
agaaggaaggagactcacctct

SEQ ID NO: 153028 - DNA, 13 bp, Homo sapiens
agaaggagagaaa

SEQ ID NO: 153029 - DNA, 14 bp, Homo sapiens
agaaggagagaaag

SEQ ID NO: 153030 - DNA, 19 bp, Homo sapiens
agaaggagagaaagtgggt

SEQ ID NO: 153031 - DNA, 22 bp, Homo sapiens
agaaggcaagtttctagctaga

SEQ ID NO: 153032 - DNA, 15 bp, Homo sapiens
agaagggtccttccc

SEQ ID NO: 153033 - DNA, 18 bp, Homo sapiens
agaagggtccttccctct

SEQ ID NO: 153034 - DNA, 14 bp, Homo sapiens
agaaggtccttaat

SEQ ID NO: 153035 - DNA, 22 bp, Homo sapiens
agaagtttgagatcagcctggg

SEQ ID NO: 153036 - DNA, 14 bp, Homo sapiens
agaataagagaaag

SEQ ID NO: 153037 - DNA, 16 bp, Homo sapiens
agaataagagaaagaa

SEQ ID NO: 153038 - DNA, 15 bp, Homo sapiens
agaataagtcatgtt

SEQ ID NO: 153039 - DNA, 18 bp, Homo sapiens
agaatacagaaagatgga

SEQ ID NO: 153040 - DNA, 21 bp, Homo sapiens
agaatacagaaagatggatgt

SEQ ID NO: 153041 - DNA, 16 bp, Homo sapiens
agaatatttattacct

SEQ ID NO: 153042 - DNA, 19 bp, Homo sapiens
agaatatttattacctctg

SEQ ID NO: 153043 - DNA, 14 bp, Homo sapiens
agaatcaaaactct

SEQ ID NO: 153044 - DNA, 14 bp, Homo sapiens
agaatctttagaga

SEQ ID NO: 153045 - DNA, 17 bp, Homo sapiens
agaatctttattgagaa

SEQ ID NO: 153046 - DNA, 21 bp, Homo sapiens
agaatctttattgagaaagag

SEQ ID NO: 153047 - DNA, 24 bp, Homo sapiens
agaatctttattgagaaagagcac

SEQ ID NO: 153048 - DNA, 17 bp, Homo sapiens
agaatgaaaattgtatg

SEQ ID NO: 153049 - DNA, 17 bp, Homo sapiens
agaatgaggaggaagga

SEQ ID NO: 153050 - DNA, 23 bp, Homo sapiens
agaattaacacatgatcctgcaa

SEQ ID NO: 153051 - DNA, 22 bp, Homo sapiens
agaattgaacccaggaggtgga

SEQ ID NO: 153052 - DNA, 22 bp, Homo sapiens
agaattgctgattcttgagttt

SEQ ID NO: 153053 - DNA, 21 bp, Homo sapiens
agaattggagagtaaaaactg

SEQ ID NO: 153054 - DNA, 14 bp, Homo sapiens
agaatttattcaat

SEQ ID NO: 153055 - DNA, 21 bp, Homo sapiens
agaatttattcaattcctctg

SEQ ID NO: 153056 - DNA, 13 bp, Homo sapiens
agaattttaaatt

SEQ ID NO: 153057 - DNA, 21 bp, Homo sapiens
agaattttcagaccccagcgg

SEQ ID NO: 153058 - DNA, 15 bp, Homo sapiens
agaattttgagcagg

SEQ ID NO: 153059 - DNA, 16 bp, Homo sapiens
agacaaaaacagcctc

SEQ ID NO: 153060 - DNA, 22 bp, Homo sapiens
agacaaaaacagcctcacagaa

SEQ ID NO: 153061 - DNA, 23 bp, Homo sapiens
agacaaatctatgccactcagaa

SEQ ID NO: 153062 - DNA, 18 bp, Homo sapiens
agacaaatgctgcgccct

SEQ ID NO: 153063 - DNA, 15 bp, Homo sapiens
agacaagacttcagt

SEQ ID NO: 153064 - DNA, 19 bp, Homo sapiens
agacacaactatttttcca

SEQ ID NO: 153065 - DNA, 14 bp, Homo sapiens
agacacctgcacct

SEQ ID NO: 153066 - DNA, 20 bp, Homo sapiens
agacacctgcacctcccccc

SEQ ID NO: 153067 - DNA, 20 bp, Homo sapiens
agacacggatctgagaatct

SEQ ID NO: 153068 - DNA, 20 bp, Homo sapiens
agacacttctaaatgaagtg

SEQ ID NO: 153069 - DNA, 22 bp, Homo sapiens
agacagagaccctctgccacca

SEQ ID NO: 153070 - DNA, 13 bp, Homo sapiens
agacagccccaga

SEQ ID NO: 153071 - DNA, 18 bp, Homo sapiens
agacagccccagagcagg

SEQ ID NO: 153072 - DNA, 15 bp, Homo sapiens
agacagctccctctg

SEQ ID NO: 153073 - DNA, 19 bp, Homo sapiens
agacagctccctctgcctg

SEQ ID NO: 153074 - DNA, 18 bp, Homo sapiens
agacaggaaagggaaggc

SEQ ID NO: 153075 - DNA, 23 bp, Homo sapiens
agacagggtttggctgtgtctaa

SEQ ID NO: 153076 - DNA, 14 bp, Homo sapiens
agacatagaattaa

SEQ ID NO: 153077 - DNA, 21 bp, Homo sapiens
agacatagaattaacacatga

SEQ ID NO: 153078 - DNA, 17 bp, Homo sapiens
agacatcaacagataaa

SEQ ID NO: 153079 - DNA, 18 bp, Homo sapiens
agacatcaacagataaat

SEQ ID NO: 153080 - DNA, 20 bp, Homo sapiens
agacatcaagcacagaagga

SEQ ID NO: 153081 - DNA, 22 bp, Homo sapiens
agacatccatgtttgtaaaact

SEQ ID NO: 153082 - DNA, 17 bp, Homo sapiens
agacatgtggtgggaca

SEQ ID NO: 153083 - DNA, 19 bp, Homo sapiens
agacattctgccaggcccc

SEQ ID NO: 153084 - DNA, 13 bp, Homo sapiens
agaccataatgtt

SEQ ID NO: 153085 - DNA, 21 bp, Homo sapiens
agacccctggcttttcactgc

SEQ ID NO: 153086 - DNA, 16 bp, Homo sapiens
agaccctaccccacca

SEQ ID NO: 153087 - DNA, 14 bp, Homo sapiens
agaccctcgtggcc

SEQ ID NO: 153088 - DNA, 18 bp, Homo sapiens
agacccttgacacctgct

SEQ ID NO: 153089 - DNA, 15 bp, Homo sapiens
agaccgtcctcaccc

SEQ ID NO: 153090 - DNA, 20 bp, Homo sapiens
agaccgtcctcacccctgtc

SEQ ID NO: 153091 - DNA, 11 bp, Homo sapiens
agacctcagcc

SEQ ID NO: 153092 - DNA, 17 bp, Homo sapiens
agacctcagcctgtgct

SEQ ID NO: 153093 - DNA, 14 bp, Homo sapiens
agacctccccagcc

SEQ ID NO: 153094 - DNA, 23 bp, Homo sapiens
agacctccccagcccctagccca

SEQ ID NO: 153095 - DNA, 13 bp, Homo sapiens
agacctgtaatca

SEQ ID NO: 153096 - DNA, 20 bp, Homo sapiens
agaccttgttcacactctca

SEQ ID NO: 153097 - DNA, 15 bp, Homo sapiens
agacgcctgaggaac

SEQ ID NO: 153098 - DNA, 16 bp, Homo sapiens
agacggcacccaccca

SEQ ID NO: 153099 - DNA, 15 bp, Homo sapiens
agactattcaaacag

SEQ ID NO: 153100 - DNA, 19 bp, Homo sapiens
agactcacctctgcctcaa

SEQ ID NO: 153101 - DNA, 16 bp, Homo sapiens
agactcagggccccag

SEQ ID NO: 153102 - DNA, 21 bp, Homo sapiens
agactcagggccccagcacta

SEQ ID NO: 153103 - DNA, 12 bp, Homo sapiens
agactcagtgtt

SEQ ID NO: 153104 - DNA, 13 bp, Homo sapiens
agactccaaagaa

SEQ ID NO: 153105 - DNA, 21 bp, Homo sapiens
agactctaccagactgtgtat

SEQ ID NO: 153106 - DNA, 21 bp, Homo sapiens
agactctaggacataaattag

SEQ ID NO: 153107 - DNA, 15 bp, Homo sapiens
agactctttgcatat

SEQ ID NO: 153108 - DNA, 14 bp, Homo sapiens
agactggcacagtt

SEQ ID NO: 153109 - DNA, 20 bp, Homo sapiens
agactggcacagttttctga

SEQ ID NO: 153110 - DNA, 21 bp, Homo sapiens
agactggcacagttttctgag

SEQ ID NO: 153111 - DNA, 18 bp, Homo sapiens
agactggggggcttgaaa

SEQ ID NO: 153112 - DNA, 15 bp, Homo sapiens
agactggtcctgtgt

SEQ ID NO: 153113 - DNA, 14 bp, Homo sapiens
agactgtctcaaga

SEQ ID NO: 153114 - DNA, 14 bp, Homo sapiens
agactgtggctgct

SEQ ID NO: 153115 - DNA, 20 bp, Homo sapiens
agactgtggctgctagcact

SEQ ID NO: 153116 - DNA, 19 bp, Homo sapiens
agacttccctgaatgtatt

SEQ ID NO: 153117 - DNA, 18 bp, Homo sapiens
agacttggcaacagaagc

SEQ ID NO: 153118 - DNA, 22 bp, Homo sapiens
agacttggtgtcctttccctcc

SEQ ID NO: 153119 - DNA, 23 bp, Homo sapiens
agacttggtgtcctttccctcca

SEQ ID NO: 153120 - DNA, 18 bp, Homo sapiens
agagaaacaataaagaga

SEQ ID NO: 153121 - DNA, 15 bp, Homo sapiens
agagaaagaaaatga

SEQ ID NO: 153122 - DNA, 16 bp, Homo sapiens
agagaaagaaaatgaa

SEQ ID NO: 153123 - DNA, 12 bp, Homo sapiens
agagaaagggga

SEQ ID NO: 153124 - DNA, 21 bp, Homo sapiens
agagaagagattgtggtttca

SEQ ID NO: 153125 - DNA, 16 bp, Homo sapiens
agagaatgtctgatct

SEQ ID NO: 153126 - DNA, 13 bp, Homo sapiens
agagacacctgca

SEQ ID NO: 153127 - DNA, 16 bp, Homo sapiens
agagacacctgcacct

SEQ ID NO: 153128 - DNA, 19 bp, Homo sapiens
agagacacctgcacctccc

SEQ ID NO: 153129 - DNA, 20 bp, Homo sapiens
agagacacctgcacctcccc

SEQ ID NO: 153130 - DNA, 13 bp, Homo sapiens
agagacaggaaaa

SEQ ID NO: 153131 - DNA, 23 bp, Homo sapiens
agagacaggaaaatcctctggct

SEQ ID NO: 153132 - DNA, 19 bp, Homo sapiens
agagaccctctgccaccag

SEQ ID NO: 153133 - DNA, 17 bp, Homo sapiens
agagacccttgtttgat

SEQ ID NO: 153134 - DNA, 17 bp, Homo sapiens
agagacttttaatcaga

SEQ ID NO: 153135 - DNA, 19 bp, Homo sapiens
agagacttttaatcagaca

SEQ ID NO: 153136 - DNA, 15 bp, Homo sapiens
agagagaaagccagg

SEQ ID NO: 153137 - DNA, 14 bp, Homo sapiens
agagagggggccac

SEQ ID NO: 153138 - DNA, 20 bp, Homo sapiens
agagatggcctgagaagaga

SEQ ID NO: 153139 - DNA, 13 bp, Homo sapiens
agagatttttcat

SEQ ID NO: 153140 - DNA, 14 bp, Homo sapiens
agagcaaaattgat

SEQ ID NO: 153141 - DNA, 20 bp, Homo sapiens
agagcaaaattgatgtgttt

SEQ ID NO: 153142 - DNA, 19 bp, Homo sapiens
agagcacctagtccagtga

SEQ ID NO: 153143 - DNA, 20 bp, Homo sapiens
cttaaccccagtaagccact

SEQ ID NO: 153144 - DNA, 23 bp, Homo sapiens
cttaagagaatattttaagtatt

SEQ ID NO: 153145 - DNA, 21 bp, Homo sapiens
cttaaggatggagccagctct

SEQ ID NO: 153146 - DNA, 17 bp, Homo sapiens
cttaatacacacagtta

SEQ ID NO: 153147 - DNA, 16 bp, Homo sapiens
cttacaattccctgct

SEQ ID NO: 153148 - DNA, 16 bp, Homo sapiens
cttacagtaggagccc

SEQ ID NO: 153149 - DNA, 16 bp, Homo sapiens
cttacataatttttta

SEQ ID NO: 153150 - DNA, 20 bp, Homo sapiens
cttacattagcagtttgctt

SEQ ID NO: 153151 - DNA, 22 bp, Homo sapiens
cttacattagcagtttgctttg

SEQ ID NO: 153152 - DNA, 22 bp, Homo sapiens
cttacatttttacaataaataa

SEQ ID NO: 153153 - DNA, 16 bp, Homo sapiens
cttaccaactttctgt

SEQ ID NO: 153154 - DNA, 19 bp, Homo sapiens
cttaccaactttctgtaaa

SEQ ID NO: 153155 - DNA, 20 bp, Homo sapiens
cttacctcctgcccaggaga

SEQ ID NO: 153156 - DNA, 18 bp, Homo sapiens
cttacgatggcacccagt

SEQ ID NO: 153157 - DNA, 20 bp, Homo sapiens
cttactttcctttccccagc

SEQ ID NO: 153158 - DNA, 22 bp, Homo sapiens
cttactttcctttccccagccc

SEQ ID NO: 153159 - DNA, 16 bp, Homo sapiens
cttagaaagcaggggc

SEQ ID NO: 153160 - DNA, 20 bp, Homo sapiens
cttagaagtggaccaggaca

SEQ ID NO: 153161 - DNA, 23 bp, Homo sapiens
cttagaagtggaccaggacagga

SEQ ID NO: 153162 - DNA, 13 bp, Homo sapiens
cttagacctcagc

SEQ ID NO: 153163 - DNA, 14 bp, Homo sapiens
cttagacctcagcc

SEQ ID NO: 153164 - DNA, 21 bp, Homo sapiens
cttagcactaccactcctgcc

SEQ ID NO: 153165 - DNA, 16 bp, Homo sapiens
cttagcagctatctct

SEQ ID NO: 153166 - DNA, 22 bp, Homo sapiens
cttagcagctatctctcagtga

SEQ ID NO: 153167 - DNA, 23 bp, Homo sapiens
cttagcagctatctctcagtgaa

SEQ ID NO: 153168 - DNA, 17 bp, Homo sapiens
cttagcagcttccagat

SEQ ID NO: 153169 - DNA, 18 bp, Homo sapiens
cttagcatgtgttgaaaa

SEQ ID NO: 153170 - DNA, 14 bp, Homo sapiens
cttagctatcagaa

SEQ ID NO: 153171 - DNA, 15 bp, Homo sapiens
cttagcttagacctc

SEQ ID NO: 153172 - DNA, 17 bp, Homo sapiens
cttagcttagacctcag

SEQ ID NO: 153173 - DNA, 22 bp, Homo sapiens
cttaggaagagaaaccagggag

SEQ ID NO: 153174 - DNA, 17 bp, Homo sapiens
cttaggttggcaaaaag

SEQ ID NO: 153175 - DNA, 14 bp, Homo sapiens
cttatagaatattt

SEQ ID NO: 153176 - DNA, 16 bp, Homo sapiens
cttatagaatatttat

SEQ ID NO: 153177 - DNA, 20 bp, Homo sapiens
cttatagaatatttattacc

SEQ ID NO: 153178 - DNA, 11 bp, Homo sapiens
cttattagaac

SEQ ID NO: 153179 - DNA, 21 bp, Homo sapiens
cttattagagtgtctttccac

SEQ ID NO: 153180 - DNA, 18 bp, Homo sapiens
cttattgtacctctctta

SEQ ID NO: 153181 - DNA, 17 bp, Homo sapiens
cttatttcatgaaaatt

SEQ ID NO: 153182 - DNA, 23 bp, Homo sapiens
cttcaactgaccagcctccatgc

SEQ ID NO: 153183 - DNA, 16 bp, Homo sapiens
cttcacacacaggcaa

SEQ ID NO: 153184 - DNA, 22 bp, Homo sapiens
cttcacacacaggcaactgagg

SEQ ID NO: 153185 - DNA, 13 bp, Homo sapiens
cttcacactgcaa

SEQ ID NO: 153186 - DNA, 19 bp, Homo sapiens
cttcacggaagagccttgc

SEQ ID NO: 153187 - DNA, 11 bp, Homo sapiens
cttcagacata

SEQ ID NO: 153188 - DNA, 17 bp, Homo sapiens
cttcagccacctctctt

SEQ ID NO: 153189 - DNA, 13 bp, Homo sapiens
cttcagcctagcc

SEQ ID NO: 153190 - DNA, 16 bp, Homo sapiens
agagcttccctgactc

SEQ ID NO: 153191 - DNA, 20 bp, Homo sapiens
agagcttccctgactcattc

SEQ ID NO: 153192 - DNA, 20 bp, Homo sapiens
agaggaactgtccagagagc

SEQ ID NO: 153193 - DNA, 15 bp, Homo sapiens
agaggaaggggccag

SEQ ID NO: 153194 - DNA, 24 bp, Homo sapiens
agaggaatcagacttcacactgca

SEQ ID NO: 153195 - DNA, 13 bp, Homo sapiens
agaggaatgaagt

SEQ ID NO: 153196 - DNA, 13 bp, Homo sapiens
agaggagagaggc

SEQ ID NO: 153197 - DNA, 16 bp, Homo sapiens
agaggagaggagagag

SEQ ID NO: 153198 - DNA, 13 bp, Homo sapiens
agaggagaggggc

SEQ ID NO: 153199 - DNA, 14 bp, Homo sapiens
agaggcagagagcg

SEQ ID NO: 153200 - DNA, 15 bp, Homo sapiens
agaggccagcctggc

SEQ ID NO: 153201 - DNA, 17 bp, Homo sapiens
agaggctgaggcctgga

SEQ ID NO: 153202 - DNA, 20 bp, Homo sapiens
agaggctggaggcagggcct

SEQ ID NO: 153203 - DNA, 21 bp, Homo sapiens
agagggacgcctgggggtgcc

SEQ ID NO: 153204 - DNA, 23 bp, Homo sapiens
agagggataaggtacctttcaca

SEQ ID NO: 153205 - DNA, 15 bp, Homo sapiens
agaggggcagaacag

SEQ ID NO: 153206 - DNA, 14 bp, Homo sapiens
agaggggggctgcc

SEQ ID NO: 153207 - DNA, 19 bp, Homo sapiens
agaggtcttttttaaaagg

SEQ ID NO: 153208 - DNA, 16 bp, Homo sapiens
agaggtggggagcaga

SEQ ID NO: 153209 - DNA, 16 bp, Homo sapiens
agaggttttgttgttt

SEQ ID NO: 153210 - DNA, 19 bp, Homo sapiens
agaggttttgttgttttat

SEQ ID NO: 153211 - DNA, 21 bp, Homo sapiens
agagtagatggtgaaatttat

SEQ ID NO: 153212 - DNA, 13 bp, Homo sapiens
agagtagccgaga

SEQ ID NO: 153213 - DNA, 19 bp, Homo sapiens
agagtagccgagagcctgc

SEQ ID NO: 153214 - DNA, 13 bp, Homo sapiens
agagtatatgcac

SEQ ID NO: 153215 - DNA, 12 bp, Homo sapiens
agagtcctattt

SEQ ID NO: 153216 - DNA, 13 bp, Homo sapiens
agagtgcccagaa

SEQ ID NO: 153217 - DNA, 12 bp, Homo sapiens
agagtggctcct

SEQ ID NO: 153218 - DNA, 15 bp, Homo sapiens
agagtggctcctccc

SEQ ID NO: 153219 - DNA, 23 bp, Homo sapiens
agagtggctcctcccggtgccca

SEQ ID NO: 153220 - DNA, 11 bp, Homo sapiens
agagtgggagc

SEQ ID NO: 153221 - DNA, 22 bp, Homo sapiens
agagtgtcttcacggcaggaca

SEQ ID NO: 153222 - DNA, 15 bp, Homo sapiens
agagttgtaaatata

SEQ ID NO: 153223 - DNA, 17 bp, Homo sapiens
agagttgtaaatatata

SEQ ID NO: 153224 - DNA, 19 bp, Homo sapiens
agagttgtaaatatataaa

SEQ ID NO: 153225 - DNA, 20 bp, Homo sapiens
agagttgtaaatatataaat

SEQ ID NO: 153226 - DNA, 14 bp, Homo sapiens
agagtttaacacaa

SEQ ID NO: 153227 - DNA, 22 bp, Homo sapiens
agagtttaacacaagtcctgtg

SEQ ID NO: 153228 - DNA, 13 bp, Homo sapiens
agataaagatgat

SEQ ID NO: 153229 - DNA, 23 bp, Homo sapiens
agataccagcgaggaggctccag

SEQ ID NO: 153230 - DNA, 17 bp, Homo sapiens
agatatattaaaaatat

SEQ ID NO: 153231 - DNA, 18 bp, Homo sapiens
agatatattaaaaatata

SEQ ID NO: 153232 - DNA, 19 bp, Homo sapiens
agatatattaaaaatataa

SEQ ID NO: 153233 - DNA, 20 bp, Homo sapiens
agatatattaaaaatataaa

SEQ ID NO: 153234 - DNA, 16 bp, Homo sapiens
agatatgatatgtaaa

SEQ ID NO: 153235 - DNA, 13 bp, Homo sapiens
agatatttttcat

SEQ ID NO: 153236 - DNA, 19 bp, Homo sapiens
agatatttttccatttttt

SEQ ID NO: 153237 - DNA, 18 bp, Homo sapiens
agatattttttcagaaat

SEQ ID NO: 153238 - DNA, 16 bp, Homo sapiens
agatcaaatggaaagg

SEQ ID NO: 153239 - DNA, 14 bp, Homo sapiens
agatcaatttgtaa

SEQ ID NO: 153240 - DNA, 18 bp, Homo sapiens
agatcacgttccttcccc

SEQ ID NO: 153241 - DNA, 20 bp, Homo sapiens
agatcagcaaaccggggcct

SEQ ID NO: 153242 - DNA, 16 bp, Homo sapiens
agatcatcctttccag

SEQ ID NO: 153243 - DNA, 12 bp, Homo sapiens
agatcatgaaga

SEQ ID NO: 153244 - DNA, 21 bp, Homo sapiens
agatcccagaaggacctcctg

SEQ ID NO: 153245 - DNA, 13 bp, Homo sapiens
agatcccagctca

SEQ ID NO: 153246 - DNA, 22 bp, Homo sapiens
agatcgtgccgttactctccaa

SEQ ID NO: 153247 - DNA, 19 bp, Homo sapiens
agatctaggtgaggattga

SEQ ID NO: 153248 - DNA, 18 bp, Homo sapiens
agatctctgctttggaaa

SEQ ID NO: 153249 - DNA, 19 bp, Homo sapiens
agatgatgatgatctttaa

SEQ ID NO: 153250 - DNA, 15 bp, Homo sapiens
agatgcaaagaggca

SEQ ID NO: 153251 - DNA, 16 bp, Homo sapiens
agatgcaaagaggcaa

SEQ ID NO: 153252 - DNA, 19 bp, Homo sapiens
agatgcagcaaaatgtgaa

SEQ ID NO: 153253 - DNA, 16 bp, Homo sapiens
agatgccgcatttgga

SEQ ID NO: 153254 - DNA, 17 bp, Homo sapiens
agatgcctccaccgctg

SEQ ID NO: 153255 - DNA, 13 bp, Homo sapiens
agatgctggagaa

SEQ ID NO: 153256 - DNA, 16 bp, Homo sapiens
agatgctggagaagag

SEQ ID NO: 153257 - DNA, 20 bp, Homo sapiens
agatgctggagaagagagga

SEQ ID NO: 153258 - DNA, 21 bp, Homo sapiens
agatgctggagaagagaggag

SEQ ID NO: 153259 - DNA, 17 bp, Homo sapiens
agatggaaccgcaggaa

SEQ ID NO: 153260 - DNA, 21 bp, Homo sapiens
agatggaaccgcaggaagctg

SEQ ID NO: 153261 - DNA, 22 bp, Homo sapiens
agatggaagttgcagtgagctg

SEQ ID NO: 153262 - DNA, 15 bp, Homo sapiens
agatggaatgctgtg

SEQ ID NO: 153263 - DNA, 18 bp, Homo sapiens
agatggaatgctgtgtta

SEQ ID NO: 153264 - DNA, 17 bp, Homo sapiens
agatggctgtgcctctg

SEQ ID NO: 153265 - DNA, 22 bp, Homo sapiens
agatggctgtgcctctgcctgt

SEQ ID NO: 153266 - DNA, 21 bp, Homo sapiens
agatgggagaatcacttgaac

SEQ ID NO: 153267 - DNA, 13 bp, Homo sapiens
agatgggtgggga

SEQ ID NO: 153268 - DNA, 19 bp, Homo sapiens
agatggtcacgcacctggg

SEQ ID NO: 153269 - DNA, 18 bp, Homo sapiens
agatgtgcaaatgcaagc

SEQ ID NO: 153270 - DNA, 17 bp, Homo sapiens
agatgttctaagtcttt

SEQ ID NO: 153271 - DNA, 20 bp, Homo sapiens
agatgttctaagtctttcca

SEQ ID NO: 153272 - DNA, 22 bp, Homo sapiens
agatgtttcttttgtatgtaaa

SEQ ID NO: 153273 - DNA, 17 bp, Homo sapiens
agatgtttgtcagatat

SEQ ID NO: 153274 - DNA, 19 bp, Homo sapiens
agatgtttgtcagatatga

SEQ ID NO: 153275 - DNA, 24 bp, Homo sapiens
agatgtttgtcagatatgatatgt

SEQ ID NO: 153276 - DNA, 21 bp, Homo sapiens
agattagaatgaaaattgtat

SEQ ID NO: 153277 - DNA, 15 bp, Homo sapiens
agattagatctttta

SEQ ID NO: 153278 - DNA, 15 bp, Homo sapiens
agattcatccattta

SEQ ID NO: 153279 - DNA, 12 bp, Homo sapiens
agattcattttt

SEQ ID NO: 153280 - DNA, 17 bp, Homo sapiens
agattcatttttctttc

SEQ ID NO: 153281 - DNA, 12 bp, Homo sapiens
agattcccagag

SEQ ID NO: 153282 - DNA, 22 bp, Homo sapiens
agattccccattgcctcctcct

SEQ ID NO: 153283 - DNA, 23 bp, Homo sapiens
agattccccattgcctcctcctt

SEQ ID NO: 153284 - DNA, 23 bp, Homo sapiens
gaaaatctaatattaaaaatatg

SEQ ID NO: 153285 - DNA, 23 bp, Homo sapiens
gaaaatgagtttttatggggctg

SEQ ID NO: 153286 - DNA, 22 bp, Homo sapiens
gaaaattaggatttcatgattt

SEQ ID NO: 153287 - DNA, 15 bp, Homo sapiens
gaaaattatttgcat

SEQ ID NO: 153288 - DNA, 16 bp, Homo sapiens
gaaacacactgaggca

SEQ ID NO: 153289 - DNA, 19 bp, Homo sapiens
gaaacacactgaggcaggg

SEQ ID NO: 153290 - DNA, 23 bp, Homo sapiens
gaaacacactgaggcagggaagt

SEQ ID NO: 153291 - DNA, 15 bp, Homo sapiens
gaaacataaataaaa

SEQ ID NO: 153292 - DNA, 17 bp, Homo sapiens
gaaacataaataaaatg

SEQ ID NO: 153293 - DNA, 16 bp, Homo sapiens
gaaacccgacagaggg

SEQ ID NO: 153294 - DNA, 14 bp, Homo sapiens
gaaaccctgtctct

SEQ ID NO: 153295 - DNA, 17 bp, Homo sapiens
gaaactcaccatgtaaa

SEQ ID NO: 153296 - DNA, 21 bp, Homo sapiens
gaaactcacccccaaggggca

SEQ ID NO: 153297 - DNA, 15 bp, Homo sapiens
gaaactgcagggaaa

SEQ ID NO: 153298 - DNA, 15 bp, Homo sapiens
gaaactgttgccaga

SEQ ID NO: 153299 - DNA, 17 bp, Homo sapiens
gaaactgttgccagaga

SEQ ID NO: 153300 - DNA, 18 bp, Homo sapiens
gaaagaaaatcaggctgg

SEQ ID NO: 153301 - DNA, 21 bp, Homo sapiens
gaaagaaacccgacagaggga

SEQ ID NO: 153302 - DNA, 18 bp, Homo sapiens
gaaagaagtggggacaga

SEQ ID NO: 153303 - DNA, 17 bp, Homo sapiens
gaaagactattcaaaca

SEQ ID NO: 153304 - DNA, 19 bp, Homo sapiens
gaaagactattcaaacagt

SEQ ID NO: 153305 - DNA, 16 bp, Homo sapiens
gaaagagcacttaaga

SEQ ID NO: 153306 - DNA, 22 bp, Homo sapiens
gaaagagcacttaagagaatat

SEQ ID NO: 153307 - DNA, 22 bp, Homo sapiens
gaaagaggctgaggcctggact

SEQ ID NO: 153308 - DNA, 13 bp, Homo sapiens
gaaagcagaacag

SEQ ID NO: 153309 - DNA, 14 bp, Homo sapiens
gaaagcagggactt

SEQ ID NO: 153310 - DNA, 22 bp, Homo sapiens
gaaagccctgagctttctgcta

SEQ ID NO: 153311 - DNA, 21 bp, Homo sapiens
gaaagcttgccctggtgcctc

SEQ ID NO: 153312 - DNA, 21 bp, Homo sapiens
gaaagtgatatcccccagcct

SEQ ID NO: 153313 - DNA, 17 bp, Homo sapiens
gaaagttacaaattgct

SEQ ID NO: 153314 - DNA, 15 bp, Homo sapiens
gaaataaaacctttc

SEQ ID NO: 153315 - DNA, 17 bp, Homo sapiens
gaaataaaacctttcaa

SEQ ID NO: 153316 - DNA, 14 bp, Homo sapiens
gaaataatatgcat

SEQ ID NO: 153317 - DNA, 21 bp, Homo sapiens
gaaatacatatttccaagaag

SEQ ID NO: 153318 - DNA, 20 bp, Homo sapiens
gaaatagaaaaaccctgccc

SEQ ID NO: 153319 - DNA, 21 bp, Homo sapiens
gaaatagaaaaaccctgcccc

SEQ ID NO: 153320 - DNA, 21 bp, Homo sapiens
gaaatatcagttactcagccc

SEQ ID NO: 153321 - DNA, 12 bp, Homo sapiens
gaaatatcattt

SEQ ID NO: 153322 - DNA, 14 bp, Homo sapiens
gaaatatgatttta

SEQ ID NO: 153323 - DNA, 22 bp, Homo sapiens
gaaatatgattttatttgacaa

SEQ ID NO: 153324 - DNA, 13 bp, Homo sapiens
gaaatatgcatct

SEQ ID NO: 153325 - DNA, 17 bp, Homo sapiens
gaaatcaaatatgcaaa

SEQ ID NO: 153326 - DNA, 18 bp, Homo sapiens
gaaatcaaatatgcaaag

SEQ ID NO: 153327 - DNA, 23 bp, Homo sapiens
gaaatcaaatatgcaaagcactg

SEQ ID NO: 153328 - DNA, 21 bp, Homo sapiens
gaaatccctgtttaatattta

SEQ ID NO: 153329 - DNA, 18 bp, Homo sapiens
gaaatgaaagcagggact

SEQ ID NO: 153330 - DNA, 16 bp, Homo sapiens
gaaattagctgtgtga

SEQ ID NO: 153331 - DNA, 18 bp, Homo sapiens
gaaattatgtatgtttac

SEQ ID NO: 153332 - DNA, 19 bp, Homo sapiens
gaaattgcatttcctgaca

SEQ ID NO: 153333 - DNA, 21 bp, Homo sapiens
gaaatttattagttaatatat

SEQ ID NO: 153334 - DNA, 14 bp, Homo sapiens
gaaatttgatttct

SEQ ID NO: 153335 - DNA, 21 bp, Homo sapiens
gaaattttctagactttctgt

SEQ ID NO: 153336 - DNA, 19 bp, Homo sapiens
gaacaaaaaaatctgcaga

SEQ ID NO: 153337 - DNA, 23 bp, Homo sapiens
gaacaaatttacagagacagaaa

SEQ ID NO: 153338 - DNA, 16 bp, Homo sapiens
gaacaccctatatttt

SEQ ID NO: 153339 - DNA, 14 bp, Homo sapiens
gaacaccctcgaag

SEQ ID NO: 153340 - DNA, 17 bp, Homo sapiens
gaacactgggggagggg

SEQ ID NO: 153341 - DNA, 13 bp, Homo sapiens
gaacagaaatacc

SEQ ID NO: 153342 - DNA, 17 bp, Homo sapiens
gaacagacaggagaaat

SEQ ID NO: 153343 - DNA, 18 bp, Homo sapiens
gaacagacaggagaaatg

SEQ ID NO: 153344 - DNA, 21 bp, Homo sapiens
gaacagatgtttcttttgtat

SEQ ID NO: 153345 - DNA, 14 bp, Homo sapiens
gaacatccctgcca

SEQ ID NO: 153346 - DNA, 17 bp, Homo sapiens
gaaccatgaagacagga

SEQ ID NO: 153347 - DNA, 23 bp, Homo sapiens
gaaccatgtcagcaaaaagcaaa

SEQ ID NO: 153348 - DNA, 16 bp, Homo sapiens
gaacccaagtccaagc

SEQ ID NO: 153349 - DNA, 14 bp, Homo sapiens
gaacccacctgctg

SEQ ID NO: 153350 - DNA, 16 bp, Homo sapiens
gaacccaggaggtgga

SEQ ID NO: 153351 - DNA, 17 bp, Homo sapiens
gaaccccttcatcctct

SEQ ID NO: 153352 - DNA, 17 bp, Homo sapiens
gaacccgggaggcagag

SEQ ID NO: 153353 - DNA, 21 bp, Homo sapiens
gaacccttggcttgcccacgt

SEQ ID NO: 153354 - DNA, 18 bp, Homo sapiens
gaacctcacgcacctccc

SEQ ID NO: 153355 - DNA, 19 bp, Homo sapiens
ctggaggcagggccttgcc

SEQ ID NO: 153356 - DNA, 21 bp, Homo sapiens
ctggaggggacgctggtagag

SEQ ID NO: 153357 - DNA, 17 bp, Homo sapiens
ctggaggtgggagcagg

SEQ ID NO: 153358 - DNA, 20 bp, Homo sapiens
ctggaggtgggagcaggaga

SEQ ID NO: 153359 - DNA, 16 bp, Homo sapiens
ctggagtccagtctct

SEQ ID NO: 153360 - DNA, 20 bp, Homo sapiens
ctggatctgggaccctttcc

SEQ ID NO: 153361 - DNA, 21 bp, Homo sapiens
ctggatctgggaccctttcct

SEQ ID NO: 153362 - DNA, 23 bp, Homo sapiens
ctggatgaagattctcctgtgct

SEQ ID NO: 153363 - DNA, 20 bp, Homo sapiens
ctggatgatggtcttcagcc

SEQ ID NO: 153364 - DNA, 15 bp, Homo sapiens
ctggatggagcccag

SEQ ID NO: 153365 - DNA, 17 bp, Homo sapiens
ctggatggagcccaggc

SEQ ID NO: 153366 - DNA, 23 bp, Homo sapiens
ctggatggagcccaggcgggagc

SEQ ID NO: 153367 - DNA, 18 bp, Homo sapiens
ctggcaaagacagaagcc

SEQ ID NO: 153368 - DNA, 21 bp, Homo sapiens
ctggcaatgaaaaattctcag

SEQ ID NO: 153369 - DNA, 15 bp, Homo sapiens
ctggcacagggcagt

SEQ ID NO: 153370 - DNA, 20 bp, Homo sapiens
ctggcacagttttctgagaa

SEQ ID NO: 153371 - DNA, 17 bp, Homo sapiens
ctggcacatttccccag

SEQ ID NO: 153372 - DNA, 23 bp, Homo sapiens
ctggcacatttccccagacctga

SEQ ID NO: 153373 - DNA, 17 bp, Homo sapiens
ctggcagccgtgccttc

SEQ ID NO: 153374 - DNA, 19 bp, Homo sapiens
ctggcagccgtgccttcag

SEQ ID NO: 153375 - DNA, 21 bp, Homo sapiens
ctggcagccgtgccttcagct

SEQ ID NO: 153376 - DNA, 17 bp, Homo sapiens
ctggcagggtgggatgg

SEQ ID NO: 153377 - DNA, 13 bp, Homo sapiens
ctggccagaggct

SEQ ID NO: 153378 - DNA, 15 bp, Homo sapiens
ctggcccactgcatc

SEQ ID NO: 153379 - DNA, 17 bp, Homo sapiens
ctggcccagccaaaccc

SEQ ID NO: 153380 - DNA, 16 bp, Homo sapiens
ctggccccatgtctct

SEQ ID NO: 153381 - DNA, 15 bp, Homo sapiens
ctggcccccagctgt

SEQ ID NO: 153382 - DNA, 17 bp, Homo sapiens
ctggccctcacccctgc

SEQ ID NO: 153383 - DNA, 21 bp, Homo sapiens
ctggccctcacccctgccctg

SEQ ID NO: 153384 - DNA, 14 bp, Homo sapiens
ctggccctgccttc

SEQ ID NO: 153385 - DNA, 22 bp, Homo sapiens
ctggccggagcaaactctgctg

SEQ ID NO: 153386 - DNA, 19 bp, Homo sapiens
ctggcctgctgggctctcc

SEQ ID NO: 153387 - DNA, 19 bp, Homo sapiens
ctggccttgaaaccacctt

SEQ ID NO: 153388 - DNA, 16 bp, Homo sapiens
ctggcggctactcagc

SEQ ID NO: 153389 - DNA, 17 bp, Homo sapiens
ctggctaactggaagca

SEQ ID NO: 153390 - DNA, 19 bp, Homo sapiens
ctggctcatattcctgcag

SEQ ID NO: 153391 - DNA, 20 bp, Homo sapiens
ctggctcatattcctgcagc

SEQ ID NO: 153392 - DNA, 23 bp, Homo sapiens
ctggctcatattcctgcagcctg

SEQ ID NO: 153393 - DNA, 18 bp, Homo sapiens
ctggctcccacaggccct

SEQ ID NO: 153394 - DNA, 22 bp, Homo sapiens
ctggctcccacaggcccttcct

SEQ ID NO: 153395 - DNA, 17 bp, Homo sapiens
ctggctcttgtgctgga

SEQ ID NO: 153396 - DNA, 14 bp, Homo sapiens
ctggctgccttaga

SEQ ID NO: 153397 - DNA, 19 bp, Homo sapiens
ctggctgccttagaacctt

SEQ ID NO: 153398 - DNA, 21 bp, Homo sapiens
ctggctgggtggcaccagcag

SEQ ID NO: 153399 - DNA, 22 bp, Homo sapiens
ctggctgggtggcaccagcagc

SEQ ID NO: 153400 - DNA, 14 bp, Homo sapiens
ctgggaaaataccc

SEQ ID NO: 153401 - DNA, 22 bp, Homo sapiens
ctgggaacccaagtccaagcat

SEQ ID NO: 153402 - DNA, 13 bp, Homo sapiens
ctgggaagggaag

SEQ ID NO: 153403 - DNA, 19 bp, Homo sapiens
ctgggaccctttccttcct

SEQ ID NO: 153404 - DNA, 13 bp, Homo sapiens
ctgggaggaaaag

SEQ ID NO: 153405 - DNA, 22 bp, Homo sapiens
ctgggaggaaaagaaaagaggg

SEQ ID NO: 153406 - DNA, 17 bp, Homo sapiens
ctgggaggaatggacag

SEQ ID NO: 153407 - DNA, 13 bp, Homo sapiens
ctgggaggcatgg

SEQ ID NO: 153408 - DNA, 19 bp, Homo sapiens
ctgggagggcagcagggct

SEQ ID NO: 153409 - DNA, 20 bp, Homo sapiens
ctgggagggcccacttcagg

SEQ ID NO: 153410 - DNA, 23 bp, Homo sapiens
ctgggagttgatcgcctttccca

SEQ ID NO: 153411 - DNA, 21 bp, Homo sapiens
ctgggatgagccgctgtgagc

SEQ ID NO: 153412 - DNA, 21 bp, Homo sapiens
ctgggatgtccacagatgcct

SEQ ID NO: 153413 - DNA, 18 bp, Homo sapiens
ctgggattctactttaag

SEQ ID NO: 153414 - DNA, 22 bp, Homo sapiens
ctgggattctactttaagcact

SEQ ID NO: 153415 - DNA, 12 bp, Homo sapiens
ctgggcagctgt

SEQ ID NO: 153416 - DNA, 18 bp, Homo sapiens
ctgggccccaccacctag

SEQ ID NO: 153417 - DNA, 13 bp, Homo sapiens
ctgggctgagaga

SEQ ID NO: 153418 - DNA, 12 bp, Homo sapiens
ctgggctgaggg

SEQ ID NO: 153419 - DNA, 13 bp, Homo sapiens
ctgggctgaggga

SEQ ID NO: 153420 - DNA, 19 bp, Homo sapiens
ctgggctgagggagcctgg

SEQ ID NO: 153421 - DNA, 15 bp, Homo sapiens
ctggggatgtgggag

SEQ ID NO: 153422 - DNA, 17 bp, Homo sapiens
ctggggatgtgggaggg

SEQ ID NO: 153423 - DNA, 15 bp, Homo sapiens
ctgggggaagaagct

SEQ ID NO: 153424 - DNA, 21 bp, Homo sapiens
gacagagacacctgcacctcc

SEQ ID NO: 153425 - DNA, 20 bp, Homo sapiens
gacagagctggttgggaaga

SEQ ID NO: 153426 - DNA, 12 bp, Homo sapiens
gacagaggaggg

SEQ ID NO: 153427 - DNA, 20 bp, Homo sapiens
gacagagggaaacacagcag

SEQ ID NO: 153428 - DNA, 23 bp, Homo sapiens
gacagatctctgctttggaaatc

SEQ ID NO: 153429 - DNA, 20 bp, Homo sapiens
gacagatgaatgccgtggat

SEQ ID NO: 153430 - DNA, 18 bp, Homo sapiens
gacagccccagagcaggg

SEQ ID NO: 153431 - DNA, 22 bp, Homo sapiens
gacagcctgtggcggtgcctgg

SEQ ID NO: 153432 - DNA, 16 bp, Homo sapiens
gacagctccctctgcc

SEQ ID NO: 153433 - DNA, 12 bp, Homo sapiens
gacagctctgca

SEQ ID NO: 153434 - DNA, 18 bp, Homo sapiens
gacagctgtccctgtcac

SEQ ID NO: 153435 - DNA, 19 bp, Homo sapiens
gacagctgtccctgtcacc

SEQ ID NO: 153436 - DNA, 12 bp, Homo sapiens
gacaggaaaggg

SEQ ID NO: 153437 - DNA, 13 bp, Homo sapiens
gacaggacctgac

SEQ ID NO: 153438 - DNA, 15 bp, Homo sapiens
gacaggacctgacta

SEQ ID NO: 153439 - DNA, 16 bp, Homo sapiens
gacaggatgggggctg

SEQ ID NO: 153440 - DNA, 19 bp, Homo sapiens
gacaggctcttagcagctt

SEQ ID NO: 153441 - DNA, 19 bp, Homo sapiens
gacagggacccacttcaca

SEQ ID NO: 153442 - DNA, 15 bp, Homo sapiens
gacagggcatggcca

SEQ ID NO: 153443 - DNA, 19 bp, Homo sapiens
gacagtcaaggagtggctt

SEQ ID NO: 153444 - DNA, 22 bp, Homo sapiens
gacagtcaaggagtggcttact

SEQ ID NO: 153445 - DNA, 20 bp, Homo sapiens
gacagtggattgcatttctt

SEQ ID NO: 153446 - DNA, 15 bp, Homo sapiens
gacagttcatatgta

SEQ ID NO: 153447 - DNA, 19 bp, Homo sapiens
gacatcaagcacagaagga

SEQ ID NO: 153448 - DNA, 15 bp, Homo sapiens
gacatctcaggggcc

SEQ ID NO: 153449 - DNA, 20 bp, Homo sapiens
gacatctcaggggccagagg

SEQ ID NO: 153450 - DNA, 22 bp, Homo sapiens
gacatctcaggggccagaggaa

SEQ ID NO: 153451 - DNA, 14 bp, Homo sapiens
gacatgcgggctgg

SEQ ID NO: 153452 - DNA, 20 bp, Homo sapiens
gacatgtgacatttatatat

SEQ ID NO: 153453 - DNA, 22 bp, Homo sapiens
gacatgtggtgggacagggacc

SEQ ID NO: 153454 - DNA, 18 bp, Homo sapiens
gacatgttatatattttt

SEQ ID NO: 153455 - DNA, 14 bp, Homo sapiens
gacatgtttttgtt

SEQ ID NO: 153456 - DNA, 19 bp, Homo sapiens
gacatttctcttactgcaa

SEQ ID NO: 153457 - DNA, 15 bp, Homo sapiens
gacatttgccttgct

SEQ ID NO: 153458 - DNA, 21 bp, Homo sapiens
gaccaacatggagaaaccctg

SEQ ID NO: 153459 - DNA, 20 bp, Homo sapiens
gaccaagcaggaagctcaga

SEQ ID NO: 153460 - DNA, 13 bp, Homo sapiens
gaccaattcaacc

SEQ ID NO: 153461 - DNA, 14 bp, Homo sapiens
gaccacgctttcta

SEQ ID NO: 153462 - DNA, 20 bp, Homo sapiens
gaccacggacgtttccatca

SEQ ID NO: 153463 - DNA, 22 bp, Homo sapiens
gaccacggacgtttccatcagg

SEQ ID NO: 153464 - DNA, 18 bp, Homo sapiens
gaccactgcagaagacag

SEQ ID NO: 153465 - DNA, 15 bp, Homo sapiens
gaccagtaattgtga

SEQ ID NO: 153466 - DNA, 15 bp, Homo sapiens
gaccataatgttaca

SEQ ID NO: 153467 - DNA, 16 bp, Homo sapiens
gacccaaaaggcagaa

SEQ ID NO: 153468 - DNA, 19 bp, Homo sapiens
gacccaaaaggcagaagca

SEQ ID NO: 153469 - DNA, 20 bp, Homo sapiens
gacccaaaaggcagaagcaa

SEQ ID NO: 153470 - DNA, 22 bp, Homo sapiens
gacccagccccttgagaaacct

SEQ ID NO: 153471 - DNA, 17 bp, Homo sapiens
gacccagccctcatccc

SEQ ID NO: 153472 - DNA, 23 bp, Homo sapiens
gacccagtgagattacagaggaa

SEQ ID NO: 153473 - DNA, 22 bp, Homo sapiens
gaccccagctgtgagccttggc

SEQ ID NO: 153474 - DNA, 18 bp, Homo sapiens
gacccccactctcattcc

SEQ ID NO: 153475 - DNA, 17 bp, Homo sapiens
gacccctcctcactggc

SEQ ID NO: 153476 - DNA, 19 bp, Homo sapiens
gacccctcctcactggcca

SEQ ID NO: 153477 - DNA, 14 bp, Homo sapiens
gaccctaccccacc

SEQ ID NO: 153478 - DNA, 16 bp, Homo sapiens
gaccctctgccaccag

SEQ ID NO: 153479 - DNA, 17 bp, Homo sapiens
gacccttgacacctgct

SEQ ID NO: 153480 - DNA, 21 bp, Homo sapiens
gacccttgacacctgctgaga

SEQ ID NO: 153481 - DNA, 10 bp, Homo sapiens
gacctcagcc

SEQ ID NO: 153482 - DNA, 13 bp, Homo sapiens
gacctcagccttc

SEQ ID NO: 153483 - DNA, 14 bp, Homo sapiens
gacctcagccttcc

SEQ ID NO: 153484 - DNA, 17 bp, Homo sapiens
gacctcaggcactagcc

SEQ ID NO: 153485 - DNA, 19 bp, Homo sapiens
gacctcaggcactagcctt

SEQ ID NO: 153486 - DNA, 21 bp, Homo sapiens
gacctcaggcactagcctttg

SEQ ID NO: 153487 - DNA, 21 bp, Homo sapiens
gacctcagttttatcattttc

SEQ ID NO: 153488 - DNA, 19 bp, Homo sapiens
gacctcgtcctccccctgc

SEQ ID NO: 153489 - DNA, 22 bp, Homo sapiens
gacctcgtcctccccctgccag

SEQ ID NO: 153490 - DNA, 15 bp, Homo sapiens
gacctgactattgaa

SEQ ID NO: 153491 - DNA, 18 bp, Homo sapiens
gacctgagctccccacca

SEQ ID NO: 153492 - DNA, 13 bp, Homo sapiens
gacctgaggaagc

SEQ ID NO: 153493 - DNA, 19 bp, Homo sapiens
gacctgctgagggaccagc

SEQ ID NO: 153494 - DNA, 15 bp, Homo sapiens
gacctggataactta

SEQ ID NO: 153495 - DNA, 21 bp, Homo sapiens
gacgacaagtgctgaacagtg

SEQ ID NO: 153496 - DNA, 14 bp, Homo sapiens
gacgcctgaggaac

SEQ ID NO: 153497 - DNA, 21 bp, Homo sapiens
gacgcctgggggtgccaggac

SEQ ID NO: 153498 - DNA, 21 bp, Homo sapiens
gacgctggtagagatggagga

SEQ ID NO: 153499 - DNA, 18 bp, Homo sapiens
gactaaaaatattataac

SEQ ID NO: 153500 - DNA, 21 bp, Homo sapiens
gactagcccctgtggagactg

SEQ ID NO: 153501 - DNA, 18 bp, Homo sapiens
gactagtgaggaaagatt

SEQ ID NO: 153502 - DNA, 18 bp, Homo sapiens
gactatcaaactgaagcc

SEQ ID NO: 153503 - DNA, 16 bp, Homo sapiens
gactattcaaacagtc

SEQ ID NO: 153504 - DNA, 22 bp, Homo sapiens
gactattcaaacagtctcagga

SEQ ID NO: 153505 - DNA, 19 bp, Homo sapiens
gactcaaatctccagtatt

SEQ ID NO: 153506 - DNA, 16 bp, Homo sapiens
gactcaagtgtctcag

SEQ ID NO: 153507 - DNA, 12 bp, Homo sapiens
gactcacccaag

SEQ ID NO: 153508 - DNA, 12 bp, Homo sapiens
gactcacctctg

SEQ ID NO: 153509 - DNA, 13 bp, Homo sapiens
gactcacctctgc

SEQ ID NO: 153510 - DNA, 15 bp, Homo sapiens
gactcacctctgcct

SEQ ID NO: 153511 - DNA, 17 bp, Homo sapiens
gactcacctctgcctca

SEQ ID NO: 153512 - DNA, 18 bp, Homo sapiens
gactcacctctgcctcaa

SEQ ID NO: 153513 - DNA, 13 bp, Homo sapiens
gactcagaagcct

SEQ ID NO: 153514 - DNA, 15 bp, Homo sapiens
gactcagaagcctct

SEQ ID NO: 153515 - DNA, 19 bp, Homo sapiens
gactcaggatgcccagggc

SEQ ID NO: 153516 - DNA, 23 bp, Homo sapiens
gactcaggatgcccagggccact

SEQ ID NO: 153517 - DNA, 12 bp, Homo sapiens
gactcagggctc

SEQ ID NO: 153518 - DNA, 17 bp, Homo sapiens
gactcagggctcctggg

SEQ ID NO: 153519 - DNA, 15 bp, Homo sapiens
gactcaggttgtctg

SEQ ID NO: 153520 - DNA, 21 bp, Homo sapiens
gactcattttaaaaaatggaa

SEQ ID NO: 153521 - DNA, 20 bp, Homo sapiens
gactctaccagactgtgtat

SEQ ID NO: 153522 - DNA, 16 bp, Homo sapiens
gactctgcctcctctt

SEQ ID NO: 153523 - DNA, 20 bp, Homo sapiens
gactctttttagggccaggc

SEQ ID NO: 153524 - DNA, 16 bp, Homo sapiens
gactgaggggagggga

SEQ ID NO: 153525 - DNA, 21 bp, Homo sapiens
gactgatgttgagggaacaga

SEQ ID NO: 153526 - DNA, 15 bp, Homo sapiens
gactgcacagcggcc

SEQ ID NO: 153527 - DNA, 18 bp, Homo sapiens
gactgcacagcggcccct

SEQ ID NO: 153528 - DNA, 18 bp, Homo sapiens
gactgccccaactcctgg

SEQ ID NO: 153529 - DNA, 15 bp, Homo sapiens
gactgccccgtgcag

SEQ ID NO: 153530 - DNA, 20 bp, Homo sapiens
gactgccccgtgcagactgg

SEQ ID NO: 153531 - DNA, 15 bp, Homo sapiens
gactgggagggccca

SEQ ID NO: 153532 - DNA, 15 bp, Homo sapiens
gactggtcctgtgtg

SEQ ID NO: 153533 - DNA, 14 bp, Homo sapiens
gactggtgagcaga

SEQ ID NO: 153534 - DNA, 23 bp, Homo sapiens
gactgtactcctcccaggcgccc

SEQ ID NO: 153535 - DNA, 22 bp, Homo sapiens
gactgtctcaagagggcactgg

SEQ ID NO: 153536 - DNA, 12 bp, Homo sapiens
gactgtggctgc

SEQ ID NO: 153537 - DNA, 14 bp, Homo sapiens
gactgtggctgcta

SEQ ID NO: 153538 - DNA, 22 bp, Homo sapiens
gacttcacactgcaagagcctt

SEQ ID NO: 153539 - DNA, 14 bp, Homo sapiens
gacttcagctctgt

SEQ ID NO: 153540 - DNA, 17 bp, Homo sapiens
gacttcagtatgttgtc

SEQ ID NO: 153541 - DNA, 15 bp, Homo sapiens
gacttcatttttcct

SEQ ID NO: 153542 - DNA, 17 bp, Homo sapiens
gacttctaagtaaaacc

SEQ ID NO: 153543 - DNA, 18 bp, Homo sapiens
gacttctaagtaaaacca

SEQ ID NO: 153544 - DNA, 23 bp, Homo sapiens
gacttctaagtaaaaccacagca

SEQ ID NO: 153545 - DNA, 20 bp, Homo sapiens
gacttctgtcttcacaacag

SEQ ID NO: 153546 - DNA, 11 bp, Homo sapiens
gacttgaagtt

SEQ ID NO: 153547 - DNA, 15 bp, Homo sapiens
gacttgaagttgtta

SEQ ID NO: 153548 - DNA, 19 bp, Homo sapiens
gacttgactttagtctgca

SEQ ID NO: 153549 - DNA, 19 bp, Homo sapiens
gacttggcaacagaagcag

SEQ ID NO: 153550 - DNA, 23 bp, Homo sapiens
gacttggtgtcctttccctccac

SEQ ID NO: 153551 - DNA, 18 bp, Homo sapiens
gacttgtgtcccatgatc

SEQ ID NO: 153552 - DNA, 14 bp, Homo sapiens
gactttcaggtact

SEQ ID NO: 153553 - DNA, 21 bp, Homo sapiens
gacttttctgtccgagctttg

SEQ ID NO: 153554 - DNA, 19 bp, Homo sapiens
gagaaaaagctcctgtcct

SEQ ID NO: 153555 - DNA, 23 bp, Homo sapiens
gagaaaccttattgtacctctct

SEQ ID NO: 153556 - DNA, 13 bp, Homo sapiens
gagaaagactatt

SEQ ID NO: 153557 - DNA, 15 bp, Homo sapiens
gagaaagactattca

SEQ ID NO: 153558 - DNA, 11 bp, Homo sapiens
gagaaattatt

SEQ ID NO: 153559 - DNA, 20 bp, Homo sapiens
gagaagaattttcagacccc

SEQ ID NO: 153560 - DNA, 19 bp, Homo sapiens
gcagattggagaaaccctt

SEQ ID NO: 153561 - DNA, 20 bp, Homo sapiens
gcagatttagtgaaagctag

SEQ ID NO: 153562 - DNA, 17 bp, Homo sapiens
gcagcagggctaccctg

SEQ ID NO: 153563 - DNA, 19 bp, Homo sapiens
gcagcagggctaccctgag

SEQ ID NO: 153564 - DNA, 20 bp, Homo sapiens
gcagcagggctaccctgagc

SEQ ID NO: 153565 - DNA, 12 bp, Homo sapiens
gcccttcctctc

SEQ ID NO: 153566 - DNA, 17 bp, Homo sapiens
gcccttcctctccactg

SEQ ID NO: 153567 - DNA, 19 bp, Homo sapiens
gcccttcctctccactgcc

SEQ ID NO: 153568 - DNA, 21 bp, Homo sapiens
gcccttcctctccactgcctt

SEQ ID NO: 153569 - DNA, 22 bp, Homo sapiens
gcccttcctctccactgccttc

SEQ ID NO: 153570 - DNA, 13 bp, Homo sapiens
gccctttctgtgt

SEQ ID NO: 153571 - DNA, 11 bp, Homo sapiens
gccgacctcag

SEQ ID NO: 153572 - DNA, 14 bp, Homo sapiens
gccgacctcagcct

SEQ ID NO: 153573 - DNA, 15 bp, Homo sapiens
gccgacctcagcctt

SEQ ID NO: 153574 - DNA, 22 bp, Homo sapiens
gccgactgcacagcggcccctg

SEQ ID NO: 153575 - DNA, 12 bp, Homo sapiens
gccgagagcctg

SEQ ID NO: 153576 - DNA, 17 bp, Homo sapiens
gccgattcacctgagca

SEQ ID NO: 153577 - DNA, 17 bp, Homo sapiens
gccgcaagtctgcagcc

SEQ ID NO: 153578 - DNA, 21 bp, Homo sapiens
gaggacatgtttttgttttct

SEQ ID NO: 153579 - DNA, 23 bp, Homo sapiens
gaggactgccccgtgcagactgg

SEQ ID NO: 153580 - DNA, 22 bp, Homo sapiens
gaggagactagatttatgaata

SEQ ID NO: 153581 - DNA, 12 bp, Homo sapiens
gaggagagaggc

SEQ ID NO: 153582 - DNA, 13 bp, Homo sapiens
gaggagaggagag

SEQ ID NO: 153583 - DNA, 19 bp, Homo sapiens
gaggaggaaggagagaagg

SEQ ID NO: 153584 - DNA, 17 bp, Homo sapiens
gaggaggtttaggtcaa

SEQ ID NO: 153585 - DNA, 13 bp, Homo sapiens
gaggatctcttga

SEQ ID NO: 153586 - DNA, 21 bp, Homo sapiens
gaggatgcagagtcagcagaa

SEQ ID NO: 153587 - DNA, 20 bp, Homo sapiens
gaggatggcctctgctaagc

SEQ ID NO: 153588 - DNA, 20 bp, Homo sapiens
gaggattgcttgagctcagg

SEQ ID NO: 153589 - DNA, 13 bp, Homo sapiens
gaggcaagagaat

SEQ ID NO: 153590 - DNA, 19 bp, Homo sapiens
gaggcagacagcagctcag

SEQ ID NO: 153591 - DNA, 21 bp, Homo sapiens
gaggcagacagcagctcaggc

SEQ ID NO: 153592 - DNA, 19 bp, Homo sapiens
gaggcagaggttgcagtga

SEQ ID NO: 153593 - DNA, 20 bp, Homo sapiens
gaggcagcagtgtgaggcca

SEQ ID NO: 153594 - DNA, 22 bp, Homo sapiens
gaggcagcagtgtgaggccagg

SEQ ID NO: 153595 - DNA, 17 bp, Homo sapiens
gaggcagggccttgccc

SEQ ID NO: 153596 - DNA, 20 bp, Homo sapiens
gaggcagggccttgcccaga

SEQ ID NO: 153597 - DNA, 22 bp, Homo sapiens
gaggcagggccttgcccagaga

SEQ ID NO: 153598 - DNA, 15 bp, Homo sapiens
gaggcaggggcggag

SEQ ID NO: 153599 - DNA, 14 bp, Homo sapiens
gaggccagcctggc

SEQ ID NO: 153600 - DNA, 13 bp, Homo sapiens
gaggccagggcag

SEQ ID NO: 153601 - DNA, 17 bp, Homo sapiens
gaggccctcgctgccag

SEQ ID NO: 153602 - DNA, 13 bp, Homo sapiens
gaggcctggactt

SEQ ID NO: 153603 - DNA, 19 bp, Homo sapiens
gaggcgggtggatcacttg

SEQ ID NO: 153604 - DNA, 14 bp, Homo sapiens
gaggctgaggcaga

SEQ ID NO: 153605 - DNA, 18 bp, Homo sapiens
gaggctgaggcagaagaa

SEQ ID NO: 153606 - DNA, 18 bp, Homo sapiens
gaggctgaggcctggact

SEQ ID NO: 153607 - DNA, 15 bp, Homo sapiens
gaggctggaggcagg

SEQ ID NO: 153608 - DNA, 19 bp, Homo sapiens
gaggctggaggcagggcct

SEQ ID NO: 153609 - DNA, 12 bp, Homo sapiens
gaggctgtcctg

SEQ ID NO: 153610 - DNA, 14 bp, Homo sapiens
gaggctgtcctgta

SEQ ID NO: 153611 - DNA, 21 bp, Homo sapiens
gagggaatccccgaaggtgct

SEQ ID NO: 153612 - DNA, 16 bp, Homo sapiens
gagggaccagccaaga

SEQ ID NO: 153613 - DNA, 14 bp, Homo sapiens
gagggacgcctggg

SEQ ID NO: 153614 - DNA, 16 bp, Homo sapiens
gagggacgcctggggg

SEQ ID NO: 153615 - DNA, 23 bp, Homo sapiens
gagggacgcctgggggtgccagg

SEQ ID NO: 153616 - DNA, 12 bp, Homo sapiens
gagggcactggt

SEQ ID NO: 153617 - DNA, 15 bp, Homo sapiens
gagggcagaggctgg

SEQ ID NO: 153618 - DNA, 16 bp, Homo sapiens
gagggcagaggctgga

SEQ ID NO: 153619 - DNA, 18 bp, Homo sapiens
gagggccaagacttggca

SEQ ID NO: 153620 - DNA, 16 bp, Homo sapiens
gagggccacatgggag

SEQ ID NO: 153621 - DNA, 16 bp, Homo sapiens
gagggcccagagcagg

SEQ ID NO: 153622 - DNA, 13 bp, Homo sapiens
gaggggcctggca

SEQ ID NO: 153623 - DNA, 14 bp, Homo sapiens
gaggggcctggcag

SEQ ID NO: 153624 - DNA, 16 bp, Homo sapiens
gaggggctctcagctc

SEQ ID NO: 153625 - DNA, 20 bp, Homo sapiens
gagggggccacctccccagg

SEQ ID NO: 153626 - DNA, 22 bp, Homo sapiens
gagggggccacctccccaggcc

SEQ ID NO: 153627 - DNA, 13 bp, Homo sapiens
gagggtcaggaag

SEQ ID NO: 153628 - DNA, 19 bp, Homo sapiens
gagggtccccacctgggac

SEQ ID NO: 153629 - DNA, 24 bp, Homo sapiens
gagggtctggagaagcagtgagcc

SEQ ID NO: 153630 - DNA, 15 bp, Homo sapiens
gagggttagggaggg

SEQ ID NO: 153631 - DNA, 19 bp, Homo sapiens
gaggtcaagcccaggagga

SEQ ID NO: 153632 - DNA, 24 bp, Homo sapiens
gaggtcaagcccaggaggactgcc

SEQ ID NO: 153633 - DNA, 22 bp, Homo sapiens
gaggtcgaccccaaagcccctt

SEQ ID NO: 153634 - DNA, 16 bp, Homo sapiens
gaggtgctgggaggga

SEQ ID NO: 153635 - DNA, 20 bp, Homo sapiens
gaggtggaagccctccttcc

SEQ ID NO: 153636 - DNA, 20 bp, Homo sapiens
gaggtggaggttgcagtgag

SEQ ID NO: 153637 - DNA, 21 bp, Homo sapiens
gaggtggccagagctgggagg

SEQ ID NO: 153638 - DNA, 22 bp, Homo sapiens
gaggtggccagagctgggaggc

SEQ ID NO: 153639 - DNA, 13 bp, Homo sapiens
gaggtgggagcag

SEQ ID NO: 153640 - DNA, 23 bp, Homo sapiens
gaggtgggagcaggagattgaga

SEQ ID NO: 153641 - DNA, 15 bp, Homo sapiens
gaggttaaggctgag

SEQ ID NO: 153642 - DNA, 19 bp, Homo sapiens
gaggtttaggtcaagaaga

SEQ ID NO: 153643 - DNA, 18 bp, Homo sapiens
gagtagccgagagcctgc

SEQ ID NO: 153644 - DNA, 20 bp, Homo sapiens
gagtagttgatgttgcattt

SEQ ID NO: 153645 - DNA, 21 bp, Homo sapiens
gagtcactgcctctccctggc

SEQ ID NO: 153646 - DNA, 23 bp, Homo sapiens
gagtcactgcctctccctggccc

SEQ ID NO: 153647 - DNA, 18 bp, Homo sapiens
gagtcatgatctccctgc

SEQ ID NO: 153648 - DNA, 22 bp, Homo sapiens
gagtccaacgtggggcagcaca

SEQ ID NO: 153649 - DNA, 14 bp, Homo sapiens
gagtcccgtcagga

SEQ ID NO: 153650 - DNA, 15 bp, Homo sapiens
gagtctatcaatcaa

SEQ ID NO: 153651 - DNA, 15 bp, Homo sapiens
gagtctcttctccac

SEQ ID NO: 153652 - DNA, 16 bp, Homo sapiens
gagtctcttctccact

SEQ ID NO: 153653 - DNA, 18 bp, Homo sapiens
gagtctcttctccactgg

SEQ ID NO: 153654 - DNA, 23 bp, Homo sapiens
gagtctgaagcagatgcaaagag

SEQ ID NO: 153655 - DNA, 22 bp, Homo sapiens
gagtgagacccagccctcatcc

SEQ ID NO: 153656 - DNA, 17 bp, Homo sapiens
gagtgcagtcctgatca

SEQ ID NO: 153657 - DNA, 19 bp, Homo sapiens
gagtggaggttaaggctga

SEQ ID NO: 153658 - DNA, 13 bp, Homo sapiens
gagtggctcctcc

SEQ ID NO: 153659 - DNA, 13 bp, Homo sapiens
gagtgggtgaata

SEQ ID NO: 153660 - DNA, 13 bp, Homo sapiens
gagtgtctttcca

SEQ ID NO: 153661 - DNA, 21 bp, Homo sapiens
gagtgtgtccaagtgtgtgtg

SEQ ID NO: 153662 - DNA, 17 bp, Homo sapiens
gagtgtgtttgtcaccg

SEQ ID NO: 153663 - DNA, 22 bp, Homo sapiens
gagttaaatagagtatatgcac

SEQ ID NO: 153664 - DNA, 21 bp, Homo sapiens
gagttccttgatctgtatata

SEQ ID NO: 153665 - DNA, 15 bp, Homo sapiens
gagttgattcagctc

SEQ ID NO: 153666 - DNA, 15 bp, Homo sapiens
gagtttcctcaggct

SEQ ID NO: 153667 - DNA, 16 bp, Homo sapiens
gagtttcctcaggctg

SEQ ID NO: 153668 - DNA, 21 bp, Homo sapiens
gagtttcctcaggctgctgga

SEQ ID NO: 153669 - DNA, 23 bp, Homo sapiens
gagtttcctcaggctgctggagg

SEQ ID NO: 153670 - DNA, 18 bp, Homo sapiens
gagtttttatggggctga

SEQ ID NO: 153671 - DNA, 13 bp, Homo sapiens
gataaattataag

SEQ ID NO: 153672 - DNA, 21 bp, Homo sapiens
gataacttaggtggcaagctg

SEQ ID NO: 153673 - DNA, 23 bp, Homo sapiens
gataaggtacctttcacatagag

SEQ ID NO: 153674 - DNA, 14 bp, Homo sapiens
gataatcagcctct

SEQ ID NO: 153675 - DNA, 19 bp, Homo sapiens
gataatgctgttgcctcat

SEQ ID NO: 153676 - DNA, 21 bp, Homo sapiens
gataatgtgatattatacata

SEQ ID NO: 153677 - DNA, 18 bp, Homo sapiens
gataattctagctttgag

SEQ ID NO: 153678 - DNA, 22 bp, Homo sapiens
gatacactgaagttaacagaga

SEQ ID NO: 153679 - DNA, 18 bp, Homo sapiens
gatactgcagggccagga

SEQ ID NO: 153680 - DNA, 21 bp, Homo sapiens
gatactgcagggccaggactg

SEQ ID NO: 153681 - DNA, 22 bp, Homo sapiens
gatagcatttttgatttatgca

SEQ ID NO: 153682 - DNA, 20 bp, Homo sapiens
gatagccttccgtaacccaa

SEQ ID NO: 153683 - DNA, 20 bp, Homo sapiens
gatagctttattttttaagt

SEQ ID NO: 153684 - DNA, 17 bp, Homo sapiens
gatatataagtgtacat

SEQ ID NO: 153685 - DNA, 13 bp, Homo sapiens
gatatattaaaaa

SEQ ID NO: 153686 - DNA, 17 bp, Homo sapiens
gatatccctatgctgcc

SEQ ID NO: 153687 - DNA, 23 bp, Homo sapiens
gatatccctatgctgcctaggct

SEQ ID NO: 153688 - DNA, 21 bp, Homo sapiens
gatatgagttgttttcagact

SEQ ID NO: 153689 - DNA, 22 bp, Homo sapiens
gatattgtcagagttctgctct

SEQ ID NO: 153690 - DNA, 23 bp, Homo sapiens
gatcaaattcatttttttcactg

SEQ ID NO: 153691 - DNA, 13 bp, Homo sapiens
gatcacaaaaaca

SEQ ID NO: 153692 - DNA, 14 bp, Homo sapiens
gatcacagcctctg

SEQ ID NO: 153693 - DNA, 15 bp, Homo sapiens
gatcagaacagcaga

SEQ ID NO: 153694 - DNA, 16 bp, Homo sapiens
gatcagagccgtggtc

SEQ ID NO: 153695 - DNA, 14 bp, Homo sapiens
gatcaggtggggag

SEQ ID NO: 153696 - DNA, 18 bp, Homo sapiens
gatccacctgtctcagcc

SEQ ID NO: 153697 - DNA, 16 bp, Homo sapiens
gatccatgtagcagga

SEQ ID NO: 153698 - DNA, 12 bp, Homo sapiens
gatccctcatct

SEQ ID NO: 153699 - DNA, 23 bp, Homo sapiens
gatctaaggatgtcacagggcca

SEQ ID NO: 153700 - DNA, 15 bp, Homo sapiens
gatctaggtgaggat

SEQ ID NO: 153701 - DNA, 20 bp, Homo sapiens
gatctccctgccgcctcaat

SEQ ID NO: 153702 - DNA, 18 bp, Homo sapiens
gatctcttgagcctggga

SEQ ID NO: 153703 - DNA, 19 bp, Homo sapiens
gatctgaacagaaatacca

SEQ ID NO: 153704 - DNA, 17 bp, Homo sapiens
gatctgggaccctttcc

SEQ ID NO: 153705 - DNA, 22 bp, Homo sapiens
gatctgggaccctttccttcct

SEQ ID NO: 153706 - DNA, 20 bp, Homo sapiens
gcacctaccatcagggacag

SEQ ID NO: 153707 - DNA, 18 bp, Homo sapiens
gcacctccacatcctcca

SEQ ID NO: 153708 - DNA, 21 bp, Homo sapiens
gcacctccccccactgcaggc

SEQ ID NO: 153709 - DNA, 23 bp, Homo sapiens
gcacctccccccactgcaggccc

SEQ ID NO: 153710 - DNA, 19 bp, Homo sapiens
gcacctgccgacctcgtcc

SEQ ID NO: 153711 - DNA, 21 bp, Homo sapiens
gcacctgccgacctcgtcctc

SEQ ID NO: 153712 - DNA, 19 bp, Homo sapiens
gcaccttaccaactttctg

SEQ ID NO: 153713 - DNA, 15 bp, Homo sapiens
gcacgaacccacctg

SEQ ID NO: 153714 - DNA, 19 bp, Homo sapiens
gcacgaacccacctgctga

SEQ ID NO: 153715 - DNA, 15 bp, Homo sapiens
gcacgcccatgtgtg

SEQ ID NO: 153716 - DNA, 17 bp, Homo sapiens
gcacgtggcctcttgag

SEQ ID NO: 153717 - DNA, 19 bp, Homo sapiens
gcacgtggcctcttgagca

SEQ ID NO: 153718 - DNA, 23 bp, Homo sapiens
gcacgtgggtcttcagggggcca

SEQ ID NO: 153719 - DNA, 20 bp, Homo sapiens
gcactaaagtatgtaaagta

SEQ ID NO: 153720 - DNA, 20 bp, Homo sapiens
gcactaccactcctgccaag

SEQ ID NO: 153721 - DNA, 15 bp, Homo sapiens
gcactagcctttggc

SEQ ID NO: 153722 - DNA, 21 bp, Homo sapiens
gcactagcctttggctctgga

SEQ ID NO: 153723 - DNA, 23 bp, Homo sapiens
gcactcccttggtggcaagagcc

SEQ ID NO: 153724 - DNA, 17 bp, Homo sapiens
gcactgaggaccagcca

SEQ ID NO: 153725 - DNA, 18 bp, Homo sapiens
gcactgctgcccagcctc

SEQ ID NO: 153726 - DNA, 20 bp, Homo sapiens
gcactgctgcccagcctcca

SEQ ID NO: 153727 - DNA, 14 bp, Homo sapiens
gcactggagtccag

SEQ ID NO: 153728 - DNA, 23 bp, Homo sapiens
gcactgggatgagccgctgtgag

SEQ ID NO: 153729 - DNA, 18 bp, Homo sapiens
gcactgggttgactttca

SEQ ID NO: 153730 - DNA, 22 bp, Homo sapiens
gcacttggagccaagggttcag

SEQ ID NO: 153731 - DNA, 16 bp, Homo sapiens
gcagaaaagcacctgc

SEQ ID NO: 153732 - DNA, 23 bp, Homo sapiens
gcagaaagcaaatgtgacctgtg

SEQ ID NO: 153733 - DNA, 22 bp, Homo sapiens
gcagaacagtgattaccaggga

SEQ ID NO: 153734 - DNA, 13 bp, Homo sapiens
gcagaaggaaaaa

SEQ ID NO: 153735 - DNA, 21 bp, Homo sapiens
gcagacacagggacttgaagt

SEQ ID NO: 153736 - DNA, 22 bp, Homo sapiens
gcagacacagggacttgaagtt

SEQ ID NO: 153737 - DNA, 13 bp, Homo sapiens
gcagacagcagct

SEQ ID NO: 153738 - DNA, 19 bp, Homo sapiens
gcagacatgtgcacttgaa

SEQ ID NO: 153739 - DNA, 13 bp, Homo sapiens
gcagacctcccca

SEQ ID NO: 153740 - DNA, 23 bp, Homo sapiens
gcagacctccccagcccctagcc

SEQ ID NO: 153741 - DNA, 21 bp, Homo sapiens
gctgcctctacctgacactcc

SEQ ID NO: 153742 - DNA, 18 bp, Homo sapiens
gctgcctgcccacacagg

SEQ ID NO: 153743 - DNA, 22 bp, Homo sapiens
gctgcctggcccccagctgtgg

SEQ ID NO: 153744 - DNA, 20 bp, Homo sapiens
gctgcctttagtcgctgagg

SEQ ID NO: 153745 - DNA, 15 bp, Homo sapiens
gctgcggcacccttg

SEQ ID NO: 153746 - DNA, 20 bp, Homo sapiens
gctgctagcacttggagcca

SEQ ID NO: 153747 - DNA, 20 bp, Homo sapiens
gctgctcccctccctcctct

SEQ ID NO: 153748 - DNA, 16 bp, Homo sapiens
gctgctgactgatgtt

SEQ ID NO: 153749 - DNA, 23 bp, Homo sapiens
gctgctgcctttagtcgctgagg

SEQ ID NO: 153750 - DNA, 21 bp, Homo sapiens
gctgcttcttaaccccagtaa

SEQ ID NO: 153751 - DNA, 19 bp, Homo sapiens
gctggacggggactgggga

SEQ ID NO: 153752 - DNA, 21 bp, Homo sapiens
gctggacggggactggggatg

SEQ ID NO: 153753 - DNA, 13 bp, Homo sapiens
gctggagaagaga

SEQ ID NO: 153754 - DNA, 12 bp, Homo sapiens
gctggaggcagg

SEQ ID NO: 153755 - DNA, 21 bp, Homo sapiens
gctggaggcagggccttgccc

SEQ ID NO: 153756 - DNA, 16 bp, Homo sapiens
gctggaggtgggagca

SEQ ID NO: 153757 - DNA, 22 bp, Homo sapiens
gctggaggtgggagcaggagat

SEQ ID NO: 153758 - DNA, 20 bp, Homo sapiens
gctggatgagaatttgagtg

SEQ ID NO: 153759 - DNA, 21 bp, Homo sapiens
gctggatgctccttccaacag

SEQ ID NO: 153760 - DNA, 22 bp, Homo sapiens
gctggatgctccttccaacagg

SEQ ID NO: 153761 - DNA, 14 bp, Homo sapiens
gctggatggagccc

SEQ ID NO: 153762 - DNA, 16 bp, Homo sapiens
gctggatggagcccag

SEQ ID NO: 153763 - DNA, 13 bp, Homo sapiens
gctggcagcagag

SEQ ID NO: 153764 - DNA, 15 bp, Homo sapiens
gctggcagcagagtg

SEQ ID NO: 153765 - DNA, 14 bp, Homo sapiens
gctggcccagccaa

SEQ ID NO: 153766 - DNA, 19 bp, Homo sapiens
gctggccctggctcccaca

SEQ ID NO: 153767 - DNA, 22 bp, Homo sapiens
gctggccggagcaaactctgct

SEQ ID NO: 153768 - DNA, 23 bp, Homo sapiens
gctggcctctggctctcatgggg

SEQ ID NO: 153769 - DNA, 16 bp, Homo sapiens
gctggcggctactcag

SEQ ID NO: 153770 - DNA, 14 bp, Homo sapiens
gctggctgccttag

SEQ ID NO: 153771 - DNA, 14 bp, Homo sapiens
gctgggaggcatgg

SEQ ID NO: 153772 - DNA, 15 bp, Homo sapiens
gctgggaggcatggc

SEQ ID NO: 153773 - DNA, 14 bp, Homo sapiens
gctgggcaggttgg

SEQ ID NO: 153774 - DNA, 15 bp, Homo sapiens
gctggtaaactattt

SEQ ID NO: 153775 - DNA, 17 bp, Homo sapiens
gctggtagagatggagg

SEQ ID NO: 153776 - DNA, 15 bp, Homo sapiens
gctggtcactgccat

SEQ ID NO: 153777 - DNA, 21 bp, Homo sapiens
gctggtgggaagcgtctgtcc

SEQ ID NO: 153778 - DNA, 14 bp, Homo sapiens
gctggtgggagggg

SEQ ID NO: 153779 - DNA, 14 bp, Homo sapiens
gctgtaaataaatg

SEQ ID NO: 153780 - DNA, 17 bp, Homo sapiens
gctgtccttacccatct

SEQ ID NO: 153781 - DNA, 22 bp, Homo sapiens
gctgtcttctcaggctctgccc

SEQ ID NO: 153782 - DNA, 20 bp, Homo sapiens
gctgtgagcccctggtcctg

SEQ ID NO: 153783 - DNA, 18 bp, Homo sapiens
gctgtgaggcccctggac

SEQ ID NO: 153784 - DNA, 13 bp, Homo sapiens
gctgtgaggctgt

SEQ ID NO: 153785 - DNA, 16 bp, Homo sapiens
gctgtgaggctgtcct

SEQ ID NO: 153786 - DNA, 17 bp, Homo sapiens
gctgtgaggctgtcctg

SEQ ID NO: 153787 - DNA, 12 bp, Homo sapiens
gctgtgcctctg

SEQ ID NO: 153788 - DNA, 13 bp, Homo sapiens
gctgtgggcaggt

SEQ ID NO: 153789 - DNA, 17 bp, Homo sapiens
gctgtgggcaggtggga

SEQ ID NO: 153790 - DNA, 18 bp, Homo sapiens
gctgtgggtacagagagg

SEQ ID NO: 153791 - DNA, 23 bp, Homo sapiens
gctgtggtgtgtccccctctgtc

SEQ ID NO: 153792 - DNA, 14 bp, Homo sapiens
gctgtgtccttgca

SEQ ID NO: 153793 - DNA, 19 bp, Homo sapiens
gctgtgtccttgcacctgc

SEQ ID NO: 153794 - DNA, 20 bp, Homo sapiens
gctgtgtccttgcacctgca

SEQ ID NO: 153795 - DNA, 18 bp, Homo sapiens
gctgtgttaaataaacct

SEQ ID NO: 153796 - DNA, 15 bp, Homo sapiens
gctgttcacagccag

SEQ ID NO: 153797 - DNA, 23 bp, Homo sapiens
gctgttcacagccagactggcac

SEQ ID NO: 153798 - DNA, 22 bp, Homo sapiens
gctgttcacccacagggctaag

SEQ ID NO: 153799 - DNA, 13 bp, Homo sapiens
gctgttcagctgg

SEQ ID NO: 153800 - DNA, 16 bp, Homo sapiens
gctgttgagctgtttt

SEQ ID NO: 153801 - DNA, 18 bp, Homo sapiens
gctgttgagctgttttcc

SEQ ID NO: 153802 - DNA, 13 bp, Homo sapiens
gctgttgcctcat

SEQ ID NO: 153803 - DNA, 17 bp, Homo sapiens
gctgttttccctgacct

SEQ ID NO: 153804 - DNA, 14 bp, Homo sapiens
gcttaatgtttatt

SEQ ID NO: 153805 - DNA, 17 bp, Homo sapiens
gcttaatgtttattcct

SEQ ID NO: 153806 - DNA, 14 bp, Homo sapiens
gcttacaattccct

SEQ ID NO: 153807 - DNA, 14 bp, Homo sapiens
gcttagacctcagc

SEQ ID NO: 153808 - DNA, 15 bp, Homo sapiens
gcttagacctcagcc

SEQ ID NO: 153809 - DNA, 23 bp, Homo sapiens
gcttagacctcagcctgtgctgc

SEQ ID NO: 153810 - DNA, 19 bp, Homo sapiens
gcttatctcaggggtgtgc

SEQ ID NO: 153811 - DNA, 22 bp, Homo sapiens
gcttccagattgacgacaagtg

SEQ ID NO: 153812 - DNA, 23 bp, Homo sapiens
gcttccagattgacgacaagtgc

SEQ ID NO: 153813 - DNA, 12 bp, Homo sapiens
gcttccattcca

SEQ ID NO: 153814 - DNA, 17 bp, Homo sapiens
gcttcccgctcagccct

SEQ ID NO: 153815 - DNA, 23 bp, Homo sapiens
gcttcccgctcagccctccctgc

SEQ ID NO: 153816 - DNA, 21 bp, Homo sapiens
gcttcgaggcccagcgacctc

SEQ ID NO: 153817 - DNA, 22 bp, Homo sapiens
gcttctcactgccatgccagct

SEQ ID NO: 153818 - DNA, 22 bp, Homo sapiens
gcttctctgtgaacgatttaga

SEQ ID NO: 153819 - DNA, 16 bp, Homo sapiens
gcttcttcagatcagt

SEQ ID NO: 153820 - DNA, 19 bp, Homo sapiens
gcttcttcagatcagtgct

SEQ ID NO: 153821 - DNA, 15 bp, Homo sapiens
gcttcttccaggtgc

SEQ ID NO: 153822 - DNA, 16 bp, Homo sapiens
gcttcttccaggtgcc

SEQ ID NO: 153823 - DNA, 18 bp, Homo sapiens
gcttcttctcctatgtgt

SEQ ID NO: 153824 - DNA, 19 bp, Homo sapiens
gcttcttctcctatgtgta

SEQ ID NO: 153825 - DNA, 20 bp, Homo sapiens
gcttgaaagaaaatatgcat

SEQ ID NO: 153826 - DNA, 13 bp, Homo sapiens
gcttgaacccagg

SEQ ID NO: 153827 - DNA, 17 bp, Homo sapiens
gcttgccctggtgcctc

SEQ ID NO: 153828 - DNA, 14 bp, Homo sapiens
gcttgctcattttt

SEQ ID NO: 153829 - DNA, 23 bp, Homo sapiens
gcttgctcttcagtgggagaaaa

SEQ ID NO: 153830 - DNA, 23 bp, Homo sapiens
gcttggaagagcctgcaggtgct

SEQ ID NO: 153831 - DNA, 23 bp, Homo sapiens
gcttgggcttccatttgtgtgtg

SEQ ID NO: 153832 - DNA, 16 bp, Homo sapiens
gcttggggcttcctaa

SEQ ID NO: 153833 - DNA, 15 bp, Homo sapiens
gcttgtaactccacc

SEQ ID NO: 153834 - DNA, 22 bp, Homo sapiens
gcttgtaactccaccaacccat

SEQ ID NO: 153835 - DNA, 16 bp, Homo sapiens
gcttgtccagcgccta

SEQ ID NO: 153836 - DNA, 19 bp, Homo sapiens
gcttgtcccctcctcactc

SEQ ID NO: 153837 - DNA, 15 bp, Homo sapiens
gcttgttatttataa

SEQ ID NO: 153838 - DNA, 21 bp, Homo sapiens
gctttaaactcagggacagag

SEQ ID NO: 153839 - DNA, 17 bp, Homo sapiens
gctttattttttaagta

SEQ ID NO: 153840 - DNA, 21 bp, Homo sapiens
gctttattttttaagtattta

SEQ ID NO: 153841 - DNA, 23 bp, Homo sapiens
gctttattttttaagtatttata

SEQ ID NO: 153842 - DNA, 15 bp, Homo sapiens
gctttcatgtaaact

SEQ ID NO: 153843 - DNA, 20 bp, Homo sapiens
gctttcatgtaaactgtgca

SEQ ID NO: 153844 - DNA, 18 bp, Homo sapiens
gctttccacacctggcac

SEQ ID NO: 153845 - DNA, 11 bp, Homo sapiens
gctttcctgcc

SEQ ID NO: 153846 - DNA, 17 bp, Homo sapiens
ggcgtgactcacccaag

SEQ ID NO: 153847 - DNA, 15 bp, Homo sapiens
ggcgtgaggatggga

SEQ ID NO: 153848 - DNA, 17 bp, Homo sapiens
ggctactcagcagccct

SEQ ID NO: 153849 - DNA, 18 bp, Homo sapiens
ggctactcagcagccctc

SEQ ID NO: 153850 - DNA, 19 bp, Homo sapiens
ggctactctcctcggcccc

SEQ ID NO: 153851 - DNA, 18 bp, Homo sapiens
ggctactgcagctttaca

SEQ ID NO: 153852 - DNA, 15 bp, Homo sapiens
ggctagtcagagaga

SEQ ID NO: 153853 - DNA, 12 bp, Homo sapiens
ggctcagcctgg

SEQ ID NO: 153854 - DNA, 13 bp, Homo sapiens
ggctcagcctggt

SEQ ID NO: 153855 - DNA, 20 bp, Homo sapiens
ggctcagcctggtgggcctc

SEQ ID NO: 153856 - DNA, 17 bp, Homo sapiens
ggctcatattcctgcag

SEQ ID NO: 153857 - DNA, 20 bp, Homo sapiens
ggctcccacaggcccttcct

SEQ ID NO: 153858 - DNA, 21 bp, Homo sapiens
ggctcccacaggcccttcctc

SEQ ID NO: 153859 - DNA, 24 bp, Homo sapiens
ggctccgtcagtatcaggcctgcc

SEQ ID NO: 153860 - DNA, 14 bp, Homo sapiens
ggctctcagctcag

SEQ ID NO: 153861 - DNA, 19 bp, Homo sapiens
ggctctcagctcagcgcca

SEQ ID NO: 153862 - DNA, 12 bp, Homo sapiens
ggctctccacct

SEQ ID NO: 153863 - DNA, 14 bp, Homo sapiens
ggctctccacctca

SEQ ID NO: 153864 - DNA, 15 bp, Homo sapiens
ggctctccacctcag

SEQ ID NO: 153865 - DNA, 19 bp, Homo sapiens
ggctctgctggccggagca

SEQ ID NO: 153866 - DNA, 16 bp, Homo sapiens
ggctctggagacagcc

SEQ ID NO: 153867 - DNA, 21 bp, Homo sapiens
ggctctggagacagccccaga

SEQ ID NO: 153868 - DNA, 23 bp, Homo sapiens
ggctctgggatagctgacccagc

SEQ ID NO: 153869 - DNA, 19 bp, Homo sapiens
ggctcttagcagcttccag

SEQ ID NO: 153870 - DNA, 21 bp, Homo sapiens
ggctcttagcagcttccagat

SEQ ID NO: 153871 - DNA, 13 bp, Homo sapiens
ggctcttctcctt

SEQ ID NO: 153872 - DNA, 15 bp, Homo sapiens
ggctgaacggggaga

SEQ ID NO: 153873 - DNA, 20 bp, Homo sapiens
ggctgaacggggagaaaagg

SEQ ID NO: 153874 - DNA, 22 bp, Homo sapiens
ggctgaggaaaggccagctggc

SEQ ID NO: 153875 - DNA, 21 bp, Homo sapiens
ggctgaggaagcacagcagca

SEQ ID NO: 153876 - DNA, 13 bp, Homo sapiens
ggctgaggcagaa

SEQ ID NO: 153877 - DNA, 16 bp, Homo sapiens
ggctgagggagcctgg

SEQ ID NO: 153878 - DNA, 15 bp, Homo sapiens
ggctgaggtgggagg

SEQ ID NO: 153879 - DNA, 14 bp, Homo sapiens
ggctgccctggtgc

SEQ ID NO: 153880 - DNA, 22 bp, Homo sapiens
ggctgccctggtgctgccacac

SEQ ID NO: 153881 - DNA, 16 bp, Homo sapiens
ggctgccttagaacct

SEQ ID NO: 153882 - DNA, 12 bp, Homo sapiens
ggctgctcctcc

SEQ ID NO: 153883 - DNA, 13 bp, Homo sapiens
ggctgctcctcca

SEQ ID NO: 153884 - DNA, 16 bp, Homo sapiens
ggctgctgacctccac

SEQ ID NO: 153885 - DNA, 21 bp, Homo sapiens
ggctgctgacctccacagctt

SEQ ID NO: 153886 - DNA, 16 bp, Homo sapiens
ggctgctggaggaaaa

SEQ ID NO: 153887 - DNA, 15 bp, Homo sapiens
ggctggaggcagggc

SEQ ID NO: 153888 - DNA, 19 bp, Homo sapiens
ggctggaggcagggccttg

SEQ ID NO: 153889 - DNA, 15 bp, Homo sapiens
ggctggatgaaattt

SEQ ID NO: 153890 - DNA, 19 bp, Homo sapiens
ggctggcctctggctctca

SEQ ID NO: 153891 - DNA, 17 bp, Homo sapiens
ggctggctaactggaag

SEQ ID NO: 153892 - DNA, 15 bp, Homo sapiens
ggctgggagctctgc

SEQ ID NO: 153893 - DNA, 14 bp, Homo sapiens
ggctgggcagctgt

SEQ ID NO: 153894 - DNA, 16 bp, Homo sapiens
ggctgggggaagaagc

SEQ ID NO: 153895 - DNA, 17 bp, Homo sapiens
ggctggtgggaggggcg

SEQ ID NO: 153896 - DNA, 17 bp, Homo sapiens
ggctgtcagcaggaagc

SEQ ID NO: 153897 - DNA, 13 bp, Homo sapiens
ggctgtgaggccc

SEQ ID NO: 153898 - DNA, 16 bp, Homo sapiens
ggctgtgtctaaactg

SEQ ID NO: 153899 - DNA, 22 bp, Homo sapiens
ggcttactacatgtgggagctt

SEQ ID NO: 153900 - DNA, 18 bp, Homo sapiens
ggcttcaggggagtcccg

SEQ ID NO: 153901 - DNA, 14 bp, Homo sapiens
ggcttcccgctcag

SEQ ID NO: 153902 - DNA, 20 bp, Homo sapiens
ggcttcttcagatcagtgct

SEQ ID NO: 153903 - DNA, 18 bp, Homo sapiens
ggcttgtaactccaccaa

SEQ ID NO: 153904 - DNA, 14 bp, Homo sapiens
ggcttttctcagct

SEQ ID NO: 153905 - DNA, 13 bp, Homo sapiens
gggaaaatcagcc

SEQ ID NO: 153906 - DNA, 14 bp, Homo sapiens
gggaaataagagag

SEQ ID NO: 153907 - DNA, 16 bp, Homo sapiens
gggaacagacaggaga

SEQ ID NO: 153908 - DNA, 18 bp, Homo sapiens
gggaacgtgactgcccca

SEQ ID NO: 153909 - DNA, 18 bp, Homo sapiens
gggaagaagctctctcct

SEQ ID NO: 153910 - DNA, 17 bp, Homo sapiens
gggaagacgcctgagct

SEQ ID NO: 153911 - DNA, 20 bp, Homo sapiens
gggaagcttcttaaatgaga

SEQ ID NO: 153912 - DNA, 13 bp, Homo sapiens
gggaagggagagc

SEQ ID NO: 153913 - DNA, 14 bp, Homo sapiens
gggaagtccccagg

SEQ ID NO: 153914 - DNA, 22 bp, Homo sapiens
gggaatccccgaaggtgctgga

SEQ ID NO: 153915 - DNA, 16 bp, Homo sapiens
gggacacctgccctgc

SEQ ID NO: 153916 - DNA, 17 bp, Homo sapiens
gggacacctgccctgcc

SEQ ID NO: 153917 - DNA, 14 bp, Homo sapiens
gggaccagccaaga

SEQ ID NO: 153918 - DNA, 21 bp, Homo sapiens
gggacgcctgggggtgccagg

SEQ ID NO: 153919 - DNA, 22 bp, Homo sapiens
gggacgcctgggggtgccagga

SEQ ID NO: 153920 - DNA, 23 bp, Homo sapiens
gggacgtcctgccacctggggca

SEQ ID NO: 153921 - DNA, 15 bp, Homo sapiens
gggactagcccctgt

SEQ ID NO: 153922 - DNA, 20 bp, Homo sapiens
gggactgggagccgcagcag

SEQ ID NO: 153923 - DNA, 12 bp, Homo sapiens
gggagagagaga

SEQ ID NO: 153924 - DNA, 19 bp, Homo sapiens
gggagatggatcaatcaaa

SEQ ID NO: 153925 - DNA, 13 bp, Homo sapiens
gggagcaggagat

SEQ ID NO: 153926 - DNA, 19 bp, Homo sapiens
gggaggccaaggtgggagg

SEQ ID NO: 153927 - DNA, 18 bp, Homo sapiens
gggaggccccactgggga

SEQ ID NO: 153928 - DNA, 15 bp, Homo sapiens
gggagggcccacttc

SEQ ID NO: 153929 - DNA, 18 bp, Homo sapiens
gggaggggcgcccacctc

SEQ ID NO: 153930 - DNA, 18 bp, Homo sapiens
gggaggtcaaggctgcag

SEQ ID NO: 153931 - DNA, 16 bp, Homo sapiens
gggagtatgcaaaagt

SEQ ID NO: 153932 - DNA, 17 bp, Homo sapiens
gggagtctgaagcagat

SEQ ID NO: 153933 - DNA, 13 bp, Homo sapiens
gggatactgcagg

SEQ ID NO: 153934 - DNA, 21 bp, Homo sapiens
gggatatgatttaaatcagcc

SEQ ID NO: 153935 - DNA, 15 bp, Homo sapiens
gggatgagccgctgt

SEQ ID NO: 153936 - DNA, 12 bp, Homo sapiens
gggatgggaggt

SEQ ID NO: 153937 - DNA, 14 bp, Homo sapiens
gggatgtgggaggg

SEQ ID NO: 153938 - DNA, 22 bp, Homo sapiens
gggatgttcagcactgtccctt

SEQ ID NO: 153939 - DNA, 16 bp, Homo sapiens
gggattaacctctgca

SEQ ID NO: 153940 - DNA, 13 bp, Homo sapiens
gggcactggtggc

SEQ ID NO: 153941 - DNA, 22 bp, Homo sapiens
gggcagaacagccgctcctgtc

SEQ ID NO: 153942 - DNA, 15 bp, Homo sapiens
gggcagaggctggag

SEQ ID NO: 153943 - DNA, 23 bp, Homo sapiens
gggcagaggctggaggcagggcc

SEQ ID NO: 153944 - DNA, 20 bp, Homo sapiens
gggcagagggcagaggctgg

SEQ ID NO: 153945 - DNA, 13 bp, Homo sapiens
gggcaggtgggag

SEQ ID NO: 153946 - DNA, 17 bp, Homo sapiens
gggcaggttggtggggg

SEQ ID NO: 153947 - DNA, 17 bp, Homo sapiens
gggcagtctggaggggc

SEQ ID NO: 153948 - DNA, 16 bp, Homo sapiens
gggcatgccccggcca

SEQ ID NO: 153949 - DNA, 16 bp, Homo sapiens
gggcatggccagcagc

SEQ ID NO: 153950 - DNA, 17 bp, Homo sapiens
gggcatggccaggtggc

SEQ ID NO: 153951 - DNA, 20 bp, Homo sapiens
gggcatggccaggtggccac

SEQ ID NO: 153952 - DNA, 18 bp, Homo sapiens
gggcattgatggggaagg

SEQ ID NO: 153953 - DNA, 22 bp, Homo sapiens
gggccaacttgagggcccagag

SEQ ID NO: 153954 - DNA, 15 bp, Homo sapiens
gggccacctccccag

SEQ ID NO: 153955 - DNA, 16 bp, Homo sapiens
gggccacctccccagg

SEQ ID NO: 153956 - DNA, 14 bp, Homo sapiens
gggccacgtgccag

SEQ ID NO: 153957 - DNA, 19 bp, Homo sapiens
gggccacgtgccaggcccg

SEQ ID NO: 153958 - DNA, 15 bp, Homo sapiens
gggccactctgcctc

SEQ ID NO: 153959 - DNA, 12 bp, Homo sapiens
gggccagaggct

SEQ ID NO: 153960 - DNA, 13 bp, Homo sapiens
gggccaggcaggt

SEQ ID NO: 153961 - DNA, 19 bp, Homo sapiens
gggcccctcaccctgcctt

SEQ ID NO: 153962 - DNA, 19 bp, Homo sapiens
gggccctgcacctgtgcag

SEQ ID NO: 153963 - DNA, 21 bp, Homo sapiens
gggcctcctctgtccagggcc

SEQ ID NO: 153964 - DNA, 23 bp, Homo sapiens
gggcctcttgcggtcccttctta

SEQ ID NO: 153965 - DNA, 18 bp, Homo sapiens
gggcctggtcgttttcaa

SEQ ID NO: 153966 - DNA, 14 bp, Homo sapiens
gggccttgcccaga

SEQ ID NO: 153967 - DNA, 22 bp, Homo sapiens
gggccttggcctcccctgctga

SEQ ID NO: 153968 - DNA, 18 bp, Homo sapiens
gggcgagtcactgcctct

SEQ ID NO: 153969 - DNA, 13 bp, Homo sapiens
gggcgcccacctc

SEQ ID NO: 153970 - DNA, 21 bp, Homo sapiens
gggcgcccacctccccacgcc

SEQ ID NO: 153971 - DNA, 16 bp, Homo sapiens
gggcgtgactcaccca

SEQ ID NO: 153972 - DNA, 16 bp, Homo sapiens
gggctaccctgagctg

SEQ ID NO: 153973 - DNA, 19 bp, Homo sapiens
gggctaccctgagctgagg

SEQ ID NO: 153974 - DNA, 20 bp, Homo sapiens
gggctactgcagctttacat

SEQ ID NO: 153975 - DNA, 18 bp, Homo sapiens
gggctcagcaaaagatgc

SEQ ID NO: 153976 - DNA, 12 bp, Homo sapiens
gggctccctgac

SEQ ID NO: 153977 - DNA, 18 bp, Homo sapiens
gggctccctgactgggag

SEQ ID NO: 153978 - DNA, 21 bp, Homo sapiens
gggctccctgtaacctcttca

SEQ ID NO: 153979 - DNA, 15 bp, Homo sapiens
gggctctggagagaa

SEQ ID NO: 153980 - DNA, 15 bp, Homo sapiens
gggctgccctggtgc

SEQ ID NO: 153981 - DNA, 15 bp, Homo sapiens
gggctgctcctccag

SEQ ID NO: 153982 - DNA, 18 bp, Homo sapiens
gggctgctcctccagggc

SEQ ID NO: 153983 - DNA, 19 bp, Homo sapiens
gggctggcctctggctctc

SEQ ID NO: 153984 - DNA, 19 bp, Homo sapiens
gggctggcggctactcagc

SEQ ID NO: 153985 - DNA, 13 bp, Homo sapiens
gggctgggcagct

SEQ ID NO: 153986 - DNA, 17 bp, Homo sapiens
ggggaaaatcagcctgc

SEQ ID NO: 153987 - DNA, 24 bp, Homo sapiens
ggggaaaatcagcctgctccagct

SEQ ID NO: 153988 - DNA, 13 bp, Homo sapiens
ggggaagccctgg

SEQ ID NO: 153989 - DNA, 19 bp, Homo sapiens
tgcccgtcttcagcctagc

SEQ ID NO: 153990 - DNA, 13 bp, Homo sapiens
tgccctagctcca

SEQ ID NO: 153991 - DNA, 14 bp, Homo sapiens
tgccctaggctccg

SEQ ID NO: 153992 - DNA, 20 bp, Homo sapiens
tgccctcgggcgagtcactg

SEQ ID NO: 153993 - DNA, 11 bp, Homo sapiens
tgccctgcccc

SEQ ID NO: 153994 - DNA, 16 bp, Homo sapiens
tgccctgccctagctc

SEQ ID NO: 153995 - DNA, 18 bp, Homo sapiens
tgccctggtgctgccaca

SEQ ID NO: 153996 - DNA, 21 bp, Homo sapiens
tgccctggtgctgccacactt

SEQ ID NO: 153997 - DNA, 19 bp, Homo sapiens
tgccctgttaaaagatgaa

SEQ ID NO: 153998 - DNA, 20 bp, Homo sapiens
tgccctgttaaaagatgaaa

SEQ ID NO: 153999 - DNA, 17 bp, Homo sapiens
tgcccttcacagtgttt

SEQ ID NO: 154000 - DNA, 21 bp, Homo sapiens
tgccgacctcgtcctccccct

SEQ ID NO: 154001 - DNA, 12 bp, Homo sapiens
tgccgcacccca

SEQ ID NO: 154002 - DNA, 15 bp, Homo sapiens
tgccgcaccccagag

SEQ ID NO: 154003 - DNA, 13 bp, Homo sapiens
tgccgcctcccag

SEQ ID NO: 154004 - DNA, 18 bp, Homo sapiens
tgccgcctcccagcctgg

SEQ ID NO: 154005 - DNA, 18 bp, Homo sapiens
tgccgggttttatatttt

SEQ ID NO: 154006 - DNA, 16 bp, Homo sapiens
tgccgttactctccaa

SEQ ID NO: 154007 - DNA, 22 bp, Homo sapiens
tgccgttactctccaacctgga

SEQ ID NO: 154008 - DNA, 22 bp, Homo sapiens
tgcctcaatgtgaatcagaccc

SEQ ID NO: 154009 - DNA, 23 bp, Homo sapiens
tgcctcaatgtgaatcagaccct

SEQ ID NO: 154010 - DNA, 19 bp, Homo sapiens
tgcctcagtgtatttgtat

SEQ ID NO: 154011 - DNA, 20 bp, Homo sapiens
tgcctcatctataacatgca

SEQ ID NO: 154012 - DNA, 21 bp, Homo sapiens
tgcctctgccaaaggatgtga

SEQ ID NO: 154013 - DNA, 12 bp, Homo sapiens
tgcctctgcctg

SEQ ID NO: 154014 - DNA, 20 bp, Homo sapiens
tgcctcttctgggagggcag

SEQ ID NO: 154015 - DNA, 21 bp, Homo sapiens
tgcctcttctgggagggcagc

SEQ ID NO: 154016 - DNA, 19 bp, Homo sapiens
tgcctgcggagttgtgcac

SEQ ID NO: 154017 - DNA, 16 bp, Homo sapiens
tgcctggcccccagct

SEQ ID NO: 154018 - DNA, 19 bp, Homo sapiens
tgcctgggtggggctgctc

SEQ ID NO: 154019 - DNA, 22 bp, Homo sapiens
tgcctgggtggggctgctcctc

SEQ ID NO: 154020 - DNA, 23 bp, Homo sapiens
tgcctgggtggggctgctcctcc

SEQ ID NO: 154021 - DNA, 16 bp, Homo sapiens
tgcctggtcacagggc

SEQ ID NO: 154022 - DNA, 22 bp, Homo sapiens
tgcctggtcacagggcatgccc

SEQ ID NO: 154023 - DNA, 13 bp, Homo sapiens
tgcctgtaaacat

SEQ ID NO: 154024 - DNA, 15 bp, Homo sapiens
tgcctgtagcagtga

SEQ ID NO: 154025 - DNA, 20 bp, Homo sapiens
tgcctgtagcccactctgct

SEQ ID NO: 154026 - DNA, 16 bp, Homo sapiens
tgcctgtagttaggaa

SEQ ID NO: 154027 - DNA, 20 bp, Homo sapiens
tgcctgtagttaggaaataa

SEQ ID NO: 154028 - DNA, 22 bp, Homo sapiens
tgcctgtagttaggaaataaaa

SEQ ID NO: 154029 - DNA, 23 bp, Homo sapiens
tgcctgtctcctttgcaggctca

SEQ ID NO: 154030 - DNA, 13 bp, Homo sapiens
tgccttaaagaaa

SEQ ID NO: 154031 - DNA, 15 bp, Homo sapiens
tgccttacctcctgc

SEQ ID NO: 154032 - DNA, 16 bp, Homo sapiens
tgccttacctcctgcc

SEQ ID NO: 154033 - DNA, 17 bp, Homo sapiens
tgccttacctcctgccc

SEQ ID NO: 154034 - DNA, 21 bp, Homo sapiens
tgccttattagagtgtctttc

SEQ ID NO: 154035 - DNA, 18 bp, Homo sapiens
tgccttccagcaccctgc

SEQ ID NO: 154036 - DNA, 20 bp, Homo sapiens
tgccttcctcctgggccctc

SEQ ID NO: 154037 - DNA, 23 bp, Homo sapiens
tgccttctccagacaaaccagaa

SEQ ID NO: 154038 - DNA, 23 bp, Homo sapiens
tgccttgaatatcccctcccagt

SEQ ID NO: 154039 - DNA, 19 bp, Homo sapiens
tgccttgtgtacagttatt

SEQ ID NO: 154040 - DNA, 19 bp, Homo sapiens
tgcctttgagtttcctcag

SEQ ID NO: 154041 - DNA, 13 bp, Homo sapiens
tgccttttatagc

SEQ ID NO: 154042 - DNA, 17 bp, Homo sapiens
tgccttttatagctatt

SEQ ID NO: 154043 - DNA, 13 bp, Homo sapiens
tgcgagtgtgtgc

SEQ ID NO: 154044 - DNA, 19 bp, Homo sapiens
tgcgagtgtgtgcatgtgt

SEQ ID NO: 154045 - DNA, 21 bp, Homo sapiens
tgcgagtgtgtgcatgtgtgt

SEQ ID NO: 154046 - DNA, 17 bp, Homo sapiens
tgcgccattgcactcca

SEQ ID NO: 154047 - DNA, 18 bp, Homo sapiens
tgcgccattgcactccag

SEQ ID NO: 154048 - DNA, 13 bp, Homo sapiens
tgcggaccccagc

SEQ ID NO: 154049 - DNA, 19 bp, Homo sapiens
tgctaacttggagccccag

SEQ ID NO: 154050 - DNA, 17 bp, Homo sapiens
tgctaatcttcagggca

SEQ ID NO: 154051 - DNA, 14 bp, Homo sapiens
tgctacaaaaacac

SEQ ID NO: 154052 - DNA, 16 bp, Homo sapiens
tgctacctcactgggg

SEQ ID NO: 154053 - DNA, 20 bp, Homo sapiens
tgctcagggtcaatttcttt

SEQ ID NO: 154054 - DNA, 22 bp, Homo sapiens
tgctcatcattccttgagaaaa

SEQ ID NO: 154055 - DNA, 17 bp, Homo sapiens
tgctcatcattctctgt

SEQ ID NO: 154056 - DNA, 21 bp, Homo sapiens
tgctcatcattctctgtctca

SEQ ID NO: 154057 - DNA, 16 bp, Homo sapiens
tgctccagctgttcag

SEQ ID NO: 154058 - DNA, 19 bp, Homo sapiens
tgctccagctgttcagctg

SEQ ID NO: 154059 - DNA, 20 bp, Homo sapiens
tgctccagctgttcagctgg

SEQ ID NO: 154060 - DNA, 21 bp, Homo sapiens
tgctccagctgttcagctggt

SEQ ID NO: 154061 - DNA, 20 bp, Homo sapiens
tgctccctgaagccagcctt

SEQ ID NO: 154062 - DNA, 21 bp, Homo sapiens
tgctccctgaagccagccttc

SEQ ID NO: 154063 - DNA, 22 bp, Homo sapiens
tgctccctgaagccagccttct

SEQ ID NO: 154064 - DNA, 12 bp, Homo sapiens
tgctcctccagg

SEQ ID NO: 154065 - DNA, 22 bp, Homo sapiens
tgctcctccagggccacgtgcc

SEQ ID NO: 154066 - DNA, 19 bp, Homo sapiens
tgctccttgggccctttga

SEQ ID NO: 154067 - DNA, 21 bp, Homo sapiens
tgctccttgggccctttgagt

SEQ ID NO: 154068 - DNA, 16 bp, Homo sapiens
tgctctcccctgccct

SEQ ID NO: 154069 - DNA, 17 bp, Homo sapiens
tgctctcccctgccctg

SEQ ID NO: 154070 - DNA, 20 bp, Homo sapiens
tgctctcccctgccctgctg

SEQ ID NO: 154071 - DNA, 12 bp, Homo sapiens
tgctctcctctt

SEQ ID NO: 154072 - DNA, 20 bp, Homo sapiens
tgctctctgcagccagccca

SEQ ID NO: 154073 - DNA, 21 bp, Homo sapiens
tgctctctgcagccagcccag

SEQ ID NO: 154074 - DNA, 14 bp, Homo sapiens
tgctctgatccctc

SEQ ID NO: 154075 - DNA, 19 bp, Homo sapiens
tgctctgatccctctacag

SEQ ID NO: 154076 - DNA, 13 bp, Homo sapiens
tgctcttcagtgg

SEQ ID NO: 154077 - DNA, 17 bp, Homo sapiens
tgctctttctctgccag

SEQ ID NO: 154078 - DNA, 17 bp, Homo sapiens
tgctgaaacaggagaga

SEQ ID NO: 154079 - DNA, 22 bp, Homo sapiens
tgctgaaggtggggattgccca

SEQ ID NO: 154080 - DNA, 15 bp, Homo sapiens
tgctgacctccacag

SEQ ID NO: 154081 - DNA, 14 bp, Homo sapiens
tgctgactgtactc

SEQ ID NO: 154082 - DNA, 16 bp, Homo sapiens
tgctgactgtactcct

SEQ ID NO: 154083 - DNA, 22 bp, Homo sapiens
tgctgactgtactcctcccagg

SEQ ID NO: 154084 - DNA, 21 bp, Homo sapiens
tgctgactgttttctcttgag

SEQ ID NO: 154085 - DNA, 15 bp, Homo sapiens
tgctgagagacccaa

SEQ ID NO: 154086 - DNA, 17 bp, Homo sapiens
tgctgagagacccaagg

SEQ ID NO: 154087 - DNA, 22 bp, Homo sapiens
tgctgagagacccaaggaggaa

SEQ ID NO: 154088 - DNA, 20 bp, Homo sapiens
tgctgagggaccagccaaga

SEQ ID NO: 154089 - DNA, 13 bp, Homo sapiens
tgctgcaggggct

SEQ ID NO: 154090 - DNA, 17 bp, Homo sapiens
tgctgcaggggctctgg

SEQ ID NO: 154091 - DNA, 18 bp, Homo sapiens
tgctgcaggggctctgga

SEQ ID NO: 154092 - DNA, 19 bp, Homo sapiens
tgctgcaggggctctggag

SEQ ID NO: 154093 - DNA, 22 bp, Homo sapiens
tgctgccacacttcaggctctt

SEQ ID NO: 154094 - DNA, 21 bp, Homo sapiens
tgctgccccatcagtgctccc

SEQ ID NO: 154095 - DNA, 20 bp, Homo sapiens
tgctgcccgtcttcagccta

SEQ ID NO: 154096 - DNA, 22 bp, Homo sapiens
tgctgcccgtcttcagcctagc

SEQ ID NO: 154097 - DNA, 17 bp, Homo sapiens
tgctgccgcctcccagc

SEQ ID NO: 154098 - DNA, 13 bp, Homo sapiens
tgctgcctaggct

SEQ ID NO: 154099 - DNA, 18 bp, Homo sapiens
tgctgcctaggctgacct

SEQ ID NO: 154100 - DNA, 12 bp, Homo sapiens
tgctgcttgagg

SEQ ID NO: 154101 - DNA, 17 bp, Homo sapiens
tgctgcttttccttggg

SEQ ID NO: 154102 - DNA, 20 bp, Homo sapiens
tgctggacggggactgggga

SEQ ID NO: 154103 - DNA, 22 bp, Homo sapiens
tgctggaggtgggagcaggaga

SEQ ID NO: 154104 - DNA, 14 bp, Homo sapiens
tgctggctgcctta

SEQ ID NO: 154105 - DNA, 21 bp, Homo sapiens
tgctggctgccttagaacctt

SEQ ID NO: 154106 - DNA, 16 bp, Homo sapiens
tgctgggctctccacc

SEQ ID NO: 154107 - DNA, 17 bp, Homo sapiens
tgctgggctctccacct

SEQ ID NO: 154108 - DNA, 20 bp, Homo sapiens
tgctgggggggattgtaaaa

SEQ ID NO: 154109 - DNA, 18 bp, Homo sapiens
tgctgtgaggctgtcctg

SEQ ID NO: 154110 - DNA, 15 bp, Homo sapiens
tgctgtggtgtgtcc

SEQ ID NO: 154111 - DNA, 17 bp, Homo sapiens
tgctgtggtgtgtcccc

SEQ ID NO: 154112 - DNA, 16 bp, Homo sapiens
tgctgtgtatctgata

SEQ ID NO: 154113 - DNA, 15 bp, Homo sapiens
tgcttacatttttac

SEQ ID NO: 154114 - DNA, 16 bp, Homo sapiens
tgcttcagtggagaat

SEQ ID NO: 154115 - DNA, 23 bp, Homo sapiens
tgcttcttctcctatgtgtaagg

SEQ ID NO: 154116 - DNA, 20 bp, Homo sapiens
tgcttgacataatttcactg

SEQ ID NO: 154117 - DNA, 15 bp, Homo sapiens
tgcttgagctcagga

SEQ ID NO: 154118 - DNA, 15 bp, Homo sapiens
tgcttgtgttaagta

SEQ ID NO: 154119 - DNA, 19 bp, Homo sapiens
tgcttgttccctctccctg

SEQ ID NO: 154120 - DNA, 19 bp, Homo sapiens
tcctccagggccacgtgcc

SEQ ID NO: 154121 - DNA, 20 bp, Homo sapiens
tcctccagggccacgtgcca

SEQ ID NO: 154122 - DNA, 19 bp, Homo sapiens
tcctcccaggcgccccttc

SEQ ID NO: 154123 - DNA, 15 bp, Homo sapiens
tcctcccatcccctg

SEQ ID NO: 154124 - DNA, 17 bp, Homo sapiens
tcctccccctgccagtg

SEQ ID NO: 154125 - DNA, 24 bp, Homo sapiens
tcctccccctgccagtgccttacc

SEQ ID NO: 154126 - DNA, 16 bp, Homo sapiens
tcctcccctcacagcc

SEQ ID NO: 154127 - DNA, 17 bp, Homo sapiens
tcctcctgcccacctgt

SEQ ID NO: 154128 - DNA, 13 bp, Homo sapiens
tcctcgcaagctg

SEQ ID NO: 154129 - DNA, 16 bp, Homo sapiens
tgaaggttaggattta

SEQ ID NO: 154130 - DNA, 14 bp, Homo sapiens
tgaagtagtttgta

SEQ ID NO: 154131 - DNA, 17 bp, Homo sapiens
tgaagtatttctcactc

SEQ ID NO: 154132 - DNA, 15 bp, Homo sapiens
tgaagtcactgcaca

SEQ ID NO: 154133 - DNA, 21 bp, Homo sapiens
tgaagtcactgcacagtgcat

SEQ ID NO: 154134 - DNA, 18 bp, Homo sapiens
tgaagtgtaggcagacac

SEQ ID NO: 154135 - DNA, 22 bp, Homo sapiens
tgaagtgtgtttccttcagtgc

SEQ ID NO: 154136 - DNA, 20 bp, Homo sapiens
tgaagttgttactaactaaa

SEQ ID NO: 154137 - DNA, 16 bp, Homo sapiens
tgaagtttacattgta

SEQ ID NO: 154138 - DNA, 15 bp, Homo sapiens
tgaataaagacacct

SEQ ID NO: 154139 - DNA, 18 bp, Homo sapiens
tgaataaagcctgctttt

SEQ ID NO: 154140 - DNA, 13 bp, Homo sapiens
tgaataatacagt

SEQ ID NO: 154141 - DNA, 14 bp, Homo sapiens
tgaatatcccctcc

SEQ ID NO: 154142 - DNA, 19 bp, Homo sapiens
tgaatatgattagtaaaga

SEQ ID NO: 154143 - DNA, 21 bp, Homo sapiens
tgaatatggactcagttttct

SEQ ID NO: 154144 - DNA, 18 bp, Homo sapiens
tgaatcagaccctacccc

SEQ ID NO: 154145 - DNA, 17 bp, Homo sapiens
tgaatccatgcttgggt

SEQ ID NO: 154146 - DNA, 16 bp, Homo sapiens
tgaatcttggtgtcta

SEQ ID NO: 154147 - DNA, 15 bp, Homo sapiens
tgaatgaatggctaa

SEQ ID NO: 154148 - DNA, 23 bp, Homo sapiens
tgaatgatgatcctaggcatttg

SEQ ID NO: 154149 - DNA, 19 bp, Homo sapiens
tgaatgatttccaaagaga

SEQ ID NO: 154150 - DNA, 23 bp, Homo sapiens
tgaatgcccacaggcaaatgcat

SEQ ID NO: 154151 - DNA, 14 bp, Homo sapiens
tgaatgccgtggat

SEQ ID NO: 154152 - DNA, 18 bp, Homo sapiens
tgaatgggaaaagagatg

SEQ ID NO: 154153 - DNA, 16 bp, Homo sapiens
tgaatgtattgaactt

SEQ ID NO: 154154 - DNA, 16 bp, Homo sapiens
tgaattaatatcccta

SEQ ID NO: 154155 - DNA, 21 bp, Homo sapiens
tgaattaatgacagagccagt

SEQ ID NO: 154156 - DNA, 21 bp, Homo sapiens
tgaattcttggttgaggaaac

SEQ ID NO: 154157 - DNA, 22 bp, Homo sapiens
tgaattcttggttgaggaaaca

SEQ ID NO: 154158 - DNA, 18 bp, Homo sapiens
tgaattgtaactgttctt

SEQ ID NO: 154159 - DNA, 15 bp, Homo sapiens
tgaattgtccccagt

SEQ ID NO: 154160 - DNA, 20 bp, Homo sapiens
tgaatttcttcactgttgaa

SEQ ID NO: 154161 - DNA, 21 bp, Homo sapiens
tgaatttcttcactgttgaaa

SEQ ID NO: 154162 - DNA, 17 bp, Homo sapiens
tgacaaagaaacccaag

SEQ ID NO: 154163 - DNA, 13 bp, Homo sapiens
tgacaacagaagc

SEQ ID NO: 154164 - DNA, 14 bp, Homo sapiens
tgacaataaatgtg

SEQ ID NO: 154165 - DNA, 17 bp, Homo sapiens
tgacaataatttcaggt

SEQ ID NO: 154166 - DNA, 15 bp, Homo sapiens
tgacacttaaaaatg

SEQ ID NO: 154167 - DNA, 15 bp, Homo sapiens
tgacagacaggctct

SEQ ID NO: 154168 - DNA, 19 bp, Homo sapiens
tgacagacaggctcttagc

SEQ ID NO: 154169 - DNA, 12 bp, Homo sapiens
tgacagagccag

SEQ ID NO: 154170 - DNA, 19 bp, Homo sapiens
tgacagatgttgaatgccc

SEQ ID NO: 154171 - DNA, 17 bp, Homo sapiens
tgacagcctcccacccc

SEQ ID NO: 154172 - DNA, 22 bp, Homo sapiens
tgacagcctcccacccccatct

SEQ ID NO: 154173 - DNA, 17 bp, Homo sapiens
tgacataacactataaa

SEQ ID NO: 154174 - DNA, 15 bp, Homo sapiens
tgacatatttttgct

SEQ ID NO: 154175 - DNA, 15 bp, Homo sapiens
tgacatctcaggggc

SEQ ID NO: 154176 - DNA, 19 bp, Homo sapiens
tgacatctcaggggccaga

SEQ ID NO: 154177 - DNA, 17 bp, Homo sapiens
tgacatcttagtatttg

SEQ ID NO: 154178 - DNA, 17 bp, Homo sapiens
tgacatgcgggctgggc

SEQ ID NO: 154179 - DNA, 20 bp, Homo sapiens
tgacatgtggggccaggtca

SEQ ID NO: 154180 - DNA, 21 bp, Homo sapiens
tgacatttggagtgttcccct

SEQ ID NO: 154181 - DNA, 23 bp, Homo sapiens
tgacatttgggagacatgtgaca

SEQ ID NO: 154182 - DNA, 24 bp, Homo sapiens
tgacatttgggagacatgtgacat

SEQ ID NO: 154183 - DNA, 17 bp, Homo sapiens
tgaccaacagttccttc

SEQ ID NO: 154184 - DNA, 23 bp, Homo sapiens
tgaccaacatggagaaaccctgt

SEQ ID NO: 154185 - DNA, 17 bp, Homo sapiens
tgaccaagcaggaagct

SEQ ID NO: 154186 - DNA, 19 bp, Homo sapiens
tgaccaagcaggaagctca

SEQ ID NO: 154187 - DNA, 13 bp, Homo sapiens
tgaccaatgtctt

SEQ ID NO: 154188 - DNA, 21 bp, Homo sapiens
tgaccacggacgtttccatca

SEQ ID NO: 154189 - DNA, 18 bp, Homo sapiens
tgaccactgcagaagaca

SEQ ID NO: 154190 - DNA, 17 bp, Homo sapiens
tgaccagcagatcccag

SEQ ID NO: 154191 - DNA, 18 bp, Homo sapiens
tgaccagcagatcccagc

SEQ ID NO: 154192 - DNA, 21 bp, Homo sapiens
tgaccagcctccatgctgcct

SEQ ID NO: 154193 - DNA, 23 bp, Homo sapiens
tgaccagcctccatgctgcctcc

SEQ ID NO: 154194 - DNA, 18 bp, Homo sapiens
tgacccagccccttgaga

SEQ ID NO: 154195 - DNA, 19 bp, Homo sapiens
tgacccagccccttgagaa

SEQ ID NO: 154196 - DNA, 15 bp, Homo sapiens
tgacccagtccctgg

SEQ ID NO: 154197 - DNA, 20 bp, Homo sapiens
tgacccagtccctgggggaa

SEQ ID NO: 154198 - DNA, 15 bp, Homo sapiens
tgacccctcctcact

SEQ ID NO: 154199 - DNA, 15 bp, Homo sapiens
tgaccctctccaccc

SEQ ID NO: 154200 - DNA, 14 bp, Homo sapiens
tgacctccacagct

SEQ ID NO: 154201 - DNA, 17 bp, Homo sapiens
tgacctccacagcttcc

SEQ ID NO: 154202 - DNA, 13 bp, Homo sapiens
tgacctccctcta

SEQ ID NO: 154203 - DNA, 22 bp, Homo sapiens
tgacctccctctaatttatctt

SEQ ID NO: 154204 - DNA, 14 bp, Homo sapiens
tgacctgaggaagc

SEQ ID NO: 154205 - DNA, 22 bp, Homo sapiens
tgacctggataacttaggtggc

SEQ ID NO: 154206 - DNA, 14 bp, Homo sapiens
tgactaaaaatatt

SEQ ID NO: 154207 - DNA, 16 bp, Homo sapiens
tgactacagtcaggaa

SEQ ID NO: 154208 - DNA, 18 bp, Homo sapiens
tgactacagtcaggaaag

SEQ ID NO: 154209 - DNA, 19 bp, Homo sapiens
tgactagtgaggaaagatt

SEQ ID NO: 154210 - DNA, 20 bp, Homo sapiens
tgactattgaagttgcagat

SEQ ID NO: 154211 - DNA, 14 bp, Homo sapiens
tgactctcaaatct

SEQ ID NO: 154212 - DNA, 19 bp, Homo sapiens
tgactgagcagactggtga

SEQ ID NO: 154213 - DNA, 15 bp, Homo sapiens
tgactgccccaactc

SEQ ID NO: 154214 - DNA, 17 bp, Homo sapiens
tgactgccccaactcct

SEQ ID NO: 154215 - DNA, 20 bp, Homo sapiens
tgactgccccaactcctgga

SEQ ID NO: 154216 - DNA, 20 bp, Homo sapiens
tgactgctccccagccctgg

SEQ ID NO: 154217 - DNA, 21 bp, Homo sapiens
tgactgggtttctctgtatag

SEQ ID NO: 154218 - DNA, 23 bp, Homo sapiens
tgactgggtttctctgtatagta

SEQ ID NO: 154219 - DNA, 18 bp, Homo sapiens
tgactgtactcctcccag

SEQ ID NO: 154220 - DNA, 23 bp, Homo sapiens
tgacttctaagtaaaaccacagc

SEQ ID NO: 154221 - DNA, 16 bp, Homo sapiens
tgacttgactttagtc

SEQ ID NO: 154222 - DNA, 18 bp, Homo sapiens
tgactttagtctgcaaaa

SEQ ID NO: 154223 - DNA, 13 bp, Homo sapiens
tgactttcaggta

SEQ ID NO: 154224 - DNA, 22 bp, Homo sapiens
tgacttttctgtccgagctttg

SEQ ID NO: 154225 - DNA, 18 bp, Homo sapiens
tgagaaaaagctcctgtc

SEQ ID NO: 154226 - DNA, 15 bp, Homo sapiens
tgagaaagactattc

SEQ ID NO: 154227 - DNA, 17 bp, Homo sapiens
tgagaaggaatttgagt

SEQ ID NO: 154228 - DNA, 16 bp, Homo sapiens
tgagaaggagagaaag

SEQ ID NO: 154229 - DNA, 19 bp, Homo sapiens
tgagaatctttattgagaa

SEQ ID NO: 154230 - DNA, 21 bp, Homo sapiens
tgagaatctttattgagaaag

SEQ ID NO: 154231 - DNA, 20 bp, Homo sapiens
tgagaattgtgctcaaaatt

SEQ ID NO: 154232 - DNA, 20 bp, Homo sapiens
tgagaatttgagtgctctga

SEQ ID NO: 154233 - DNA, 16 bp, Homo sapiens
tgagacagctctgcat

SEQ ID NO: 154234 - DNA, 12 bp, Homo sapiens
tgagacctcagc

SEQ ID NO: 154235 - DNA, 16 bp, Homo sapiens
tgagacctcagccatg

SEQ ID NO: 154236 - DNA, 13 bp, Homo sapiens
tgagagaaaataa

SEQ ID NO: 154237 - DNA, 12 bp, Homo sapiens
tgagagactttt

SEQ ID NO: 154238 - DNA, 18 bp, Homo sapiens
tgagaggcagacttccct

SEQ ID NO: 154239 - DNA, 17 bp, Homo sapiens
tgagagtatcaggtctc

SEQ ID NO: 154240 - DNA, 16 bp, Homo sapiens
tgagagtgaacaaatt

SEQ ID NO: 154241 - DNA, 22 bp, Homo sapiens
tgagagtgtcttcacggcagga

SEQ ID NO: 154242 - DNA, 24 bp, Homo sapiens
tgagagtgtcttcacggcaggaca

SEQ ID NO: 154243 - DNA, 22 bp, Homo sapiens
tgagataatgtgatattataca

SEQ ID NO: 154244 - DNA, 13 bp, Homo sapiens
tgagatgctggag

SEQ ID NO: 154245 - DNA, 15 bp, Homo sapiens
tgagatgctggagaa

SEQ ID NO: 154246 - DNA, 24 bp, Homo sapiens
tgagatgtgaacacatcagcttgc

SEQ ID NO: 154247 - DNA, 18 bp, Homo sapiens
tgagcaaatgtggctcct

SEQ ID NO: 154248 - DNA, 19 bp, Homo sapiens
tgagcaaatgtggctcctg

SEQ ID NO: 154249 - DNA, 20 bp, Homo sapiens
tgagcaggattttaatcttt

SEQ ID NO: 154250 - DNA, 14 bp, Homo sapiens
tgagcagtggctgg

SEQ ID NO: 154251 - DNA, 22 bp, Homo sapiens
tgagcagtggctggtccagggc

SEQ ID NO: 154252 - DNA, 23 bp, Homo sapiens
tgagccccgcagacctccccagc

SEQ ID NO: 154253 - DNA, 14 bp, Homo sapiens
tgagcccctgggac

SEQ ID NO: 154254 - DNA, 23 bp, Homo sapiens
tgagccgcatcttctccatctgg

SEQ ID NO: 154255 - DNA, 21 bp, Homo sapiens
tgagccgctgtgagcccctgg

SEQ ID NO: 154256 - DNA, 11 bp, Homo sapiens
tgagcctggca

SEQ ID NO: 154257 - DNA, 19 bp, Homo sapiens
tgagcctgggaggtcaagg

SEQ ID NO: 154258 - DNA, 22 bp, Homo sapiens
tgagcctgggaggtcaaggctg

SEQ ID NO: 154259 - DNA, 16 bp, Homo sapiens
tgagctcagaccccca

SEQ ID NO: 154260 - DNA, 17 bp, Homo sapiens
tgagctcagacccccac

SEQ ID NO: 154261 - DNA, 19 bp, Homo sapiens
tgagctcagacccccactc

SEQ ID NO: 154262 - DNA, 20 bp, Homo sapiens
tgagctcagacccccactct

SEQ ID NO: 154263 - DNA, 11 bp, Homo sapiens
tgagctcagga

SEQ ID NO: 154264 - DNA, 23 bp, Homo sapiens
tgagctccccaccaccccagctg

SEQ ID NO: 154265 - DNA, 20 bp, Homo sapiens
tgagctcggtggacccaggg

SEQ ID NO: 154266 - DNA, 18 bp, Homo sapiens
tgagctctacccagggcc

SEQ ID NO: 154267 - DNA, 19 bp, Homo sapiens
tgagctctacccagggcct

SEQ ID NO: 154268 - DNA, 22 bp, Homo sapiens
tgagctctacccagggcctgca

SEQ ID NO: 154269 - DNA, 19 bp, Homo sapiens
tgagctgagatcgtgccgt

SEQ ID NO: 154270 - DNA, 13 bp, Homo sapiens
tgagctgagcagg

SEQ ID NO: 154271 - DNA, 23 bp, Homo sapiens
tgagcttaagaattttgagcagg

SEQ ID NO: 154272 - DNA, 15 bp, Homo sapiens
tgaggaaaggccagc

SEQ ID NO: 154273 - DNA, 16 bp, Homo sapiens
tgaggaaaggccagct

SEQ ID NO: 154274 - DNA, 18 bp, Homo sapiens
tgaggaaaggccagctgg

SEQ ID NO: 154275 - DNA, 17 bp, Homo sapiens
aagcacctgccgacctc

SEQ ID NO: 154276 - DNA, 17 bp, Homo sapiens
aagcactacataaactg

SEQ ID NO: 154277 - DNA, 23 bp, Homo sapiens
aagcactacataaactgacttta

SEQ ID NO: 154278 - DNA, 19 bp, Homo sapiens
aagcactgacttctaagta

SEQ ID NO: 154279 - DNA, 21 bp, Homo sapiens
aagcagaggaaggagaggaga

SEQ ID NO: 154280 - DNA, 14 bp, Homo sapiens
aagcagatgcaaag

SEQ ID NO: 154281 - DNA, 19 bp, Homo sapiens
aagcagatgcaaagaggca

SEQ ID NO: 154282 - DNA, 21 bp, Homo sapiens
aagcagatgcaaagaggcaag

SEQ ID NO: 154283 - DNA, 19 bp, Homo sapiens
aagcagctcaaaggcacag

SEQ ID NO: 154284 - DNA, 22 bp, Homo sapiens
aagcaggaaatgaaaatgtctt

SEQ ID NO: 154285 - DNA, 11 bp, Homo sapiens
aagcaggaagc

SEQ ID NO: 154286 - DNA, 15 bp, Homo sapiens
aagcagggacttgaa

SEQ ID NO: 154287 - DNA, 18 bp, Homo sapiens
aagcaggggagtatgcaa

SEQ ID NO: 154288 - DNA, 21 bp, Homo sapiens
aagcaggggctacaagaggga

SEQ ID NO: 154289 - DNA, 21 bp, Homo sapiens
aagcagtagaaataatatgca

SEQ ID NO: 154290 - DNA, 17 bp, Homo sapiens
aagcagtggacaccagg

SEQ ID NO: 154291 - DNA, 18 bp, Homo sapiens
aagcatgtattcagcttt

SEQ ID NO: 154292 - DNA, 16 bp, Homo sapiens
aagccacaagaaattt

SEQ ID NO: 154293 - DNA, 18 bp, Homo sapiens
aagccacaagaaatttga

SEQ ID NO: 154294 - DNA, 19 bp, Homo sapiens
aagccagcgtcctcctctg

SEQ ID NO: 154295 - DNA, 21 bp, Homo sapiens
aagccaggcaggtagccaggg

SEQ ID NO: 154296 - DNA, 22 bp, Homo sapiens
aagcccatcaattatagaaagc

SEQ ID NO: 154297 - DNA, 13 bp, Homo sapiens
aagccctcttcca

SEQ ID NO: 154298 - DNA, 23 bp, Homo sapiens
aagccctgattgtgtatattcat

SEQ ID NO: 154299 - DNA, 14 bp, Homo sapiens
aagccgtgccctgc

SEQ ID NO: 154300 - DNA, 15 bp, Homo sapiens
aagccgtggcttccc

SEQ ID NO: 154301 - DNA, 14 bp, Homo sapiens
aagcctaagaatct

SEQ ID NO: 154302 - DNA, 13 bp, Homo sapiens
aagcctcagagaa

SEQ ID NO: 154303 - DNA, 19 bp, Homo sapiens
aagcctcctccagccgcca

SEQ ID NO: 154304 - DNA, 23 bp, Homo sapiens
aagcgtgaaggccgagaagcaag

SEQ ID NO: 154305 - DNA, 18 bp, Homo sapiens
aagctagtggcttcaaaa

SEQ ID NO: 154306 - DNA, 11 bp, Homo sapiens
aagctcacagt

SEQ ID NO: 154307 - DNA, 15 bp, Homo sapiens
aagctcacagttcct

SEQ ID NO: 154308 - DNA, 19 bp, Homo sapiens
aagctcacagttcctcgcc

SEQ ID NO: 154309 - DNA, 17 bp, Homo sapiens
aagctcagctactgatt

SEQ ID NO: 154310 - DNA, 23 bp, Homo sapiens
aagctcatattttgtatatatct

SEQ ID NO: 154311 - DNA, 14 bp, Homo sapiens
aagctccatctcca

SEQ ID NO: 154312 - DNA, 14 bp, Homo sapiens
aagctcctgtcctc

SEQ ID NO: 154313 - DNA, 22 bp, Homo sapiens
aagctcctgtcctcccatcccc

SEQ ID NO: 154314 - DNA, 20 bp, Homo sapiens
aagctgcaccctcaggcagg

SEQ ID NO: 154315 - DNA, 22 bp, Homo sapiens
aagctgcaccctcaggcaggtg

SEQ ID NO: 154316 - DNA, 21 bp, Homo sapiens
aagctgctttaaaaaaataca

SEQ ID NO: 154317 - DNA, 23 bp, Homo sapiens
aagctgtagtagccctttctgtg

SEQ ID NO: 154318 - DNA, 19 bp, Homo sapiens
aagctgtgacttctccagg

SEQ ID NO: 154319 - DNA, 13 bp, Homo sapiens
aagctgtggccag

SEQ ID NO: 154320 - DNA, 20 bp, Homo sapiens
aagctgtgtccttgcacctg

SEQ ID NO: 154321 - DNA, 22 bp, Homo sapiens
aagcttcgaggcccagcgacct

SEQ ID NO: 154322 - DNA, 22 bp, Homo sapiens
aagctttcatgtaaactgtgca

SEQ ID NO: 154323 - DNA, 12 bp, Homo sapiens
aagctttcctgc

SEQ ID NO: 154324 - DNA, 15 bp, Homo sapiens
aaggaaaaatgtgta

SEQ ID NO: 154325 - DNA, 16 bp, Homo sapiens
aaggaaaaatgtgtaa

SEQ ID NO: 154326 - DNA, 14 bp, Homo sapiens
aaggaaaatgatac

SEQ ID NO: 154327 - DNA, 14 bp, Homo sapiens
aaggaaaggcctga

SEQ ID NO: 154328 - DNA, 20 bp, Homo sapiens
aaggaaggagactcacctct

SEQ ID NO: 154329 - DNA, 17 bp, Homo sapiens
aaggacaaaaatgaact

SEQ ID NO: 154330 - DNA, 18 bp, Homo sapiens
aaggacccggaggggcct

SEQ ID NO: 154331 - DNA, 13 bp, Homo sapiens
aaggacctcctga

SEQ ID NO: 154332 - DNA, 21 bp, Homo sapiens
aaggacggccttcaactgaaa

SEQ ID NO: 154333 - DNA, 11 bp, Homo sapiens
aaggagagaaa

SEQ ID NO: 154334 - DNA, 14 bp, Homo sapiens
aaggagagaaagtg

SEQ ID NO: 154335 - DNA, 18 bp, Homo sapiens
aaggagagaaggggagga

SEQ ID NO: 154336 - DNA, 17 bp, Homo sapiens
aaggagccccattcctg

SEQ ID NO: 154337 - DNA, 20 bp, Homo sapiens
aaggagcccttatctgtgct

SEQ ID NO: 154338 - DNA, 19 bp, Homo sapiens
aaggatgtaaacagtgcct

SEQ ID NO: 154339 - DNA, 14 bp, Homo sapiens
aaggattgtgatat

SEQ ID NO: 154340 - DNA, 22 bp, Homo sapiens
aaggcacctataaaacaggtca

SEQ ID NO: 154341 - DNA, 16 bp, Homo sapiens
aaggcaggaatgtgtg

SEQ ID NO: 154342 - DNA, 14 bp, Homo sapiens
aaggccagctggca

SEQ ID NO: 154343 - DNA, 19 bp, Homo sapiens
aaggccagctggcagcaga

SEQ ID NO: 154344 - DNA, 14 bp, Homo sapiens
aaggccgagaagca

SEQ ID NO: 154345 - DNA, 22 bp, Homo sapiens
aaggccgctgttcacccacagg

SEQ ID NO: 154346 - DNA, 15 bp, Homo sapiens
aaggctatacttgtc

SEQ ID NO: 154347 - DNA, 19 bp, Homo sapiens
aaggctgagaggagagaga

SEQ ID NO: 154348 - DNA, 20 bp, Homo sapiens
aaggctgaggaaaggccagc

SEQ ID NO: 154349 - DNA, 16 bp, Homo sapiens
aagggaaaagtctctt

SEQ ID NO: 154350 - DNA, 12 bp, Homo sapiens
aagggaaataga

SEQ ID NO: 154351 - DNA, 17 bp, Homo sapiens
aagggaagttgtgcctt

SEQ ID NO: 154352 - DNA, 19 bp, Homo sapiens
aagggatatataagatgga

SEQ ID NO: 154353 - DNA, 14 bp, Homo sapiens
aagggatggcaaga

SEQ ID NO: 154354 - DNA, 22 bp, Homo sapiens
aaggggatgtatccatgggggc

SEQ ID NO: 154355 - DNA, 20 bp, Homo sapiens
aaggggcagtctggaggggc

SEQ ID NO: 154356 - DNA, 15 bp, Homo sapiens
aaggggcccgtggga

SEQ ID NO: 154357 - DNA, 19 bp, Homo sapiens
aagggtccttccctctccc

SEQ ID NO: 154358 - DNA, 13 bp, Homo sapiens
aagggtgtctgag

SEQ ID NO: 154359 - DNA, 11 bp, Homo sapiens
aaggtgaagga

SEQ ID NO: 154360 - DNA, 15 bp, Homo sapiens
aaggtgaaggaatat

SEQ ID NO: 154361 - DNA, 20 bp, Homo sapiens
aaggtgctggaggtgggagc

SEQ ID NO: 154362 - DNA, 20 bp, Homo sapiens
aaggtggactggaaggggcc

SEQ ID NO: 154363 - DNA, 21 bp, Homo sapiens
aaggtggggtctttgtgagag

SEQ ID NO: 154364 - DNA, 23 bp, Homo sapiens
aaggttccgcttggagcagaggg

SEQ ID NO: 154365 - DNA, 17 bp, Homo sapiens
aaggttctcataggaaa

SEQ ID NO: 154366 - DNA, 17 bp, Homo sapiens
aaggtttgtatattgtc

SEQ ID NO: 154367 - DNA, 16 bp, Homo sapiens
aagtaaaaccacagca

SEQ ID NO: 154368 - DNA, 21 bp, Homo sapiens
aagtaaagctaaaatgatttt

SEQ ID NO: 154369 - DNA, 12 bp, Homo sapiens
aagtaaatgcta

SEQ ID NO: 154370 - DNA, 19 bp, Homo sapiens
aagtaagaaaatattttgt

SEQ ID NO: 154371 - DNA, 13 bp, Homo sapiens
aagtaagcaaaga

SEQ ID NO: 154372 - DNA, 14 bp, Homo sapiens
aagtaattcctctc

SEQ ID NO: 154373 - DNA, 23 bp, Homo sapiens
aagtactgctgtaaataaatgct

SEQ ID NO: 154374 - DNA, 19 bp, Homo sapiens
aagtaggggttgtgggtga

SEQ ID NO: 154375 - DNA, 15 bp, Homo sapiens
aagtatacataagtt

SEQ ID NO: 154376 - DNA, 16 bp, Homo sapiens
aagtatatatagaatc

SEQ ID NO: 154377 - DNA, 17 bp, Homo sapiens
aagtatgagggaaaatg

SEQ ID NO: 154378 - DNA, 12 bp, Homo sapiens
aagtatgtaaag

SEQ ID NO: 154379 - DNA, 21 bp, Homo sapiens
aagtatttatatatttataac

SEQ ID NO: 154380 - DNA, 17 bp, Homo sapiens
aagtattttcataagta

SEQ ID NO: 154381 - DNA, 22 bp, Homo sapiens
aagtattttcataagtatttca

SEQ ID NO: 154382 - DNA, 22 bp, Homo sapiens
aagtcaaagtaaaacttgctgc

SEQ ID NO: 154383 - DNA, 16 bp, Homo sapiens
aagtcaaccaatgtag

SEQ ID NO: 154384 - DNA, 22 bp, Homo sapiens
aagtcaaccaatgtagaaagct

SEQ ID NO: 154385 - DNA, 18 bp, Homo sapiens
aagtcagtgggaacgtga

SEQ ID NO: 154386 - DNA, 11 bp, Homo sapiens
aagtcatgagc

SEQ ID NO: 154387 - DNA, 14 bp, Homo sapiens
aagtcatgtgcatt

SEQ ID NO: 154388 - DNA, 15 bp, Homo sapiens
aagtcatgtgcattt

SEQ ID NO: 154389 - DNA, 12 bp, Homo sapiens
aagtcatgttcc

SEQ ID NO: 154390 - DNA, 14 bp, Homo sapiens
aagtccccaggccc

SEQ ID NO: 154391 - DNA, 21 bp, Homo sapiens
aagtccccaggccccaggaag

SEQ ID NO: 154392 - DNA, 22 bp, Homo sapiens
aagtccccaggccccaggaagc

SEQ ID NO: 154393 - DNA, 23 bp, Homo sapiens
aagtctgtgtgatgaactttctc

SEQ ID NO: 154394 - DNA, 18 bp, Homo sapiens
aagtcttaaaataactta

SEQ ID NO: 154395 - DNA, 12 bp, Homo sapiens
aagtcttcaggg

SEQ ID NO: 154396 - DNA, 22 bp, Homo sapiens
aagtgaaggtttacaatttaca

SEQ ID NO: 154397 - DNA, 13 bp, Homo sapiens
aagtgattgtatg

SEQ ID NO: 154398 - DNA, 20 bp, Homo sapiens
aagtggaccaggacaggacc

SEQ ID NO: 154399 - DNA, 14 bp, Homo sapiens
aagtggctgctgac

SEQ ID NO: 154400 - DNA, 16 bp, Homo sapiens
aagtgggccaggacag

SEQ ID NO: 154401 - DNA, 14 bp, Homo sapiens
aagtgggtgagatg

SEQ ID NO: 154402 - DNA, 19 bp, Homo sapiens
aagtgggtgagatgctgga

SEQ ID NO: 154403 - DNA, 19 bp, Homo sapiens
aagtgtaagaaacacactg

SEQ ID NO: 154404 - DNA, 17 bp, Homo sapiens
aagtgtaggcagacaca

SEQ ID NO: 154405 - DNA, 20 bp, Homo sapiens
aagtgtaggcagacacaggg

SEQ ID NO: 154406 - DNA, 19 bp, Homo sapiens
aagtgtctcagtccacctg

SEQ ID NO: 154407 - DNA, 13 bp, Homo sapiens
aagtgtggtagag

SEQ ID NO: 154408 - DNA, 13 bp, Homo sapiens
aagtgtgtattaa

SEQ ID NO: 154409 - DNA, 16 bp, Homo sapiens
aagtgtgtattaaaaa

SEQ ID NO: 154410 - DNA, 17 bp, Homo sapiens
aagtgttgtaaatattt

SEQ ID NO: 154411 - DNA, 18 bp, Homo sapiens
aagtgttgtaaatattta

SEQ ID NO: 154412 - DNA, 23 bp, Homo sapiens
aagttaagaatgttcttatgttg

SEQ ID NO: 154413 - DNA, 23 bp, Homo sapiens
aagttacttcactttaattctca

SEQ ID NO: 154414 - DNA, 11 bp, Homo sapiens
aagttattgta

SEQ ID NO: 154415 - DNA, 20 bp, Homo sapiens
aagttattgtacagctgttt

SEQ ID NO: 154416 - DNA, 23 bp, Homo sapiens
aagttcatattccatatttattc

SEQ ID NO: 154417 - DNA, 19 bp, Homo sapiens
aagttccagtgttctctct

SEQ ID NO: 154418 - DNA, 20 bp, Homo sapiens
aagttccttatgtatattta

SEQ ID NO: 154419 - DNA, 17 bp, Homo sapiens
aagttctgcagataaac

SEQ ID NO: 154420 - DNA, 20 bp, Homo sapiens
aagttgaaagagtcctattt

SEQ ID NO: 154421 - DNA, 22 bp, Homo sapiens
aagttgcagtgagctgatatca

SEQ ID NO: 154422 - DNA, 19 bp, Homo sapiens
aagggtgatgggaaagcat

SEQ ID NO: 154423 - DNA, 20 bp, Homo sapiens
aaggtagccctggccagagg

SEQ ID NO: 154424 - DNA, 11 bp, Homo sapiens
aaggtataatt

SEQ ID NO: 154425 - DNA, 11 bp, Homo sapiens
aaggtgcctgt

SEQ ID NO: 154426 - DNA, 20 bp, Homo sapiens
aaggtgcctgtgaggcaggg

SEQ ID NO: 154427 - DNA, 15 bp, Homo sapiens
aaggtgctggaggtg

SEQ ID NO: 154428 - DNA, 11 bp, Homo sapiens
aaggtgggagg

SEQ ID NO: 154429 - DNA, 18 bp, Homo sapiens
aaggtgtcagaataataa

SEQ ID NO: 154430 - DNA, 17 bp, Homo sapiens
aaggttaggatttaaca

SEQ ID NO: 154431 - DNA, 18 bp, Homo sapiens
aaggttaggatttaacag

SEQ ID NO: 154432 - DNA, 18 bp, Homo sapiens
aagtaaaaccacagcagt

SEQ ID NO: 154433 - DNA, 14 bp, Homo sapiens
aagtaagaaaatat

SEQ ID NO: 154434 - DNA, 16 bp, Homo sapiens
aagtaagaaaatattt

SEQ ID NO: 154435 - DNA, 13 bp, Homo sapiens
aagtacatttaat

SEQ ID NO: 154436 - DNA, 17 bp, Homo sapiens
aagtactgctgtaaata

SEQ ID NO: 154437 - DNA, 23 bp, Homo sapiens
aagtagacttcatttttcctaac

SEQ ID NO: 154438 - DNA, 12 bp, Homo sapiens
aagtagaggagg

SEQ ID NO: 154439 - DNA, 13 bp, Homo sapiens
aagtaggaagtaa

SEQ ID NO: 154440 - DNA, 21 bp, Homo sapiens
aagtagggacttctgtcttca

SEQ ID NO: 154441 - DNA, 18 bp, Homo sapiens
aagtatgtgtaaaatgtg

SEQ ID NO: 154442 - DNA, 19 bp, Homo sapiens
aagtatgtgtaaaatgtga

SEQ ID NO: 154443 - DNA, 18 bp, Homo sapiens
aagtattgcatctgtata

SEQ ID NO: 154444 - DNA, 19 bp, Homo sapiens
aagtattgcatctgtataa

SEQ ID NO: 154445 - DNA, 16 bp, Homo sapiens
aagtatttatatattt

SEQ ID NO: 154446 - DNA, 17 bp, Homo sapiens
aagtatttatatattta

SEQ ID NO: 154447 - DNA, 20 bp, Homo sapiens
aagtatttatatatttataa

SEQ ID NO: 154448 - DNA, 22 bp, Homo sapiens
aagtatttatatatttataact

SEQ ID NO: 154449 - DNA, 23 bp, Homo sapiens
aagtatttatatatttataactc

SEQ ID NO: 154450 - DNA, 16 bp, Homo sapiens
aagtcaaaaggtgcct

SEQ ID NO: 154451 - DNA, 19 bp, Homo sapiens
aagtcaaaaggtgcctgtg

SEQ ID NO: 154452 - DNA, 16 bp, Homo sapiens
aagtcaacctgcctga

SEQ ID NO: 154453 - DNA, 21 bp, Homo sapiens
aagtcaagtgaaaaaggagga

SEQ ID NO: 154454 - DNA, 23 bp, Homo sapiens
aagtcagtccaggatgctaacat

SEQ ID NO: 154455 - DNA, 23 bp, Homo sapiens
aagtccccaggccccaggaagcc

SEQ ID NO: 154456 - DNA, 19 bp, Homo sapiens
aagtctaggagctgggagg

SEQ ID NO: 154457 - DNA, 17 bp, Homo sapiens
aagtcttaaaataactt

SEQ ID NO: 154458 - DNA, 10 bp, Homo sapiens
aagtgaaggt

SEQ ID NO: 154459 - DNA, 17 bp, Homo sapiens
aagtgaaggtttacaat

SEQ ID NO: 154460 - DNA, 18 bp, Homo sapiens
aagtgaaggtttacaatt

SEQ ID NO: 154461 - DNA, 18 bp, Homo sapiens
aagtgagaataggcagcc

SEQ ID NO: 154462 - DNA, 16 bp, Homo sapiens
aagtggaccaggacag

SEQ ID NO: 154463 - DNA, 19 bp, Homo sapiens
aagtggaccaggacaggac

SEQ ID NO: 154464 - DNA, 14 bp, Homo sapiens
aagtgtacatatgt

SEQ ID NO: 154465 - DNA, 13 bp, Homo sapiens
aagtgtaggcaga

SEQ ID NO: 154466 - DNA, 14 bp, Homo sapiens
aagtgtaggcagac

SEQ ID NO: 154467 - DNA, 16 bp, Homo sapiens
aagtgtaggcagacac

SEQ ID NO: 154468 - DNA, 18 bp, Homo sapiens
aagtgtatgcacgtgtgc

SEQ ID NO: 154469 - DNA, 12 bp, Homo sapiens
aagtgtgtatgt

SEQ ID NO: 154470 - DNA, 17 bp, Homo sapiens
aagtgtgtttccttcag

SEQ ID NO: 154471 - DNA, 23 bp, Homo sapiens
aagtgttggctaatgaagggaaa

SEQ ID NO: 154472 - DNA, 22 bp, Homo sapiens
aagtgttgtaaatatttatgta

SEQ ID NO: 154473 - DNA, 12 bp, Homo sapiens
aagttaaataaa

SEQ ID NO: 154474 - DNA, 14 bp, Homo sapiens
aagttaaataaatc

SEQ ID NO: 154475 - DNA, 11 bp, Homo sapiens
aagttaagaat

SEQ ID NO: 154476 - DNA, 16 bp, Homo sapiens
aagttacttattctag

SEQ ID NO: 154477 - DNA, 15 bp, Homo sapiens
aagttcatattccat

SEQ ID NO: 154478 - DNA, 18 bp, Homo sapiens
aagttgatggtgatgaaa

SEQ ID NO: 154479 - DNA, 16 bp, Homo sapiens
aagttgcagtgagctg

SEQ ID NO: 154480 - DNA, 20 bp, Homo sapiens
aagttgtgccttttatagct

SEQ ID NO: 154481 - DNA, 16 bp, Homo sapiens
aagttgtggtgctgac

SEQ ID NO: 154482 - DNA, 21 bp, Homo sapiens
aagttgttactaactaaactc

SEQ ID NO: 154483 - DNA, 23 bp, Homo sapiens
aagttgttactaactaaactctc

SEQ ID NO: 154484 - DNA, 21 bp, Homo sapiens
aagtttacaagtgtatatcag

SEQ ID NO: 154485 - DNA, 16 bp, Homo sapiens
aagtttgatttcatta

SEQ ID NO: 154486 - DNA, 15 bp, Homo sapiens
aagttttcaatgatg

SEQ ID NO: 154487 - DNA, 15 bp, Homo sapiens
aataaaacctttcaa

SEQ ID NO: 154488 - DNA, 16 bp, Homo sapiens
aataaaacctttcaaa

SEQ ID NO: 154489 - DNA, 21 bp, Homo sapiens
aataaaacctttcaaatttca

SEQ ID NO: 154490 - DNA, 14 bp, Homo sapiens
aataaaattgcact

SEQ ID NO: 154491 - DNA, 17 bp, Homo sapiens
aataaacctcaaaatgt

SEQ ID NO: 154492 - DNA, 13 bp, Homo sapiens
aataaatatatat

SEQ ID NO: 154493 - DNA, 15 bp, Homo sapiens
aataaatatatataa

SEQ ID NO: 154494 - DNA, 12 bp, Homo sapiens
aataaatgtctt

SEQ ID NO: 154495 - DNA, 20 bp, Homo sapiens
aataaatgtgaaattctgtc

SEQ ID NO: 154496 - DNA, 12 bp, Homo sapiens
aataaatgtgcc

SEQ ID NO: 154497 - DNA, 20 bp, Homo sapiens
aataaattgctccttgacat

SEQ ID NO: 154498 - DNA, 21 bp, Homo sapiens
aataaatttggttctaataga

SEQ ID NO: 154499 - DNA, 12 bp, Homo sapiens
aataacacacat

SEQ ID NO: 154500 - DNA, 19 bp, Homo sapiens
aataactctgtggcattat

SEQ ID NO: 154501 - DNA, 13 bp, Homo sapiens
aataactgtgaag

SEQ ID NO: 154502 - DNA, 21 bp, Homo sapiens
aataataattatccagagttt

SEQ ID NO: 154503 - DNA, 17 bp, Homo sapiens
aataatatattttaaat

SEQ ID NO: 154504 - DNA, 12 bp, Homo sapiens
aataatatgcat

SEQ ID NO: 154505 - DNA, 15 bp, Homo sapiens
aataatatgcattgt

SEQ ID NO: 154506 - DNA, 20 bp, Homo sapiens
aatacactaattcctttcta

SEQ ID NO: 154507 - DNA, 13 bp, Homo sapiens
aatacagaggcaa

SEQ ID NO: 154508 - DNA, 16 bp, Homo sapiens
aatacagggcattttg

SEQ ID NO: 154509 - DNA, 16 bp, Homo sapiens
aatacagtacaggcag

SEQ ID NO: 154510 - DNA, 17 bp, Homo sapiens
aatacagtacaggcagc

SEQ ID NO: 154511 - DNA, 21 bp, Homo sapiens
aatacagtcttccatttgcaa

SEQ ID NO: 154512 - DNA, 17 bp, Homo sapiens
aatacatgacatttatt

SEQ ID NO: 154513 - DNA, 23 bp, Homo sapiens
aatacatgacatttatttttcat

SEQ ID NO: 154514 - DNA, 14 bp, Homo sapiens
aatacatgctgcta

SEQ ID NO: 154515 - DNA, 17 bp, Homo sapiens
aatacattgaattagaa

SEQ ID NO: 154516 - DNA, 20 bp, Homo sapiens
aataccaaaattatttcaga

SEQ ID NO: 154517 - DNA, 16 bp, Homo sapiens
aataccaagtatttat

SEQ ID NO: 154518 - DNA, 16 bp, Homo sapiens
aatactgtattttgta

SEQ ID NO: 154519 - DNA, 17 bp, Homo sapiens
aatagaaaactgaaaat

SEQ ID NO: 154520 - DNA, 19 bp, Homo sapiens
aatagaaaactgaaaatct

SEQ ID NO: 154521 - DNA, 20 bp, Homo sapiens
aatagaaaactgaaaatcta

SEQ ID NO: 154522 - DNA, 16 bp, Homo sapiens
aatagacttaaatctc

SEQ ID NO: 154523 - DNA, 14 bp, Homo sapiens
aatagagcctgagg

SEQ ID NO: 154524 - DNA, 16 bp, Homo sapiens
aatagagcctgaggga

SEQ ID NO: 154525 - DNA, 15 bp, Homo sapiens
aatagagtatatgca

SEQ ID NO: 154526 - DNA, 16 bp, Homo sapiens
aatagagtatatgcac

SEQ ID NO: 154527 - DNA, 17 bp, Homo sapiens
aatagagtatatgcact

SEQ ID NO: 154528 - DNA, 13 bp, Homo sapiens
aatagtcaagaaa

SEQ ID NO: 154529 - DNA, 17 bp, Homo sapiens
aatagtcaagaaaaatt

SEQ ID NO: 154530 - DNA, 19 bp, Homo sapiens
aatagtgcagaatctcata

SEQ ID NO: 154531 - DNA, 21 bp, Homo sapiens
aatagttttattaataaacat

SEQ ID NO: 154532 - DNA, 21 bp, Homo sapiens
aatataaagatggctgacttt

SEQ ID NO: 154533 - DNA, 16 bp, Homo sapiens
aatatagctgtacaaa

SEQ ID NO: 154534 - DNA, 18 bp, Homo sapiens
aatatagctgtacaaata

SEQ ID NO: 154535 - DNA, 21 bp, Homo sapiens
aatatagctgtacaaatataa

SEQ ID NO: 154536 - DNA, 18 bp, Homo sapiens
aatatataaaaagaaaag

SEQ ID NO: 154537 - DNA, 21 bp, Homo sapiens
aatatataaaaagaaaagata

SEQ ID NO: 154538 - DNA, 14 bp, Homo sapiens
aatatatataaacc

SEQ ID NO: 154539 - DNA, 18 bp, Homo sapiens
aatatatatatatataaa

SEQ ID NO: 154540 - DNA, 21 bp, Homo sapiens
aatatatatatatataaaata

SEQ ID NO: 154541 - DNA, 22 bp, Homo sapiens
aatatatatatatataaaataa

SEQ ID NO: 154542 - DNA, 16 bp, Homo sapiens
aatatatcccagaaat

SEQ ID NO: 154543 - DNA, 20 bp, Homo sapiens
aatatatggcagagttgtaa

SEQ ID NO: 154544 - DNA, 16 bp, Homo sapiens
aatatattataatctt

SEQ ID NO: 154545 - DNA, 15 bp, Homo sapiens
aatatatttttatat

SEQ ID NO: 154546 - DNA, 13 bp, Homo sapiens
aatatctgggatt

SEQ ID NO: 154547 - DNA, 20 bp, Homo sapiens
aatatgattagtaaagaaat

SEQ ID NO: 154548 - DNA, 17 bp, Homo sapiens
aatatgcaaagcactga

SEQ ID NO: 154549 - DNA, 20 bp, Homo sapiens
aatatgcatctaataaaaaa

SEQ ID NO: 154550 - DNA, 17 bp, Homo sapiens
aatatggaacttctaat

SEQ ID NO: 154551 - DNA, 20 bp, Homo sapiens
aatatggaacttctaatata

SEQ ID NO: 154552 - DNA, 16 bp, Homo sapiens
aatatgttagcaaaga

SEQ ID NO: 154553 - DNA, 13 bp, Homo sapiens
aatattagaaaca

SEQ ID NO: 154554 - DNA, 15 bp, Homo sapiens
aatattccctagaaa

SEQ ID NO: 154555 - DNA, 17 bp, Homo sapiens
aatattccctagaaact

SEQ ID NO: 154556 - DNA, 15 bp, Homo sapiens
aatattcctgcattt

SEQ ID NO: 154557 - DNA, 16 bp, Homo sapiens
aatattgtcattcctg

SEQ ID NO: 154558 - DNA, 17 bp, Homo sapiens
aatatttatatatttat

SEQ ID NO: 154559 - DNA, 15 bp, Homo sapiens
aatatttatgtaaac

SEQ ID NO: 154560 - DNA, 13 bp, Homo sapiens
aatatttattacc

SEQ ID NO: 154561 - DNA, 14 bp, Homo sapiens
aatatttattacct

SEQ ID NO: 154562 - DNA, 12 bp, Homo sapiens
aatatttgctga

SEQ ID NO: 154563 - DNA, 17 bp, Homo sapiens
aatattttaagtattgc

SEQ ID NO: 154564 - DNA, 18 bp, Homo sapiens
aatattttaagtattgca

SEQ ID NO: 154565 - DNA, 20 bp, Homo sapiens
aatattttgtctaaaatgcc

SEQ ID NO: 154566 - DNA, 21 bp, Homo sapiens
aatattttgtctaaaatgcct

SEQ ID NO: 154567 - DNA, 22 bp, Homo sapiens
aatcaaatatgcaaagcactga

SEQ ID NO: 154568 - DNA, 23 bp, Homo sapiens
aatcaagttggcttctaatcaaa

SEQ ID NO: 154569 - DNA, 22 bp, Homo sapiens
aatcaatgctataactatgttg

SEQ ID NO: 154570 - DNA, 15 bp, Homo sapiens
aagttgtttcattga

SEQ ID NO: 154571 - DNA, 23 bp, Homo sapiens
aagtttacaagtgtatatcagaa

SEQ ID NO: 154572 - DNA, 19 bp, Homo sapiens
aagtttacattgtaaatag

SEQ ID NO: 154573 - DNA, 23 bp, Homo sapiens
aagtttctagctagaaatatgat

SEQ ID NO: 154574 - DNA, 20 bp, Homo sapiens
aagtttgagatcagcctggg

SEQ ID NO: 154575 - DNA, 22 bp, Homo sapiens
aataaaaaccaagaagatgtct

SEQ ID NO: 154576 - DNA, 19 bp, Homo sapiens
aataaaaactgactcctta

SEQ ID NO: 154577 - DNA, 18 bp, Homo sapiens
aataaaaaggcacctata

SEQ ID NO: 154578 - DNA, 22 bp, Homo sapiens
aataaaaatattgtgttgtgaa

SEQ ID NO: 154579 - DNA, 22 bp, Homo sapiens
aataaaacctttcaaatttcac

SEQ ID NO: 154580 - DNA, 16 bp, Homo sapiens
aataaaatcttgaaaa

SEQ ID NO: 154581 - DNA, 23 bp, Homo sapiens
aataaaattaaagctgaaaactg

SEQ ID NO: 154582 - DNA, 15 bp, Homo sapiens
aataaaattgcactt

SEQ ID NO: 154583 - DNA, 20 bp, Homo sapiens
aataaacctcaaaatgtcta

SEQ ID NO: 154584 - DNA, 15 bp, Homo sapiens
aataaagtatatata

SEQ ID NO: 154585 - DNA, 19 bp, Homo sapiens
aataaatatatataaacct

SEQ ID NO: 154586 - DNA, 16 bp, Homo sapiens
aataaatcataaaact

SEQ ID NO: 154587 - DNA, 21 bp, Homo sapiens
aataaatgtgccttcattttt

SEQ ID NO: 154588 - DNA, 18 bp, Homo sapiens
aataaatttggttctaat

SEQ ID NO: 154589 - DNA, 20 bp, Homo sapiens
aataacataatttgtacata

SEQ ID NO: 154590 - DNA, 19 bp, Homo sapiens
aataactagtgttgcttgg

SEQ ID NO: 154591 - DNA, 14 bp, Homo sapiens
aataactgtgaagt

SEQ ID NO: 154592 - DNA, 16 bp, Homo sapiens
aataactgtgaagttt

SEQ ID NO: 154593 - DNA, 15 bp, Homo sapiens
aataagagaaagaaa

SEQ ID NO: 154594 - DNA, 16 bp, Homo sapiens
aataaggtcaatgcca

SEQ ID NO: 154595 - DNA, 18 bp, Homo sapiens
aataataaagatgctctt

SEQ ID NO: 154596 - DNA, 19 bp, Homo sapiens
aataataaagatgctcttt

SEQ ID NO: 154597 - DNA, 14 bp, Homo sapiens
aataataaatattt

SEQ ID NO: 154598 - DNA, 11 bp, Homo sapiens
aataataaatc

SEQ ID NO: 154599 - DNA, 11 bp, Homo sapiens
aataatatgca

SEQ ID NO: 154600 - DNA, 17 bp, Homo sapiens
aataatatgcattgtca

SEQ ID NO: 154601 - DNA, 13 bp, Homo sapiens
aataatcggccca

SEQ ID NO: 154602 - DNA, 16 bp, Homo sapiens
aataatcggcccacag

SEQ ID NO: 154603 - DNA, 22 bp, Homo sapiens
aataatgaatggactcaaactg

SEQ ID NO: 154604 - DNA, 19 bp, Homo sapiens
aataatgtacatctggcct

SEQ ID NO: 154605 - DNA, 21 bp, Homo sapiens
aataattttaagaaatcaaag

SEQ ID NO: 154606 - DNA, 16 bp, Homo sapiens
aatacacgaggtatga

SEQ ID NO: 154607 - DNA, 18 bp, Homo sapiens
aatacagtacaggcagca

SEQ ID NO: 154608 - DNA, 12 bp, Homo sapiens
aatacagtgtta

SEQ ID NO: 154609 - DNA, 13 bp, Homo sapiens
aatacatgcatct

SEQ ID NO: 154610 - DNA, 18 bp, Homo sapiens
aataccatgccatttaaa

SEQ ID NO: 154611 - DNA, 22 bp, Homo sapiens
aatactctaccctcttagaaaa

SEQ ID NO: 154612 - DNA, 13 bp, Homo sapiens
aatagaaactcac

SEQ ID NO: 154613 - DNA, 20 bp, Homo sapiens
aatagagcaaaattgatgtg

SEQ ID NO: 154614 - DNA, 22 bp, Homo sapiens
aatagagcaaaattgatgtgtt

SEQ ID NO: 154615 - DNA, 18 bp, Homo sapiens
aatagagtatatgcactt

SEQ ID NO: 154616 - DNA, 14 bp, Homo sapiens
aatagcttgtatag

SEQ ID NO: 154617 - DNA, 20 bp, Homo sapiens
aatagtatttgagagttcta

SEQ ID NO: 154618 - DNA, 20 bp, Homo sapiens
aatagttttattaataaaca

SEQ ID NO: 154619 - DNA, 13 bp, Homo sapiens
aatataagaataa

SEQ ID NO: 154620 - DNA, 14 bp, Homo sapiens
aatatataaatata

SEQ ID NO: 154621 - DNA, 13 bp, Homo sapiens
aatatatataaac

SEQ ID NO: 154622 - DNA, 22 bp, Homo sapiens
aatatatcccagaaattagaaa

SEQ ID NO: 154623 - DNA, 14 bp, Homo sapiens
aatatatggcagag

SEQ ID NO: 154624 - DNA, 21 bp, Homo sapiens
aatatatggcagagttgtaaa

SEQ ID NO: 154625 - DNA, 20 bp, Homo sapiens
aatatatttaagataattat

SEQ ID NO: 154626 - DNA, 19 bp, Homo sapiens
aatatatttttatatttag

SEQ ID NO: 154627 - DNA, 19 bp, Homo sapiens
aatatcagttactcagccc

SEQ ID NO: 154628 - DNA, 13 bp, Homo sapiens
aatatcatttatt

SEQ ID NO: 154629 - DNA, 17 bp, Homo sapiens
aatatccctacatgtat

SEQ ID NO: 154630 - DNA, 19 bp, Homo sapiens
aatatccctacatgtattg

SEQ ID NO: 154631 - DNA, 16 bp, Homo sapiens
aatatgacagctgtcc

SEQ ID NO: 154632 - DNA, 19 bp, Homo sapiens
aatatgattagtaaagaaa

SEQ ID NO: 154633 - DNA, 12 bp, Homo sapiens
aatatgatttta

SEQ ID NO: 154634 - DNA, 14 bp, Homo sapiens
aatatggaacttct

SEQ ID NO: 154635 - DNA, 14 bp, Homo sapiens
aatattatgtgttt

SEQ ID NO: 154636 - DNA, 23 bp, Homo sapiens
aatattgtgaagaaaaataaagt

SEQ ID NO: 154637 - DNA, 18 bp, Homo sapiens
aatattgtgttgtgaatg

SEQ ID NO: 154638 - DNA, 17 bp, Homo sapiens
aatatttaaacagcagt

SEQ ID NO: 154639 - DNA, 19 bp, Homo sapiens
aatatttatgtctatttaa

SEQ ID NO: 154640 - DNA, 21 bp, Homo sapiens
aatatttatgtctatttaagc

SEQ ID NO: 154641 - DNA, 23 bp, Homo sapiens
aatatttatgtctatttaagcct

SEQ ID NO: 154642 - DNA, 16 bp, Homo sapiens
aatatttattacctct

SEQ ID NO: 154643 - DNA, 17 bp, Homo sapiens
aatatttattacctctg

SEQ ID NO: 154644 - DNA, 15 bp, Homo sapiens
aatattttaagtatt

SEQ ID NO: 154645 - DNA, 13 bp, Homo sapiens
aatattttgtcta

SEQ ID NO: 154646 - DNA, 15 bp, Homo sapiens
aatattttgtctaaa

SEQ ID NO: 154647 - DNA, 19 bp, Homo sapiens
aatattttgtctaaaatgc

SEQ ID NO: 154648 - DNA, 13 bp, Homo sapiens
aatatttttctta

SEQ ID NO: 154649 - DNA, 13 bp, Homo sapiens
aatcagacaaagt

SEQ ID NO: 154650 - DNA, 20 bp, Homo sapiens
aatcagaccctaccccacca

SEQ ID NO: 154651 - DNA, 12 bp, Homo sapiens
aatcagcctctt

SEQ ID NO: 154652 - DNA, 11 bp, Homo sapiens
aatcagcctgc

SEQ ID NO: 154653 - DNA, 13 bp, Homo sapiens
aatcagcctgctc

SEQ ID NO: 154654 - DNA, 18 bp, Homo sapiens
aatcagggaggtcatttt

SEQ ID NO: 154655 - DNA, 21 bp, Homo sapiens
aatcagtaatatttatatatt

SEQ ID NO: 154656 - DNA, 22 bp, Homo sapiens
aatcagtgtgtctaaatttgaa

SEQ ID NO: 154657 - DNA, 20 bp, Homo sapiens
aatcataagatatttttcat

SEQ ID NO: 154658 - DNA, 18 bp, Homo sapiens
aatcatataataaatgta

SEQ ID NO: 154659 - DNA, 12 bp, Homo sapiens
aatcatttctat

SEQ ID NO: 154660 - DNA, 23 bp, Homo sapiens
aatcattttatatgtcaaagcag

SEQ ID NO: 154661 - DNA, 17 bp, Homo sapiens
aatcccatttaaaaaaa

SEQ ID NO: 154662 - DNA, 14 bp, Homo sapiens
aatcccctcattca

SEQ ID NO: 154663 - DNA, 15 bp, Homo sapiens
aatcctgtcctcagc

SEQ ID NO: 154664 - DNA, 22 bp, Homo sapiens
aatcggatctggggctctggga

SEQ ID NO: 154665 - DNA, 17 bp, Homo sapiens
aatctaagtgatataaa

SEQ ID NO: 154666 - DNA, 17 bp, Homo sapiens
aatctaatattaaaaat

SEQ ID NO: 154667 - DNA, 20 bp, Homo sapiens
aatctaatattaaaaatatg

SEQ ID NO: 154668 - DNA, 16 bp, Homo sapiens
aatctacccaaaggat

SEQ ID NO: 154669 - DNA, 17 bp, Homo sapiens
aatctacccaaaggata

SEQ ID NO: 154670 - DNA, 17 bp, Homo sapiens
aatctattttgtaactt

SEQ ID NO: 154671 - DNA, 20 bp, Homo sapiens
aatctctcggttccacgtcc

SEQ ID NO: 154672 - DNA, 14 bp, Homo sapiens
aatctgcagaagga

SEQ ID NO: 154673 - DNA, 23 bp, Homo sapiens
aatctgcagaaggaaaaatgtgt

SEQ ID NO: 154674 - DNA, 17 bp, Homo sapiens
aatctggactcctctgt

SEQ ID NO: 154675 - DNA, 16 bp, Homo sapiens
aatctgggaagggaag

SEQ ID NO: 154676 - DNA, 13 bp, Homo sapiens
aatcttgaaaatg

SEQ ID NO: 154677 - DNA, 14 bp, Homo sapiens
aatctttattgaga

SEQ ID NO: 154678 - DNA, 15 bp, Homo sapiens
aatgaaaatgtcttg

SEQ ID NO: 154679 - DNA, 19 bp, Homo sapiens
aatgaaacactcagttgtt

SEQ ID NO: 154680 - DNA, 21 bp, Homo sapiens
aatgaaataatgtacatctgg

SEQ ID NO: 154681 - DNA, 17 bp, Homo sapiens
aatgaaatgctctcctt

SEQ ID NO: 154682 - DNA, 18 bp, Homo sapiens
aatgaaatgctctccttt

SEQ ID NO: 154683 - DNA, 14 bp, Homo sapiens
aatgaacaaattga

SEQ ID NO: 154684 - DNA, 11 bp, Homo sapiens
aatgaagaaag

SEQ ID NO: 154685 - DNA, 22 bp, Homo sapiens
aatgaaggttaggatttaacag

SEQ ID NO: 154686 - DNA, 21 bp, Homo sapiens
aatgaataataattatccaga

SEQ ID NO: 154687 - DNA, 13 bp, Homo sapiens
aatgacaacagaa

SEQ ID NO: 154688 - DNA, 15 bp, Homo sapiens
aatgacaacagaagc

SEQ ID NO: 154689 - DNA, 18 bp, Homo sapiens
aatgaccagtaattgtga

SEQ ID NO: 154690 - DNA, 19 bp, Homo sapiens
aatgaccagtaattgtgaa

SEQ ID NO: 154691 - DNA, 20 bp, Homo sapiens
aatgactcagaatattgctt

SEQ ID NO: 154692 - DNA, 13 bp, Homo sapiens
aatgagcctggca

SEQ ID NO: 154693 - DNA, 21 bp, Homo sapiens
aatgagtttttatggggctga

SEQ ID NO: 154694 - DNA, 21 bp, Homo sapiens
aatgatgatcctaggcatttg

SEQ ID NO: 154695 - DNA, 22 bp, Homo sapiens
aatgatggacccaatgcacaca

SEQ ID NO: 154696 - DNA, 15 bp, Homo sapiens
aatgcacacaaaaca

SEQ ID NO: 154697 - DNA, 17 bp, Homo sapiens
aatgcacacaaaacaac

SEQ ID NO: 154698 - DNA, 16 bp, Homo sapiens
aatgcataaaatgtta

SEQ ID NO: 154699 - DNA, 16 bp, Homo sapiens
aatgcccttaaatcat

SEQ ID NO: 154700 - DNA, 20 bp, Homo sapiens
aatgctaaagaaaaagtcat

SEQ ID NO: 154701 - DNA, 13 bp, Homo sapiens
aatgctctccttt

SEQ ID NO: 154702 - DNA, 17 bp, Homo sapiens
aatgctgtcaactatga

SEQ ID NO: 154703 - DNA, 13 bp, Homo sapiens
aatgctgtgttaa

SEQ ID NO: 154704 - DNA, 14 bp, Homo sapiens
aatgctttttgaat

SEQ ID NO: 154705 - DNA, 17 bp, Homo sapiens
aatgctttttgaatgtt

SEQ ID NO: 154706 - DNA, 13 bp, Homo sapiens
aatggaaaggaga

SEQ ID NO: 154707 - DNA, 15 bp, Homo sapiens
aatggaaaggagagg

SEQ ID NO: 154708 - DNA, 14 bp, Homo sapiens
aatggactcaaact

SEQ ID NO: 154709 - DNA, 16 bp, Homo sapiens
aatggtataaatttca

SEQ ID NO: 154710 - DNA, 19 bp, Homo sapiens
aatgtaatcaatgtttctt

SEQ ID NO: 154711 - DNA, 21 bp, Homo sapiens
aatgtatatgttttgtgggaa

SEQ ID NO: 154712 - DNA, 15 bp, Homo sapiens
aatgtcaccaccttc

SEQ ID NO: 154713 - DNA, 16 bp, Homo sapiens
aatgtcaccaccttcc

SEQ ID NO: 154714 - DNA, 20 bp, Homo sapiens
aatgtcaccaccttcccagc

SEQ ID NO: 154715 - DNA, 17 bp, Homo sapiens
aatgtcatcagaacttt

SEQ ID NO: 154716 - DNA, 22 bp, Homo sapiens
aatgtctagttgtaacaccatg

SEQ ID NO: 154717 - DNA, 17 bp, Homo sapiens
aatgtgaaaagaaaaat

SEQ ID NO: 154718 - DNA, 16 bp, Homo sapiens
aatcagcctcttaaag

SEQ ID NO: 154719 - DNA, 18 bp, Homo sapiens
aatcagcctgctccagct

SEQ ID NO: 154720 - DNA, 19 bp, Homo sapiens
aatcagggaggtcattttg

SEQ ID NO: 154721 - DNA, 17 bp, Homo sapiens
aatcagtgtgtctaaat

SEQ ID NO: 154722 - DNA, 18 bp, Homo sapiens
aatcagtgtgtctaaatt

SEQ ID NO: 154723 - DNA, 23 bp, Homo sapiens
aatcataagatatttttcatgat

SEQ ID NO: 154724 - DNA, 21 bp, Homo sapiens
aatcatataataaatgtacat

SEQ ID NO: 154725 - DNA, 15 bp, Homo sapiens
aatcatccaatgctc

SEQ ID NO: 154726 - DNA, 18 bp, Homo sapiens
aatcatctgtgtgaaaat

SEQ ID NO: 154727 - DNA, 16 bp, Homo sapiens
aatcatgaaatatgca

SEQ ID NO: 154728 - DNA, 19 bp, Homo sapiens
aatcatttctatttctcct

SEQ ID NO: 154729 - DNA, 14 bp, Homo sapiens
aatcatttgctttt

SEQ ID NO: 154730 - DNA, 15 bp, Homo sapiens
aatcattttaattat

SEQ ID NO: 154731 - DNA, 16 bp, Homo sapiens
aatcattttaattatt

SEQ ID NO: 154732 - DNA, 19 bp, Homo sapiens
aatcattttaattattatt

SEQ ID NO: 154733 - DNA, 19 bp, Homo sapiens
aatcattttgcctcttttc

SEQ ID NO: 154734 - DNA, 22 bp, Homo sapiens
aatccaagatattttaaaatct

SEQ ID NO: 154735 - DNA, 15 bp, Homo sapiens
aatccatgcttgggt

SEQ ID NO: 154736 - DNA, 18 bp, Homo sapiens
aatcccagctactcagga

SEQ ID NO: 154737 - DNA, 13 bp, Homo sapiens
aatccctgtttaa

SEQ ID NO: 154738 - DNA, 14 bp, Homo sapiens
aatccctgtttaat

SEQ ID NO: 154739 - DNA, 17 bp, Homo sapiens
aatccctgtttaatatt

SEQ ID NO: 154740 - DNA, 21 bp, Homo sapiens
aatccgaccactaattgccaa

SEQ ID NO: 154741 - DNA, 15 bp, Homo sapiens
aatcctaaaagaagc

SEQ ID NO: 154742 - DNA, 18 bp, Homo sapiens
aatcctgtcctcagcttc

SEQ ID NO: 154743 - DNA, 21 bp, Homo sapiens
aatcggatctggggctctggg

SEQ ID NO: 154744 - DNA, 20 bp, Homo sapiens
aatctaaccacatcaatatt

SEQ ID NO: 154745 - DNA, 16 bp, Homo sapiens
aatctaatattaaaaa

SEQ ID NO: 154746 - DNA, 22 bp, Homo sapiens
aatctcaccccatcccacaccc

SEQ ID NO: 154747 - DNA, 17 bp, Homo sapiens
aatctgcagaaggaaaa

SEQ ID NO: 154748 - DNA, 16 bp, Homo sapiens
aatctggactcctctg

SEQ ID NO: 154749 - DNA, 22 bp, Homo sapiens
aatcttgactacagtcaggaaa

SEQ ID NO: 154750 - DNA, 21 bp, Homo sapiens
aatctttagagaagtatacat

SEQ ID NO: 154751 - DNA, 22 bp, Homo sapiens
aatctttagagaagtatacata

SEQ ID NO: 154752 - DNA, 14 bp, Homo sapiens
aatgaaaaaatgta

SEQ ID NO: 154753 - DNA, 17 bp, Homo sapiens
aatgaaacattttgtca

SEQ ID NO: 154754 - DNA, 14 bp, Homo sapiens
aatgaactgaagtt

SEQ ID NO: 154755 - DNA, 22 bp, Homo sapiens
aatgaaggtgtcagaataataa

SEQ ID NO: 154756 - DNA, 21 bp, Homo sapiens
aatgaaggttaggatttaaca

SEQ ID NO: 154757 - DNA, 14 bp, Homo sapiens
aatgaatgaaacat

SEQ ID NO: 154758 - DNA, 15 bp, Homo sapiens
aatgaatgaatgaat

SEQ ID NO: 154759 - DNA, 22 bp, Homo sapiens
aatgacatctcaggggccagag

SEQ ID NO: 154760 - DNA, 17 bp, Homo sapiens
aatgagaaggaatttga

SEQ ID NO: 154761 - DNA, 18 bp, Homo sapiens
aatgagagaataagtcat

SEQ ID NO: 154762 - DNA, 14 bp, Homo sapiens
aatgagcctggcaa

SEQ ID NO: 154763 - DNA, 15 bp, Homo sapiens
aatgagcctggcaag

SEQ ID NO: 154764 - DNA, 13 bp, Homo sapiens
aatgaggaatgta

SEQ ID NO: 154765 - DNA, 16 bp, Homo sapiens
aatgaggacatgtttt

SEQ ID NO: 154766 - DNA, 12 bp, Homo sapiens
aatgaggaggaa

SEQ ID NO: 154767 - DNA, 18 bp, Homo sapiens
aatgataagtaaatgcta

SEQ ID NO: 154768 - DNA, 21 bp, Homo sapiens
aatgataagtaaatgctaggt

SEQ ID NO: 154769 - DNA, 13 bp, Homo sapiens
aatgattgtaaaa

SEQ ID NO: 154770 - DNA, 16 bp, Homo sapiens
aatgatttcattcaat

SEQ ID NO: 154771 - DNA, 14 bp, Homo sapiens
aatgatttttagat

SEQ ID NO: 154772 - DNA, 20 bp, Homo sapiens
aatgcaaacacacaaaggta

SEQ ID NO: 154773 - DNA, 21 bp, Homo sapiens
aatgcaagattttccacaaga

SEQ ID NO: 154774 - DNA, 17 bp, Homo sapiens
aatgcaagctagtggct

SEQ ID NO: 154775 - DNA, 19 bp, Homo sapiens
aatgcatccattcctcagg

SEQ ID NO: 154776 - DNA, 23 bp, Homo sapiens
aatgccagtaacgcgtcttcctg

SEQ ID NO: 154777 - DNA, 21 bp, Homo sapiens
aatgcctcagtgtatttgtat

SEQ ID NO: 154778 - DNA, 23 bp, Homo sapiens
aatgcctcagtgtatttgtattt

SEQ ID NO: 154779 - DNA, 21 bp, Homo sapiens
aatgctaggttaattccaatt

SEQ ID NO: 154780 - DNA, 22 bp, Homo sapiens
aatgctgtattagtcacagaga

SEQ ID NO: 154781 - DNA, 12 bp, Homo sapiens
aatgctgtgtta

SEQ ID NO: 154782 - DNA, 16 bp, Homo sapiens
aatgctgttgcctcat

SEQ ID NO: 154783 - DNA, 21 bp, Homo sapiens
aatgcttctgacttcatagat

SEQ ID NO: 154784 - DNA, 17 bp, Homo sapiens
aatgcttggcttctcat

SEQ ID NO: 154785 - DNA, 20 bp, Homo sapiens
aatggaaggtttgtatattg

SEQ ID NO: 154786 - DNA, 19 bp, Homo sapiens
aatggagtcagtttgcagt

SEQ ID NO: 154787 - DNA, 22 bp, Homo sapiens
aatggtgaaaataaaataaagc

SEQ ID NO: 154788 - DNA, 22 bp, Homo sapiens
aatggtggggaactataaagaa

SEQ ID NO: 154789 - DNA, 17 bp, Homo sapiens
aatggttgactgggttt

SEQ ID NO: 154790 - DNA, 18 bp, Homo sapiens
aatggttgccttaaagaa

SEQ ID NO: 154791 - DNA, 16 bp, Homo sapiens
aatggtttaaatggtc

SEQ ID NO: 154792 - DNA, 15 bp, Homo sapiens
aatgtaatgatcata

SEQ ID NO: 154793 - DNA, 19 bp, Homo sapiens
aatttttaaagtatatatt

SEQ ID NO: 154794 - DNA, 17 bp, Homo sapiens
aatttttattaaattat

SEQ ID NO: 154795 - DNA, 20 bp, Homo sapiens
aatttttttaaccaaaggtg

SEQ ID NO: 154796 - DNA, 13 bp, Homo sapiens
acaaaaaaatata

SEQ ID NO: 154797 - DNA, 16 bp, Homo sapiens
acaaaaaaatctgcag

SEQ ID NO: 154798 - DNA, 15 bp, Homo sapiens
acaaaaacacagcaa

SEQ ID NO: 154799 - DNA, 21 bp, Homo sapiens
acaaaaacagcctcacagaag

SEQ ID NO: 154800 - DNA, 16 bp, Homo sapiens
acaaaaagaacaaaaa

SEQ ID NO: 154801 - DNA, 20 bp, Homo sapiens
acaaaaaggttctcaggtgt

SEQ ID NO: 154802 - DNA, 14 bp, Homo sapiens
acaaaaattaaaat

SEQ ID NO: 154803 - DNA, 17 bp, Homo sapiens
acaaaacaaccctagag

SEQ ID NO: 154804 - DNA, 14 bp, Homo sapiens
acaaaacttttcta

SEQ ID NO: 154805 - DNA, 22 bp, Homo sapiens
acaaaataaccaatcctggaca

SEQ ID NO: 154806 - DNA, 14 bp, Homo sapiens
acaaaccagaagca

SEQ ID NO: 154807 - DNA, 16 bp, Homo sapiens
acaaactacatgtaat

SEQ ID NO: 154808 - DNA, 18 bp, Homo sapiens
acaaagtgtgtattaaaa

SEQ ID NO: 154809 - DNA, 17 bp, Homo sapiens
acaaatactcttaggaa

SEQ ID NO: 154810 - DNA, 23 bp, Homo sapiens
acaaatactcttaggaagagaaa

SEQ ID NO: 154811 - DNA, 14 bp, Homo sapiens
acaaatctatgcca

SEQ ID NO: 154812 - DNA, 15 bp, Homo sapiens
acaaatctatgccac

SEQ ID NO: 154813 - DNA, 21 bp, Homo sapiens
acaaatctatgccactcagaa

SEQ ID NO: 154814 - DNA, 20 bp, Homo sapiens
acaaatgccacacatcaccc

SEQ ID NO: 154815 - DNA, 22 bp, Homo sapiens
acaaattgaactctttgaatga

SEQ ID NO: 154816 - DNA, 19 bp, Homo sapiens
acaaatttacagagacaga

SEQ ID NO: 154817 - DNA, 18 bp, Homo sapiens
acaactatgatttggaaa

SEQ ID NO: 154818 - DNA, 17 bp, Homo sapiens
acaacttcaatatccaa

SEQ ID NO: 154819 - DNA, 14 bp, Homo sapiens
acaacttcagcagt

SEQ ID NO: 154820 - DNA, 18 bp, Homo sapiens
acaacttcccagtgaatt

SEQ ID NO: 154821 - DNA, 21 bp, Homo sapiens
acaagaaatccctgtttaata

SEQ ID NO: 154822 - DNA, 23 bp, Homo sapiens
acaagaaatccctgtttaatatt

SEQ ID NO: 154823 - DNA, 15 bp, Homo sapiens
acaagaaatgaaagc

SEQ ID NO: 154824 - DNA, 16 bp, Homo sapiens
acaagaaatgaaagca

SEQ ID NO: 154825 - DNA, 15 bp, Homo sapiens
acaagaactgaaacc

SEQ ID NO: 154826 - DNA, 22 bp, Homo sapiens
acaagagtttatttccaaataa

SEQ ID NO: 154827 - DNA, 14 bp, Homo sapiens
acaagattcccaga

SEQ ID NO: 154828 - DNA, 11 bp, Homo sapiens
acaagcagagg

SEQ ID NO: 154829 - DNA, 14 bp, Homo sapiens
acaagctaaaatta

SEQ ID NO: 154830 - DNA, 21 bp, Homo sapiens
acaagctgcaccctcaggcag

SEQ ID NO: 154831 - DNA, 22 bp, Homo sapiens
acaagctgcaccctcaggcagg

SEQ ID NO: 154832 - DNA, 23 bp, Homo sapiens
acaagctgcaccctcaggcaggt

SEQ ID NO: 154833 - DNA, 17 bp, Homo sapiens
acaaggctagatcatga

SEQ ID NO: 154834 - DNA, 17 bp, Homo sapiens
acaagggtctagggaga

SEQ ID NO: 154835 - DNA, 20 bp, Homo sapiens
acaagggtctagggagagac

SEQ ID NO: 154836 - DNA, 22 bp, Homo sapiens
acaaggtagccctggccagagg

SEQ ID NO: 154837 - DNA, 16 bp, Homo sapiens
acaagtcctgtgaatt

SEQ ID NO: 154838 - DNA, 14 bp, Homo sapiens
acaagtgctgaaca

SEQ ID NO: 154839 - DNA, 18 bp, Homo sapiens
acaagtgtatatcagaaa

SEQ ID NO: 154840 - DNA, 15 bp, Homo sapiens
acaagttaaataaat

SEQ ID NO: 154841 - DNA, 12 bp, Homo sapiens
acaataatttca

SEQ ID NO: 154842 - DNA, 18 bp, Homo sapiens
acaatcatgaaatatgca

SEQ ID NO: 154843 - DNA, 18 bp, Homo sapiens
acaatgaagataaaaaga

SEQ ID NO: 154844 - DNA, 14 bp, Homo sapiens
acaattccaaagga

SEQ ID NO: 154845 - DNA, 18 bp, Homo sapiens
acaattccaaaggaatct

SEQ ID NO: 154846 - DNA, 23 bp, Homo sapiens
acaattcctctactaacaatcag

SEQ ID NO: 154847 - DNA, 20 bp, Homo sapiens
acaattgtaaaactgaggca

SEQ ID NO: 154848 - DNA, 19 bp, Homo sapiens
acaatttacaaagtgtgta

SEQ ID NO: 154849 - DNA, 17 bp, Homo sapiens
acaatttcctttatatt

SEQ ID NO: 154850 - DNA, 23 bp, Homo sapiens
acaatttcctttatatttagtga

SEQ ID NO: 154851 - DNA, 22 bp, Homo sapiens
acacaagcttttttacacaaat

SEQ ID NO: 154852 - DNA, 22 bp, Homo sapiens
acacacaaaatgtacccagtat

SEQ ID NO: 154853 - DNA, 13 bp, Homo sapiens
acacacacacaca

SEQ ID NO: 154854 - DNA, 17 bp, Homo sapiens
acacacaccacacatac

SEQ ID NO: 154855 - DNA, 15 bp, Homo sapiens
acacaccacacatac

SEQ ID NO: 154856 - DNA, 20 bp, Homo sapiens
acacactcaaatcaagaaac

SEQ ID NO: 154857 - DNA, 20 bp, Homo sapiens
acacagctttatcaccagag

SEQ ID NO: 154858 - DNA, 19 bp, Homo sapiens
acacaggcaactgaggcag

SEQ ID NO: 154859 - DNA, 15 bp, Homo sapiens
acacagttgctgtca

SEQ ID NO: 154860 - DNA, 22 bp, Homo sapiens
acacagttgctgtcataagaat

SEQ ID NO: 154861 - DNA, 18 bp, Homo sapiens
acacatcacccttaccat

SEQ ID NO: 154862 - DNA, 22 bp, Homo sapiens
acacatcagcttgccctgttaa

SEQ ID NO: 154863 - DNA, 20 bp, Homo sapiens
acacatccctaatgtgtgcc

SEQ ID NO: 154864 - DNA, 16 bp, Homo sapiens
acaccacacccagcct

SEQ ID NO: 154865 - DNA, 17 bp, Homo sapiens
acaccaggagtccctgg

SEQ ID NO: 154866 - DNA, 12 bp, Homo sapiens
acacccagcctc

SEQ ID NO: 154867 - DNA, 13 bp, Homo sapiens
acacccagcctca

SEQ ID NO: 154868 - DNA, 23 bp, Homo sapiens
acacccagcctcagtcctcccct

SEQ ID NO: 154869 - DNA, 13 bp, Homo sapiens
acaccctcccccg

SEQ ID NO: 154870 - DNA, 19 bp, Homo sapiens
aatttgtaattgcttacat

SEQ ID NO: 154871 - DNA, 18 bp, Homo sapiens
aatttgttgaaattatgt

SEQ ID NO: 154872 - DNA, 13 bp, Homo sapiens
aattttaatgcta

SEQ ID NO: 154873 - DNA, 14 bp, Homo sapiens
aattttatccctca

SEQ ID NO: 154874 - DNA, 20 bp, Homo sapiens
aattttatccctcacctgta

SEQ ID NO: 154875 - DNA, 21 bp, Homo sapiens
aattttgaataaataaatgta

SEQ ID NO: 154876 - DNA, 14 bp, Homo sapiens
aattttgatgaaca

SEQ ID NO: 154877 - DNA, 20 bp, Homo sapiens
aatttttaaagtatatattt

SEQ ID NO: 154878 - DNA, 15 bp, Homo sapiens
aatttttatttttct

SEQ ID NO: 154879 - DNA, 19 bp, Homo sapiens
aatttttttcaatatttat

SEQ ID NO: 154880 - DNA, 21 bp, Homo sapiens
acaaaaatgtaatgatcataa

SEQ ID NO: 154881 - DNA, 12 bp, Homo sapiens
acaaaatagaag

SEQ ID NO: 154882 - DNA, 20 bp, Homo sapiens
acaaaatgtagggttataat

SEQ ID NO: 154883 - DNA, 21 bp, Homo sapiens
acaaaccgagtgcaatgaatg

SEQ ID NO: 154884 - DNA, 17 bp, Homo sapiens
acaaagccaacagtcaa

SEQ ID NO: 154885 - DNA, 16 bp, Homo sapiens
acaaagccagaagctg

SEQ ID NO: 154886 - DNA, 19 bp, Homo sapiens
acaaaggtataattttatg

SEQ ID NO: 154887 - DNA, 12 bp, Homo sapiens
acaaagtgtgta

SEQ ID NO: 154888 - DNA, 13 bp, Homo sapiens
acaaagtgtgtat

SEQ ID NO: 154889 - DNA, 15 bp, Homo sapiens
acaaagtgtgtatta

SEQ ID NO: 154890 - DNA, 19 bp, Homo sapiens
acaaagtgtgtattaaaaa

SEQ ID NO: 154891 - DNA, 15 bp, Homo sapiens
acaaagttgtatgtg

SEQ ID NO: 154892 - DNA, 14 bp, Homo sapiens
acaaatataagaat

SEQ ID NO: 154893 - DNA, 16 bp, Homo sapiens
acaaatataagaataa

SEQ ID NO: 154894 - DNA, 11 bp, Homo sapiens
acaaatatgca

SEQ ID NO: 154895 - DNA, 19 bp, Homo sapiens
acaaatatgcaaaaggttc

SEQ ID NO: 154896 - DNA, 18 bp, Homo sapiens
acaaattgcttgaaagaa

SEQ ID NO: 154897 - DNA, 13 bp, Homo sapiens
acaacagaagctt

SEQ ID NO: 154898 - DNA, 18 bp, Homo sapiens
acaaccttctgtggctca

SEQ ID NO: 154899 - DNA, 17 bp, Homo sapiens
acaacttcaagtgcatg

SEQ ID NO: 154900 - DNA, 15 bp, Homo sapiens
acaagaaatccctgt

SEQ ID NO: 154901 - DNA, 22 bp, Homo sapiens
acaagaaatgaaagcagggact

SEQ ID NO: 154902 - DNA, 20 bp, Homo sapiens
acaagaagccacagacctag

SEQ ID NO: 154903 - DNA, 16 bp, Homo sapiens
acaagacttcagtatg

SEQ ID NO: 154904 - DNA, 21 bp, Homo sapiens
acaagacttcagtatgttgtc

SEQ ID NO: 154905 - DNA, 16 bp, Homo sapiens
acaagagcgaaactcc

SEQ ID NO: 154906 - DNA, 15 bp, Homo sapiens
acaagattcccagag

SEQ ID NO: 154907 - DNA, 19 bp, Homo sapiens
acaagctgcaccctcaggc

SEQ ID NO: 154908 - DNA, 20 bp, Homo sapiens
acaagcttttttacacaaat

SEQ ID NO: 154909 - DNA, 21 bp, Homo sapiens
acaaggaagtcaaagcaagga

SEQ ID NO: 154910 - DNA, 17 bp, Homo sapiens
acaaggcattcaagtgt

SEQ ID NO: 154911 - DNA, 18 bp, Homo sapiens
acaagggtctagggagag

SEQ ID NO: 154912 - DNA, 19 bp, Homo sapiens
acaagggtctagggagaga

SEQ ID NO: 154913 - DNA, 23 bp, Homo sapiens
acaagtcataggttaatatttaa

SEQ ID NO: 154914 - DNA, 19 bp, Homo sapiens
acaagtgtatatcagaaaa

SEQ ID NO: 154915 - DNA, 12 bp, Homo sapiens
acaataaagaga

SEQ ID NO: 154916 - DNA, 18 bp, Homo sapiens
acaatcagctccttcctg

SEQ ID NO: 154917 - DNA, 22 bp, Homo sapiens
acaatcagctccttcctggaga

SEQ ID NO: 154918 - DNA, 18 bp, Homo sapiens
acaatcatttgctttttg

SEQ ID NO: 154919 - DNA, 15 bp, Homo sapiens
acaatgttcatccca

SEQ ID NO: 154920 - DNA, 17 bp, Homo sapiens
acaatttacaaagtgtg

SEQ ID NO: 154921 - DNA, 20 bp, Homo sapiens
acaatttacaaagtgtgtat

SEQ ID NO: 154922 - DNA, 23 bp, Homo sapiens
acaatttacaaagtgtgtattaa

SEQ ID NO: 154923 - DNA, 18 bp, Homo sapiens
acacaaacgggctcagca

SEQ ID NO: 154924 - DNA, 16 bp, Homo sapiens
acacaagtcctgtgaa

SEQ ID NO: 154925 - DNA, 14 bp, Homo sapiens
acacacaacaatta

SEQ ID NO: 154926 - DNA, 15 bp, Homo sapiens
acacacacacacaca

SEQ ID NO: 154927 - DNA, 24 bp, Homo sapiens
acacacctgtagtcccagctactc

SEQ ID NO: 154928 - DNA, 15 bp, Homo sapiens
acacactcaaatcaa

SEQ ID NO: 154929 - DNA, 14 bp, Homo sapiens
acacactttttaag

SEQ ID NO: 154930 - DNA, 23 bp, Homo sapiens
acacagacattctgccaggcccc

SEQ ID NO: 154931 - DNA, 23 bp, Homo sapiens
acacagccgattcacctgagcag

SEQ ID NO: 154932 - DNA, 22 bp, Homo sapiens
acacagctgagagacttttaat

SEQ ID NO: 154933 - DNA, 21 bp, Homo sapiens
acacagctttatcaccagaga

SEQ ID NO: 154934 - DNA, 19 bp, Homo sapiens
accatcattggaaatgaaa

SEQ ID NO: 154935 - DNA, 15 bp, Homo sapiens
accatccctttttga

SEQ ID NO: 154936 - DNA, 13 bp, Homo sapiens
accatcctattta

SEQ ID NO: 154937 - DNA, 16 bp, Homo sapiens
accatcctatttaact

SEQ ID NO: 154938 - DNA, 16 bp, Homo sapiens
accatcctgcagcctc

SEQ ID NO: 154939 - DNA, 13 bp, Homo sapiens
accatctaatagc

SEQ ID NO: 154940 - DNA, 15 bp, Homo sapiens
accatgaaacaaagc

SEQ ID NO: 154941 - DNA, 15 bp, Homo sapiens
accatgaagacagga

SEQ ID NO: 154942 - DNA, 19 bp, Homo sapiens
accatgaagagatttttca

SEQ ID NO: 154943 - DNA, 20 bp, Homo sapiens
accatgaagagatttttcat

SEQ ID NO: 154944 - DNA, 22 bp, Homo sapiens
accatgattaaccacttcagct

SEQ ID NO: 154945 - DNA, 11 bp, Homo sapiens
accatgtacat

SEQ ID NO: 154946 - DNA, 18 bp, Homo sapiens
accatgtcagcaaaaagc

SEQ ID NO: 154947 - DNA, 13 bp, Homo sapiens
accatgtgcctga

SEQ ID NO: 154948 - DNA, 20 bp, Homo sapiens
accatgtttgagctcagacc

SEQ ID NO: 154949 - DNA, 20 bp, Homo sapiens
acccaaatgttcatcaatga

SEQ ID NO: 154950 - DNA, 13 bp, Homo sapiens
acccaactctcct

SEQ ID NO: 154951 - DNA, 16 bp, Homo sapiens
acccaagtgggggcag

SEQ ID NO: 154952 - DNA, 20 bp, Homo sapiens
acccacaaaagtacaattta

SEQ ID NO: 154953 - DNA, 15 bp, Homo sapiens
acccacaagaaatga

SEQ ID NO: 154954 - DNA, 16 bp, Homo sapiens
acccacccagcaccca

SEQ ID NO: 154955 - DNA, 11 bp, Homo sapiens
acccacctgct

SEQ ID NO: 154956 - DNA, 22 bp, Homo sapiens
acccacctgctgagagacccaa

SEQ ID NO: 154957 - DNA, 21 bp, Homo sapiens
acccagacagctccctctgcc

SEQ ID NO: 154958 - DNA, 17 bp, Homo sapiens
acccagcaactccaact

SEQ ID NO: 154959 - DNA, 19 bp, Homo sapiens
acccagcccattctctctc

SEQ ID NO: 154960 - DNA, 22 bp, Homo sapiens
acccagcccattctctctcctg

SEQ ID NO: 154961 - DNA, 23 bp, Homo sapiens
acccagcccattctctctcctgt

SEQ ID NO: 154962 - DNA, 17 bp, Homo sapiens
acccagccccttgagaa

SEQ ID NO: 154963 - DNA, 22 bp, Homo sapiens
acccagcctcagtcctcccctc

SEQ ID NO: 154964 - DNA, 23 bp, Homo sapiens
acccaggagatggaagttgcagt

SEQ ID NO: 154965 - DNA, 20 bp, Homo sapiens
acccaggaggtggaggttgc

SEQ ID NO: 154966 - DNA, 23 bp, Homo sapiens
acccaggaggtggaggttgcagt

SEQ ID NO: 154967 - DNA, 13 bp, Homo sapiens
acccagggcctgc

SEQ ID NO: 154968 - DNA, 14 bp, Homo sapiens
acccagggcctgca

SEQ ID NO: 154969 - DNA, 17 bp, Homo sapiens
acccagggcctgcagga

SEQ ID NO: 154970 - DNA, 13 bp, Homo sapiens
acccatctgcacc

SEQ ID NO: 154971 - DNA, 20 bp, Homo sapiens
acccatctgcacccccctgg

SEQ ID NO: 154972 - DNA, 20 bp, Homo sapiens
acccatgatgagctcctctt

SEQ ID NO: 154973 - DNA, 16 bp, Homo sapiens
acccatgtttctctgg

SEQ ID NO: 154974 - DNA, 14 bp, Homo sapiens
acccattttcacat

SEQ ID NO: 154975 - DNA, 15 bp, Homo sapiens
accccaaagcccctt

SEQ ID NO: 154976 - DNA, 12 bp, Homo sapiens
accccaccccct

SEQ ID NO: 154977 - DNA, 22 bp, Homo sapiens
accccacccccttcagtgccca

SEQ ID NO: 154978 - DNA, 13 bp, Homo sapiens
accccagcggctg

SEQ ID NO: 154979 - DNA, 21 bp, Homo sapiens
accccatagtgaccggctgct

SEQ ID NO: 154980 - DNA, 15 bp, Homo sapiens
acccccactccagct

SEQ ID NO: 154981 - DNA, 17 bp, Homo sapiens
acccccactctcattcc

SEQ ID NO: 154982 - DNA, 18 bp, Homo sapiens
acccccactctcattccc

SEQ ID NO: 154983 - DNA, 21 bp, Homo sapiens
acccccactctcattccccag

SEQ ID NO: 154984 - DNA, 22 bp, Homo sapiens
acccccactctcattccccagg

SEQ ID NO: 154985 - DNA, 19 bp, Homo sapiens
accccccagaacctgtcct

SEQ ID NO: 154986 - DNA, 12 bp, Homo sapiens
acccccctgggc

SEQ ID NO: 154987 - DNA, 14 bp, Homo sapiens
accccctccccagg

SEQ ID NO: 154988 - DNA, 20 bp, Homo sapiens
acccccttcagtgcccacca

SEQ ID NO: 154989 - DNA, 18 bp, Homo sapiens
accccgaccacctgccca

SEQ ID NO: 154990 - DNA, 22 bp, Homo sapiens
acccctaaagagatactttgat

SEQ ID NO: 154991 - DNA, 18 bp, Homo sapiens
acccctcactctggcctc

SEQ ID NO: 154992 - DNA, 17 bp, Homo sapiens
acccctcctcactggcc

SEQ ID NO: 154993 - DNA, 12 bp, Homo sapiens
acccctccttcc

SEQ ID NO: 154994 - DNA, 21 bp, Homo sapiens
acccctccttccttgaccagc

SEQ ID NO: 154995 - DNA, 23 bp, Homo sapiens
acccctccttccttgaccagcag

SEQ ID NO: 154996 - DNA, 19 bp, Homo sapiens
acccctggcttttcactgc

SEQ ID NO: 154997 - DNA, 20 bp, Homo sapiens
acccctggcttttcactgct

SEQ ID NO: 154998 - DNA, 15 bp, Homo sapiens
acccctgtcctcact

SEQ ID NO: 154999 - DNA, 19 bp, Homo sapiens
acccctgtcctcactgctc

SEQ ID NO: 155000 - DNA, 21 bp, Homo sapiens
acccctgtcctcactgctccc

SEQ ID NO: 155001 - DNA, 12 bp, Homo sapiens
acccctttcctg

SEQ ID NO: 155002 - DNA, 21 bp, Homo sapiens
acccgacagagggaagaaaag

SEQ ID NO: 155003 - DNA, 13 bp, Homo sapiens
acccgaggaaact

SEQ ID NO: 155004 - DNA, 15 bp, Homo sapiens
acccggaggggcctg

SEQ ID NO: 155005 - DNA, 21 bp, Homo sapiens
acccggaggggcctggcagcc

SEQ ID NO: 155006 - DNA, 17 bp, Homo sapiens
acccgggaggcagaggt

SEQ ID NO: 155007 - DNA, 18 bp, Homo sapiens
accctcagagccacccct

SEQ ID NO: 155008 - DNA, 16 bp, Homo sapiens
accctcaggcaggtgg

SEQ ID NO: 155009 - DNA, 18 bp, Homo sapiens
accctgaaagccctgagc

SEQ ID NO: 155010 - DNA, 17 bp, Homo sapiens
accctgagctgaggcag

SEQ ID NO: 155011 - DNA, 14 bp, Homo sapiens
accctgccttatct

SEQ ID NO: 155012 - DNA, 11 bp, Homo sapiens
accctgtctct

SEQ ID NO: 155013 - DNA, 13 bp, Homo sapiens
acccttacagtag

SEQ ID NO: 155014 - DNA, 11 bp, Homo sapiens
acccttgacac

SEQ ID NO: 155015 - DNA, 21 bp, Homo sapiens
acccttggaggctgtcttctc

SEQ ID NO: 155016 - DNA, 17 bp, Homo sapiens
acccttggcttgcccac

SEQ ID NO: 155017 - DNA, 14 bp, Homo sapiens
accctttccttcct

SEQ ID NO: 155018 - DNA, 17 bp, Homo sapiens
accctttccttccttcc

SEQ ID NO: 155019 - DNA, 23 bp, Homo sapiens
accctttccttccttccctggct

SEQ ID NO: 155020 - DNA, 12 bp, Homo sapiens
accctttgcccc

SEQ ID NO: 155021 - DNA, 12 bp, Homo sapiens
accgaaacagcg

SEQ ID NO: 155022 - DNA, 16 bp, Homo sapiens
accgacgcgtctcctg

SEQ ID NO: 155023 - DNA, 21 bp, Homo sapiens
accgagtctcttctccactgg

SEQ ID NO: 155024 - DNA, 12 bp, Homo sapiens
accgcaggaagc

SEQ ID NO: 155025 - DNA, 13 bp, Homo sapiens
accgcaggaagct

SEQ ID NO: 155026 - DNA, 13 bp, Homo sapiens
accgcgttgtaaa

SEQ ID NO: 155027 - DNA, 15 bp, Homo sapiens
accgcgttgtaaaat

SEQ ID NO: 155028 - DNA, 14 bp, Homo sapiens
accggatcctgggt

SEQ ID NO: 155029 - DNA, 18 bp, Homo sapiens
accggcaatttccggcca

SEQ ID NO: 155030 - DNA, 14 bp, Homo sapiens
accggctgcttttc

SEQ ID NO: 155031 - DNA, 20 bp, Homo sapiens
accggctgcttttccctaag

SEQ ID NO: 155032 - DNA, 17 bp, Homo sapiens
accgtaataattattat

SEQ ID NO: 155033 - DNA, 12 bp, Homo sapiens
accgtcctcacc

SEQ ID NO: 155034 - DNA, 13 bp, Homo sapiens
acctaaaaaagat

SEQ ID NO: 155035 - DNA, 21 bp, Homo sapiens
acctaaaaggaaatctcaccc

SEQ ID NO: 155036 - DNA, 13 bp, Homo sapiens
acccaaaaggcag

SEQ ID NO: 155037 - DNA, 16 bp, Homo sapiens
acccaactctcctgga

SEQ ID NO: 155038 - DNA, 20 bp, Homo sapiens
acccaatgcacacaaaacaa

SEQ ID NO: 155039 - DNA, 21 bp, Homo sapiens
acccacaagaaatgaaagcag

SEQ ID NO: 155040 - DNA, 16 bp, Homo sapiens
acccacctcagcctcc

SEQ ID NO: 155041 - DNA, 13 bp, Homo sapiens
acccacctgctga

SEQ ID NO: 155042 - DNA, 17 bp, Homo sapiens
acccacctgctgagaga

SEQ ID NO: 155043 - DNA, 15 bp, Homo sapiens
acccagacagctccc

SEQ ID NO: 155044 - DNA, 22 bp, Homo sapiens
acccagacagctccctctgcct

SEQ ID NO: 155045 - DNA, 17 bp, Homo sapiens
acccagagaggaatcag

SEQ ID NO: 155046 - DNA, 14 bp, Homo sapiens
acccagcccattct

SEQ ID NO: 155047 - DNA, 20 bp, Homo sapiens
acccagccccttgagaaacc

SEQ ID NO: 155048 - DNA, 23 bp, Homo sapiens
acccagcctcagtcctcccctca

SEQ ID NO: 155049 - DNA, 11 bp, Homo sapiens
acccaggaggt

SEQ ID NO: 155050 - DNA, 21 bp, Homo sapiens
acccaggaggtggaggttgca

SEQ ID NO: 155051 - DNA, 12 bp, Homo sapiens
acccagggcctg

SEQ ID NO: 155052 - DNA, 15 bp, Homo sapiens
acccagggcctgcag

SEQ ID NO: 155053 - DNA, 16 bp, Homo sapiens
acccagtccacaaaat

SEQ ID NO: 155054 - DNA, 17 bp, Homo sapiens
acccagtccccgtgccc

SEQ ID NO: 155055 - DNA, 14 bp, Homo sapiens
acccagtccctggg

SEQ ID NO: 155056 - DNA, 15 bp, Homo sapiens
acccagtccctgggg

SEQ ID NO: 155057 - DNA, 15 bp, Homo sapiens
acccatcaacaaaaa

SEQ ID NO: 155058 - DNA, 18 bp, Homo sapiens
acccatgatgagctcctc

SEQ ID NO: 155059 - DNA, 17 bp, Homo sapiens
acccattcctatttctt

SEQ ID NO: 155060 - DNA, 16 bp, Homo sapiens
accccaaagccccttg

SEQ ID NO: 155061 - DNA, 18 bp, Homo sapiens
accccaaagccccttgct

SEQ ID NO: 155062 - DNA, 15 bp, Homo sapiens
accccaactccagta

SEQ ID NO: 155063 - DNA, 21 bp, Homo sapiens
accccacccccttcagtgccc

SEQ ID NO: 155064 - DNA, 13 bp, Homo sapiens
accccacccttcc

SEQ ID NO: 155065 - DNA, 19 bp, Homo sapiens
accccacccttcccctcct

SEQ ID NO: 155066 - DNA, 13 bp, Homo sapiens
accccagagtgtg

SEQ ID NO: 155067 - DNA, 20 bp, Homo sapiens
accccagctgtgagccttgg

SEQ ID NO: 155068 - DNA, 24 bp, Homo sapiens
accccagggcctgagcctggccag

SEQ ID NO: 155069 - DNA, 15 bp, Homo sapiens
accccatcccacacc

SEQ ID NO: 155070 - DNA, 23 bp, Homo sapiens
accccatgtcaccggatcctggg

SEQ ID NO: 155071 - DNA, 17 bp, Homo sapiens
acccccatttctattta

SEQ ID NO: 155072 - DNA, 16 bp, Homo sapiens
accccctcattgttta

SEQ ID NO: 155073 - DNA, 18 bp, Homo sapiens
acccccttcagtgcccac

SEQ ID NO: 155074 - DNA, 18 bp, Homo sapiens
acccccttctccatccac

SEQ ID NO: 155075 - DNA, 23 bp, Homo sapiens
accccgtctggggttcagcccct

SEQ ID NO: 155076 - DNA, 15 bp, Homo sapiens
acccctcactctggc

SEQ ID NO: 155077 - DNA, 15 bp, Homo sapiens
actcagaagcctctg

SEQ ID NO: 155078 - DNA, 19 bp, Homo sapiens
actcagacaggaaagggaa

SEQ ID NO: 155079 - DNA, 21 bp, Homo sapiens
actcagatggaaccgcaggaa

SEQ ID NO: 155080 - DNA, 22 bp, Homo sapiens
actcagatggaaccgcaggaag

SEQ ID NO: 155081 - DNA, 14 bp, Homo sapiens
actcagcagccctc

SEQ ID NO: 155082 - DNA, 22 bp, Homo sapiens
actcagcagccctcctcacccc

SEQ ID NO: 155083 - DNA, 23 bp, Homo sapiens
actcagcagccctcctcaccccg

SEQ ID NO: 155084 - DNA, 16 bp, Homo sapiens
actcagccctgggccc

SEQ ID NO: 155085 - DNA, 16 bp, Homo sapiens
actcaggatgcccagg

SEQ ID NO: 155086 - DNA, 18 bp, Homo sapiens
actcagggacagagccat

SEQ ID NO: 155087 - DNA, 20 bp, Homo sapiens
actcagggacagagccatgc

SEQ ID NO: 155088 - DNA, 15 bp, Homo sapiens
actcagggccccagc

SEQ ID NO: 155089 - DNA, 16 bp, Homo sapiens
actcagggctcctggg

SEQ ID NO: 155090 - DNA, 15 bp, Homo sapiens
actcagttttaacta

SEQ ID NO: 155091 - DNA, 22 bp, Homo sapiens
actcagttttaactagaattta

SEQ ID NO: 155092 - DNA, 12 bp, Homo sapiens
actcatcttagg

SEQ ID NO: 155093 - DNA, 20 bp, Homo sapiens
actcattttaaaaaatggaa

SEQ ID NO: 155094 - DNA, 18 bp, Homo sapiens
actccaaagaaatgtaag

SEQ ID NO: 155095 - DNA, 20 bp, Homo sapiens
actccaccaacccatcagaa

SEQ ID NO: 155096 - DNA, 21 bp, Homo sapiens
actccagacccctggcttttc

SEQ ID NO: 155097 - DNA, 12 bp, Homo sapiens
actccagcctgg

SEQ ID NO: 155098 - DNA, 19 bp, Homo sapiens
actccagtgccagcaatga

SEQ ID NO: 155099 - DNA, 14 bp, Homo sapiens
actccatcagctta

SEQ ID NO: 155100 - DNA, 21 bp, Homo sapiens
actcccttggtggcaagagcc

SEQ ID NO: 155101 - DNA, 22 bp, Homo sapiens
actcccttggtggcaagagccc

SEQ ID NO: 155102 - DNA, 15 bp, Homo sapiens
actccgtctcaagga

SEQ ID NO: 155103 - DNA, 16 bp, Homo sapiens
actccgtctcaaggaa

SEQ ID NO: 155104 - DNA, 13 bp, Homo sapiens
actccttcctgcc

SEQ ID NO: 155105 - DNA, 20 bp, Homo sapiens
actcgcttcccccatagcca

SEQ ID NO: 155106 - DNA, 14 bp, Homo sapiens
actctaccagactg

SEQ ID NO: 155107 - DNA, 13 bp, Homo sapiens
actctaccctctt

SEQ ID NO: 155108 - DNA, 21 bp, Homo sapiens
actctaccctcttagaaaaac

SEQ ID NO: 155109 - DNA, 21 bp, Homo sapiens
actctacttagcatgtcccta

SEQ ID NO: 155110 - DNA, 17 bp, Homo sapiens
actctatgttctaagaa

SEQ ID NO: 155111 - DNA, 18 bp, Homo sapiens
actctcaggatcaagaaa

SEQ ID NO: 155112 - DNA, 16 bp, Homo sapiens
actctcagtctctgag

SEQ ID NO: 155113 - DNA, 17 bp, Homo sapiens
actctcagtctctgagc

SEQ ID NO: 155114 - DNA, 18 bp, Homo sapiens
actctcagtctctgagca

SEQ ID NO: 155115 - DNA, 21 bp, Homo sapiens
actctcattccccaggtggct

SEQ ID NO: 155116 - DNA, 19 bp, Homo sapiens
actctccaacctggacaac

SEQ ID NO: 155117 - DNA, 19 bp, Homo sapiens
actctcctcggccccctcc

SEQ ID NO: 155118 - DNA, 20 bp, Homo sapiens
actctcctcggccccctcca

SEQ ID NO: 155119 - DNA, 22 bp, Homo sapiens
actctcctcggccccctccatc

SEQ ID NO: 155120 - DNA, 15 bp, Homo sapiens
actctcctggactgc

SEQ ID NO: 155121 - DNA, 16 bp, Homo sapiens
actctgcattctagta

SEQ ID NO: 155122 - DNA, 16 bp, Homo sapiens
actctgcctcctcttc

SEQ ID NO: 155123 - DNA, 9 bp, Homo sapiens
actctgctg

SEQ ID NO: 155124 - DNA, 20 bp, Homo sapiens
actctgctttgactgagcag

SEQ ID NO: 155125 - DNA, 19 bp, Homo sapiens
actctgggaaataagagag

SEQ ID NO: 155126 - DNA, 17 bp, Homo sapiens
actctgtctcagtccat

SEQ ID NO: 155127 - DNA, 19 bp, Homo sapiens
actcttcttaacttaaatt

SEQ ID NO: 155128 - DNA, 11 bp, Homo sapiens
actctttcaaa

SEQ ID NO: 155129 - DNA, 14 bp, Homo sapiens
actctttgtaagag

SEQ ID NO: 155130 - DNA, 19 bp, Homo sapiens
actctttttagggccaggc

SEQ ID NO: 155131 - DNA, 20 bp, Homo sapiens
actctttttagggccaggca

SEQ ID NO: 155132 - DNA, 13 bp, Homo sapiens
actgaacttcagg

SEQ ID NO: 155133 - DNA, 21 bp, Homo sapiens
actgaacttcaggataataaa

SEQ ID NO: 155134 - DNA, 17 bp, Homo sapiens
actgaagttaacagaga

SEQ ID NO: 155135 - DNA, 16 bp, Homo sapiens
actgaagtttcacatg

SEQ ID NO: 155136 - DNA, 16 bp, Homo sapiens
actgaatgctctgtgc

SEQ ID NO: 155137 - DNA, 22 bp, Homo sapiens
actgaatgcttctgacttcata

SEQ ID NO: 155138 - DNA, 22 bp, Homo sapiens
actgaattaatgacagagccag

SEQ ID NO: 155139 - DNA, 16 bp, Homo sapiens
actgacacccatgttt

SEQ ID NO: 155140 - DNA, 12 bp, Homo sapiens
actgacatgtgg

SEQ ID NO: 155141 - DNA, 18 bp, Homo sapiens
actgacatgtggggccag

SEQ ID NO: 155142 - DNA, 13 bp, Homo sapiens
actgaccagcctc

SEQ ID NO: 155143 - DNA, 20 bp, Homo sapiens
actgaccagcctccatgctg

SEQ ID NO: 155144 - DNA, 15 bp, Homo sapiens
actgactttatcctc

SEQ ID NO: 155145 - DNA, 18 bp, Homo sapiens
actgagagtgaacaaatt

SEQ ID NO: 155146 - DNA, 19 bp, Homo sapiens
actgagataccagcgagga

SEQ ID NO: 155147 - DNA, 22 bp, Homo sapiens
actgagatgtgaacacatcagc

SEQ ID NO: 155148 - DNA, 14 bp, Homo sapiens
actgagcagactgg

SEQ ID NO: 155149 - DNA, 20 bp, Homo sapiens
actgagccccgcagacctcc

SEQ ID NO: 155150 - DNA, 17 bp, Homo sapiens
actgagcttctctgtga

SEQ ID NO: 155151 - DNA, 15 bp, Homo sapiens
actgaggcagacagc

SEQ ID NO: 155152 - DNA, 14 bp, Homo sapiens
actgaggcagggaa

SEQ ID NO: 155153 - DNA, 12 bp, Homo sapiens
actgagggcagt

SEQ ID NO: 155154 - DNA, 23 bp, Homo sapiens
actgagggcagtcgatagagctg

SEQ ID NO: 155155 - DNA, 22 bp, Homo sapiens
actgaggggaggggagcatggg

SEQ ID NO: 155156 - DNA, 22 bp, Homo sapiens
actgatatatcatgagtgaata

SEQ ID NO: 155157 - DNA, 13 bp, Homo sapiens
actgatttcacaa

SEQ ID NO: 155158 - DNA, 20 bp, Homo sapiens
actgatttcacaacagatca

SEQ ID NO: 155159 - DNA, 14 bp, Homo sapiens
actgatttttgtga

SEQ ID NO: 155160 - DNA, 16 bp, Homo sapiens
actgcacagtgcatct

SEQ ID NO: 155161 - DNA, 23 bp, Homo sapiens
actgcacagtgcatctcagccca

SEQ ID NO: 155162 - DNA, 17 bp, Homo sapiens
actgcactccagcctgg

SEQ ID NO: 155163 - DNA, 20 bp, Homo sapiens
actgcactccagcctgggtg

SEQ ID NO: 155164 - DNA, 15 bp, Homo sapiens
actgcaggccccgct

SEQ ID NO: 155165 - DNA, 23 bp, Homo sapiens
actgcaggccccgcttgtccagc

SEQ ID NO: 155166 - DNA, 23 bp, Homo sapiens
actgcagggaaaattatttgcat

SEQ ID NO: 155167 - DNA, 13 bp, Homo sapiens
actgcagggccag

SEQ ID NO: 155168 - DNA, 15 bp, Homo sapiens
actgcagggccagga

SEQ ID NO: 155169 - DNA, 17 bp, Homo sapiens
actgcagggccaggact

SEQ ID NO: 155170 - DNA, 20 bp, Homo sapiens
actgcattaccgcgttgtaa

SEQ ID NO: 155171 - DNA, 21 bp, Homo sapiens
actgccaaagggaaatatcat

SEQ ID NO: 155172 - DNA, 14 bp, Homo sapiens
actgccaacctggg

SEQ ID NO: 155173 - DNA, 13 bp, Homo sapiens
actgccagcaacg

SEQ ID NO: 155174 - DNA, 13 bp, Homo sapiens
actgccataaaac

SEQ ID NO: 155175 - DNA, 14 bp, Homo sapiens
actgccatgccagc

SEQ ID NO: 155176 - DNA, 21 bp, Homo sapiens
actgccatggaggcacacagc

SEQ ID NO: 155177 - DNA, 22 bp, Homo sapiens
actgcccggcagggtcctagaa

SEQ ID NO: 155178 - DNA, 16 bp, Homo sapiens
actgcctactgcatcg

SEQ ID NO: 155179 - DNA, 18 bp, Homo sapiens
actgcctctccctggccc

SEQ ID NO: 155180 - DNA, 14 bp, Homo sapiens
actgcctcttcctc

SEQ ID NO: 155181 - DNA, 14 bp, Homo sapiens
actgcctgggctcc

SEQ ID NO: 155182 - DNA, 17 bp, Homo sapiens
actgccttgaatatccc

SEQ ID NO: 155183 - DNA, 23 bp, Homo sapiens
actgctacaaatactcttaggaa

SEQ ID NO: 155184 - DNA, 19 bp, Homo sapiens
actgctcatcattccttga

SEQ ID NO: 155185 - DNA, 20 bp, Homo sapiens
actgctccctgaagccagcc

SEQ ID NO: 155186 - DNA, 22 bp, Homo sapiens
actgctccctgaagccagcctt

SEQ ID NO: 155187 - DNA, 16 bp, Homo sapiens
actgctgcccagcctc

SEQ ID NO: 155188 - DNA, 18 bp, Homo sapiens
actgctgcccagcctcca

SEQ ID NO: 155189 - DNA, 13 bp, Homo sapiens
actgctgctgcct

SEQ ID NO: 155190 - DNA, 21 bp, Homo sapiens
actgctgtgctgtgcccaagt

SEQ ID NO: 155191 - DNA, 14 bp, Homo sapiens
actgcttgaggaaa

SEQ ID NO: 155192 - DNA, 15 bp, Homo sapiens
actgcttgaggaaaa

SEQ ID NO: 155193 - DNA, 18 bp, Homo sapiens
actgcttgaggaaaacaa

SEQ ID NO: 155194 - DNA, 12 bp, Homo sapiens
actggaactctc

SEQ ID NO: 155195 - DNA, 14 bp, Homo sapiens
acctttttatctcc

SEQ ID NO: 155196 - DNA, 12 bp, Homo sapiens
acgaaatgttat

SEQ ID NO: 155197 - DNA, 14 bp, Homo sapiens
acgaatacttttgc

SEQ ID NO: 155198 - DNA, 22 bp, Homo sapiens
acgaatacttttgccctttgat

SEQ ID NO: 155199 - DNA, 12 bp, Homo sapiens
acgactgtctcc

SEQ ID NO: 155200 - DNA, 14 bp, Homo sapiens
acgatgaaaaactt

SEQ ID NO: 155201 - DNA, 14 bp, Homo sapiens
acgatgtggccctg

SEQ ID NO: 155202 - DNA, 22 bp, Homo sapiens
acgatgtggccctggcctgctg

SEQ ID NO: 155203 - DNA, 19 bp, Homo sapiens
acgcacctcccatcctaat

SEQ ID NO: 155204 - DNA, 23 bp, Homo sapiens
acgcagccctgctttgggctgcc

SEQ ID NO: 155205 - DNA, 16 bp, Homo sapiens
acgcccatgtgtgagt

SEQ ID NO: 155206 - DNA, 15 bp, Homo sapiens
acgccctcccctccc

SEQ ID NO: 155207 - DNA, 19 bp, Homo sapiens
acgccctcccctcccctgc

SEQ ID NO: 155208 - DNA, 22 bp, Homo sapiens
acgccctcccctcccctgctgc

SEQ ID NO: 155209 - DNA, 14 bp, Homo sapiens
acgcctgcaaacgc

SEQ ID NO: 155210 - DNA, 19 bp, Homo sapiens
acgcctgcaaacgctgcct

SEQ ID NO: 155211 - DNA, 20 bp, Homo sapiens
acgcctgcaaacgctgcctg

SEQ ID NO: 155212 - DNA, 18 bp, Homo sapiens
acgcctgtaatcccagca

SEQ ID NO: 155213 - DNA, 14 bp, Homo sapiens
acgctgcctgcccg

SEQ ID NO: 155214 - DNA, 23 bp, Homo sapiens
acgctggtagagatggaggagga

SEQ ID NO: 155215 - DNA, 15 bp, Homo sapiens
acgctgtgggcaggt

SEQ ID NO: 155216 - DNA, 13 bp, Homo sapiens
acggaagttttca

SEQ ID NO: 155217 - DNA, 20 bp, Homo sapiens
acggaagttttcaatgatgg

SEQ ID NO: 155218 - DNA, 19 bp, Homo sapiens
acggacactcaaaagctgg

SEQ ID NO: 155219 - DNA, 15 bp, Homo sapiens
actgtcactgtttct

SEQ ID NO: 155220 - DNA, 20 bp, Homo sapiens
actgtcactgtttctctgct

SEQ ID NO: 155221 - DNA, 13 bp, Homo sapiens
actgtccagagag

SEQ ID NO: 155222 - DNA, 16 bp, Homo sapiens
actgtcccttgcctca

SEQ ID NO: 155223 - DNA, 20 bp, Homo sapiens
actgtctcaagagggcactg

SEQ ID NO: 155224 - DNA, 21 bp, Homo sapiens
actgtctcaagagggcactgg

SEQ ID NO: 155225 - DNA, 17 bp, Homo sapiens
actgtctggttttaaca

SEQ ID NO: 155226 - DNA, 16 bp, Homo sapiens
actgtgaagagaacca

SEQ ID NO: 155227 - DNA, 15 bp, Homo sapiens
actgtgcacatctgt

SEQ ID NO: 155228 - DNA, 21 bp, Homo sapiens
actgtgcacatctgtgtcttg

SEQ ID NO: 155229 - DNA, 15 bp, Homo sapiens
actgttccccctgtg

SEQ ID NO: 155230 - DNA, 23 bp, Homo sapiens
actgttgaaaattattttaaaca

SEQ ID NO: 155231 - DNA, 13 bp, Homo sapiens
actgtttctctgc

SEQ ID NO: 155232 - DNA, 14 bp, Homo sapiens
actgtttctctgct

SEQ ID NO: 155233 - DNA, 22 bp, Homo sapiens
actgtttgccttctacttttaa

SEQ ID NO: 155234 - DNA, 15 bp, Homo sapiens
acttaaaaaaatgac

SEQ ID NO: 155235 - DNA, 21 bp, Homo sapiens
acttaaaaatggtttaaatgg

SEQ ID NO: 155236 - DNA, 15 bp, Homo sapiens
acttaagagaatatt

SEQ ID NO: 155237 - DNA, 19 bp, Homo sapiens
acttagaaagcaggggcta

SEQ ID NO: 155238 - DNA, 17 bp, Homo sapiens
acttatatcatcagcat

SEQ ID NO: 155239 - DNA, 19 bp, Homo sapiens
acttatcctaaaacaaata

SEQ ID NO: 155240 - DNA, 14 bp, Homo sapiens
acttcacactgcaa

SEQ ID NO: 155241 - DNA, 16 bp, Homo sapiens
acttcacactgcaaga

SEQ ID NO: 155242 - DNA, 12 bp, Homo sapiens
acttcagacata

SEQ ID NO: 155243 - DNA, 13 bp, Homo sapiens
acttcagctctgt

SEQ ID NO: 155244 - DNA, 11 bp, Homo sapiens
acttcagctga

SEQ ID NO: 155245 - DNA, 14 bp, Homo sapiens
acttcaggctcttc

SEQ ID NO: 155246 - DNA, 17 bp, Homo sapiens
acttcaggctcttctcc

SEQ ID NO: 155247 - DNA, 15 bp, Homo sapiens
acttcattcttgaaa

SEQ ID NO: 155248 - DNA, 19 bp, Homo sapiens
acttcattcttgaaagctg

SEQ ID NO: 155249 - DNA, 21 bp, Homo sapiens
acttcattcttgaaagctgtg

SEQ ID NO: 155250 - DNA, 21 bp, Homo sapiens
acttccaaatcccctaagcag

SEQ ID NO: 155251 - DNA, 20 bp, Homo sapiens
acttcgggaggtcgaggcag

SEQ ID NO: 155252 - DNA, 22 bp, Homo sapiens
acttcgggaggtcgaggcagga

SEQ ID NO: 155253 - DNA, 18 bp, Homo sapiens
acttctaagtaaaaccac

SEQ ID NO: 155254 - DNA, 19 bp, Homo sapiens
acttctaagtaaaaccaca

SEQ ID NO: 155255 - DNA, 21 bp, Homo sapiens
acttctaagtaaaaccacagc

SEQ ID NO: 155256 - DNA, 14 bp, Homo sapiens
acttctgctttcca

SEQ ID NO: 155257 - DNA, 21 bp, Homo sapiens
acttgaacccatatttgtaca

SEQ ID NO: 155258 - DNA, 12 bp, Homo sapiens
acttgaagttgt

SEQ ID NO: 155259 - DNA, 19 bp, Homo sapiens
acttgacccccttgagggt

SEQ ID NO: 155260 - DNA, 19 bp, Homo sapiens
acttgagggcccagagcag

SEQ ID NO: 155261 - DNA, 19 bp, Homo sapiens
acttgcattgaatatatta

SEQ ID NO: 155262 - DNA, 22 bp, Homo sapiens
acttgctgcagtatgaaaataa

SEQ ID NO: 155263 - DNA, 14 bp, Homo sapiens
acttggagccaagg

SEQ ID NO: 155264 - DNA, 14 bp, Homo sapiens
acttggagccccag

SEQ ID NO: 155265 - DNA, 16 bp, Homo sapiens
acttggcaacagaagc

SEQ ID NO: 155266 - DNA, 15 bp, Homo sapiens
acttgggccactgtg

SEQ ID NO: 155267 - DNA, 23 bp, Homo sapiens
acttggggggctgaggtgggagg

SEQ ID NO: 155268 - DNA, 21 bp, Homo sapiens
acttggtgtcctttccctcca

SEQ ID NO: 155269 - DNA, 18 bp, Homo sapiens
acttggttgggtcctcac

SEQ ID NO: 155270 - DNA, 14 bp, Homo sapiens
actttaagcactac

SEQ ID NO: 155271 - DNA, 15 bp, Homo sapiens
actttaagcactaca

SEQ ID NO: 155272 - DNA, 16 bp, Homo sapiens
actttaagcactacat

SEQ ID NO: 155273 - DNA, 19 bp, Homo sapiens
actttacaatgttcatccc

SEQ ID NO: 155274 - DNA, 16 bp, Homo sapiens
actttagtctgcaaaa

SEQ ID NO: 155275 - DNA, 18 bp, Homo sapiens
actttagtctgcaaaatg

SEQ ID NO: 155276 - DNA, 22 bp, Homo sapiens
actttctatagcagattgtgta

SEQ ID NO: 155277 - DNA, 19 bp, Homo sapiens
actttctcttcatactttt

SEQ ID NO: 155278 - DNA, 14 bp, Homo sapiens
actttctgtaaact

SEQ ID NO: 155279 - DNA, 21 bp, Homo sapiens
actttcttttcgccgtggctg

SEQ ID NO: 155280 - DNA, 19 bp, Homo sapiens
actttcttttctggaatgt

SEQ ID NO: 155281 - DNA, 18 bp, Homo sapiens
actttgcactgatatatc

SEQ ID NO: 155282 - DNA, 21 bp, Homo sapiens
actttgcactgatatatcatg

SEQ ID NO: 155283 - DNA, 23 bp, Homo sapiens
actttgcagccggcacagggtct

SEQ ID NO: 155284 - DNA, 23 bp, Homo sapiens
agaaaaaatattttcctgccagg

SEQ ID NO: 155285 - DNA, 13 bp, Homo sapiens
agaaaaagaaaaa

SEQ ID NO: 155286 - DNA, 17 bp, Homo sapiens
agaaaaatgagcctggc

SEQ ID NO: 155287 - DNA, 20 bp, Homo sapiens
agaaaacggttaaaactgtc

SEQ ID NO: 155288 - DNA, 15 bp, Homo sapiens
agaaaactgaaaatc

SEQ ID NO: 155289 - DNA, 16 bp, Homo sapiens
agaaaactgaaaatct

SEQ ID NO: 155290 - DNA, 15 bp, Homo sapiens
agaaaagataaagat

SEQ ID NO: 155291 - DNA, 15 bp, Homo sapiens
agaaaagcacctgcc

SEQ ID NO: 155292 - DNA, 17 bp, Homo sapiens
agaaaataatcattctt

SEQ ID NO: 155293 - DNA, 20 bp, Homo sapiens
agaaaatattttgtctaaaa

SEQ ID NO: 155294 - DNA, 17 bp, Homo sapiens
agaaacaactctttgag

SEQ ID NO: 155295 - DNA, 20 bp, Homo sapiens
agaaacaactctttgagaaa

SEQ ID NO: 155296 - DNA, 14 bp, Homo sapiens
agaaacacaatatt

SEQ ID NO: 155297 - DNA, 17 bp, Homo sapiens
agaaacacactgaggca

SEQ ID NO: 155298 - DNA, 19 bp, Homo sapiens
agaaacacactgaggcagg

SEQ ID NO: 155299 - DNA, 22 bp, Homo sapiens
agaaacacactgaggcagggaa

SEQ ID NO: 155300 - DNA, 15 bp, Homo sapiens
agaaacataaataaa

SEQ ID NO: 155301 - DNA, 23 bp, Homo sapiens
agaaacataaataaaatgaccag

SEQ ID NO: 155302 - DNA, 14 bp, Homo sapiens
agaaaccctgtctc

SEQ ID NO: 155303 - DNA, 22 bp, Homo sapiens
agaaactcacccccaaggggca

SEQ ID NO: 155304 - DNA, 23 bp, Homo sapiens
agaaactcacccccaaggggcag

SEQ ID NO: 155305 - DNA, 13 bp, Homo sapiens
agaaactggaact

SEQ ID NO: 155306 - DNA, 20 bp, Homo sapiens
agaaactgtagtctcaggac

SEQ ID NO: 155307 - DNA, 20 bp, Homo sapiens
agaaagaaacccgacagagg

SEQ ID NO: 155308 - DNA, 22 bp, Homo sapiens
agaaagaaacccgacagaggga

SEQ ID NO: 155309 - DNA, 18 bp, Homo sapiens
agaaagactattcaaaca

SEQ ID NO: 155310 - DNA, 19 bp, Homo sapiens
agaaagactattcaaacag

SEQ ID NO: 155311 - DNA, 20 bp, Homo sapiens
agaaagtggaaaacaaggaa

SEQ ID NO: 155312 - DNA, 20 bp, Homo sapiens
agaaagtgggtgagatgctg

SEQ ID NO: 155313 - DNA, 16 bp, Homo sapiens
agaaataatatgcatt

SEQ ID NO: 155314 - DNA, 18 bp, Homo sapiens
agaaataccaaaattatt

SEQ ID NO: 155315 - DNA, 23 bp, Homo sapiens
agaaataccaaaattatttcaga

SEQ ID NO: 155316 - DNA, 22 bp, Homo sapiens
agaaatatgattttatttgaca

SEQ ID NO: 155317 - DNA, 17 bp, Homo sapiens
agaaatcaaagagagaa

SEQ ID NO: 155318 - DNA, 14 bp, Homo sapiens
agaaatgaaagcag

SEQ ID NO: 155319 - DNA, 14 bp, Homo sapiens
agaaattatttaat

SEQ ID NO: 155320 - DNA, 16 bp, Homo sapiens
agaaatttgatttcta

SEQ ID NO: 155321 - DNA, 21 bp, Homo sapiens
agaacacagccgattcacctg

SEQ ID NO: 155322 - DNA, 19 bp, Homo sapiens
agaacagataatcagtgtg

SEQ ID NO: 155323 - DNA, 18 bp, Homo sapiens
agaacagccgctcctgtc

SEQ ID NO: 155324 - DNA, 19 bp, Homo sapiens
agaacatccctgccagctc

SEQ ID NO: 155325 - DNA, 20 bp, Homo sapiens
agaaccaggcaacttgggaa

SEQ ID NO: 155326 - DNA, 11 bp, Homo sapiens
agaactcctag

SEQ ID NO: 155327 - DNA, 19 bp, Homo sapiens
agaactgtatgtcagacat

SEQ ID NO: 155328 - DNA, 23 bp, Homo sapiens
agaacttggatgtacctgccccc

SEQ ID NO: 155329 - DNA, 20 bp, Homo sapiens
agaagaattgaacccaggag

SEQ ID NO: 155330 - DNA, 22 bp, Homo sapiens
agaagaattttcagaccccagc

SEQ ID NO: 155331 - DNA, 21 bp, Homo sapiens
agaagaccacaaaaattgact

SEQ ID NO: 155332 - DNA, 13 bp, Homo sapiens
agaagatagcagg

SEQ ID NO: 155333 - DNA, 14 bp, Homo sapiens
agaagcagaaatac

SEQ ID NO: 155334 - DNA, 13 bp, Homo sapiens
agaagcagtgagc

SEQ ID NO: 155335 - DNA, 23 bp, Homo sapiens
agaagcagtgagccgcatcttct

SEQ ID NO: 155336 - DNA, 13 bp, Homo sapiens
agaagctgtagta

SEQ ID NO: 155337 - DNA, 17 bp, Homo sapiens
agaaggaaaaatgtgta

SEQ ID NO: 155338 - DNA, 17 bp, Homo sapiens
agaaggagacagagctg

SEQ ID NO: 155339 - DNA, 20 bp, Homo sapiens
agaagggtccttccctctcc

SEQ ID NO: 155340 - DNA, 20 bp, Homo sapiens
agaaggtccttaatgatccg

SEQ ID NO: 155341 - DNA, 13 bp, Homo sapiens
agaagtatacata

SEQ ID NO: 155342 - DNA, 17 bp, Homo sapiens
agaagtggaccaggaca

SEQ ID NO: 155343 - DNA, 18 bp, Homo sapiens
agaagtggaccaggacag

SEQ ID NO: 155344 - DNA, 18 bp, Homo sapiens
agaagtgggccaggacag

SEQ ID NO: 155345 - DNA, 17 bp, Homo sapiens
agaataaagttctgagt

SEQ ID NO: 155346 - DNA, 12 bp, Homo sapiens
agaatacagaaa

SEQ ID NO: 155347 - DNA, 22 bp, Homo sapiens
agaatatttattacctctgata

SEQ ID NO: 155348 - DNA, 20 bp, Homo sapiens
agaatattttaagtattgca

SEQ ID NO: 155349 - DNA, 17 bp, Homo sapiens
agaatctacccaaagga

SEQ ID NO: 155350 - DNA, 19 bp, Homo sapiens
agaatctacccaaaggata

SEQ ID NO: 155351 - DNA, 18 bp, Homo sapiens
agaatctttattgagaaa

SEQ ID NO: 155352 - DNA, 15 bp, Homo sapiens
agaatgaacaaattg

SEQ ID NO: 155353 - DNA, 14 bp, Homo sapiens
agaatgagagtgtg

SEQ ID NO: 155354 - DNA, 23 bp, Homo sapiens
agaatggttgccttaaagaaagt

SEQ ID NO: 155355 - DNA, 20 bp, Homo sapiens
agaattataattagttcctc

SEQ ID NO: 155356 - DNA, 22 bp, Homo sapiens
agaattctgctacctcactggg

SEQ ID NO: 155357 - DNA, 17 bp, Homo sapiens
agaattcttcaggtgga

SEQ ID NO: 155358 - DNA, 16 bp, Homo sapiens
agaattgaacccagga

SEQ ID NO: 155359 - DNA, 17 bp, Homo sapiens
agaattgaacccaggag

SEQ ID NO: 155360 - DNA, 17 bp, Homo sapiens
agaatttgagtgctctg

SEQ ID NO: 155361 - DNA, 13 bp, Homo sapiens
agacaagaaatcc

SEQ ID NO: 155362 - DNA, 18 bp, Homo sapiens
agacaagaaatccctgtt

SEQ ID NO: 155363 - DNA, 17 bp, Homo sapiens
agacacagaagaggctg

SEQ ID NO: 155364 - DNA, 15 bp, Homo sapiens
agacacggatctgag

SEQ ID NO: 155365 - DNA, 14 bp, Homo sapiens
agacagacacacac

SEQ ID NO: 155366 - DNA, 15 bp, Homo sapiens
agacagacacacaca

SEQ ID NO: 155367 - DNA, 16 bp, Homo sapiens
agacagacacacacac

SEQ ID NO: 155368 - DNA, 21 bp, Homo sapiens
agacagagctggttgggaaga

SEQ ID NO: 155369 - DNA, 17 bp, Homo sapiens
agacagccccagagcag

SEQ ID NO: 155370 - DNA, 20 bp, Homo sapiens
agacagccccagagcagggt

SEQ ID NO: 155371 - DNA, 19 bp, Homo sapiens
agacaggaaaatcctctgg

SEQ ID NO: 155372 - DNA, 20 bp, Homo sapiens
agacaggaaaatcctctggc

SEQ ID NO: 155373 - DNA, 21 bp, Homo sapiens
agacaggaaaatcctctggct

SEQ ID NO: 155374 - DNA, 16 bp, Homo sapiens
agacagggtttggctg

SEQ ID NO: 155375 - DNA, 17 bp, Homo sapiens
agacagtcaaggagtgg

SEQ ID NO: 155376 - DNA, 17 bp, Homo sapiens
agacatcaagcacagaa

SEQ ID NO: 155377 - DNA, 17 bp, Homo sapiens
agacatccatgtttgta

SEQ ID NO: 155378 - DNA, 19 bp, Homo sapiens
agacatggggaggaaggac

SEQ ID NO: 155379 - DNA, 13 bp, Homo sapiens
agacatgtgacat

SEQ ID NO: 155380 - DNA, 14 bp, Homo sapiens
agacatgtgacatt

SEQ ID NO: 155381 - DNA, 23 bp, Homo sapiens
agacatttctcttactgcaaatg

SEQ ID NO: 155382 - DNA, 17 bp, Homo sapiens
agaccaagactctgaaa

SEQ ID NO: 155383 - DNA, 17 bp, Homo sapiens
agacccaaaaggcagaa

SEQ ID NO: 155384 - DNA, 17 bp, Homo sapiens
agacccagccctcatcc

SEQ ID NO: 155385 - DNA, 18 bp, Homo sapiens
agacccagccctcatccc

SEQ ID NO: 155386 - DNA, 14 bp, Homo sapiens
agacccctggcttt

SEQ ID NO: 155387 - DNA, 15 bp, Homo sapiens
agacccctggctttt

SEQ ID NO: 155388 - DNA, 15 bp, Homo sapiens
agacccgaggaaact

SEQ ID NO: 155389 - DNA, 18 bp, Homo sapiens
agaccctaccccaccacg

SEQ ID NO: 155390 - DNA, 20 bp, Homo sapiens
agaccctctgccaccagaga

SEQ ID NO: 155391 - DNA, 21 bp, Homo sapiens
agaccctctgccaccagagac

SEQ ID NO: 155392 - DNA, 16 bp, Homo sapiens
agaccgtcctcacccc

SEQ ID NO: 155393 - DNA, 12 bp, Homo sapiens
agacctcagcca

SEQ ID NO: 155394 - DNA, 14 bp, Homo sapiens
agacctcagccatg

SEQ ID NO: 155395 - DNA, 13 bp, Homo sapiens
agacctcagcctg

SEQ ID NO: 155396 - DNA, 15 bp, Homo sapiens
agacctcagcctgtg

SEQ ID NO: 155397 - DNA, 19 bp, Homo sapiens
agacctcagcctgtgctgc

SEQ ID NO: 155398 - DNA, 20 bp, Homo sapiens
agacctcagcctgtgctgcc

SEQ ID NO: 155399 - DNA, 15 bp, Homo sapiens
agacctccccagccc

SEQ ID NO: 155400 - DNA, 20 bp, Homo sapiens
agacctgctgagggaccagc

SEQ ID NO: 155401 - DNA, 15 bp, Homo sapiens
agacgcctgagctca

SEQ ID NO: 155402 - DNA, 16 bp, Homo sapiens
agactattcaaacagt

SEQ ID NO: 155403 - DNA, 20 bp, Homo sapiens
agactattcaaacagtctca

SEQ ID NO: 155404 - DNA, 12 bp, Homo sapiens
agactcacctct

SEQ ID NO: 155405 - DNA, 15 bp, Homo sapiens
agactcacctctgcc

SEQ ID NO: 155406 - DNA, 18 bp, Homo sapiens
agactcacctctgcctca

SEQ ID NO: 155407 - DNA, 15 bp, Homo sapiens
agactcagactccat

SEQ ID NO: 155408 - DNA, 16 bp, Homo sapiens
agactccaaagaaatg

SEQ ID NO: 155409 - DNA, 16 bp, Homo sapiens
agactcccaagctgga

SEQ ID NO: 155410 - DNA, 13 bp, Homo sapiens
agactctaccaga

SEQ ID NO: 155411 - DNA, 16 bp, Homo sapiens
agactctgaaatctca

SEQ ID NO: 155412 - DNA, 20 bp, Homo sapiens
agactctgaaatctcagaat

SEQ ID NO: 155413 - DNA, 18 bp, Homo sapiens
agactctgtctcagtcca

SEQ ID NO: 155414 - DNA, 11 bp, Homo sapiens
agactggaggg

SEQ ID NO: 155415 - DNA, 13 bp, Homo sapiens
agactggagggga

SEQ ID NO: 155416 - DNA, 15 bp, Homo sapiens
agactggcacagttt

SEQ ID NO: 155417 - DNA, 23 bp, Homo sapiens
agactggcacagttttctgagaa

SEQ ID NO: 155418 - DNA, 14 bp, Homo sapiens
agactgggctgagg

SEQ ID NO: 155419 - DNA, 11 bp, Homo sapiens
agactgtggct

SEQ ID NO: 155420 - DNA, 13 bp, Homo sapiens
agacttcagtatg

SEQ ID NO: 155421 - DNA, 18 bp, Homo sapiens
agacttctgctttccaca

SEQ ID NO: 155422 - DNA, 19 bp, Homo sapiens
agacttggcaacagaagca

SEQ ID NO: 155423 - DNA, 21 bp, Homo sapiens
agagaaaaaaagtttgccaga

SEQ ID NO: 155424 - DNA, 16 bp, Homo sapiens
agagaaagccaggcag

SEQ ID NO: 155425 - DNA, 19 bp, Homo sapiens
agagaaagccaggcaggta

SEQ ID NO: 155426 - DNA, 20 bp, Homo sapiens
agagaacctcacgcacctcc

SEQ ID NO: 155427 - DNA, 10 bp, Homo sapiens
agagaagaga

SEQ ID NO: 155428 - DNA, 20 bp, Homo sapiens
agagaaggcaggaatgtgtg

SEQ ID NO: 155429 - DNA, 18 bp, Homo sapiens
agagaagtatacataagt

SEQ ID NO: 155430 - DNA, 13 bp, Homo sapiens
agagaatatttta

SEQ ID NO: 155431 - DNA, 23 bp, Homo sapiens
agagaatccctagtcttcaagca

SEQ ID NO: 155432 - DNA, 14 bp, Homo sapiens
agagacacctgcac

SEQ ID NO: 155433 - DNA, 18 bp, Homo sapiens
agagacacctgcacctcc

SEQ ID NO: 155434 - DNA, 14 bp, Homo sapiens
agagacagaaagca

SEQ ID NO: 155435 - DNA, 24 bp, Homo sapiens
agagacagaaagcagaacagtgat

SEQ ID NO: 155436 - DNA, 21 bp, Homo sapiens
agagacaggaaaatcctctgg

SEQ ID NO: 155437 - DNA, 12 bp, Homo sapiens
agagacccaagg

SEQ ID NO: 155438 - DNA, 16 bp, Homo sapiens
agagacccaaggagga

SEQ ID NO: 155439 - DNA, 21 bp, Homo sapiens
agagacccccggaacaagcct

SEQ ID NO: 155440 - DNA, 16 bp, Homo sapiens
agagagaaagccaggc

SEQ ID NO: 155441 - DNA, 20 bp, Homo sapiens
agagagaacaactactgtga

SEQ ID NO: 155442 - DNA, 14 bp, Homo sapiens
agagaggaatcaga

SEQ ID NO: 155443 - DNA, 17 bp, Homo sapiens
agagaggaatcagactt

SEQ ID NO: 155444 - DNA, 18 bp, Homo sapiens
agagaggacgtgggcggc

SEQ ID NO: 155445 - DNA, 13 bp, Homo sapiens
agagaggagagga

SEQ ID NO: 155446 - DNA, 13 bp, Homo sapiens
agagaggagtcag

SEQ ID NO: 155447 - DNA, 13 bp, Homo sapiens
agagaggcagaga

SEQ ID NO: 155448 - DNA, 14 bp, Homo sapiens
agagaggcagagag

SEQ ID NO: 155449 - DNA, 15 bp, Homo sapiens
agagaggcagagagc

SEQ ID NO: 155450 - DNA, 19 bp, Homo sapiens
agagagggggccacctccc

SEQ ID NO: 155451 - DNA, 23 bp, Homo sapiens
agagaggtcaagcccaggaggac

SEQ ID NO: 155452 - DNA, 17 bp, Homo sapiens
agagagtggctcctccc

SEQ ID NO: 155453 - DNA, 17 bp, Homo sapiens
agagatatggcagcgaa

SEQ ID NO: 155454 - DNA, 21 bp, Homo sapiens
agagatcatcctttccagcat

SEQ ID NO: 155455 - DNA, 12 bp, Homo sapiens
agagatgcctcc

SEQ ID NO: 155456 - DNA, 23 bp, Homo sapiens
agagatgcctccaccgctgccta

SEQ ID NO: 155457 - DNA, 14 bp, Homo sapiens
agagatggaggagg

SEQ ID NO: 155458 - DNA, 15 bp, Homo sapiens
agagatggaggagga

SEQ ID NO: 155459 - DNA, 18 bp, Homo sapiens
agagatggaggaggaggc

SEQ ID NO: 155460 - DNA, 16 bp, Homo sapiens
agagattgtggtttca

SEQ ID NO: 155461 - DNA, 14 bp, Homo sapiens
agagcaactctgag

SEQ ID NO: 155462 - DNA, 15 bp, Homo sapiens
agagcacttaagaga

SEQ ID NO: 155463 - DNA, 19 bp, Homo sapiens
agagcacttaagagaatat

SEQ ID NO: 155464 - DNA, 21 bp, Homo sapiens
agagcacttaagagaatattt

SEQ ID NO: 155465 - DNA, 20 bp, Homo sapiens
agagcaggaagcattcagag

SEQ ID NO: 155466 - DNA, 12 bp, Homo sapiens
agagccagccct

SEQ ID NO: 155467 - DNA, 20 bp, Homo sapiens
agagccagccctccctgtcc

SEQ ID NO: 155468 - DNA, 21 bp, Homo sapiens
agagccagccctccctgtcct

SEQ ID NO: 155469 - DNA, 19 bp, Homo sapiens
agagcctgcaggtgctgct

SEQ ID NO: 155470 - DNA, 15 bp, Homo sapiens
agagcctgctccccc

SEQ ID NO: 155471 - DNA, 16 bp, Homo sapiens
agagcctgctccccca

SEQ ID NO: 155472 - DNA, 18 bp, Homo sapiens
agagcctgctcccccacc

SEQ ID NO: 155473 - DNA, 19 bp, Homo sapiens
agagccttggtgtccacct

SEQ ID NO: 155474 - DNA, 14 bp, Homo sapiens
agagcgcctgcccc

SEQ ID NO: 155475 - DNA, 23 bp, Homo sapiens
agagcgcctgcccctcccagaac

SEQ ID NO: 155476 - DNA, 14 bp, Homo sapiens
agagcggtctcagg

SEQ ID NO: 155477 - DNA, 23 bp, Homo sapiens
agagcggtctcaggctggtggga

SEQ ID NO: 155478 - DNA, 16 bp, Homo sapiens
agagctagcgctgccg

SEQ ID NO: 155479 - DNA, 16 bp, Homo sapiens
agagctggttgggaag

SEQ ID NO: 155480 - DNA, 12 bp, Homo sapiens
agagcttccctg

SEQ ID NO: 155481 - DNA, 15 bp, Homo sapiens
agagcttctggcact

SEQ ID NO: 155482 - DNA, 18 bp, Homo sapiens
agaggaactgtccagaga

SEQ ID NO: 155483 - DNA, 23 bp, Homo sapiens
agaggaatcagacttcacactgc

SEQ ID NO: 155484 - DNA, 12 bp, Homo sapiens
agaggagagagg

SEQ ID NO: 155485 - DNA, 15 bp, Homo sapiens
agaggagaggagaga

SEQ ID NO: 155486 - DNA, 19 bp, Homo sapiens
agaggagggcgtgactcac

SEQ ID NO: 155487 - DNA, 20 bp, Homo sapiens
agaggatgagctctacccag

SEQ ID NO: 155488 - DNA, 12 bp, Homo sapiens
agaggcagagag

SEQ ID NO: 155489 - DNA, 13 bp, Homo sapiens
agaggcagagagc

SEQ ID NO: 155490 - DNA, 15 bp, Homo sapiens
agaggcagagagcgg

SEQ ID NO: 155491 - DNA, 14 bp, Homo sapiens
agaggccctcgctg

SEQ ID NO: 155492 - DNA, 22 bp, Homo sapiens
agaggctcgttgactggctgtg

SEQ ID NO: 155493 - DNA, 14 bp, Homo sapiens
agaggctgaggcct

SEQ ID NO: 155494 - DNA, 18 bp, Homo sapiens
agaggctgaggcctggac

SEQ ID NO: 155495 - DNA, 16 bp, Homo sapiens
agaggctggaggcagg

SEQ ID NO: 155496 - DNA, 14 bp, Homo sapiens
agagggaagaaaag

SEQ ID NO: 155497 - DNA, 17 bp, Homo sapiens
actgagatgtgaacaca

SEQ ID NO: 155498 - DNA, 13 bp, Homo sapiens
actgagcagactg

SEQ ID NO: 155499 - DNA, 18 bp, Homo sapiens
actgagccccgcagacct

SEQ ID NO: 155500 - DNA, 18 bp, Homo sapiens
actgaggaatgatgaagc

SEQ ID NO: 155501 - DNA, 22 bp, Homo sapiens
actgaggcagacagcagctcag

SEQ ID NO: 155502 - DNA, 15 bp, Homo sapiens
actgaggcagggaag

SEQ ID NO: 155503 - DNA, 21 bp, Homo sapiens
actgaggggtctccaggagga

SEQ ID NO: 155504 - DNA, 15 bp, Homo sapiens
actgatcacaaaaac

SEQ ID NO: 155505 - DNA, 16 bp, Homo sapiens
actgatttggagatat

SEQ ID NO: 155506 - DNA, 21 bp, Homo sapiens
actgcaaatgtcatcagaact

SEQ ID NO: 155507 - DNA, 22 bp, Homo sapiens
actgcacagcggcccctgcatc

SEQ ID NO: 155508 - DNA, 18 bp, Homo sapiens
actgcacagtgcatctca

SEQ ID NO: 155509 - DNA, 18 bp, Homo sapiens
actgcactccagcctggg

SEQ ID NO: 155510 - DNA, 19 bp, Homo sapiens
actgcactccagcctgggt

SEQ ID NO: 155511 - DNA, 15 bp, Homo sapiens
actgcagctttacat

SEQ ID NO: 155512 - DNA, 21 bp, Homo sapiens
actgcaggccccgcttgtcca

SEQ ID NO: 155513 - DNA, 20 bp, Homo sapiens
actgcagggccaggactgag

SEQ ID NO: 155514 - DNA, 16 bp, Homo sapiens
actgcatatgaaagga

SEQ ID NO: 155515 - DNA, 21 bp, Homo sapiens
actgcattaccgcgttgtaaa

SEQ ID NO: 155516 - DNA, 22 bp, Homo sapiens
actgcattaccgcgttgtaaaa

SEQ ID NO: 155517 - DNA, 15 bp, Homo sapiens
actgccataaaacat

SEQ ID NO: 155518 - DNA, 21 bp, Homo sapiens
actgccataaaacattaagaa

SEQ ID NO: 155519 - DNA, 19 bp, Homo sapiens
actgcccaggcctgcctgt

SEQ ID NO: 155520 - DNA, 15 bp, Homo sapiens
actgccccaactcct

SEQ ID NO: 155521 - DNA, 17 bp, Homo sapiens
actgccccaactcctgg

SEQ ID NO: 155522 - DNA, 17 bp, Homo sapiens
actgccccgtgcagact

SEQ ID NO: 155523 - DNA, 19 bp, Homo sapiens
actgccccgtgcagactgg

SEQ ID NO: 155524 - DNA, 15 bp, Homo sapiens
actgcccggcagggt

SEQ ID NO: 155525 - DNA, 15 bp, Homo sapiens
actgccttaaaactt

SEQ ID NO: 155526 - DNA, 18 bp, Homo sapiens
actgccttgaatatcccc

SEQ ID NO: 155527 - DNA, 18 bp, Homo sapiens
actgccttggcttcaggg

SEQ ID NO: 155528 - DNA, 18 bp, Homo sapiens
actgctccccagccctgg

SEQ ID NO: 155529 - DNA, 18 bp, Homo sapiens
actgctccctgaagccag

SEQ ID NO: 155530 - DNA, 22 bp, Homo sapiens
actgctgtaaataaatgcttta

SEQ ID NO: 155531 - DNA, 21 bp, Homo sapiens
actggaagcatgtaggagaat

SEQ ID NO: 155532 - DNA, 23 bp, Homo sapiens
actggactcaggatgcccagggc

SEQ ID NO: 155533 - DNA, 13 bp, Homo sapiens
actggagcaccag

SEQ ID NO: 155534 - DNA, 16 bp, Homo sapiens
actggagcaccaggca

SEQ ID NO: 155535 - DNA, 17 bp, Homo sapiens
actggagtccagtctct

SEQ ID NO: 155536 - DNA, 15 bp, Homo sapiens
actggagttacatta

SEQ ID NO: 155537 - DNA, 13 bp, Homo sapiens
actggatgaagat

SEQ ID NO: 155538 - DNA, 14 bp, Homo sapiens
actggatgaagatt

SEQ ID NO: 155539 - DNA, 16 bp, Homo sapiens
actgggatgagccgct

SEQ ID NO: 155540 - DNA, 13 bp, Homo sapiens
actgggctgaggg

SEQ ID NO: 155541 - DNA, 17 bp, Homo sapiens
actgggctgagggagcc

SEQ ID NO: 155542 - DNA, 18 bp, Homo sapiens
actggggtcctggggcct

SEQ ID NO: 155543 - DNA, 20 bp, Homo sapiens
actgggttgactttcaggta

SEQ ID NO: 155544 - DNA, 14 bp, Homo sapiens
actggtcctgtgtg

SEQ ID NO: 155545 - DNA, 16 bp, Homo sapiens
actggtgagcagactg

SEQ ID NO: 155546 - DNA, 20 bp, Homo sapiens
actggtggcccgacagcctg

SEQ ID NO: 155547 - DNA, 21 bp, Homo sapiens
actggtggcccgacagcctgg

SEQ ID NO: 155548 - DNA, 20 bp, Homo sapiens
actggtgggatctgtgccca

SEQ ID NO: 155549 - DNA, 21 bp, Homo sapiens
actggtgttatcaccgtgggc

SEQ ID NO: 155550 - DNA, 10 bp, Homo sapiens
actgtaacac

SEQ ID NO: 155551 - DNA, 15 bp, Homo sapiens
actgtactcctccca

SEQ ID NO: 155552 - DNA, 20 bp, Homo sapiens
actgtactcctcccaggcgc

SEQ ID NO: 155553 - DNA, 13 bp, Homo sapiens
actgtagtctcag

SEQ ID NO: 155554 - DNA, 14 bp, Homo sapiens
actgtcaccctcca

SEQ ID NO: 155555 - DNA, 21 bp, Homo sapiens
actgtcactgtttctctgctg

SEQ ID NO: 155556 - DNA, 23 bp, Homo sapiens
actgtcagctcccctcggagaag

SEQ ID NO: 155557 - DNA, 15 bp, Homo sapiens
actgtccagagagca

SEQ ID NO: 155558 - DNA, 19 bp, Homo sapiens
actgtctcaagagggcact

SEQ ID NO: 155559 - DNA, 13 bp, Homo sapiens
actgtctggtttt

SEQ ID NO: 155560 - DNA, 18 bp, Homo sapiens
actgtctggttttaacaa

SEQ ID NO: 155561 - DNA, 19 bp, Homo sapiens
actgtctggttttaacaat

SEQ ID NO: 155562 - DNA, 12 bp, Homo sapiens
actgtcttcagt

SEQ ID NO: 155563 - DNA, 23 bp, Homo sapiens
actgtgactctttttagggccag

SEQ ID NO: 155564 - DNA, 12 bp, Homo sapiens
actgtggctgct

SEQ ID NO: 155565 - DNA, 20 bp, Homo sapiens
actgttaaattgctgtgtat

SEQ ID NO: 155566 - DNA, 18 bp, Homo sapiens
actgttccccctgtgcag

SEQ ID NO: 155567 - DNA, 14 bp, Homo sapiens
acttaaaaaaatga

SEQ ID NO: 155568 - DNA, 23 bp, Homo sapiens
acttaaaaaacttgtaaatgctg

SEQ ID NO: 155569 - DNA, 22 bp, Homo sapiens
acttaaaaatggtttaaatggt

SEQ ID NO: 155570 - DNA, 23 bp, Homo sapiens
acttaactattcaggagagtaga

SEQ ID NO: 155571 - DNA, 18 bp, Homo sapiens
acttaagagaatatttta

SEQ ID NO: 155572 - DNA, 17 bp, Homo sapiens
acttacactttatgcac

SEQ ID NO: 155573 - DNA, 16 bp, Homo sapiens
acttagaaagcagggg

SEQ ID NO: 155574 - DNA, 20 bp, Homo sapiens
acttagaggtggggagcaga

SEQ ID NO: 155575 - DNA, 22 bp, Homo sapiens
acttatatcatcagcatacctt

SEQ ID NO: 155576 - DNA, 19 bp, Homo sapiens
acttcacacacaggcaact

SEQ ID NO: 155577 - DNA, 13 bp, Homo sapiens
acttcacactgca

SEQ ID NO: 155578 - DNA, 19 bp, Homo sapiens
acttcacactgcaagagcc

SEQ ID NO: 155579 - DNA, 23 bp, Homo sapiens
acttcacactgcaagagccttgg

SEQ ID NO: 155580 - DNA, 20 bp, Homo sapiens
acttcaggctcttctccttt

SEQ ID NO: 155581 - DNA, 21 bp, Homo sapiens
acttcagggttctcctctccc

SEQ ID NO: 155582 - DNA, 23 bp, Homo sapiens
acttcagtatgttgtcaaagaga

SEQ ID NO: 155583 - DNA, 18 bp, Homo sapiens
acttccaatttacatact

SEQ ID NO: 155584 - DNA, 14 bp, Homo sapiens
acttccaccagcct

SEQ ID NO: 155585 - DNA, 15 bp, Homo sapiens
acttccaccagcctg

SEQ ID NO: 155586 - DNA, 17 bp, Homo sapiens
acttccataatctggac

SEQ ID NO: 155587 - DNA, 14 bp, Homo sapiens
acttccctttctgc

SEQ ID NO: 155588 - DNA, 22 bp, Homo sapiens
acttccctttctgcttgtgtta

SEQ ID NO: 155589 - DNA, 16 bp, Homo sapiens
acttctaaatgaagtg

SEQ ID NO: 155590 - DNA, 23 bp, Homo sapiens
acttctaagtaaaaccacagcag

SEQ ID NO: 155591 - DNA, 22 bp, Homo sapiens
acttctaatatatttttatatt

SEQ ID NO: 155592 - DNA, 23 bp, Homo sapiens
acttctacttctgcccttgccaa

SEQ ID NO: 155593 - DNA, 19 bp, Homo sapiens
acttctgctttccacacct

SEQ ID NO: 155594 - DNA, 17 bp, Homo sapiens
acttcttatacatttga

SEQ ID NO: 155595 - DNA, 18 bp, Homo sapiens
acttcttatacatttgat

SEQ ID NO: 155596 - DNA, 15 bp, Homo sapiens
acttcttttataact

SEQ ID NO: 155597 - DNA, 22 bp, Homo sapiens
acttcttttataactagtcctt

SEQ ID NO: 155598 - DNA, 19 bp, Homo sapiens
acttgaacccgggaggcag

SEQ ID NO: 155599 - DNA, 20 bp, Homo sapiens
acttgaagttgttactaact

SEQ ID NO: 155600 - DNA, 16 bp, Homo sapiens
acttgagggcccagag

SEQ ID NO: 155601 - DNA, 17 bp, Homo sapiens
acttgagggcccagagc

SEQ ID NO: 155602 - DNA, 19 bp, Homo sapiens
acttgcacgcccatgtgtg

SEQ ID NO: 155603 - DNA, 11 bp, Homo sapiens
acttgcatttc

SEQ ID NO: 155604 - DNA, 15 bp, Homo sapiens
acttggcaacagaag

SEQ ID NO: 155605 - DNA, 15 bp, Homo sapiens
acttgggtcttccct

SEQ ID NO: 155606 - DNA, 14 bp, Homo sapiens
acttgtaaatgctg

SEQ ID NO: 155607 - DNA, 18 bp, Homo sapiens
acttgtaaatgtggtaaa

SEQ ID NO: 155608 - DNA, 14 bp, Homo sapiens
acttgtatatttta

SEQ ID NO: 155609 - DNA, 13 bp, Homo sapiens
actttaagcacta

SEQ ID NO: 155610 - DNA, 15 bp, Homo sapiens
actttagaatgagag

SEQ ID NO: 155611 - DNA, 22 bp, Homo sapiens
actttcaggccacatggctaaa

SEQ ID NO: 155612 - DNA, 18 bp, Homo sapiens
actttcaggtactaaata

SEQ ID NO: 155613 - DNA, 21 bp, Homo sapiens
actttcaggtactaaatacct

SEQ ID NO: 155614 - DNA, 14 bp, Homo sapiens
actttcctgcaact

SEQ ID NO: 155615 - DNA, 19 bp, Homo sapiens
actttcctttccccagccc

SEQ ID NO: 155616 - DNA, 22 bp, Homo sapiens
actttcctttccccagcccagg

SEQ ID NO: 155617 - DNA, 15 bp, Homo sapiens
actttctagattaag

SEQ ID NO: 155618 - DNA, 19 bp, Homo sapiens
actttgcactgatatatca

SEQ ID NO: 155619 - DNA, 15 bp, Homo sapiens
actttgctctttctt

SEQ ID NO: 155620 - DNA, 17 bp, Homo sapiens
agaaaaaaagatttatt

SEQ ID NO: 155621 - DNA, 17 bp, Homo sapiens
agaaaaaatattttccc

SEQ ID NO: 155622 - DNA, 15 bp, Homo sapiens
agaaaaattattgta

SEQ ID NO: 155623 - DNA, 18 bp, Homo sapiens
agaaaagcacctgccgac

SEQ ID NO: 155624 - DNA, 23 bp, Homo sapiens
agaaaatattatgtgtttccata

SEQ ID NO: 155625 - DNA, 16 bp, Homo sapiens
agaaaatattttgtct

SEQ ID NO: 155626 - DNA, 15 bp, Homo sapiens
agaaacaataaagag

SEQ ID NO: 155627 - DNA, 15 bp, Homo sapiens
agaaacacactgagg

SEQ ID NO: 155628 - DNA, 16 bp, Homo sapiens
agaaacccgacagagg

SEQ ID NO: 155629 - DNA, 21 bp, Homo sapiens
agaaacccgacagagggaaga

SEQ ID NO: 155630 - DNA, 16 bp, Homo sapiens
agaaaccttattgtac

SEQ ID NO: 155631 - DNA, 21 bp, Homo sapiens
agaaacgtttggaacaatcta

SEQ ID NO: 155632 - DNA, 19 bp, Homo sapiens
agaaacttccaaatcccct

SEQ ID NO: 155633 - DNA, 14 bp, Homo sapiens
agaaagaaaatcag

SEQ ID NO: 155634 - DNA, 12 bp, Homo sapiens
agaaagaagccc

SEQ ID NO: 155635 - DNA, 20 bp, Homo sapiens
agaaagactattcaaacagt

SEQ ID NO: 155636 - DNA, 12 bp, Homo sapiens
agaaagactgag

SEQ ID NO: 155637 - DNA, 13 bp, Homo sapiens
agaaagagcactt

SEQ ID NO: 155638 - DNA, 19 bp, Homo sapiens
agaaagagcacttaagaga

SEQ ID NO: 155639 - DNA, 19 bp, Homo sapiens
agaaagatggatgtgcttt

SEQ ID NO: 155640 - DNA, 20 bp, Homo sapiens
agaaagcagaacagtgatta

SEQ ID NO: 155641 - DNA, 12 bp, Homo sapiens
agaaagcagggg

SEQ ID NO: 155642 - DNA, 18 bp, Homo sapiens
agaaagcctgggtgacat

SEQ ID NO: 155643 - DNA, 20 bp, Homo sapiens
agaaagcctgggtgacattt

SEQ ID NO: 155644 - DNA, 12 bp, Homo sapiens
aaaaaaatgact

SEQ ID NO: 155645 - DNA, 11 bp, Homo sapiens
aaaaaaatttg

SEQ ID NO: 155646 - DNA, 15 bp, Homo sapiens
aaaaaatctgcagaa

SEQ ID NO: 155647 - DNA, 11 bp, Homo sapiens
aaaaacaaaaa

SEQ ID NO: 155648 - DNA, 19 bp, Homo sapiens
aaaaacagcctcacagaag

SEQ ID NO: 155649 - DNA, 12 bp, Homo sapiens
aaaaactgaatg

SEQ ID NO: 155650 - DNA, 16 bp, Homo sapiens
aaaaagttttagtttt

SEQ ID NO: 155651 - DNA, 13 bp, Homo sapiens
aaaaatacaaaaa

SEQ ID NO: 155652 - DNA, 13 bp, Homo sapiens
aaaaatataaaac

SEQ ID NO: 155653 - DNA, 14 bp, Homo sapiens
aaaaatataaaact

SEQ ID NO: 155654 - DNA, 20 bp, Homo sapiens
aaaaatatggaacttctaat

SEQ ID NO: 155655 - DNA, 16 bp, Homo sapiens
aaaaatattataactt

SEQ ID NO: 155656 - DNA, 20 bp, Homo sapiens
aaaaatgactaaaaatatta

SEQ ID NO: 155657 - DNA, 12 bp, Homo sapiens
aaaaatgtgtaa

SEQ ID NO: 155658 - DNA, 23 bp, Homo sapiens
aaaaattgtttcaaaataaaaac

SEQ ID NO: 155659 - DNA, 22 bp, Homo sapiens
aaaaattttataaaattaagca

SEQ ID NO: 155660 - DNA, 15 bp, Homo sapiens
aaaacaaaaagaaca

SEQ ID NO: 155661 - DNA, 17 bp, Homo sapiens
aaaacaaaaagaacaaa

SEQ ID NO: 155662 - DNA, 15 bp, Homo sapiens
aaaacaaatgccaca

SEQ ID NO: 155663 - DNA, 13 bp, Homo sapiens
aaaacactgtgca

SEQ ID NO: 155664 - DNA, 18 bp, Homo sapiens
aaaacagcctcacagaag

SEQ ID NO: 155665 - DNA, 14 bp, Homo sapiens
aaaacatggtagaa

SEQ ID NO: 155666 - DNA, 16 bp, Homo sapiens
aaaacattaagaaaat

SEQ ID NO: 155667 - DNA, 14 bp, Homo sapiens
aaaaccaagaagat

SEQ ID NO: 155668 - DNA, 21 bp, Homo sapiens
aaaaccaatgttctctcttct

SEQ ID NO: 155669 - DNA, 12 bp, Homo sapiens
aaaaccacagca

SEQ ID NO: 155670 - DNA, 12 bp, Homo sapiens
aaaacccagaga

SEQ ID NO: 155671 - DNA, 13 bp, Homo sapiens
aaaacccagagag

SEQ ID NO: 155672 - DNA, 13 bp, Homo sapiens
aaaacctgacaaa

SEQ ID NO: 155673 - DNA, 17 bp, Homo sapiens
aaaacttgtaaatgctg

SEQ ID NO: 155674 - DNA, 17 bp, Homo sapiens
aaaagaaagaaaatcag

SEQ ID NO: 155675 - DNA, 13 bp, Homo sapiens
aaaagaatatttt

SEQ ID NO: 155676 - DNA, 16 bp, Homo sapiens
aaaagatatattaaaa

SEQ ID NO: 155677 - DNA, 22 bp, Homo sapiens
aaaagatatattaaaaatataa

SEQ ID NO: 155678 - DNA, 12 bp, Homo sapiens
aaaagcaaaatc

SEQ ID NO: 155679 - DNA, 13 bp, Homo sapiens
aaaagcataaatg

SEQ ID NO: 155680 - DNA, 19 bp, Homo sapiens
aaaagcctgcaatttcata

SEQ ID NO: 155681 - DNA, 14 bp, Homo sapiens
aaaagctcatattt

SEQ ID NO: 155682 - DNA, 20 bp, Homo sapiens
aaaagggaagttgtgccttt

SEQ ID NO: 155683 - DNA, 19 bp, Homo sapiens
aaaaggttcactaaagcag

SEQ ID NO: 155684 - DNA, 15 bp, Homo sapiens
aaaagtacaatttac

SEQ ID NO: 155685 - DNA, 15 bp, Homo sapiens
aaaagtcaaaaggtg

SEQ ID NO: 155686 - DNA, 19 bp, Homo sapiens
aaaagtcttcactctctga

SEQ ID NO: 155687 - DNA, 16 bp, Homo sapiens
aaaagtttacaagtgt

SEQ ID NO: 155688 - DNA, 12 bp, Homo sapiens
aaatctctaata

SEQ ID NO: 155689 - DNA, 18 bp, Homo sapiens
aaatcttttagtcattat

SEQ ID NO: 155690 - DNA, 21 bp, Homo sapiens
aaatgaaagcagggacttgaa

SEQ ID NO: 155691 - DNA, 22 bp, Homo sapiens
aaatgaaagcagggacttgaac

SEQ ID NO: 155692 - DNA, 22 bp, Homo sapiens
aaatgaaggttaggatttaaca

SEQ ID NO: 155693 - DNA, 11 bp, Homo sapiens
aaatgaagtgc

SEQ ID NO: 155694 - DNA, 20 bp, Homo sapiens
aaatgaagtgcaaatttgat

SEQ ID NO: 155695 - DNA, 21 bp, Homo sapiens
aaatgaccagtaattgtgaaa

SEQ ID NO: 155696 - DNA, 17 bp, Homo sapiens
aaatgactaaaaatatt

SEQ ID NO: 155697 - DNA, 20 bp, Homo sapiens
aaatgactaaaaatattata

SEQ ID NO: 155698 - DNA, 19 bp, Homo sapiens
aaatgaggaatgtatatgt

SEQ ID NO: 155699 - DNA, 13 bp, Homo sapiens
aaatgcatggagg

SEQ ID NO: 155700 - DNA, 13 bp, Homo sapiens
aaatgcccagctt

SEQ ID NO: 155701 - DNA, 19 bp, Homo sapiens
aaatgcctcagtgtatttg

SEQ ID NO: 155702 - DNA, 18 bp, Homo sapiens
aaatgctttatgcaaacc

SEQ ID NO: 155703 - DNA, 21 bp, Homo sapiens
aaatggaaaggagaggaaaga

SEQ ID NO: 155704 - DNA, 22 bp, Homo sapiens
aaatgggttggtgcttctaacc

SEQ ID NO: 155705 - DNA, 22 bp, Homo sapiens
aaatgtaagggaaactgccagc

SEQ ID NO: 155706 - DNA, 14 bp, Homo sapiens
aaatgtatatgcac

SEQ ID NO: 155707 - DNA, 13 bp, Homo sapiens
aaatgtcttgtgt

SEQ ID NO: 155708 - DNA, 22 bp, Homo sapiens
aaatgtctttccttttgctctt

SEQ ID NO: 155709 - DNA, 21 bp, Homo sapiens
aaaatcatttctgcatcagct

SEQ ID NO: 155710 - DNA, 21 bp, Homo sapiens
aaaatctacactccagtgaga

SEQ ID NO: 155711 - DNA, 18 bp, Homo sapiens
aaaatcttggcacagaaa

SEQ ID NO: 155712 - DNA, 20 bp, Homo sapiens
aaaatgaaggttaggattta

SEQ ID NO: 155713 - DNA, 13 bp, Homo sapiens
aaaatgacagatg

SEQ ID NO: 155714 - DNA, 19 bp, Homo sapiens
aaaatgaccagtaattgtg

SEQ ID NO: 155715 - DNA, 21 bp, Homo sapiens
aaaatgactaaaaatattata

SEQ ID NO: 155716 - DNA, 16 bp, Homo sapiens
aaaatgaggaatgtat

SEQ ID NO: 155717 - DNA, 19 bp, Homo sapiens
aaaatgaggaatgtatatg

SEQ ID NO: 155718 - DNA, 20 bp, Homo sapiens
aaaatgattgtaaaatagct

SEQ ID NO: 155719 - DNA, 16 bp, Homo sapiens
aaaatgcctcagtgta

SEQ ID NO: 155720 - DNA, 18 bp, Homo sapiens
aaaatgcctcagtgtatt

SEQ ID NO: 155721 - DNA, 22 bp, Homo sapiens
aaaatgcctcagtgtatttgta

SEQ ID NO: 155722 - DNA, 23 bp, Homo sapiens
aaaatgctgtattagtcacagag

SEQ ID NO: 155723 - DNA, 12 bp, Homo sapiens
aaaatggaaaga

SEQ ID NO: 155724 - DNA, 14 bp, Homo sapiens
aaaatggaaagaat

SEQ ID NO: 155725 - DNA, 16 bp, Homo sapiens
aaaatggtttaaatgg

SEQ ID NO: 155726 - DNA, 14 bp, Homo sapiens
aaaatgtatatgca

SEQ ID NO: 155727 - DNA, 19 bp, Homo sapiens
aaaatgttgaaaagtcaaa

SEQ ID NO: 155728 - DNA, 15 bp, Homo sapiens
aaaattagccaagtg

SEQ ID NO: 155729 - DNA, 14 bp, Homo sapiens
aaaattatttcaga

SEQ ID NO: 155730 - DNA, 13 bp, Homo sapiens
aaaattatttgca

SEQ ID NO: 155731 - DNA, 20 bp, Homo sapiens
aaaattctcagtcagtaatt

SEQ ID NO: 155732 - DNA, 21 bp, Homo sapiens
aaaattgatgtgtttatttat

SEQ ID NO: 155733 - DNA, 21 bp, Homo sapiens
aaaattgtatgttaagttact

SEQ ID NO: 155734 - DNA, 13 bp, Homo sapiens
aaaatttcacatt

SEQ ID NO: 155735 - DNA, 21 bp, Homo sapiens
aaaattttataaaattaagca

SEQ ID NO: 155736 - DNA, 12 bp, Homo sapiens
aaacaaaaagaa

SEQ ID NO: 155737 - DNA, 17 bp, Homo sapiens
aaacaaaaagaacaaaa

SEQ ID NO: 155738 - DNA, 12 bp, Homo sapiens
aaacaaagccag

SEQ ID NO: 155739 - DNA, 12 bp, Homo sapiens
aaacaaatatgc

SEQ ID NO: 155740 - DNA, 14 bp, Homo sapiens
aaacaaatatgcaa

SEQ ID NO: 155741 - DNA, 17 bp, Homo sapiens
aaacaaatatgcaaaag

SEQ ID NO: 155742 - DNA, 22 bp, Homo sapiens
aaacaacaatttctactttgaa

SEQ ID NO: 155743 - DNA, 17 bp, Homo sapiens
aaacaactctttgagaa

SEQ ID NO: 155744 - DNA, 15 bp, Homo sapiens
aaacaataaatgtgc

SEQ ID NO: 155745 - DNA, 16 bp, Homo sapiens
aaacacactgaggcag

SEQ ID NO: 155746 - DNA, 19 bp, Homo sapiens
aaacacactgaggcaggga

SEQ ID NO: 155747 - DNA, 11 bp, Homo sapiens
aaacacagcaa

SEQ ID NO: 155748 - DNA, 12 bp, Homo sapiens
aaacacagcaag

SEQ ID NO: 155749 - DNA, 13 bp, Homo sapiens
aaacactgtgcac

SEQ ID NO: 155750 - DNA, 22 bp, Homo sapiens
aaacagacaaaaacagcctcac

SEQ ID NO: 155751 - DNA, 16 bp, Homo sapiens
aaacagagatgtgata

SEQ ID NO: 155752 - DNA, 14 bp, Homo sapiens
aaacagcagtgttc

SEQ ID NO: 155753 - DNA, 12 bp, Homo sapiens
aaacaggagaga

SEQ ID NO: 155754 - DNA, 17 bp, Homo sapiens
aaacaggtcaatacagt

SEQ ID NO: 155755 - DNA, 14 bp, Homo sapiens
aaacagtagtgata

SEQ ID NO: 155756 - DNA, 14 bp, Homo sapiens
aaacataaataaaa

SEQ ID NO: 155757 - DNA, 13 bp, Homo sapiens
aaacataattctt

SEQ ID NO: 155758 - DNA, 21 bp, Homo sapiens
aaacataattcttgtatatta

SEQ ID NO: 155759 - DNA, 22 bp, Homo sapiens
aaacatcacacacacagacaga

SEQ ID NO: 155760 - DNA, 12 bp, Homo sapiens
aaacatgaagtg

SEQ ID NO: 155761 - DNA, 18 bp, Homo sapiens
aaacatgtacaaaatcga

SEQ ID NO: 155762 - DNA, 16 bp, Homo sapiens
aaacatgttagaagca

SEQ ID NO: 155763 - DNA, 17 bp, Homo sapiens
aaacatgttagaagcaa

SEQ ID NO: 155764 - DNA, 13 bp, Homo sapiens
aaacattaagaaa

SEQ ID NO: 155765 - DNA, 20 bp, Homo sapiens
aaacattaagaaaatcatat

SEQ ID NO: 155766 - DNA, 23 bp, Homo sapiens
aaacatttaacttgtttccaatg

SEQ ID NO: 155767 - DNA, 19 bp, Homo sapiens
aaacattttgtcatataag

SEQ ID NO: 155768 - DNA, 12 bp, Homo sapiens
aaaccacagcag

SEQ ID NO: 155769 - DNA, 11 bp, Homo sapiens
aaacccagaga

SEQ ID NO: 155770 - DNA, 18 bp, Homo sapiens
aaacccgacagagggaag

SEQ ID NO: 155771 - DNA, 12 bp, Homo sapiens
aaaccctgtctc

SEQ ID NO: 155772 - DNA, 19 bp, Homo sapiens
aaacctaaaaaagatatat

SEQ ID NO: 155773 - DNA, 22 bp, Homo sapiens
aaacctcaaaatgtctaagata

SEQ ID NO: 155774 - DNA, 11 bp, Homo sapiens
aaacctttcaa

SEQ ID NO: 155775 - DNA, 17 bp, Homo sapiens
aaacctttcaaatttca

SEQ ID NO: 155776 - DNA, 19 bp, Homo sapiens
aaacctttcaaatttcaca

SEQ ID NO: 155777 - DNA, 12 bp, Homo sapiens
aaacgctgcctg

SEQ ID NO: 155778 - DNA, 15 bp, Homo sapiens
aaacggttaaaactg

SEQ ID NO: 155779 - DNA, 22 bp, Homo sapiens
aaactacacatccctaatgtgt

SEQ ID NO: 155780 - DNA, 18 bp, Homo sapiens
aaactcaaaacttaacat

SEQ ID NO: 155781 - DNA, 22 bp, Homo sapiens
aaactcaaaacttaacatattt

SEQ ID NO: 155782 - DNA, 11 bp, Homo sapiens
aaactcaaatg

SEQ ID NO: 155783 - DNA, 16 bp, Homo sapiens
aaactcaccatgtaaa

SEQ ID NO: 155784 - DNA, 18 bp, Homo sapiens
aaactcaccatgtaaaag

SEQ ID NO: 155785 - DNA, 23 bp, Homo sapiens
aaactcaggatggtcatcttgga

SEQ ID NO: 155786 - DNA, 22 bp, Homo sapiens
aaactctctttgggaatgtttg

SEQ ID NO: 155787 - DNA, 11 bp, Homo sapiens
aaactctgctg

SEQ ID NO: 155788 - DNA, 23 bp, Homo sapiens
aaactcttaaaacccaagtgcct

SEQ ID NO: 155789 - DNA, 13 bp, Homo sapiens
aaactgaaaatct

SEQ ID NO: 155790 - DNA, 14 bp, Homo sapiens
aaactgaaaatcta

SEQ ID NO: 155791 - DNA, 19 bp, Homo sapiens
aaactgaaaatctaatatt

SEQ ID NO: 155792 - DNA, 14 bp, Homo sapiens
aaactgaatggaag

SEQ ID NO: 155793 - DNA, 21 bp, Homo sapiens
aaactgagactcagacaggaa

SEQ ID NO: 155794 - DNA, 23 bp, Homo sapiens
aaactgagatgtgaacacatcag

SEQ ID NO: 155795 - DNA, 14 bp, Homo sapiens
aaactgcattagaa

SEQ ID NO: 155796 - DNA, 16 bp, Homo sapiens
aaactgtagtctcagg

SEQ ID NO: 155797 - DNA, 16 bp, Homo sapiens
aaactgttgccagaga

SEQ ID NO: 155798 - DNA, 19 bp, Homo sapiens
aaacttcagacatagaatt

SEQ ID NO: 155799 - DNA, 24 bp, Homo sapiens
aaacttttttgaaataataaatct

SEQ ID NO: 155800 - DNA, 14 bp, Homo sapiens
aaagaaaagataaa

SEQ ID NO: 155801 - DNA, 14 bp, Homo sapiens
aaagaaaatatgca

SEQ ID NO: 155802 - DNA, 15 bp, Homo sapiens
aaagaaaatatgcat

SEQ ID NO: 155803 - DNA, 20 bp, Homo sapiens
aaagaaacccgacagaggga

SEQ ID NO: 155804 - DNA, 17 bp, Homo sapiens
aaagaaagcctcagaga

SEQ ID NO: 155805 - DNA, 20 bp, Homo sapiens
aaagaaggtttcagaaagaa

SEQ ID NO: 155806 - DNA, 15 bp, Homo sapiens
aaagaatacagaaag

SEQ ID NO: 155807 - DNA, 19 bp, Homo sapiens
aaagacacctactgagtgg

SEQ ID NO: 155808 - DNA, 19 bp, Homo sapiens
aaagacattctgacatctt

SEQ ID NO: 155809 - DNA, 15 bp, Homo sapiens
aaagaccatttttcc

SEQ ID NO: 155810 - DNA, 20 bp, Homo sapiens
aaagactaatttaaaaaata

SEQ ID NO: 155811 - DNA, 19 bp, Homo sapiens
aaagactattcaaacagtc

SEQ ID NO: 155812 - DNA, 14 bp, Homo sapiens
aaagactccaaaga

SEQ ID NO: 155813 - DNA, 15 bp, Homo sapiens
aaagactccaaagaa

SEQ ID NO: 155814 - DNA, 21 bp, Homo sapiens
aaagactccaaagaaatgtaa

SEQ ID NO: 155815 - DNA, 18 bp, Homo sapiens
aaagagaaaaaaagtttg

SEQ ID NO: 155816 - DNA, 12 bp, Homo sapiens
aaagagcactta

SEQ ID NO: 155817 - DNA, 22 bp, Homo sapiens
aaagagcacttaagagaatatt

SEQ ID NO: 155818 - DNA, 11 bp, Homo sapiens
aaagaggtttt

SEQ ID NO: 155819 - DNA, 16 bp, Homo sapiens
aaagagttcttaagga

SEQ ID NO: 155820 - DNA, 15 bp, Homo sapiens
aaagataaagatgat

SEQ ID NO: 155821 - DNA, 21 bp, Homo sapiens
aaagataaattatatcaattt

SEQ ID NO: 155822 - DNA, 12 bp, Homo sapiens
aaagatatatta

SEQ ID NO: 155823 - DNA, 19 bp, Homo sapiens
aaagatatattaaaaatat

SEQ ID NO: 155824 - DNA, 22 bp, Homo sapiens
aaagatgccgggttttatattt

SEQ ID NO: 155825 - DNA, 17 bp, Homo sapiens
aaagatgcttctcactg

SEQ ID NO: 155826 - DNA, 19 bp, Homo sapiens
aaagatgcttctcactgcc

SEQ ID NO: 155827 - DNA, 16 bp, Homo sapiens
aaagatggatgtgctt

SEQ ID NO: 155828 - DNA, 17 bp, Homo sapiens
aaagcactgacttctaa

SEQ ID NO: 155829 - DNA, 16 bp, Homo sapiens
aaagcagaacagtgat

SEQ ID NO: 155830 - DNA, 18 bp, Homo sapiens
aaagcagctcaaaggcac

SEQ ID NO: 155831 - DNA, 18 bp, Homo sapiens
aactgactttatcctcag

SEQ ID NO: 155832 - DNA, 23 bp, Homo sapiens
aactgcagggaaaattatttgca

SEQ ID NO: 155833 - DNA, 22 bp, Homo sapiens
aactgcattaccgcgttgtaaa

SEQ ID NO: 155834 - DNA, 14 bp, Homo sapiens
aactgcattagaaa

SEQ ID NO: 155835 - DNA, 16 bp, Homo sapiens
aactgcattagaaatt

SEQ ID NO: 155836 - DNA, 16 bp, Homo sapiens
aactgcgttaaaggct

SEQ ID NO: 155837 - DNA, 20 bp, Homo sapiens
aactgctgactgttttctct

SEQ ID NO: 155838 - DNA, 13 bp, Homo sapiens
aactggactcagg

SEQ ID NO: 155839 - DNA, 18 bp, Homo sapiens
aactgtacttttaaggca

SEQ ID NO: 155840 - DNA, 19 bp, Homo sapiens
aactgttaaattgctgtgt

SEQ ID NO: 155841 - DNA, 23 bp, Homo sapiens
aacttacattgtgaaacttctgt

SEQ ID NO: 155842 - DNA, 19 bp, Homo sapiens
aacttagcatgtgttgaaa

SEQ ID NO: 155843 - DNA, 19 bp, Homo sapiens
aacttatcctaaaacaaat

SEQ ID NO: 155844 - DNA, 23 bp, Homo sapiens
aacttccttggactcattttaaa

SEQ ID NO: 155845 - DNA, 16 bp, Homo sapiens
aacttctaatatattt

SEQ ID NO: 155846 - DNA, 20 bp, Homo sapiens
aacttgctgcagtatgaaaa

SEQ ID NO: 155847 - DNA, 15 bp, Homo sapiens
aacttggagccccag

SEQ ID NO: 155848 - DNA, 18 bp, Homo sapiens
aacttgtaaatgctgtca

SEQ ID NO: 155849 - DNA, 19 bp, Homo sapiens
aagaaaaaatattttccct

SEQ ID NO: 155850 - DNA, 20 bp, Homo sapiens
aagaaaaagtcatccaatct

SEQ ID NO: 155851 - DNA, 13 bp, Homo sapiens
aagaaaatatttt

SEQ ID NO: 155852 - DNA, 17 bp, Homo sapiens
aagaaaatcatattgct

SEQ ID NO: 155853 - DNA, 18 bp, Homo sapiens
aagaaacccgacagaggg

SEQ ID NO: 155854 - DNA, 16 bp, Homo sapiens
aagaaactcaccccca

SEQ ID NO: 155855 - DNA, 13 bp, Homo sapiens
aagaaagaaaatc

SEQ ID NO: 155856 - DNA, 17 bp, Homo sapiens
aagaaagctggtaaact

SEQ ID NO: 155857 - DNA, 13 bp, Homo sapiens
aagaaatgtaagg

SEQ ID NO: 155858 - DNA, 14 bp, Homo sapiens
aagaaatgtaaggg

SEQ ID NO: 155859 - DNA, 16 bp, Homo sapiens
aagaaatttgatttct

SEQ ID NO: 155860 - DNA, 20 bp, Homo sapiens
aagaacaaaaaaatctgcag

SEQ ID NO: 155861 - DNA, 21 bp, Homo sapiens
aagaacaaaaaaatctgcaga

SEQ ID NO: 155862 - DNA, 24 bp, Homo sapiens
aagaagggtccttccctctcccca

SEQ ID NO: 155863 - DNA, 22 bp, Homo sapiens
aagaagtgaaaatctacactcc

SEQ ID NO: 155864 - DNA, 23 bp, Homo sapiens
aaagggagcactgggttgacttt

SEQ ID NO: 155865 - DNA, 14 bp, Homo sapiens
aaaggtgaaggaat

SEQ ID NO: 155866 - DNA, 19 bp, Homo sapiens
aaaggtggactggaagggg

SEQ ID NO: 155867 - DNA, 14 bp, Homo sapiens
aaagtacatttaat

SEQ ID NO: 155868 - DNA, 15 bp, Homo sapiens
aaagtatatatttat

SEQ ID NO: 155869 - DNA, 20 bp, Homo sapiens
aaagtatgtaaagtatgtaa

SEQ ID NO: 155870 - DNA, 15 bp, Homo sapiens
aaagtcgaattaata

SEQ ID NO: 155871 - DNA, 22 bp, Homo sapiens
aaagtctgtgtgatgaactttc

SEQ ID NO: 155872 - DNA, 21 bp, Homo sapiens
aaagtgataatttctggaatt

SEQ ID NO: 155873 - DNA, 19 bp, Homo sapiens
aaagtggaaaacaaggaag

SEQ ID NO: 155874 - DNA, 20 bp, Homo sapiens
aaagtggaaaacaaggaagt

SEQ ID NO: 155875 - DNA, 22 bp, Homo sapiens
aaagtgtgtattaaaaaaaaca

SEQ ID NO: 155876 - DNA, 17 bp, Homo sapiens
aaagttacaaattgctt

SEQ ID NO: 155877 - DNA, 23 bp, Homo sapiens
aaagttccctacttcctgtgact

SEQ ID NO: 155878 - DNA, 21 bp, Homo sapiens
aaagttctgtactcaaatgta

SEQ ID NO: 155879 - DNA, 18 bp, Homo sapiens
aaagttgtgattccagat

SEQ ID NO: 155880 - DNA, 11 bp, Homo sapiens
aaataaaacct

SEQ ID NO: 155881 - DNA, 14 bp, Homo sapiens
aaataaaacctttc

SEQ ID NO: 155882 - DNA, 15 bp, Homo sapiens
aaataaaacctttca

SEQ ID NO: 155883 - DNA, 14 bp, Homo sapiens
aaataaatatatat

SEQ ID NO: 155884 - DNA, 23 bp, Homo sapiens
aaataacaaatctcaagcaaaca

SEQ ID NO: 155885 - DNA, 19 bp, Homo sapiens
aaataaccaatcctggaca

SEQ ID NO: 155886 - DNA, 18 bp, Homo sapiens
aaataacttcaagcaaac

SEQ ID NO: 155887 - DNA, 17 bp, Homo sapiens
aaataataaagatgctc

SEQ ID NO: 155888 - DNA, 12 bp, Homo sapiens
aaataatatgca

SEQ ID NO: 155889 - DNA, 15 bp, Homo sapiens
aaatacacactcaaa

SEQ ID NO: 155890 - DNA, 13 bp, Homo sapiens
aaatacatgacat

SEQ ID NO: 155891 - DNA, 17 bp, Homo sapiens
aaataccagtgtggttt

SEQ ID NO: 155892 - DNA, 21 bp, Homo sapiens
aaatagataagagtagaaact

SEQ ID NO: 155893 - DNA, 13 bp, Homo sapiens
aaatagtaaaaat

SEQ ID NO: 155894 - DNA, 14 bp, Homo sapiens
aaatagtatttgag

SEQ ID NO: 155895 - DNA, 14 bp, Homo sapiens
aaatatataaatat

SEQ ID NO: 155896 - DNA, 16 bp, Homo sapiens
aaatatataaatatat

SEQ ID NO: 155897 - DNA, 16 bp, Homo sapiens
aaatatatataaacct

SEQ ID NO: 155898 - DNA, 20 bp, Homo sapiens
aaatatatttaagataatta

SEQ ID NO: 155899 - DNA, 19 bp, Homo sapiens
aaatatgattttatttgac

SEQ ID NO: 155900 - DNA, 20 bp, Homo sapiens
aaatatgattttatttgaca

SEQ ID NO: 155901 - DNA, 19 bp, Homo sapiens
aaatatggaacttctaata

SEQ ID NO: 155902 - DNA, 16 bp, Homo sapiens
aaatatgtcctggggt

SEQ ID NO: 155903 - DNA, 16 bp, Homo sapiens
aaatatgttgatgaaa

SEQ ID NO: 155904 - DNA, 14 bp, Homo sapiens
aaatattagaaaca

SEQ ID NO: 155905 - DNA, 20 bp, Homo sapiens
aaatattattttatgaaagg

SEQ ID NO: 155906 - DNA, 20 bp, Homo sapiens
aaatattgtgttgtgaatgt

SEQ ID NO: 155907 - DNA, 15 bp, Homo sapiens
aaatatttatgtaaa

SEQ ID NO: 155908 - DNA, 12 bp, Homo sapiens
aaatcaaatatg

SEQ ID NO: 155909 - DNA, 15 bp, Homo sapiens
aaatcaaatatgcaa

SEQ ID NO: 155910 - DNA, 19 bp, Homo sapiens
aaatcaatgctataactat

SEQ ID NO: 155911 - DNA, 19 bp, Homo sapiens
aaatcagcctgctccagct

SEQ ID NO: 155912 - DNA, 22 bp, Homo sapiens
aaatcataagatatttttcatg

SEQ ID NO: 155913 - DNA, 22 bp, Homo sapiens
aaatcatttctgcatcagctgc

SEQ ID NO: 155914 - DNA, 16 bp, Homo sapiens
aaatccttccatgaaa

SEQ ID NO: 155915 - DNA, 14 bp, Homo sapiens
aaatcgattggctt

SEQ ID NO: 155916 - DNA, 15 bp, Homo sapiens
aaatcgattggcttt

SEQ ID NO: 155917 - DNA, 23 bp, Homo sapiens
aaatcggatctggggctctggga

SEQ ID NO: 155918 - DNA, 14 bp, Homo sapiens
aaatgacagatgtt

SEQ ID NO: 155919 - DNA, 19 bp, Homo sapiens
aaatgaccagtaattgtga

SEQ ID NO: 155920 - DNA, 13 bp, Homo sapiens
aaatgagaaggaa

SEQ ID NO: 155921 - DNA, 20 bp, Homo sapiens
aaatgagaccctcgtggcct

SEQ ID NO: 155922 - DNA, 13 bp, Homo sapiens
aaatgagcctggc

SEQ ID NO: 155923 - DNA, 19 bp, Homo sapiens
aaatgagcctggcaagaat

SEQ ID NO: 155924 - DNA, 12 bp, Homo sapiens
aaatgagtgtgt

SEQ ID NO: 155925 - DNA, 18 bp, Homo sapiens
aaatgagtgtgtttgtca

SEQ ID NO: 155926 - DNA, 15 bp, Homo sapiens
aaatgattgtaaaat

SEQ ID NO: 155927 - DNA, 22 bp, Homo sapiens
aaatgattgtaaaatagcttgt

SEQ ID NO: 155928 - DNA, 17 bp, Homo sapiens
aaatgcaaacacacaaa

SEQ ID NO: 155929 - DNA, 16 bp, Homo sapiens
aaatgcatccattcct

SEQ ID NO: 155930 - DNA, 22 bp, Homo sapiens
aaatgcatccattcctcaggga

SEQ ID NO: 155931 - DNA, 16 bp, Homo sapiens
aaatgcctcagtgtat

SEQ ID NO: 155932 - DNA, 17 bp, Homo sapiens
aaatgcctcagtgtatt

SEQ ID NO: 155933 - DNA, 18 bp, Homo sapiens
aaatgcctcagtgtattt

SEQ ID NO: 155934 - DNA, 23 bp, Homo sapiens
aaatgcctcagtgtatttgtatt

SEQ ID NO: 155935 - DNA, 20 bp, Homo sapiens
aaatgctgcgcccttcccca

SEQ ID NO: 155936 - DNA, 20 bp, Homo sapiens
aaatgggttggtgcttctaa

SEQ ID NO: 155937 - DNA, 23 bp, Homo sapiens
aaatggtgaaaataaaataaagc

SEQ ID NO: 155938 - DNA, 19 bp, Homo sapiens
aaatgtgaatgggaaaaga

SEQ ID NO: 155939 - DNA, 13 bp, Homo sapiens
aaatgtgatgaat

SEQ ID NO: 155940 - DNA, 15 bp, Homo sapiens
aaatgtgcttttaaa

SEQ ID NO: 155941 - DNA, 10 bp, Homo sapiens
aaatgtgtaa

SEQ ID NO: 155942 - DNA, 20 bp, Homo sapiens
aaatgtgtatcggatgcttt

SEQ ID NO: 155943 - DNA, 16 bp, Homo sapiens
aaatgtgtttaaaaca

SEQ ID NO: 155944 - DNA, 16 bp, Homo sapiens
aaatgttcacttttga

SEQ ID NO: 155945 - DNA, 22 bp, Homo sapiens
aaatgttgttctcttctttaaa

SEQ ID NO: 155946 - DNA, 17 bp, Homo sapiens
aaattaaagctgaaaac

SEQ ID NO: 155947 - DNA, 18 bp, Homo sapiens
aaattaacagtcctaact

SEQ ID NO: 155948 - DNA, 17 bp, Homo sapiens
aaattagctgtgtgaaa

SEQ ID NO: 155949 - DNA, 18 bp, Homo sapiens
aaattaggatttcatgat

SEQ ID NO: 155950 - DNA, 22 bp, Homo sapiens
aaattataacttaaaatatttt

SEQ ID NO: 155951 - DNA, 16 bp, Homo sapiens
aaattatttgtgtaat

SEQ ID NO: 155952 - DNA, 22 bp, Homo sapiens
aaattatttgtgtaatagaaaa

SEQ ID NO: 155953 - DNA, 17 bp, Homo sapiens
aaattattttaaacaaa

SEQ ID NO: 155954 - DNA, 16 bp, Homo sapiens
aaattcacaatagaaa

SEQ ID NO: 155955 - DNA, 13 bp, Homo sapiens
aaattcatttttt

SEQ ID NO: 155956 - DNA, 19 bp, Homo sapiens
aaattgacacttaaaaatg

SEQ ID NO: 155957 - DNA, 14 bp, Homo sapiens
aaattgatgtgttt

SEQ ID NO: 155958 - DNA, 21 bp, Homo sapiens
aaattgatgtgtttatttata

SEQ ID NO: 155959 - DNA, 16 bp, Homo sapiens
aaattgcttgaaagaa

SEQ ID NO: 155960 - DNA, 21 bp, Homo sapiens
aaattgtcccttaaacaaaaa

SEQ ID NO: 155961 - DNA, 21 bp, Homo sapiens
aaattgtttcaaaataaaaac

SEQ ID NO: 155962 - DNA, 14 bp, Homo sapiens
aaattttaatttat

SEQ ID NO: 155963 - DNA, 21 bp, Homo sapiens
aaattttataaaattaagcaa

SEQ ID NO: 155964 - DNA, 13 bp, Homo sapiens
aacaaaaaaatct

SEQ ID NO: 155965 - DNA, 12 bp, Homo sapiens
aacaaaaagaac

SEQ ID NO: 155966 - DNA, 13 bp, Homo sapiens
aacaaaaattgtc

SEQ ID NO: 155967 - DNA, 17 bp, Homo sapiens
aacaaagccagaagctg

SEQ ID NO: 155968 - DNA, 13 bp, Homo sapiens
aacaaatatgcaa

SEQ ID NO: 155969 - DNA, 20 bp, Homo sapiens
aacaaattatgttacatctg

SEQ ID NO: 155970 - DNA, 18 bp, Homo sapiens
aacaaatttacagagaca

SEQ ID NO: 155971 - DNA, 15 bp, Homo sapiens
aacaactctttgaga

SEQ ID NO: 155972 - DNA, 14 bp, Homo sapiens
aacaaggaagtcaa

SEQ ID NO: 155973 - DNA, 13 bp, Homo sapiens
aagctgggcaggt

SEQ ID NO: 155974 - DNA, 17 bp, Homo sapiens
aagctggtaaactattt

SEQ ID NO: 155975 - DNA, 22 bp, Homo sapiens
aagctgtagtagccctttctgt

SEQ ID NO: 155976 - DNA, 15 bp, Homo sapiens
aagctgtttccatag

SEQ ID NO: 155977 - DNA, 19 bp, Homo sapiens
aagcttccagtccaatctc

SEQ ID NO: 155978 - DNA, 21 bp, Homo sapiens
aagcttccagtccaatctcat

SEQ ID NO: 155979 - DNA, 21 bp, Homo sapiens
aagcttggctgtagaaggaga

SEQ ID NO: 155980 - DNA, 18 bp, Homo sapiens
aagctttcctgccccagg

SEQ ID NO: 155981 - DNA, 22 bp, Homo sapiens
aagctttcctgccccaggcctg

SEQ ID NO: 155982 - DNA, 23 bp, Homo sapiens
aagctttgcttatggtaataaaa

SEQ ID NO: 155983 - DNA, 12 bp, Homo sapiens
aaggaaaatgat

SEQ ID NO: 155984 - DNA, 18 bp, Homo sapiens
aaggaagctccactgtca

SEQ ID NO: 155985 - DNA, 22 bp, Homo sapiens
aaggaagttactgttatagagg

SEQ ID NO: 155986 - DNA, 17 bp, Homo sapiens
aaggaatctccagtttt

SEQ ID NO: 155987 - DNA, 21 bp, Homo sapiens
aaggaatctccagttttcagt

SEQ ID NO: 155988 - DNA, 23 bp, Homo sapiens
aaggacaaaaatgaactgaagtt

SEQ ID NO: 155989 - DNA, 21 bp, Homo sapiens
aaggacccggaggggcctggc

SEQ ID NO: 155990 - DNA, 22 bp, Homo sapiens
aaggacccggaggggcctggca

SEQ ID NO: 155991 - DNA, 13 bp, Homo sapiens
aaggactccaccc

SEQ ID NO: 155992 - DNA, 17 bp, Homo sapiens
aaggagactcacctctg

SEQ ID NO: 155993 - DNA, 20 bp, Homo sapiens
aaggagactcacctctgcct

SEQ ID NO: 155994 - DNA, 23 bp, Homo sapiens
aaggagactcacctctgcctcaa

SEQ ID NO: 155995 - DNA, 19 bp, Homo sapiens
aaggagccccattcctggg

SEQ ID NO: 155996 - DNA, 20 bp, Homo sapiens
aaggaggaagagaaaaaata

SEQ ID NO: 155997 - DNA, 19 bp, Homo sapiens
aaggagggttagggagggg

SEQ ID NO: 155998 - DNA, 17 bp, Homo sapiens
aaggatgtaaacagtgc

SEQ ID NO: 155999 - DNA, 15 bp, Homo sapiens
aaggatgtcacaggg

SEQ ID NO: 156000 - DNA, 16 bp, Homo sapiens
aaggatgtcacagggc

SEQ ID NO: 156001 - DNA, 17 bp, Homo sapiens
aaggatgtcacagggcc

SEQ ID NO: 156002 - DNA, 20 bp, Homo sapiens
aaggcaaacccatcaacaaa

SEQ ID NO: 156003 - DNA, 18 bp, Homo sapiens
aaggcaagcacttgtggg

SEQ ID NO: 156004 - DNA, 17 bp, Homo sapiens
aaggccgagaagcaaga

SEQ ID NO: 156005 - DNA, 15 bp, Homo sapiens
aaggctcgattttgt

SEQ ID NO: 156006 - DNA, 17 bp, Homo sapiens
aaggctcgattttgtat

SEQ ID NO: 156007 - DNA, 23 bp, Homo sapiens
aaggctctgagcaaatgtggctc

SEQ ID NO: 156008 - DNA, 23 bp, Homo sapiens
aaggctgaggaaaggccagctgg

SEQ ID NO: 156009 - DNA, 19 bp, Homo sapiens
aaggctgggggaagaagct

SEQ ID NO: 156010 - DNA, 17 bp, Homo sapiens
aaggcttctctctgtgg

SEQ ID NO: 156011 - DNA, 23 bp, Homo sapiens
aagggaaactgccagcaacgcag

SEQ ID NO: 156012 - DNA, 13 bp, Homo sapiens
aagggaaatatca

SEQ ID NO: 156013 - DNA, 13 bp, Homo sapiens
aagggagaaaaaa

SEQ ID NO: 156014 - DNA, 13 bp, Homo sapiens
aaggggaggaggg

SEQ ID NO: 156015 - DNA, 17 bp, Homo sapiens
aaggggccagaggctcg

SEQ ID NO: 156016 - DNA, 22 bp, Homo sapiens
aagggtctagggagagaccctt

SEQ ID NO: 156017 - DNA, 18 bp, Homo sapiens
aacattaagaaaatcata

SEQ ID NO: 156018 - DNA, 16 bp, Homo sapiens
aacattttgtcatata

SEQ ID NO: 156019 - DNA, 21 bp, Homo sapiens
aaccaaaggtgaaggaatata

SEQ ID NO: 156020 - DNA, 16 bp, Homo sapiens
aaccaagccgtggctt

SEQ ID NO: 156021 - DNA, 18 bp, Homo sapiens
aaccaagccgtggcttcc

SEQ ID NO: 156022 - DNA, 15 bp, Homo sapiens
aaccacttcagctga

SEQ ID NO: 156023 - DNA, 18 bp, Homo sapiens
aaccagaataaagttctg

SEQ ID NO: 156024 - DNA, 18 bp, Homo sapiens
aaccagggaagctgtccc

SEQ ID NO: 156025 - DNA, 21 bp, Homo sapiens
aaccatgaagagatttttcat

SEQ ID NO: 156026 - DNA, 23 bp, Homo sapiens
aaccatgaagagatttttcatga

SEQ ID NO: 156027 - DNA, 24 bp, Homo sapiens
aaccatgaagagatttttcatgat

SEQ ID NO: 156028 - DNA, 21 bp, Homo sapiens
aaccatgtcagcaaaaagcaa

SEQ ID NO: 156029 - DNA, 18 bp, Homo sapiens
aacccaagtccaagcata

SEQ ID NO: 156030 - DNA, 12 bp, Homo sapiens
aacccagagagg

SEQ ID NO: 156031 - DNA, 11 bp, Homo sapiens
aacccaggagg

SEQ ID NO: 156032 - DNA, 20 bp, Homo sapiens
aacccatatttgtacaccaa

SEQ ID NO: 156033 - DNA, 15 bp, Homo sapiens
aacccatcagaagga

SEQ ID NO: 156034 - DNA, 17 bp, Homo sapiens
aacccgacagagggaag

SEQ ID NO: 156035 - DNA, 15 bp, Homo sapiens
aaccctattggtaaa

SEQ ID NO: 156036 - DNA, 12 bp, Homo sapiens
aaccctcagagc

SEQ ID NO: 156037 - DNA, 14 bp, Homo sapiens
aacccttgaaaaga

SEQ ID NO: 156038 - DNA, 15 bp, Homo sapiens
aacccttgaaaagac

SEQ ID NO: 156039 - DNA, 21 bp, Homo sapiens
aacccttggagccaatggaga

SEQ ID NO: 156040 - DNA, 13 bp, Homo sapiens
aaccgcaggaagc

SEQ ID NO: 156041 - DNA, 15 bp, Homo sapiens
aaccgcaggaagctg

SEQ ID NO: 156042 - DNA, 22 bp, Homo sapiens
aacctaaatttggttctaggcc

SEQ ID NO: 156043 - DNA, 19 bp, Homo sapiens
aacctgacaaaaaaaaagt

SEQ ID NO: 156044 - DNA, 20 bp, Homo sapiens
aacctgagccccaaaaggta

SEQ ID NO: 156045 - DNA, 19 bp, Homo sapiens
aacctgcaagggctcccca

SEQ ID NO: 156046 - DNA, 22 bp, Homo sapiens
aacctgcaagggctccccactg

SEQ ID NO: 156047 - DNA, 11 bp, Homo sapiens
aacctgctctc

SEQ ID NO: 156048 - DNA, 23 bp, Homo sapiens
aaccttagatgttctaagtcttt

SEQ ID NO: 156049 - DNA, 15 bp, Homo sapiens
aaccttattgtacct

SEQ ID NO: 156050 - DNA, 16 bp, Homo sapiens
aaccttattgtacctc

SEQ ID NO: 156051 - DNA, 17 bp, Homo sapiens
aaccttattgtacctct

SEQ ID NO: 156052 - DNA, 18 bp, Homo sapiens
aacctttcaaatttcaca

SEQ ID NO: 156053 - DNA, 12 bp, Homo sapiens
aacgaggaagcc

SEQ ID NO: 156054 - DNA, 16 bp, Homo sapiens
aacgcagccctgcttt

SEQ ID NO: 156055 - DNA, 12 bp, Homo sapiens
aacgctgcctgc

SEQ ID NO: 156056 - DNA, 14 bp, Homo sapiens
aacgctgcctgccc

SEQ ID NO: 156057 - DNA, 15 bp, Homo sapiens
aacgctgcctgccca

SEQ ID NO: 156058 - DNA, 20 bp, Homo sapiens
aacggagccccaggcctctg

SEQ ID NO: 156059 - DNA, 13 bp, Homo sapiens
aacggttaaaact

SEQ ID NO: 156060 - DNA, 16 bp, Homo sapiens
aacgtggctctgctgg

SEQ ID NO: 156061 - DNA, 15 bp, Homo sapiens
aacgttttgaactaa

SEQ ID NO: 156062 - DNA, 20 bp, Homo sapiens
aacgttttgaactaataaaa

SEQ ID NO: 156063 - DNA, 23 bp, Homo sapiens
aactaagaaatatgcacaatagc

SEQ ID NO: 156064 - DNA, 15 bp, Homo sapiens
aactaataaaagcat

SEQ ID NO: 156065 - DNA, 18 bp, Homo sapiens
aactagccaccaactctt

SEQ ID NO: 156066 - DNA, 17 bp, Homo sapiens
aactagggccaagccca

SEQ ID NO: 156067 - DNA, 15 bp, Homo sapiens
aactagtcctttact

SEQ ID NO: 156068 - DNA, 15 bp, Homo sapiens
aactatgttgataaa

SEQ ID NO: 156069 - DNA, 18 bp, Homo sapiens
aactatttgtctttcagg

SEQ ID NO: 156070 - DNA, 11 bp, Homo sapiens
aactcaaatgc

SEQ ID NO: 156071 - DNA, 16 bp, Homo sapiens
aactcagggacagagc

SEQ ID NO: 156072 - DNA, 18 bp, Homo sapiens
aactcagggacagagcca

SEQ ID NO: 156073 - DNA, 18 bp, Homo sapiens
aactcagttttaactaga

SEQ ID NO: 156074 - DNA, 16 bp, Homo sapiens
aactcatcataaaata

SEQ ID NO: 156075 - DNA, 23 bp, Homo sapiens
aactcattcctgcctgtctcctt

SEQ ID NO: 156076 - DNA, 23 bp, Homo sapiens
aactccaccaacccatcagaagg

SEQ ID NO: 156077 - DNA, 13 bp, Homo sapiens
aactctaattcta

SEQ ID NO: 156078 - DNA, 10 bp, Homo sapiens
aactctcttt

SEQ ID NO: 156079 - DNA, 11 bp, Homo sapiens
aactctgctgt

SEQ ID NO: 156080 - DNA, 13 bp, Homo sapiens
aactctttcaaaa

SEQ ID NO: 156081 - DNA, 19 bp, Homo sapiens
aactctttgaatgacaaag

SEQ ID NO: 156082 - DNA, 16 bp, Homo sapiens
aactgaagtttcacat

SEQ ID NO: 156083 - DNA, 23 bp, Homo sapiens
aactgagatgtgaacacatcagc

SEQ ID NO: 156084 - DNA, 12 bp, Homo sapiens
aactgaggcaga

SEQ ID NO: 156085 - DNA, 23 bp, Homo sapiens
aactgcattaccgcgttgtaaaa

SEQ ID NO: 156086 - DNA, 16 bp, Homo sapiens
aactgccttggcttca

SEQ ID NO: 156087 - DNA, 21 bp, Homo sapiens
aactggactcaggatgcccag

SEQ ID NO: 156088 - DNA, 17 bp, Homo sapiens
aactgtgaagtttacat

SEQ ID NO: 156089 - DNA, 19 bp, Homo sapiens
aactgtgaagtttacattg

SEQ ID NO: 156090 - DNA, 16 bp, Homo sapiens
aacttaaaatatttta

SEQ ID NO: 156091 - DNA, 14 bp, Homo sapiens
aacttaacatattt

SEQ ID NO: 156092 - DNA, 16 bp, Homo sapiens
aacttaacatatttac

SEQ ID NO: 156093 - DNA, 19 bp, Homo sapiens
aacttacctgggcattctt

SEQ ID NO: 156094 - DNA, 23 bp, Homo sapiens
aacttatatcatcagcatacctt

SEQ ID NO: 156095 - DNA, 11 bp, Homo sapiens
aacttcagcag

SEQ ID NO: 156096 - DNA, 13 bp, Homo sapiens
aacttccaattta

SEQ ID NO: 156097 - DNA, 18 bp, Homo sapiens
aacttcccagtgaattct

SEQ ID NO: 156098 - DNA, 20 bp, Homo sapiens
aacttcgaaagcatcattat

SEQ ID NO: 156099 - DNA, 15 bp, Homo sapiens
aacttgtaaatgctg

SEQ ID NO: 156100 - DNA, 15 bp, Homo sapiens
aacttgtaaatgtgg

SEQ ID NO: 156101 - DNA, 21 bp, Homo sapiens
aactttatgctaagtgaaata

SEQ ID NO: 156102 - DNA, 18 bp, Homo sapiens
aactttctcttcatactt

SEQ ID NO: 156103 - DNA, 11 bp, Homo sapiens
aactttctgta

SEQ ID NO: 156104 - DNA, 17 bp, Homo sapiens
aagaaaaatgagcctgg

SEQ ID NO: 156105 - DNA, 16 bp, Homo sapiens
aagaaaagagctttct

SEQ ID NO: 156106 - DNA, 19 bp, Homo sapiens
aagaaaagtgaatgctcaa

SEQ ID NO: 156107 - DNA, 14 bp, Homo sapiens
aagaaaatattttg

SEQ ID NO: 156108 - DNA, 20 bp, Homo sapiens
aagaaaatattttgtctaaa

SEQ ID NO: 156109 - DNA, 22 bp, Homo sapiens
aagaaaatctattttgtaactt

SEQ ID NO: 156110 - DNA, 17 bp, Homo sapiens
aagaagggtccttccct

SEQ ID NO: 156111 - DNA, 16 bp, Homo sapiens
aagaagtgaaaatcta

SEQ ID NO: 156112 - DNA, 18 bp, Homo sapiens
aagaataaaatgttgaaa

SEQ ID NO: 156113 - DNA, 23 bp, Homo sapiens
aagaataaaatgttgaaaagtca

SEQ ID NO: 156114 - DNA, 13 bp, Homo sapiens
aagaatattttaa

SEQ ID NO: 156115 - DNA, 19 bp, Homo sapiens
aggctcgattttgtatctg

SEQ ID NO: 156116 - DNA, 11 bp, Homo sapiens
aggctctgccc

SEQ ID NO: 156117 - DNA, 14 bp, Homo sapiens
aggctgaggaaagg

SEQ ID NO: 156118 - DNA, 20 bp, Homo sapiens
aggctgaggaaaggccagct

SEQ ID NO: 156119 - DNA, 13 bp, Homo sapiens
aggctgaggactt

SEQ ID NO: 156120 - DNA, 18 bp, Homo sapiens
aggctgaggcaagagaat

SEQ ID NO: 156121 - DNA, 14 bp, Homo sapiens
aggctgaggcagaa

SEQ ID NO: 156122 - DNA, 17 bp, Homo sapiens
aggctgaggcagaagaa

SEQ ID NO: 156123 - DNA, 13 bp, Homo sapiens
aggctgaggcctg

SEQ ID NO: 156124 - DNA, 17 bp, Homo sapiens
aggctgaggcctggact

SEQ ID NO: 156125 - DNA, 19 bp, Homo sapiens
aggctgcagtgagccgaga

SEQ ID NO: 156126 - DNA, 13 bp, Homo sapiens
aggctgctggagg

SEQ ID NO: 156127 - DNA, 14 bp, Homo sapiens
aggctggaggcagg

SEQ ID NO: 156128 - DNA, 17 bp, Homo sapiens
aggctggaggcagggcc

SEQ ID NO: 156129 - DNA, 19 bp, Homo sapiens
aggctggaggcagggcctt

SEQ ID NO: 156130 - DNA, 18 bp, Homo sapiens
aggctggtgggaggggcg

SEQ ID NO: 156131 - DNA, 16 bp, Homo sapiens
aggcttctctctgtgg

SEQ ID NO: 156132 - DNA, 16 bp, Homo sapiens
agggaaactgccagca

SEQ ID NO: 156133 - DNA, 15 bp, Homo sapiens
agggaaatatcattt

SEQ ID NO: 156134 - DNA, 15 bp, Homo sapiens
agggaacagacagga

SEQ ID NO: 156135 - DNA, 20 bp, Homo sapiens
agggaacagacaggagaaat

SEQ ID NO: 156136 - DNA, 21 bp, Homo sapiens
agggaatgaaggtgtcagaat

SEQ ID NO: 156137 - DNA, 20 bp, Homo sapiens
agggacagagacacctgcac

SEQ ID NO: 156138 - DNA, 15 bp, Homo sapiens
agggacgcctggggg

SEQ ID NO: 156139 - DNA, 18 bp, Homo sapiens
agggacgcctgggggtgc

SEQ ID NO: 156140 - DNA, 22 bp, Homo sapiens
agggacgcctgggggtgccagg

SEQ ID NO: 156141 - DNA, 13 bp, Homo sapiens
agggagagaagat

SEQ ID NO: 156142 - DNA, 14 bp, Homo sapiens
agggagagaagata

SEQ ID NO: 156143 - DNA, 13 bp, Homo sapiens
agggagagagaga

SEQ ID NO: 156144 - DNA, 14 bp, Homo sapiens
agggagcctggccc

SEQ ID NO: 156145 - DNA, 14 bp, Homo sapiens
agggagcggaaagc

SEQ ID NO: 156146 - DNA, 17 bp, Homo sapiens
agggagcggaaagcagc

SEQ ID NO: 156147 - DNA, 14 bp, Homo sapiens
agggatacactgaa

SEQ ID NO: 156148 - DNA, 16 bp, Homo sapiens
agggatagaggggggc

SEQ ID NO: 156149 - DNA, 18 bp, Homo sapiens
agggatatataagatgga

SEQ ID NO: 156150 - DNA, 18 bp, Homo sapiens
agggatgaaggcctccct

SEQ ID NO: 156151 - DNA, 23 bp, Homo sapiens
agggatgaggtgctgggagggat

SEQ ID NO: 156152 - DNA, 18 bp, Homo sapiens
agggatgccatctgtggg

SEQ ID NO: 156153 - DNA, 16 bp, Homo sapiens
agggatggattccaac

SEQ ID NO: 156154 - DNA, 17 bp, Homo sapiens
agggattaacctctgca

SEQ ID NO: 156155 - DNA, 22 bp, Homo sapiens
agggcaacaatacatgctgcta

SEQ ID NO: 156156 - DNA, 14 bp, Homo sapiens
agggcactggtggc

SEQ ID NO: 156157 - DNA, 14 bp, Homo sapiens
agggcagaggctgg

SEQ ID NO: 156158 - DNA, 20 bp, Homo sapiens
agggcagtcgatagagctgt

SEQ ID NO: 156159 - DNA, 20 bp, Homo sapiens
agggccacatgggaggctca

SEQ ID NO: 156160 - DNA, 15 bp, Homo sapiens
agggccactctgcct

SEQ ID NO: 156161 - DNA, 18 bp, Homo sapiens
agggccactctgcctctg

SEQ ID NO: 156162 - DNA, 12 bp, Homo sapiens
agggccaggact

SEQ ID NO: 156163 - DNA, 17 bp, Homo sapiens
agggccaggactgagcc

SEQ ID NO: 156164 - DNA, 21 bp, Homo sapiens
agggccaggactgagccccgc

SEQ ID NO: 156165 - DNA, 10 bp, Homo sapiens
agggccaggc

SEQ ID NO: 156166 - DNA, 12 bp, Homo sapiens
agggccaggcag

SEQ ID NO: 156167 - DNA, 14 bp, Homo sapiens
agggccaggcaggt

SEQ ID NO: 156168 - DNA, 21 bp, Homo sapiens
agggccaggcaggtgcctgga

SEQ ID NO: 156169 - DNA, 15 bp, Homo sapiens
agggcccagagcagg

SEQ ID NO: 156170 - DNA, 15 bp, Homo sapiens
agggcctgagcctgg

SEQ ID NO: 156171 - DNA, 20 bp, Homo sapiens
agggcctgcaggacctgcct

SEQ ID NO: 156172 - DNA, 15 bp, Homo sapiens
agggccttgcccaga

SEQ ID NO: 156173 - DNA, 17 bp, Homo sapiens
agggccttgcccagaga

SEQ ID NO: 156174 - DNA, 13 bp, Homo sapiens
agggctaagagct

SEQ ID NO: 156175 - DNA, 21 bp, Homo sapiens
agggctactgcagctttacat

SEQ ID NO: 156176 - DNA, 22 bp, Homo sapiens
agggctagtgacttgtgtccca

SEQ ID NO: 156177 - DNA, 14 bp, Homo sapiens
agggctcagcctgg

SEQ ID NO: 156178 - DNA, 11 bp, Homo sapiens
agggctcccca

SEQ ID NO: 156179 - DNA, 20 bp, Homo sapiens
agggctccccactgcctact

SEQ ID NO: 156180 - DNA, 20 bp, Homo sapiens
agggctgacacgtccacccc

SEQ ID NO: 156181 - DNA, 23 bp, Homo sapiens
aggggacgctggtagagatggag

SEQ ID NO: 156182 - DNA, 14 bp, Homo sapiens
aggggcagaacagc

SEQ ID NO: 156183 - DNA, 15 bp, Homo sapiens
aggggcagtctggag

SEQ ID NO: 156184 - DNA, 16 bp, Homo sapiens
aggggcagtctggagg

SEQ ID NO: 156185 - DNA, 17 bp, Homo sapiens
aggggcagtctggaggg

SEQ ID NO: 156186 - DNA, 20 bp, Homo sapiens
aggggcagtctggaggggca

SEQ ID NO: 156187 - DNA, 21 bp, Homo sapiens
aggggcccgagcagaagcagg

SEQ ID NO: 156188 - DNA, 14 bp, Homo sapiens
aggggcgcccacct

SEQ ID NO: 156189 - DNA, 10 bp, Homo sapiens
agggggccac

SEQ ID NO: 156190 - DNA, 17 bp, Homo sapiens
aggggggctgcctggcc

SEQ ID NO: 156191 - DNA, 16 bp, Homo sapiens
aggggtcaaagaaatg

SEQ ID NO: 156192 - DNA, 15 bp, Homo sapiens
agggtaaggtgcctt

SEQ ID NO: 156193 - DNA, 21 bp, Homo sapiens
agggtcagacgcctgaggaac

SEQ ID NO: 156194 - DNA, 13 bp, Homo sapiens
agggtcaggaagg

SEQ ID NO: 156195 - DNA, 22 bp, Homo sapiens
agggtcaggaaggatgagcatt

SEQ ID NO: 156196 - DNA, 18 bp, Homo sapiens
agggtcaggagaggggca

SEQ ID NO: 156197 - DNA, 18 bp, Homo sapiens
agggtccccacctgggac

SEQ ID NO: 156198 - DNA, 15 bp, Homo sapiens
agggtcctccacaat

SEQ ID NO: 156199 - DNA, 14 bp, Homo sapiens
agggtccttccctc

SEQ ID NO: 156200 - DNA, 17 bp, Homo sapiens
agggtccttccctctcc

SEQ ID NO: 156201 - DNA, 22 bp, Homo sapiens
agggtccttccctctccccaag

SEQ ID NO: 156202 - DNA, 19 bp, Homo sapiens
agggtctagggagagaccc

SEQ ID NO: 156203 - DNA, 15 bp, Homo sapiens
agggtctggagaagc

SEQ ID NO: 156204 - DNA, 19 bp, Homo sapiens
agggtctggagaagcagtg

SEQ ID NO: 156205 - DNA, 13 bp, Homo sapiens
agggtgaggatgg

SEQ ID NO: 156206 - DNA, 20 bp, Homo sapiens
agggtggacttagaaagcag

SEQ ID NO: 156207 - DNA, 22 bp, Homo sapiens
agggtggacttagaaagcaggg

SEQ ID NO: 156208 - DNA, 21 bp, Homo sapiens
agggtggctgggtccagggga

SEQ ID NO: 156209 - DNA, 21 bp, Homo sapiens
agggtgttgggatactgcagg

SEQ ID NO: 156210 - DNA, 13 bp, Homo sapiens
agggttagggagg

SEQ ID NO: 156211 - DNA, 16 bp, Homo sapiens
agggttgaccccagag

SEQ ID NO: 156212 - DNA, 20 bp, Homo sapiens
agggtttatgtttaggatgt

SEQ ID NO: 156213 - DNA, 21 bp, Homo sapiens
agggtttggctgtgtctaaac

SEQ ID NO: 156214 - DNA, 22 bp, Homo sapiens
agggtttggctgtgtctaaact

SEQ ID NO: 156215 - DNA, 22 bp, Homo sapiens
aggtaccagcaatatgtaaata

SEQ ID NO: 156216 - DNA, 19 bp, Homo sapiens
aggtaggagaattgcttga

SEQ ID NO: 156217 - DNA, 11 bp, Homo sapiens
aggtataattt

SEQ ID NO: 156218 - DNA, 19 bp, Homo sapiens
aggtcaagaagaagatgga

SEQ ID NO: 156219 - DNA, 16 bp, Homo sapiens
aggtcaagcccaggag

SEQ ID NO: 156220 - DNA, 21 bp, Homo sapiens
aggtcaaggctgcagtgagcc

SEQ ID NO: 156221 - DNA, 20 bp, Homo sapiens
aggtcaggagttcctaacca

SEQ ID NO: 156222 - DNA, 14 bp, Homo sapiens
aggtcgaggcagga

SEQ ID NO: 156223 - DNA, 22 bp, Homo sapiens
aggtctaggaacatacttcagc

SEQ ID NO: 156224 - DNA, 14 bp, Homo sapiens
aggtctcctcttaa

SEQ ID NO: 156225 - DNA, 23 bp, Homo sapiens
aggtctcctcttaaaaaataaaa

SEQ ID NO: 156226 - DNA, 13 bp, Homo sapiens
aggtgagggaagc

SEQ ID NO: 156227 - DNA, 18 bp, Homo sapiens
aggtgcagagtgcccaga

SEQ ID NO: 156228 - DNA, 17 bp, Homo sapiens
aggtgcccatccctgga

SEQ ID NO: 156229 - DNA, 20 bp, Homo sapiens
aggtgcccttggaggccagc

SEQ ID NO: 156230 - DNA, 17 bp, Homo sapiens
aggtgcctgtgaggcag

SEQ ID NO: 156231 - DNA, 21 bp, Homo sapiens
aggtgcctgtgaggcaggggc

SEQ ID NO: 156232 - DNA, 22 bp, Homo sapiens
aggtgccttcttattctcactc

SEQ ID NO: 156233 - DNA, 21 bp, Homo sapiens
aggtgctacaaaaacacagca

SEQ ID NO: 156234 - DNA, 20 bp, Homo sapiens
aggtgctacacccttttcca

SEQ ID NO: 156235 - DNA, 23 bp, Homo sapiens
aggtgctggaggtgggagcagga

SEQ ID NO: 156236 - DNA, 15 bp, Homo sapiens
aggtgctgggaggga

SEQ ID NO: 156237 - DNA, 23 bp, Homo sapiens
aggtgctgttatccatggggaag

SEQ ID NO: 156238 - DNA, 13 bp, Homo sapiens
aggtggaaaaaca

SEQ ID NO: 156239 - DNA, 13 bp, Homo sapiens
aggtggaagccct

SEQ ID NO: 156240 - DNA, 20 bp, Homo sapiens
aggtggaagccctccttcca

SEQ ID NO: 156241 - DNA, 16 bp, Homo sapiens
aggtggactggaaggg

SEQ ID NO: 156242 - DNA, 20 bp, Homo sapiens
aggtggaggttgcagtgagc

SEQ ID NO: 156243 - DNA, 16 bp, Homo sapiens
aggtggatcacagagg

SEQ ID NO: 156244 - DNA, 17 bp, Homo sapiens
aggtggccactccagac

SEQ ID NO: 156245 - DNA, 23 bp, Homo sapiens
aggtggctgacccagtccctggg

SEQ ID NO: 156246 - DNA, 16 bp, Homo sapiens
aggtgggagcaggaga

SEQ ID NO: 156247 - DNA, 17 bp, Homo sapiens
aggtgggagcaggagat

SEQ ID NO: 156248 - DNA, 23 bp, Homo sapiens
aggtgggatatccctatgctgcc

SEQ ID NO: 156249 - DNA, 21 bp, Homo sapiens
aggtggggtctttgtgagagt

SEQ ID NO: 156250 - DNA, 21 bp, Homo sapiens
aggtgggttttcttcccatca

SEQ ID NO: 156251 - DNA, 17 bp, Homo sapiens
aggtgtcatttccatta

SEQ ID NO: 156252 - DNA, 21 bp, Homo sapiens
aggtgttgccaaatatgtcct

SEQ ID NO: 156253 - DNA, 22 bp, Homo sapiens
aggtgttgccaaatatgtcctg

SEQ ID NO: 156254 - DNA, 23 bp, Homo sapiens
aggtgttgccaaatatgtcctgg

SEQ ID NO: 156255 - DNA, 16 bp, Homo sapiens
aggttaaggctgagga

SEQ ID NO: 156256 - DNA, 15 bp, Homo sapiens
aggttaattccaatt

SEQ ID NO: 156257 - DNA, 21 bp, Homo sapiens
aggttcatgccaccatggcca

SEQ ID NO: 156258 - DNA, 18 bp, Homo sapiens
aggttccgcttggagcag

SEQ ID NO: 156259 - DNA, 20 bp, Homo sapiens
aggttggcaaaaaggcagga

SEQ ID NO: 156260 - DNA, 23 bp, Homo sapiens
aggtttacaatttacaaagtgtg

SEQ ID NO: 156261 - DNA, 15 bp, Homo sapiens
aggttttgtaaagat

SEQ ID NO: 156262 - DNA, 17 bp, Homo sapiens
tctgtctcatccatcat

SEQ ID NO: 156263 - DNA, 15 bp, Homo sapiens
tctgtcttcacaaca

SEQ ID NO: 156264 - DNA, 17 bp, Homo sapiens
tctgtgaaatgctggca

SEQ ID NO: 156265 - DNA, 16 bp, Homo sapiens
tctgtgaccaatgtct

SEQ ID NO: 156266 - DNA, 19 bp, Homo sapiens
tctgtgaccaatgtcttga

SEQ ID NO: 156267 - DNA, 15 bp, Homo sapiens
tctgtgacctcaggc

SEQ ID NO: 156268 - DNA, 17 bp, Homo sapiens
tctgtgagattcattca

SEQ ID NO: 156269 - DNA, 19 bp, Homo sapiens
tctgtgagattcattcatg

SEQ ID NO: 156270 - DNA, 23 bp, Homo sapiens
tctgtgggatgggatggtggagg

SEQ ID NO: 156271 - DNA, 15 bp, Homo sapiens
tctgtgtccttccct

SEQ ID NO: 156272 - DNA, 17 bp, Homo sapiens
tctgtgtccttccctgc

SEQ ID NO: 156273 - DNA, 18 bp, Homo sapiens
tctgtgtccttccctgca

SEQ ID NO: 156274 - DNA, 12 bp, Homo sapiens
tctgtgtcttgt

SEQ ID NO: 156275 - DNA, 20 bp, Homo sapiens
tctgtgtgatgaactttctc

SEQ ID NO: 156276 - DNA, 19 bp, Homo sapiens
tctgtgtgcaccttaccaa

SEQ ID NO: 156277 - DNA, 22 bp, Homo sapiens
tctgtgtgcaccttaccaactt

SEQ ID NO: 156278 - DNA, 13 bp, Homo sapiens
tctgttcaccttc

SEQ ID NO: 156279 - DNA, 20 bp, Homo sapiens
tctgttccccatggccactt

SEQ ID NO: 156280 - DNA, 17 bp, Homo sapiens
tctgtttaaagtagatt

SEQ ID NO: 156281 - DNA, 23 bp, Homo sapiens
tctgttttctttctaatgagata

SEQ ID NO: 156282 - DNA, 14 bp, Homo sapiens
tcttaaaataactt

SEQ ID NO: 156283 - DNA, 15 bp, Homo sapiens
tcttaaaataactta

SEQ ID NO: 156284 - DNA, 18 bp, Homo sapiens
tcttaatataactgcctt

SEQ ID NO: 156285 - DNA, 23 bp, Homo sapiens
tcttaatttaatcttttttatgt

SEQ ID NO: 156286 - DNA, 13 bp, Homo sapiens
tcttactgcaaat

SEQ ID NO: 156287 - DNA, 14 bp, Homo sapiens
tcttactgcaaatg

SEQ ID NO: 156288 - DNA, 22 bp, Homo sapiens
tcttactttcctttccccagcc

SEQ ID NO: 156289 - DNA, 23 bp, Homo sapiens
tcttactttcctttccccagccc

SEQ ID NO: 156290 - DNA, 15 bp, Homo sapiens
tcttaggaagagaaa

SEQ ID NO: 156291 - DNA, 20 bp, Homo sapiens
tcttaggttggcaaaaaggc

SEQ ID NO: 156292 - DNA, 14 bp, Homo sapiens
tcttatacatttga

SEQ ID NO: 156293 - DNA, 22 bp, Homo sapiens
tcttatagtcaatgtttctttt

SEQ ID NO: 156294 - DNA, 15 bp, Homo sapiens
tcttattctcactcc

SEQ ID NO: 156295 - DNA, 13 bp, Homo sapiens
tcttatttattat

SEQ ID NO: 156296 - DNA, 16 bp, Homo sapiens
tcttatttcatgaaaa

SEQ ID NO: 156297 - DNA, 18 bp, Homo sapiens
tcttatttcatgaaaatt

SEQ ID NO: 156298 - DNA, 15 bp, Homo sapiens
tcttatttcatttct

SEQ ID NO: 156299 - DNA, 19 bp, Homo sapiens
tcttcaactgaccagcctc

SEQ ID NO: 156300 - DNA, 18 bp, Homo sapiens
tcttcactctctgaagat

SEQ ID NO: 156301 - DNA, 19 bp, Homo sapiens
tcttcagccacctctcttt

SEQ ID NO: 156302 - DNA, 12 bp, Homo sapiens
tcttcagcctag

SEQ ID NO: 156303 - DNA, 21 bp, Homo sapiens
tcttcagcctagccgacctca

SEQ ID NO: 156304 - DNA, 22 bp, Homo sapiens
tcttcagcctctttctgtccct

SEQ ID NO: 156305 - DNA, 16 bp, Homo sapiens
tcttcaggtggaaaaa

SEQ ID NO: 156306 - DNA, 15 bp, Homo sapiens
tcttcagtaagccgt

SEQ ID NO: 156307 - DNA, 16 bp, Homo sapiens
tcttcagtaagccgtg

SEQ ID NO: 156308 - DNA, 20 bp, Homo sapiens
tcttcataacaattttagga

SEQ ID NO: 156309 - DNA, 22 bp, Homo sapiens
tcttcattaagccctcttccat

SEQ ID NO: 156310 - DNA, 18 bp, Homo sapiens
tcttcccgaaccccaagg

SEQ ID NO: 156311 - DNA, 22 bp, Homo sapiens
tcttccctacagttgaaaaaca

SEQ ID NO: 156312 - DNA, 12 bp, Homo sapiens
tcttcctctgct

SEQ ID NO: 156313 - DNA, 14 bp, Homo sapiens
tcttcctctgctga

SEQ ID NO: 156314 - DNA, 14 bp, Homo sapiens
tcttcctgagtggt

SEQ ID NO: 156315 - DNA, 20 bp, Homo sapiens
tcttctcaggctctgccctg

SEQ ID NO: 156316 - DNA, 21 bp, Homo sapiens
tcttctcaggctctgccctgc

SEQ ID NO: 156317 - DNA, 12 bp, Homo sapiens
tcttctccacca

SEQ ID NO: 156318 - DNA, 12 bp, Homo sapiens
tcttctccatct

SEQ ID NO: 156319 - DNA, 18 bp, Homo sapiens
tcttctgccggccctggg

SEQ ID NO: 156320 - DNA, 17 bp, Homo sapiens
tcttctgggagggcagc

SEQ ID NO: 156321 - DNA, 23 bp, Homo sapiens
tcttctgggagggcagcagggct

SEQ ID NO: 156322 - DNA, 13 bp, Homo sapiens
tcttcttaactta

SEQ ID NO: 156323 - DNA, 18 bp, Homo sapiens
tcttcttaagacttttgg

SEQ ID NO: 156324 - DNA, 13 bp, Homo sapiens
tcttcttcaccat

SEQ ID NO: 156325 - DNA, 14 bp, Homo sapiens
tcttgaaagctgtg

SEQ ID NO: 156326 - DNA, 21 bp, Homo sapiens
tcttgaatttaataatctgta

SEQ ID NO: 156327 - DNA, 21 bp, Homo sapiens
tcttgaccaagcaggaagctc

SEQ ID NO: 156328 - DNA, 23 bp, Homo sapiens
tcttgcaccccaaagctttcctg

SEQ ID NO: 156329 - DNA, 17 bp, Homo sapiens
tcttgccactgcctctt

SEQ ID NO: 156330 - DNA, 13 bp, Homo sapiens
tcttggttgagga

SEQ ID NO: 156331 - DNA, 15 bp, Homo sapiens
tcttggttgaggaaa

SEQ ID NO: 156332 - DNA, 14 bp, Homo sapiens
tcttgtctctgggc

SEQ ID NO: 156333 - DNA, 23 bp, Homo sapiens
tcttgtgctggatggagcccagg

SEQ ID NO: 156334 - DNA, 14 bp, Homo sapiens
tcttgtttcaattc

SEQ ID NO: 156335 - DNA, 20 bp, Homo sapiens
tctttaacttaattgctatg

SEQ ID NO: 156336 - DNA, 23 bp, Homo sapiens
tctttaatcattttgcctctttt

SEQ ID NO: 156337 - DNA, 20 bp, Homo sapiens
tctttataattctactttga

SEQ ID NO: 156338 - DNA, 20 bp, Homo sapiens
tctttcaaaaccttttgaaa

SEQ ID NO: 156339 - DNA, 23 bp, Homo sapiens
tctttcaaaaccttttgaaatta

SEQ ID NO: 156340 - DNA, 23 bp, Homo sapiens
tctttcatccactagtgcaaatc

SEQ ID NO: 156341 - DNA, 21 bp, Homo sapiens
tctttctaactccagtgaagt

SEQ ID NO: 156342 - DNA, 19 bp, Homo sapiens
tctttctagttcagctgcc

SEQ ID NO: 156343 - DNA, 13 bp, Homo sapiens
tctttctgtccct

SEQ ID NO: 156344 - DNA, 15 bp, Homo sapiens
tctttcttcctctgc

SEQ ID NO: 156345 - DNA, 16 bp, Homo sapiens
tctttcttcctctgct

SEQ ID NO: 156346 - DNA, 14 bp, Homo sapiens
tcttttacattctg

SEQ ID NO: 156347 - DNA, 13 bp, Homo sapiens
tcttttctctgtg

SEQ ID NO: 156348 - DNA, 10 bp, Homo sapiens
tcttttgtat

SEQ ID NO: 156349 - DNA, 15 bp, Homo sapiens
tcttttgtatgtaaa

SEQ ID NO: 156350 - DNA, 17 bp, Homo sapiens
tcttttgtatgtaaatg

SEQ ID NO: 156351 - DNA, 20 bp, Homo sapiens
tcttttgtatgtaaatgtgc

SEQ ID NO: 156352 - DNA, 14 bp, Homo sapiens
tgaaaaaaaagttt

SEQ ID NO: 156353 - DNA, 22 bp, Homo sapiens
tgaaaaagttctgcagataaac

SEQ ID NO: 156354 - DNA, 19 bp, Homo sapiens
tgaaaacatggtagaattg

SEQ ID NO: 156355 - DNA, 23 bp, Homo sapiens
tgaaaacatggtagaattggaga

SEQ ID NO: 156356 - DNA, 15 bp, Homo sapiens
tgaaaagaaaaatga

SEQ ID NO: 156357 - DNA, 18 bp, Homo sapiens
tgaaaagacatcaagcac

SEQ ID NO: 156358 - DNA, 22 bp, Homo sapiens
tgaaaagactccaaagaaatgt

SEQ ID NO: 156359 - DNA, 16 bp, Homo sapiens
tgaaaagataaattat

SEQ ID NO: 156360 - DNA, 21 bp, Homo sapiens
tgaaaatatttgtatcacaaa

SEQ ID NO: 156361 - DNA, 22 bp, Homo sapiens
tgaaaatatttgtatcacaaat

SEQ ID NO: 156362 - DNA, 14 bp, Homo sapiens
tgaaaatctaatat

SEQ ID NO: 156363 - DNA, 21 bp, Homo sapiens
tgaaaatctaatattaaaaat

SEQ ID NO: 156364 - DNA, 15 bp, Homo sapiens
tgaaaattattttaa

SEQ ID NO: 156365 - DNA, 18 bp, Homo sapiens
tgaaaattattttaaaca

SEQ ID NO: 156366 - DNA, 19 bp, Homo sapiens
tgaaaattattttaaacaa

SEQ ID NO: 156367 - DNA, 21 bp, Homo sapiens
tgaaaattattttaaacaaaa

SEQ ID NO: 156368 - DNA, 14 bp, Homo sapiens
tgaaaattcagtgg

SEQ ID NO: 156369 - DNA, 22 bp, Homo sapiens
tgaaacaacaaataggaattgt

SEQ ID NO: 156370 - DNA, 17 bp, Homo sapiens
tgaaacaagaagccaca

SEQ ID NO: 156371 - DNA, 23 bp, Homo sapiens
tgaaacactcagttgttcaataa

SEQ ID NO: 156372 - DNA, 21 bp, Homo sapiens
tgaaacaggagagaaagggga

SEQ ID NO: 156373 - DNA, 15 bp, Homo sapiens
tgaaaccctggacca

SEQ ID NO: 156374 - DNA, 21 bp, Homo sapiens
tgaaaccctggaccagtggtc

SEQ ID NO: 156375 - DNA, 19 bp, Homo sapiens
tgaaagaggctgaggcctg

SEQ ID NO: 156376 - DNA, 19 bp, Homo sapiens
tgaaagcagggacttgaac

SEQ ID NO: 156377 - DNA, 14 bp, Homo sapiens
tgaaaggagccctt

SEQ ID NO: 156378 - DNA, 18 bp, Homo sapiens
tgaaataagccagacatc

SEQ ID NO: 156379 - DNA, 16 bp, Homo sapiens
tgaaataccagtgtgg

SEQ ID NO: 156380 - DNA, 16 bp, Homo sapiens
tgaaatgctctccttt

SEQ ID NO: 156381 - DNA, 17 bp, Homo sapiens
tgaaattaacctctcac

SEQ ID NO: 156382 - DNA, 17 bp, Homo sapiens
tgaaattatgtatgttt

SEQ ID NO: 156383 - DNA, 21 bp, Homo sapiens
tgaaattatgtatgtttacat

SEQ ID NO: 156384 - DNA, 22 bp, Homo sapiens
tgaaatttattagttaatatat

SEQ ID NO: 156385 - DNA, 19 bp, Homo sapiens
tgaaattttaaaaattgtt

SEQ ID NO: 156386 - DNA, 21 bp, Homo sapiens
tgaaattttctagactttctg

SEQ ID NO: 156387 - DNA, 19 bp, Homo sapiens
tgaacaaatttacagagac

SEQ ID NO: 156388 - DNA, 12 bp, Homo sapiens
tgaacccaggag

SEQ ID NO: 156389 - DNA, 14 bp, Homo sapiens
tgaacccaggaggt

SEQ ID NO: 156390 - DNA, 13 bp, Homo sapiens
tgaacccttgctt

SEQ ID NO: 156391 - DNA, 15 bp, Homo sapiens
tgaacctgatgctga

SEQ ID NO: 156392 - DNA, 20 bp, Homo sapiens
tgaactaccttggttccccc

SEQ ID NO: 156393 - DNA, 15 bp, Homo sapiens
tgaactcttaatcaa

SEQ ID NO: 156394 - DNA, 17 bp, Homo sapiens
tgaactctttgaatgac

SEQ ID NO: 156395 - DNA, 15 bp, Homo sapiens
tgaactgaagtttca

SEQ ID NO: 156396 - DNA, 14 bp, Homo sapiens
tgaagacagaggga

SEQ ID NO: 156397 - DNA, 23 bp, Homo sapiens
tgaagagtaagtcaacctgcctg

SEQ ID NO: 156398 - DNA, 15 bp, Homo sapiens
tgaagatatttttcc

SEQ ID NO: 156399 - DNA, 21 bp, Homo sapiens
tgaagatgcagcaaaatgtga

SEQ ID NO: 156400 - DNA, 16 bp, Homo sapiens
tgaagatgtctaatag

SEQ ID NO: 156401 - DNA, 18 bp, Homo sapiens
tgaagattctcctgtgct

SEQ ID NO: 156402 - DNA, 19 bp, Homo sapiens
tgaagcagatgcaaagagg

SEQ ID NO: 156403 - DNA, 16 bp, Homo sapiens
tgaagccagccttctt

SEQ ID NO: 156404 - DNA, 15 bp, Homo sapiens
tgaaggaaaatgata

SEQ ID NO: 156405 - DNA, 11 bp, Homo sapiens
tgaaggagccc

SEQ ID NO: 156406 - DNA, 19 bp, Homo sapiens
tgaaggcttctctctgtgg

SEQ ID NO: 156407 - DNA, 21 bp, Homo sapiens
tgaagggaaaggatattttct

SEQ ID NO: 156408 - DNA, 15 bp, Homo sapiens
tgaaggttaggattt

SEQ ID NO: 156409 - DNA, 20 bp, Homo sapiens
aggtttttggaattatgtct

SEQ ID NO: 156410 - DNA, 21 bp, Homo sapiens
aggtttttttgtatagtaaag

SEQ ID NO: 156411 - DNA, 22 bp, Homo sapiens
aggtttttttgtatagtaaagt

SEQ ID NO: 156412 - DNA, 12 bp, Homo sapiens
agtaaaaataaa

SEQ ID NO: 156413 - DNA, 15 bp, Homo sapiens
agtaaaaataaaatt

SEQ ID NO: 156414 - DNA, 16 bp, Homo sapiens
agtaaaaccacagcag

SEQ ID NO: 156415 - DNA, 14 bp, Homo sapiens
agtaaaacttgctg

SEQ ID NO: 156416 - DNA, 14 bp, Homo sapiens
agtaaagctaaaat

SEQ ID NO: 156417 - DNA, 18 bp, Homo sapiens
agtaaagtgataatttct

SEQ ID NO: 156418 - DNA, 22 bp, Homo sapiens
agtaaatgctaggttaattcca

SEQ ID NO: 156419 - DNA, 16 bp, Homo sapiens
agtaacgcgtcttcct

SEQ ID NO: 156420 - DNA, 18 bp, Homo sapiens
agtaacgcgtcttcctga

SEQ ID NO: 156421 - DNA, 22 bp, Homo sapiens
agtaacgcgtcttcctgagtgg

SEQ ID NO: 156422 - DNA, 17 bp, Homo sapiens
agtaacttacttaggtg

SEQ ID NO: 156423 - DNA, 12 bp, Homo sapiens
agtaagaaaata

SEQ ID NO: 156424 - DNA, 16 bp, Homo sapiens
agtaagggaaatagaa

SEQ ID NO: 156425 - DNA, 14 bp, Homo sapiens
agtaatagagcaaa

SEQ ID NO: 156426 - DNA, 15 bp, Homo sapiens
agtaattcaagaaaa

SEQ ID NO: 156427 - DNA, 13 bp, Homo sapiens
agtaattgtgaaa

SEQ ID NO: 156428 - DNA, 17 bp, Homo sapiens
agtacaggcagcacaga

SEQ ID NO: 156429 - DNA, 12 bp, Homo sapiens
agtacatttaat

SEQ ID NO: 156430 - DNA, 13 bp, Homo sapiens
agtacatttaata

SEQ ID NO: 156431 - DNA, 16 bp, Homo sapiens
agtaccaatcatttta

SEQ ID NO: 156432 - DNA, 23 bp, Homo sapiens
agtactaactcctaggaaaatac

SEQ ID NO: 156433 - DNA, 19 bp, Homo sapiens
agtagaacagataatcagt

SEQ ID NO: 156434 - DNA, 15 bp, Homo sapiens
agtagccctttctgt

SEQ ID NO: 156435 - DNA, 20 bp, Homo sapiens
agtagccctttctgtgtgca

SEQ ID NO: 156436 - DNA, 20 bp, Homo sapiens
agtagcttgggacaaatcaa

SEQ ID NO: 156437 - DNA, 12 bp, Homo sapiens
agtagtcatttc

SEQ ID NO: 156438 - DNA, 13 bp, Homo sapiens
agtagtcatttca

SEQ ID NO: 156439 - DNA, 14 bp, Homo sapiens
agtagttaattctg

SEQ ID NO: 156440 - DNA, 17 bp, Homo sapiens
agtagtttgtataactt

SEQ ID NO: 156441 - DNA, 15 bp, Homo sapiens
agtatcaggcctgcc

SEQ ID NO: 156442 - DNA, 12 bp, Homo sapiens
agtatgaaaata

SEQ ID NO: 156443 - DNA, 16 bp, Homo sapiens
agtatgaataaagaca

SEQ ID NO: 156444 - DNA, 22 bp, Homo sapiens
agtattccattgtgtgagtgta

SEQ ID NO: 156445 - DNA, 18 bp, Homo sapiens
agtattcttgtcaaaaaa

SEQ ID NO: 156446 - DNA, 12 bp, Homo sapiens
agtatttatata

SEQ ID NO: 156447 - DNA, 16 bp, Homo sapiens
agtatttatatattta

SEQ ID NO: 156448 - DNA, 19 bp, Homo sapiens
agtatttatatatttataa

SEQ ID NO: 156449 - DNA, 20 bp, Homo sapiens
agtatttatatatttataac

SEQ ID NO: 156450 - DNA, 16 bp, Homo sapiens
agtatttgcatattct

SEQ ID NO: 156451 - DNA, 21 bp, Homo sapiens
agtcaaaacagagatgtgata

SEQ ID NO: 156452 - DNA, 15 bp, Homo sapiens
agtcaaaaggtgcct

SEQ ID NO: 156453 - DNA, 18 bp, Homo sapiens
agtcaaaaggtgcctgtg

SEQ ID NO: 156454 - DNA, 17 bp, Homo sapiens
agtcaaaccataaactt

SEQ ID NO: 156455 - DNA, 20 bp, Homo sapiens
agtcaaaccataaacttcat

SEQ ID NO: 156456 - DNA, 21 bp, Homo sapiens
agtcaaagtaaaacttgctgc

SEQ ID NO: 156457 - DNA, 16 bp, Homo sapiens
agtcaaggagtggctt

SEQ ID NO: 156458 - DNA, 23 bp, Homo sapiens
agtcaatgttttcagttctcttg

SEQ ID NO: 156459 - DNA, 13 bp, Homo sapiens
agtcaccaggaat

SEQ ID NO: 156460 - DNA, 22 bp, Homo sapiens
agtcagtgggaacgtgactgcc

SEQ ID NO: 156461 - DNA, 14 bp, Homo sapiens
agtcagtttgcagt

SEQ ID NO: 156462 - DNA, 16 bp, Homo sapiens
agtcataggttaatat

SEQ ID NO: 156463 - DNA, 13 bp, Homo sapiens
agtcatccaatct

SEQ ID NO: 156464 - DNA, 14 bp, Homo sapiens
agtcatctcaacca

SEQ ID NO: 156465 - DNA, 15 bp, Homo sapiens
agtcatgatctccct

SEQ ID NO: 156466 - DNA, 16 bp, Homo sapiens
agtcatgatctccctg

SEQ ID NO: 156467 - DNA, 18 bp, Homo sapiens
agtcatgatctccctgcc

SEQ ID NO: 156468 - DNA, 21 bp, Homo sapiens
agtcatgatctccctgccgcc

SEQ ID NO: 156469 - DNA, 23 bp, Homo sapiens
agtcatgatctccctgccgcctc

SEQ ID NO: 156470 - DNA, 13 bp, Homo sapiens
agtcatgtgcatt

SEQ ID NO: 156471 - DNA, 19 bp, Homo sapiens
agtcattatagatccccca

SEQ ID NO: 156472 - DNA, 23 bp, Homo sapiens
agtcattatagatcccccagact

SEQ ID NO: 156473 - DNA, 18 bp, Homo sapiens
agtccaacgtggggcagc

SEQ ID NO: 156474 - DNA, 23 bp, Homo sapiens
agtccaacgtggggcagcacaga

SEQ ID NO: 156475 - DNA, 15 bp, Homo sapiens
agtccagtctcttct

SEQ ID NO: 156476 - DNA, 17 bp, Homo sapiens
agtccagtgacctgctg

SEQ ID NO: 156477 - DNA, 13 bp, Homo sapiens
agtccccaggccc

SEQ ID NO: 156478 - DNA, 19 bp, Homo sapiens
agtccccaggccccaggaa

SEQ ID NO: 156479 - DNA, 16 bp, Homo sapiens
agtccccctgccccag

SEQ ID NO: 156480 - DNA, 13 bp, Homo sapiens
agtcccgtcagga

SEQ ID NO: 156481 - DNA, 15 bp, Homo sapiens
agtcccgtcaggacg

SEQ ID NO: 156482 - DNA, 22 bp, Homo sapiens
agtccctgggggaagccctgga

SEQ ID NO: 156483 - DNA, 12 bp, Homo sapiens
agtcctcccctc

SEQ ID NO: 156484 - DNA, 13 bp, Homo sapiens
agtcctcccctca

SEQ ID NO: 156485 - DNA, 14 bp, Homo sapiens
agtcctcccctcac

SEQ ID NO: 156486 - DNA, 19 bp, Homo sapiens
agtcctcccctcacagcct

SEQ ID NO: 156487 - DNA, 21 bp, Homo sapiens
agtcctcccctcacagcctct

SEQ ID NO: 156488 - DNA, 22 bp, Homo sapiens
agtcctcccctcacagcctctg

SEQ ID NO: 156489 - DNA, 16 bp, Homo sapiens
agtcctgcctcagcct

SEQ ID NO: 156490 - DNA, 16 bp, Homo sapiens
agtcctgtgaatttct

SEQ ID NO: 156491 - DNA, 15 bp, Homo sapiens
agtcgctgaggaaaa

SEQ ID NO: 156492 - DNA, 14 bp, Homo sapiens
agtctacgctctcc

SEQ ID NO: 156493 - DNA, 20 bp, Homo sapiens
agtctaggagctgggaggaa

SEQ ID NO: 156494 - DNA, 13 bp, Homo sapiens
agtctcaggaaat

SEQ ID NO: 156495 - DNA, 22 bp, Homo sapiens
agtctgcaaaatgaggaatgta

SEQ ID NO: 156496 - DNA, 13 bp, Homo sapiens
agtctggaggggc

SEQ ID NO: 156497 - DNA, 22 bp, Homo sapiens
agtctggaggggcatggccagc

SEQ ID NO: 156498 - DNA, 17 bp, Homo sapiens
agtctggatctgggacc

SEQ ID NO: 156499 - DNA, 23 bp, Homo sapiens
agtcttaaaataacttatatcat

SEQ ID NO: 156500 - DNA, 23 bp, Homo sapiens
agtcttcaagcagattggagaaa

SEQ ID NO: 156501 - DNA, 17 bp, Homo sapiens
agtcttcactctctgaa

SEQ ID NO: 156502 - DNA, 17 bp, Homo sapiens
agtgaaaaaggaggaag

SEQ ID NO: 156503 - DNA, 23 bp, Homo sapiens
agtgaaaaaggaggaagagaaaa

SEQ ID NO: 156504 - DNA, 22 bp, Homo sapiens
agtgaaagaggcagcttgaaac

SEQ ID NO: 156505 - DNA, 22 bp, Homo sapiens
agtgaacaaatttacagagaca

SEQ ID NO: 156506 - DNA, 20 bp, Homo sapiens
agtgaactacgcttgctcat

SEQ ID NO: 156507 - DNA, 20 bp, Homo sapiens
agtgaacttgggccactgtg

SEQ ID NO: 156508 - DNA, 19 bp, Homo sapiens
agtgaagaaaagtgaatgc

SEQ ID NO: 156509 - DNA, 23 bp, Homo sapiens
agtgaagaaaagtgaatgctcaa

SEQ ID NO: 156510 - DNA, 13 bp, Homo sapiens
agtgaataaatgt

SEQ ID NO: 156511 - DNA, 18 bp, Homo sapiens
agtgaatgctcaagtttt

SEQ ID NO: 156512 - DNA, 20 bp, Homo sapiens
agtgaattcttgaaggaaaa

SEQ ID NO: 156513 - DNA, 17 bp, Homo sapiens
agtgacagacaggctct

SEQ ID NO: 156514 - DNA, 22 bp, Homo sapiens
agtgacatctctttgatgtcat

SEQ ID NO: 156515 - DNA, 15 bp, Homo sapiens
agtgacctgaggaag

SEQ ID NO: 156516 - DNA, 17 bp, Homo sapiens
agtgacctgaggaagcg

SEQ ID NO: 156517 - DNA, 19 bp, Homo sapiens
agtgagaaaaagctcctgt

SEQ ID NO: 156518 - DNA, 14 bp, Homo sapiens
agtgagacagctct

SEQ ID NO: 156519 - DNA, 21 bp, Homo sapiens
agtgagaccctgtctcaaaaa

SEQ ID NO: 156520 - DNA, 13 bp, Homo sapiens
agtgagcctggct

SEQ ID NO: 156521 - DNA, 20 bp, Homo sapiens
agtgagggcttgtcattacc

SEQ ID NO: 156522 - DNA, 14 bp, Homo sapiens
agtgagtctgtcag

SEQ ID NO: 156523 - DNA, 15 bp, Homo sapiens
agtgagtctgtcagc

SEQ ID NO: 156524 - DNA, 16 bp, Homo sapiens
agtgatgtaccatgaa

SEQ ID NO: 156525 - DNA, 19 bp, Homo sapiens
agtgatgtcactagggcag

SEQ ID NO: 156526 - DNA, 18 bp, Homo sapiens
agtgcaaatcatagctgg

SEQ ID NO: 156527 - DNA, 13 bp, Homo sapiens
agtgcacccactc

SEQ ID NO: 156528 - DNA, 17 bp, Homo sapiens
agtgcacccactctgct

SEQ ID NO: 156529 - DNA, 16 bp, Homo sapiens
agtgcatctcagccca

SEQ ID NO: 156530 - DNA, 15 bp, Homo sapiens
agtgcatgctctctg

SEQ ID NO: 156531 - DNA, 14 bp, Homo sapiens
agtgccaagcacag

SEQ ID NO: 156532 - DNA, 16 bp, Homo sapiens
agtgcccaccaacatc

SEQ ID NO: 156533 - DNA, 23 bp, Homo sapiens
agtgcccagaactggactcagga

SEQ ID NO: 156534 - DNA, 12 bp, Homo sapiens
agtgctctgata

SEQ ID NO: 156535 - DNA, 16 bp, Homo sapiens
agtgctctgatccctc

SEQ ID NO: 156536 - DNA, 16 bp, Homo sapiens
agtgctgaacagtgga

SEQ ID NO: 156537 - DNA, 19 bp, Homo sapiens
agtggaccaggacaggacc

SEQ ID NO: 156538 - DNA, 12 bp, Homo sapiens
agtgggagaaaa

SEQ ID NO: 156539 - DNA, 19 bp, Homo sapiens
agtgggccaggacaggccc

SEQ ID NO: 156540 - DNA, 23 bp, Homo sapiens
agtggggtctccctctcctgcct

SEQ ID NO: 156541 - DNA, 13 bp, Homo sapiens
agtgggtgaataa

SEQ ID NO: 156542 - DNA, 19 bp, Homo sapiens
agtgggtgaataatacagt

SEQ ID NO: 156543 - DNA, 22 bp, Homo sapiens
agtgggtgagatgctggagaag

SEQ ID NO: 156544 - DNA, 13 bp, Homo sapiens
agtgtaccataat

SEQ ID NO: 156545 - DNA, 15 bp, Homo sapiens
agtgtaggcagacac

SEQ ID NO: 156546 - DNA, 19 bp, Homo sapiens
agtgtcaatgcagccccca

SEQ ID NO: 156547 - DNA, 20 bp, Homo sapiens
agtgtcatcagaagataact

SEQ ID NO: 156548 - DNA, 13 bp, Homo sapiens
agtgtcccctcca

SEQ ID NO: 156549 - DNA, 14 bp, Homo sapiens
agtgtcccctccac

SEQ ID NO: 156550 - DNA, 21 bp, Homo sapiens
agtgtcccctccactgtcaca

SEQ ID NO: 156551 - DNA, 13 bp, Homo sapiens
agtgtctgtgtgc

SEQ ID NO: 156552 - DNA, 20 bp, Homo sapiens
agtgtgtatgtgcgtgtgtg

SEQ ID NO: 156553 - DNA, 19 bp, Homo sapiens
agtgtgtattaaaaaaaac

SEQ ID NO: 156554 - DNA, 21 bp, Homo sapiens
agtgtgtccaagtgtgtgtgc

SEQ ID NO: 156555 - DNA, 20 bp, Homo sapiens
agtgtgtgcacatgtgtgcg

SEQ ID NO: 156556 - DNA, 14 bp, Homo sapiens
agtgtgtgcatgtg

SEQ ID NO: 156557 - DNA, 16 bp, Homo sapiens
tgagggaacagacagg

SEQ ID NO: 156558 - DNA, 17 bp, Homo sapiens
tgagggaacagacagga

SEQ ID NO: 156559 - DNA, 18 bp, Homo sapiens
tgagggaccagccaagag

SEQ ID NO: 156560 - DNA, 11 bp, Homo sapiens
tgagggcagtc

SEQ ID NO: 156561 - DNA, 16 bp, Homo sapiens
tgagggcccagagcag

SEQ ID NO: 156562 - DNA, 17 bp, Homo sapiens
tgagggcccagagcagg

SEQ ID NO: 156563 - DNA, 21 bp, Homo sapiens
tgagggcccagagcaggaagc

SEQ ID NO: 156564 - DNA, 15 bp, Homo sapiens
tgagggtccccacct

SEQ ID NO: 156565 - DNA, 19 bp, Homo sapiens
tgagggtccccacctggga

SEQ ID NO: 156566 - DNA, 17 bp, Homo sapiens
tgaggtactgagagtga

SEQ ID NO: 156567 - DNA, 16 bp, Homo sapiens
tgaggtcaggagttcc

SEQ ID NO: 156568 - DNA, 13 bp, Homo sapiens
tgaggtgggagga

SEQ ID NO: 156569 - DNA, 21 bp, Homo sapiens
tgaggtgggttttcttcccat

SEQ ID NO: 156570 - DNA, 13 bp, Homo sapiens
tgagtgctctgat

SEQ ID NO: 156571 - DNA, 19 bp, Homo sapiens
tgagtgctctgatccctct

SEQ ID NO: 156572 - DNA, 18 bp, Homo sapiens
tgagtgtcttaattaaaa

SEQ ID NO: 156573 - DNA, 17 bp, Homo sapiens
tgagtgtgtccaagtgt

SEQ ID NO: 156574 - DNA, 17 bp, Homo sapiens
tgagttattttaattat

SEQ ID NO: 156575 - DNA, 15 bp, Homo sapiens
tgagttcaggtagct

SEQ ID NO: 156576 - DNA, 23 bp, Homo sapiens
tgagtttaccttgtatactgtag

SEQ ID NO: 156577 - DNA, 21 bp, Homo sapiens
tgagtttagtgatctgaacag

SEQ ID NO: 156578 - DNA, 16 bp, Homo sapiens
tgagtttcctcaggct

SEQ ID NO: 156579 - DNA, 18 bp, Homo sapiens
tgagtttttatggggctg

SEQ ID NO: 156580 - DNA, 19 bp, Homo sapiens
tgagtttttgatagcttta

SEQ ID NO: 156581 - DNA, 14 bp, Homo sapiens
tgataaacatttaa

SEQ ID NO: 156582 - DNA, 16 bp, Homo sapiens
tgataagtaaatgcta

SEQ ID NO: 156583 - DNA, 11 bp, Homo sapiens
tgatagcttta

SEQ ID NO: 156584 - DNA, 24 bp, Homo sapiens
tgatagttgtaccgcaatgtgact

SEQ ID NO: 156585 - DNA, 15 bp, Homo sapiens
tgatatgtaaacata

SEQ ID NO: 156586 - DNA, 21 bp, Homo sapiens
tgatatgtaaacataattctt

SEQ ID NO: 156587 - DNA, 22 bp, Homo sapiens
tgatattttcaacgcagccctg

SEQ ID NO: 156588 - DNA, 22 bp, Homo sapiens
tgatcaaattcatttttttcac

SEQ ID NO: 156589 - DNA, 23 bp, Homo sapiens
tgatcaaattcatttttttcact

SEQ ID NO: 156590 - DNA, 23 bp, Homo sapiens
tgatcagagccgtggtcctttgg

SEQ ID NO: 156591 - DNA, 19 bp, Homo sapiens
tgatccctgtgttgtctct

SEQ ID NO: 156592 - DNA, 20 bp, Homo sapiens
tgatccctgtgttgtctcta

SEQ ID NO: 156593 - DNA, 22 bp, Homo sapiens
tgatccgttccattgcaagctt

SEQ ID NO: 156594 - DNA, 22 bp, Homo sapiens
tgatcctaatgaatgcataaaa

SEQ ID NO: 156595 - DNA, 15 bp, Homo sapiens
tgatcgcctttccca

SEQ ID NO: 156596 - DNA, 14 bp, Homo sapiens
tgatctccctgccg

SEQ ID NO: 156597 - DNA, 20 bp, Homo sapiens
tgatctgatgcaagcaagaa

SEQ ID NO: 156598 - DNA, 21 bp, Homo sapiens
tgatctgatgcaagcaagaaa

SEQ ID NO: 156599 - DNA, 15 bp, Homo sapiens
tgatgaaaaatagca

SEQ ID NO: 156600 - DNA, 18 bp, Homo sapiens
tgatgaaatgtaaatact

SEQ ID NO: 156601 - DNA, 16 bp, Homo sapiens
tgatgagctcctcttc

SEQ ID NO: 156602 - DNA, 17 bp, Homo sapiens
tgatgcatgcactgttc

SEQ ID NO: 156603 - DNA, 23 bp, Homo sapiens
tgatgcatgcactgttccccctg

SEQ ID NO: 156604 - DNA, 14 bp, Homo sapiens
tgatgccaggacac

SEQ ID NO: 156605 - DNA, 20 bp, Homo sapiens
tgatggacccaatgcacaca

SEQ ID NO: 156606 - DNA, 22 bp, Homo sapiens
tgatggcacttagctatcagaa

SEQ ID NO: 156607 - DNA, 14 bp, Homo sapiens
tgatggggaaggag

SEQ ID NO: 156608 - DNA, 17 bp, Homo sapiens
tgatgtagtgcctcttt

SEQ ID NO: 156609 - DNA, 21 bp, Homo sapiens
tgatgtattctagctaatgta

SEQ ID NO: 156610 - DNA, 12 bp, Homo sapiens
tgattaaaccaa

SEQ ID NO: 156611 - DNA, 19 bp, Homo sapiens
tgattaaccacttcagctg

SEQ ID NO: 156612 - DNA, 15 bp, Homo sapiens
tgattacacaaaaca

SEQ ID NO: 156613 - DNA, 14 bp, Homo sapiens
tgattcagctctgc

SEQ ID NO: 156614 - DNA, 20 bp, Homo sapiens
tgattcctttgaagaggaaa

SEQ ID NO: 156615 - DNA, 15 bp, Homo sapiens
tgattcttgagttta

SEQ ID NO: 156616 - DNA, 16 bp, Homo sapiens
tgattggattattcat

SEQ ID NO: 156617 - DNA, 21 bp, Homo sapiens
tgattggattattcatttaaa

SEQ ID NO: 156618 - DNA, 20 bp, Homo sapiens
tgattggcaggagttggaag

SEQ ID NO: 156619 - DNA, 21 bp, Homo sapiens
tgatttagaactgtatgtcag

SEQ ID NO: 156620 - DNA, 18 bp, Homo sapiens
tgatttccaaagagaaaa

SEQ ID NO: 156621 - DNA, 14 bp, Homo sapiens
tgatttctattcaa

SEQ ID NO: 156622 - DNA, 12 bp, Homo sapiens
tgatttggaaaa

SEQ ID NO: 156623 - DNA, 16 bp, Homo sapiens
tgattttaataatata

SEQ ID NO: 156624 - DNA, 16 bp, Homo sapiens
tgattttatctgtgaa

SEQ ID NO: 156625 - DNA, 16 bp, Homo sapiens
tgatttttttttttca

SEQ ID NO: 156626 - DNA, 19 bp, Homo sapiens
tgcaaaaggactctcagga

SEQ ID NO: 156627 - DNA, 20 bp, Homo sapiens
tgcaaaagttctgacttgac

SEQ ID NO: 156628 - DNA, 17 bp, Homo sapiens
tgcaaaatgagaccctc

SEQ ID NO: 156629 - DNA, 21 bp, Homo sapiens
tgcaaacgctgcctgcccgta

SEQ ID NO: 156630 - DNA, 15 bp, Homo sapiens
tgcaaagaggcaaga

SEQ ID NO: 156631 - DNA, 22 bp, Homo sapiens
tgcaaagcactgacttctaagt

SEQ ID NO: 156632 - DNA, 14 bp, Homo sapiens
tgcaaattaacagt

SEQ ID NO: 156633 - DNA, 22 bp, Homo sapiens
tgcaacctcgctggactctcag

SEQ ID NO: 156634 - DNA, 17 bp, Homo sapiens
tgcaacttctttttatt

SEQ ID NO: 156635 - DNA, 18 bp, Homo sapiens
tgcaacttgtaaatgtgg

SEQ ID NO: 156636 - DNA, 18 bp, Homo sapiens
tgcaagtatgtgagtgtg

SEQ ID NO: 156637 - DNA, 16 bp, Homo sapiens
tgcaagtgtctgtgtg

SEQ ID NO: 156638 - DNA, 18 bp, Homo sapiens
tgcaagtgtctgtgtgca

SEQ ID NO: 156639 - DNA, 19 bp, Homo sapiens
tgcaagtgtgtatgtgcgt

SEQ ID NO: 156640 - DNA, 13 bp, Homo sapiens
tgcaagtgtgtgc

SEQ ID NO: 156641 - DNA, 18 bp, Homo sapiens
tgcaagtgtgtgcatgtg

SEQ ID NO: 156642 - DNA, 20 bp, Homo sapiens
tgcaattttaattgattatt

SEQ ID NO: 156643 - DNA, 22 bp, Homo sapiens
tgcacactttgccatattttca

SEQ ID NO: 156644 - DNA, 18 bp, Homo sapiens
tgcacagcggcccctgca

SEQ ID NO: 156645 - DNA, 17 bp, Homo sapiens
tgcacagtgcatctcag

SEQ ID NO: 156646 - DNA, 21 bp, Homo sapiens
tgcaccatccctttttgaagt

SEQ ID NO: 156647 - DNA, 19 bp, Homo sapiens
tgcaccccaaagctttcct

SEQ ID NO: 156648 - DNA, 16 bp, Homo sapiens
tgcacccccctgggct

SEQ ID NO: 156649 - DNA, 16 bp, Homo sapiens
tgcaccctcaggcagg

SEQ ID NO: 156650 - DNA, 15 bp, Homo sapiens
tgcacctccccccac

SEQ ID NO: 156651 - DNA, 20 bp, Homo sapiens
tgcacctccccccactgcag

SEQ ID NO: 156652 - DNA, 20 bp, Homo sapiens
tgcaccttaccaactttctg

SEQ ID NO: 156653 - DNA, 21 bp, Homo sapiens
tgcaccttaccaactttctgt

SEQ ID NO: 156654 - DNA, 12 bp, Homo sapiens
tgcacgtgtgca

SEQ ID NO: 156655 - DNA, 18 bp, Homo sapiens
tgcactaaagtatgtaaa

SEQ ID NO: 156656 - DNA, 15 bp, Homo sapiens
tgcactactgacatg

SEQ ID NO: 156657 - DNA, 13 bp, Homo sapiens
tgcactccagcct

SEQ ID NO: 156658 - DNA, 15 bp, Homo sapiens
tgcactccagcctgg

SEQ ID NO: 156659 - DNA, 19 bp, Homo sapiens
tgcactggagtccagtctc

SEQ ID NO: 156660 - DNA, 14 bp, Homo sapiens
tgcactgttccccc

SEQ ID NO: 156661 - DNA, 19 bp, Homo sapiens
tgcactgttccccctgtgc

SEQ ID NO: 156662 - DNA, 17 bp, Homo sapiens
tgcagaaaagcacctgc

SEQ ID NO: 156663 - DNA, 19 bp, Homo sapiens
tgcagaaaagcacctgccg

SEQ ID NO: 156664 - DNA, 14 bp, Homo sapiens
tgcagaagacagta

SEQ ID NO: 156665 - DNA, 15 bp, Homo sapiens
tgcagaagacagtat

SEQ ID NO: 156666 - DNA, 20 bp, Homo sapiens
tgcagaaggaaaaatgtgta

SEQ ID NO: 156667 - DNA, 21 bp, Homo sapiens
tgcagagcaggaaacatgact

SEQ ID NO: 156668 - DNA, 15 bp, Homo sapiens
tgcagagctgaagat

SEQ ID NO: 156669 - DNA, 15 bp, Homo sapiens
tgcagagtgcccaga

SEQ ID NO: 156670 - DNA, 18 bp, Homo sapiens
tgcagagtgcccagaact

SEQ ID NO: 156671 - DNA, 17 bp, Homo sapiens
tgcagataaacagtagt

SEQ ID NO: 156672 - DNA, 14 bp, Homo sapiens
tgcagatgacaaaa

SEQ ID NO: 156673 - DNA, 15 bp, Homo sapiens
tgcagccagcccagc

SEQ ID NO: 156674 - DNA, 23 bp, Homo sapiens
tgcagccagcccagcccagctgg

SEQ ID NO: 156675 - DNA, 20 bp, Homo sapiens
tgcagcccggcgccaccatc

SEQ ID NO: 156676 - DNA, 14 bp, Homo sapiens
tgcagccgctgagc

SEQ ID NO: 156677 - DNA, 18 bp, Homo sapiens
tgcagccggcacagggtc

SEQ ID NO: 156678 - DNA, 22 bp, Homo sapiens
tgcagctcaaggaaaggcctga

SEQ ID NO: 156679 - DNA, 14 bp, Homo sapiens
tgcaggacctcagg

SEQ ID NO: 156680 - DNA, 15 bp, Homo sapiens
tgcaggacctcaggt

SEQ ID NO: 156681 - DNA, 15 bp, Homo sapiens
tgcaggacctgcctg

SEQ ID NO: 156682 - DNA, 17 bp, Homo sapiens
tgcaggacctgcctgta

SEQ ID NO: 156683 - DNA, 19 bp, Homo sapiens
tgcaggacctgcctgtagc

SEQ ID NO: 156684 - DNA, 10 bp, Homo sapiens
tgcaggcccc

SEQ ID NO: 156685 - DNA, 20 bp, Homo sapiens
tgcagggaaaattatttgca

SEQ ID NO: 156686 - DNA, 22 bp, Homo sapiens
tgcagggaaaattatttgcata

SEQ ID NO: 156687 - DNA, 23 bp, Homo sapiens
tgcagggccaggactgagccccg

SEQ ID NO: 156688 - DNA, 15 bp, Homo sapiens
tgcaggtctcaaccc

SEQ ID NO: 156689 - DNA, 13 bp, Homo sapiens
tgcaggtggggag

SEQ ID NO: 156690 - DNA, 16 bp, Homo sapiens
tgcagtatgaaaataa

SEQ ID NO: 156691 - DNA, 13 bp, Homo sapiens
tgcagtcatcttg

SEQ ID NO: 156692 - DNA, 15 bp, Homo sapiens
cagccagactggcac

SEQ ID NO: 156693 - DNA, 14 bp, Homo sapiens
cagccagcagccag

SEQ ID NO: 156694 - DNA, 17 bp, Homo sapiens
cagccagcagccagctc

SEQ ID NO: 156695 - DNA, 18 bp, Homo sapiens
cagccagcagccagctct

SEQ ID NO: 156696 - DNA, 15 bp, Homo sapiens
cagccagcccagccc

SEQ ID NO: 156697 - DNA, 16 bp, Homo sapiens
cagccagcccagccca

SEQ ID NO: 156698 - DNA, 18 bp, Homo sapiens
cagccagctctcagccaa

SEQ ID NO: 156699 - DNA, 20 bp, Homo sapiens
cagccagtgacctgaggaag

SEQ ID NO: 156700 - DNA, 18 bp, Homo sapiens
cagccatgaggagttgct

SEQ ID NO: 156701 - DNA, 22 bp, Homo sapiens
cagccatgaggagttgctgttt

SEQ ID NO: 156702 - DNA, 15 bp, Homo sapiens
cagcccacccctcaa

SEQ ID NO: 156703 - DNA, 15 bp, Homo sapiens
cagccccagagcagg

SEQ ID NO: 156704 - DNA, 16 bp, Homo sapiens
cagcccctcctctgcc

SEQ ID NO: 156705 - DNA, 20 bp, Homo sapiens
cagcccctcctctgccacct

SEQ ID NO: 156706 - DNA, 23 bp, Homo sapiens
cagcccctcctctgccacctccc

SEQ ID NO: 156707 - DNA, 16 bp, Homo sapiens
cagccccttctcagaa

SEQ ID NO: 156708 - DNA, 17 bp, Homo sapiens
cagccccttgagaaacc

SEQ ID NO: 156709 - DNA, 13 bp, Homo sapiens
cagccctcatccc

SEQ ID NO: 156710 - DNA, 14 bp, Homo sapiens
cagccctcatcccg

SEQ ID NO: 156711 - DNA, 15 bp, Homo sapiens
cagccctccctgccc

SEQ ID NO: 156712 - DNA, 17 bp, Homo sapiens
cagccctccctgcccct

SEQ ID NO: 156713 - DNA, 14 bp, Homo sapiens
cagccctccctgtc

SEQ ID NO: 156714 - DNA, 19 bp, Homo sapiens
cagccctccctgtcctcct

SEQ ID NO: 156715 - DNA, 13 bp, Homo sapiens
cagccctcctcac

SEQ ID NO: 156716 - DNA, 19 bp, Homo sapiens
cagccctgctttgggctgc

SEQ ID NO: 156717 - DNA, 21 bp, Homo sapiens
cagccctgctttgggctgccc

SEQ ID NO: 156718 - DNA, 23 bp, Homo sapiens
cagccctgctttgggctgccctg

SEQ ID NO: 156719 - DNA, 15 bp, Homo sapiens
cagccctggctctgc

SEQ ID NO: 156720 - DNA, 11 bp, Homo sapiens
cagccctgggc

SEQ ID NO: 156721 - DNA, 18 bp, Homo sapiens
cagccctgggccccacca

SEQ ID NO: 156722 - DNA, 19 bp, Homo sapiens
cagccctgggccccaccac

SEQ ID NO: 156723 - DNA, 21 bp, Homo sapiens
cagccctgggccccaccacct

SEQ ID NO: 156724 - DNA, 12 bp, Homo sapiens
cagccgctcctg

SEQ ID NO: 156725 - DNA, 14 bp, Homo sapiens
cagccgctcctgtc

SEQ ID NO: 156726 - DNA, 23 bp, Homo sapiens
cagccgctcctgtctgccagcca

SEQ ID NO: 156727 - DNA, 15 bp, Homo sapiens
cagccggcacagggt

SEQ ID NO: 156728 - DNA, 17 bp, Homo sapiens
cagccggcacagggtct

SEQ ID NO: 156729 - DNA, 18 bp, Homo sapiens
cagcctagccgacctcag

SEQ ID NO: 156730 - DNA, 22 bp, Homo sapiens
cagcctagccgacctcagcctt

SEQ ID NO: 156731 - DNA, 15 bp, Homo sapiens
cagcctcagtcctcc

SEQ ID NO: 156732 - DNA, 16 bp, Homo sapiens
cagcctcagtcctccc

SEQ ID NO: 156733 - DNA, 19 bp, Homo sapiens
cagcctcagtcctcccctc

SEQ ID NO: 156734 - DNA, 23 bp, Homo sapiens
cagcctcagtcctcccctcacag

SEQ ID NO: 156735 - DNA, 18 bp, Homo sapiens
cagcctccatgctgcctc

SEQ ID NO: 156736 - DNA, 14 bp, Homo sapiens
cagcctcccacccc

SEQ ID NO: 156737 - DNA, 18 bp, Homo sapiens
cagcctcccctgccaggg

SEQ ID NO: 156738 - DNA, 20 bp, Homo sapiens
cagcctcccctgccagggca

SEQ ID NO: 156739 - DNA, 19 bp, Homo sapiens
cagcctccgtatttcagac

SEQ ID NO: 156740 - DNA, 13 bp, Homo sapiens
cagcctcctcctg

SEQ ID NO: 156741 - DNA, 19 bp, Homo sapiens
cagcctctcccctgattac

SEQ ID NO: 156742 - DNA, 13 bp, Homo sapiens
cagttactcagcc

SEQ ID NO: 156743 - DNA, 16 bp, Homo sapiens
cagttactcagccctg

SEQ ID NO: 156744 - DNA, 18 bp, Homo sapiens
cagttactcagccctggg

SEQ ID NO: 156745 - DNA, 14 bp, Homo sapiens
cagttcctcgccct

SEQ ID NO: 156746 - DNA, 17 bp, Homo sapiens
cagttcctcgccctggg

SEQ ID NO: 156747 - DNA, 18 bp, Homo sapiens
cagttcctcgccctgggt

SEQ ID NO: 156748 - DNA, 12 bp, Homo sapiens
cagttgaaaaac

SEQ ID NO: 156749 - DNA, 22 bp, Homo sapiens
cagttgaaaagactccaaagaa

SEQ ID NO: 156750 - DNA, 19 bp, Homo sapiens
cagttgcacttggcctctg

SEQ ID NO: 156751 - DNA, 23 bp, Homo sapiens
cagttgttcaataataaatattt

SEQ ID NO: 156752 - DNA, 14 bp, Homo sapiens
cagtttgctttgta

SEQ ID NO: 156753 - DNA, 13 bp, Homo sapiens
cagtttgtatata

SEQ ID NO: 156754 - DNA, 19 bp, Homo sapiens
cagttttctgagaaagact

SEQ ID NO: 156755 - DNA, 17 bp, Homo sapiens
cataaactgactttatc

SEQ ID NO: 156756 - DNA, 16 bp, Homo sapiens
cataaacttcatggtc

SEQ ID NO: 156757 - DNA, 14 bp, Homo sapiens
cataaataaaatga

SEQ ID NO: 156758 - DNA, 16 bp, Homo sapiens
cataacaattcctcta

SEQ ID NO: 156759 - DNA, 17 bp, Homo sapiens
cataagatatttttcat

SEQ ID NO: 156760 - DNA, 16 bp, Homo sapiens
cataagtaattcaaga

SEQ ID NO: 156761 - DNA, 22 bp, Homo sapiens
cataagtaattcaagaaaacaa

SEQ ID NO: 156762 - DNA, 15 bp, Homo sapiens
cataagtatttcaaa

SEQ ID NO: 156763 - DNA, 22 bp, Homo sapiens
cataatctggactcctctgtcc

SEQ ID NO: 156764 - DNA, 17 bp, Homo sapiens
cataattcttgtatatt

SEQ ID NO: 156765 - DNA, 12 bp, Homo sapiens
caggctccttcc

SEQ ID NO: 156766 - DNA, 14 bp, Homo sapiens
caggctccttcctg

SEQ ID NO: 156767 - DNA, 14 bp, Homo sapiens
caggctctgccctg

SEQ ID NO: 156768 - DNA, 23 bp, Homo sapiens
caggctctgccctgccctagctc

SEQ ID NO: 156769 - DNA, 21 bp, Homo sapiens
caggctcttagcagcttccag

SEQ ID NO: 156770 - DNA, 22 bp, Homo sapiens
caggctcttctcctttcacaac

SEQ ID NO: 156771 - DNA, 12 bp, Homo sapiens
caggctgctgga

SEQ ID NO: 156772 - DNA, 14 bp, Homo sapiens
caggctgctggagg

SEQ ID NO: 156773 - DNA, 15 bp, Homo sapiens
caggctgctggagga

SEQ ID NO: 156774 - DNA, 21 bp, Homo sapiens
cagggaagtgtaagaaacaca

SEQ ID NO: 156775 - DNA, 21 bp, Homo sapiens
ccagaggaactgtccagagag

SEQ ID NO: 156776 - DNA, 22 bp, Homo sapiens
ccagaggaaggggccagaggct

SEQ ID NO: 156777 - DNA, 16 bp, Homo sapiens
ccagatcccagaagga

SEQ ID NO: 156778 - DNA, 18 bp, Homo sapiens
ccagatgccttctccaga

SEQ ID NO: 156779 - DNA, 18 bp, Homo sapiens
ccagattgacgacaagtg

SEQ ID NO: 156780 - DNA, 21 bp, Homo sapiens
ccagattgacgacaagtgctg

SEQ ID NO: 156781 - DNA, 24 bp, Homo sapiens
ccagattttttacagctgcctgca

SEQ ID NO: 156782 - DNA, 12 bp, Homo sapiens
ccagcaatgaca

SEQ ID NO: 156783 - DNA, 21 bp, Homo sapiens
ccagcaatgacatctcagggg

SEQ ID NO: 156784 - DNA, 19 bp, Homo sapiens
ccagcactgcttgaggaaa

SEQ ID NO: 156785 - DNA, 21 bp, Homo sapiens
ccagcagatcccagctcacgt

SEQ ID NO: 156786 - DNA, 15 bp, Homo sapiens
ccagcagccagctct

SEQ ID NO: 156787 - DNA, 18 bp, Homo sapiens
ccagcagccagctctcag

SEQ ID NO: 156788 - DNA, 21 bp, Homo sapiens
ccagcagccagctctcagcca

SEQ ID NO: 156789 - DNA, 18 bp, Homo sapiens
ccagccaaaccctgtctg

SEQ ID NO: 156790 - DNA, 22 bp, Homo sapiens
ccagccaacttttgcatgtttt

SEQ ID NO: 156791 - DNA, 23 bp, Homo sapiens
ccagccagcagccagctctcagc

SEQ ID NO: 156792 - DNA, 20 bp, Homo sapiens
ccagccagtgacctgaggaa

SEQ ID NO: 156793 - DNA, 16 bp, Homo sapiens
ccagcccagcccagct

SEQ ID NO: 156794 - DNA, 14 bp, Homo sapiens
ccagcccctagccc

SEQ ID NO: 156795 - DNA, 15 bp, Homo sapiens
ccagcccctagccca

SEQ ID NO: 156796 - DNA, 17 bp, Homo sapiens
ccagcccctagcccagg

SEQ ID NO: 156797 - DNA, 18 bp, Homo sapiens
ccagcccctagcccagga

SEQ ID NO: 156798 - DNA, 16 bp, Homo sapiens
ccagccccttctcaga

SEQ ID NO: 156799 - DNA, 16 bp, Homo sapiens
ccagccctccctgtcc

SEQ ID NO: 156800 - DNA, 19 bp, Homo sapiens
ccagccctccctgtcctcc

SEQ ID NO: 156801 - DNA, 21 bp, Homo sapiens
ccagccctccctgtcctcctc

SEQ ID NO: 156802 - DNA, 17 bp, Homo sapiens
ccagccctggctctgca

SEQ ID NO: 156803 - DNA, 15 bp, Homo sapiens
ccagcctccatgctg

SEQ ID NO: 156804 - DNA, 14 bp, Homo sapiens
ccagcctctcccct

SEQ ID NO: 156805 - DNA, 22 bp, Homo sapiens
ccagcctctcccctgattacac

SEQ ID NO: 156806 - DNA, 23 bp, Homo sapiens
ccagcctgtcccatggacactcc

SEQ ID NO: 156807 - DNA, 18 bp, Homo sapiens
ccagccttcttccatccc

SEQ ID NO: 156808 - DNA, 22 bp, Homo sapiens
ccagccttcttccatcccagga

SEQ ID NO: 156809 - DNA, 20 bp, Homo sapiens
ccagcctttctcccaggcca

SEQ ID NO: 156810 - DNA, 21 bp, Homo sapiens
ccagcctttctcccaggccag

SEQ ID NO: 156811 - DNA, 22 bp, Homo sapiens
ccagcgcctagtggggtctccc

SEQ ID NO: 156812 - DNA, 13 bp, Homo sapiens
ccagcggctgagt

SEQ ID NO: 156813 - DNA, 19 bp, Homo sapiens
ccagcgtcctcctctgtga

SEQ ID NO: 156814 - DNA, 18 bp, Homo sapiens
ccagctatacctgtgcct

SEQ ID NO: 156815 - DNA, 15 bp, Homo sapiens
ccagctcacgtcaca

SEQ ID NO: 156816 - DNA, 13 bp, Homo sapiens
ccagctcagaggg

SEQ ID NO: 156817 - DNA, 15 bp, Homo sapiens
ccagctctcagccaa

SEQ ID NO: 156818 - DNA, 16 bp, Homo sapiens
ccagctctccctctgg

SEQ ID NO: 156819 - DNA, 17 bp, Homo sapiens
ccagctctccctctggc

SEQ ID NO: 156820 - DNA, 15 bp, Homo sapiens
ccagctctgaaacca

SEQ ID NO: 156821 - DNA, 13 bp, Homo sapiens
cccacctgctgag

SEQ ID NO: 156822 - DNA, 16 bp, Homo sapiens
cccactcaagccaagc

SEQ ID NO: 156823 - DNA, 20 bp, Homo sapiens
cccactcaagccaagcagcc

SEQ ID NO: 156824 - DNA, 19 bp, Homo sapiens
cccactgcaggccccgctt

SEQ ID NO: 156825 - DNA, 17 bp, Homo sapiens
cccactgccataaaaca

SEQ ID NO: 156826 - DNA, 14 bp, Homo sapiens
cccagaacacactc

SEQ ID NO: 156827 - DNA, 18 bp, Homo sapiens
cccagaacacactccatc

SEQ ID NO: 156828 - DNA, 22 bp, Homo sapiens
cccagaacacactccatcagct

SEQ ID NO: 156829 - DNA, 14 bp, Homo sapiens
cccagaacctgtcc

SEQ ID NO: 156830 - DNA, 15 bp, Homo sapiens
cccagaacctgtcct

SEQ ID NO: 156831 - DNA, 16 bp, Homo sapiens
cccagagacaggaaaa

SEQ ID NO: 156832 - DNA, 17 bp, Homo sapiens
cccagagatgcctccac

SEQ ID NO: 156833 - DNA, 21 bp, Homo sapiens
cccagagatgcctccaccgct

SEQ ID NO: 156834 - DNA, 16 bp, Homo sapiens
cccagagcaggaagca

SEQ ID NO: 156835 - DNA, 21 bp, Homo sapiens
cccagaggaaggggccagagg

SEQ ID NO: 156836 - DNA, 22 bp, Homo sapiens
cccagaggaaggggccagaggc

SEQ ID NO: 156837 - DNA, 14 bp, Homo sapiens
cccagatcccagaa

SEQ ID NO: 156838 - DNA, 15 bp, Homo sapiens
cccagcacccagcaa

SEQ ID NO: 156839 - DNA, 17 bp, Homo sapiens
cccagcactaaagcagt

SEQ ID NO: 156840 - DNA, 16 bp, Homo sapiens
cccagcccagctggtg

SEQ ID NO: 156841 - DNA, 21 bp, Homo sapiens
cccagcccattctctctcctg

SEQ ID NO: 156842 - DNA, 22 bp, Homo sapiens
cccagcccattctctctcctgt

SEQ ID NO: 156843 - DNA, 13 bp, Homo sapiens
cccagcccctagc

SEQ ID NO: 156844 - DNA, 16 bp, Homo sapiens
cccagccctcatcccg

SEQ ID NO: 156845 - DNA, 12 bp, Homo sapiens
cccagccctggc

SEQ ID NO: 156846 - DNA, 15 bp, Homo sapiens
cccagccctggctct

SEQ ID NO: 156847 - DNA, 16 bp, Homo sapiens
cccagcctcagtcctc

SEQ ID NO: 156848 - DNA, 14 bp, Homo sapiens
cccagctcagaggg

SEQ ID NO: 156849 - DNA, 15 bp, Homo sapiens
cccagctctccctct

SEQ ID NO: 156850 - DNA, 23 bp, Homo sapiens
cccagctctccctctggccctgc

SEQ ID NO: 156851 - DNA, 14 bp, Homo sapiens
cccagctgctcccc

SEQ ID NO: 156852 - DNA, 21 bp, Homo sapiens
cccagctgctcccctccctcc

SEQ ID NO: 156853 - DNA, 19 bp, Homo sapiens
cccagctggtgggaagcgt

SEQ ID NO: 156854 - DNA, 22 bp, Homo sapiens
cccagctggtgggaagcgtctg

SEQ ID NO: 156855 - DNA, 16 bp, Homo sapiens
cccagctgtgagcctt

SEQ ID NO: 156856 - DNA, 19 bp, Homo sapiens
cccaggacaccacacccag

SEQ ID NO: 156857 - DNA, 21 bp, Homo sapiens
cccaggacaccacacccagcc

SEQ ID NO: 156858 - DNA, 22 bp, Homo sapiens
cccaggacaccacacccagcct

SEQ ID NO: 156859 - DNA, 15 bp, Homo sapiens
cccaggagagagaaa

SEQ ID NO: 156860 - DNA, 15 bp, Homo sapiens
cccaggagagccagc

SEQ ID NO: 156861 - DNA, 17 bp, Homo sapiens
cccaggccccaggaagc

SEQ ID NO: 156862 - DNA, 21 bp, Homo sapiens
cccagggagcggaaagcagct

SEQ ID NO: 156863 - DNA, 18 bp, Homo sapiens
cccagggccactctgcct

SEQ ID NO: 156864 - DNA, 16 bp, Homo sapiens
cccagggcctgcagga

SEQ ID NO: 156865 - DNA, 15 bp, Homo sapiens
cccagggctaccctc

SEQ ID NO: 156866 - DNA, 14 bp, Homo sapiens
cccagggctcagcc

SEQ ID NO: 156867 - DNA, 15 bp, Homo sapiens
cccagggctcagcct

SEQ ID NO: 156868 - DNA, 20 bp, Homo sapiens
cccagggctcagcctggtgg

SEQ ID NO: 156869 - DNA, 13 bp, Homo sapiens
cccaggtgccagt

SEQ ID NO: 156870 - DNA, 22 bp, Homo sapiens
cccaggtggctgacccagtccc

SEQ ID NO: 156871 - DNA, 23 bp, Homo sapiens
cccaggtggctgacccagtccct

SEQ ID NO: 156872 - DNA, 12 bp, Homo sapiens
cccagtccctgg

SEQ ID NO: 156873 - DNA, 23 bp, Homo sapiens
cccagtccctgggggaagccctg

SEQ ID NO: 156874 - DNA, 21 bp, Homo sapiens
cccagtgagcactcccaagtc

SEQ ID NO: 156875 - DNA, 15 bp, Homo sapiens
cccagtgcacccact

SEQ ID NO: 156876 - DNA, 16 bp, Homo sapiens
cccagtttgcagaaaa

SEQ ID NO: 156877 - DNA, 23 bp, Homo sapiens
cccagtttgcagaaaagcacctg

SEQ ID NO: 156878 - DNA, 19 bp, Homo sapiens
cccatagtgaccggctgct

SEQ ID NO: 156879 - DNA, 13 bp, Homo sapiens
cccatcactggag

SEQ ID NO: 156880 - DNA, 15 bp, Homo sapiens
cccatcactggagca

SEQ ID NO: 156881 - DNA, 14 bp, Homo sapiens
cccatcagaaggag

SEQ ID NO: 156882 - DNA, 15 bp, Homo sapiens
cccatcccacaccct

SEQ ID NO: 156883 - DNA, 12 bp, Homo sapiens
cccatccctgcc

SEQ ID NO: 156884 - DNA, 15 bp, Homo sapiens
cccatccctgcctgg

SEQ ID NO: 156885 - DNA, 17 bp, Homo sapiens
cccatccctgcctggtc

SEQ ID NO: 156886 - DNA, 18 bp, Homo sapiens
cccatccctgcctggtca

SEQ ID NO: 156887 - DNA, 22 bp, Homo sapiens
cccatcctatcagcctgtctct

SEQ ID NO: 156888 - DNA, 18 bp, Homo sapiens
cccatctctccctcccct

SEQ ID NO: 156889 - DNA, 22 bp, Homo sapiens
cccatctgcacccccctgggct

SEQ ID NO: 156890 - DNA, 18 bp, Homo sapiens
cccatctgggtccttgca

SEQ ID NO: 156891 - DNA, 22 bp, Homo sapiens
cccatctgggtccttgcacccc

SEQ ID NO: 156892 - DNA, 22 bp, Homo sapiens
cccatggacactccagtgccag

SEQ ID NO: 156893 - DNA, 14 bp, Homo sapiens
cccattcctgggaa

SEQ ID NO: 156894 - DNA, 17 bp, Homo sapiens
cccattctctctcctgt

SEQ ID NO: 156895 - DNA, 18 bp, Homo sapiens
cccatttctaaaggcctc

SEQ ID NO: 156896 - DNA, 19 bp, Homo sapiens
cccatttctatttatttac

SEQ ID NO: 156897 - DNA, 19 bp, Homo sapiens
ccccaaacctgcaagggct

SEQ ID NO: 156898 - DNA, 21 bp, Homo sapiens
ccccaaagctttcctgcccca

SEQ ID NO: 156899 - DNA, 20 bp, Homo sapiens
ccccaacagcgacatagccc

SEQ ID NO: 156900 - DNA, 15 bp, Homo sapiens
ccccaactcctggaa

SEQ ID NO: 156901 - DNA, 15 bp, Homo sapiens
ccccaaggagggaga

SEQ ID NO: 156902 - DNA, 22 bp, Homo sapiens
ccccaagggcaaaattcccagg

SEQ ID NO: 156903 - DNA, 14 bp, Homo sapiens
ccccaaggggcagt

SEQ ID NO: 156904 - DNA, 16 bp, Homo sapiens
ccccaaggggcagtct

SEQ ID NO: 156905 - DNA, 14 bp, Homo sapiens
ccccaccaccccag

SEQ ID NO: 156906 - DNA, 23 bp, Homo sapiens
ccccaccacgatgtggccctggc

SEQ ID NO: 156907 - DNA, 23 bp, Homo sapiens
ccccaccccctccccaggggaga

SEQ ID NO: 156908 - DNA, 17 bp, Homo sapiens
ccccacgagggtcagga

SEQ ID NO: 156909 - DNA, 21 bp, Homo sapiens
ccccagaacctgtccttgcac

SEQ ID NO: 156910 - DNA, 19 bp, Homo sapiens
ccccagacctgagctcccc

SEQ ID NO: 156911 - DNA, 11 bp, Homo sapiens
ccccagcccag

SEQ ID NO: 156912 - DNA, 13 bp, Homo sapiens
ccccagcccaggg

SEQ ID NO: 156913 - DNA, 18 bp, Homo sapiens
ccccagcccctagcccag

SEQ ID NO: 156914 - DNA, 15 bp, Homo sapiens
ccccagctgtgagcc

SEQ ID NO: 156915 - DNA, 16 bp, Homo sapiens
ccccagctgtgagcct

SEQ ID NO: 156916 - DNA, 19 bp, Homo sapiens
ccccagctgtgagccttgg

SEQ ID NO: 156917 - DNA, 21 bp, Homo sapiens
ccccaggcctgaaagaggctg

SEQ ID NO: 156918 - DNA, 15 bp, Homo sapiens
ccccagggcctgagc

SEQ ID NO: 156919 - DNA, 18 bp, Homo sapiens
ccccaggggaaaatgaag

SEQ ID NO: 156920 - DNA, 14 bp, Homo sapiens
ccccaggtgccagt

SEQ ID NO: 156921 - DNA, 20 bp, Homo sapiens
ccccaggtggctgacccagt

SEQ ID NO: 156922 - DNA, 21 bp, Homo sapiens
ccccaggtggctgacccagtc

SEQ ID NO: 156923 - DNA, 23 bp, Homo sapiens
ccccagtttgcagaaaagcacct

SEQ ID NO: 156924 - DNA, 13 bp, Homo sapiens
ccccatcagtgct

SEQ ID NO: 156925 - DNA, 13 bp, Homo sapiens
ccccatcattcat

SEQ ID NO: 156926 - DNA, 12 bp, Homo sapiens
ccccatctctcc

SEQ ID NO: 156927 - DNA, 16 bp, Homo sapiens
ccccatctctccctcc

SEQ ID NO: 156928 - DNA, 14 bp, Homo sapiens
ccccatctgggtcc

SEQ ID NO: 156929 - DNA, 17 bp, Homo sapiens
ccccatgtctctcagaa

SEQ ID NO: 156930 - DNA, 23 bp, Homo sapiens
cccccaaccaagtggctcccaca

SEQ ID NO: 156931 - DNA, 16 bp, Homo sapiens
cccccaaggggcagtc

SEQ ID NO: 156932 - DNA, 23 bp, Homo sapiens
cccccaaggggcagtctggaggg

SEQ ID NO: 156933 - DNA, 12 bp, Homo sapiens
cccccaccccct

SEQ ID NO: 156934 - DNA, 14 bp, Homo sapiens
cccccactgcaggc

SEQ ID NO: 156935 - DNA, 15 bp, Homo sapiens
cccccagaacctgtc

SEQ ID NO: 156936 - DNA, 22 bp, Homo sapiens
cccccagaacctgtccttgcac

SEQ ID NO: 156937 - DNA, 11 bp, Homo sapiens
cccccagctgt

SEQ ID NO: 156938 - DNA, 18 bp, Homo sapiens
ccccccagaacctgtcct

SEQ ID NO: 156939 - DNA, 16 bp, Homo sapiens
ccccctgccagtgcct

SEQ ID NO: 156940 - DNA, 18 bp, Homo sapiens
cccccttgccagacatgt

SEQ ID NO: 156941 - DNA, 12 bp, Homo sapiens
ccccgcagacct

SEQ ID NO: 156942 - DNA, 13 bp, Homo sapiens
ccccgcagacctc

SEQ ID NO: 156943 - DNA, 20 bp, Homo sapiens
ccccgcagacctccccagcc

SEQ ID NO: 156944 - DNA, 15 bp, Homo sapiens
ccccgcttgtccagc

SEQ ID NO: 156945 - DNA, 13 bp, Homo sapiens
ccccggccacctc

SEQ ID NO: 156946 - DNA, 15 bp, Homo sapiens
ccccggccacctctg

SEQ ID NO: 156947 - DNA, 16 bp, Homo sapiens
ccccggtcccttgaga

SEQ ID NO: 156948 - DNA, 24 bp, Homo sapiens
ccccggtcccttgagacctcagcc

SEQ ID NO: 156949 - DNA, 21 bp, Homo sapiens
ccccgtctggggttcagcccc

SEQ ID NO: 156950 - DNA, 14 bp, Homo sapiens
cccctatccaccca

SEQ ID NO: 156951 - DNA, 20 bp, Homo sapiens
cccctatccacccagcccat

SEQ ID NO: 156952 - DNA, 17 bp, Homo sapiens
cccctcacagcctctga

SEQ ID NO: 156953 - DNA, 18 bp, Homo sapiens
cccctcacagcctctgac

SEQ ID NO: 156954 - DNA, 20 bp, Homo sapiens
cccctcacagcctctgaccc

SEQ ID NO: 156955 - DNA, 13 bp, Homo sapiens
cccctcaccctgc

SEQ ID NO: 156956 - DNA, 23 bp, Homo sapiens
cccctccaatcccaccaaccctc

SEQ ID NO: 156957 - DNA, 12 bp, Homo sapiens
cccctccactgt

SEQ ID NO: 156958 - DNA, 15 bp, Homo sapiens
cccctcggagaagag

SEQ ID NO: 156959 - DNA, 12 bp, Homo sapiens
cccctctctcct

SEQ ID NO: 156960 - DNA, 12 bp, Homo sapiens
cccctctgtcca

SEQ ID NO: 156961 - DNA, 22 bp, Homo sapiens
cccctctgtccaggcactgaga

SEQ ID NO: 156962 - DNA, 13 bp, Homo sapiens
cccctgcactcca

SEQ ID NO: 156963 - DNA, 19 bp, Homo sapiens
cccctgccagggcagggcc

SEQ ID NO: 156964 - DNA, 17 bp, Homo sapiens
cccctgccagtgcctta

SEQ ID NO: 156965 - DNA, 13 bp, Homo sapiens
cccctgccctgct

SEQ ID NO: 156966 - DNA, 20 bp, Homo sapiens
cccctggcttttcactgctg

SEQ ID NO: 156967 - DNA, 22 bp, Homo sapiens
cccctggcttttcactgctggc

SEQ ID NO: 156968 - DNA, 23 bp, Homo sapiens
cccctggcttttcactgctggct

SEQ ID NO: 156969 - DNA, 23 bp, Homo sapiens
ccctgcccctcccttcaaccatt

SEQ ID NO: 156970 - DNA, 14 bp, Homo sapiens
ccctgccctagctc

SEQ ID NO: 156971 - DNA, 16 bp, Homo sapiens
ccctgccctagctcca

SEQ ID NO: 156972 - DNA, 21 bp, Homo sapiens
ccctgctgcaggggctctgga

SEQ ID NO: 156973 - DNA, 19 bp, Homo sapiens
ccctgctgccgcctcccag

SEQ ID NO: 156974 - DNA, 18 bp, Homo sapiens
ccctgctttgggctgccc

SEQ ID NO: 156975 - DNA, 13 bp, Homo sapiens
ccctggccagagg

SEQ ID NO: 156976 - DNA, 14 bp, Homo sapiens
ccctggcctgctgg

SEQ ID NO: 156977 - DNA, 22 bp, Homo sapiens
ccctggcctgctgggctctcca

SEQ ID NO: 156978 - DNA, 20 bp, Homo sapiens
ccctggctcccacaggccct

SEQ ID NO: 156979 - DNA, 13 bp, Homo sapiens
ccctggctctgca

SEQ ID NO: 156980 - DNA, 20 bp, Homo sapiens
ccctggcttgtaactccacc

SEQ ID NO: 156981 - DNA, 18 bp, Homo sapiens
ccctggcttttcactgct

SEQ ID NO: 156982 - DNA, 16 bp, Homo sapiens
ccctgggccccaccac

SEQ ID NO: 156983 - DNA, 13 bp, Homo sapiens
ccctgggctgaga

SEQ ID NO: 156984 - DNA, 21 bp, Homo sapiens
ccctggggcttctcctgaccc

SEQ ID NO: 156985 - DNA, 15 bp, Homo sapiens
ccctggtcctgaggg

SEQ ID NO: 156986 - DNA, 14 bp, Homo sapiens
ccctggtgctgcca

SEQ ID NO: 156987 - DNA, 16 bp, Homo sapiens
ccctggtgctgccaca

SEQ ID NO: 156988 - DNA, 10 bp, Homo sapiens
ccctgtccct

SEQ ID NO: 156989 - DNA, 18 bp, Homo sapiens
ccctgtccctcccacctc

SEQ ID NO: 156990 - DNA, 19 bp, Homo sapiens
ccctgtccctcccacctct

SEQ ID NO: 156991 - DNA, 17 bp, Homo sapiens
ccctgtcctcactgctc

SEQ ID NO: 156992 - DNA, 18 bp, Homo sapiens
ccctgtcctcactgctcc

SEQ ID NO: 156993 - DNA, 14 bp, Homo sapiens
ccctgtctaaaaaa

SEQ ID NO: 156994 - DNA, 20 bp, Homo sapiens
ccctgtctcaaaaaaagaaa

SEQ ID NO: 156995 - DNA, 20 bp, Homo sapiens
ccctgtggatgagccctcag

SEQ ID NO: 156996 - DNA, 22 bp, Homo sapiens
ccctgtggatgagccctcagaa

SEQ ID NO: 156997 - DNA, 23 bp, Homo sapiens
ccctgtggatgagccctcagaac

SEQ ID NO: 156998 - DNA, 16 bp, Homo sapiens
ccctgtgttgtctcta

SEQ ID NO: 156999 - DNA, 18 bp, Homo sapiens
ccctgtgttgtctctaga

SEQ ID NO: 157000 - DNA, 21 bp, Homo sapiens
ccctgtgttgtctctagagca

SEQ ID NO: 157001 - DNA, 14 bp, Homo sapiens
ccctgttcactcta

SEQ ID NO: 157002 - DNA, 11 bp, Homo sapiens
ccctgtttaat

SEQ ID NO: 157003 - DNA, 21 bp, Homo sapiens
ccctgtttaatatttaaacag

SEQ ID NO: 157004 - DNA, 14 bp, Homo sapiens
cccttacagtagga

SEQ ID NO: 157005 - DNA, 20 bp, Homo sapiens
cccttccatgtcgcctctgc

SEQ ID NO: 157006 - DNA, 14 bp, Homo sapiens
cccttcccacagga

SEQ ID NO: 157007 - DNA, 20 bp, Homo sapiens
cccttcctacagatagtcaa

SEQ ID NO: 157008 - DNA, 23 bp, Homo sapiens
cccttctcattccaacagtgagt

SEQ ID NO: 157009 - DNA, 23 bp, Homo sapiens
cccttctccatccacatgggagc

SEQ ID NO: 157010 - DNA, 17 bp, Homo sapiens
cccttctgtccctcaca

SEQ ID NO: 157011 - DNA, 15 bp, Homo sapiens
cccttgacacctgct

SEQ ID NO: 157012 - DNA, 14 bp, Homo sapiens
cccttgagaaacct

SEQ ID NO: 157013 - DNA, 18 bp, Homo sapiens
cccttgagacctcagcca

SEQ ID NO: 157014 - DNA, 13 bp, Homo sapiens
cccttgccagaca

SEQ ID NO: 157015 - DNA, 15 bp, Homo sapiens
cccttgcccagggct

SEQ ID NO: 157016 - DNA, 20 bp, Homo sapiens
cccttgcccagggctcagcc

SEQ ID NO: 157017 - DNA, 23 bp, Homo sapiens
cccttgtgcgtgggtgaagccgc

SEQ ID NO: 157018 - DNA, 13 bp, Homo sapiens
ccctttcctgcgg

SEQ ID NO: 157019 - DNA, 12 bp, Homo sapiens
ccctttctgtgt

SEQ ID NO: 157020 - DNA, 14 bp, Homo sapiens
ccctttgagtgcag

SEQ ID NO: 157021 - DNA, 15 bp, Homo sapiens
ccctttttgaagtgt

SEQ ID NO: 157022 - DNA, 20 bp, Homo sapiens
ccgaagaagggtccttccct

SEQ ID NO: 157023 - DNA, 14 bp, Homo sapiens
ccgacagcctggca

SEQ ID NO: 157024 - DNA, 22 bp, Homo sapiens
ccgacagcctggcacagggcag

SEQ ID NO: 157025 - DNA, 13 bp, Homo sapiens
ccgacctcagcct

SEQ ID NO: 157026 - DNA, 14 bp, Homo sapiens
ccgacctcagcctt

SEQ ID NO: 157027 - DNA, 19 bp, Homo sapiens
ccgacctcgtcctccccct

SEQ ID NO: 157028 - DNA, 22 bp, Homo sapiens
ccgacctcgtcctccccctgcc

SEQ ID NO: 157029 - DNA, 23 bp, Homo sapiens
ccgactgcacagcggcccctgca

SEQ ID NO: 157030 - DNA, 15 bp, Homo sapiens
ccgagagcctgctcc

SEQ ID NO: 157031 - DNA, 21 bp, Homo sapiens
ccgagagtagccgagagcctg

SEQ ID NO: 157032 - DNA, 22 bp, Homo sapiens
ccgagagtagccgagagcctgc

SEQ ID NO: 157033 - DNA, 14 bp, Homo sapiens
ccgagtctcttctc

SEQ ID NO: 157034 - DNA, 15 bp, Homo sapiens
ccgcagacctcccca

SEQ ID NO: 157035 - DNA, 17 bp, Homo sapiens
ccgcagacctccccagc

SEQ ID NO: 157036 - DNA, 18 bp, Homo sapiens
ccgcagacctccccagcc

SEQ ID NO: 157037 - DNA, 20 bp, Homo sapiens
ccgcagacctccccagcccc

SEQ ID NO: 157038 - DNA, 22 bp, Homo sapiens
ccgcatcttctccatctggcag

SEQ ID NO: 157039 - DNA, 15 bp, Homo sapiens
ccgcattccctgagt

SEQ ID NO: 157040 - DNA, 12 bp, Homo sapiens
ccgccaggcgag

SEQ ID NO: 157041 - DNA, 11 bp, Homo sapiens
ccgcctctgct

SEQ ID NO: 157042 - DNA, 17 bp, Homo sapiens
ccgcgtctggtgacaac

SEQ ID NO: 157043 - DNA, 13 bp, Homo sapiens
ccgctcagccctc

SEQ ID NO: 157044 - DNA, 22 bp, Homo sapiens
ccgctcagccctccctgcccct

SEQ ID NO: 157045 - DNA, 19 bp, Homo sapiens
ccgctgcctaagtggctgc

SEQ ID NO: 157046 - DNA, 18 bp, Homo sapiens
ccgctgtgagcccctggt

SEQ ID NO: 157047 - DNA, 19 bp, Homo sapiens
ccgctgtgagcccctggtc

SEQ ID NO: 157048 - DNA, 20 bp, Homo sapiens
ccgctgtgagcccctggtcc

SEQ ID NO: 157049 - DNA, 15 bp, Homo sapiens
ccgctgttcacccac

SEQ ID NO: 157050 - DNA, 17 bp, Homo sapiens
ccgcttgtccagcgcct

SEQ ID NO: 157051 - DNA, 18 bp, Homo sapiens
ccgcttgtccagcgccta

SEQ ID NO: 157052 - DNA, 19 bp, Homo sapiens
ccggaatcctgtcctcagc

SEQ ID NO: 157053 - DNA, 17 bp, Homo sapiens
ccggagcaaactctgct

SEQ ID NO: 157054 - DNA, 19 bp, Homo sapiens
ccggagcaaactctgctgt

SEQ ID NO: 157055 - DNA, 15 bp, Homo sapiens
ccggaggggcctggc

SEQ ID NO: 157056 - DNA, 21 bp, Homo sapiens
ccggaggggcctggcagccgt

SEQ ID NO: 157057 - DNA, 14 bp, Homo sapiens
ccggccacctctgc

SEQ ID NO: 157058 - DNA, 17 bp, Homo sapiens
ccgggacctggtgctgc

SEQ ID NO: 157059 - DNA, 22 bp, Homo sapiens
ccgggcatggtggcgcaagcct

SEQ ID NO: 157060 - DNA, 19 bp, Homo sapiens
ccgggcctggagaactaga

SEQ ID NO: 157061 - DNA, 16 bp, Homo sapiens
ccgggcgtggtggtga

SEQ ID NO: 157062 - DNA, 18 bp, Homo sapiens
ccgggctgggagctctgc

SEQ ID NO: 157063 - DNA, 11 bp, Homo sapiens
ccggtgtcctt

SEQ ID NO: 157064 - DNA, 21 bp, Homo sapiens
ccgtaaacacgcctgcaaacg

SEQ ID NO: 157065 - DNA, 15 bp, Homo sapiens
ccgtagttccctgaa

SEQ ID NO: 157066 - DNA, 12 bp, Homo sapiens
ccgtatttcaga

SEQ ID NO: 157067 - DNA, 23 bp, Homo sapiens
ccgtcctcacccctgtcctcact

SEQ ID NO: 157068 - DNA, 21 bp, Homo sapiens
ccgtcgaggggctctcagctc

SEQ ID NO: 157069 - DNA, 17 bp, Homo sapiens
ccgtctggggttcagcc

SEQ ID NO: 157070 - DNA, 19 bp, Homo sapiens
ccgtctggggttcagcccc

SEQ ID NO: 157071 - DNA, 13 bp, Homo sapiens
ccgtctgtgaatt

SEQ ID NO: 157072 - DNA, 22 bp, Homo sapiens
ccgtcttagaagtggaccagga

SEQ ID NO: 157073 - DNA, 14 bp, Homo sapiens
ccgtcttcagccta

SEQ ID NO: 157074 - DNA, 14 bp, Homo sapiens
ccgtgaggatgtca

SEQ ID NO: 157075 - DNA, 15 bp, Homo sapiens
ccgtgccttcagctc

SEQ ID NO: 157076 - DNA, 20 bp, Homo sapiens
ccgtggattgcacgtggcct

SEQ ID NO: 157077 - DNA, 16 bp, Homo sapiens
ccgtgtgccctcgggc

SEQ ID NO: 157078 - DNA, 14 bp, Homo sapiens
ccgttactctccaa

SEQ ID NO: 157079 - DNA, 14 bp, Homo sapiens
cctaaaaacacaga

SEQ ID NO: 157080 - DNA, 12 bp, Homo sapiens
cctaaagagata

SEQ ID NO: 157081 - DNA, 12 bp, Homo sapiens
cctaaccccttt

SEQ ID NO: 157082 - DNA, 15 bp, Homo sapiens
cctaacgaagtatcc

SEQ ID NO: 157083 - DNA, 20 bp, Homo sapiens
cctaacgaagtatccttcag

SEQ ID NO: 157084 - DNA, 13 bp, Homo sapiens
cctaagccaaggg

SEQ ID NO: 157085 - DNA, 21 bp, Homo sapiens
cctaagccaagggcctcttgc

SEQ ID NO: 157086 - DNA, 21 bp, Homo sapiens
cctaataaagttctgtactca

SEQ ID NO: 157087 - DNA, 22 bp, Homo sapiens
cctaatgacatcaccacagttt

SEQ ID NO: 157088 - DNA, 22 bp, Homo sapiens
cctaccatcagggacaggatga

SEQ ID NO: 157089 - DNA, 14 bp, Homo sapiens
cctaccccaccacg

SEQ ID NO: 157090 - DNA, 21 bp, Homo sapiens
cctaccgagtctcttctccac

SEQ ID NO: 157091 - DNA, 21 bp, Homo sapiens
cctaccggcaatttccggcca

SEQ ID NO: 157092 - DNA, 13 bp, Homo sapiens
cctactgaatgct

SEQ ID NO: 157093 - DNA, 11 bp, Homo sapiens
cctagcccagg

SEQ ID NO: 157094 - DNA, 20 bp, Homo sapiens
cctagcccaggagagagaaa

SEQ ID NO: 157095 - DNA, 15 bp, Homo sapiens
cctagccgacctcag

SEQ ID NO: 157096 - DNA, 16 bp, Homo sapiens
cctagccgacctcagc

SEQ ID NO: 157097 - DNA, 17 bp, Homo sapiens
cctagccgacctcagcc

SEQ ID NO: 157098 - DNA, 20 bp, Homo sapiens
cctagcctgtgcctctggga

SEQ ID NO: 157099 - DNA, 23 bp, Homo sapiens
cctagcctgtgcctctgggactg

SEQ ID NO: 157100 - DNA, 16 bp, Homo sapiens
cctaggccactcctcc

SEQ ID NO: 157101 - DNA, 14 bp, Homo sapiens
cctagtagtcattt

SEQ ID NO: 157102 - DNA, 19 bp, Homo sapiens
cctagtggggtctccctct

SEQ ID NO: 157103 - DNA, 23 bp, Homo sapiens
cctagtggggtctccctctcctg

SEQ ID NO: 157104 - DNA, 24 bp, Homo sapiens
cctagtggggtctccctctcctgc

SEQ ID NO: 157105 - DNA, 17 bp, Homo sapiens
cctataaagtaaagcta

SEQ ID NO: 157106 - DNA, 17 bp, Homo sapiens
cctatccacccagccca

SEQ ID NO: 157107 - DNA, 18 bp, Homo sapiens
cctatccacccagcccat

SEQ ID NO: 157108 - DNA, 11 bp, Homo sapiens
cctatgtgtaa

SEQ ID NO: 157109 - DNA, 16 bp, Homo sapiens
cctattagagaagaga

SEQ ID NO: 157110 - DNA, 18 bp, Homo sapiens
cctcaatccagctatgtt

SEQ ID NO: 157111 - DNA, 20 bp, Homo sapiens
cctcaatgtgaatcagaccc

SEQ ID NO: 157112 - DNA, 22 bp, Homo sapiens
cctcaatgtgaatcagacccta

SEQ ID NO: 157113 - DNA, 13 bp, Homo sapiens
cctcacagcctct

SEQ ID NO: 157114 - DNA, 19 bp, Homo sapiens
cctcacagcctctgacccc

SEQ ID NO: 157115 - DNA, 20 bp, Homo sapiens
cctcacagcctctgacccct

SEQ ID NO: 157116 - DNA, 16 bp, Homo sapiens
cctcacatctttcaca

SEQ ID NO: 157117 - DNA, 14 bp, Homo sapiens
cctcacccctgccc

SEQ ID NO: 157118 - DNA, 15 bp, Homo sapiens
cctcaccctgcctta

SEQ ID NO: 157119 - DNA, 14 bp, Homo sapiens
cctcacgcacctcc

SEQ ID NO: 157120 - DNA, 17 bp, Homo sapiens
cctcacgcacctcccat

SEQ ID NO: 157121 - DNA, 20 bp, Homo sapiens
cctcactcccttcccataag

SEQ ID NO: 157122 - DNA, 17 bp, Homo sapiens
cctcactgctccctgaa

SEQ ID NO: 157123 - DNA, 19 bp, Homo sapiens
cctcactgctccctgaagc

SEQ ID NO: 157124 - DNA, 12 bp, Homo sapiens
cctcactggcca

SEQ ID NO: 157125 - DNA, 19 bp, Homo sapiens
cctcactggggtcctgggg

SEQ ID NO: 157126 - DNA, 20 bp, Homo sapiens
cctcactggggtcctggggc

SEQ ID NO: 157127 - DNA, 16 bp, Homo sapiens
cctcagaacccttggc

SEQ ID NO: 157128 - DNA, 22 bp, Homo sapiens
cctcagaacccttggcttgccc

SEQ ID NO: 157129 - DNA, 11 bp, Homo sapiens
cctcagcctgt

SEQ ID NO: 157130 - DNA, 12 bp, Homo sapiens
cctcagcctgtg

SEQ ID NO: 157131 - DNA, 22 bp, Homo sapiens
cctcagccttccccttgcccag

SEQ ID NO: 157132 - DNA, 18 bp, Homo sapiens
cctcaggcactagccttt

SEQ ID NO: 157133 - DNA, 11 bp, Homo sapiens
cctcaggcagg

SEQ ID NO: 157134 - DNA, 15 bp, Homo sapiens
cctcaggctgctgga

SEQ ID NO: 157135 - DNA, 23 bp, Homo sapiens
cctcagggacagagacacctgca

SEQ ID NO: 157136 - DNA, 16 bp, Homo sapiens
cctcaggtgagaagca

SEQ ID NO: 157137 - DNA, 18 bp, Homo sapiens
cctcaggtgagaagcaga

SEQ ID NO: 157138 - DNA, 22 bp, Homo sapiens
cctcaggtgagaagcagaggaa

SEQ ID NO: 157139 - DNA, 16 bp, Homo sapiens
cctcagtcctcccctc

SEQ ID NO: 157140 - DNA, 19 bp, Homo sapiens
cctcagtcctcccctcaca

SEQ ID NO: 157141 - DNA, 21 bp, Homo sapiens
cctcagtcctcccctcacagc

SEQ ID NO: 157142 - DNA, 24 bp, Homo sapiens
cctcagtcctcccctcacagcctc

SEQ ID NO: 157143 - DNA, 14 bp, Homo sapiens
cctcatcccgagca

SEQ ID NO: 157144 - DNA, 20 bp, Homo sapiens
cctcatcccgagcacctcca

SEQ ID NO: 157145 - DNA, 13 bp, Homo sapiens
cctcattcaggaa

SEQ ID NO: 157146 - DNA, 17 bp, Homo sapiens
cctcattcaggaaaact

SEQ ID NO: 157147 - DNA, 22 bp, Homo sapiens
cctcattcaggaaaactgacag

SEQ ID NO: 157148 - DNA, 19 bp, Homo sapiens
cctcatttatccctcaacc

SEQ ID NO: 157149 - DNA, 21 bp, Homo sapiens
cctccaagctccatctccact

SEQ ID NO: 157150 - DNA, 22 bp, Homo sapiens
cctccaatcccaccaaccctca

SEQ ID NO: 157151 - DNA, 15 bp, Homo sapiens
cctccactccttcct

SEQ ID NO: 157152 - DNA, 12 bp, Homo sapiens
cctccactgtca

SEQ ID NO: 157153 - DNA, 17 bp, Homo sapiens
cctccagggccacgtgc

SEQ ID NO: 157154 - DNA, 19 bp, Homo sapiens
cctccagggccacgtgcca

SEQ ID NO: 157155 - DNA, 21 bp, Homo sapiens
cctccagggccacgtgccagg

SEQ ID NO: 157156 - DNA, 15 bp, Homo sapiens
cctccatgctgcctc

SEQ ID NO: 157157 - DNA, 13 bp, Homo sapiens
cctcccaccccca

SEQ ID NO: 157158 - DNA, 14 bp, Homo sapiens
cctcccatcccctg

SEQ ID NO: 157159 - DNA, 17 bp, Homo sapiens
cctcccatcccctggac

SEQ ID NO: 157160 - DNA, 17 bp, Homo sapiens
cctccccagcccctagc

SEQ ID NO: 157161 - DNA, 22 bp, Homo sapiens
cctccccagcccctagcccagg

SEQ ID NO: 157162 - DNA, 12 bp, Homo sapiens
cctccccagggg

SEQ ID NO: 157163 - DNA, 15 bp, Homo sapiens
cctcccctcacagcc

SEQ ID NO: 157164 - DNA, 15 bp, Homo sapiens
cctcccctcccctgc

SEQ ID NO: 157165 - DNA, 18 bp, Homo sapiens
cctcccctgccagggcag

SEQ ID NO: 157166 - DNA, 14 bp, Homo sapiens
cctcccctgccatt

SEQ ID NO: 157167 - DNA, 14 bp, Homo sapiens
cctcccctgcccta

SEQ ID NO: 157168 - DNA, 16 bp, Homo sapiens
cctcccctgctgcagg

SEQ ID NO: 157169 - DNA, 16 bp, Homo sapiens
cctccctcctctgtcc

SEQ ID NO: 157170 - DNA, 19 bp, Homo sapiens
cctcctatcagaagtttct

SEQ ID NO: 157171 - DNA, 15 bp, Homo sapiens
cctcctcactggcca

SEQ ID NO: 157172 - DNA, 15 bp, Homo sapiens
cctcctccacaccag

SEQ ID NO: 157173 - DNA, 13 bp, Homo sapiens
cctcctccttccc

SEQ ID NO: 157174 - DNA, 12 bp, Homo sapiens
cctcctctgcca

SEQ ID NO: 157175 - DNA, 15 bp, Homo sapiens
cctcctctgccacct

SEQ ID NO: 157176 - DNA, 14 bp, Homo sapiens
cctcctctgtccct

SEQ ID NO: 157177 - DNA, 12 bp, Homo sapiens
cctcctgcccac

SEQ ID NO: 157178 - DNA, 17 bp, Homo sapiens
cctcctgcccacctgtc

SEQ ID NO: 157179 - DNA, 15 bp, Homo sapiens
cctcctgcccaggag

SEQ ID NO: 157180 - DNA, 14 bp, Homo sapiens
cctccttccttgac

SEQ ID NO: 157181 - DNA, 15 bp, Homo sapiens
cctccttctcccttt

SEQ ID NO: 157182 - DNA, 20 bp, Homo sapiens
cctcgctgccagctctgtat

SEQ ID NO: 157183 - DNA, 13 bp, Homo sapiens
cctcggagcctca

SEQ ID NO: 157184 - DNA, 15 bp, Homo sapiens
cctcggatcaccgag

SEQ ID NO: 157185 - DNA, 20 bp, Homo sapiens
cctcggcttttctcagctgg

SEQ ID NO: 157186 - DNA, 16 bp, Homo sapiens
cctcggtgccttcctc

SEQ ID NO: 157187 - DNA, 14 bp, Homo sapiens
cctctcccaggacc

SEQ ID NO: 157188 - DNA, 22 bp, Homo sapiens
cctctccccaagacttggtgtc

SEQ ID NO: 157189 - DNA, 10 bp, Homo sapiens
cctctccctg

SEQ ID NO: 157190 - DNA, 12 bp, Homo sapiens
cctctcctgcct

SEQ ID NO: 157191 - DNA, 13 bp, Homo sapiens
cctctcctgccta

SEQ ID NO: 157192 - DNA, 11 bp, Homo sapiens
cctctctctga

SEQ ID NO: 157193 - DNA, 13 bp, Homo sapiens
cctctctctgact

SEQ ID NO: 157194 - DNA, 14 bp, Homo sapiens
cctctctctgactc

SEQ ID NO: 157195 - DNA, 20 bp, Homo sapiens
cctctcttatagaatattta

SEQ ID NO: 157196 - DNA, 21 bp, Homo sapiens
cctctcttggtttccttcctt

SEQ ID NO: 157197 - DNA, 16 bp, Homo sapiens
cctctgaaaccctgga

SEQ ID NO: 157198 - DNA, 13 bp, Homo sapiens
cctctgacccctc

SEQ ID NO: 157199 - DNA, 18 bp, Homo sapiens
cctctgacccctcctcac

SEQ ID NO: 157200 - DNA, 19 bp, Homo sapiens
cctctgacccctcctcact

SEQ ID NO: 157201 - DNA, 22 bp, Homo sapiens
cctcttagacttctgctttcca

SEQ ID NO: 157202 - DNA, 13 bp, Homo sapiens
cctcttctgggag

SEQ ID NO: 157203 - DNA, 17 bp, Homo sapiens
cctcttctgggagggca

SEQ ID NO: 157204 - DNA, 15 bp, Homo sapiens
cctcttgagcagtgg

SEQ ID NO: 157205 - DNA, 16 bp, Homo sapiens
cctcttgagcagtggc

SEQ ID NO: 157206 - DNA, 18 bp, Homo sapiens
cctcttgcggtcccttct

SEQ ID NO: 157207 - DNA, 18 bp, Homo sapiens
cctgaaaacactgtgcac

SEQ ID NO: 157208 - DNA, 23 bp, Homo sapiens
cctgaaagaggaatgaagtactc

SEQ ID NO: 157209 - DNA, 13 bp, Homo sapiens
cctgaaagccctg

SEQ ID NO: 157210 - DNA, 14 bp, Homo sapiens
cctgaaagccctga

SEQ ID NO: 157211 - DNA, 23 bp, Homo sapiens
cctgaatgtattgaacttggaaa

SEQ ID NO: 157212 - DNA, 19 bp, Homo sapiens
cctgacaaccactggtctg

SEQ ID NO: 157213 - DNA, 11 bp, Homo sapiens
cctgagcccca

SEQ ID NO: 157214 - DNA, 14 bp, Homo sapiens
cctgagcctggcca

SEQ ID NO: 157215 - DNA, 16 bp, Homo sapiens
cctgagcctggccagc

SEQ ID NO: 157216 - DNA, 18 bp, Homo sapiens
cctgagctcggtggaccc

SEQ ID NO: 157217 - DNA, 15 bp, Homo sapiens
cctgagctgaggcag

SEQ ID NO: 157218 - DNA, 18 bp, Homo sapiens
cctgagctgaggcagcag

SEQ ID NO: 157219 - DNA, 14 bp, Homo sapiens
cctgagctttctgc

SEQ ID NO: 157220 - DNA, 12 bp, Homo sapiens
cctgaggaagcg

SEQ ID NO: 157221 - DNA, 13 bp, Homo sapiens
cctgagggtcccc

SEQ ID NO: 157222 - DNA, 19 bp, Homo sapiens
cctgagggtccccacctgg

SEQ ID NO: 157223 - DNA, 13 bp, Homo sapiens
cctgagtcaccag

SEQ ID NO: 157224 - DNA, 14 bp, Homo sapiens
cctgagtcaccagg

SEQ ID NO: 157225 - DNA, 17 bp, Homo sapiens
cctgataataattgatc

SEQ ID NO: 157226 - DNA, 13 bp, Homo sapiens
cctgatcagagcc

SEQ ID NO: 157227 - DNA, 18 bp, Homo sapiens
cctgcaaaatgagaccct

SEQ ID NO: 157228 - DNA, 18 bp, Homo sapiens
cctgcaaacgctgcctgc

SEQ ID NO: 157229 - DNA, 22 bp, Homo sapiens
cctgcaaacgctgcctgcccgt

SEQ ID NO: 157230 - DNA, 18 bp, Homo sapiens
cctgcaactcaaggactt

SEQ ID NO: 157231 - DNA, 19 bp, Homo sapiens
cctgcaatttcatatgctg

SEQ ID NO: 157232 - DNA, 22 bp, Homo sapiens
cctgcacaaagcccttccatgt

SEQ ID NO: 157233 - DNA, 14 bp, Homo sapiens
cctgcacctccccc

SEQ ID NO: 157234 - DNA, 17 bp, Homo sapiens
cctgcacctccccccac

SEQ ID NO: 157235 - DNA, 14 bp, Homo sapiens
cctgcacctgtgca

SEQ ID NO: 157236 - DNA, 15 bp, Homo sapiens
cctgcaggacctgcc

SEQ ID NO: 157237 - DNA, 17 bp, Homo sapiens
cctgcaggacctgcctg

SEQ ID NO: 157238 - DNA, 18 bp, Homo sapiens
cctgcaggacctgcctgt

SEQ ID NO: 157239 - DNA, 18 bp, Homo sapiens
cctgcagtactttacctc

SEQ ID NO: 157240 - DNA, 15 bp, Homo sapiens
cctgcagtcatcttg

SEQ ID NO: 157241 - DNA, 21 bp, Homo sapiens
cctgcatccccttggctgtga

SEQ ID NO: 157242 - DNA, 24 bp, Homo sapiens
cctgcatccccttggctgtgaggc

SEQ ID NO: 157243 - DNA, 23 bp, Homo sapiens
cctgcatgtaaacacgcctgcaa

SEQ ID NO: 157244 - DNA, 16 bp, Homo sapiens
cctgcattcacccaga

SEQ ID NO: 157245 - DNA, 22 bp, Homo sapiens
cctgcattctgccgtgtgccct

SEQ ID NO: 157246 - DNA, 14 bp, Homo sapiens
cctgcatttctgag

SEQ ID NO: 157247 - DNA, 16 bp, Homo sapiens
cctgccaggcatggtg

SEQ ID NO: 157248 - DNA, 17 bp, Homo sapiens
cctgccagggcagggcc

SEQ ID NO: 157249 - DNA, 13 bp, Homo sapiens
cctgccagtgcct

SEQ ID NO: 157250 - DNA, 16 bp, Homo sapiens
cctgcccatctgggaa

SEQ ID NO: 157251 - DNA, 17 bp, Homo sapiens
cctgccccagggctccc

SEQ ID NO: 157252 - DNA, 15 bp, Homo sapiens
cctgcccccaatcca

SEQ ID NO: 157253 - DNA, 21 bp, Homo sapiens
cctgcccgtaaacacgcctgc

SEQ ID NO: 157254 - DNA, 24 bp, Homo sapiens
cctgccctagagcacactgtagca

SEQ ID NO: 157255 - DNA, 14 bp, Homo sapiens
cctgccctagctcc

SEQ ID NO: 157256 - DNA, 16 bp, Homo sapiens
cctgccctagctccac

SEQ ID NO: 157257 - DNA, 13 bp, Homo sapiens
cctgccctgctgc

SEQ ID NO: 157258 - DNA, 15 bp, Homo sapiens
cctgcccttgtccca

SEQ ID NO: 157259 - DNA, 22 bp, Homo sapiens
cctgccggtaaacacgcctgca

SEQ ID NO: 157260 - DNA, 23 bp, Homo sapiens
cctgccggtaaacacgcctgcaa

SEQ ID NO: 157261 - DNA, 22 bp, Homo sapiens
cctgcctgttcccattcttgca

SEQ ID NO: 157262 - DNA, 22 bp, Homo sapiens
cctgccttcctcctgggccctc

SEQ ID NO: 157263 - DNA, 21 bp, Homo sapiens
cctgcgggcttttccccggtc

SEQ ID NO: 157264 - DNA, 19 bp, Homo sapiens
cctgctacaacttcagcag

SEQ ID NO: 157265 - DNA, 18 bp, Homo sapiens
cctgctcccccaccccct

SEQ ID NO: 157266 - DNA, 23 bp, Homo sapiens
cctgctgaatgatttccaaagag

SEQ ID NO: 157267 - DNA, 19 bp, Homo sapiens
cctgctgagggaccagcca

SEQ ID NO: 157268 - DNA, 13 bp, Homo sapiens
cctgctgcagggg

SEQ ID NO: 157269 - DNA, 14 bp, Homo sapiens
cctgctgcaggggc

SEQ ID NO: 157270 - DNA, 15 bp, Homo sapiens
cctgctgcaggggct

SEQ ID NO: 157271 - DNA, 17 bp, Homo sapiens
cctgctgcaggggctct

SEQ ID NO: 157272 - DNA, 20 bp, Homo sapiens
cctgctgcaggggctctgga

SEQ ID NO: 157273 - DNA, 22 bp, Homo sapiens
cctgctgcaggggctctggaga

SEQ ID NO: 157274 - DNA, 14 bp, Homo sapiens
cctgctgccgcctc

SEQ ID NO: 157275 - DNA, 17 bp, Homo sapiens
cctgctgggctctccac

SEQ ID NO: 157276 - DNA, 19 bp, Homo sapiens
cctgctgggctctccacct

SEQ ID NO: 157277 - DNA, 17 bp, Homo sapiens
cctgctttgggctgccc

SEQ ID NO: 157278 - DNA, 19 bp, Homo sapiens
cctgctttgggctgccctg

SEQ ID NO: 157279 - DNA, 20 bp, Homo sapiens
cctggaagctgtgtccttgc

SEQ ID NO: 157280 - DNA, 20 bp, Homo sapiens
cctggacatttgccttgctg

SEQ ID NO: 157281 - DNA, 14 bp, Homo sapiens
cctggaccctgtgg

SEQ ID NO: 157282 - DNA, 21 bp, Homo sapiens
cctggacctgccctgggccac

SEQ ID NO: 157283 - DNA, 13 bp, Homo sapiens
cctggactgggag

SEQ ID NO: 157284 - DNA, 18 bp, Homo sapiens
cctggactgggaggtaga

SEQ ID NO: 157285 - DNA, 14 bp, Homo sapiens
cctggactttcctg

SEQ ID NO: 157286 - DNA, 16 bp, Homo sapiens
cctggactttcctgca

SEQ ID NO: 157287 - DNA, 19 bp, Homo sapiens
cctggactttcctgcaact

SEQ ID NO: 157288 - DNA, 12 bp, Homo sapiens
cctggagaacta

SEQ ID NO: 157289 - DNA, 18 bp, Homo sapiens
cctggcacagggcagtgg

SEQ ID NO: 157290 - DNA, 19 bp, Homo sapiens
cctggcagccgtgccttca

SEQ ID NO: 157291 - DNA, 12 bp, Homo sapiens
cctggccagagg

SEQ ID NO: 157292 - DNA, 15 bp, Homo sapiens
cctggccagcctaca

SEQ ID NO: 157293 - DNA, 12 bp, Homo sapiens
cctggccccatg

SEQ ID NO: 157294 - DNA, 18 bp, Homo sapiens
cctggccccatggtcagc

SEQ ID NO: 157295 - DNA, 17 bp, Homo sapiens
cctggccccatgtctct

SEQ ID NO: 157296 - DNA, 14 bp, Homo sapiens
cctggcccccagct

SEQ ID NO: 157297 - DNA, 13 bp, Homo sapiens
cctggcctgctgg

SEQ ID NO: 157298 - DNA, 23 bp, Homo sapiens
cctggctcccacaggcccttcct

SEQ ID NO: 157299 - DNA, 11 bp, Homo sapiens
cctggctctga

SEQ ID NO: 157300 - DNA, 20 bp, Homo sapiens
cctggctctgaccgaaacag

SEQ ID NO: 157301 - DNA, 18 bp, Homo sapiens
cctggcttttcactgctg

SEQ ID NO: 157302 - DNA, 24 bp, Homo sapiens
cctggcttttcactgctggctgcc

SEQ ID NO: 157303 - DNA, 20 bp, Homo sapiens
cctgggatgtccacagatgc

SEQ ID NO: 157304 - DNA, 22 bp, Homo sapiens
cctgggcatatccaccacctcc

SEQ ID NO: 157305 - DNA, 23 bp, Homo sapiens
cctgggcatatccaccacctccc

SEQ ID NO: 157306 - DNA, 16 bp, Homo sapiens
cctgggcatccttctt

SEQ ID NO: 157307 - DNA, 21 bp, Homo sapiens
cctgggccccaccacctaggc

SEQ ID NO: 157308 - DNA, 14 bp, Homo sapiens
cctgggccctctct

SEQ ID NO: 157309 - DNA, 22 bp, Homo sapiens
cctgggctgagagaacctcacg

SEQ ID NO: 157310 - DNA, 16 bp, Homo sapiens
cctgggggaagccctg

SEQ ID NO: 157311 - DNA, 18 bp, Homo sapiens
cctgggggttctttcttc

SEQ ID NO: 157312 - DNA, 22 bp, Homo sapiens
cctgggggttctttcttcctct

SEQ ID NO: 157313 - DNA, 17 bp, Homo sapiens
cctgggtggggctgctc

SEQ ID NO: 157314 - DNA, 20 bp, Homo sapiens
cctgggtggggctgctcctc

SEQ ID NO: 157315 - DNA, 23 bp, Homo sapiens
cctgggtggggctgctcctccag

SEQ ID NO: 157316 - DNA, 14 bp, Homo sapiens
cctgggtggtctgc

SEQ ID NO: 157317 - DNA, 23 bp, Homo sapiens
cctgggttttgtattctctgagc

SEQ ID NO: 157318 - DNA, 17 bp, Homo sapiens
cctggtagaatagatat

SEQ ID NO: 157319 - DNA, 22 bp, Homo sapiens
cctggtcacaggactctgcctc

SEQ ID NO: 157320 - DNA, 14 bp, Homo sapiens
cctggtcctgaggg

SEQ ID NO: 157321 - DNA, 15 bp, Homo sapiens
cctggtgctgcctct

SEQ ID NO: 157322 - DNA, 20 bp, Homo sapiens
cctggttccggaatcctgtc

SEQ ID NO: 157323 - DNA, 20 bp, Homo sapiens
cctgtaatcatataataaat

SEQ ID NO: 157324 - DNA, 15 bp, Homo sapiens
cctgtaatcccagca

SEQ ID NO: 157325 - DNA, 16 bp, Homo sapiens
cctgtagagtgggagc

SEQ ID NO: 157326 - DNA, 21 bp, Homo sapiens
cctgtagagtgggagctgagt

SEQ ID NO: 157327 - DNA, 23 bp, Homo sapiens
cctgtagcccactctgctcgcct

SEQ ID NO: 157328 - DNA, 14 bp, Homo sapiens
cctgtagttaggaa

SEQ ID NO: 157329 - DNA, 15 bp, Homo sapiens
cctgtagttaggaaa

SEQ ID NO: 157330 - DNA, 15 bp, Homo sapiens
ctctgtcttgtgttt

SEQ ID NO: 157331 - DNA, 21 bp, Homo sapiens
ctctgtgaacgatttagaaag

SEQ ID NO: 157332 - DNA, 14 bp, Homo sapiens
ctctgtgaccaatg

SEQ ID NO: 157333 - DNA, 18 bp, Homo sapiens
ctcttaaaaaataaaaac

SEQ ID NO: 157334 - DNA, 24 bp, Homo sapiens
ctcttaaaacccaagtgccttagc

SEQ ID NO: 157335 - DNA, 16 bp, Homo sapiens
ctcttactgcaaatgt

SEQ ID NO: 157336 - DNA, 19 bp, Homo sapiens
ctcttactgcaaatgtcat

SEQ ID NO: 157337 - DNA, 17 bp, Homo sapiens
ctcttagcagcttccag

SEQ ID NO: 157338 - DNA, 19 bp, Homo sapiens
ctcttagcagcttccagat

SEQ ID NO: 157339 - DNA, 17 bp, Homo sapiens
ctcttatagaatattta

SEQ ID NO: 157340 - DNA, 21 bp, Homo sapiens
ctcttatagaatatttattac

SEQ ID NO: 157341 - DNA, 22 bp, Homo sapiens
ctcttatagaatatttattacc

SEQ ID NO: 157342 - DNA, 15 bp, Homo sapiens
ctcttattttacaat

SEQ ID NO: 157343 - DNA, 20 bp, Homo sapiens
ctcttcaactgaccagcctc

SEQ ID NO: 157344 - DNA, 16 bp, Homo sapiens
ctcttcaccccccact

SEQ ID NO: 157345 - DNA, 17 bp, Homo sapiens
ctcttcaccccccactc

SEQ ID NO: 157346 - DNA, 17 bp, Homo sapiens
ctcttcagaggccctcg

SEQ ID NO: 157347 - DNA, 13 bp, Homo sapiens
ctcttcatacttt

SEQ ID NO: 157348 - DNA, 13 bp, Homo sapiens
ctcttctcctttc

SEQ ID NO: 157349 - DNA, 20 bp, Homo sapiens
ctcttctgccggccctgggg

SEQ ID NO: 157350 - DNA, 21 bp, Homo sapiens
ctcttctgggagggcagcagg

SEQ ID NO: 157351 - DNA, 22 bp, Homo sapiens
ctcttctgggagggcagcaggg

SEQ ID NO: 157352 - DNA, 22 bp, Homo sapiens
ctcttctttaaagggatggcaa

SEQ ID NO: 157353 - DNA, 16 bp, Homo sapiens
ctcttgccactgcctc

SEQ ID NO: 157354 - DNA, 20 bp, Homo sapiens
ctcttggtttccttccttgg

SEQ ID NO: 157355 - DNA, 21 bp, Homo sapiens
ctcttgtaatccgaatctctt

SEQ ID NO: 157356 - DNA, 13 bp, Homo sapiens
ctctttcatccac

SEQ ID NO: 157357 - DNA, 15 bp, Homo sapiens
ctctttctctgccag

SEQ ID NO: 157358 - DNA, 18 bp, Homo sapiens
ctctttttagggccaggc

SEQ ID NO: 157359 - DNA, 15 bp, Homo sapiens
ctgaaaaaaagttta

SEQ ID NO: 157360 - DNA, 14 bp, Homo sapiens
ctgaaaacccagag

SEQ ID NO: 157361 - DNA, 19 bp, Homo sapiens
ctgaaaagactcagtgttc

SEQ ID NO: 157362 - DNA, 14 bp, Homo sapiens
ctgaaaccagtgtt

SEQ ID NO: 157363 - DNA, 15 bp, Homo sapiens
ctgaaagacaatata

SEQ ID NO: 157364 - DNA, 17 bp, Homo sapiens
ctgaaagaggaatgaag

SEQ ID NO: 157365 - DNA, 22 bp, Homo sapiens
ctgaaagaggctgaggcctgga

SEQ ID NO: 157366 - DNA, 17 bp, Homo sapiens
ctgaaagccctgagctt

SEQ ID NO: 157367 - DNA, 18 bp, Homo sapiens
ctgaaagccctgagcttt

SEQ ID NO: 157368 - DNA, 12 bp, Homo sapiens
ctgaacagtgga

SEQ ID NO: 157369 - DNA, 14 bp, Homo sapiens
ctgaacctgatgct

SEQ ID NO: 157370 - DNA, 17 bp, Homo sapiens
ctgaacctgatgctgac

SEQ ID NO: 157371 - DNA, 13 bp, Homo sapiens
ctgaacggggaga

SEQ ID NO: 157372 - DNA, 22 bp, Homo sapiens
ctgaacttcaggataataaagt

SEQ ID NO: 157373 - DNA, 13 bp, Homo sapiens
ctgaagaacagta

SEQ ID NO: 157374 - DNA, 22 bp, Homo sapiens
ctgaagcagatgcaaagaggca

SEQ ID NO: 157375 - DNA, 17 bp, Homo sapiens
ctgaagccagccttctt

SEQ ID NO: 157376 - DNA, 21 bp, Homo sapiens
ctgaaggagccccattcctgg

SEQ ID NO: 157377 - DNA, 16 bp, Homo sapiens
ctgaagttaacagaga

SEQ ID NO: 157378 - DNA, 16 bp, Homo sapiens
ctgaatacagaggcaa

SEQ ID NO: 157379 - DNA, 15 bp, Homo sapiens
ctgaattgtccccag

SEQ ID NO: 157380 - DNA, 14 bp, Homo sapiens
ctgacagaaggact

SEQ ID NO: 157381 - DNA, 21 bp, Homo sapiens
ctgacatgtggggccaggtca

SEQ ID NO: 157382 - DNA, 21 bp, Homo sapiens
ctgacatttggagtgttcccc

SEQ ID NO: 157383 - DNA, 17 bp, Homo sapiens
ctgaccagcctccatgc

SEQ ID NO: 157384 - DNA, 21 bp, Homo sapiens
ctgaccagcctccatgctgcc

SEQ ID NO: 157385 - DNA, 21 bp, Homo sapiens
ctgacccagccccttgagaaa

SEQ ID NO: 157386 - DNA, 13 bp, Homo sapiens
ctgacccagtccc

SEQ ID NO: 157387 - DNA, 14 bp, Homo sapiens
ctgacccagtgaga

SEQ ID NO: 157388 - DNA, 20 bp, Homo sapiens
ctgacccttacagcctctga

SEQ ID NO: 157389 - DNA, 14 bp, Homo sapiens
ctgacctccacagc

SEQ ID NO: 157390 - DNA, 16 bp, Homo sapiens
ctgacctccacagctt

SEQ ID NO: 157391 - DNA, 20 bp, Homo sapiens
ctgacctccctctaatttat

SEQ ID NO: 157392 - DNA, 20 bp, Homo sapiens
ctgaccttgaactcctgggc

SEQ ID NO: 157393 - DNA, 23 bp, Homo sapiens
ctgacctttgtcatctttcttct

SEQ ID NO: 157394 - DNA, 15 bp, Homo sapiens
ctgactcagggctcc

SEQ ID NO: 157395 - DNA, 15 bp, Homo sapiens
ctgactccttagaga

SEQ ID NO: 157396 - DNA, 19 bp, Homo sapiens
ctgactgatgttgagggaa

SEQ ID NO: 157397 - DNA, 16 bp, Homo sapiens
ctgactgttttctctt

SEQ ID NO: 157398 - DNA, 18 bp, Homo sapiens
ctgactgttttctcttga

SEQ ID NO: 157399 - DNA, 13 bp, Homo sapiens
ctgacttctaagt

SEQ ID NO: 157400 - DNA, 12 bp, Homo sapiens
ctgagaaagact

SEQ ID NO: 157401 - DNA, 13 bp, Homo sapiens
ctgagaaagacta

SEQ ID NO: 157402 - DNA, 18 bp, Homo sapiens
ctgagaaagactattcaa

SEQ ID NO: 157403 - DNA, 23 bp, Homo sapiens
ctgagaagagagatcaaatggaa

SEQ ID NO: 157404 - DNA, 14 bp, Homo sapiens
ctgagaatctttat

SEQ ID NO: 157405 - DNA, 22 bp, Homo sapiens
ctgagaatctttattgagaaag

SEQ ID NO: 157406 - DNA, 19 bp, Homo sapiens
ctgagagacccaaggagga

SEQ ID NO: 157407 - DNA, 14 bp, Homo sapiens
ctgagatcgtgccg

SEQ ID NO: 157408 - DNA, 16 bp, Homo sapiens
ctgagatgtgaacaca

SEQ ID NO: 157409 - DNA, 20 bp, Homo sapiens
ctgagatgtgaacacatcag

SEQ ID NO: 157410 - DNA, 12 bp, Homo sapiens
ctgagcaaagca

SEQ ID NO: 157411 - DNA, 17 bp, Homo sapiens
ctgagcaaatgtggctc

SEQ ID NO: 157412 - DNA, 17 bp, Homo sapiens
ctgagcagactggtgag

SEQ ID NO: 157413 - DNA, 20 bp, Homo sapiens
ctgagcagtgaatgattcag

SEQ ID NO: 157414 - DNA, 17 bp, Homo sapiens
ctgagccccgcagacct

SEQ ID NO: 157415 - DNA, 21 bp, Homo sapiens
ctgagccccgcagacctcccc

SEQ ID NO: 157416 - DNA, 16 bp, Homo sapiens
ctgagcccctgggact

SEQ ID NO: 157417 - DNA, 19 bp, Homo sapiens
ctgagcccctgggactgct

SEQ ID NO: 157418 - DNA, 13 bp, Homo sapiens
ctgagcctggcca

SEQ ID NO: 157419 - DNA, 16 bp, Homo sapiens
ctgagcgacagtgaga

SEQ ID NO: 157420 - DNA, 15 bp, Homo sapiens
ctgagctgaggcagc

SEQ ID NO: 157421 - DNA, 15 bp, Homo sapiens
ctgagctgccatcca

SEQ ID NO: 157422 - DNA, 16 bp, Homo sapiens
ctgagctgccatccag

SEQ ID NO: 157423 - DNA, 16 bp, Homo sapiens
ctgagcttctctgtga

SEQ ID NO: 157424 - DNA, 14 bp, Homo sapiens
ctgagctttctgct

SEQ ID NO: 157425 - DNA, 22 bp, Homo sapiens
ctgaggaaaggccagctggcag

SEQ ID NO: 157426 - DNA, 13 bp, Homo sapiens
ctgaggcacgagc

SEQ ID NO: 157427 - DNA, 13 bp, Homo sapiens
ctgaggcagacag

SEQ ID NO: 157428 - DNA, 14 bp, Homo sapiens
ctgaggcagacagc

SEQ ID NO: 157429 - DNA, 17 bp, Homo sapiens
ctgaggcagacagcagc

SEQ ID NO: 157430 - DNA, 24 bp, Homo sapiens
ctgaggcagcagtgtgaggccagg

SEQ ID NO: 157431 - DNA, 12 bp, Homo sapiens
ctgaggcctgga

SEQ ID NO: 157432 - DNA, 22 bp, Homo sapiens
ctgaggcctggactttcctgca

SEQ ID NO: 157433 - DNA, 22 bp, Homo sapiens
ctgaggctctgacccagtgaga

SEQ ID NO: 157434 - DNA, 15 bp, Homo sapiens
ctgagggaccagcca

SEQ ID NO: 157435 - DNA, 13 bp, Homo sapiens
ctgagggagcctg

SEQ ID NO: 157436 - DNA, 15 bp, Homo sapiens
ctgagggtccccacc

SEQ ID NO: 157437 - DNA, 19 bp, Homo sapiens
ctgagggtccccacctggg

SEQ ID NO: 157438 - DNA, 21 bp, Homo sapiens
ctgagggtccccacctgggac

SEQ ID NO: 157439 - DNA, 22 bp, Homo sapiens
ctgaggtgggaggatctcttga

SEQ ID NO: 157440 - DNA, 22 bp, Homo sapiens
ctgagtatctcctcgcaagctg

SEQ ID NO: 157441 - DNA, 20 bp, Homo sapiens
ctgagtcatgatctccctgc

SEQ ID NO: 157442 - DNA, 22 bp, Homo sapiens
ctgagtgggggatcacagcctc

SEQ ID NO: 157443 - DNA, 23 bp, Homo sapiens
ctgataaaaccatgtagaaaatt

SEQ ID NO: 157444 - DNA, 14 bp, Homo sapiens
ctgataataattga

SEQ ID NO: 157445 - DNA, 19 bp, Homo sapiens
ctgatcagtctaagatggg

SEQ ID NO: 157446 - DNA, 20 bp, Homo sapiens
ctgatctgatgcaagcaaga

SEQ ID NO: 157447 - DNA, 21 bp, Homo sapiens
ctgatgaactcttaatcaaat

SEQ ID NO: 157448 - DNA, 20 bp, Homo sapiens
ctgatgttcctagtgaaaga

SEQ ID NO: 157449 - DNA, 21 bp, Homo sapiens
ctgatgttcctagtgaaagag

SEQ ID NO: 157450 - DNA, 14 bp, Homo sapiens
ctgattacaccagc

SEQ ID NO: 157451 - DNA, 18 bp, Homo sapiens
ctgcaaaaggactctcag

SEQ ID NO: 157452 - DNA, 22 bp, Homo sapiens
ctgcaaaatgaggaatgtatat

SEQ ID NO: 157453 - DNA, 18 bp, Homo sapiens
ctgcaaacgctgcctgcc

SEQ ID NO: 157454 - DNA, 19 bp, Homo sapiens
ctgcaaacgctgcctgccc

SEQ ID NO: 157455 - DNA, 15 bp, Homo sapiens
ctgcaagagccttgg

SEQ ID NO: 157456 - DNA, 23 bp, Homo sapiens
ctgctttgactgagcagactggt

SEQ ID NO: 157457 - DNA, 23 bp, Homo sapiens
ctgctttgggctgccctggtgct

SEQ ID NO: 157458 - DNA, 22 bp, Homo sapiens
ctgcttttccttggggcaggca

SEQ ID NO: 157459 - DNA, 23 bp, Homo sapiens
ctgcttttccttggggcaggcag

SEQ ID NO: 157460 - DNA, 14 bp, Homo sapiens
ctggaatgtaatca

SEQ ID NO: 157461 - DNA, 15 bp, Homo sapiens
ctggaatgtaatcaa

SEQ ID NO: 157462 - DNA, 18 bp, Homo sapiens
ctggacaagcagaggtgg

SEQ ID NO: 157463 - DNA, 23 bp, Homo sapiens
ctggacggggactggggatgtgg

SEQ ID NO: 157464 - DNA, 13 bp, Homo sapiens
ctggactcaggat

SEQ ID NO: 157465 - DNA, 18 bp, Homo sapiens
ctggactcctctgtccag

SEQ ID NO: 157466 - DNA, 19 bp, Homo sapiens
ctggactcctctgtccagg

SEQ ID NO: 157467 - DNA, 23 bp, Homo sapiens
ctggactcctctgtccaggcact

SEQ ID NO: 157468 - DNA, 14 bp, Homo sapiens
ctggactctcagtc

SEQ ID NO: 157469 - DNA, 17 bp, Homo sapiens
ctggactctcagtctct

SEQ ID NO: 157470 - DNA, 21 bp, Homo sapiens
ctggactctcagtctctgagc

SEQ ID NO: 157471 - DNA, 13 bp, Homo sapiens
ctggactgggagg

SEQ ID NO: 157472 - DNA, 14 bp, Homo sapiens
ctggactgggaggt

SEQ ID NO: 157473 - DNA, 17 bp, Homo sapiens
ctggactgggaggtaga

SEQ ID NO: 157474 - DNA, 14 bp, Homo sapiens
ctggagaactagag

SEQ ID NO: 157475 - DNA, 15 bp, Homo sapiens
ctggagaactagaga

SEQ ID NO: 157476 - DNA, 18 bp, Homo sapiens
ctggagaagagaggagag

SEQ ID NO: 157477 - DNA, 11 bp, Homo sapiens
ctggagacagc

SEQ ID NO: 157478 - DNA, 15 bp, Homo sapiens
ctggagacagcccca

SEQ ID NO: 157479 - DNA, 19 bp, Homo sapiens
ctggagacagccccagagc

SEQ ID NO: 157480 - DNA, 21 bp, Homo sapiens
ctggagacagccccagagcag

SEQ ID NO: 157481 - DNA, 23 bp, Homo sapiens
ctggagacagccccagagcaggg

SEQ ID NO: 157482 - DNA, 14 bp, Homo sapiens
ctggagagaaacaa

SEQ ID NO: 157483 - DNA, 14 bp, Homo sapiens
ctggagcaccaggc

SEQ ID NO: 157484 - DNA, 14 bp, Homo sapiens
ctggagcccaggga

SEQ ID NO: 157485 - DNA, 14 bp, Homo sapiens
ctggaggaaaactg

SEQ ID NO: 157486 - DNA, 17 bp, Homo sapiens
ctggaggaaaactgaga

SEQ ID NO: 157487 - DNA, 13 bp, Homo sapiens
ctggaggcagggc

SEQ ID NO: 157488 - DNA, 18 bp, Homo sapiens
ctggaggtgggagcagga

SEQ ID NO: 157489 - DNA, 16 bp, Homo sapiens
ctggagttacattaat

SEQ ID NO: 157490 - DNA, 22 bp, Homo sapiens
ctggagttacattaatgttaat

SEQ ID NO: 157491 - DNA, 14 bp, Homo sapiens
ctggataacttagg

SEQ ID NO: 157492 - DNA, 17 bp, Homo sapiens
ctggatccatcaggcca

SEQ ID NO: 157493 - DNA, 13 bp, Homo sapiens
ctggatgaaattt

SEQ ID NO: 157494 - DNA, 18 bp, Homo sapiens
ctggatggagcccaggcg

SEQ ID NO: 157495 - DNA, 18 bp, Homo sapiens
ctggcacagttttctgag

SEQ ID NO: 157496 - DNA, 19 bp, Homo sapiens
ctggcacagttttctgaga

SEQ ID NO: 157497 - DNA, 22 bp, Homo sapiens
ctggcacatttccccagacctg

SEQ ID NO: 157498 - DNA, 13 bp, Homo sapiens
ctggcactgctgt

SEQ ID NO: 157499 - DNA, 21 bp, Homo sapiens
ctggcacttggagacttgtat

SEQ ID NO: 157500 - DNA, 21 bp, Homo sapiens
ctggcagaaagcaaatgtgac

SEQ ID NO: 157501 - DNA, 13 bp, Homo sapiens
ctggcccagccaa

SEQ ID NO: 157502 - DNA, 20 bp, Homo sapiens
ctggcccagccaaaccctgt

SEQ ID NO: 157503 - DNA, 17 bp, Homo sapiens
ctggccccatggtcagc

SEQ ID NO: 157504 - DNA, 19 bp, Homo sapiens
ctggccctcacccctgccc

SEQ ID NO: 157505 - DNA, 16 bp, Homo sapiens
ctggccctcagtttcc

SEQ ID NO: 157506 - DNA, 12 bp, Homo sapiens
ctggccctgcct

SEQ ID NO: 157507 - DNA, 21 bp, Homo sapiens
ctggccggagcaaactctgct

SEQ ID NO: 157508 - DNA, 15 bp, Homo sapiens
ctggcctgctgggct

SEQ ID NO: 157509 - DNA, 20 bp, Homo sapiens
ctggcctgctgggctctcca

SEQ ID NO: 157510 - DNA, 20 bp, Homo sapiens
ctggcggctactcagcagcc

SEQ ID NO: 157511 - DNA, 23 bp, Homo sapiens
ctggcggctactcagcagccctc

SEQ ID NO: 157512 - DNA, 13 bp, Homo sapiens
ctggcgtgtgggt

SEQ ID NO: 157513 - DNA, 15 bp, Homo sapiens
ctggctcccacaggc

SEQ ID NO: 157514 - DNA, 18 bp, Homo sapiens
ctggctctgcaatgggca

SEQ ID NO: 157515 - DNA, 19 bp, Homo sapiens
ctggcttgtaactccacca

SEQ ID NO: 157516 - DNA, 20 bp, Homo sapiens
ctggcttgtaactccaccaa

SEQ ID NO: 157517 - DNA, 17 bp, Homo sapiens
ctgggaaaataccccat

SEQ ID NO: 157518 - DNA, 17 bp, Homo sapiens
ctgggaaataagagaga

SEQ ID NO: 157519 - DNA, 16 bp, Homo sapiens
ctgggaaatattccct

SEQ ID NO: 157520 - DNA, 19 bp, Homo sapiens
ctgggaagacgcctgagct

SEQ ID NO: 157521 - DNA, 14 bp, Homo sapiens
ctgggaccctttcc

SEQ ID NO: 157522 - DNA, 15 bp, Homo sapiens
ctgggaccctttcct

SEQ ID NO: 157523 - DNA, 20 bp, Homo sapiens
ctgggaccctttccttcctt

SEQ ID NO: 157524 - DNA, 15 bp, Homo sapiens
ctgggagctctgcag

SEQ ID NO: 157525 - DNA, 19 bp, Homo sapiens
ctgggaggaatggacagac

SEQ ID NO: 157526 - DNA, 11 bp, Homo sapiens
ctgggagggca

SEQ ID NO: 157527 - DNA, 13 bp, Homo sapiens
ctgggagggcagc

SEQ ID NO: 157528 - DNA, 13 bp, Homo sapiens
ctgggagggccca

SEQ ID NO: 157529 - DNA, 19 bp, Homo sapiens
ctgggaggtcaaggctgca

SEQ ID NO: 157530 - DNA, 17 bp, Homo sapiens
ctgggatcctaagggct

SEQ ID NO: 157531 - DNA, 17 bp, Homo sapiens
ctgggatgagccgctgt

SEQ ID NO: 157532 - DNA, 22 bp, Homo sapiens
ctgggatgagccgctgtgagcc

SEQ ID NO: 157533 - DNA, 21 bp, Homo sapiens
ctgggattctactttaagcac

SEQ ID NO: 157534 - DNA, 21 bp, Homo sapiens
ctgggcagctgttagagtcca

SEQ ID NO: 157535 - DNA, 13 bp, Homo sapiens
ctgggccccacca

SEQ ID NO: 157536 - DNA, 16 bp, Homo sapiens
ctgggccccaccacct

SEQ ID NO: 157537 - DNA, 15 bp, Homo sapiens
ctgggccctctctgc

SEQ ID NO: 157538 - DNA, 17 bp, Homo sapiens
ctgggctctccacctca

SEQ ID NO: 157539 - DNA, 19 bp, Homo sapiens
ctgggctctccacctcagc

SEQ ID NO: 157540 - DNA, 21 bp, Homo sapiens
ctgggctctccacctcagcct

SEQ ID NO: 157541 - DNA, 18 bp, Homo sapiens
ctgggctgagggagcctg

SEQ ID NO: 157542 - DNA, 23 bp, Homo sapiens
ctgggctgagggagcctggcccc

SEQ ID NO: 157543 - DNA, 20 bp, Homo sapiens
ctgggcttggggcttcctaa

SEQ ID NO: 157544 - DNA, 16 bp, Homo sapiens
ctggggatgtgggagg

SEQ ID NO: 157545 - DNA, 19 bp, Homo sapiens
ctggggcctcggagcctca

SEQ ID NO: 157546 - DNA, 23 bp, Homo sapiens
ctggggcctcggagcctcatccg

SEQ ID NO: 157547 - DNA, 14 bp, Homo sapiens
ctggggctctggga

SEQ ID NO: 157548 - DNA, 15 bp, Homo sapiens
ctggggctctgggat

SEQ ID NO: 157549 - DNA, 16 bp, Homo sapiens
ctgggggaagccctgg

SEQ ID NO: 157550 - DNA, 22 bp, Homo sapiens
ctgggggggattgtaaaatggt

SEQ ID NO: 157551 - DNA, 15 bp, Homo sapiens
ctgggggtgccagga

SEQ ID NO: 157552 - DNA, 19 bp, Homo sapiens
ctgggggtgccaggaccag

SEQ ID NO: 157553 - DNA, 19 bp, Homo sapiens
ctggggtcctggggcctcg

SEQ ID NO: 157554 - DNA, 16 bp, Homo sapiens
ctggggtgtgggaggc

SEQ ID NO: 157555 - DNA, 22 bp, Homo sapiens
ctgggtaactagggaagataat

SEQ ID NO: 157556 - DNA, 22 bp, Homo sapiens
ctgggtggcaccagcagcctgg

SEQ ID NO: 157557 - DNA, 13 bp, Homo sapiens
ctgggtggggctg

SEQ ID NO: 157558 - DNA, 21 bp, Homo sapiens
ctgggtggtctgcaggcaggg

SEQ ID NO: 157559 - DNA, 15 bp, Homo sapiens
ctggtaatattgact

SEQ ID NO: 157560 - DNA, 18 bp, Homo sapiens
ctggtcacaggactctgc

SEQ ID NO: 157561 - DNA, 19 bp, Homo sapiens
ctggtcacaggactctgcc

SEQ ID NO: 157562 - DNA, 21 bp, Homo sapiens
ctggtcctgagggtccccacc

SEQ ID NO: 157563 - DNA, 21 bp, Homo sapiens
ctggtctcaaactcctgggct

SEQ ID NO: 157564 - DNA, 14 bp, Homo sapiens
ctggtgacaccagc

SEQ ID NO: 157565 - DNA, 21 bp, Homo sapiens
ctggtgcctcaccccttgcca

SEQ ID NO: 157566 - DNA, 13 bp, Homo sapiens
ctggtgctgccac

SEQ ID NO: 157567 - DNA, 14 bp, Homo sapiens
ctggtggcctctgc

SEQ ID NO: 157568 - DNA, 24 bp, Homo sapiens
ctggtgggatctgtgcccagagat

SEQ ID NO: 157569 - DNA, 12 bp, Homo sapiens
ctggtgggcctc

SEQ ID NO: 157570 - DNA, 18 bp, Homo sapiens
ctggttccggaatcctgt

SEQ ID NO: 157571 - DNA, 21 bp, Homo sapiens
ctggttggtgttgcagaaggt

SEQ ID NO: 157572 - DNA, 19 bp, Homo sapiens
ctgtaaactcaaaacttaa

SEQ ID NO: 157573 - DNA, 22 bp, Homo sapiens
ctgtaaactcaaaacttaacat

SEQ ID NO: 157574 - DNA, 15 bp, Homo sapiens
ctgtaacctcttcag

SEQ ID NO: 157575 - DNA, 19 bp, Homo sapiens
ctgtaacctcttcagaggc

SEQ ID NO: 157576 - DNA, 23 bp, Homo sapiens
ctgtaacctcttcagaggccctc

SEQ ID NO: 157577 - DNA, 20 bp, Homo sapiens
ctgtaatcccagcactttgg

SEQ ID NO: 157578 - DNA, 17 bp, Homo sapiens
ctgtacaaatataagaa

SEQ ID NO: 157579 - DNA, 19 bp, Homo sapiens
ctgtactcctcccaggcgc

SEQ ID NO: 157580 - DNA, 13 bp, Homo sapiens
ctgtagagtggga

SEQ ID NO: 157581 - DNA, 18 bp, Homo sapiens
ctgtagtagccctttctg

SEQ ID NO: 157582 - DNA, 18 bp, Homo sapiens
ctgtagtcccagctactc

SEQ ID NO: 157583 - DNA, 22 bp, Homo sapiens
ctgtagtcccagctactcagga

SEQ ID NO: 157584 - DNA, 14 bp, Homo sapiens
ctgtagtctcagga

SEQ ID NO: 157585 - DNA, 15 bp, Homo sapiens
ctgtagtctcaggac

SEQ ID NO: 157586 - DNA, 21 bp, Homo sapiens
ctgtataagtaagaaaatatt

SEQ ID NO: 157587 - DNA, 15 bp, Homo sapiens
ctgtatagtactggc

SEQ ID NO: 157588 - DNA, 16 bp, Homo sapiens
ctgtatagttaggata

SEQ ID NO: 157589 - DNA, 21 bp, Homo sapiens
ctgtatagttaggatagcatt

SEQ ID NO: 157590 - DNA, 18 bp, Homo sapiens
ctgtatatacaataacat

SEQ ID NO: 157591 - DNA, 17 bp, Homo sapiens
ctgtattagtcacagag

SEQ ID NO: 157592 - DNA, 20 bp, Homo sapiens
ctgtattttgtattgtttca

SEQ ID NO: 157593 - DNA, 22 bp, Homo sapiens
ctgtcaaacaaagccagaagct

SEQ ID NO: 157594 - DNA, 14 bp, Homo sapiens
ctgtcaccaagctc

SEQ ID NO: 157595 - DNA, 14 bp, Homo sapiens
ctgtcaccctccac

SEQ ID NO: 157596 - DNA, 16 bp, Homo sapiens
ctgtccaggcactgag

SEQ ID NO: 157597 - DNA, 20 bp, Homo sapiens
ctgtccaggcactgctgccc

SEQ ID NO: 157598 - DNA, 22 bp, Homo sapiens
ctgtccaggcactgctgcccag

SEQ ID NO: 157599 - DNA, 18 bp, Homo sapiens
ctgtccagggccctgagc

SEQ ID NO: 157600 - DNA, 18 bp, Homo sapiens
ctgtcccatggacactcc

SEQ ID NO: 157601 - DNA, 17 bp, Homo sapiens
ctgtccctaggtcagct

SEQ ID NO: 157602 - DNA, 13 bp, Homo sapiens
ctgtccctcacag

SEQ ID NO: 157603 - DNA, 20 bp, Homo sapiens
gaacccttggcttgcccacg

SEQ ID NO: 157604 - DNA, 15 bp, Homo sapiens
gaaccgcaggaagct

SEQ ID NO: 157605 - DNA, 16 bp, Homo sapiens
gaaccgcaggaagctg

SEQ ID NO: 157606 - DNA, 12 bp, Homo sapiens
gaacctgtcctt

SEQ ID NO: 157607 - DNA, 15 bp, Homo sapiens
gaacggggagaaaag

SEQ ID NO: 157608 - DNA, 16 bp, Homo sapiens
gaacgtggctctgctg

SEQ ID NO: 157609 - DNA, 17 bp, Homo sapiens
gaacgtggctctgctgg

SEQ ID NO: 157610 - DNA, 15 bp, Homo sapiens
gaactaataaaagca

SEQ ID NO: 157611 - DNA, 22 bp, Homo sapiens
gaactagccaccaactcttgca

SEQ ID NO: 157612 - DNA, 13 bp, Homo sapiens
gaactcattcctg

SEQ ID NO: 157613 - DNA, 22 bp, Homo sapiens
gaactcattcctgcctgtctcc

SEQ ID NO: 157614 - DNA, 14 bp, Homo sapiens
gaactcctgggctc

SEQ ID NO: 157615 - DNA, 20 bp, Homo sapiens
gaactcctgggctcaagcag

SEQ ID NO: 157616 - DNA, 22 bp, Homo sapiens
gaactgctagtcaagtgcgtcc

SEQ ID NO: 157617 - DNA, 23 bp, Homo sapiens
gaactggactcaggatgcccagg

SEQ ID NO: 157618 - DNA, 18 bp, Homo sapiens
gaactgtccagagagcaa

SEQ ID NO: 157619 - DNA, 22 bp, Homo sapiens
gaactgtccagagagcaactct

SEQ ID NO: 157620 - DNA, 17 bp, Homo sapiens
gaactgtgcctttgagt

SEQ ID NO: 157621 - DNA, 14 bp, Homo sapiens
gaagaatgaacaaa

SEQ ID NO: 157622 - DNA, 20 bp, Homo sapiens
gaagaattttcagaccccag

SEQ ID NO: 157623 - DNA, 21 bp, Homo sapiens
gaagaattttcagaccccagc

SEQ ID NO: 157624 - DNA, 16 bp, Homo sapiens
gaagacgcctgagctc

SEQ ID NO: 157625 - DNA, 13 bp, Homo sapiens
gaagactctacca

SEQ ID NO: 157626 - DNA, 15 bp, Homo sapiens
gaagactctaccaga

SEQ ID NO: 157627 - DNA, 23 bp, Homo sapiens
gaagactctaccagactgtgtat

SEQ ID NO: 157628 - DNA, 19 bp, Homo sapiens
gaagagaggagaggagaga

SEQ ID NO: 157629 - DNA, 21 bp, Homo sapiens
gaagagaggagaggagagagg

SEQ ID NO: 157630 - DNA, 15 bp, Homo sapiens
gaagagatttttcat

SEQ ID NO: 157631 - DNA, 18 bp, Homo sapiens
gaagagcctgcaggtgct

SEQ ID NO: 157632 - DNA, 14 bp, Homo sapiens
gaagaggaaaatga

SEQ ID NO: 157633 - DNA, 18 bp, Homo sapiens
gaagaggaaaatgaataa

SEQ ID NO: 157634 - DNA, 19 bp, Homo sapiens
gaagagggataaggtacct

SEQ ID NO: 157635 - DNA, 20 bp, Homo sapiens
gaagataatattaaggaaga

SEQ ID NO: 157636 - DNA, 17 bp, Homo sapiens
gaagatgtagaggagaa

SEQ ID NO: 157637 - DNA, 23 bp, Homo sapiens
gaagcaacccaaatgttcatcaa

SEQ ID NO: 157638 - DNA, 16 bp, Homo sapiens
gaagcaacgaagggaa

SEQ ID NO: 157639 - DNA, 21 bp, Homo sapiens
gaagcagatgcaaagaggcaa

SEQ ID NO: 157640 - DNA, 15 bp, Homo sapiens
gaagcagtgagccgc

SEQ ID NO: 157641 - DNA, 17 bp, Homo sapiens
gaagcatgtaggagaat

SEQ ID NO: 157642 - DNA, 14 bp, Homo sapiens
gaagccctccttcc

SEQ ID NO: 157643 - DNA, 19 bp, Homo sapiens
gaagccctccttccacgga

SEQ ID NO: 157644 - DNA, 11 bp, Homo sapiens
gaagccctgga

SEQ ID NO: 157645 - DNA, 18 bp, Homo sapiens
gaagccctggatttcaga

SEQ ID NO: 157646 - DNA, 19 bp, Homo sapiens
gaagccctggatttcagaa

SEQ ID NO: 157647 - DNA, 21 bp, Homo sapiens
gaagccctggatttcagaaag

SEQ ID NO: 157648 - DNA, 16 bp, Homo sapiens
gaagccgtgccctgcc

SEQ ID NO: 157649 - DNA, 19 bp, Homo sapiens
gaagccgtgccctgccccc

SEQ ID NO: 157650 - DNA, 14 bp, Homo sapiens
gaagcggctggcag

SEQ ID NO: 157651 - DNA, 13 bp, Homo sapiens
gaagctccactgt

SEQ ID NO: 157652 - DNA, 14 bp, Homo sapiens
gaagctccactgtc

SEQ ID NO: 157653 - DNA, 19 bp, Homo sapiens
gaagctccactgtcaccct

SEQ ID NO: 157654 - DNA, 17 bp, Homo sapiens
gaagctgagcaccaggg

SEQ ID NO: 157655 - DNA, 19 bp, Homo sapiens
gaagctgagcaccagggga

SEQ ID NO: 157656 - DNA, 13 bp, Homo sapiens
gaagctgctccgt

SEQ ID NO: 157657 - DNA, 20 bp, Homo sapiens
gaagctgtgtccttgcacct

SEQ ID NO: 157658 - DNA, 23 bp, Homo sapiens
gaagctgtgtccttgcacctgca

SEQ ID NO: 157659 - DNA, 15 bp, Homo sapiens
gaagcttcagaagtt

SEQ ID NO: 157660 - DNA, 13 bp, Homo sapiens
gaagcttccagtc

SEQ ID NO: 157661 - DNA, 22 bp, Homo sapiens
gaaggaataaattgctccttga

SEQ ID NO: 157662 - DNA, 20 bp, Homo sapiens
gaaggaatatatggcagagt

SEQ ID NO: 157663 - DNA, 16 bp, Homo sapiens
gaaggacaaggctaga

SEQ ID NO: 157664 - DNA, 15 bp, Homo sapiens
gaaggagacagagct

SEQ ID NO: 157665 - DNA, 21 bp, Homo sapiens
gaaggagagaaagtgggtgag

SEQ ID NO: 157666 - DNA, 21 bp, Homo sapiens
gaagggtccttccctctcccc

SEQ ID NO: 157667 - DNA, 22 bp, Homo sapiens
gaaggtgccccaaaatgcaaga

SEQ ID NO: 157668 - DNA, 20 bp, Homo sapiens
gaaggtttacaatttacaaa

SEQ ID NO: 157669 - DNA, 19 bp, Homo sapiens
gaagtagtttgtataactt

SEQ ID NO: 157670 - DNA, 23 bp, Homo sapiens
gaagtccccaggccccaggaagc

SEQ ID NO: 157671 - DNA, 20 bp, Homo sapiens
gaagtctaggagctgggagg

SEQ ID NO: 157672 - DNA, 18 bp, Homo sapiens
gaagtgcaaatttgatac

SEQ ID NO: 157673 - DNA, 19 bp, Homo sapiens
gaagtgggccaggacaggc

SEQ ID NO: 157674 - DNA, 21 bp, Homo sapiens
gaagttgttactaactaaact

SEQ ID NO: 157675 - DNA, 22 bp, Homo sapiens
gaagttgttactaactaaactc

SEQ ID NO: 157676 - DNA, 16 bp, Homo sapiens
gaagtttacattgtaa

SEQ ID NO: 157677 - DNA, 14 bp, Homo sapiens
gaagtttcacatga

SEQ ID NO: 157678 - DNA, 23 bp, Homo sapiens
gaagttttcaatgatgggcgagc

SEQ ID NO: 157679 - DNA, 17 bp, Homo sapiens
gaataaagcctgctttt

SEQ ID NO: 157680 - DNA, 20 bp, Homo sapiens
gaataaagttctgagtgttt

SEQ ID NO: 157681 - DNA, 21 bp, Homo sapiens
gaataactctgtggcattatt

SEQ ID NO: 157682 - DNA, 17 bp, Homo sapiens
gaataatacagtatctc

SEQ ID NO: 157683 - DNA, 14 bp, Homo sapiens
gaataatgaatgga

SEQ ID NO: 157684 - DNA, 21 bp, Homo sapiens
gaatacagaggcaactgcatt

SEQ ID NO: 157685 - DNA, 19 bp, Homo sapiens
gaatacttttgccctttga

SEQ ID NO: 157686 - DNA, 15 bp, Homo sapiens
gaatatatggcagag

SEQ ID NO: 157687 - DNA, 23 bp, Homo sapiens
gaatatatggcagagttgtaaat

SEQ ID NO: 157688 - DNA, 17 bp, Homo sapiens
gaatatcccctcccagt

SEQ ID NO: 157689 - DNA, 14 bp, Homo sapiens
gaatatgacagctg

SEQ ID NO: 157690 - DNA, 10 bp, Homo sapiens
gaatatttat

SEQ ID NO: 157691 - DNA, 18 bp, Homo sapiens
gaatattttaagtattgc

SEQ ID NO: 157692 - DNA, 13 bp, Homo sapiens
gaatcagaaacag

SEQ ID NO: 157693 - DNA, 16 bp, Homo sapiens
gaatccccgaaggtgc

SEQ ID NO: 157694 - DNA, 22 bp, Homo sapiens
gaatctttattgagaaagagca

SEQ ID NO: 157695 - DNA, 13 bp, Homo sapiens
gaatgaacaaatt

SEQ ID NO: 157696 - DNA, 20 bp, Homo sapiens
gaatgaggaggaaggagaga

SEQ ID NO: 157697 - DNA, 15 bp, Homo sapiens
gaatgattcagtgtt

SEQ ID NO: 157698 - DNA, 23 bp, Homo sapiens
gaatgattctaatttttaagcaa

SEQ ID NO: 157699 - DNA, 20 bp, Homo sapiens
gaatgatttccaaagagaaa

SEQ ID NO: 157700 - DNA, 14 bp, Homo sapiens
gaatgcataaaatg

SEQ ID NO: 157701 - DNA, 14 bp, Homo sapiens
gaatgccgtggatt

SEQ ID NO: 157702 - DNA, 18 bp, Homo sapiens
gaatgtaatcaatgtttc

SEQ ID NO: 157703 - DNA, 21 bp, Homo sapiens
gaatgtatatgttttgtggga

SEQ ID NO: 157704 - DNA, 16 bp, Homo sapiens
gaatgttaaagtcagt

SEQ ID NO: 157705 - DNA, 20 bp, Homo sapiens
gaatgtttacactctttgta

SEQ ID NO: 157706 - DNA, 14 bp, Homo sapiens
gaattaacacatga

SEQ ID NO: 157707 - DNA, 19 bp, Homo sapiens
gaattaatgacagagccag

SEQ ID NO: 157708 - DNA, 16 bp, Homo sapiens
gaattcagattttaaa

SEQ ID NO: 157709 - DNA, 18 bp, Homo sapiens
gaattctgctacctcact

SEQ ID NO: 157710 - DNA, 18 bp, Homo sapiens
gaattgaacccaggaggt

SEQ ID NO: 157711 - DNA, 14 bp, Homo sapiens
gaattgaagcagga

SEQ ID NO: 157712 - DNA, 23 bp, Homo sapiens
gaattgtccccagtttgcagaaa

SEQ ID NO: 157713 - DNA, 16 bp, Homo sapiens
gaattgtgctcaaaat

SEQ ID NO: 157714 - DNA, 13 bp, Homo sapiens
gaatttgctgggg

SEQ ID NO: 157715 - DNA, 20 bp, Homo sapiens
gacaaaaacagcctcacaga

SEQ ID NO: 157716 - DNA, 23 bp, Homo sapiens
gacaaagcttggaagagcctgca

SEQ ID NO: 157717 - DNA, 17 bp, Homo sapiens
gacaaaggacatttgtt

SEQ ID NO: 157718 - DNA, 17 bp, Homo sapiens
gacaaatcaagcttcag

SEQ ID NO: 157719 - DNA, 21 bp, Homo sapiens
gacaaatgctgcgcccttccc

SEQ ID NO: 157720 - DNA, 22 bp, Homo sapiens
gacaaatgtgtatcggatgctt

SEQ ID NO: 157721 - DNA, 15 bp, Homo sapiens
gacaaccactggtct

SEQ ID NO: 157722 - DNA, 12 bp, Homo sapiens
gacaaccatgac

SEQ ID NO: 157723 - DNA, 21 bp, Homo sapiens
gacaaggtagccctggccaga

SEQ ID NO: 157724 - DNA, 13 bp, Homo sapiens
gacacaactattt

SEQ ID NO: 157725 - DNA, 16 bp, Homo sapiens
gacaccacacccagcc

SEQ ID NO: 157726 - DNA, 17 bp, Homo sapiens
gacaccacacccagcct

SEQ ID NO: 157727 - DNA, 17 bp, Homo sapiens
gattagggagagaagat

SEQ ID NO: 157728 - DNA, 19 bp, Homo sapiens
gattatgtagcaaaataca

SEQ ID NO: 157729 - DNA, 13 bp, Homo sapiens
gattattcattta

SEQ ID NO: 157730 - DNA, 14 bp, Homo sapiens
gattattcatttaa

SEQ ID NO: 157731 - DNA, 22 bp, Homo sapiens
gattcacaatgaaatgctctcc

SEQ ID NO: 157732 - DNA, 14 bp, Homo sapiens
gattcacctgagca

SEQ ID NO: 157733 - DNA, 13 bp, Homo sapiens
gattcagctctgc

SEQ ID NO: 157734 - DNA, 20 bp, Homo sapiens
gattcagtgttaaatgtgat

SEQ ID NO: 157735 - DNA, 22 bp, Homo sapiens
gattccagagagtggctcctcc

SEQ ID NO: 157736 - DNA, 13 bp, Homo sapiens
gattcccagagac

SEQ ID NO: 157737 - DNA, 14 bp, Homo sapiens
gattcccagagaca

SEQ ID NO: 157738 - DNA, 21 bp, Homo sapiens
gattcccagagacaggaaaat

SEQ ID NO: 157739 - DNA, 17 bp, Homo sapiens
gattccccattgcctcc

SEQ ID NO: 157740 - DNA, 21 bp, Homo sapiens
gattcccctaacctcattccc

SEQ ID NO: 157741 - DNA, 16 bp, Homo sapiens
gattctcctgtgctag

SEQ ID NO: 157742 - DNA, 22 bp, Homo sapiens
gattctgtgtgttttcataata

SEQ ID NO: 157743 - DNA, 20 bp, Homo sapiens
gattctttcccaattcacat

SEQ ID NO: 157744 - DNA, 13 bp, Homo sapiens
ctgtccctcccac

SEQ ID NO: 157745 - DNA, 16 bp, Homo sapiens
ctgtccctcccacctc

SEQ ID NO: 157746 - DNA, 17 bp, Homo sapiens
ctgtccctcccacctct

SEQ ID NO: 157747 - DNA, 18 bp, Homo sapiens
ctgtcccttctgtccctc

SEQ ID NO: 157748 - DNA, 15 bp, Homo sapiens
ctgtcccttgcctca

SEQ ID NO: 157749 - DNA, 16 bp, Homo sapiens
ctgtcccttgcctcaa

SEQ ID NO: 157750 - DNA, 20 bp, Homo sapiens
ctgtcccttgcctcaatgcc

SEQ ID NO: 157751 - DNA, 21 bp, Homo sapiens
ctgtcccttgcctcaatgcca

SEQ ID NO: 157752 - DNA, 18 bp, Homo sapiens
ctgtccgtttactccaag

SEQ ID NO: 157753 - DNA, 21 bp, Homo sapiens
ctgtcctcccatcccctggac

SEQ ID NO: 157754 - DNA, 16 bp, Homo sapiens
ctgtctaacctgtgac

SEQ ID NO: 157755 - DNA, 18 bp, Homo sapiens
ctgtctcaagagggcact

SEQ ID NO: 157756 - DNA, 20 bp, Homo sapiens
ctgtctcaagagggcactgg

SEQ ID NO: 157757 - DNA, 22 bp, Homo sapiens
ctgtctcaagagggcactggtg

SEQ ID NO: 157758 - DNA, 15 bp, Homo sapiens
ctgtctcagcctccc

SEQ ID NO: 157759 - DNA, 15 bp, Homo sapiens
ctgtctcatccatca

SEQ ID NO: 157760 - DNA, 21 bp, Homo sapiens
ctgtctcatccatcatcatgt

SEQ ID NO: 157761 - DNA, 18 bp, Homo sapiens
ctgtctctactaaaaata

SEQ ID NO: 157762 - DNA, 12 bp, Homo sapiens
ctgtctcttcca

SEQ ID NO: 157763 - DNA, 20 bp, Homo sapiens
ctgtctgacaacctcttggt

SEQ ID NO: 157764 - DNA, 20 bp, Homo sapiens
ctgtctgccagccagcagcc

SEQ ID NO: 157765 - DNA, 14 bp, Homo sapiens
ctgtctgtacctaa

SEQ ID NO: 157766 - DNA, 16 bp, Homo sapiens
ctgtgaaatgctggca

SEQ ID NO: 157767 - DNA, 18 bp, Homo sapiens
ctgtgaagtttacattgt

SEQ ID NO: 157768 - DNA, 23 bp, Homo sapiens
ctgtgaagtttacattgtaaata

SEQ ID NO: 157769 - DNA, 15 bp, Homo sapiens
ctgtgaccaatgtct

SEQ ID NO: 157770 - DNA, 14 bp, Homo sapiens
ctgtgactcttttt

SEQ ID NO: 157771 - DNA, 16 bp, Homo sapiens
ctgtgacttctccagg

SEQ ID NO: 157772 - DNA, 15 bp, Homo sapiens
ctgtgagcccctggt

SEQ ID NO: 157773 - DNA, 17 bp, Homo sapiens
ctgtgagccttggctgt

SEQ ID NO: 157774 - DNA, 13 bp, Homo sapiens
ctgtgaggcaggg

SEQ ID NO: 157775 - DNA, 15 bp, Homo sapiens
ctgtgaggcccctgg

SEQ ID NO: 157776 - DNA, 16 bp, Homo sapiens
ctgtgaggctgtcctg

SEQ ID NO: 157777 - DNA, 19 bp, Homo sapiens
ctgtgcacatctgtgtctt

SEQ ID NO: 157778 - DNA, 21 bp, Homo sapiens
ctgtgcacatctgtgtcttgt

SEQ ID NO: 157779 - DNA, 14 bp, Homo sapiens
ctgtgcaccaagca

SEQ ID NO: 157780 - DNA, 23 bp, Homo sapiens
ctgtgcagtggcccccacagaaa

SEQ ID NO: 157781 - DNA, 14 bp, Homo sapiens
ctgtgcccaagttg

SEQ ID NO: 157782 - DNA, 12 bp, Homo sapiens
ctgtgcctctgc

SEQ ID NO: 157783 - DNA, 15 bp, Homo sapiens
ctgtgcctctgcctg

SEQ ID NO: 157784 - DNA, 21 bp, Homo sapiens
ctgtgcctttgagtttcctca

SEQ ID NO: 157785 - DNA, 16 bp, Homo sapiens
ctgtgctcaggactca

SEQ ID NO: 157786 - DNA, 19 bp, Homo sapiens
ctgtgctcaggactcagaa

SEQ ID NO: 157787 - DNA, 18 bp, Homo sapiens
ctgtgcttcaattaataa

SEQ ID NO: 157788 - DNA, 19 bp, Homo sapiens
ctgtgcttcgggcccttcc

SEQ ID NO: 157789 - DNA, 19 bp, Homo sapiens
ctgtggatgagccctcaga

SEQ ID NO: 157790 - DNA, 13 bp, Homo sapiens
ctgtggccaaagg

SEQ ID NO: 157791 - DNA, 22 bp, Homo sapiens
ctgtgggtgaagacagagggaa

SEQ ID NO: 157792 - DNA, 15 bp, Homo sapiens
ctgtggtgtgtcccc

SEQ ID NO: 157793 - DNA, 21 bp, Homo sapiens
ctgtggttgttttagctcctt

SEQ ID NO: 157794 - DNA, 13 bp, Homo sapiens
ctgtgtagctggg

SEQ ID NO: 157795 - DNA, 20 bp, Homo sapiens
ctgtgtcagcatagaagtaa

SEQ ID NO: 157796 - DNA, 18 bp, Homo sapiens
ctgtgtccttgcacctgc

SEQ ID NO: 157797 - DNA, 15 bp, Homo sapiens
ctgtgtctaaactgc

SEQ ID NO: 157798 - DNA, 21 bp, Homo sapiens
ctgtgtgaaataccagtgtgg

SEQ ID NO: 157799 - DNA, 18 bp, Homo sapiens
ctgtgtgttttcataata

SEQ ID NO: 157800 - DNA, 19 bp, Homo sapiens
ctgtgtgttttcataataa

SEQ ID NO: 157801 - DNA, 20 bp, Homo sapiens
ctgttaaattgctgtgtatc

SEQ ID NO: 157802 - DNA, 13 bp, Homo sapiens
ctgttactgtctt

SEQ ID NO: 157803 - DNA, 13 bp, Homo sapiens
ctgttatccatgg

SEQ ID NO: 157804 - DNA, 17 bp, Homo sapiens
ctgttcaatgtttaatg

SEQ ID NO: 157805 - DNA, 12 bp, Homo sapiens
ctgttcacagcc

SEQ ID NO: 157806 - DNA, 12 bp, Homo sapiens
ctgttcagctgg

SEQ ID NO: 157807 - DNA, 12 bp, Homo sapiens
ctgttccccctg

SEQ ID NO: 157808 - DNA, 15 bp, Homo sapiens
ctgttccccctgtgc

SEQ ID NO: 157809 - DNA, 16 bp, Homo sapiens
ctgttccccctgtgca

SEQ ID NO: 157810 - DNA, 12 bp, Homo sapiens
ctgttgaaaatt

SEQ ID NO: 157811 - DNA, 14 bp, Homo sapiens
ctgttgaaaattat

SEQ ID NO: 157812 - DNA, 22 bp, Homo sapiens
ctgttgaaaattattttaaaca

SEQ ID NO: 157813 - DNA, 20 bp, Homo sapiens
ctgttgacatccaagcttcc

SEQ ID NO: 157814 - DNA, 23 bp, Homo sapiens
ctgttgacatccaagcttccttt

SEQ ID NO: 157815 - DNA, 20 bp, Homo sapiens
ctgttgagctgttttccctg

SEQ ID NO: 157816 - DNA, 17 bp, Homo sapiens
ctgttgttatggaaact

SEQ ID NO: 157817 - DNA, 18 bp, Homo sapiens
ctgtttaatatttaaaca

SEQ ID NO: 157818 - DNA, 21 bp, Homo sapiens
ctgtttaatatttaaacagca

SEQ ID NO: 157819 - DNA, 13 bp, Homo sapiens
ctgtttcctttta

SEQ ID NO: 157820 - DNA, 22 bp, Homo sapiens
ctgttttacaaaaaagaaaaga

SEQ ID NO: 157821 - DNA, 13 bp, Homo sapiens
ctgttttccctga

SEQ ID NO: 157822 - DNA, 17 bp, Homo sapiens
ctgttttctcttgagag

SEQ ID NO: 157823 - DNA, 15 bp, Homo sapiens
ctgtttttaagctgt

SEQ ID NO: 157824 - DNA, 12 bp, Homo sapiens
cttaaaaaactt

SEQ ID NO: 157825 - DNA, 16 bp, Homo sapiens
cttaaaaagtggaaaa

SEQ ID NO: 157826 - DNA, 13 bp, Homo sapiens
cttaaaataactt

SEQ ID NO: 157827 - DNA, 22 bp, Homo sapiens
cttaaaatagcaacactctata

SEQ ID NO: 157828 - DNA, 19 bp, Homo sapiens
cttaaacaaaaattaaaat

SEQ ID NO: 157829 - DNA, 20 bp, Homo sapiens
cttaaaggcaccatctaata

SEQ ID NO: 157830 - DNA, 15 bp, Homo sapiens
cttaacatatttact

SEQ ID NO: 157831 - DNA, 17 bp, Homo sapiens
cttaacatatttactaa

SEQ ID NO: 157832 - DNA, 22 bp, Homo sapiens
cttaacttaaattttaatttat

SEQ ID NO: 157833 - DNA, 18 bp, Homo sapiens
cttaagaattttgagcag

SEQ ID NO: 157834 - DNA, 13 bp, Homo sapiens
cttaagagaatat

SEQ ID NO: 157835 - DNA, 21 bp, Homo sapiens
cttaatgatccgttccattgc

SEQ ID NO: 157836 - DNA, 18 bp, Homo sapiens
cttaatgccactaaattg

SEQ ID NO: 157837 - DNA, 12 bp, Homo sapiens
cttaatgtttat

SEQ ID NO: 157838 - DNA, 14 bp, Homo sapiens
cttaatgtttattc

SEQ ID NO: 157839 - DNA, 15 bp, Homo sapiens
cttaatgtttattcc

SEQ ID NO: 157840 - DNA, 16 bp, Homo sapiens
cttaattaaaagaata

SEQ ID NO: 157841 - DNA, 19 bp, Homo sapiens
cttacaattccctgctgtc

SEQ ID NO: 157842 - DNA, 17 bp, Homo sapiens
cttacatttttacaata

SEQ ID NO: 157843 - DNA, 14 bp, Homo sapiens
cttacctcctgccc

SEQ ID NO: 157844 - DNA, 19 bp, Homo sapiens
cttacctcctgcccaggag

SEQ ID NO: 157845 - DNA, 23 bp, Homo sapiens
cttacgaatacttttgccctttg

SEQ ID NO: 157846 - DNA, 14 bp, Homo sapiens
ccatctctccctcc

SEQ ID NO: 157847 - DNA, 17 bp, Homo sapiens
ccatctgggtccttgca

SEQ ID NO: 157848 - DNA, 18 bp, Homo sapiens
ccatctgggtccttgcac

SEQ ID NO: 157849 - DNA, 13 bp, Homo sapiens
ccatgaaacaaag

SEQ ID NO: 157850 - DNA, 15 bp, Homo sapiens
ccatgaaccaagacc

SEQ ID NO: 157851 - DNA, 12 bp, Homo sapiens
ccatgaagacag

SEQ ID NO: 157852 - DNA, 15 bp, Homo sapiens
ccatgaagacaggat

SEQ ID NO: 157853 - DNA, 18 bp, Homo sapiens
ccatgaagagatttttca

SEQ ID NO: 157854 - DNA, 18 bp, Homo sapiens
ccatgaggagttgctgtt

SEQ ID NO: 157855 - DNA, 14 bp, Homo sapiens
ccatgatccctgtg

SEQ ID NO: 157856 - DNA, 16 bp, Homo sapiens
ccatgatccctgtgtt

SEQ ID NO: 157857 - DNA, 22 bp, Homo sapiens
ccatgatccctgtgttgtctct

SEQ ID NO: 157858 - DNA, 18 bp, Homo sapiens
ccatgatgtagtgcctct

SEQ ID NO: 157859 - DNA, 13 bp, Homo sapiens
ccatgctcctggc

SEQ ID NO: 157860 - DNA, 14 bp, Homo sapiens
ccatgctgcctcca

SEQ ID NO: 157861 - DNA, 20 bp, Homo sapiens
ccatggaggcacacagctgc

SEQ ID NO: 157862 - DNA, 21 bp, Homo sapiens
ccatgggaaatgtcaacaagt

SEQ ID NO: 157863 - DNA, 17 bp, Homo sapiens
ccatgggcagagcccaa

SEQ ID NO: 157864 - DNA, 15 bp, Homo sapiens
ccatgtagaaaattt

SEQ ID NO: 157865 - DNA, 22 bp, Homo sapiens
ccatgtcaccggatcctgggtg

SEQ ID NO: 157866 - DNA, 17 bp, Homo sapiens
ccatgtcagcaaaaagc

SEQ ID NO: 157867 - DNA, 18 bp, Homo sapiens
ccatgtcagcaaaaagca

SEQ ID NO: 157868 - DNA, 12 bp, Homo sapiens
ccatgtcgcctc

SEQ ID NO: 157869 - DNA, 16 bp, Homo sapiens
ccatgtctctcagaat

SEQ ID NO: 157870 - DNA, 17 bp, Homo sapiens
ccatgtgtgagtgtgtg

SEQ ID NO: 157871 - DNA, 18 bp, Homo sapiens
ccatgtgtgagtgtgtgc

SEQ ID NO: 157872 - DNA, 19 bp, Homo sapiens
ccatgtgtgtgcaagtgtg

SEQ ID NO: 157873 - DNA, 16 bp, Homo sapiens
ccatgtttctctggcc

SEQ ID NO: 157874 - DNA, 13 bp, Homo sapiens
ccatgtttgtaaa

SEQ ID NO: 157875 - DNA, 14 bp, Homo sapiens
ccatgtttgtaaaa

SEQ ID NO: 157876 - DNA, 12 bp, Homo sapiens
ccattcctcagg

SEQ ID NO: 157877 - DNA, 14 bp, Homo sapiens
ccattgccctggtt

SEQ ID NO: 157878 - DNA, 23 bp, Homo sapiens
ccattgcctcctccttcccaaag

SEQ ID NO: 157879 - DNA, 19 bp, Homo sapiens
ccattgtccaatcctatgt

SEQ ID NO: 157880 - DNA, 17 bp, Homo sapiens
ccatttcatctatttct

SEQ ID NO: 157881 - DNA, 14 bp, Homo sapiens
ccatttctatttat

SEQ ID NO: 157882 - DNA, 14 bp, Homo sapiens
ccatttgtgtgtgt

SEQ ID NO: 157883 - DNA, 22 bp, Homo sapiens
cccaaaagtcaaaaggtgcctg

SEQ ID NO: 157884 - DNA, 15 bp, Homo sapiens
cccaaagctttcctg

SEQ ID NO: 157885 - DNA, 17 bp, Homo sapiens
cccaactcctggaagct

SEQ ID NO: 157886 - DNA, 12 bp, Homo sapiens
cccaactctcct

SEQ ID NO: 157887 - DNA, 19 bp, Homo sapiens
cccaagggcaaaattccca

SEQ ID NO: 157888 - DNA, 19 bp, Homo sapiens
cccaagtgggggcagaggg

SEQ ID NO: 157889 - DNA, 11 bp, Homo sapiens
cccaatattat

SEQ ID NO: 157890 - DNA, 13 bp, Homo sapiens
cccacaagaaatg

SEQ ID NO: 157891 - DNA, 13 bp, Homo sapiens
cccacacacccca

SEQ ID NO: 157892 - DNA, 14 bp, Homo sapiens
cccacacaccccaa

SEQ ID NO: 157893 - DNA, 15 bp, Homo sapiens
cccacagctcccacc

SEQ ID NO: 157894 - DNA, 17 bp, Homo sapiens
cccacagctcccacccc

SEQ ID NO: 157895 - DNA, 20 bp, Homo sapiens
cccacaggacatttctctaa

SEQ ID NO: 157896 - DNA, 18 bp, Homo sapiens
cccacaggcccttcctct

SEQ ID NO: 157897 - DNA, 20 bp, Homo sapiens
cccaccacgatgtggccctg

SEQ ID NO: 157898 - DNA, 12 bp, Homo sapiens
cccacccccatc

SEQ ID NO: 157899 - DNA, 15 bp, Homo sapiens
cccacctccccacgc

SEQ ID NO: 157900 - DNA, 17 bp, Homo sapiens
cccacctccccacgccc

SEQ ID NO: 157901 - DNA, 15 bp, Homo sapiens
cccacctctgtgacc

SEQ ID NO: 157902 - DNA, 21 bp, Homo sapiens
cccacctctgtgacctcaggc

SEQ ID NO: 157903 - DNA, 23 bp, Homo sapiens
tatttaaaagaaagcctcagaga

SEQ ID NO: 157904 - DNA, 14 bp, Homo sapiens
tatttaaagacagg

SEQ ID NO: 157905 - DNA, 21 bp, Homo sapiens
tatttaagcctcatatttaaa

SEQ ID NO: 157906 - DNA, 16 bp, Homo sapiens
tatttactgagcttct

SEQ ID NO: 157907 - DNA, 22 bp, Homo sapiens
tatttactgagcttctctgtga

SEQ ID NO: 157908 - DNA, 23 bp, Homo sapiens
tatttactgagcttctctgtgaa

SEQ ID NO: 157909 - DNA, 14 bp, Homo sapiens
tatttataagcaga

SEQ ID NO: 157910 - DNA, 16 bp, Homo sapiens
tatttatatatgtatt

SEQ ID NO: 157911 - DNA, 13 bp, Homo sapiens
tatttatatattt

SEQ ID NO: 157912 - DNA, 18 bp, Homo sapiens
tatttatatatttataac

SEQ ID NO: 157913 - DNA, 20 bp, Homo sapiens
tatttatctgtgcaaatcct

SEQ ID NO: 157914 - DNA, 17 bp, Homo sapiens
tatttatttactgagct

SEQ ID NO: 157915 - DNA, 12 bp, Homo sapiens
tatttcatttct

SEQ ID NO: 157916 - DNA, 21 bp, Homo sapiens
tatttccattccagaatatct

SEQ ID NO: 157917 - DNA, 21 bp, Homo sapiens
tatttctgagaaggtccttaa

SEQ ID NO: 157918 - DNA, 23 bp, Homo sapiens
tatttcttacaggcacaaaatga

SEQ ID NO: 157919 - DNA, 16 bp, Homo sapiens
tatttgcactgtagcc

SEQ ID NO: 157920 - DNA, 17 bp, Homo sapiens
tatttgtgtaatagaaa

SEQ ID NO: 157921 - DNA, 18 bp, Homo sapiens
tatttgttattttcagta

SEQ ID NO: 157922 - DNA, 19 bp, Homo sapiens
tattttcaacgcagccctg

SEQ ID NO: 157923 - DNA, 14 bp, Homo sapiens
tattttcaccattt

SEQ ID NO: 157924 - DNA, 12 bp, Homo sapiens
tattttttaatt

SEQ ID NO: 157925 - DNA, 19 bp, Homo sapiens
tcaaaagaatcagaaacag

SEQ ID NO: 157926 - DNA, 13 bp, Homo sapiens
tcaaaaggtgcct

SEQ ID NO: 157927 - DNA, 13 bp, Homo sapiens
tcaaaataaaaac

SEQ ID NO: 157928 - DNA, 20 bp, Homo sapiens
tcaaaataaaaaccaagaag

SEQ ID NO: 157929 - DNA, 14 bp, Homo sapiens
tcaaaatgtctaag

SEQ ID NO: 157930 - DNA, 17 bp, Homo sapiens
tcaaacaaagccagaag

SEQ ID NO: 157931 - DNA, 21 bp, Homo sapiens
tcaaacaaagccagaagctga

SEQ ID NO: 157932 - DNA, 20 bp, Homo sapiens
tcaaaccccgaccacctgcc

SEQ ID NO: 157933 - DNA, 15 bp, Homo sapiens
tcaaacgtgaaaatg

SEQ ID NO: 157934 - DNA, 14 bp, Homo sapiens
tcaaactcttaaaa

SEQ ID NO: 157935 - DNA, 16 bp, Homo sapiens
tcaaagaaggatggca

SEQ ID NO: 157936 - DNA, 17 bp, Homo sapiens
tcaaagacattctgaca

SEQ ID NO: 157937 - DNA, 23 bp, Homo sapiens
tcaaagaggttttaaaaaaatcc

SEQ ID NO: 157938 - DNA, 16 bp, Homo sapiens
tcaaagcaaggaaact

SEQ ID NO: 157939 - DNA, 12 bp, Homo sapiens
tcaaagccagcg

SEQ ID NO: 157940 - DNA, 19 bp, Homo sapiens
tcaaaggcacagtgaaggc

SEQ ID NO: 157941 - DNA, 19 bp, Homo sapiens
tcaaagtaaaacttgctgc

SEQ ID NO: 157942 - DNA, 14 bp, Homo sapiens
tcaaatatgcaaag

SEQ ID NO: 157943 - DNA, 16 bp, Homo sapiens
tcaaatatgcaaagca

SEQ ID NO: 157944 - DNA, 19 bp, Homo sapiens
tcaaatatgcaaagcactg

SEQ ID NO: 157945 - DNA, 20 bp, Homo sapiens
tcaaatcaagaaacttaagg

SEQ ID NO: 157946 - DNA, 21 bp, Homo sapiens
tcaaatgcttggcttctcata

SEQ ID NO: 157947 - DNA, 12 bp, Homo sapiens
tcaacagagaag

SEQ ID NO: 157948 - DNA, 17 bp, Homo sapiens
tcaacagagaaggcagg

SEQ ID NO: 157949 - DNA, 20 bp, Homo sapiens
tcccctccgccaggcgagat

SEQ ID NO: 157950 - DNA, 14 bp, Homo sapiens
tcccctcctcactc

SEQ ID NO: 157951 - DNA, 14 bp, Homo sapiens
tcccctgccagggc

SEQ ID NO: 157952 - DNA, 23 bp, Homo sapiens
tcccctgccctgctgccgcctcc

SEQ ID NO: 157953 - DNA, 15 bp, Homo sapiens
tcccctgctgcaggg

SEQ ID NO: 157954 - DNA, 18 bp, Homo sapiens
tcccctgctgcaggggct

SEQ ID NO: 157955 - DNA, 21 bp, Homo sapiens
tcccctgctgcaggggctctg

SEQ ID NO: 157956 - DNA, 13 bp, Homo sapiens
tccccttgcccag

SEQ ID NO: 157957 - DNA, 20 bp, Homo sapiens
tccccttgcccagggctcag

SEQ ID NO: 157958 - DNA, 14 bp, Homo sapiens
tcccgctcagccct

SEQ ID NO: 157959 - DNA, 20 bp, Homo sapiens
tcccgctcagccctccctgc

SEQ ID NO: 157960 - DNA, 15 bp, Homo sapiens
tccctaagccaaggg

SEQ ID NO: 157961 - DNA, 20 bp, Homo sapiens
tccctaagccaagggcctct

SEQ ID NO: 157962 - DNA, 24 bp, Homo sapiens
tccctacatgtattgcacattgta

SEQ ID NO: 157963 - DNA, 18 bp, Homo sapiens
tccctagtcttcaagcag

SEQ ID NO: 157964 - DNA, 23 bp, Homo sapiens
tccctcattccaccttcccatgc

SEQ ID NO: 157965 - DNA, 19 bp, Homo sapiens
tccctccacgttcacccct

SEQ ID NO: 157966 - DNA, 23 bp, Homo sapiens
tccctccactccttcctgccacc

SEQ ID NO: 157967 - DNA, 13 bp, Homo sapiens
tccctcccacctc

SEQ ID NO: 157968 - DNA, 15 bp, Homo sapiens
tccctccctttgaaa

SEQ ID NO: 157969 - DNA, 12 bp, Homo sapiens
tccctctccctg

SEQ ID NO: 157970 - DNA, 14 bp, Homo sapiens
tccctctcctgcct

SEQ ID NO: 157971 - DNA, 12 bp, Homo sapiens
tccctctctctg

SEQ ID NO: 157972 - DNA, 11 bp, Homo sapiens
tccctctgcct

SEQ ID NO: 157973 - DNA, 21 bp, Homo sapiens
tccctctgcctgaaccttcca

SEQ ID NO: 157974 - DNA, 20 bp, Homo sapiens
tccctgaaaacccagagagg

SEQ ID NO: 157975 - DNA, 14 bp, Homo sapiens
tccctgagtcacca

SEQ ID NO: 157976 - DNA, 16 bp, Homo sapiens
tccctgagtcaccagg

SEQ ID NO: 157977 - DNA, 20 bp, Homo sapiens
tccctgcccctcccttcaac

SEQ ID NO: 157978 - DNA, 21 bp, Homo sapiens
tccctgggggaagccctggat

SEQ ID NO: 157979 - DNA, 18 bp, Homo sapiens
tccctgtaacctcttcag

SEQ ID NO: 157980 - DNA, 19 bp, Homo sapiens
tccctgtaacctcttcaga

SEQ ID NO: 157981 - DNA, 23 bp, Homo sapiens
tccctgtaacctcttcagaggcc

SEQ ID NO: 157982 - DNA, 14 bp, Homo sapiens
tccctgttgaagct

SEQ ID NO: 157983 - DNA, 15 bp, Homo sapiens
tccctgtttaatatt

SEQ ID NO: 157984 - DNA, 18 bp, Homo sapiens
tccctgtttaatatttaa

SEQ ID NO: 157985 - DNA, 11 bp, Homo sapiens
tcccttcaacc

SEQ ID NO: 157986 - DNA, 16 bp, Homo sapiens
tcccttcccataagct

SEQ ID NO: 157987 - DNA, 20 bp, Homo sapiens
tcccttgcctcaatgccagt

SEQ ID NO: 157988 - DNA, 22 bp, Homo sapiens
tccgtaacccaactctcctgga

SEQ ID NO: 157989 - DNA, 14 bp, Homo sapiens
tccgtagttccctg

SEQ ID NO: 157990 - DNA, 14 bp, Homo sapiens
tccgtatttcagac

SEQ ID NO: 157991 - DNA, 15 bp, Homo sapiens
tccgtatttcagact

SEQ ID NO: 157992 - DNA, 16 bp, Homo sapiens
tcctagaaattcccca

SEQ ID NO: 157993 - DNA, 21 bp, Homo sapiens
tcctagaaattccccaccctg

SEQ ID NO: 157994 - DNA, 21 bp, Homo sapiens
tcctagcctgtgcctctggga

SEQ ID NO: 157995 - DNA, 18 bp, Homo sapiens
tcctaggagtatcctcat

SEQ ID NO: 157996 - DNA, 23 bp, Homo sapiens
tcctagtgaaagaggcagcttga

SEQ ID NO: 157997 - DNA, 15 bp, Homo sapiens
tcctatatagtttat

SEQ ID NO: 157998 - DNA, 18 bp, Homo sapiens
tcctatatagtttattga

SEQ ID NO: 157999 - DNA, 17 bp, Homo sapiens
tcctatcagaagtttct

SEQ ID NO: 158000 - DNA, 22 bp, Homo sapiens
tcctatcagcctgtctcttcca

SEQ ID NO: 158001 - DNA, 12 bp, Homo sapiens
tcctatgtgtaa

SEQ ID NO: 158002 - DNA, 19 bp, Homo sapiens
tcctatgtttttgttcaaa

SEQ ID NO: 158003 - DNA, 14 bp, Homo sapiens
tcctcaatccagct

SEQ ID NO: 158004 - DNA, 19 bp, Homo sapiens
tcctcacccctgtcctcac

SEQ ID NO: 158005 - DNA, 13 bp, Homo sapiens
tcctcactgctcc

SEQ ID NO: 158006 - DNA, 21 bp, Homo sapiens
tcctcactgctccctgaagcc

SEQ ID NO: 158007 - DNA, 17 bp, Homo sapiens
tcctcactggccatccc

SEQ ID NO: 158008 - DNA, 19 bp, Homo sapiens
tcctcaggctgctggagga

SEQ ID NO: 158009 - DNA, 21 bp, Homo sapiens
tcctcatttggggtagctaga

SEQ ID NO: 158010 - DNA, 23 bp, Homo sapiens
tcctccaaaggaagtctaggagc

SEQ ID NO: 158011 - DNA, 21 bp, Homo sapiens
tcctccacgttctgctcatca

SEQ ID NO: 158012 - DNA, 22 bp, Homo sapiens
tcctccacgttctgctcatcat

SEQ ID NO: 158013 - DNA, 23 bp, Homo sapiens
tcctccacgttctgctcatcatt

SEQ ID NO: 158014 - DNA, 21 bp, Homo sapiens
tcctccagggatgatcaacag

SEQ ID NO: 158015 - DNA, 13 bp, Homo sapiens
tcctccagggcca

SEQ ID NO: 158016 - DNA, 23 bp, Homo sapiens
tcctccagggccacgtgccaggc

SEQ ID NO: 158017 - DNA, 12 bp, Homo sapiens
tcctccatggga

SEQ ID NO: 158018 - DNA, 13 bp, Homo sapiens
tcctcccaggcgc

SEQ ID NO: 158019 - DNA, 18 bp, Homo sapiens
tcctcccatcccctggac

SEQ ID NO: 158020 - DNA, 13 bp, Homo sapiens
tcctccccctgcc

SEQ ID NO: 158021 - DNA, 14 bp, Homo sapiens
tcctccccctgcca

SEQ ID NO: 158022 - DNA, 15 bp, Homo sapiens
tcctccccctgccag

SEQ ID NO: 158023 - DNA, 13 bp, Homo sapiens
tcctcctctgtga

SEQ ID NO: 158024 - DNA, 12 bp, Homo sapiens
tcctcctgccca

SEQ ID NO: 158025 - DNA, 15 bp, Homo sapiens
tcctcctgggccctc

SEQ ID NO: 158026 - DNA, 20 bp, Homo sapiens
tcctcctgggccctctctgc

SEQ ID NO: 158027 - DNA, 16 bp, Homo sapiens
tcctcgcaagctgggt

SEQ ID NO: 158028 - DNA, 16 bp, Homo sapiens
tcctcggatcaccgag

SEQ ID NO: 158029 - DNA, 14 bp, Homo sapiens
tcctcggccccctc

SEQ ID NO: 158030 - DNA, 12 bp, Homo sapiens
tcctctccactg

SEQ ID NO: 158031 - DNA, 15 bp, Homo sapiens
tcctctccactgcct

SEQ ID NO: 158032 - DNA, 16 bp, Homo sapiens
tcctctccactgcctt

SEQ ID NO: 158033 - DNA, 17 bp, Homo sapiens
tcctctccactgccttc

SEQ ID NO: 158034 - DNA, 18 bp, Homo sapiens
tcctctccactgccttcg

SEQ ID NO: 158035 - DNA, 16 bp, Homo sapiens
tcctctgactcagggc

SEQ ID NO: 158036 - DNA, 18 bp, Homo sapiens
tcctctgccacctcccct

SEQ ID NO: 158037 - DNA, 21 bp, Homo sapiens
tcctctgtgaccaatgtcttg

SEQ ID NO: 158038 - DNA, 17 bp, Homo sapiens
tcctgagggtccccacc

SEQ ID NO: 158039 - DNA, 19 bp, Homo sapiens
tcctgagggtccccacctg

SEQ ID NO: 158040 - DNA, 18 bp, Homo sapiens
tcctgataataattgatc

SEQ ID NO: 158041 - DNA, 18 bp, Homo sapiens
tcctgatggtacaggaaa

SEQ ID NO: 158042 - DNA, 16 bp, Homo sapiens
tcctgcagcctcctcc

SEQ ID NO: 158043 - DNA, 17 bp, Homo sapiens
tcctgcagcctggaggc

SEQ ID NO: 158044 - DNA, 13 bp, Homo sapiens
tcctgcccaggag

SEQ ID NO: 158045 - DNA, 18 bp, Homo sapiens
tcctgcccaggagagcca

SEQ ID NO: 158046 - DNA, 22 bp, Homo sapiens
tcctgcccaggagagccagccc

SEQ ID NO: 158047 - DNA, 23 bp, Homo sapiens
tcctgcccaggagagccagccct

SEQ ID NO: 158048 - DNA, 14 bp, Homo sapiens
tcctgccccaggcc

SEQ ID NO: 158049 - DNA, 14 bp, Homo sapiens
tcctgcctcagcct

SEQ ID NO: 158050 - DNA, 23 bp, Homo sapiens
tcctgccttcctcctgggccctc

SEQ ID NO: 158051 - DNA, 22 bp, Homo sapiens
tcctggacatgaagattctttc

SEQ ID NO: 158052 - DNA, 16 bp, Homo sapiens
tcctgggaaatattcc

SEQ ID NO: 158053 - DNA, 16 bp, Homo sapiens
tcctgggccctctctg

SEQ ID NO: 158054 - DNA, 17 bp, Homo sapiens
tcctgggccctctctgc

SEQ ID NO: 158055 - DNA, 13 bp, Homo sapiens
tcctgggctcagg

SEQ ID NO: 158056 - DNA, 13 bp, Homo sapiens
tcctggggcctcg

SEQ ID NO: 158057 - DNA, 23 bp, Homo sapiens
tcctgggggttctttcttcctct

SEQ ID NO: 158058 - DNA, 21 bp, Homo sapiens
tcctgggttttgtattctctg

SEQ ID NO: 158059 - DNA, 14 bp, Homo sapiens
tcctgtacattgtg

SEQ ID NO: 158060 - DNA, 15 bp, Homo sapiens
tcctgtattcacccg

SEQ ID NO: 158061 - DNA, 21 bp, Homo sapiens
tcctgtctgccagccagcagc

SEQ ID NO: 158062 - DNA, 15 bp, Homo sapiens
tcctgtgtgcagtga

SEQ ID NO: 158063 - DNA, 16 bp, Homo sapiens
tcctgtttttctgggt

SEQ ID NO: 158064 - DNA, 23 bp, Homo sapiens
tccttaaaggcaccatctaatag

SEQ ID NO: 158065 - DNA, 14 bp, Homo sapiens
tccttaatgatccg

SEQ ID NO: 158066 - DNA, 19 bp, Homo sapiens
tccttagagacatcaaaat

SEQ ID NO: 158067 - DNA, 22 bp, Homo sapiens
tccttagcttagacctcagcct

SEQ ID NO: 158068 - DNA, 20 bp, Homo sapiens
tccttcaagatcatgtaccc

SEQ ID NO: 158069 - DNA, 13 bp, Homo sapiens
tccttcagcctga

SEQ ID NO: 158070 - DNA, 12 bp, Homo sapiens
tccttcagtgca

SEQ ID NO: 158071 - DNA, 18 bp, Homo sapiens
tccttcccaaaggactcc

SEQ ID NO: 158072 - DNA, 23 bp, Homo sapiens
tccttcccaaaggactccaccca

SEQ ID NO: 158073 - DNA, 14 bp, Homo sapiens
tccttccctggctt

SEQ ID NO: 158074 - DNA, 14 bp, Homo sapiens
tccttcctgtcttc

SEQ ID NO: 158075 - DNA, 17 bp, Homo sapiens
tccttcctgtcttcctg

SEQ ID NO: 158076 - DNA, 14 bp, Homo sapiens
tccttccttccctg

SEQ ID NO: 158077 - DNA, 12 bp, Homo sapiens
tccttctccctt

SEQ ID NO: 158078 - DNA, 20 bp, Homo sapiens
tccttctgtgaaagtacatt

SEQ ID NO: 158079 - DNA, 21 bp, Homo sapiens
tccttgcacactcccctgcac

SEQ ID NO: 158080 - DNA, 22 bp, Homo sapiens
tccttgcacactcccctgcact

SEQ ID NO: 158081 - DNA, 17 bp, Homo sapiens
tccttgcacctgcatcc

SEQ ID NO: 158082 - DNA, 15 bp, Homo sapiens
tccttgcatcaattt

SEQ ID NO: 158083 - DNA, 16 bp, Homo sapiens
tccttggactcatttt

SEQ ID NO: 158084 - DNA, 20 bp, Homo sapiens
tccttggcatgccttccagc

SEQ ID NO: 158085 - DNA, 21 bp, Homo sapiens
tccttgggaggccccactggg

SEQ ID NO: 158086 - DNA, 22 bp, Homo sapiens
tccttgggaggccccactgggg

SEQ ID NO: 158087 - DNA, 14 bp, Homo sapiens
tccttgggcccttt

SEQ ID NO: 158088 - DNA, 17 bp, Homo sapiens
tccttggggcaggcagt

SEQ ID NO: 158089 - DNA, 14 bp, Homo sapiens
tcctttccccagcc

SEQ ID NO: 158090 - DNA, 20 bp, Homo sapiens
ctgcactccagcctgagcga

SEQ ID NO: 158091 - DNA, 18 bp, Homo sapiens
ctgcactccagcctgggt

SEQ ID NO: 158092 - DNA, 20 bp, Homo sapiens
ctgcagaacgtattggtcca

SEQ ID NO: 158093 - DNA, 19 bp, Homo sapiens
ctgcagaaggaaaaatgtg

SEQ ID NO: 158094 - DNA, 21 bp, Homo sapiens
ctgcagaaggaaaaatgtgta

SEQ ID NO: 158095 - DNA, 17 bp, Homo sapiens
ctgcagagacagagagg

SEQ ID NO: 158096 - DNA, 20 bp, Homo sapiens
ctgcagagcaggaaacatga

SEQ ID NO: 158097 - DNA, 15 bp, Homo sapiens
ctgcagccagcccag

SEQ ID NO: 158098 - DNA, 17 bp, Homo sapiens
ctgcagccagcccagcc

SEQ ID NO: 158099 - DNA, 22 bp, Homo sapiens
ctgcagccagcccagcccagct

SEQ ID NO: 158100 - DNA, 23 bp, Homo sapiens
ctgcagccagcccagcccagctg

SEQ ID NO: 158101 - DNA, 13 bp, Homo sapiens
ctgcagcctcctc

SEQ ID NO: 158102 - DNA, 16 bp, Homo sapiens
ctgcagcctcctcctg

SEQ ID NO: 158103 - DNA, 18 bp, Homo sapiens
ctgcagcctcctcctgac

SEQ ID NO: 158104 - DNA, 14 bp, Homo sapiens
ctgcagcctggagg

SEQ ID NO: 158105 - DNA, 20 bp, Homo sapiens
ctgcagcctggaggccgggt

SEQ ID NO: 158106 - DNA, 18 bp, Homo sapiens
ctgcagcctttgcctccc

SEQ ID NO: 158107 - DNA, 14 bp, Homo sapiens
ctgcagctttacat

SEQ ID NO: 158108 - DNA, 17 bp, Homo sapiens
ctgcaggacctgcctgt

SEQ ID NO: 158109 - DNA, 21 bp, Homo sapiens
ctgcaggacctgcctgtagcc

SEQ ID NO: 158110 - DNA, 14 bp, Homo sapiens
ctgcaggcagacac

SEQ ID NO: 158111 - DNA, 15 bp, Homo sapiens
ctgcaggcagacacg

SEQ ID NO: 158112 - DNA, 11 bp, Homo sapiens
ctgcaggcagg

SEQ ID NO: 158113 - DNA, 21 bp, Homo sapiens
ctgcagggccaggactgagcc

SEQ ID NO: 158114 - DNA, 11 bp, Homo sapiens
ctgcaggggct

SEQ ID NO: 158115 - DNA, 16 bp, Homo sapiens
ctgcaggggctctgga

SEQ ID NO: 158116 - DNA, 21 bp, Homo sapiens
ctgcaggggctctggagagaa

SEQ ID NO: 158117 - DNA, 16 bp, Homo sapiens
ctgcagtatgaaaata

SEQ ID NO: 158118 - DNA, 15 bp, Homo sapiens
ctgcatatgaaagga

SEQ ID NO: 158119 - DNA, 12 bp, Homo sapiens
ctgcatcccctt

SEQ ID NO: 158120 - DNA, 21 bp, Homo sapiens
ctgcatccgtagttccctgaa

SEQ ID NO: 158121 - DNA, 22 bp, Homo sapiens
ctgcatcgtttcatcttccaac

SEQ ID NO: 158122 - DNA, 21 bp, Homo sapiens
ctgcattcacccagacagctc

SEQ ID NO: 158123 - DNA, 13 bp, Homo sapiens
ctgcatttgtgaa

SEQ ID NO: 158124 - DNA, 14 bp, Homo sapiens
ctgcatttgtgaaa

SEQ ID NO: 158125 - DNA, 22 bp, Homo sapiens
ctgccacacgtctgaccctctc

SEQ ID NO: 158126 - DNA, 24 bp, Homo sapiens
ctgccacacgtctgaccctctcca

SEQ ID NO: 158127 - DNA, 17 bp, Homo sapiens
ctgccacacttcaggct

SEQ ID NO: 158128 - DNA, 22 bp, Homo sapiens
ctgccacacttcaggctcttct

SEQ ID NO: 158129 - DNA, 22 bp, Homo sapiens
ctgccacagcctcccctgccag

SEQ ID NO: 158130 - DNA, 14 bp, Homo sapiens
ctgccaccagagac

SEQ ID NO: 158131 - DNA, 15 bp, Homo sapiens
ctgccacctgctgct

SEQ ID NO: 158132 - DNA, 14 bp, Homo sapiens
ctgccacctggggc

SEQ ID NO: 158133 - DNA, 15 bp, Homo sapiens
ctgccacctggggca

SEQ ID NO: 158134 - DNA, 18 bp, Homo sapiens
ctgccacctggggcagtc

SEQ ID NO: 158135 - DNA, 22 bp, Homo sapiens
ctgccagacggcacccacccag

SEQ ID NO: 158136 - DNA, 15 bp, Homo sapiens
ctgccagcaacgcag

SEQ ID NO: 158137 - DNA, 14 bp, Homo sapiens
ctgccagccagcag

SEQ ID NO: 158138 - DNA, 19 bp, Homo sapiens
ctgccagccagcagccagc

SEQ ID NO: 158139 - DNA, 11 bp, Homo sapiens
ctgccaggcat

SEQ ID NO: 158140 - DNA, 13 bp, Homo sapiens
ctgccaggccccc

SEQ ID NO: 158141 - DNA, 12 bp, Homo sapiens
ctgccagggcag

SEQ ID NO: 158142 - DNA, 17 bp, Homo sapiens
ctgccagtccccctgcc

SEQ ID NO: 158143 - DNA, 20 bp, Homo sapiens
ctgccagtccccctgcccca

SEQ ID NO: 158144 - DNA, 12 bp, Homo sapiens
ctgccagtgcct

SEQ ID NO: 158145 - DNA, 17 bp, Homo sapiens
ctgccatccagggatgc

SEQ ID NO: 158146 - DNA, 23 bp, Homo sapiens
ctgccatggaggcacacagctgc

SEQ ID NO: 158147 - DNA, 19 bp, Homo sapiens
ctgcccaacctgctctcct

SEQ ID NO: 158148 - DNA, 11 bp, Homo sapiens
ctgcccaggag

SEQ ID NO: 158149 - DNA, 12 bp, Homo sapiens
ctgcccaggaga

SEQ ID NO: 158150 - DNA, 18 bp, Homo sapiens
ctgcccaggagagccagc

SEQ ID NO: 158151 - DNA, 19 bp, Homo sapiens
ctgcccaggagagccagcc

SEQ ID NO: 158152 - DNA, 22 bp, Homo sapiens
ctgcccaggagagccagccctc

SEQ ID NO: 158153 - DNA, 21 bp, Homo sapiens
ctgccccaactcctggaagct

SEQ ID NO: 158154 - DNA, 12 bp, Homo sapiens
ctgccccaggcc

SEQ ID NO: 158155 - DNA, 22 bp, Homo sapiens
ctgccccgtctcatgaggggcc

SEQ ID NO: 158156 - DNA, 17 bp, Homo sapiens
ctgccccgtgcagactg

SEQ ID NO: 158157 - DNA, 18 bp, Homo sapiens
ctgccccgtgcagactgg

SEQ ID NO: 158158 - DNA, 14 bp, Homo sapiens
ctgcccctcccaga

SEQ ID NO: 158159 - DNA, 14 bp, Homo sapiens
ctgcccctcccttc

SEQ ID NO: 158160 - DNA, 20 bp, Homo sapiens
ctgcccggcagggtcctaga

SEQ ID NO: 158161 - DNA, 15 bp, Homo sapiens
ctgcccgtcttcagc

SEQ ID NO: 158162 - DNA, 21 bp, Homo sapiens
ctgcccgtcttcagcctagcc

SEQ ID NO: 158163 - DNA, 22 bp, Homo sapiens
ctgccctagctccacaccctct

SEQ ID NO: 158164 - DNA, 18 bp, Homo sapiens
ctgccctaggctccgtca

SEQ ID NO: 158165 - DNA, 11 bp, Homo sapiens
ctgccctgctg

SEQ ID NO: 158166 - DNA, 19 bp, Homo sapiens
ctgccctgggatgtccaca

SEQ ID NO: 158167 - DNA, 16 bp, Homo sapiens
ctgccctggtgctgcc

SEQ ID NO: 158168 - DNA, 17 bp, Homo sapiens
ctgccgacctcgtcctc

SEQ ID NO: 158169 - DNA, 14 bp, Homo sapiens
ctgccgcaccccag

SEQ ID NO: 158170 - DNA, 16 bp, Homo sapiens
ctgccgcaccccagag

SEQ ID NO: 158171 - DNA, 18 bp, Homo sapiens
ctgccgcctcccagcctg

SEQ ID NO: 158172 - DNA, 18 bp, Homo sapiens
ctgccggtaaacacgcct

SEQ ID NO: 158173 - DNA, 21 bp, Homo sapiens
ctgccggtaaacacgcctgca

SEQ ID NO: 158174 - DNA, 14 bp, Homo sapiens
ctgccgtgtgccct

SEQ ID NO: 158175 - DNA, 15 bp, Homo sapiens
ctgcctaagtgcagc

SEQ ID NO: 158176 - DNA, 15 bp, Homo sapiens
ctgcctactgcatcg

SEQ ID NO: 158177 - DNA, 24 bp, Homo sapiens
ctgcctcaatgtgaatcagaccct

SEQ ID NO: 158178 - DNA, 18 bp, Homo sapiens
ctgcctctccctggccct

SEQ ID NO: 158179 - DNA, 19 bp, Homo sapiens
ctgcctctccctggccctc

SEQ ID NO: 158180 - DNA, 18 bp, Homo sapiens
ctgcctctcggtggccag

SEQ ID NO: 158181 - DNA, 20 bp, Homo sapiens
ctgcctctgcctgcattctg

SEQ ID NO: 158182 - DNA, 12 bp, Homo sapiens
ctgcctcttcct

SEQ ID NO: 158183 - DNA, 13 bp, Homo sapiens
ctgcctcttctct

SEQ ID NO: 158184 - DNA, 14 bp, Homo sapiens
ctgcctggccccca

SEQ ID NO: 158185 - DNA, 20 bp, Homo sapiens
ctgcctggcccccagctgtg

SEQ ID NO: 158186 - DNA, 16 bp, Homo sapiens
ctgcctgtagcagtga

SEQ ID NO: 158187 - DNA, 15 bp, Homo sapiens
ctgcctgtagttagg

SEQ ID NO: 158188 - DNA, 17 bp, Homo sapiens
ctgcctgtagttaggaa

SEQ ID NO: 158189 - DNA, 18 bp, Homo sapiens
ctgcctgtagttaggaaa

SEQ ID NO: 158190 - DNA, 20 bp, Homo sapiens
ctgcctgtagttaggaaata

SEQ ID NO: 158191 - DNA, 15 bp, Homo sapiens
ctgcctgttcccatt

SEQ ID NO: 158192 - DNA, 17 bp, Homo sapiens
ctgccttatcttgcacc

SEQ ID NO: 158193 - DNA, 15 bp, Homo sapiens
ctgccttcctcctgg

SEQ ID NO: 158194 - DNA, 18 bp, Homo sapiens
ctgccttcctcctgggcc

SEQ ID NO: 158195 - DNA, 16 bp, Homo sapiens
ctgcgcccttccccag

SEQ ID NO: 158196 - DNA, 15 bp, Homo sapiens
ctgcggaccccagct

SEQ ID NO: 158197 - DNA, 21 bp, Homo sapiens
ctgcggcacccttgcgctttt

SEQ ID NO: 158198 - DNA, 19 bp, Homo sapiens
ctgcgtgtcacctgtgctt

SEQ ID NO: 158199 - DNA, 20 bp, Homo sapiens
ctgctaacttggagccccag

SEQ ID NO: 158200 - DNA, 21 bp, Homo sapiens
ctgctagcacttggagccaag

SEQ ID NO: 158201 - DNA, 12 bp, Homo sapiens
ctgctcatcatt

SEQ ID NO: 158202 - DNA, 16 bp, Homo sapiens
ctgctccccagccctg

SEQ ID NO: 158203 - DNA, 13 bp, Homo sapiens
ctgctcccccacc

SEQ ID NO: 158204 - DNA, 17 bp, Homo sapiens
ctgctcccccaccccct

SEQ ID NO: 158205 - DNA, 20 bp, Homo sapiens
ctgctccctgaagccagcct

SEQ ID NO: 158206 - DNA, 11 bp, Homo sapiens
ctgctcctcca

SEQ ID NO: 158207 - DNA, 22 bp, Homo sapiens
ctgctcctccagggccacgtgc

SEQ ID NO: 158208 - DNA, 14 bp, Homo sapiens
ctgctctcctcttg

SEQ ID NO: 158209 - DNA, 21 bp, Homo sapiens
ctgctctgcgtgtcacctgtg

SEQ ID NO: 158210 - DNA, 22 bp, Homo sapiens
ctgctctgcgtgtcacctgtgc

SEQ ID NO: 158211 - DNA, 20 bp, Homo sapiens
ctgctctttctctgccagtg

SEQ ID NO: 158212 - DNA, 16 bp, Homo sapiens
ctgctgacctccacag

SEQ ID NO: 158213 - DNA, 19 bp, Homo sapiens
ctgctgacctccacagctt

SEQ ID NO: 158214 - DNA, 21 bp, Homo sapiens
ctgctgactgttttctcttga

SEQ ID NO: 158215 - DNA, 16 bp, Homo sapiens
ctgctgagagacccaa

SEQ ID NO: 158216 - DNA, 17 bp, Homo sapiens
ctgctgagggaccagcc

SEQ ID NO: 158217 - DNA, 11 bp, Homo sapiens
ctgctgcaggg

SEQ ID NO: 158218 - DNA, 12 bp, Homo sapiens
ctgctgcagggg

SEQ ID NO: 158219 - DNA, 13 bp, Homo sapiens
ctgctgcaggggc

SEQ ID NO: 158220 - DNA, 20 bp, Homo sapiens
ctgctgcaggggctctggag

SEQ ID NO: 158221 - DNA, 21 bp, Homo sapiens
ctgctgccgcctcccagcctg

SEQ ID NO: 158222 - DNA, 21 bp, Homo sapiens
ctgctgctaatcttcagggca

SEQ ID NO: 158223 - DNA, 22 bp, Homo sapiens
ctgctggcccagccaaaccctg

SEQ ID NO: 158224 - DNA, 13 bp, Homo sapiens
ctgctggctgcct

SEQ ID NO: 158225 - DNA, 15 bp, Homo sapiens
ctgctggctgcctta

SEQ ID NO: 158226 - DNA, 15 bp, Homo sapiens
ctgctgggctctcca

SEQ ID NO: 158227 - DNA, 17 bp, Homo sapiens
ctgctgggctctccacc

SEQ ID NO: 158228 - DNA, 22 bp, Homo sapiens
ctgctggtgcagagctgaagat

SEQ ID NO: 158229 - DNA, 19 bp, Homo sapiens
ctgctgtgctgtgcccaag

SEQ ID NO: 158230 - DNA, 20 bp, Homo sapiens
ctgcttacaattccctgctg

SEQ ID NO: 158231 - DNA, 22 bp, Homo sapiens
ctgcttacaattccctgctgtc

SEQ ID NO: 158232 - DNA, 16 bp, Homo sapiens
ctgcttcttaacccca

SEQ ID NO: 158233 - DNA, 13 bp, Homo sapiens
ctgcttgaggaaa

SEQ ID NO: 158234 - DNA, 14 bp, Homo sapiens
ctgcttgaggaaaa

SEQ ID NO: 158235 - DNA, 20 bp, Homo sapiens
ctgcttgcttgctttttaat

SEQ ID NO: 158236 - DNA, 12 bp, Homo sapiens
ctgctttccaca

SEQ ID NO: 158237 - DNA, 22 bp, Homo sapiens
ctgctttgactgagcagactgg

SEQ ID NO: 158238 - DNA, 21 bp, Homo sapiens
tataaaataaatatatataaa

SEQ ID NO: 158239 - DNA, 14 bp, Homo sapiens
tataaacatcacac

SEQ ID NO: 158240 - DNA, 17 bp, Homo sapiens
tataaacatcacacaca

SEQ ID NO: 158241 - DNA, 15 bp, Homo sapiens
tataaacctaaaaaa

SEQ ID NO: 158242 - DNA, 20 bp, Homo sapiens
tataaacctaaaaaagatat

SEQ ID NO: 158243 - DNA, 15 bp, Homo sapiens
tataaagtaaagcta

SEQ ID NO: 158244 - DNA, 19 bp, Homo sapiens
tataactactccggagaca

SEQ ID NO: 158245 - DNA, 18 bp, Homo sapiens
tataactagtcctttact

SEQ ID NO: 158246 - DNA, 17 bp, Homo sapiens
tataactcatcataaaa

SEQ ID NO: 158247 - DNA, 19 bp, Homo sapiens
tataactcatcataaaata

SEQ ID NO: 158248 - DNA, 16 bp, Homo sapiens
tataacttcttaaaag

SEQ ID NO: 158249 - DNA, 16 bp, Homo sapiens
tataagaataaaatgt

SEQ ID NO: 158250 - DNA, 16 bp, Homo sapiens
tataagattagaatga

SEQ ID NO: 158251 - DNA, 15 bp, Homo sapiens
tataagtgtacatat

SEQ ID NO: 158252 - DNA, 15 bp, Homo sapiens
tataatggttgactg

SEQ ID NO: 158253 - DNA, 18 bp, Homo sapiens
tataatgttgttatttaa

SEQ ID NO: 158254 - DNA, 17 bp, Homo sapiens
tataattctactttgag

SEQ ID NO: 158255 - DNA, 16 bp, Homo sapiens
tataatttaatgcatg

SEQ ID NO: 158256 - DNA, 15 bp, Homo sapiens
tatagaatatttatt

SEQ ID NO: 158257 - DNA, 11 bp, Homo sapiens
tatagactcta

SEQ ID NO: 158258 - DNA, 11 bp, Homo sapiens
tatagctatta

SEQ ID NO: 158259 - DNA, 12 bp, Homo sapiens
tataggaattga

SEQ ID NO: 158260 - DNA, 23 bp, Homo sapiens
tataggtgctacaaaaacacagc

SEQ ID NO: 158261 - DNA, 13 bp, Homo sapiens
tatagtccagctt

SEQ ID NO: 158262 - DNA, 21 bp, Homo sapiens
tatagtgtaaaataagaatga

SEQ ID NO: 158263 - DNA, 17 bp, Homo sapiens
tatagttaggatagcat

SEQ ID NO: 158264 - DNA, 18 bp, Homo sapiens
tatagtttgtacatgcat

SEQ ID NO: 158265 - DNA, 17 bp, Homo sapiens
tatataaaataaatata

SEQ ID NO: 158266 - DNA, 18 bp, Homo sapiens
tatataaaataaatatat

SEQ ID NO: 158267 - DNA, 22 bp, Homo sapiens
tatataaaataaatatatataa

SEQ ID NO: 158268 - DNA, 23 bp, Homo sapiens
tatataaaataaatatatataaa

SEQ ID NO: 158269 - DNA, 17 bp, Homo sapiens
tatataaacctaaaaaa

SEQ ID NO: 158270 - DNA, 21 bp, Homo sapiens
tatataaacctaaaaaagata

SEQ ID NO: 158271 - DNA, 18 bp, Homo sapiens
tatataagatggaagctt

SEQ ID NO: 158272 - DNA, 17 bp, Homo sapiens
tatataggttgtgcaaa

SEQ ID NO: 158273 - DNA, 12 bp, Homo sapiens
tatatataaacc

SEQ ID NO: 158274 - DNA, 13 bp, Homo sapiens
tatatatataaaa

SEQ ID NO: 158275 - DNA, 13 bp, Homo sapiens
tatatatatatat

SEQ ID NO: 158276 - DNA, 22 bp, Homo sapiens
tatatatcatattggtattcac

SEQ ID NO: 158277 - DNA, 16 bp, Homo sapiens
tatatctgcttcagtg

SEQ ID NO: 158278 - DNA, 16 bp, Homo sapiens
tatatggcaagaaagc

SEQ ID NO: 158279 - DNA, 18 bp, Homo sapiens
tatatggcagagttgtaa

SEQ ID NO: 158280 - DNA, 23 bp, Homo sapiens
tatatggcagagttgtaaatata

SEQ ID NO: 158281 - DNA, 13 bp, Homo sapiens
tatattaaaaata

SEQ ID NO: 158282 - DNA, 17 bp, Homo sapiens
tatattaaaaatataaa

SEQ ID NO: 158283 - DNA, 18 bp, Homo sapiens
tatattaaaaatataaaa

SEQ ID NO: 158284 - DNA, 20 bp, Homo sapiens
tatattaaaaatataaaact

SEQ ID NO: 158285 - DNA, 12 bp, Homo sapiens
tatatttataac

SEQ ID NO: 158286 - DNA, 15 bp, Homo sapiens
tatatttataactca

SEQ ID NO: 158287 - DNA, 21 bp, Homo sapiens
tatatttataactcatcataa

SEQ ID NO: 158288 - DNA, 20 bp, Homo sapiens
tatatttttatatttagtta

SEQ ID NO: 158289 - DNA, 19 bp, Homo sapiens
tatcaaaactttcttttct

SEQ ID NO: 158290 - DNA, 14 bp, Homo sapiens
tatcaaaagaaaga

SEQ ID NO: 158291 - DNA, 13 bp, Homo sapiens
tatcaatagtcaa

SEQ ID NO: 158292 - DNA, 23 bp, Homo sapiens
tatcaccgtgggctccctgactg

SEQ ID NO: 158293 - DNA, 21 bp, Homo sapiens
tatcagaagaccacaaaaatt

SEQ ID NO: 158294 - DNA, 23 bp, Homo sapiens
tatcagaagaccacaaaaattga

SEQ ID NO: 158295 - DNA, 11 bp, Homo sapiens
tatcagcctgt

SEQ ID NO: 158296 - DNA, 13 bp, Homo sapiens
tatcagcctgtct

SEQ ID NO: 158297 - DNA, 20 bp, Homo sapiens
tatcaggacccagaggaagg

SEQ ID NO: 158298 - DNA, 16 bp, Homo sapiens
tatcaggtgcccatcc

SEQ ID NO: 158299 - DNA, 15 bp, Homo sapiens
tatcagttactcagc

SEQ ID NO: 158300 - DNA, 21 bp, Homo sapiens
tatcatcagcatacctttatt

SEQ ID NO: 158301 - DNA, 13 bp, Homo sapiens
tatcatgacatgt

SEQ ID NO: 158302 - DNA, 20 bp, Homo sapiens
tatcatttattttttacatt

SEQ ID NO: 158303 - DNA, 14 bp, Homo sapiens
tatcattttctgca

SEQ ID NO: 158304 - DNA, 12 bp, Homo sapiens
tatccacccagc

SEQ ID NO: 158305 - DNA, 14 bp, Homo sapiens
tatccacccagccc

SEQ ID NO: 158306 - DNA, 15 bp, Homo sapiens
tatccacccagccca

SEQ ID NO: 158307 - DNA, 14 bp, Homo sapiens
tatcccagaaatta

SEQ ID NO: 158308 - DNA, 19 bp, Homo sapiens
tatcccccccctgtatagt

SEQ ID NO: 158309 - DNA, 23 bp, Homo sapiens
tatctaaactggattcacagctc

SEQ ID NO: 158310 - DNA, 15 bp, Homo sapiens
tatctcagggcctgg

SEQ ID NO: 158311 - DNA, 13 bp, Homo sapiens
tatctgaggtcac

SEQ ID NO: 158312 - DNA, 16 bp, Homo sapiens
tatctgcaggcagaca

SEQ ID NO: 158313 - DNA, 19 bp, Homo sapiens
tatctgcaggcagacacgg

SEQ ID NO: 158314 - DNA, 15 bp, Homo sapiens
tatcttgtctctggg

SEQ ID NO: 158315 - DNA, 22 bp, Homo sapiens
tatgaaagatggctgtgcctct

SEQ ID NO: 158316 - DNA, 18 bp, Homo sapiens
tatgaataaagacaccta

SEQ ID NO: 158317 - DNA, 17 bp, Homo sapiens
tatgactgctccccagc

SEQ ID NO: 158318 - DNA, 18 bp, Homo sapiens
tatgagcttccttctgtg

SEQ ID NO: 158319 - DNA, 21 bp, Homo sapiens
tatgagcttccttctgtgaaa

SEQ ID NO: 158320 - DNA, 14 bp, Homo sapiens
tatgaggatgcaga

SEQ ID NO: 158321 - DNA, 22 bp, Homo sapiens
tatgaggcaaccacaggcagca

SEQ ID NO: 158322 - DNA, 15 bp, Homo sapiens
tatgatttatagttt

SEQ ID NO: 158323 - DNA, 18 bp, Homo sapiens
tatgatttatagtttgta

SEQ ID NO: 158324 - DNA, 16 bp, Homo sapiens
tatgattttatttgac

SEQ ID NO: 158325 - DNA, 22 bp, Homo sapiens
tatgcaaaagttctgacttgac

SEQ ID NO: 158326 - DNA, 16 bp, Homo sapiens
tatgcatctaataaaa

SEQ ID NO: 158327 - DNA, 22 bp, Homo sapiens
tatgcatttaaatacagtcttc

SEQ ID NO: 158328 - DNA, 13 bp, Homo sapiens
tatggaacttcta

SEQ ID NO: 158329 - DNA, 17 bp, Homo sapiens
tatggaatacagtgtta

SEQ ID NO: 158330 - DNA, 23 bp, Homo sapiens
tatggaatacagtgttattttct

SEQ ID NO: 158331 - DNA, 17 bp, Homo sapiens
tatggcagagttgtaaa

SEQ ID NO: 158332 - DNA, 14 bp, Homo sapiens
tatggcagcgaaag

SEQ ID NO: 158333 - DNA, 17 bp, Homo sapiens
tatggctataggtgcta

SEQ ID NO: 158334 - DNA, 15 bp, Homo sapiens
tatgtaaacaggaga

SEQ ID NO: 158335 - DNA, 18 bp, Homo sapiens
tatgtaaacataattctt

SEQ ID NO: 158336 - DNA, 14 bp, Homo sapiens
tatgtaaagtatgt

SEQ ID NO: 158337 - DNA, 19 bp, Homo sapiens
tatgtaaagtatgtaaaca

SEQ ID NO: 158338 - DNA, 16 bp, Homo sapiens
tatgtaccatgtacat

SEQ ID NO: 158339 - DNA, 12 bp, Homo sapiens
tatgtatttata

SEQ ID NO: 158340 - DNA, 14 bp, Homo sapiens
tatgtcaaagcagg

SEQ ID NO: 158341 - DNA, 15 bp, Homo sapiens
tatgtcatcatacat

SEQ ID NO: 158342 - DNA, 15 bp, Homo sapiens
tatgtcccttgctgt

SEQ ID NO: 158343 - DNA, 19 bp, Homo sapiens
tatgttacatctgttttaa

SEQ ID NO: 158344 - DNA, 17 bp, Homo sapiens
tatgttctaagaagtga

SEQ ID NO: 158345 - DNA, 11 bp, Homo sapiens
tctagctgttg

SEQ ID NO: 158346 - DNA, 18 bp, Homo sapiens
tctagctgttgagctgtt

SEQ ID NO: 158347 - DNA, 16 bp, Homo sapiens
tctaggagctgggagg

SEQ ID NO: 158348 - DNA, 20 bp, Homo sapiens
tctaggagctgggaggaaaa

SEQ ID NO: 158349 - DNA, 21 bp, Homo sapiens
tctaggagctgggaggaaaag

SEQ ID NO: 158350 - DNA, 17 bp, Homo sapiens
tctagggagagaccctt

SEQ ID NO: 158351 - DNA, 17 bp, Homo sapiens
tctagttttcagtttgt

SEQ ID NO: 158352 - DNA, 13 bp, Homo sapiens
tctatagactcta

SEQ ID NO: 158353 - DNA, 16 bp, Homo sapiens
tctattaagatttcca

SEQ ID NO: 158354 - DNA, 17 bp, Homo sapiens
tctattgctggcaaaga

SEQ ID NO: 158355 - DNA, 22 bp, Homo sapiens
tctattgctggcaaagacagaa

SEQ ID NO: 158356 - DNA, 17 bp, Homo sapiens
tctattgtttattcttt

SEQ ID NO: 158357 - DNA, 22 bp, Homo sapiens
tctatttatttactgagcttct

SEQ ID NO: 158358 - DNA, 20 bp, Homo sapiens
tctatttctcctccatggga

SEQ ID NO: 158359 - DNA, 23 bp, Homo sapiens
tctcaacccttttgtctgcctct

SEQ ID NO: 158360 - DNA, 17 bp, Homo sapiens
tctcaagagggcactgg

SEQ ID NO: 158361 - DNA, 18 bp, Homo sapiens
tctcaagagggcactggt

SEQ ID NO: 158362 - DNA, 12 bp, Homo sapiens
tctcaatttcta

SEQ ID NO: 158363 - DNA, 15 bp, Homo sapiens
tctcaccccatccca

SEQ ID NO: 158364 - DNA, 17 bp, Homo sapiens
tctcaccccatcccaca

SEQ ID NO: 158365 - DNA, 21 bp, Homo sapiens
tctcacgggcatgggcactcc

SEQ ID NO: 158366 - DNA, 13 bp, Homo sapiens
tctcactccacca

SEQ ID NO: 158367 - DNA, 17 bp, Homo sapiens
tctcactccaccaccca

SEQ ID NO: 158368 - DNA, 18 bp, Homo sapiens
tctcactccaccacccaa

SEQ ID NO: 158369 - DNA, 17 bp, Homo sapiens
tctcactcctacctggt

SEQ ID NO: 158370 - DNA, 17 bp, Homo sapiens
tctcactggatgcaaag

SEQ ID NO: 158371 - DNA, 15 bp, Homo sapiens
tctcagccaacgagt

SEQ ID NO: 158372 - DNA, 12 bp, Homo sapiens
tctcagcctccc

SEQ ID NO: 158373 - DNA, 19 bp, Homo sapiens
tctcaggctctgccctgcc

SEQ ID NO: 158374 - DNA, 20 bp, Homo sapiens
tctcaggctctgccctgccc

SEQ ID NO: 158375 - DNA, 18 bp, Homo sapiens
tctcaggctggtgggagg

SEQ ID NO: 158376 - DNA, 17 bp, Homo sapiens
tctcagtctctgagcag

SEQ ID NO: 158377 - DNA, 18 bp, Homo sapiens
tctcagtctctgagcagt

SEQ ID NO: 158378 - DNA, 15 bp, Homo sapiens
tctcatacgtccacc

SEQ ID NO: 158379 - DNA, 16 bp, Homo sapiens
tctcataggaaaagta

SEQ ID NO: 158380 - DNA, 21 bp, Homo sapiens
tctcataggaaaagtacattt

SEQ ID NO: 158381 - DNA, 24 bp, Homo sapiens
tctcataggaaaagtacatttaat

SEQ ID NO: 158382 - DNA, 15 bp, Homo sapiens
tctcatgtgatcctt

SEQ ID NO: 158383 - DNA, 17 bp, Homo sapiens
tctcatgtgatcctttt

SEQ ID NO: 158384 - DNA, 18 bp, Homo sapiens
tctcatgtgatcctttta

SEQ ID NO: 158385 - DNA, 19 bp, Homo sapiens
tctcatgtgatccttttat

SEQ ID NO: 158386 - DNA, 19 bp, Homo sapiens
tctcattccaacagtgagt

SEQ ID NO: 158387 - DNA, 11 bp, Homo sapiens
tctccacctca

SEQ ID NO: 158388 - DNA, 23 bp, Homo sapiens
tctccagccccttctcagaatct

SEQ ID NO: 158389 - DNA, 19 bp, Homo sapiens
tctccatccacatgggagc

SEQ ID NO: 158390 - DNA, 14 bp, Homo sapiens
tctccatggccctg

SEQ ID NO: 158391 - DNA, 15 bp, Homo sapiens
tctccatggccctgc

SEQ ID NO: 158392 - DNA, 16 bp, Homo sapiens
tctccatgtttgatgt

SEQ ID NO: 158393 - DNA, 23 bp, Homo sapiens
tctcccagataatgtgaaaatgg

SEQ ID NO: 158394 - DNA, 23 bp, Homo sapiens
tctcccaggccaggctccttcct

SEQ ID NO: 158395 - DNA, 14 bp, Homo sapiens
tctccctctcctgc

SEQ ID NO: 158396 - DNA, 15 bp, Homo sapiens
tctccctctcctgcc

SEQ ID NO: 158397 - DNA, 16 bp, Homo sapiens
tctccctctcctgcct

SEQ ID NO: 158398 - DNA, 21 bp, Homo sapiens
tctccctctcctgcctactca

SEQ ID NO: 158399 - DNA, 12 bp, Homo sapiens
tctccctctggc

SEQ ID NO: 158400 - DNA, 15 bp, Homo sapiens
tctccctctggccct

SEQ ID NO: 158401 - DNA, 17 bp, Homo sapiens
tctccctctggccctgc

SEQ ID NO: 158402 - DNA, 12 bp, Homo sapiens
tctccctgccgc

SEQ ID NO: 158403 - DNA, 13 bp, Homo sapiens
tctccctgccgcc

SEQ ID NO: 158404 - DNA, 13 bp, Homo sapiens
tctccctggccct

SEQ ID NO: 158405 - DNA, 14 bp, Homo sapiens
tctcctatgtgtaa

SEQ ID NO: 158406 - DNA, 15 bp, Homo sapiens
tctcctatgtgtaag

SEQ ID NO: 158407 - DNA, 17 bp, Homo sapiens
tctcctccatactcagg

SEQ ID NO: 158408 - DNA, 18 bp, Homo sapiens
tctcctccatactcagga

SEQ ID NO: 158409 - DNA, 16 bp, Homo sapiens
tctcctcctgcccacc

SEQ ID NO: 158410 - DNA, 16 bp, Homo sapiens
tctcctcgcaagctgg

SEQ ID NO: 158411 - DNA, 22 bp, Homo sapiens
tctcctcttaaaaaataaaaac

SEQ ID NO: 158412 - DNA, 14 bp, Homo sapiens
tctcctgcctactc

SEQ ID NO: 158413 - DNA, 15 bp, Homo sapiens
tctcctgcctactca

SEQ ID NO: 158414 - DNA, 18 bp, Homo sapiens
tctcctgccttcctcctg

SEQ ID NO: 158415 - DNA, 16 bp, Homo sapiens
tctcctgtccaaccta

SEQ ID NO: 158416 - DNA, 17 bp, Homo sapiens
tctcctgtttttctggg

SEQ ID NO: 158417 - DNA, 16 bp, Homo sapiens
tctcctttcacaacct

SEQ ID NO: 158418 - DNA, 17 bp, Homo sapiens
tctcctttgcaggctca

SEQ ID NO: 158419 - DNA, 15 bp, Homo sapiens
tctctacaaaaagca

SEQ ID NO: 158420 - DNA, 20 bp, Homo sapiens
tctctccctccctttgaaat

SEQ ID NO: 158421 - DNA, 11 bp, Homo sapiens
tctctcctcct

SEQ ID NO: 158422 - DNA, 15 bp, Homo sapiens
tctctcggttccacg

SEQ ID NO: 158423 - DNA, 12 bp, Homo sapiens
tctctctcctgt

SEQ ID NO: 158424 - DNA, 17 bp, Homo sapiens
tctctgactctcaaatc

SEQ ID NO: 158425 - DNA, 14 bp, Homo sapiens
tctctgagcagtga

SEQ ID NO: 158426 - DNA, 15 bp, Homo sapiens
tctctgagctgtgca

SEQ ID NO: 158427 - DNA, 16 bp, Homo sapiens
tctctgagctgtgcag

SEQ ID NO: 158428 - DNA, 11 bp, Homo sapiens
tctctgcagcc

SEQ ID NO: 158429 - DNA, 21 bp, Homo sapiens
tctctgccagtgacagacagg

SEQ ID NO: 158430 - DNA, 18 bp, Homo sapiens
tctctgctctgcgtgtca

SEQ ID NO: 158431 - DNA, 22 bp, Homo sapiens
tctctgctctgcgtgtcacctg

SEQ ID NO: 158432 - DNA, 12 bp, Homo sapiens
tctctgctggcc

SEQ ID NO: 158433 - DNA, 15 bp, Homo sapiens
tctctgctggcccag

SEQ ID NO: 158434 - DNA, 16 bp, Homo sapiens
tctctgctggcccagc

SEQ ID NO: 158435 - DNA, 21 bp, Homo sapiens
tctctgggcttggggcttcct

SEQ ID NO: 158436 - DNA, 16 bp, Homo sapiens
tctctgtctcatccat

SEQ ID NO: 158437 - DNA, 22 bp, Homo sapiens
tctctgtgaacgatttagaaag

SEQ ID NO: 158438 - DNA, 17 bp, Homo sapiens
tctcttatagaatattt

SEQ ID NO: 158439 - DNA, 18 bp, Homo sapiens
tctcttatagaatattta

SEQ ID NO: 158440 - DNA, 20 bp, Homo sapiens
ttcatttgagttattttaat

SEQ ID NO: 158441 - DNA, 21 bp, Homo sapiens
ttccaaaaagattttcagaaa

SEQ ID NO: 158442 - DNA, 21 bp, Homo sapiens
ttccaaaataattttaagaaa

SEQ ID NO: 158443 - DNA, 14 bp, Homo sapiens
ttccaacagtgagt

SEQ ID NO: 158444 - DNA, 19 bp, Homo sapiens
ttccacaagattcccagag

SEQ ID NO: 158445 - DNA, 21 bp, Homo sapiens
ttccacaagattcccagagac

SEQ ID NO: 158446 - DNA, 19 bp, Homo sapiens
ttccacgtccccctggggc

SEQ ID NO: 158447 - DNA, 15 bp, Homo sapiens
ttccactgagggcag

SEQ ID NO: 158448 - DNA, 20 bp, Homo sapiens
ttccactgtcaagaaagagc

SEQ ID NO: 158449 - DNA, 19 bp, Homo sapiens
ttccacttataggaattga

SEQ ID NO: 158450 - DNA, 23 bp, Homo sapiens
ttccagataaccagctgtaacac

SEQ ID NO: 158451 - DNA, 15 bp, Homo sapiens
ttccagtccaatctc

SEQ ID NO: 158452 - DNA, 19 bp, Homo sapiens
ttccataatctggactcct

SEQ ID NO: 158453 - DNA, 15 bp, Homo sapiens
ttccatatgacctca

SEQ ID NO: 158454 - DNA, 12 bp, Homo sapiens
ttccatcatgtc

SEQ ID NO: 158455 - DNA, 21 bp, Homo sapiens
ttccatggtgtgatcgtctga

SEQ ID NO: 158456 - DNA, 20 bp, Homo sapiens
ttccatgtcgcctctgcatt

SEQ ID NO: 158457 - DNA, 16 bp, Homo sapiens
ttccattccagaatat

SEQ ID NO: 158458 - DNA, 13 bp, Homo sapiens
ttccattgtgtga

SEQ ID NO: 158459 - DNA, 14 bp, Homo sapiens
ttccatttgtgtgt

SEQ ID NO: 158460 - DNA, 14 bp, Homo sapiens
ttcccaattcacat

SEQ ID NO: 158461 - DNA, 13 bp, Homo sapiens
ttcccaattgctt

SEQ ID NO: 158462 - DNA, 19 bp, Homo sapiens
ttcccagagacaggaaaat

SEQ ID NO: 158463 - DNA, 13 bp, Homo sapiens
ttcccagggaagt

SEQ ID NO: 158464 - DNA, 17 bp, Homo sapiens
ttccccactgacagcct

SEQ ID NO: 158465 - DNA, 14 bp, Homo sapiens
ttccccagcccagg

SEQ ID NO: 158466 - DNA, 23 bp, Homo sapiens
ttccccatggttttaatctgtat

SEQ ID NO: 158467 - DNA, 17 bp, Homo sapiens
ttcccccatagccaccc

SEQ ID NO: 158468 - DNA, 19 bp, Homo sapiens
ttcccctaacctcattccc

SEQ ID NO: 158469 - DNA, 17 bp, Homo sapiens
ttcccctccttctccct

SEQ ID NO: 158470 - DNA, 16 bp, Homo sapiens
ttcccgctcagccctc

SEQ ID NO: 158471 - DNA, 21 bp, Homo sapiens
ttcccgctcagccctccctgc

SEQ ID NO: 158472 - DNA, 14 bp, Homo sapiens
ttccctacttcctg

SEQ ID NO: 158473 - DNA, 16 bp, Homo sapiens
ttccctacttcctgtg

SEQ ID NO: 158474 - DNA, 22 bp, Homo sapiens
ttccctagaaacttccaaatcc

SEQ ID NO: 158475 - DNA, 14 bp, Homo sapiens
ttccctctctctga

SEQ ID NO: 158476 - DNA, 20 bp, Homo sapiens
ttccctgaaaacccagagag

SEQ ID NO: 158477 - DNA, 16 bp, Homo sapiens
ttccctgactcattct

SEQ ID NO: 158478 - DNA, 22 bp, Homo sapiens
ttccctgctgtcgtcttagcaa

SEQ ID NO: 158479 - DNA, 19 bp, Homo sapiens
ttccgcttggagcagaggg

SEQ ID NO: 158480 - DNA, 19 bp, Homo sapiens
ttcctaacaggattagaca

SEQ ID NO: 158481 - DNA, 19 bp, Homo sapiens
ttcctaataaagttctgta

SEQ ID NO: 158482 - DNA, 21 bp, Homo sapiens
ttcctatatagtttattgaca

SEQ ID NO: 158483 - DNA, 23 bp, Homo sapiens
ttcctcctgggccctctctgctc

SEQ ID NO: 158484 - DNA, 17 bp, Homo sapiens
ttcctctcactaaactt

SEQ ID NO: 158485 - DNA, 12 bp, Homo sapiens
ttcctctccact

SEQ ID NO: 158486 - DNA, 15 bp, Homo sapiens
ttcctctccactgcc

SEQ ID NO: 158487 - DNA, 18 bp, Homo sapiens
ttcctctccactgccttc

SEQ ID NO: 158488 - DNA, 20 bp, Homo sapiens
ttcctgcaactcaaggactt

SEQ ID NO: 158489 - DNA, 18 bp, Homo sapiens
ttcctgcattcacccaga

SEQ ID NO: 158490 - DNA, 16 bp, Homo sapiens
ttcctgcatttgtgaa

SEQ ID NO: 158491 - DNA, 13 bp, Homo sapiens
ttcctgccccagg

SEQ ID NO: 158492 - DNA, 15 bp, Homo sapiens
ttcctgcctgtctcc

SEQ ID NO: 158493 - DNA, 18 bp, Homo sapiens
ttcctgcctgtctccttt

SEQ ID NO: 158494 - DNA, 21 bp, Homo sapiens
ttcctgcgggcttttccccgg

SEQ ID NO: 158495 - DNA, 21 bp, Homo sapiens
ttcctgtggatgtaaagtgat

SEQ ID NO: 158496 - DNA, 23 bp, Homo sapiens
ttccttatgtatatttaaaagaa

SEQ ID NO: 158497 - DNA, 15 bp, Homo sapiens
ttccttgaccagcag

SEQ ID NO: 158498 - DNA, 15 bp, Homo sapiens
ttccttggggcaggc

SEQ ID NO: 158499 - DNA, 18 bp, Homo sapiens
ttccttgtatttaaatat

SEQ ID NO: 158500 - DNA, 14 bp, Homo sapiens
ttcctttccccagc

SEQ ID NO: 158501 - DNA, 15 bp, Homo sapiens
ttcctttccccagcc

SEQ ID NO: 158502 - DNA, 15 bp, Homo sapiens
ttcctttgaagagga

SEQ ID NO: 158503 - DNA, 18 bp, Homo sapiens
ttccttttctaactctcc

SEQ ID NO: 158504 - DNA, 18 bp, Homo sapiens
ttcgagaccaacctgacc

SEQ ID NO: 158505 - DNA, 20 bp, Homo sapiens
ttcgccgtggctgcggcacc

SEQ ID NO: 158506 - DNA, 14 bp, Homo sapiens
ttgctgtgaggctg

SEQ ID NO: 158507 - DNA, 18 bp, Homo sapiens
ttgctgtgaggctgtcct

SEQ ID NO: 158508 - DNA, 20 bp, Homo sapiens
ttgctgtgaggctgtcctgt

SEQ ID NO: 158509 - DNA, 20 bp, Homo sapiens
ttgctgtgtcataccaggcc

SEQ ID NO: 158510 - DNA, 16 bp, Homo sapiens
ttgcttggactattat

SEQ ID NO: 158511 - DNA, 14 bp, Homo sapiens
ttggaaaagaatac

SEQ ID NO: 158512 - DNA, 15 bp, Homo sapiens
ttggagaaattattt

SEQ ID NO: 158513 - DNA, 19 bp, Homo sapiens
ttggagtgttccccttcca

SEQ ID NO: 158514 - DNA, 17 bp, Homo sapiens
ttggattattcatttaa

SEQ ID NO: 158515 - DNA, 23 bp, Homo sapiens
ttggattattcatttaaaatgat

SEQ ID NO: 158516 - DNA, 22 bp, Homo sapiens
ttggctctggagacagccccag

SEQ ID NO: 158517 - DNA, 17 bp, Homo sapiens
ttggctgtgaggcccct

SEQ ID NO: 158518 - DNA, 22 bp, Homo sapiens
ttggctttgggttgcaggacct

SEQ ID NO: 158519 - DNA, 11 bp, Homo sapiens
ttgggaatgtt

SEQ ID NO: 158520 - DNA, 12 bp, Homo sapiens
ttgggaggctga

SEQ ID NO: 158521 - DNA, 22 bp, Homo sapiens
ttggggggctgaggtgggagga

SEQ ID NO: 158522 - DNA, 14 bp, Homo sapiens
ttgggtaggcggga

SEQ ID NO: 158523 - DNA, 20 bp, Homo sapiens
ttggtgtaaagccaacaccc

SEQ ID NO: 158524 - DNA, 15 bp, Homo sapiens
ttggttctaatagaa

SEQ ID NO: 158525 - DNA, 14 bp, Homo sapiens
ttgtaaaatatagc

SEQ ID NO: 158526 - DNA, 12 bp, Homo sapiens
ttgtaaaatggt

SEQ ID NO: 158527 - DNA, 13 bp, Homo sapiens
ttgtaaaatggtg

SEQ ID NO: 158528 - DNA, 17 bp, Homo sapiens
ttgtaaatagtatttga

SEQ ID NO: 158529 - DNA, 15 bp, Homo sapiens
ttgtaaatatataaa

SEQ ID NO: 158530 - DNA, 17 bp, Homo sapiens
ttgtaaatatataaata

SEQ ID NO: 158531 - DNA, 16 bp, Homo sapiens
ttgtaaatatttatgt

SEQ ID NO: 158532 - DNA, 19 bp, Homo sapiens
ttgtaaatatttatgtaaa

SEQ ID NO: 158533 - DNA, 20 bp, Homo sapiens
ttgtaagagtggaaccaaca

SEQ ID NO: 158534 - DNA, 14 bp, Homo sapiens
ttgtaatgtcacca

SEQ ID NO: 158535 - DNA, 23 bp, Homo sapiens
ttgtaattctaaatgaatgttta

SEQ ID NO: 158536 - DNA, 19 bp, Homo sapiens
ttgtaggggtcaaagaaat

SEQ ID NO: 158537 - DNA, 14 bp, Homo sapiens
ttgtataacttctt

SEQ ID NO: 158538 - DNA, 14 bp, Homo sapiens
ttgtatagtaaagt

SEQ ID NO: 158539 - DNA, 16 bp, Homo sapiens
ttgtatagtgtaaaat

SEQ ID NO: 158540 - DNA, 19 bp, Homo sapiens
ttgtatattgtcagatatt

SEQ ID NO: 158541 - DNA, 19 bp, Homo sapiens
ttgtatcacaaatcttaac

SEQ ID NO: 158542 - DNA, 22 bp, Homo sapiens
ttgtatgaaagatggctgtgcc

SEQ ID NO: 158543 - DNA, 14 bp, Homo sapiens
ttgtattctctgag

SEQ ID NO: 158544 - DNA, 15 bp, Homo sapiens
ttgtattctctgagc

SEQ ID NO: 158545 - DNA, 21 bp, Homo sapiens
ttgtatttttttgcaagtgaa

SEQ ID NO: 158546 - DNA, 22 bp, Homo sapiens
ttgtatttttttgcaagtgaag

SEQ ID NO: 158547 - DNA, 20 bp, Homo sapiens
ttgtcaagtctctgctggcc

SEQ ID NO: 158548 - DNA, 11 bp, Homo sapiens
ttgtccccagt

SEQ ID NO: 158549 - DNA, 22 bp, Homo sapiens
ttgtctaaaatgcctcagtgta

SEQ ID NO: 158550 - DNA, 20 bp, Homo sapiens
ttgtctgaagtcactgcaca

SEQ ID NO: 158551 - DNA, 21 bp, Homo sapiens
ttgtctgaagtcactgcacag

SEQ ID NO: 158552 - DNA, 19 bp, Homo sapiens
ttgtgaagaaaaataaagt

SEQ ID NO: 158553 - DNA, 23 bp, Homo sapiens
ttgtgatcagaccataatgttac

SEQ ID NO: 158554 - DNA, 22 bp, Homo sapiens
ttgtgatgtcccaacttgtaaa

SEQ ID NO: 158555 - DNA, 18 bp, Homo sapiens
ttgtgctggatggagccc

SEQ ID NO: 158556 - DNA, 20 bp, Homo sapiens
ttgtggctgtcagcaggaag

SEQ ID NO: 158557 - DNA, 19 bp, Homo sapiens
ttgtgtaatagaaaactga

SEQ ID NO: 158558 - DNA, 18 bp, Homo sapiens
ttgtgtcccatgatccct

SEQ ID NO: 158559 - DNA, 12 bp, Homo sapiens
ttgtgtgtgtgc

SEQ ID NO: 158560 - DNA, 16 bp, Homo sapiens
ttgttaaaataactag

SEQ ID NO: 158561 - DNA, 22 bp, Homo sapiens
ttgttaatttttcctatattgc

SEQ ID NO: 158562 - DNA, 18 bp, Homo sapiens
ttgttactaactaaactc

SEQ ID NO: 158563 - DNA, 20 bp, Homo sapiens
ttgttcaataataaatattt

SEQ ID NO: 158564 - DNA, 22 bp, Homo sapiens
ttgttcaataataaatattttt

SEQ ID NO: 158565 - DNA, 14 bp, Homo sapiens
ttgttcttcttaaa

SEQ ID NO: 158566 - DNA, 18 bp, Homo sapiens
ttgtttaaaatcatttct

SEQ ID NO: 158567 - DNA, 19 bp, Homo sapiens
ttgtttgctcacctggggt

SEQ ID NO: 158568 - DNA, 19 bp, Homo sapiens
ttgttttgacggatgattg

SEQ ID NO: 158569 - DNA, 20 bp, Homo sapiens
ttgttttgcacactttgcca

SEQ ID NO: 158570 - DNA, 13 bp, Homo sapiens
ttgttttgtttta

SEQ ID NO: 158571 - DNA, 13 bp, Homo sapiens
ttgtttttccttg

SEQ ID NO: 158572 - DNA, 22 bp, Homo sapiens
ttgtttttccttgtatttaaat

SEQ ID NO: 158573 - DNA, 15 bp, Homo sapiens
tttaaaaaccttgta

SEQ ID NO: 158574 - DNA, 19 bp, Homo sapiens
tttaaaagacaagacttca

SEQ ID NO: 158575 - DNA, 20 bp, Homo sapiens
tttaaacaaaatagaagctg

SEQ ID NO: 158576 - DNA, 24 bp, Homo sapiens
tttaaagcttattaaaactcattt

SEQ ID NO: 158577 - DNA, 16 bp, Homo sapiens
tttaaaggggcagaaa

SEQ ID NO: 158578 - DNA, 16 bp, Homo sapiens
tttaaagtagattaga

SEQ ID NO: 158579 - DNA, 23 bp, Homo sapiens
tttaacaatttcctttatattta

SEQ ID NO: 158580 - DNA, 15 bp, Homo sapiens
tttaacagtcattta

SEQ ID NO: 158581 - DNA, 12 bp, Homo sapiens
tttaaccaaagg

SEQ ID NO: 158582 - DNA, 17 bp, Homo sapiens
tttaactagaatttatt

SEQ ID NO: 158583 - DNA, 15 bp, Homo sapiens
tttaagataaattat

SEQ ID NO: 158584 - DNA, 20 bp, Homo sapiens
tttaagcccatcaattatag

SEQ ID NO: 158585 - DNA, 13 bp, Homo sapiens
tttaagtatttat

SEQ ID NO: 158586 - DNA, 15 bp, Homo sapiens
tttaagtatttatat

SEQ ID NO: 158587 - DNA, 15 bp, Homo sapiens
tttaatatttaaaca

SEQ ID NO: 158588 - DNA, 18 bp, Homo sapiens
tttacaaagtgtgtatta

SEQ ID NO: 158589 - DNA, 18 bp, Homo sapiens
tttacaatttacaaagtg

SEQ ID NO: 158590 - DNA, 13 bp, Homo sapiens
tttacagagacag

SEQ ID NO: 158591 - DNA, 12 bp, Homo sapiens
tttaccaagttt

SEQ ID NO: 158592 - DNA, 23 bp, Homo sapiens
tttaccagcctccgtatttcaga

SEQ ID NO: 158593 - DNA, 18 bp, Homo sapiens
tttacccaaaaactaaat

SEQ ID NO: 158594 - DNA, 20 bp, Homo sapiens
tttactaagccacaagaaat

SEQ ID NO: 158595 - DNA, 14 bp, Homo sapiens
tttactgagcttct

SEQ ID NO: 158596 - DNA, 18 bp, Homo sapiens
tttactgagcttctctgt

SEQ ID NO: 158597 - DNA, 16 bp, Homo sapiens
tttactgcagctttgt

SEQ ID NO: 158598 - DNA, 11 bp, Homo sapiens
tttacttaaac

SEQ ID NO: 158599 - DNA, 13 bp, Homo sapiens
tttacttcttata

SEQ ID NO: 158600 - DNA, 22 bp, Homo sapiens
tttacttcttatacatttgata

SEQ ID NO: 158601 - DNA, 18 bp, Homo sapiens
tttacttgcattgaatat

SEQ ID NO: 158602 - DNA, 21 bp, Homo sapiens
tttacttgcattgaatatatt

SEQ ID NO: 158603 - DNA, 23 bp, Homo sapiens
tttagaaagaagcccaatattat

SEQ ID NO: 158604 - DNA, 14 bp, Homo sapiens
tttagaaatataat

SEQ ID NO: 158605 - DNA, 17 bp, Homo sapiens
tttaggataaaataatg

SEQ ID NO: 158606 - DNA, 20 bp, Homo sapiens
tcagcccctcctctgccacc

SEQ ID NO: 158607 - DNA, 19 bp, Homo sapiens
tcagccctccctgcccctc

SEQ ID NO: 158608 - DNA, 22 bp, Homo sapiens
tcagccctgggccccaccacct

SEQ ID NO: 158609 - DNA, 23 bp, Homo sapiens
tcagccctgggccccaccaccta

SEQ ID NO: 158610 - DNA, 13 bp, Homo sapiens
tcagcctcctgtg

SEQ ID NO: 158611 - DNA, 21 bp, Homo sapiens
tcagcctcttaaagctgcctg

SEQ ID NO: 158612 - DNA, 10 bp, Homo sapiens
tcagcctggg

SEQ ID NO: 158613 - DNA, 12 bp, Homo sapiens
tcagcctgggca

SEQ ID NO: 158614 - DNA, 14 bp, Homo sapiens
tcagcctggtgggc

SEQ ID NO: 158615 - DNA, 17 bp, Homo sapiens
tcagcctggtgggcctc

SEQ ID NO: 158616 - DNA, 17 bp, Homo sapiens
tcagcctgtctcttcca

SEQ ID NO: 158617 - DNA, 21 bp, Homo sapiens
tcagccttccccttgcccagg

SEQ ID NO: 158618 - DNA, 14 bp, Homo sapiens
tcagctactgattt

SEQ ID NO: 158619 - DNA, 15 bp, Homo sapiens
tcagctactgatttt

SEQ ID NO: 158620 - DNA, 19 bp, Homo sapiens
tcagctatttactgccaaa

SEQ ID NO: 158621 - DNA, 20 bp, Homo sapiens
tcagctatttactgccaaag

SEQ ID NO: 158622 - DNA, 14 bp, Homo sapiens
tcagctccttcctg

SEQ ID NO: 158623 - DNA, 17 bp, Homo sapiens
tcagctccttcctggag

SEQ ID NO: 158624 - DNA, 16 bp, Homo sapiens
tcagctgccccacagg

SEQ ID NO: 158625 - DNA, 21 bp, Homo sapiens
tcaggaaaactgacagaggag

SEQ ID NO: 158626 - DNA, 20 bp, Homo sapiens
tcaggaaatcaaatatgcaa

SEQ ID NO: 158627 - DNA, 21 bp, Homo sapiens
tcaggaaatcaaatatgcaaa

SEQ ID NO: 158628 - DNA, 22 bp, Homo sapiens
tcaggaaatcaaatatgcaaag

SEQ ID NO: 158629 - DNA, 17 bp, Homo sapiens
tcaggaaggatgagcat

SEQ ID NO: 158630 - DNA, 21 bp, Homo sapiens
tcaggactcagaagcctctgg

SEQ ID NO: 158631 - DNA, 15 bp, Homo sapiens
tcaggagaggggcag

SEQ ID NO: 158632 - DNA, 18 bp, Homo sapiens
tcaggagaggggcagaac

SEQ ID NO: 158633 - DNA, 20 bp, Homo sapiens
tcaggagaggggcagaacag

SEQ ID NO: 158634 - DNA, 17 bp, Homo sapiens
tcaggatcaagaaagtg

SEQ ID NO: 158635 - DNA, 16 bp, Homo sapiens
tcaggatgcccagggc

SEQ ID NO: 158636 - DNA, 17 bp, Homo sapiens
tcaggcaggtgggatgg

SEQ ID NO: 158637 - DNA, 14 bp, Homo sapiens
tcaggccacggcag

SEQ ID NO: 158638 - DNA, 13 bp, Homo sapiens
tcaggccacttga

SEQ ID NO: 158639 - DNA, 13 bp, Homo sapiens
tcaggcctgtgtg

SEQ ID NO: 158640 - DNA, 20 bp, Homo sapiens
tcaggcgatccacctgtctc

SEQ ID NO: 158641 - DNA, 21 bp, Homo sapiens
tcaggcgatccacctgtctca

SEQ ID NO: 158642 - DNA, 19 bp, Homo sapiens
tcaggctctgccctgccct

SEQ ID NO: 158643 - DNA, 15 bp, Homo sapiens
tcaggctgctggagg

SEQ ID NO: 158644 - DNA, 14 bp, Homo sapiens
tcagggacagagcc

SEQ ID NO: 158645 - DNA, 15 bp, Homo sapiens
tcagggacaggatga

SEQ ID NO: 158646 - DNA, 14 bp, Homo sapiens
tcagggacccctgc

SEQ ID NO: 158647 - DNA, 16 bp, Homo sapiens
tcagggccccagcact

SEQ ID NO: 158648 - DNA, 23 bp, Homo sapiens
tcagggccccagcactaaagcag

SEQ ID NO: 158649 - DNA, 22 bp, Homo sapiens
tcagggctgacacgtccacccc

SEQ ID NO: 158650 - DNA, 15 bp, Homo sapiens
tcaggggccagagga

SEQ ID NO: 158651 - DNA, 15 bp, Homo sapiens
tcaggtattaagaaa

SEQ ID NO: 158652 - DNA, 15 bp, Homo sapiens
tcaggtgagaagcag

SEQ ID NO: 158653 - DNA, 16 bp, Homo sapiens
tcaggtgagaagcaga

SEQ ID NO: 158654 - DNA, 13 bp, Homo sapiens
tcagtatcaggcc

SEQ ID NO: 158655 - DNA, 12 bp, Homo sapiens
tcagtccaggat

SEQ ID NO: 158656 - DNA, 20 bp, Homo sapiens
tcagtctctgagcagtgaat

SEQ ID NO: 158657 - DNA, 9 bp, Homo sapiens
tcagtgccc

SEQ ID NO: 158658 - DNA, 13 bp, Homo sapiens
tcagtgcccacca

SEQ ID NO: 158659 - DNA, 22 bp, Homo sapiens
tcagtgcccaccaacatcccat

SEQ ID NO: 158660 - DNA, 12 bp, Homo sapiens
tcagtgggagaa

SEQ ID NO: 158661 - DNA, 17 bp, Homo sapiens
tcagtgttaaatgtgat

SEQ ID NO: 158662 - DNA, 20 bp, Homo sapiens
tcagtgttccctttcctact

SEQ ID NO: 158663 - DNA, 18 bp, Homo sapiens
tcagttactcagccctgg

SEQ ID NO: 158664 - DNA, 20 bp, Homo sapiens
tcagtttcctggtctgtaga

SEQ ID NO: 158665 - DNA, 18 bp, Homo sapiens
tcagtttgtcctgtagag

SEQ ID NO: 158666 - DNA, 16 bp, Homo sapiens
tcataaaataaagtat

SEQ ID NO: 158667 - DNA, 21 bp, Homo sapiens
tcataaaataaagtatatata

SEQ ID NO: 158668 - DNA, 18 bp, Homo sapiens
tcataagatatttttcat

SEQ ID NO: 158669 - DNA, 15 bp, Homo sapiens
tcataccaatgaaaa

SEQ ID NO: 158670 - DNA, 14 bp, Homo sapiens
tcatacgtccacca

SEQ ID NO: 158671 - DNA, 15 bp, Homo sapiens
tcatacgtccaccat

SEQ ID NO: 158672 - DNA, 20 bp, Homo sapiens
tcataggttgccaataatac

SEQ ID NO: 158673 - DNA, 23 bp, Homo sapiens
tcatatttacttcttatacattt

SEQ ID NO: 158674 - DNA, 21 bp, Homo sapiens
tcatcagcatacctttattgt

SEQ ID NO: 158675 - DNA, 13 bp, Homo sapiens
tcatcataaaata

SEQ ID NO: 158676 - DNA, 18 bp, Homo sapiens
tcatcattctctgtctca

SEQ ID NO: 158677 - DNA, 20 bp, Homo sapiens
tcatcattctctgtctcatc

SEQ ID NO: 158678 - DNA, 14 bp, Homo sapiens
tcatccatcatcat

SEQ ID NO: 158679 - DNA, 17 bp, Homo sapiens
tcatccatcatcatgtg

SEQ ID NO: 158680 - DNA, 14 bp, Homo sapiens
tcatccattctatt

SEQ ID NO: 158681 - DNA, 14 bp, Homo sapiens
tcatccgaggcagg

SEQ ID NO: 158682 - DNA, 11 bp, Homo sapiens
tcatctatttc

SEQ ID NO: 158683 - DNA, 14 bp, Homo sapiens
tcatctatttctga

SEQ ID NO: 158684 - DNA, 15 bp, Homo sapiens
tcatctatttctgag

SEQ ID NO: 158685 - DNA, 14 bp, Homo sapiens
tcatctgtgtgaaa

SEQ ID NO: 158686 - DNA, 17 bp, Homo sapiens
tcatctgtgtgaaaatg

SEQ ID NO: 158687 - DNA, 19 bp, Homo sapiens
tcatctgtgtgaaaatggg

SEQ ID NO: 158688 - DNA, 22 bp, Homo sapiens
tcatcttgaccaagcaggaagc

SEQ ID NO: 158689 - DNA, 15 bp, Homo sapiens
tcatgaaatatgcat

SEQ ID NO: 158690 - DNA, 14 bp, Homo sapiens
tcatgacatgttat

SEQ ID NO: 158691 - DNA, 17 bp, Homo sapiens
tcatgacatgttatata

SEQ ID NO: 158692 - DNA, 16 bp, Homo sapiens
tcatgagctgagcagg

SEQ ID NO: 158693 - DNA, 15 bp, Homo sapiens
tcatgatctccctgc

SEQ ID NO: 158694 - DNA, 17 bp, Homo sapiens
tcatgatctccctgccg

SEQ ID NO: 158695 - DNA, 17 bp, Homo sapiens
tcatgatttcatttcaa

SEQ ID NO: 158696 - DNA, 22 bp, Homo sapiens
tcatgctaattatataatattt

SEQ ID NO: 158697 - DNA, 18 bp, Homo sapiens
tcatgcttgtgttataac

SEQ ID NO: 158698 - DNA, 14 bp, Homo sapiens
tcatggcttaatgt

SEQ ID NO: 158699 - DNA, 14 bp, Homo sapiens
tcatgtaaactgtg

SEQ ID NO: 158700 - DNA, 17 bp, Homo sapiens
tcatgtcaggcctgtgt

SEQ ID NO: 158701 - DNA, 21 bp, Homo sapiens
tcatgtccccaaacctgcaag

SEQ ID NO: 158702 - DNA, 18 bp, Homo sapiens
tcatgtggaatataaaga

SEQ ID NO: 158703 - DNA, 20 bp, Homo sapiens
tcatgtgtacaaaagtttca

SEQ ID NO: 158704 - DNA, 12 bp, Homo sapiens
tcatgtgtgtcc

SEQ ID NO: 158705 - DNA, 21 bp, Homo sapiens
tcatgttccttcaagatcatg

SEQ ID NO: 158706 - DNA, 20 bp, Homo sapiens
tcattatctcaaaactgcac

SEQ ID NO: 158707 - DNA, 17 bp, Homo sapiens
tcattccaacagtgagt

SEQ ID NO: 158708 - DNA, 14 bp, Homo sapiens
tcattccccaggtg

SEQ ID NO: 158709 - DNA, 23 bp, Homo sapiens
tcattccccaggtggctgaccca

SEQ ID NO: 158710 - DNA, 17 bp, Homo sapiens
tcattcctgcctgtctc

SEQ ID NO: 158711 - DNA, 19 bp, Homo sapiens
tcattcctgcctgtctcct

SEQ ID NO: 158712 - DNA, 14 bp, Homo sapiens
tcattcctgtattc

SEQ ID NO: 158713 - DNA, 23 bp, Homo sapiens
tcattccttgagaaaaacaatga

SEQ ID NO: 158714 - DNA, 14 bp, Homo sapiens
tcattctcctgcct

SEQ ID NO: 158715 - DNA, 15 bp, Homo sapiens
tcattctcctgcctg

SEQ ID NO: 158716 - DNA, 14 bp, Homo sapiens
tcattctctgtctc

SEQ ID NO: 158717 - DNA, 16 bp, Homo sapiens
tcattctctgtctcat

SEQ ID NO: 158718 - DNA, 19 bp, Homo sapiens
tcatttgcccttaaggaca

SEQ ID NO: 158719 - DNA, 21 bp, Homo sapiens
tcattttatatgtcaaagcag

SEQ ID NO: 158720 - DNA, 14 bp, Homo sapiens
tcatttttgaatac

SEQ ID NO: 158721 - DNA, 20 bp, Homo sapiens
tccaaaaagattttcagaaa

SEQ ID NO: 158722 - DNA, 19 bp, Homo sapiens
tccaaaataattttaagaa

SEQ ID NO: 158723 - DNA, 19 bp, Homo sapiens
tccaaactaccttccagtt

SEQ ID NO: 158724 - DNA, 14 bp, Homo sapiens
tccaaagaaatgta

SEQ ID NO: 158725 - DNA, 18 bp, Homo sapiens
tgaaaacactgtgcacat

SEQ ID NO: 158726 - DNA, 14 bp, Homo sapiens
tgaaaacccagaga

SEQ ID NO: 158727 - DNA, 20 bp, Homo sapiens
tgaaaagaaaaatgagcctg

SEQ ID NO: 158728 - DNA, 15 bp, Homo sapiens
tgaaaagactccaaa

SEQ ID NO: 158729 - DNA, 21 bp, Homo sapiens
tgaaaatgggttggtgcttct

SEQ ID NO: 158730 - DNA, 14 bp, Homo sapiens
tgaaaatgtcttgt

SEQ ID NO: 158731 - DNA, 15 bp, Homo sapiens
tgaaaatgtcttgtg

SEQ ID NO: 158732 - DNA, 17 bp, Homo sapiens
tgaaaattgtatgttaa

SEQ ID NO: 158733 - DNA, 18 bp, Homo sapiens
tgaaaccctgtctctact

SEQ ID NO: 158734 - DNA, 22 bp, Homo sapiens
tgaaactgagatgtgaacacat

SEQ ID NO: 158735 - DNA, 21 bp, Homo sapiens
tgaaagaggctgaggcctgga

SEQ ID NO: 158736 - DNA, 19 bp, Homo sapiens
tgaaagatggctgtgcctc

SEQ ID NO: 158737 - DNA, 21 bp, Homo sapiens
tgaaagatggctgtgcctctg

SEQ ID NO: 158738 - DNA, 18 bp, Homo sapiens
tgaaagccctgagctttc

SEQ ID NO: 158739 - DNA, 11 bp, Homo sapiens
tgaaagctgtg

SEQ ID NO: 158740 - DNA, 18 bp, Homo sapiens
tgaaaggaagctccactg

SEQ ID NO: 158741 - DNA, 23 bp, Homo sapiens
tgaaagtacatttggagacacaa

SEQ ID NO: 158742 - DNA, 23 bp, Homo sapiens
tgaaataagccagacatcaacag

SEQ ID NO: 158743 - DNA, 21 bp, Homo sapiens
tgaaatttattagttaatata

SEQ ID NO: 158744 - DNA, 18 bp, Homo sapiens
tgaaattttctagacttt

SEQ ID NO: 158745 - DNA, 19 bp, Homo sapiens
tgaaattttctagactttc

SEQ ID NO: 158746 - DNA, 18 bp, Homo sapiens
tgaacaaattgaactctt

SEQ ID NO: 158747 - DNA, 19 bp, Homo sapiens
tgaacaagttgtttcattg

SEQ ID NO: 158748 - DNA, 14 bp, Homo sapiens
tgaacacatcagct

SEQ ID NO: 158749 - DNA, 14 bp, Homo sapiens
tgaacactggggga

SEQ ID NO: 158750 - DNA, 22 bp, Homo sapiens
tgaacccatatttgtacaccaa

SEQ ID NO: 158751 - DNA, 17 bp, Homo sapiens
tgaacctgatgctgact

SEQ ID NO: 158752 - DNA, 13 bp, Homo sapiens
tgaacggggagaa

SEQ ID NO: 158753 - DNA, 16 bp, Homo sapiens
tgaacggggagaaaag

SEQ ID NO: 158754 - DNA, 16 bp, Homo sapiens
tgaactaataaaagca

SEQ ID NO: 158755 - DNA, 21 bp, Homo sapiens
tgaactacgcttgctcatttt

SEQ ID NO: 158756 - DNA, 14 bp, Homo sapiens
tgaactcctgggct

SEQ ID NO: 158757 - DNA, 17 bp, Homo sapiens
tgaactgaagtttcaca

SEQ ID NO: 158758 - DNA, 21 bp, Homo sapiens
tgcccaggagagccagccctc

SEQ ID NO: 158759 - DNA, 19 bp, Homo sapiens
tgcccagggccactctgcc

SEQ ID NO: 158760 - DNA, 17 bp, Homo sapiens
tgcccagggctcagcct

SEQ ID NO: 158761 - DNA, 21 bp, Homo sapiens
tgccccatcagtgctccctca

SEQ ID NO: 158762 - DNA, 14 bp, Homo sapiens
tgccccggccacct

SEQ ID NO: 158763 - DNA, 21 bp, Homo sapiens
tgccccgtgcagactggaggg

SEQ ID NO: 158764 - DNA, 13 bp, Homo sapiens
tgcccctcccttc

SEQ ID NO: 158765 - DNA, 23 bp, Homo sapiens
tgcccgtaaacacgcctgcaaac

SEQ ID NO: 158766 - DNA, 14 bp, Homo sapiens
tgccctagctccac

SEQ ID NO: 158767 - DNA, 18 bp, Homo sapiens
tgccctaggctccgtcag

SEQ ID NO: 158768 - DNA, 23 bp, Homo sapiens
tgccctcgggcgagtcactgcct

SEQ ID NO: 158769 - DNA, 13 bp, Homo sapiens
tgccctgggccac

SEQ ID NO: 158770 - DNA, 12 bp, Homo sapiens
tgccctggtgct

SEQ ID NO: 158771 - DNA, 14 bp, Homo sapiens
tgccctggtgctgc

SEQ ID NO: 158772 - DNA, 16 bp, Homo sapiens
tgccctggtgctgcca

SEQ ID NO: 158773 - DNA, 15 bp, Homo sapiens
tgcccttaaatcata

SEQ ID NO: 158774 - DNA, 15 bp, Homo sapiens
tgccgacctcgtcct

SEQ ID NO: 158775 - DNA, 13 bp, Homo sapiens
tgccgcaccccag

SEQ ID NO: 158776 - DNA, 18 bp, Homo sapiens
tgccgcaccccagagtgt

SEQ ID NO: 158777 - DNA, 16 bp, Homo sapiens
tgccgcctcaatgtgg

SEQ ID NO: 158778 - DNA, 15 bp, Homo sapiens
tgccggccctggggc

SEQ ID NO: 158779 - DNA, 20 bp, Homo sapiens
tgccgtggattgcacgtggc

SEQ ID NO: 158780 - DNA, 22 bp, Homo sapiens
tgccgtggattgcacgtggcct

SEQ ID NO: 158781 - DNA, 19 bp, Homo sapiens
tgccgttactctccaacct

SEQ ID NO: 158782 - DNA, 15 bp, Homo sapiens
tgcctaagtggctgc

SEQ ID NO: 158783 - DNA, 17 bp, Homo sapiens
tgcctaagtggctgctg

SEQ ID NO: 158784 - DNA, 12 bp, Homo sapiens
tgcctactgcat

SEQ ID NO: 158785 - DNA, 14 bp, Homo sapiens
tgcctaggctgacc

SEQ ID NO: 158786 - DNA, 18 bp, Homo sapiens
tgcctaggctgaccttga

SEQ ID NO: 158787 - DNA, 24 bp, Homo sapiens
tgcctcaatgtgaatcagacccta

SEQ ID NO: 158788 - DNA, 15 bp, Homo sapiens
tgcctcagtgtattt

SEQ ID NO: 158789 - DNA, 18 bp, Homo sapiens
tgcctccaccgctgccta

SEQ ID NO: 158790 - DNA, 20 bp, Homo sapiens
tgcctccaccgctgcctaag

SEQ ID NO: 158791 - DNA, 21 bp, Homo sapiens
tgcctcggcttttctcagctg

SEQ ID NO: 158792 - DNA, 23 bp, Homo sapiens
tgcctctacctgacactcccttg

SEQ ID NO: 158793 - DNA, 18 bp, Homo sapiens
tgcctctgcctgtctccc

SEQ ID NO: 158794 - DNA, 13 bp, Homo sapiens
tgcctctgggact

SEQ ID NO: 158795 - DNA, 21 bp, Homo sapiens
tgcctcttctctactctaggg

SEQ ID NO: 158796 - DNA, 13 bp, Homo sapiens
tgcctcttctggg

SEQ ID NO: 158797 - DNA, 16 bp, Homo sapiens
tgcctgaaccttccat

SEQ ID NO: 158798 - DNA, 13 bp, Homo sapiens
tgcctgcattctg

SEQ ID NO: 158799 - DNA, 16 bp, Homo sapiens
tgcctgggtggggctg

SEQ ID NO: 158800 - DNA, 17 bp, Homo sapiens
tgcctgggtggggctgc

SEQ ID NO: 158801 - DNA, 17 bp, Homo sapiens
tgcctggtcacagggca

SEQ ID NO: 158802 - DNA, 18 bp, Homo sapiens
tgcctgtaatcacagcta

SEQ ID NO: 158803 - DNA, 23 bp, Homo sapiens
tgcctgtagcccactctgctcgc

SEQ ID NO: 158804 - DNA, 13 bp, Homo sapiens
tgcctgtagttag

SEQ ID NO: 158805 - DNA, 18 bp, Homo sapiens
tgcctgtagttaggaaat

SEQ ID NO: 158806 - DNA, 16 bp, Homo sapiens
tgcctgtgaggcaggg

SEQ ID NO: 158807 - DNA, 17 bp, Homo sapiens
tgcctgtgaggcagggg

SEQ ID NO: 158808 - DNA, 14 bp, Homo sapiens
tgcctgtgtcttct

SEQ ID NO: 158809 - DNA, 19 bp, Homo sapiens
tgccttacctcctgcccag

SEQ ID NO: 158810 - DNA, 23 bp, Homo sapiens
tgccttacctcctgcccaggaga

SEQ ID NO: 158811 - DNA, 21 bp, Homo sapiens
tgccttagaacctttcttaca

SEQ ID NO: 158812 - DNA, 18 bp, Homo sapiens
tgccttcagctctacagc

SEQ ID NO: 158813 - DNA, 14 bp, Homo sapiens
tgccttcctcctgg

SEQ ID NO: 158814 - DNA, 15 bp, Homo sapiens
tgccttcctcctggg

SEQ ID NO: 158815 - DNA, 17 bp, Homo sapiens
tgccttcctcctgggcc

SEQ ID NO: 158816 - DNA, 16 bp, Homo sapiens
tgccttctacttttaa

SEQ ID NO: 158817 - DNA, 21 bp, Homo sapiens
tgccttcttattctcactcca

SEQ ID NO: 158818 - DNA, 20 bp, Homo sapiens
tgccttttttcacggaagtt

SEQ ID NO: 158819 - DNA, 17 bp, Homo sapiens
tgcgagtgtgtgcatgt

SEQ ID NO: 158820 - DNA, 14 bp, Homo sapiens
tgcggaatcagctt

SEQ ID NO: 158821 - DNA, 22 bp, Homo sapiens
tgcggaccccagctgtgagcct

SEQ ID NO: 158822 - DNA, 13 bp, Homo sapiens
tgcgggctgggca

SEQ ID NO: 158823 - DNA, 14 bp, Homo sapiens
tgcgggctgggcag

SEQ ID NO: 158824 - DNA, 17 bp, Homo sapiens
tgcgggcttttccccgg

SEQ ID NO: 158825 - DNA, 18 bp, Homo sapiens
tgcgtgtgcgtgcatgtg

SEQ ID NO: 158826 - DNA, 17 bp, Homo sapiens
tgcgtgtgtccatgtgt

SEQ ID NO: 158827 - DNA, 19 bp, Homo sapiens
tgcgtgtgtccatgtgtgt

SEQ ID NO: 158828 - DNA, 22 bp, Homo sapiens
tgctaaagaaaaagtcatccaa

SEQ ID NO: 158829 - DNA, 17 bp, Homo sapiens
tgctaacttggagcccc

SEQ ID NO: 158830 - DNA, 17 bp, Homo sapiens
tgctacaaaaacacagc

SEQ ID NO: 158831 - DNA, 18 bp, Homo sapiens
tgctacaaaaacacagca

SEQ ID NO: 158832 - DNA, 19 bp, Homo sapiens
tgctacaacttcagcagta

SEQ ID NO: 158833 - DNA, 15 bp, Homo sapiens
tgctacctcactggg

SEQ ID NO: 158834 - DNA, 14 bp, Homo sapiens
tgctactgccaacc

SEQ ID NO: 158835 - DNA, 15 bp, Homo sapiens
tgctactgccaacct

SEQ ID NO: 158836 - DNA, 19 bp, Homo sapiens
tgctagatgtgcaaatgca

SEQ ID NO: 158837 - DNA, 20 bp, Homo sapiens
tgctagcacttggagccaag

SEQ ID NO: 158838 - DNA, 16 bp, Homo sapiens
tgctaggttaattcca

SEQ ID NO: 158839 - DNA, 12 bp, Homo sapiens
tgctatggggag

SEQ ID NO: 158840 - DNA, 19 bp, Homo sapiens
tgctatggggagaaaagac

SEQ ID NO: 158841 - DNA, 19 bp, Homo sapiens
tgctcaaaatttgaagaat

SEQ ID NO: 158842 - DNA, 14 bp, Homo sapiens
tgctcaagaaacaa

SEQ ID NO: 158843 - DNA, 12 bp, Homo sapiens
tgctcacctggg

SEQ ID NO: 158844 - DNA, 14 bp, Homo sapiens
tgctcaggactcag

SEQ ID NO: 158845 - DNA, 17 bp, Homo sapiens
tgctcaggactcagaag

SEQ ID NO: 158846 - DNA, 23 bp, Homo sapiens
tgctcaggactcagaagcctctg

SEQ ID NO: 158847 - DNA, 19 bp, Homo sapiens
tgctcaggggcgtgtggct

SEQ ID NO: 158848 - DNA, 15 bp, Homo sapiens
tgctcatcattctct

SEQ ID NO: 158849 - DNA, 23 bp, Homo sapiens
tgctcatcattctctgtctcatc

SEQ ID NO: 158850 - DNA, 16 bp, Homo sapiens
tgctccccagccctgg

SEQ ID NO: 158851 - DNA, 18 bp, Homo sapiens
tgctccccagccctggct

SEQ ID NO: 158852 - DNA, 22 bp, Homo sapiens
tgctccccagccctggctctgc

SEQ ID NO: 158853 - DNA, 14 bp, Homo sapiens
tgctcccctccctc

SEQ ID NO: 158854 - DNA, 16 bp, Homo sapiens
tgctcccctccctcct

SEQ ID NO: 158855 - DNA, 16 bp, Homo sapiens
tgctccctaccacctc

SEQ ID NO: 158856 - DNA, 15 bp, Homo sapiens
tgctccctcacatgt

SEQ ID NO: 158857 - DNA, 14 bp, Homo sapiens
tgctccctgaagcc

SEQ ID NO: 158858 - DNA, 18 bp, Homo sapiens
tgctccgcctctgctggc

SEQ ID NO: 158859 - DNA, 13 bp, Homo sapiens
tgctccgtgcttg

SEQ ID NO: 158860 - DNA, 11 bp, Homo sapiens
tgctcctccag

SEQ ID NO: 158861 - DNA, 16 bp, Homo sapiens
tgctcctccagggcca

SEQ ID NO: 158862 - DNA, 21 bp, Homo sapiens
tgctccttccaacaggagctg

SEQ ID NO: 158863 - DNA, 12 bp, Homo sapiens
tgctccttgggc

SEQ ID NO: 158864 - DNA, 15 bp, Homo sapiens
tgctccttgggccct

SEQ ID NO: 158865 - DNA, 18 bp, Homo sapiens
tgctccttgggccctttg

SEQ ID NO: 158866 - DNA, 20 bp, Homo sapiens
tgctctatgtgcttgtaaaa

SEQ ID NO: 158867 - DNA, 12 bp, Homo sapiens
tgctctcccctg

SEQ ID NO: 158868 - DNA, 13 bp, Homo sapiens
tgctctctgcagc

SEQ ID NO: 158869 - DNA, 14 bp, Homo sapiens
tgctctctgcagcc

SEQ ID NO: 158870 - DNA, 15 bp, Homo sapiens
tgctctctgcagcca

SEQ ID NO: 158871 - DNA, 13 bp, Homo sapiens
tgctctgatccct

SEQ ID NO: 158872 - DNA, 16 bp, Homo sapiens
tgctctgatccctcta

SEQ ID NO: 158873 - DNA, 22 bp, Homo sapiens
tgctctgcgtgtcacctgtgct

SEQ ID NO: 158874 - DNA, 16 bp, Homo sapiens
tgctctggaagagagg

SEQ ID NO: 158875 - DNA, 12 bp, Homo sapiens
tgctctttctct

SEQ ID NO: 158876 - DNA, 15 bp, Homo sapiens
tgctctttctctgcc

SEQ ID NO: 158877 - DNA, 18 bp, Homo sapiens
tgctctttctctgccagt

SEQ ID NO: 158878 - DNA, 21 bp, Homo sapiens
tgctctttctctgccagtgac

SEQ ID NO: 158879 - DNA, 17 bp, Homo sapiens
tgctgaaacaacaaata

SEQ ID NO: 158880 - DNA, 18 bp, Homo sapiens
tgctgaatacagaggcaa

SEQ ID NO: 158881 - DNA, 23 bp, Homo sapiens
tgctgaatacagaggcaactgca

SEQ ID NO: 158882 - DNA, 17 bp, Homo sapiens
tgctgactgttttctct

SEQ ID NO: 158883 - DNA, 24 bp, Homo sapiens
tgctgactgttttctcttgagagg

SEQ ID NO: 158884 - DNA, 15 bp, Homo sapiens
tgctgagaaaacatg

SEQ ID NO: 158885 - DNA, 19 bp, Homo sapiens
tgctgagggaccagccaag

SEQ ID NO: 158886 - DNA, 15 bp, Homo sapiens
tgctgccacacttca

SEQ ID NO: 158887 - DNA, 14 bp, Homo sapiens
tgctgcccagcctc

SEQ ID NO: 158888 - DNA, 16 bp, Homo sapiens
tgctgcccagcctcca

SEQ ID NO: 158889 - DNA, 17 bp, Homo sapiens
tgctgcccgtcttcagc

SEQ ID NO: 158890 - DNA, 16 bp, Homo sapiens
tgctgccgcctcccag

SEQ ID NO: 158891 - DNA, 20 bp, Homo sapiens
tgctgccgcctcccagcctg

SEQ ID NO: 158892 - DNA, 14 bp, Homo sapiens
tgctgcctccagaa

SEQ ID NO: 158893 - DNA, 22 bp, Homo sapiens
tgctgctaatcttcagggcact

SEQ ID NO: 158894 - DNA, 19 bp, Homo sapiens
tgctgctatcctgccaaaa

SEQ ID NO: 158895 - DNA, 16 bp, Homo sapiens
tgctggaattctaaca

SEQ ID NO: 158896 - DNA, 17 bp, Homo sapiens
tgctggaattctaacaa

SEQ ID NO: 158897 - DNA, 22 bp, Homo sapiens
tgtactgagccttgtaattcta

SEQ ID NO: 158898 - DNA, 16 bp, Homo sapiens
tgtacttgatgacaga

SEQ ID NO: 158899 - DNA, 23 bp, Homo sapiens
tgtagaaaatttgttattttgca

SEQ ID NO: 158900 - DNA, 14 bp, Homo sapiens
tgtagagcttctgg

SEQ ID NO: 158901 - DNA, 16 bp, Homo sapiens
tgtagaggagaaactg

SEQ ID NO: 158902 - DNA, 11 bp, Homo sapiens
tgtagcagtga

SEQ ID NO: 158903 - DNA, 23 bp, Homo sapiens
tgtagcagtgagaaaaagctcct

SEQ ID NO: 158904 - DNA, 17 bp, Homo sapiens
tgtagcccactctgctc

SEQ ID NO: 158905 - DNA, 18 bp, Homo sapiens
tgtagggtaaggtgcctt

SEQ ID NO: 158906 - DNA, 17 bp, Homo sapiens
tgtagggttataataat

SEQ ID NO: 158907 - DNA, 12 bp, Homo sapiens
tgtagttaggaa

SEQ ID NO: 158908 - DNA, 13 bp, Homo sapiens
tgtagttaggaaa

SEQ ID NO: 158909 - DNA, 14 bp, Homo sapiens
tgtagttaggaaat

SEQ ID NO: 158910 - DNA, 18 bp, Homo sapiens
tgtataagtaagaaaata

SEQ ID NO: 158911 - DNA, 20 bp, Homo sapiens
tgtataagtaagaaaatatt

SEQ ID NO: 158912 - DNA, 15 bp, Homo sapiens
tgtatagtactggca

SEQ ID NO: 158913 - DNA, 15 bp, Homo sapiens
tgtatatacaataac

SEQ ID NO: 158914 - DNA, 16 bp, Homo sapiens
tgtatatacaataaca

SEQ ID NO: 158915 - DNA, 18 bp, Homo sapiens
tgtatatacaataacata

SEQ ID NO: 158916 - DNA, 17 bp, Homo sapiens
tgtatatatctgcttca

SEQ ID NO: 158917 - DNA, 18 bp, Homo sapiens
tgtatatcagaaaaggga

SEQ ID NO: 158918 - DNA, 18 bp, Homo sapiens
tgtatatcctttctaaca

SEQ ID NO: 158919 - DNA, 22 bp, Homo sapiens
tgtatattttaagaaataacag

SEQ ID NO: 158920 - DNA, 21 bp, Homo sapiens
tgtatcaggtgcccatccctg

SEQ ID NO: 158921 - DNA, 21 bp, Homo sapiens
tgtatcccccccctgtatagt

SEQ ID NO: 158922 - DNA, 22 bp, Homo sapiens
tgtatcccccccctgtatagtt

SEQ ID NO: 158923 - DNA, 22 bp, Homo sapiens
tgtatgaaagatggctgtgcct

SEQ ID NO: 158924 - DNA, 17 bp, Homo sapiens
tgtatggaatacagtgt

SEQ ID NO: 158925 - DNA, 18 bp, Homo sapiens
tgtatggaatacagtgtt

SEQ ID NO: 158926 - DNA, 22 bp, Homo sapiens
tgtatgtaaatgtgcattcttt

SEQ ID NO: 158927 - DNA, 15 bp, Homo sapiens
tgtatgtttacatat

SEQ ID NO: 158928 - DNA, 21 bp, Homo sapiens
tgtattaaaaaaaacaaaaag

SEQ ID NO: 158929 - DNA, 21 bp, Homo sapiens
tgtattcacccgtccagacct

SEQ ID NO: 158930 - DNA, 22 bp, Homo sapiens
tgtattcattgaagtcagatgt

SEQ ID NO: 158931 - DNA, 13 bp, Homo sapiens
tgtattctctgag

SEQ ID NO: 158932 - DNA, 14 bp, Homo sapiens
tgtattttgtattg

SEQ ID NO: 158933 - DNA, 14 bp, Homo sapiens
tgtcaaaaaaaaaa

SEQ ID NO: 158934 - DNA, 17 bp, Homo sapiens
tgtcaagtctctgctgg

SEQ ID NO: 158935 - DNA, 18 bp, Homo sapiens
tgtcaagtctctgctggc

SEQ ID NO: 158936 - DNA, 13 bp, Homo sapiens
tgtcacagggcca

SEQ ID NO: 158937 - DNA, 19 bp, Homo sapiens
tgtcaccaccttcccagct

SEQ ID NO: 158938 - DNA, 22 bp, Homo sapiens
tgtcaccctccacctcttcacc

SEQ ID NO: 158939 - DNA, 14 bp, Homo sapiens
tgtcacctgtgctt

SEQ ID NO: 158940 - DNA, 17 bp, Homo sapiens
tgtcactgtttctctgc

SEQ ID NO: 158941 - DNA, 18 bp, Homo sapiens
tgtcactgtttctctgct

SEQ ID NO: 158942 - DNA, 23 bp, Homo sapiens
tgtcagacatccatgtttgtaaa

SEQ ID NO: 158943 - DNA, 13 bp, Homo sapiens
tgtcagcaaaaag

SEQ ID NO: 158944 - DNA, 14 bp, Homo sapiens
tgtcagcaaaaagc

SEQ ID NO: 158945 - DNA, 22 bp, Homo sapiens
tgtcagcaaaaagcaaaatcat

SEQ ID NO: 158946 - DNA, 23 bp, Homo sapiens
tgtcagcaaaaagcaaaatcatt

SEQ ID NO: 158947 - DNA, 13 bp, Homo sapiens
tgtcagcaggaag

SEQ ID NO: 158948 - DNA, 21 bp, Homo sapiens
tgtcagctcccctcggagaag

SEQ ID NO: 158949 - DNA, 14 bp, Homo sapiens
tgtcaggcctgtgt

SEQ ID NO: 158950 - DNA, 14 bp, Homo sapiens
tgtcataagaatga

SEQ ID NO: 158951 - DNA, 15 bp, Homo sapiens
tgtcataagaatgaa

SEQ ID NO: 158952 - DNA, 23 bp, Homo sapiens
tgtcataccaggccgccccagcc

SEQ ID NO: 158953 - DNA, 13 bp, Homo sapiens
tgtcatcagaact

SEQ ID NO: 158954 - DNA, 15 bp, Homo sapiens
tgtcatcagaagata

SEQ ID NO: 158955 - DNA, 16 bp, Homo sapiens
tgtcatcagaagataa

SEQ ID NO: 158956 - DNA, 17 bp, Homo sapiens
tgtccaagtgtgtgtgc

SEQ ID NO: 158957 - DNA, 14 bp, Homo sapiens
tgtccaatcctatg

SEQ ID NO: 158958 - DNA, 18 bp, Homo sapiens
tgtccacagatgcctcca

SEQ ID NO: 158959 - DNA, 19 bp, Homo sapiens
tgtccacagatgcctccac

SEQ ID NO: 158960 - DNA, 14 bp, Homo sapiens
tgtccacctggccc

SEQ ID NO: 158961 - DNA, 17 bp, Homo sapiens
tgtccacgactgtctcc

SEQ ID NO: 158962 - DNA, 21 bp, Homo sapiens
tgtccagagagcaactctgag

SEQ ID NO: 158963 - DNA, 21 bp, Homo sapiens
tgtccaggcactgctgcccag

SEQ ID NO: 158964 - DNA, 17 bp, Homo sapiens
tgtccagggccctgagc

SEQ ID NO: 158965 - DNA, 15 bp, Homo sapiens
tgtccatgtgtgtgc

SEQ ID NO: 158966 - DNA, 16 bp, Homo sapiens
tgtccatgtgtgtgca

SEQ ID NO: 158967 - DNA, 17 bp, Homo sapiens
tgtccattgtccaatcc

SEQ ID NO: 158968 - DNA, 16 bp, Homo sapiens
tgtcccaacttgtaaa

SEQ ID NO: 158969 - DNA, 17 bp, Homo sapiens
tgtcccactcaagccaa

SEQ ID NO: 158970 - DNA, 17 bp, Homo sapiens
tgtcccatgatccctgt

SEQ ID NO: 158971 - DNA, 18 bp, Homo sapiens
tgtcccatgatccctgtg

SEQ ID NO: 158972 - DNA, 18 bp, Homo sapiens
tgtccccaaacctgcaag

SEQ ID NO: 158973 - DNA, 23 bp, Homo sapiens
tgtcccctatggggatggtccac

SEQ ID NO: 158974 - DNA, 21 bp, Homo sapiens
tgtcccctcctcactcccttc

SEQ ID NO: 158975 - DNA, 22 bp, Homo sapiens
tgtccctaccgagtctcttctc

SEQ ID NO: 158976 - DNA, 21 bp, Homo sapiens
tgtccctcactgttgaatttt

SEQ ID NO: 158977 - DNA, 12 bp, Homo sapiens
tgtccctcccac

SEQ ID NO: 158978 - DNA, 13 bp, Homo sapiens
tgtccctcccacc

SEQ ID NO: 158979 - DNA, 17 bp, Homo sapiens
tgtccctcccacctctg

SEQ ID NO: 158980 - DNA, 16 bp, Homo sapiens
tgtccctgtcaccaag

SEQ ID NO: 158981 - DNA, 16 bp, Homo sapiens
tgtcccttaaacaaaa

SEQ ID NO: 158982 - DNA, 20 bp, Homo sapiens
tgtccctttctgtgtgaaga

SEQ ID NO: 158983 - DNA, 14 bp, Homo sapiens
tgtccgagctttga

SEQ ID NO: 158984 - DNA, 20 bp, Homo sapiens
tgtcctaggagtatcctcat

SEQ ID NO: 158985 - DNA, 15 bp, Homo sapiens
tgtcctcactgctcc

SEQ ID NO: 158986 - DNA, 14 bp, Homo sapiens
tgtcctcagcttct

SEQ ID NO: 158987 - DNA, 11 bp, Homo sapiens
tgtcctcctcg

SEQ ID NO: 158988 - DNA, 16 bp, Homo sapiens
tgtcctgtacattgtg

SEQ ID NO: 158989 - DNA, 20 bp, Homo sapiens
tgtcctgtagaggttttgtt

SEQ ID NO: 158990 - DNA, 16 bp, Homo sapiens
tgtccttgcacctgca

SEQ ID NO: 158991 - DNA, 13 bp, Homo sapiens
tgtcgcctctgca

SEQ ID NO: 158992 - DNA, 18 bp, Homo sapiens
tgtctaaatttgaatgtt

SEQ ID NO: 158993 - DNA, 18 bp, Homo sapiens
tgtctcaagagggcactg

SEQ ID NO: 158994 - DNA, 21 bp, Homo sapiens
tgtctcaagagggcactggtg

SEQ ID NO: 158995 - DNA, 15 bp, Homo sapiens
tgtctcagcctccca

SEQ ID NO: 158996 - DNA, 17 bp, Homo sapiens
tgtctcatccatcatca

SEQ ID NO: 158997 - DNA, 22 bp, Homo sapiens
tgtctcctttcaccccagggcc

SEQ ID NO: 158998 - DNA, 17 bp, Homo sapiens
tgtctctactaaaaata

SEQ ID NO: 158999 - DNA, 13 bp, Homo sapiens
tgtctctcagaat

SEQ ID NO: 159000 - DNA, 19 bp, Homo sapiens
tgtctctggcgtgtgggta

SEQ ID NO: 159001 - DNA, 21 bp, Homo sapiens
tgtgcctcggcttttctcagc

SEQ ID NO: 159002 - DNA, 15 bp, Homo sapiens
tgtgcctctgggact

SEQ ID NO: 159003 - DNA, 16 bp, Homo sapiens
tgtgcctctgggactg

SEQ ID NO: 159004 - DNA, 21 bp, Homo sapiens
tgtgcgtgtgtccatgtgtgt

SEQ ID NO: 159005 - DNA, 16 bp, Homo sapiens
tgtgctcaaaatttga

SEQ ID NO: 159006 - DNA, 20 bp, Homo sapiens
tgtgctcaaaatttgaagaa

SEQ ID NO: 159007 - DNA, 17 bp, Homo sapiens
tgtggaaaatgaaaatt

SEQ ID NO: 159008 - DNA, 19 bp, Homo sapiens
tgtggagagtgcaacagta

SEQ ID NO: 159009 - DNA, 19 bp, Homo sapiens
tgtggatgagccctcagaa

SEQ ID NO: 159010 - DNA, 14 bp, Homo sapiens
tgtggatgataaaa

SEQ ID NO: 159011 - DNA, 17 bp, Homo sapiens
tgtggccctggcctgct

SEQ ID NO: 159012 - DNA, 20 bp, Homo sapiens
tgtggccttccatttatatg

SEQ ID NO: 159013 - DNA, 17 bp, Homo sapiens
tgtggctttctttcttt

SEQ ID NO: 159014 - DNA, 13 bp, Homo sapiens
tgtgggagggagc

SEQ ID NO: 159015 - DNA, 16 bp, Homo sapiens
tgtgggcaggaagtga

SEQ ID NO: 159016 - DNA, 21 bp, Homo sapiens
tgtgggtacagagaggtcaag

SEQ ID NO: 159017 - DNA, 20 bp, Homo sapiens
tgtggtcacaggaagtagag

SEQ ID NO: 159018 - DNA, 12 bp, Homo sapiens
tgtggtttcatt

SEQ ID NO: 159019 - DNA, 14 bp, Homo sapiens
tgtgtaaaatgtga

SEQ ID NO: 159020 - DNA, 16 bp, Homo sapiens
tgtgtaattttgttct

SEQ ID NO: 159021 - DNA, 21 bp, Homo sapiens
tgtgtattaaaaaaaacaaaa

SEQ ID NO: 159022 - DNA, 14 bp, Homo sapiens
tgtgtccatgtgtg

SEQ ID NO: 159023 - DNA, 16 bp, Homo sapiens
tgtgtccatgtgtgtg

SEQ ID NO: 159024 - DNA, 17 bp, Homo sapiens
tgtgtccatgtgtgtgc

SEQ ID NO: 159025 - DNA, 14 bp, Homo sapiens
tgtgtccttccctg

SEQ ID NO: 159026 - DNA, 16 bp, Homo sapiens
tgtgtccttccctgca

SEQ ID NO: 159027 - DNA, 17 bp, Homo sapiens
tgtgtccttccctgcat

SEQ ID NO: 159028 - DNA, 19 bp, Homo sapiens
tgtgtccttgcacctgcat

SEQ ID NO: 159029 - DNA, 12 bp, Homo sapiens
tgtgtctaaact

SEQ ID NO: 159030 - DNA, 20 bp, Homo sapiens
tgtgtgaaataccagtgtgg

SEQ ID NO: 159031 - DNA, 17 bp, Homo sapiens
tgtgtgagcaagcattt

SEQ ID NO: 159032 - DNA, 22 bp, Homo sapiens
tgtgtgcaccttaccaactttc

SEQ ID NO: 159033 - DNA, 18 bp, Homo sapiens
tgtgtgcgagtgtgtgca

SEQ ID NO: 159034 - DNA, 12 bp, Homo sapiens
tgtgtgtgtgca

SEQ ID NO: 159035 - DNA, 22 bp, Homo sapiens
tgtgttaagtatgtgtaaaatg

SEQ ID NO: 159036 - DNA, 23 bp, Homo sapiens
tgtgttacctgaaaacactgtgc

SEQ ID NO: 159037 - DNA, 16 bp, Homo sapiens
tgtgttatttaaatga

SEQ ID NO: 159038 - DNA, 15 bp, Homo sapiens
tgtgttgctatcctg

SEQ ID NO: 159039 - DNA, 19 bp, Homo sapiens
tgtgttggggccttggcct

SEQ ID NO: 159040 - DNA, 12 bp, Homo sapiens
tgtgtttccaca

SEQ ID NO: 159041 - DNA, 11 bp, Homo sapiens
tgtgtttcctt

SEQ ID NO: 159042 - DNA, 17 bp, Homo sapiens
tgtgttttcataataaa

SEQ ID NO: 159043 - DNA, 18 bp, Homo sapiens
tgttaaattgctgtgtat

SEQ ID NO: 159044 - DNA, 21 bp, Homo sapiens
tgttaacatggacatgatctt

SEQ ID NO: 159045 - DNA, 15 bp, Homo sapiens
tgttaagtatgtgta

SEQ ID NO: 159046 - DNA, 15 bp, Homo sapiens
tgttaagtattttca

SEQ ID NO: 159047 - DNA, 20 bp, Homo sapiens
tgttaatggtgcaaatccta

SEQ ID NO: 159048 - DNA, 17 bp, Homo sapiens
tgttactaactaaactc

SEQ ID NO: 159049 - DNA, 23 bp, Homo sapiens
tgttagagtccaacgtggggcag

SEQ ID NO: 159050 - DNA, 14 bp, Homo sapiens
tgttatggaaactg

SEQ ID NO: 159051 - DNA, 21 bp, Homo sapiens
tgttcaaagccagcgtcctcc

SEQ ID NO: 159052 - DNA, 22 bp, Homo sapiens
tgttcacactctcacatgttta

SEQ ID NO: 159053 - DNA, 15 bp, Homo sapiens
tgttcagcactgtcc

SEQ ID NO: 159054 - DNA, 20 bp, Homo sapiens
tgttccccttccactgaggg

SEQ ID NO: 159055 - DNA, 23 bp, Homo sapiens
tgttccccttccactgagggcag

SEQ ID NO: 159056 - DNA, 15 bp, Homo sapiens
tgttctaagaagtga

SEQ ID NO: 159057 - DNA, 17 bp, Homo sapiens
tgttctaagtctttcca

SEQ ID NO: 159058 - DNA, 22 bp, Homo sapiens
tgttctcctagactgaccctga

SEQ ID NO: 159059 - DNA, 13 bp, Homo sapiens
tgttctggccctc

SEQ ID NO: 159060 - DNA, 23 bp, Homo sapiens
tgttcttgaatttaataatctgt

SEQ ID NO: 159061 - DNA, 21 bp, Homo sapiens
tgttgaaattatgtatgttta

SEQ ID NO: 159062 - DNA, 22 bp, Homo sapiens
tgttgaaattatgtatgtttac

SEQ ID NO: 159063 - DNA, 17 bp, Homo sapiens
tgttgacatccaagctt

SEQ ID NO: 159064 - DNA, 13 bp, Homo sapiens
tgttgagctgttt

SEQ ID NO: 159065 - DNA, 20 bp, Homo sapiens
tgttgcacacccactcagct

SEQ ID NO: 159066 - DNA, 21 bp, Homo sapiens
tgttgcacacccactcagctc

SEQ ID NO: 159067 - DNA, 14 bp, Homo sapiens
tgttgtaaatattt

SEQ ID NO: 159068 - DNA, 15 bp, Homo sapiens
tgtttaatatttaaa

SEQ ID NO: 159069 - DNA, 17 bp, Homo sapiens
tgtttaatatttaaaca

SEQ ID NO: 159070 - DNA, 16 bp, Homo sapiens
tgtttagcaaatacat

SEQ ID NO: 159071 - DNA, 13 bp, Homo sapiens
tgtttattaacaa

SEQ ID NO: 159072 - DNA, 14 bp, Homo sapiens
tgtttattaacaaa

SEQ ID NO: 159073 - DNA, 16 bp, Homo sapiens
tgtttattaacaaatt

SEQ ID NO: 159074 - DNA, 18 bp, Homo sapiens
tgtttattcctgataata

SEQ ID NO: 159075 - DNA, 22 bp, Homo sapiens
tgtttatttataagcagattta

SEQ ID NO: 159076 - DNA, 23 bp, Homo sapiens
tgtttatttataagcagatttaa

SEQ ID NO: 159077 - DNA, 14 bp, Homo sapiens
tgtttatttataga

SEQ ID NO: 159078 - DNA, 24 bp, Homo sapiens
tgtttatttatagagtgtacttaa

SEQ ID NO: 159079 - DNA, 18 bp, Homo sapiens
tgtttcacgaagtttgtt

SEQ ID NO: 159080 - DNA, 15 bp, Homo sapiens
tgtttccaatgttta

SEQ ID NO: 159081 - DNA, 23 bp, Homo sapiens
tgtttccaatgtttagcaaatac

SEQ ID NO: 159082 - DNA, 22 bp, Homo sapiens
tgtttgacaaagaaacccaagt

SEQ ID NO: 159083 - DNA, 16 bp, Homo sapiens
tgtttgtcagatatga

SEQ ID NO: 159084 - DNA, 23 bp, Homo sapiens
tgttttattttttattgttttca

SEQ ID NO: 159085 - DNA, 16 bp, Homo sapiens
tgttttccctgacctc

SEQ ID NO: 159086 - DNA, 14 bp, Homo sapiens
tgtttttaagctgt

SEQ ID NO: 159087 - DNA, 15 bp, Homo sapiens
tgtttttaagctgtt

SEQ ID NO: 159088 - DNA, 22 bp, Homo sapiens
tgtttttaagctgtttccatag

SEQ ID NO: 159089 - DNA, 20 bp, Homo sapiens
tgtttttccttgtatttaaa

SEQ ID NO: 159090 - DNA, 21 bp, Homo sapiens
ttttgaaaccatgaagagatt

SEQ ID NO: 159091 - DNA, 17 bp, Homo sapiens
ttttgaaattaacctct

SEQ ID NO: 159092 - DNA, 10 bp, Homo sapiens
ttttgaagtg

SEQ ID NO: 159093 - DNA, 22 bp, Homo sapiens
ttttgaagtgtaggcagacaca

SEQ ID NO: 159094 - DNA, 13 bp, Homo sapiens
ttttgaatgttat

SEQ ID NO: 159095 - DNA, 20 bp, Homo sapiens
ttttgacggatgattggatt

SEQ ID NO: 159096 - DNA, 16 bp, Homo sapiens
ttttgatgagttgtga

SEQ ID NO: 159097 - DNA, 18 bp, Homo sapiens
ttttgctgtttcctttta

SEQ ID NO: 159098 - DNA, 21 bp, Homo sapiens
ttttggtccaagttgtgctta

SEQ ID NO: 159099 - DNA, 20 bp, Homo sapiens
ttttggtggttttagtgatt

SEQ ID NO: 159100 - DNA, 23 bp, Homo sapiens
ttttgtaggggtcaaagaaatgc

SEQ ID NO: 159101 - DNA, 16 bp, Homo sapiens
ttttgtatagtaaagt

SEQ ID NO: 159102 - DNA, 17 bp, Homo sapiens
ttttgtatagtaaagtg

SEQ ID NO: 159103 - DNA, 13 bp, Homo sapiens
ttttgtatatatc

SEQ ID NO: 159104 - DNA, 16 bp, Homo sapiens
tttttaagtatttata

SEQ ID NO: 159105 - DNA, 16 bp, Homo sapiens
tttttcaatatttatt

SEQ ID NO: 159106 - DNA, 11 bp, Homo sapiens
tttttcatgat

SEQ ID NO: 159107 - DNA, 17 bp, Homo sapiens
tttttccttgtatttaa

SEQ ID NO: 159108 - DNA, 18 bp, Homo sapiens
tttttgcaagtgaaggtt

SEQ ID NO: 159109 - DNA, 12 bp, Homo sapiens
ttttttgaaaac

SEQ ID NO: 159110 - DNA, 22 bp, Homo sapiens
catgtgatccttttatgttatt

SEQ ID NO: 159111 - DNA, 14 bp, Homo sapiens
catgtgcctgatcc

SEQ ID NO: 159112 - DNA, 19 bp, Homo sapiens
catgtgcctgatccagcct

SEQ ID NO: 159113 - DNA, 20 bp, Homo sapiens
catgtgcctgatccagcctc

SEQ ID NO: 159114 - DNA, 12 bp, Homo sapiens
catgtgggagct

SEQ ID NO: 159115 - DNA, 18 bp, Homo sapiens
catgtggggccaggtcac

SEQ ID NO: 159116 - DNA, 17 bp, Homo sapiens
catgtgtgagtgtgtgc

SEQ ID NO: 159117 - DNA, 14 bp, Homo sapiens
catgttaggaaaat

SEQ ID NO: 159118 - DNA, 13 bp, Homo sapiens
catgttatatatt

SEQ ID NO: 159119 - DNA, 20 bp, Homo sapiens
catgttatatattttttgta

SEQ ID NO: 159120 - DNA, 12 bp, Homo sapiens
catgttccttca

SEQ ID NO: 159121 - DNA, 20 bp, Homo sapiens
catgttccttcaagatcatg

SEQ ID NO: 159122 - DNA, 20 bp, Homo sapiens
catgtttgagctcagacccc

SEQ ID NO: 159123 - DNA, 23 bp, Homo sapiens
catgtttgagctcagacccccac

SEQ ID NO: 159124 - DNA, 12 bp, Homo sapiens
cattaagaaaat

SEQ ID NO: 159125 - DNA, 20 bp, Homo sapiens
cattaagccctcttccatca

SEQ ID NO: 159126 - DNA, 17 bp, Homo sapiens
cattaatatttgctgac

SEQ ID NO: 159127 - DNA, 18 bp, Homo sapiens
cattaccagacggttcac

SEQ ID NO: 159128 - DNA, 20 bp, Homo sapiens
cattaccagacggttcacca

SEQ ID NO: 159129 - DNA, 23 bp, Homo sapiens
cattaccagacggttcaccagcc

SEQ ID NO: 159130 - DNA, 22 bp, Homo sapiens
cattaccgcgttgtaaaatata

SEQ ID NO: 159131 - DNA, 13 bp, Homo sapiens
cattcacccagac

SEQ ID NO: 159132 - DNA, 15 bp, Homo sapiens
cattcacttgcattt

SEQ ID NO: 159133 - DNA, 12 bp, Homo sapiens
cattcagagagc

SEQ ID NO: 159134 - DNA, 14 bp, Homo sapiens
cattccaagcctga

SEQ ID NO: 159135 - DNA, 17 bp, Homo sapiens
cattccaccttcccatg

SEQ ID NO: 159136 - DNA, 13 bp, Homo sapiens
cattcctcaggga

SEQ ID NO: 159137 - DNA, 16 bp, Homo sapiens
cattcctcagggacag

SEQ ID NO: 159138 - DNA, 23 bp, Homo sapiens
cattctaggtaggggcccacttc

SEQ ID NO: 159139 - DNA, 13 bp, Homo sapiens
cattctcctgcct

SEQ ID NO: 159140 - DNA, 22 bp, Homo sapiens
cattctcctgcctgtagcagtg

SEQ ID NO: 159141 - DNA, 23 bp, Homo sapiens
cattctcctgcctgtagcagtga

SEQ ID NO: 159142 - DNA, 12 bp, Homo sapiens
cattctctctcc

SEQ ID NO: 159143 - DNA, 18 bp, Homo sapiens
cattctctctcctgtcca

SEQ ID NO: 159144 - DNA, 19 bp, Homo sapiens
cattctctgtctcatccat

SEQ ID NO: 159145 - DNA, 23 bp, Homo sapiens
cattctctgtctcatccatcatc

SEQ ID NO: 159146 - DNA, 16 bp, Homo sapiens
cattctgaaggagccc

SEQ ID NO: 159147 - DNA, 21 bp, Homo sapiens
cattcttatttcatgaaaatt

SEQ ID NO: 159148 - DNA, 17 bp, Homo sapiens
cattcttgaaagctgtg

SEQ ID NO: 159149 - DNA, 19 bp, Homo sapiens
cattcttttaaaagacaag

SEQ ID NO: 159150 - DNA, 22 bp, Homo sapiens
cattgaattcttggttgaggaa

SEQ ID NO: 159151 - DNA, 23 bp, Homo sapiens
cattgaattcttggttgaggaaa

SEQ ID NO: 159152 - DNA, 18 bp, Homo sapiens
cattgactatcaaactga

SEQ ID NO: 159153 - DNA, 19 bp, Homo sapiens
cattgactatcaaactgaa

SEQ ID NO: 159154 - DNA, 12 bp, Homo sapiens
cattgccctggt

SEQ ID NO: 159155 - DNA, 17 bp, Homo sapiens
cattggacccttccatg

SEQ ID NO: 159156 - DNA, 17 bp, Homo sapiens
cattgtagagcttctgg

SEQ ID NO: 159157 - DNA, 19 bp, Homo sapiens
cattgtagagcttctggca

SEQ ID NO: 159158 - DNA, 22 bp, Homo sapiens
cattgtatagttggaatcatat

SEQ ID NO: 159159 - DNA, 18 bp, Homo sapiens
cattgtttgtctgtcttc

SEQ ID NO: 159160 - DNA, 12 bp, Homo sapiens
catttaaaatga

SEQ ID NO: 159161 - DNA, 17 bp, Homo sapiens
catttaaaatgattaga

SEQ ID NO: 159162 - DNA, 18 bp, Homo sapiens
catttaaatacagtcttc

SEQ ID NO: 159163 - DNA, 15 bp, Homo sapiens
catttagtcatgtga

SEQ ID NO: 159164 - DNA, 13 bp, Homo sapiens
catttatatattg

SEQ ID NO: 159165 - DNA, 17 bp, Homo sapiens
catttattttttacatt

SEQ ID NO: 159166 - DNA, 19 bp, Homo sapiens
catttattttttacattat

SEQ ID NO: 159167 - DNA, 15 bp, Homo sapiens
catttcaactgtttg

SEQ ID NO: 159168 - DNA, 16 bp, Homo sapiens
catttcatctatttct

SEQ ID NO: 159169 - DNA, 18 bp, Homo sapiens
catttcatctatttctga

SEQ ID NO: 159170 - DNA, 20 bp, Homo sapiens
catttcatctatttctgaga

SEQ ID NO: 159171 - DNA, 17 bp, Homo sapiens
catttccaaatgaatga

SEQ ID NO: 159172 - DNA, 16 bp, Homo sapiens
catttccccagacctg

SEQ ID NO: 159173 - DNA, 20 bp, Homo sapiens
catttccccagacctgagct

SEQ ID NO: 159174 - DNA, 13 bp, Homo sapiens
catttcctgacag

SEQ ID NO: 159175 - DNA, 22 bp, Homo sapiens
catttctgagtttcattctcct

SEQ ID NO: 159176 - DNA, 21 bp, Homo sapiens
catttgaataaagcctgcttt

SEQ ID NO: 159177 - DNA, 13 bp, Homo sapiens
catttgctgaata

SEQ ID NO: 159178 - DNA, 13 bp, Homo sapiens
catttgctttttg

SEQ ID NO: 159179 - DNA, 22 bp, Homo sapiens
catttggggtagctagaggaac

SEQ ID NO: 159180 - DNA, 14 bp, Homo sapiens
catttgtgaaatga

SEQ ID NO: 159181 - DNA, 20 bp, Homo sapiens
catttttgtattttgtttaa

SEQ ID NO: 159182 - DNA, 14 bp, Homo sapiens
ccaaaaggcagaag

SEQ ID NO: 159183 - DNA, 22 bp, Homo sapiens
ccaaaagtcaaaaggtgcctgt

SEQ ID NO: 159184 - DNA, 22 bp, Homo sapiens
ccaaacctgcaagggctcccca

SEQ ID NO: 159185 - DNA, 13 bp, Homo sapiens
ccaaagccaccag

SEQ ID NO: 159186 - DNA, 17 bp, Homo sapiens
ccaaagcctcctccagc

SEQ ID NO: 159187 - DNA, 16 bp, Homo sapiens
ccaaagctttcctgcc

SEQ ID NO: 159188 - DNA, 17 bp, Homo sapiens
ccaaaggactccaccca

SEQ ID NO: 159189 - DNA, 19 bp, Homo sapiens
ccaaaggatgtgatatata

SEQ ID NO: 159190 - DNA, 16 bp, Homo sapiens
ccaaaggctctctcct

SEQ ID NO: 159191 - DNA, 20 bp, Homo sapiens
ccaaaggtgaaggaatatat

SEQ ID NO: 159192 - DNA, 16 bp, Homo sapiens
ccaaatgaatgacctt

SEQ ID NO: 159193 - DNA, 11 bp, Homo sapiens
ccaaattattt

SEQ ID NO: 159194 - DNA, 14 bp, Homo sapiens
ccaaattatttgtg

SEQ ID NO: 159195 - DNA, 18 bp, Homo sapiens
ccaaattatttgtgtaat

SEQ ID NO: 159196 - DNA, 20 bp, Homo sapiens
ccaacaccctgtctaaaaaa

SEQ ID NO: 159197 - DNA, 21 bp, Homo sapiens
ccaacacgagcaggctactgt

SEQ ID NO: 159198 - DNA, 15 bp, Homo sapiens
ccaacatggagaaac

SEQ ID NO: 159199 - DNA, 23 bp, Homo sapiens
ccaacatggagaaaccctgtctc

SEQ ID NO: 159200 - DNA, 13 bp, Homo sapiens
ccaacctgaccaa

SEQ ID NO: 159201 - DNA, 14 bp, Homo sapiens
ccaacctggacaac

SEQ ID NO: 159202 - DNA, 22 bp, Homo sapiens
ccaacggagagcgcctgcccct

SEQ ID NO: 159203 - DNA, 16 bp, Homo sapiens
ccaacgtggggcagca

SEQ ID NO: 159204 - DNA, 14 bp, Homo sapiens
cagtgtgtctaaat

SEQ ID NO: 159205 - DNA, 23 bp, Homo sapiens
cagtgtgtctaaatttgaatgtt

SEQ ID NO: 159206 - DNA, 14 bp, Homo sapiens
cagtgttaaatgtg

SEQ ID NO: 159207 - DNA, 19 bp, Homo sapiens
cagtgttaaatgtgatgaa

SEQ ID NO: 159208 - DNA, 22 bp, Homo sapiens
cagtgttttctgggataagtaa

SEQ ID NO: 159209 - DNA, 16 bp, Homo sapiens
cagttaaaaaaaattt

SEQ ID NO: 159210 - DNA, 19 bp, Homo sapiens
cagttaaaaaaaattttaa

SEQ ID NO: 159211 - DNA, 19 bp, Homo sapiens
cagttatggctataggtgc

SEQ ID NO: 159212 - DNA, 20 bp, Homo sapiens
cagttatggctataggtgct

SEQ ID NO: 159213 - DNA, 20 bp, Homo sapiens
cagttctgggtgctccctac

SEQ ID NO: 159214 - DNA, 14 bp, Homo sapiens
cagttgaaaagact

SEQ ID NO: 159215 - DNA, 20 bp, Homo sapiens
cagttgaatgacaacagaag

SEQ ID NO: 159216 - DNA, 21 bp, Homo sapiens
cagttgaatgacaacagaagc

SEQ ID NO: 159217 - DNA, 13 bp, Homo sapiens
cagttgcacttgg

SEQ ID NO: 159218 - DNA, 21 bp, Homo sapiens
cagtttgctttgtatgcactt

SEQ ID NO: 159219 - DNA, 14 bp, Homo sapiens
cagtttgtatatac

SEQ ID NO: 159220 - DNA, 16 bp, Homo sapiens
cagttttaactagaat

SEQ ID NO: 159221 - DNA, 15 bp, Homo sapiens
cagttttatcatttt

SEQ ID NO: 159222 - DNA, 14 bp, Homo sapiens
cagttttctgagaa

SEQ ID NO: 159223 - DNA, 23 bp, Homo sapiens
cataaaaagcctgcaatttcata

SEQ ID NO: 159224 - DNA, 17 bp, Homo sapiens
cataaaacattaagaaa

SEQ ID NO: 159225 - DNA, 22 bp, Homo sapiens
cataaaacattaagaaaatcat

SEQ ID NO: 159226 - DNA, 23 bp, Homo sapiens
cataaaacattaagaaaatcata

SEQ ID NO: 159227 - DNA, 19 bp, Homo sapiens
cataaaataaagtatatat

SEQ ID NO: 159228 - DNA, 20 bp, Homo sapiens
cataaaataaagtatatata

SEQ ID NO: 159229 - DNA, 18 bp, Homo sapiens
cataaataaaatgaccag

SEQ ID NO: 159230 - DNA, 14 bp, Homo sapiens
cataacaattcctc

SEQ ID NO: 159231 - DNA, 15 bp, Homo sapiens
cataacaattcctct

SEQ ID NO: 159232 - DNA, 19 bp, Homo sapiens
cataagaaaactaagaaat

SEQ ID NO: 159233 - DNA, 19 bp, Homo sapiens
cataatctggactcctctg

SEQ ID NO: 159234 - DNA, 20 bp, Homo sapiens
cataatctggactcctctgt

SEQ ID NO: 159235 - DNA, 17 bp, Homo sapiens
cataatgttacattatt

SEQ ID NO: 159236 - DNA, 15 bp, Homo sapiens
cataatttgtacata

SEQ ID NO: 159237 - DNA, 21 bp, Homo sapiens
cataatttgtacatatgtaaa

SEQ ID NO: 159238 - DNA, 23 bp, Homo sapiens
cataatttgtacatatgtaaaat

SEQ ID NO: 159239 - DNA, 22 bp, Homo sapiens
cataccaggccgccccagcctc

SEQ ID NO: 159240 - DNA, 19 bp, Homo sapiens
catacctttattgtgatct

SEQ ID NO: 159241 - DNA, 17 bp, Homo sapiens
catagaggtgagggaag

SEQ ID NO: 159242 - DNA, 15 bp, Homo sapiens
catagagtttaacac

SEQ ID NO: 159243 - DNA, 18 bp, Homo sapiens
catagagtttaacacaag

SEQ ID NO: 159244 - DNA, 18 bp, Homo sapiens
catagattccctgagcag

SEQ ID NO: 159245 - DNA, 17 bp, Homo sapiens
catagcagattttaatt

SEQ ID NO: 159246 - DNA, 19 bp, Homo sapiens
catagcagcttattcacaa

SEQ ID NO: 159247 - DNA, 20 bp, Homo sapiens
catagcagcttattcacaag

SEQ ID NO: 159248 - DNA, 22 bp, Homo sapiens
cataggaaaagtacatttaata

SEQ ID NO: 159249 - DNA, 18 bp, Homo sapiens
catagtaccaatcatttt

SEQ ID NO: 159250 - DNA, 18 bp, Homo sapiens
ccaccccctccccagggg

SEQ ID NO: 159251 - DNA, 15 bp, Homo sapiens
ccacccctccttcct

SEQ ID NO: 159252 - DNA, 13 bp, Homo sapiens
ccaccgctgccta

SEQ ID NO: 159253 - DNA, 23 bp, Homo sapiens
ccaccgggctgggagctctgcag

SEQ ID NO: 159254 - DNA, 12 bp, Homo sapiens
ccacctccccac

SEQ ID NO: 159255 - DNA, 17 bp, Homo sapiens
ccacctccccacgccct

SEQ ID NO: 159256 - DNA, 18 bp, Homo sapiens
ccacctccccacgccctc

SEQ ID NO: 159257 - DNA, 13 bp, Homo sapiens
ccacctccccagg

SEQ ID NO: 159258 - DNA, 15 bp, Homo sapiens
ccacctccctcacca

SEQ ID NO: 159259 - DNA, 15 bp, Homo sapiens
ccacctctctttttc

SEQ ID NO: 159260 - DNA, 22 bp, Homo sapiens
ccacctctgtgacctcaggcac

SEQ ID NO: 159261 - DNA, 23 bp, Homo sapiens
ccacctctgtgacctcaggcact

SEQ ID NO: 159262 - DNA, 14 bp, Homo sapiens
ccacctgctcccag

SEQ ID NO: 159263 - DNA, 15 bp, Homo sapiens
ccacctgctcccagg

SEQ ID NO: 159264 - DNA, 12 bp, Homo sapiens
ccacctggcccc

SEQ ID NO: 159265 - DNA, 22 bp, Homo sapiens
ccacctgggcatatccaccacc

SEQ ID NO: 159266 - DNA, 14 bp, Homo sapiens
ccacctggggcagt

SEQ ID NO: 159267 - DNA, 15 bp, Homo sapiens
ccacctggtggcctc

SEQ ID NO: 159268 - DNA, 20 bp, Homo sapiens
ccacctgtcaaacaaagcca

SEQ ID NO: 159269 - DNA, 22 bp, Homo sapiens
ccacctgtcaaacaaagccaga

SEQ ID NO: 159270 - DNA, 12 bp, Homo sapiens
ccacctgtctca

SEQ ID NO: 159271 - DNA, 16 bp, Homo sapiens
ccacctgtctcagcct

SEQ ID NO: 159272 - DNA, 18 bp, Homo sapiens
ccacctgtctcagcctcc

SEQ ID NO: 159273 - DNA, 11 bp, Homo sapiens
ccaccttccca

SEQ ID NO: 159274 - DNA, 12 bp, Homo sapiens
ccaccttcccag

SEQ ID NO: 159275 - DNA, 13 bp, Homo sapiens
ccaccttcccagc

SEQ ID NO: 159276 - DNA, 14 bp, Homo sapiens
ccaccttcccagct

SEQ ID NO: 159277 - DNA, 19 bp, Homo sapiens
ccaccttcccagctctccc

SEQ ID NO: 159278 - DNA, 15 bp, Homo sapiens
ccacgactgtctcca

SEQ ID NO: 159279 - DNA, 18 bp, Homo sapiens
ccacgatgtggccctggc

SEQ ID NO: 159280 - DNA, 17 bp, Homo sapiens
ccacgccctcccctccc

SEQ ID NO: 159281 - DNA, 18 bp, Homo sapiens
ccacggacgtttccatca

SEQ ID NO: 159282 - DNA, 12 bp, Homo sapiens
ccacggagccac

SEQ ID NO: 159283 - DNA, 22 bp, Homo sapiens
ccacgtccccctggggcttctc

SEQ ID NO: 159284 - DNA, 14 bp, Homo sapiens
ccacgttcacccct

SEQ ID NO: 159285 - DNA, 15 bp, Homo sapiens
ccacgttcacccctc

SEQ ID NO: 159286 - DNA, 23 bp, Homo sapiens
ccacgttctgctcatcattctct

SEQ ID NO: 159287 - DNA, 14 bp, Homo sapiens
ccactagtgcaaat

SEQ ID NO: 159288 - DNA, 16 bp, Homo sapiens
ccactagtgcaaatca

SEQ ID NO: 159289 - DNA, 17 bp, Homo sapiens
ccactagtgcaaatcat

SEQ ID NO: 159290 - DNA, 12 bp, Homo sapiens
ccactcaagcca

SEQ ID NO: 159291 - DNA, 19 bp, Homo sapiens
ccactccagacccctggct

SEQ ID NO: 159292 - DNA, 22 bp, Homo sapiens
ccactccagacccctggctttt

SEQ ID NO: 159293 - DNA, 16 bp, Homo sapiens
ccactcctccaaagga

SEQ ID NO: 159294 - DNA, 13 bp, Homo sapiens
ccactcctctgac

SEQ ID NO: 159295 - DNA, 14 bp, Homo sapiens
ccactcctctgact

SEQ ID NO: 159296 - DNA, 20 bp, Homo sapiens
ccactcctctgactcagggc

SEQ ID NO: 159297 - DNA, 19 bp, Homo sapiens
ccactctcattccccaggt

SEQ ID NO: 159298 - DNA, 21 bp, Homo sapiens
ccactctgctttgactgagca

SEQ ID NO: 159299 - DNA, 15 bp, Homo sapiens
ccactgacagcctcc

SEQ ID NO: 159300 - DNA, 17 bp, Homo sapiens
ccactgacagcctccca

SEQ ID NO: 159301 - DNA, 19 bp, Homo sapiens
ccactgacagcctcccacc

SEQ ID NO: 159302 - DNA, 14 bp, Homo sapiens
ccactgcaggcccc

SEQ ID NO: 159303 - DNA, 17 bp, Homo sapiens
ccactgcaggccccgct

SEQ ID NO: 159304 - DNA, 23 bp, Homo sapiens
ccactgcatcgtttcatcttcca

SEQ ID NO: 159305 - DNA, 23 bp, Homo sapiens
ccactgccacacgtctgaccctc

SEQ ID NO: 159306 - DNA, 16 bp, Homo sapiens
ccactgccataaaaca

SEQ ID NO: 159307 - DNA, 23 bp, Homo sapiens
ccactgtcactgtttctctgctg

SEQ ID NO: 159308 - DNA, 13 bp, Homo sapiens
ccacttaaaatgt

SEQ ID NO: 159309 - DNA, 12 bp, Homo sapiens
ccacttacctag

SEQ ID NO: 159310 - DNA, 17 bp, Homo sapiens
ccacttcaagtgaccac

SEQ ID NO: 159311 - DNA, 14 bp, Homo sapiens
ccacttcagctgac

SEQ ID NO: 159312 - DNA, 19 bp, Homo sapiens
ccacttcttgttccccact

SEQ ID NO: 159313 - DNA, 23 bp, Homo sapiens
ccagaaataaagttggtgacaga

SEQ ID NO: 159314 - DNA, 13 bp, Homo sapiens
ccagaaattagaa

SEQ ID NO: 159315 - DNA, 14 bp, Homo sapiens
ccagaacctgtcct

SEQ ID NO: 159316 - DNA, 15 bp, Homo sapiens
ccagaacctgtcctt

SEQ ID NO: 159317 - DNA, 23 bp, Homo sapiens
ccagaagtttgagatcagcctgg

SEQ ID NO: 159318 - DNA, 18 bp, Homo sapiens
ccagacacagaagaggct

SEQ ID NO: 159319 - DNA, 13 bp, Homo sapiens
ccagacagctccc

SEQ ID NO: 159320 - DNA, 17 bp, Homo sapiens
ccagacccctggctttt

SEQ ID NO: 159321 - DNA, 18 bp, Homo sapiens
ccagacccctggcttttc

SEQ ID NO: 159322 - DNA, 23 bp, Homo sapiens
ccagacgcacgtgggtcttcagg

SEQ ID NO: 159323 - DNA, 17 bp, Homo sapiens
ccagacggttcaccagc

SEQ ID NO: 159324 - DNA, 17 bp, Homo sapiens
ccagactgtgtattcat

SEQ ID NO: 159325 - DNA, 21 bp, Homo sapiens
ccagactttacatgacacagc

SEQ ID NO: 159326 - DNA, 12 bp, Homo sapiens
ccagagacagga

SEQ ID NO: 159327 - DNA, 13 bp, Homo sapiens
ccagagacaggaa

SEQ ID NO: 159328 - DNA, 23 bp, Homo sapiens
ccagagacaggaaaatcctctgg

SEQ ID NO: 159329 - DNA, 15 bp, Homo sapiens
ccagagatgcctcca

SEQ ID NO: 159330 - DNA, 12 bp, Homo sapiens
ccagagcagggt

SEQ ID NO: 159331 - DNA, 20 bp, Homo sapiens
ccagaggaactgtccagaga

SEQ ID NO: 159332 - DNA, 23 bp, Homo sapiens
ccagaggaactgtccagagagca

SEQ ID NO: 159333 - DNA, 21 bp, Homo sapiens
ccagagtgtgggaagggagag

SEQ ID NO: 159334 - DNA, 19 bp, Homo sapiens
ccagattgacgacaagtgc

SEQ ID NO: 159335 - DNA, 15 bp, Homo sapiens
ccagcaactccaact

SEQ ID NO: 159336 - DNA, 17 bp, Homo sapiens
ccagcaatatgtaaata

SEQ ID NO: 159337 - DNA, 18 bp, Homo sapiens
ccagcactgcttgaggaa

SEQ ID NO: 159338 - DNA, 23 bp, Homo sapiens
ccagcactttgggaggccaagga

SEQ ID NO: 159339 - DNA, 16 bp, Homo sapiens
ccagcagatcccagct

SEQ ID NO: 159340 - DNA, 19 bp, Homo sapiens
ccagcagatcccagctcac

SEQ ID NO: 159341 - DNA, 12 bp, Homo sapiens
ccagcagcctgg

SEQ ID NO: 159342 - DNA, 17 bp, Homo sapiens
ccagccaaaccctgtct

SEQ ID NO: 159343 - DNA, 15 bp, Homo sapiens
ccagccaaagcctcc

SEQ ID NO: 159344 - DNA, 18 bp, Homo sapiens
ccagccaaagcctcctcc

SEQ ID NO: 159345 - DNA, 15 bp, Homo sapiens
ccagccagcagccag

SEQ ID NO: 159346 - DNA, 18 bp, Homo sapiens
aggcctggactttcctgc

SEQ ID NO: 159347 - DNA, 21 bp, Homo sapiens
aggctagaaccacctgcctat

SEQ ID NO: 159348 - DNA, 23 bp, Homo sapiens
aggctatacttgtcttgttcacc

SEQ ID NO: 159349 - DNA, 23 bp, Homo sapiens
aggctcacccccttctccatcca

SEQ ID NO: 159350 - DNA, 15 bp, Homo sapiens
aggctccttcctgtc

SEQ ID NO: 159351 - DNA, 13 bp, Homo sapiens
aggctctgccctg

SEQ ID NO: 159352 - DNA, 14 bp, Homo sapiens
aggctctgccctgc

SEQ ID NO: 159353 - DNA, 17 bp, Homo sapiens
aggctctgccctgccct

SEQ ID NO: 159354 - DNA, 23 bp, Homo sapiens
aggctctgccctgccctagctcc

SEQ ID NO: 159355 - DNA, 15 bp, Homo sapiens
aggctgaggaaaggc

SEQ ID NO: 159356 - DNA, 19 bp, Homo sapiens
aggctgaggaaaggccagc

SEQ ID NO: 159357 - DNA, 22 bp, Homo sapiens
aggctgaggaaaggccagctgg

SEQ ID NO: 159358 - DNA, 11 bp, Homo sapiens
aggctgaggac

SEQ ID NO: 159359 - DNA, 15 bp, Homo sapiens
aggctgaggcagaag

SEQ ID NO: 159360 - DNA, 14 bp, Homo sapiens
aggctgctggagga

SEQ ID NO: 159361 - DNA, 15 bp, Homo sapiens
aggctgctggaggaa

SEQ ID NO: 159362 - DNA, 16 bp, Homo sapiens
aggctgctggaggaaa

SEQ ID NO: 159363 - DNA, 13 bp, Homo sapiens
aggctggagccca

SEQ ID NO: 159364 - DNA, 15 bp, Homo sapiens
aggctggagcccagg

SEQ ID NO: 159365 - DNA, 16 bp, Homo sapiens
aggctggaggcagggc

SEQ ID NO: 159366 - DNA, 17 bp, Homo sapiens
aggctgggggaagaagc

SEQ ID NO: 159367 - DNA, 19 bp, Homo sapiens
aggctgtccttacccatct

SEQ ID NO: 159368 - DNA, 22 bp, Homo sapiens
aggctgtcttctcaggctctgc

SEQ ID NO: 159369 - DNA, 23 bp, Homo sapiens
aggctgtcttctcaggctctgcc

SEQ ID NO: 159370 - DNA, 16 bp, Homo sapiens
aggcttcttcagatca

SEQ ID NO: 159371 - DNA, 22 bp, Homo sapiens
aggcttcttcagatcagtgctt

SEQ ID NO: 159372 - DNA, 18 bp, Homo sapiens
agggaaaattatttgcat

SEQ ID NO: 159373 - DNA, 23 bp, Homo sapiens
agggaaactgccagcaacgcagg

SEQ ID NO: 159374 - DNA, 13 bp, Homo sapiens
agggaacagacag

SEQ ID NO: 159375 - DNA, 17 bp, Homo sapiens
agggaacagacaggaga

SEQ ID NO: 159376 - DNA, 18 bp, Homo sapiens
agggaacagacaggagaa

SEQ ID NO: 159377 - DNA, 16 bp, Homo sapiens
agggaagaaaagagct

SEQ ID NO: 159378 - DNA, 16 bp, Homo sapiens
agggaaggccccacag

SEQ ID NO: 159379 - DNA, 16 bp, Homo sapiens
agggaagggcctgcca

SEQ ID NO: 159380 - DNA, 15 bp, Homo sapiens
agggaagtccccagg

SEQ ID NO: 159381 - DNA, 16 bp, Homo sapiens
agggaatccccgaagg

SEQ ID NO: 159382 - DNA, 20 bp, Homo sapiens
agggaatccccgaaggtgct

SEQ ID NO: 159383 - DNA, 18 bp, Homo sapiens
agggacagagacacctgc

SEQ ID NO: 159384 - DNA, 13 bp, Homo sapiens
agggacatattca

SEQ ID NO: 159385 - DNA, 23 bp, Homo sapiens
agggacatattcatttggaaata

SEQ ID NO: 159386 - DNA, 23 bp, Homo sapiens
agggacccctgcccttgtcccac

SEQ ID NO: 159387 - DNA, 23 bp, Homo sapiens
agggacgcctgggggtgccagga

SEQ ID NO: 159388 - DNA, 15 bp, Homo sapiens
agggactgaggggag

SEQ ID NO: 159389 - DNA, 23 bp, Homo sapiens
agggactgccagtccccctgccc

SEQ ID NO: 159390 - DNA, 12 bp, Homo sapiens
agggacttaaaa

SEQ ID NO: 159391 - DNA, 14 bp, Homo sapiens
agggacttgaagtt

SEQ ID NO: 159392 - DNA, 14 bp, Homo sapiens
agggagcagacagg

SEQ ID NO: 159393 - DNA, 17 bp, Homo sapiens
agggagcccctttgatg

SEQ ID NO: 159394 - DNA, 18 bp, Homo sapiens
agggagcggaaagcagct

SEQ ID NO: 159395 - DNA, 15 bp, Homo sapiens
agggagggcttctgc

SEQ ID NO: 159396 - DNA, 22 bp, Homo sapiens
agggatagcactgagcaaagca

SEQ ID NO: 159397 - DNA, 19 bp, Homo sapiens
agggatgaggtgctgggag

SEQ ID NO: 159398 - DNA, 15 bp, Homo sapiens
agggattagggagag

SEQ ID NO: 159399 - DNA, 18 bp, Homo sapiens
agggattcacatctgcat

SEQ ID NO: 159400 - DNA, 17 bp, Homo sapiens
agggcagaggctggagg

SEQ ID NO: 159401 - DNA, 12 bp, Homo sapiens
agggcagagtga

SEQ ID NO: 159402 - DNA, 12 bp, Homo sapiens
agggcagggccc

SEQ ID NO: 159403 - DNA, 23 bp, Homo sapiens
agggcatgccccggccacctctg

SEQ ID NO: 159404 - DNA, 17 bp, Homo sapiens
agggcatggccaggtgg

SEQ ID NO: 159405 - DNA, 21 bp, Homo sapiens
agggccacatgggaggctcac

SEQ ID NO: 159406 - DNA, 15 bp, Homo sapiens
agggccacgtgccag

SEQ ID NO: 159407 - DNA, 16 bp, Homo sapiens
agggccacgtgccagg

SEQ ID NO: 159408 - DNA, 20 bp, Homo sapiens
agggccacgtgccaggcccg

SEQ ID NO: 159409 - DNA, 13 bp, Homo sapiens
agggccaggcagg

SEQ ID NO: 159410 - DNA, 12 bp, Homo sapiens
agggccccagca

SEQ ID NO: 159411 - DNA, 19 bp, Homo sapiens
agggcccctcaccctgcct

SEQ ID NO: 159412 - DNA, 16 bp, Homo sapiens
agggccctgagctcgg

SEQ ID NO: 159413 - DNA, 18 bp, Homo sapiens
agggcctgagcctggcca

SEQ ID NO: 159414 - DNA, 22 bp, Homo sapiens
agggcctgagcctggccagcct

SEQ ID NO: 159415 - DNA, 22 bp, Homo sapiens
agggcctgcaggacctgcctgt

SEQ ID NO: 159416 - DNA, 18 bp, Homo sapiens
agggccttgcccagagat

SEQ ID NO: 159417 - DNA, 19 bp, Homo sapiens
agggccttgcccagagatg

SEQ ID NO: 159418 - DNA, 15 bp, Homo sapiens
agggcgtgactcacc

SEQ ID NO: 159419 - DNA, 17 bp, Homo sapiens
agggctaccctgagctg

SEQ ID NO: 159420 - DNA, 20 bp, Homo sapiens
agggctaccctgagctgagg

SEQ ID NO: 159421 - DNA, 22 bp, Homo sapiens
agggctaccctgagctgaggca

SEQ ID NO: 159422 - DNA, 23 bp, Homo sapiens
agggctaccctgagctgaggcag

SEQ ID NO: 159423 - DNA, 13 bp, Homo sapiens
agggctcagcctg

SEQ ID NO: 159424 - DNA, 12 bp, Homo sapiens
agggctcctggg

SEQ ID NO: 159425 - DNA, 23 bp, Homo sapiens
agggctctaaaaaaagccccaaa

SEQ ID NO: 159426 - DNA, 23 bp, Homo sapiens
agggcttctgccatttctgagat

SEQ ID NO: 159427 - DNA, 13 bp, Homo sapiens
aggggaaaatgaa

SEQ ID NO: 159428 - DNA, 10 bp, Homo sapiens
aggggagagg

SEQ ID NO: 159429 - DNA, 13 bp, Homo sapiens
aggggaggagggc

SEQ ID NO: 159430 - DNA, 15 bp, Homo sapiens
aggggcacagggtct

SEQ ID NO: 159431 - DNA, 17 bp, Homo sapiens
aggggcagaaaaactct

SEQ ID NO: 159432 - DNA, 18 bp, Homo sapiens
aggggcagtctggagggg

SEQ ID NO: 159433 - DNA, 22 bp, Homo sapiens
aggggccagaggaactgtccag

SEQ ID NO: 159434 - DNA, 13 bp, Homo sapiens
aggggccagaggc

SEQ ID NO: 159435 - DNA, 14 bp, Homo sapiens
aggggccagaggct

SEQ ID NO: 159436 - DNA, 14 bp, Homo sapiens
aggggcccgtggga

SEQ ID NO: 159437 - DNA, 12 bp, Homo sapiens
aggggcctggca

SEQ ID NO: 159438 - DNA, 13 bp, Homo sapiens
aggggcctggcag

SEQ ID NO: 159439 - DNA, 18 bp, Homo sapiens
aggggcctggcagccgtg

SEQ ID NO: 159440 - DNA, 23 bp, Homo sapiens
aggggcctggcagccgtgccttc

SEQ ID NO: 159441 - DNA, 17 bp, Homo sapiens
aggggcgtgtggctcac

SEQ ID NO: 159442 - DNA, 15 bp, Homo sapiens
aggggctacaagagg

SEQ ID NO: 159443 - DNA, 17 bp, Homo sapiens
aggggctctcagctcag

SEQ ID NO: 159444 - DNA, 15 bp, Homo sapiens
aggggctctggagag

SEQ ID NO: 159445 - DNA, 21 bp, Homo sapiens
aggggctctggagagaaacaa

SEQ ID NO: 159446 - DNA, 14 bp, Homo sapiens
aggggtcaaagaaa

SEQ ID NO: 159447 - DNA, 19 bp, Homo sapiens
aggggtctccaggaggaga

SEQ ID NO: 159448 - DNA, 20 bp, Homo sapiens
aggggttggttgaggtggaa

SEQ ID NO: 159449 - DNA, 15 bp, Homo sapiens
agggtagcaggtacc

SEQ ID NO: 159450 - DNA, 20 bp, Homo sapiens
agggtcaacatcttttacat

SEQ ID NO: 159451 - DNA, 13 bp, Homo sapiens
agggtcagagagg

SEQ ID NO: 159452 - DNA, 21 bp, Homo sapiens
agggtcagagaggagtcagag

SEQ ID NO: 159453 - DNA, 15 bp, Homo sapiens
agggtcaggagaggg

SEQ ID NO: 159454 - DNA, 22 bp, Homo sapiens
agggtcatatcactcaggccct

SEQ ID NO: 159455 - DNA, 14 bp, Homo sapiens
agggtctgctcttt

SEQ ID NO: 159456 - DNA, 17 bp, Homo sapiens
agggtctgctctttctc

SEQ ID NO: 159457 - DNA, 20 bp, Homo sapiens
agggtctgctctttctctgc

SEQ ID NO: 159458 - DNA, 21 bp, Homo sapiens
agggtctgctctttctctgcc

SEQ ID NO: 159459 - DNA, 14 bp, Homo sapiens
agggtctggagaag

SEQ ID NO: 159460 - DNA, 21 bp, Homo sapiens
agggtgatgggaaagcattgt

SEQ ID NO: 159461 - DNA, 17 bp, Homo sapiens
agggtgggatggaggag

SEQ ID NO: 159462 - DNA, 16 bp, Homo sapiens
agggttagggaggggt

SEQ ID NO: 159463 - DNA, 16 bp, Homo sapiens
agggttcagagactca

SEQ ID NO: 159464 - DNA, 17 bp, Homo sapiens
agggttgaccccagagg

SEQ ID NO: 159465 - DNA, 18 bp, Homo sapiens
agggttgaccccagagga

SEQ ID NO: 159466 - DNA, 19 bp, Homo sapiens
aggtacctttcacatagag

SEQ ID NO: 159467 - DNA, 15 bp, Homo sapiens
aggtactaaatacct

SEQ ID NO: 159468 - DNA, 19 bp, Homo sapiens
aggtagccctggccagagg

SEQ ID NO: 159469 - DNA, 21 bp, Homo sapiens
aggtagccctggccagaggct

SEQ ID NO: 159470 - DNA, 16 bp, Homo sapiens
cagccttccccttgcc

SEQ ID NO: 159471 - DNA, 21 bp, Homo sapiens
cagccttccccttgcccaggg

SEQ ID NO: 159472 - DNA, 17 bp, Homo sapiens
cagcctttctcccaggc

SEQ ID NO: 159473 - DNA, 17 bp, Homo sapiens
cagcctttgcctccccg

SEQ ID NO: 159474 - DNA, 19 bp, Homo sapiens
cagcgacatagcccatccc

SEQ ID NO: 159475 - DNA, 17 bp, Homo sapiens
cagcgaggaggctccag

SEQ ID NO: 159476 - DNA, 16 bp, Homo sapiens
cagcggcccctgcatc

SEQ ID NO: 159477 - DNA, 20 bp, Homo sapiens
cagcggcccctgcatcccct

SEQ ID NO: 159478 - DNA, 12 bp, Homo sapiens
cagctaaagcaa

SEQ ID NO: 159479 - DNA, 13 bp, Homo sapiens
cagctactcagga

SEQ ID NO: 159480 - DNA, 20 bp, Homo sapiens
cagctatgttatattgaaaa

SEQ ID NO: 159481 - DNA, 17 bp, Homo sapiens
cagctcacgtcacactt

SEQ ID NO: 159482 - DNA, 21 bp, Homo sapiens
cagctcaggcacacttcttct

SEQ ID NO: 159483 - DNA, 23 bp, Homo sapiens
cagctcaggcacacttcttcttg

SEQ ID NO: 159484 - DNA, 20 bp, Homo sapiens
cagctcccaccccaccccct

SEQ ID NO: 159485 - DNA, 22 bp, Homo sapiens
cagctcccaccccacccccttc

SEQ ID NO: 159486 - DNA, 14 bp, Homo sapiens
cagctccttcctgg

SEQ ID NO: 159487 - DNA, 14 bp, Homo sapiens
cagctctccctctg

SEQ ID NO: 159488 - DNA, 15 bp, Homo sapiens
cagctctccctctgg

SEQ ID NO: 159489 - DNA, 17 bp, Homo sapiens
cagctctccctctggcc

SEQ ID NO: 159490 - DNA, 16 bp, Homo sapiens
cagctctgcaagaatt

SEQ ID NO: 159491 - DNA, 20 bp, Homo sapiens
cagctctgcatactcattag

SEQ ID NO: 159492 - DNA, 18 bp, Homo sapiens
cagctcttctccccaggt

SEQ ID NO: 159493 - DNA, 22 bp, Homo sapiens
cagctcttctgccggccctggg

SEQ ID NO: 159494 - DNA, 15 bp, Homo sapiens
cagctgaaatactga

SEQ ID NO: 159495 - DNA, 12 bp, Homo sapiens
cagctgcctgca

SEQ ID NO: 159496 - DNA, 17 bp, Homo sapiens
cagctgctcccctccct

SEQ ID NO: 159497 - DNA, 23 bp, Homo sapiens
cagctggatgagaatttgagtgc

SEQ ID NO: 159498 - DNA, 17 bp, Homo sapiens
cagctgggttggaaaac

SEQ ID NO: 159499 - DNA, 20 bp, Homo sapiens
cagctggtgggaagcgtctg

SEQ ID NO: 159500 - DNA, 18 bp, Homo sapiens
cagctggttgaggtttca

SEQ ID NO: 159501 - DNA, 16 bp, Homo sapiens
cagcttattcacaaga

SEQ ID NO: 159502 - DNA, 17 bp, Homo sapiens
cagcttattcacaagac

SEQ ID NO: 159503 - DNA, 23 bp, Homo sapiens
cagcttcccctctctcctcctgc

SEQ ID NO: 159504 - DNA, 14 bp, Homo sapiens
cagcttgctgccct

SEQ ID NO: 159505 - DNA, 22 bp, Homo sapiens
cagctttaaactcagggacaga

SEQ ID NO: 159506 - DNA, 21 bp, Homo sapiens
cagctttacatgcaatttatt

SEQ ID NO: 159507 - DNA, 12 bp, Homo sapiens
cagctttgtttg

SEQ ID NO: 159508 - DNA, 20 bp, Homo sapiens
caggaaaactgacagaggag

SEQ ID NO: 159509 - DNA, 23 bp, Homo sapiens
caggaaaactgacagaggagggc

SEQ ID NO: 159510 - DNA, 19 bp, Homo sapiens
caggaaagctcagctactg

SEQ ID NO: 159511 - DNA, 17 bp, Homo sapiens
caggaaagggaaggccc

SEQ ID NO: 159512 - DNA, 21 bp, Homo sapiens
caggaaatcaaatatgcaaag

SEQ ID NO: 159513 - DNA, 22 bp, Homo sapiens
caggaaatcaaatatgcaaagc

SEQ ID NO: 159514 - DNA, 21 bp, Homo sapiens
caggaaatgaaaatgtcttgt

SEQ ID NO: 159515 - DNA, 18 bp, Homo sapiens
caggaagcattcagagag

SEQ ID NO: 159516 - DNA, 15 bp, Homo sapiens
caggaagctgctccg

SEQ ID NO: 159517 - DNA, 16 bp, Homo sapiens
caggacaacgaggaag

SEQ ID NO: 159518 - DNA, 18 bp, Homo sapiens
caggacaacgaggaagcc

SEQ ID NO: 159519 - DNA, 17 bp, Homo sapiens
caggacaccacacccag

SEQ ID NO: 159520 - DNA, 20 bp, Homo sapiens
caggacaccacacccagcct

SEQ ID NO: 159521 - DNA, 22 bp, Homo sapiens
caggacaccacacccagcctca

SEQ ID NO: 159522 - DNA, 12 bp, Homo sapiens
caggacaggacc

SEQ ID NO: 159523 - DNA, 12 bp, Homo sapiens
caggacatttct

SEQ ID NO: 159524 - DNA, 21 bp, Homo sapiens
caggaccagtcaacctgggca

SEQ ID NO: 159525 - DNA, 13 bp, Homo sapiens
caggacccagagg

SEQ ID NO: 159526 - DNA, 13 bp, Homo sapiens
caggacctcaggt

SEQ ID NO: 159527 - DNA, 13 bp, Homo sapiens
caggacctgacta

SEQ ID NO: 159528 - DNA, 13 bp, Homo sapiens
caggacctgcctg

SEQ ID NO: 159529 - DNA, 16 bp, Homo sapiens
caggactcagaagcct

SEQ ID NO: 159530 - DNA, 15 bp, Homo sapiens
caggactctgcctcc

SEQ ID NO: 159531 - DNA, 19 bp, Homo sapiens
caggactgaattgtcccca

SEQ ID NO: 159532 - DNA, 14 bp, Homo sapiens
caggactgagcccc

SEQ ID NO: 159533 - DNA, 14 bp, Homo sapiens
caggagagaaaggg

SEQ ID NO: 159534 - DNA, 15 bp, Homo sapiens
caggagagccagccc

SEQ ID NO: 159535 - DNA, 16 bp, Homo sapiens
caggagagccagccct

SEQ ID NO: 159536 - DNA, 14 bp, Homo sapiens
caggagctgggatc

SEQ ID NO: 159537 - DNA, 22 bp, Homo sapiens
caggagctgggatcctaagggc

SEQ ID NO: 159538 - DNA, 19 bp, Homo sapiens
caggaggactgccccgtgc

SEQ ID NO: 159539 - DNA, 23 bp, Homo sapiens
caggaggagactagatttatgaa

SEQ ID NO: 159540 - DNA, 19 bp, Homo sapiens
caggaggatcacttgagtc

SEQ ID NO: 159541 - DNA, 13 bp, Homo sapiens
caggaggctgagg

SEQ ID NO: 159542 - DNA, 20 bp, Homo sapiens
caggaggtggaggttgcagt

SEQ ID NO: 159543 - DNA, 22 bp, Homo sapiens
caggagtttgagaccaacctgg

SEQ ID NO: 159544 - DNA, 16 bp, Homo sapiens
caggatgacctggata

SEQ ID NO: 159545 - DNA, 13 bp, Homo sapiens
caggatgcccagg

SEQ ID NO: 159546 - DNA, 19 bp, Homo sapiens
caggatgcccagggccact

SEQ ID NO: 159547 - DNA, 24 bp, Homo sapiens
caggatgcccagggccactctgcc

SEQ ID NO: 159548 - DNA, 18 bp, Homo sapiens
caggatgggggctggcct

SEQ ID NO: 159549 - DNA, 19 bp, Homo sapiens
caggatgggggctggcctc

SEQ ID NO: 159550 - DNA, 16 bp, Homo sapiens
caggcaactgaggcag

SEQ ID NO: 159551 - DNA, 19 bp, Homo sapiens
caggcaactgaggcagaca

SEQ ID NO: 159552 - DNA, 20 bp, Homo sapiens
caggcaactgaggcagacag

SEQ ID NO: 159553 - DNA, 15 bp, Homo sapiens
caggcacacttcttc

SEQ ID NO: 159554 - DNA, 21 bp, Homo sapiens
caggcacgaacccacctgctg

SEQ ID NO: 159555 - DNA, 22 bp, Homo sapiens
caggcacgaacccacctgctga

SEQ ID NO: 159556 - DNA, 23 bp, Homo sapiens
caggcactagcctttggctctgg

SEQ ID NO: 159557 - DNA, 22 bp, Homo sapiens
caggcactgagataccagcgag

SEQ ID NO: 159558 - DNA, 23 bp, Homo sapiens
caggcactgagataccagcgagg

SEQ ID NO: 159559 - DNA, 16 bp, Homo sapiens
caggcactgctgccca

SEQ ID NO: 159560 - DNA, 11 bp, Homo sapiens
caggcagacac

SEQ ID NO: 159561 - DNA, 13 bp, Homo sapiens
caggcagcattta

SEQ ID NO: 159562 - DNA, 18 bp, Homo sapiens
caggcagcgatggtctca

SEQ ID NO: 159563 - DNA, 20 bp, Homo sapiens
caggcaggtagccaggggga

SEQ ID NO: 159564 - DNA, 22 bp, Homo sapiens
caggcagtgatgctggatgctc

SEQ ID NO: 159565 - DNA, 19 bp, Homo sapiens
caggcattgccaagggctt

SEQ ID NO: 159566 - DNA, 17 bp, Homo sapiens
caggccacggcagccta

SEQ ID NO: 159567 - DNA, 12 bp, Homo sapiens
caggccaggctc

SEQ ID NO: 159568 - DNA, 18 bp, Homo sapiens
caggccaggctccttcct

SEQ ID NO: 159569 - DNA, 16 bp, Homo sapiens
caggccccaggaagcc

SEQ ID NO: 159570 - DNA, 13 bp, Homo sapiens
caggcccccaagc

SEQ ID NO: 159571 - DNA, 23 bp, Homo sapiens
catagtcatgtaagctgaaaata

SEQ ID NO: 159572 - DNA, 18 bp, Homo sapiens
catagtgaccggctgctt

SEQ ID NO: 159573 - DNA, 18 bp, Homo sapiens
catagtgatggttcccct

SEQ ID NO: 159574 - DNA, 19 bp, Homo sapiens
catagtgatggttcccctg

SEQ ID NO: 159575 - DNA, 23 bp, Homo sapiens
catataagattcatatttacttc

SEQ ID NO: 159576 - DNA, 18 bp, Homo sapiens
catataatgttgttattt

SEQ ID NO: 159577 - DNA, 16 bp, Homo sapiens
catatccaccacctcc

SEQ ID NO: 159578 - DNA, 23 bp, Homo sapiens
catatgctgtatatcctttctaa

SEQ ID NO: 159579 - DNA, 18 bp, Homo sapiens
catattcctgcagcctgg

SEQ ID NO: 159580 - DNA, 22 bp, Homo sapiens
catattcctgcagcctggaggc

SEQ ID NO: 159581 - DNA, 14 bp, Homo sapiens
catattgtgtgtaa

SEQ ID NO: 159582 - DNA, 17 bp, Homo sapiens
catatttacttcttata

SEQ ID NO: 159583 - DNA, 20 bp, Homo sapiens
catatttacttcttatacat

SEQ ID NO: 159584 - DNA, 13 bp, Homo sapiens
catattttgtata

SEQ ID NO: 159585 - DNA, 17 bp, Homo sapiens
catcaaactcttagtta

SEQ ID NO: 159586 - DNA, 23 bp, Homo sapiens
catcaagcacagaaggaggagga

SEQ ID NO: 159587 - DNA, 21 bp, Homo sapiens
catcaagttattgacaaactc

SEQ ID NO: 159588 - DNA, 20 bp, Homo sapiens
catcacccttaccatgtgcc

SEQ ID NO: 159589 - DNA, 22 bp, Homo sapiens
catcaccttaggcagggaagtg

SEQ ID NO: 159590 - DNA, 17 bp, Homo sapiens
catcacttttcagtgat

SEQ ID NO: 159591 - DNA, 14 bp, Homo sapiens
catcagaaggagaa

SEQ ID NO: 159592 - DNA, 23 bp, Homo sapiens
catcagcttaggggctgctgacc

SEQ ID NO: 159593 - DNA, 12 bp, Homo sapiens
catcagggacag

SEQ ID NO: 159594 - DNA, 16 bp, Homo sapiens
catcagtgctccctca

SEQ ID NO: 159595 - DNA, 14 bp, Homo sapiens
catcataaaataaa

SEQ ID NO: 159596 - DNA, 22 bp, Homo sapiens
catcataaaataaagtatatat

SEQ ID NO: 159597 - DNA, 21 bp, Homo sapiens
catcatctcctgccttcctcc

SEQ ID NO: 159598 - DNA, 22 bp, Homo sapiens
catcatgtccccaaacctgcaa

SEQ ID NO: 159599 - DNA, 18 bp, Homo sapiens
catcattcatgctactgc

SEQ ID NO: 159600 - DNA, 17 bp, Homo sapiens
catcattctctgtctca

SEQ ID NO: 159601 - DNA, 22 bp, Homo sapiens
catcattctctgtctcatccat

SEQ ID NO: 159602 - DNA, 20 bp, Homo sapiens
catccaatctaaccacatca

SEQ ID NO: 159603 - DNA, 23 bp, Homo sapiens
catccaatgctcaagaaacaact

SEQ ID NO: 159604 - DNA, 14 bp, Homo sapiens
catccactagtgca

SEQ ID NO: 159605 - DNA, 14 bp, Homo sapiens
catccatcatcatg

SEQ ID NO: 159606 - DNA, 22 bp, Homo sapiens
catccatttatttggcatctgt

SEQ ID NO: 159607 - DNA, 19 bp, Homo sapiens
catccatttcatctatttc

SEQ ID NO: 159608 - DNA, 14 bp, Homo sapiens
catcccacaccctg

SEQ ID NO: 159609 - DNA, 13 bp, Homo sapiens
catcccaggacac

SEQ ID NO: 159610 - DNA, 22 bp, Homo sapiens
catcccaggacaccacacccag

SEQ ID NO: 159611 - DNA, 23 bp, Homo sapiens
catcccaggacaccacacccagc

SEQ ID NO: 159612 - DNA, 18 bp, Homo sapiens
catcccatgatgtagtgc

SEQ ID NO: 159613 - DNA, 15 bp, Homo sapiens
catcccatgtattta

SEQ ID NO: 159614 - DNA, 19 bp, Homo sapiens
catcccctggactgggagg

SEQ ID NO: 159615 - DNA, 21 bp, Homo sapiens
catcccctgtagagtgggagc

SEQ ID NO: 159616 - DNA, 17 bp, Homo sapiens
catcccgagcacctcca

SEQ ID NO: 159617 - DNA, 13 bp, Homo sapiens
catccctgcctgg

SEQ ID NO: 159618 - DNA, 13 bp, Homo sapiens
catccctttttga

SEQ ID NO: 159619 - DNA, 23 bp, Homo sapiens
catccgaggcagggtcaggagag

SEQ ID NO: 159620 - DNA, 16 bp, Homo sapiens
catccgtagttccctg

SEQ ID NO: 159621 - DNA, 16 bp, Homo sapiens
catcctatcagcctgt

SEQ ID NO: 159622 - DNA, 24 bp, Homo sapiens
catcctatcagcctgtctcttcca

SEQ ID NO: 159623 - DNA, 20 bp, Homo sapiens
catcctccacgttctgctca

SEQ ID NO: 159624 - DNA, 11 bp, Homo sapiens
catccttaaag

SEQ ID NO: 159625 - DNA, 15 bp, Homo sapiens
catctaacctcatct

SEQ ID NO: 159626 - DNA, 16 bp, Homo sapiens
catctcaaccatcccc

SEQ ID NO: 159627 - DNA, 15 bp, Homo sapiens
catctcaggggccag

SEQ ID NO: 159628 - DNA, 17 bp, Homo sapiens
catctcccagataatgt

SEQ ID NO: 159629 - DNA, 16 bp, Homo sapiens
catctcctgccttcct

SEQ ID NO: 159630 - DNA, 21 bp, Homo sapiens
catctcgccacccctccttcc

SEQ ID NO: 159631 - DNA, 12 bp, Homo sapiens
catctctccctc

SEQ ID NO: 159632 - DNA, 16 bp, Homo sapiens
catctctccctcccct

SEQ ID NO: 159633 - DNA, 20 bp, Homo sapiens
catctctccctcccctgcca

SEQ ID NO: 159634 - DNA, 22 bp, Homo sapiens
catctgcttacaattccctgct

SEQ ID NO: 159635 - DNA, 21 bp, Homo sapiens
catctgggaagatttctacct

SEQ ID NO: 159636 - DNA, 20 bp, Homo sapiens
catctgtataagtaagaaaa

SEQ ID NO: 159637 - DNA, 17 bp, Homo sapiens
catctgtccctccggga

SEQ ID NO: 159638 - DNA, 18 bp, Homo sapiens
catctgtccctccgggac

SEQ ID NO: 159639 - DNA, 20 bp, Homo sapiens
catctgtccctccgggacct

SEQ ID NO: 159640 - DNA, 13 bp, Homo sapiens
catctgtgtcttg

SEQ ID NO: 159641 - DNA, 12 bp, Homo sapiens
catctgttgttt

SEQ ID NO: 159642 - DNA, 20 bp, Homo sapiens
catcttagtatttgcatatt

SEQ ID NO: 159643 - DNA, 14 bp, Homo sapiens
catcttctccatct

SEQ ID NO: 159644 - DNA, 16 bp, Homo sapiens
catcttctccatctgg

SEQ ID NO: 159645 - DNA, 14 bp, Homo sapiens
catcttcttcacca

SEQ ID NO: 159646 - DNA, 19 bp, Homo sapiens
catcttcttcaccatttgg

SEQ ID NO: 159647 - DNA, 18 bp, Homo sapiens
catcttgaccaagcagga

SEQ ID NO: 159648 - DNA, 21 bp, Homo sapiens
catcttgaccaagcaggaagc

SEQ ID NO: 159649 - DNA, 22 bp, Homo sapiens
catcttgaccaagcaggaagct

SEQ ID NO: 159650 - DNA, 23 bp, Homo sapiens
catcttgaccaagcaggaagctc

SEQ ID NO: 159651 - DNA, 16 bp, Homo sapiens
catcttggagggacca

SEQ ID NO: 159652 - DNA, 16 bp, Homo sapiens
catctttcttctattt

SEQ ID NO: 159653 - DNA, 13 bp, Homo sapiens
catgaaacaaagc

SEQ ID NO: 159654 - DNA, 14 bp, Homo sapiens
catgaaatatgcat

SEQ ID NO: 159655 - DNA, 15 bp, Homo sapiens
catgaaatatgcatc

SEQ ID NO: 159656 - DNA, 17 bp, Homo sapiens
catgacatgttatatat

SEQ ID NO: 159657 - DNA, 20 bp, Homo sapiens
catgactcgtatatgtctca

SEQ ID NO: 159658 - DNA, 23 bp, Homo sapiens
catgactcgtatatgtctcaggt

SEQ ID NO: 159659 - DNA, 19 bp, Homo sapiens
catgagacacatctcctcc

SEQ ID NO: 159660 - DNA, 12 bp, Homo sapiens
catgaggaacta

SEQ ID NO: 159661 - DNA, 14 bp, Homo sapiens
catgagtgaataaa

SEQ ID NO: 159662 - DNA, 16 bp, Homo sapiens
catgatctccctgccg

SEQ ID NO: 159663 - DNA, 17 bp, Homo sapiens
catgatctccctgccgc

SEQ ID NO: 159664 - DNA, 19 bp, Homo sapiens
catgatctccctgccgcct

SEQ ID NO: 159665 - DNA, 21 bp, Homo sapiens
catgatctccctgccgcctca

SEQ ID NO: 159666 - DNA, 20 bp, Homo sapiens
catgatgtagtgcctctttc

SEQ ID NO: 159667 - DNA, 19 bp, Homo sapiens
catgatgttaaccagaata

SEQ ID NO: 159668 - DNA, 22 bp, Homo sapiens
catgattaaccacttcagctga

SEQ ID NO: 159669 - DNA, 24 bp, Homo sapiens
catgattttgaaatcatgaagata

SEQ ID NO: 159670 - DNA, 18 bp, Homo sapiens
catgcaatttattaaaat

SEQ ID NO: 159671 - DNA, 14 bp, Homo sapiens
catgcagcatctaa

SEQ ID NO: 159672 - DNA, 15 bp, Homo sapiens
catgcatctccacct

SEQ ID NO: 159673 - DNA, 17 bp, Homo sapiens
catgcatctccacctgc

SEQ ID NO: 159674 - DNA, 21 bp, Homo sapiens
catgccaccatggccagccaa

SEQ ID NO: 159675 - DNA, 16 bp, Homo sapiens
catgccccggccacct

SEQ ID NO: 159676 - DNA, 17 bp, Homo sapiens
catgccccggccacctc

SEQ ID NO: 159677 - DNA, 21 bp, Homo sapiens
catgccccggccacctctgcg

SEQ ID NO: 159678 - DNA, 15 bp, Homo sapiens
catgcgggctgggca

SEQ ID NO: 159679 - DNA, 18 bp, Homo sapiens
catgcgggctgggcagct

SEQ ID NO: 159680 - DNA, 21 bp, Homo sapiens
catgcgggctgggcagctgtt

SEQ ID NO: 159681 - DNA, 14 bp, Homo sapiens
catgctaattatat

SEQ ID NO: 159682 - DNA, 16 bp, Homo sapiens
catgctcctggcccac

SEQ ID NO: 159683 - DNA, 19 bp, Homo sapiens
catgctctctgcagccagc

SEQ ID NO: 159684 - DNA, 21 bp, Homo sapiens
catgctctctgcagccagccc

SEQ ID NO: 159685 - DNA, 12 bp, Homo sapiens
catgctgcctcc

SEQ ID NO: 159686 - DNA, 23 bp, Homo sapiens
catgctgggaagacgcctgagct

SEQ ID NO: 159687 - DNA, 17 bp, Homo sapiens
catggaaacctgaaaaa

SEQ ID NO: 159688 - DNA, 18 bp, Homo sapiens
catggacatgatcttctt

SEQ ID NO: 159689 - DNA, 11 bp, Homo sapiens
catggagaaac

SEQ ID NO: 159690 - DNA, 20 bp, Homo sapiens
catggagaaaccctgtctct

SEQ ID NO: 159691 - DNA, 17 bp, Homo sapiens
catggaggtttgaagat

SEQ ID NO: 159692 - DNA, 19 bp, Homo sapiens
catggcaccaaagccacca

SEQ ID NO: 159693 - DNA, 22 bp, Homo sapiens
catggccacttgggtcttccct

SEQ ID NO: 159694 - DNA, 15 bp, Homo sapiens
catggccaggtggcc

SEQ ID NO: 159695 - DNA, 12 bp, Homo sapiens
catggccctggg

SEQ ID NO: 159696 - DNA, 14 bp, Homo sapiens
catggccctggggt

SEQ ID NO: 159697 - DNA, 15 bp, Homo sapiens
catggcttaatgttt

SEQ ID NO: 159698 - DNA, 14 bp, Homo sapiens
catgggggcagggc

SEQ ID NO: 159699 - DNA, 19 bp, Homo sapiens
catggtcagccctagggtg

SEQ ID NO: 159700 - DNA, 12 bp, Homo sapiens
catggtggcgca

SEQ ID NO: 159701 - DNA, 17 bp, Homo sapiens
catggtggcgcaagcct

SEQ ID NO: 159702 - DNA, 21 bp, Homo sapiens
catggtgggtccatgggcaga

SEQ ID NO: 159703 - DNA, 15 bp, Homo sapiens
catgtaaactgtgca

SEQ ID NO: 159704 - DNA, 18 bp, Homo sapiens
catgtaagctgaaaatat

SEQ ID NO: 159705 - DNA, 23 bp, Homo sapiens
catgtaagctgaaaatatggcaa

SEQ ID NO: 159706 - DNA, 21 bp, Homo sapiens
catgtacaaaatcgattggct

SEQ ID NO: 159707 - DNA, 23 bp, Homo sapiens
catgtacaaaatcgattggcttt

SEQ ID NO: 159708 - DNA, 20 bp, Homo sapiens
catgtagaaaatttgttatt

SEQ ID NO: 159709 - DNA, 20 bp, Homo sapiens
catgtatttatctctattta

SEQ ID NO: 159710 - DNA, 23 bp, Homo sapiens
catgtatttatctctatttaata

SEQ ID NO: 159711 - DNA, 20 bp, Homo sapiens
catgtcaccggatcctgggt

SEQ ID NO: 159712 - DNA, 16 bp, Homo sapiens
catgtcagcaaaaagc

SEQ ID NO: 159713 - DNA, 20 bp, Homo sapiens
catgtccccaaacctgcaag

SEQ ID NO: 159714 - DNA, 15 bp, Homo sapiens
catgtcgcctctgca

SEQ ID NO: 159715 - DNA, 18 bp, Homo sapiens
catgtcgcctctgcattc

SEQ ID NO: 159716 - DNA, 13 bp, Homo sapiens
catgtgacattta

SEQ ID NO: 159717 - DNA, 17 bp, Homo sapiens
ccaggcaacttgggaac

SEQ ID NO: 159718 - DNA, 18 bp, Homo sapiens
ccaggcacgaacccacct

SEQ ID NO: 159719 - DNA, 23 bp, Homo sapiens
ccaggcacgaacccacctgctga

SEQ ID NO: 159720 - DNA, 16 bp, Homo sapiens
ccaggcactgctgccc

SEQ ID NO: 159721 - DNA, 16 bp, Homo sapiens
ccaggcattgccaagg

SEQ ID NO: 159722 - DNA, 15 bp, Homo sapiens
ccaggcccggggctg

SEQ ID NO: 159723 - DNA, 16 bp, Homo sapiens
ccaggccgccccagcc

SEQ ID NO: 159724 - DNA, 16 bp, Homo sapiens
ccaggccgtggctgcc

SEQ ID NO: 159725 - DNA, 16 bp, Homo sapiens
ccaggcctctgtgtcc

SEQ ID NO: 159726 - DNA, 18 bp, Homo sapiens
ccaggcctctgtgtcctt

SEQ ID NO: 159727 - DNA, 18 bp, Homo sapiens
ccaggcgccccttccccc

SEQ ID NO: 159728 - DNA, 19 bp, Homo sapiens
ccaggcgccccttccccct

SEQ ID NO: 159729 - DNA, 21 bp, Homo sapiens
ccaggcgggagcggtggccct

SEQ ID NO: 159730 - DNA, 22 bp, Homo sapiens
ccaggctccttcctgtcttcct

SEQ ID NO: 159731 - DNA, 23 bp, Homo sapiens
ccaggctccttcctgtcttcctg

SEQ ID NO: 159732 - DNA, 19 bp, Homo sapiens
ccagggccacgtgccaggc

SEQ ID NO: 159733 - DNA, 20 bp, Homo sapiens
ccagggccactctgcctctg

SEQ ID NO: 159734 - DNA, 21 bp, Homo sapiens
ccagggccactctgcctctgc

SEQ ID NO: 159735 - DNA, 18 bp, Homo sapiens
ccagggcctgagccaagc

SEQ ID NO: 159736 - DNA, 19 bp, Homo sapiens
ccagggctatgggagcagc

SEQ ID NO: 159737 - DNA, 20 bp, Homo sapiens
ccagggctatgggagcagct

SEQ ID NO: 159738 - DNA, 20 bp, Homo sapiens
ccagggctcagcctggtggg

SEQ ID NO: 159739 - DNA, 21 bp, Homo sapiens
ccaggggaaaatcagcctgct

SEQ ID NO: 159740 - DNA, 21 bp, Homo sapiens
ccaggggagagggtctggaga

SEQ ID NO: 159741 - DNA, 18 bp, Homo sapiens
ccaggggatgagtggagg

SEQ ID NO: 159742 - DNA, 17 bp, Homo sapiens
ccagggggactagcccc

SEQ ID NO: 159743 - DNA, 16 bp, Homo sapiens
ccagggttgaccccag

SEQ ID NO: 159744 - DNA, 18 bp, Homo sapiens
ccagggttgaccccagag

SEQ ID NO: 159745 - DNA, 13 bp, Homo sapiens
ccaggtgcacaga

SEQ ID NO: 159746 - DNA, 19 bp, Homo sapiens
ccaggtgcacagacgtccc

SEQ ID NO: 159747 - DNA, 12 bp, Homo sapiens
ccaggtgccagt

SEQ ID NO: 159748 - DNA, 21 bp, Homo sapiens
ccaggtggctgacccagtccc

SEQ ID NO: 159749 - DNA, 22 bp, Homo sapiens
ccaggtggctgacccagtccct

SEQ ID NO: 159750 - DNA, 23 bp, Homo sapiens
ccaggtggctgacccagtccctg

SEQ ID NO: 159751 - DNA, 18 bp, Homo sapiens
ccagtccccctgccccag

SEQ ID NO: 159752 - DNA, 17 bp, Homo sapiens
ccagtccccgtgccccg

SEQ ID NO: 159753 - DNA, 22 bp, Homo sapiens
ccagtccccgtgccccgcctcc

SEQ ID NO: 159754 - DNA, 23 bp, Homo sapiens
ccagtccctgggggaagccctgg

SEQ ID NO: 159755 - DNA, 13 bp, Homo sapiens
ccagtctgaccct

SEQ ID NO: 159756 - DNA, 20 bp, Homo sapiens
ccagtgaattcttgaaggaa

SEQ ID NO: 159757 - DNA, 22 bp, Homo sapiens
ccagtgacctgctgggtaaact

SEQ ID NO: 159758 - DNA, 16 bp, Homo sapiens
ccagtgagcactccca

SEQ ID NO: 159759 - DNA, 18 bp, Homo sapiens
ccagtgagcactcccaag

SEQ ID NO: 159760 - DNA, 20 bp, Homo sapiens
ccagtgagcactcccaagtc

SEQ ID NO: 159761 - DNA, 22 bp, Homo sapiens
ccagtgcccaaagtctgtgtga

SEQ ID NO: 159762 - DNA, 20 bp, Homo sapiens
ccagtgccgagaaggaagcc

SEQ ID NO: 159763 - DNA, 18 bp, Homo sapiens
ccagtgccttacctcctg

SEQ ID NO: 159764 - DNA, 23 bp, Homo sapiens
ccagtgccttacctcctgcccag

SEQ ID NO: 159765 - DNA, 13 bp, Homo sapiens
ccagtgggaagat

SEQ ID NO: 159766 - DNA, 17 bp, Homo sapiens
ccagtggtctcacatgg

SEQ ID NO: 159767 - DNA, 21 bp, Homo sapiens
ccagttatggctataggtgct

SEQ ID NO: 159768 - DNA, 12 bp, Homo sapiens
ccataaaacatt

SEQ ID NO: 159769 - DNA, 14 bp, Homo sapiens
ccataatctggact

SEQ ID NO: 159770 - DNA, 20 bp, Homo sapiens
ccataattttttttttcctt

SEQ ID NO: 159771 - DNA, 16 bp, Homo sapiens
ccatagagtttaacac

SEQ ID NO: 159772 - DNA, 19 bp, Homo sapiens
ccatatgacctcatgcatc

SEQ ID NO: 159773 - DNA, 12 bp, Homo sapiens
ccatatttattc

SEQ ID NO: 159774 - DNA, 13 bp, Homo sapiens
ccatcaccagaca

SEQ ID NO: 159775 - DNA, 14 bp, Homo sapiens
ccatcactggagca

SEQ ID NO: 159776 - DNA, 17 bp, Homo sapiens
ccatcaggttccatccc

SEQ ID NO: 159777 - DNA, 12 bp, Homo sapiens
ccatcagtgctc

SEQ ID NO: 159778 - DNA, 13 bp, Homo sapiens
ccatcatctcctg

SEQ ID NO: 159779 - DNA, 14 bp, Homo sapiens
ccatcatgtcccca

SEQ ID NO: 159780 - DNA, 17 bp, Homo sapiens
ccatcccactgctcccc

SEQ ID NO: 159781 - DNA, 20 bp, Homo sapiens
ccatcccactgctcccccaa

SEQ ID NO: 159782 - DNA, 14 bp, Homo sapiens
ccatcccaggacac

SEQ ID NO: 159783 - DNA, 21 bp, Homo sapiens
ccatcccaggacaccacaccc

SEQ ID NO: 159784 - DNA, 24 bp, Homo sapiens
ccatcccaggacaccacacccagc

SEQ ID NO: 159785 - DNA, 16 bp, Homo sapiens
ccatcccgaaaatctc

SEQ ID NO: 159786 - DNA, 13 bp, Homo sapiens
ccatccctgcctg

SEQ ID NO: 159787 - DNA, 16 bp, Homo sapiens
ccatccctgcctggtc

SEQ ID NO: 159788 - DNA, 19 bp, Homo sapiens
ccatccctttttgaagtgt

SEQ ID NO: 159789 - DNA, 21 bp, Homo sapiens
ccatcctaatcatccaatgct

SEQ ID NO: 159790 - DNA, 20 bp, Homo sapiens
ccatctatgtcccttgctgt

SEQ ID NO: 159791 - DNA, 22 bp, Homo sapiens
ccatctatgtcccttgctgtga

SEQ ID NO: 159792 - DNA, 23 bp, Homo sapiens
ccatctcgccacccctccttcct

SEQ ID NO: 159793 - DNA, 23 bp, Homo sapiens
ccatctctccctcccctgccatt

SEQ ID NO: 159794 - DNA, 23 bp, Homo sapiens
ccatctgggtccttgcacccctc

SEQ ID NO: 159795 - DNA, 14 bp, Homo sapiens
ccatgaagacagga

SEQ ID NO: 159796 - DNA, 14 bp, Homo sapiens
ccatgaagatgtag

SEQ ID NO: 159797 - DNA, 22 bp, Homo sapiens
ccatgagaataagagaaagaaa

SEQ ID NO: 159798 - DNA, 17 bp, Homo sapiens
ccatgatccctgtgttg

SEQ ID NO: 159799 - DNA, 21 bp, Homo sapiens
ccatgattaaccacttcagct

SEQ ID NO: 159800 - DNA, 14 bp, Homo sapiens
ccatggacactcca

SEQ ID NO: 159801 - DNA, 21 bp, Homo sapiens
ccatggacactccagtgccag

SEQ ID NO: 159802 - DNA, 21 bp, Homo sapiens
ccatggaggcacacagctgca

SEQ ID NO: 159803 - DNA, 16 bp, Homo sapiens
ccatgtagaaaatttg

SEQ ID NO: 159804 - DNA, 23 bp, Homo sapiens
ccatgtcaccggatcctgggtgg

SEQ ID NO: 159805 - DNA, 15 bp, Homo sapiens
ccatgtcgcctctgc

SEQ ID NO: 159806 - DNA, 16 bp, Homo sapiens
ccatgtcgcctctgca

SEQ ID NO: 159807 - DNA, 17 bp, Homo sapiens
ccatgtcgcctctgcat

SEQ ID NO: 159808 - DNA, 21 bp, Homo sapiens
ccatgtgcctgatccagcctc

SEQ ID NO: 159809 - DNA, 11 bp, Homo sapiens
ccatgtgtgag

SEQ ID NO: 159810 - DNA, 17 bp, Homo sapiens
ccatgtttgagctcaga

SEQ ID NO: 159811 - DNA, 15 bp, Homo sapiens
ccatgtttgtaaaac

SEQ ID NO: 159812 - DNA, 18 bp, Homo sapiens
ccatgttttgtttacggt

SEQ ID NO: 159813 - DNA, 13 bp, Homo sapiens
ccattcctcaggg

SEQ ID NO: 159814 - DNA, 16 bp, Homo sapiens
ccattcctcagggaca

SEQ ID NO: 159815 - DNA, 13 bp, Homo sapiens
ccattgaattctt

SEQ ID NO: 159816 - DNA, 18 bp, Homo sapiens
ccattgcactccagcctg

SEQ ID NO: 159817 - DNA, 15 bp, Homo sapiens
ccattggatctcatt

SEQ ID NO: 159818 - DNA, 22 bp, Homo sapiens
ccattgtggtcacaggaagtag

SEQ ID NO: 159819 - DNA, 12 bp, Homo sapiens
ccattgtgtgag

SEQ ID NO: 159820 - DNA, 21 bp, Homo sapiens
ccatttcatctatttctgaga

SEQ ID NO: 159821 - DNA, 19 bp, Homo sapiens
ccatttggcagagcttctt

SEQ ID NO: 159822 - DNA, 23 bp, Homo sapiens
cccaaaagtcaaaaggtgcctgt

SEQ ID NO: 159823 - DNA, 17 bp, Homo sapiens
cccaaacaaatatgcaa

SEQ ID NO: 159824 - DNA, 20 bp, Homo sapiens
cccaaagctttcctgcccca

SEQ ID NO: 159825 - DNA, 14 bp, Homo sapiens
cccaaaggactcca

SEQ ID NO: 159826 - DNA, 23 bp, Homo sapiens
cccaacagcgacatagcccatcc

SEQ ID NO: 159827 - DNA, 23 bp, Homo sapiens
cccaacctgctctcctcttgcca

SEQ ID NO: 159828 - DNA, 23 bp, Homo sapiens
cccaactcctggaagctgtgtcc

SEQ ID NO: 159829 - DNA, 15 bp, Homo sapiens
cccaactctcctgga

SEQ ID NO: 159830 - DNA, 15 bp, Homo sapiens
cccaaggaggaaaaa

SEQ ID NO: 159831 - DNA, 21 bp, Homo sapiens
cccaagggcaaaattcccagg

SEQ ID NO: 159832 - DNA, 22 bp, Homo sapiens
cccaagggcaaaattcccaggg

SEQ ID NO: 159833 - DNA, 12 bp, Homo sapiens
cccaaggggcag

SEQ ID NO: 159834 - DNA, 15 bp, Homo sapiens
cccaaggggcagtct

SEQ ID NO: 159835 - DNA, 12 bp, Homo sapiens
cccaatattata

SEQ ID NO: 159836 - DNA, 15 bp, Homo sapiens
cccaatattataatt

SEQ ID NO: 159837 - DNA, 17 bp, Homo sapiens
cccaatattataatttt

SEQ ID NO: 159838 - DNA, 12 bp, Homo sapiens
cccacaccctgg

SEQ ID NO: 159839 - DNA, 21 bp, Homo sapiens
cccacagaaagactgagctca

SEQ ID NO: 159840 - DNA, 14 bp, Homo sapiens
cccacagctcccac

SEQ ID NO: 159841 - DNA, 20 bp, Homo sapiens
cccacagctcccaccccacc

SEQ ID NO: 159842 - DNA, 19 bp, Homo sapiens
cccacaggacatttctcta

SEQ ID NO: 159843 - DNA, 19 bp, Homo sapiens
cccacatagtgatggttcc

SEQ ID NO: 159844 - DNA, 21 bp, Homo sapiens
cccaccaacatcccattgccc

SEQ ID NO: 159845 - DNA, 13 bp, Homo sapiens
cccaccacctagg

SEQ ID NO: 159846 - DNA, 16 bp, Homo sapiens
cccaccacctaggcca

SEQ ID NO: 159847 - DNA, 17 bp, Homo sapiens
cccaccccctccccagg

SEQ ID NO: 159848 - DNA, 17 bp, Homo sapiens
cccacctctgtgacctc

SEQ ID NO: 159849 - DNA, 20 bp, Homo sapiens
cccacctctgtgacctcagg

SEQ ID NO: 159850 - DNA, 13 bp, Homo sapiens
cccacctgggacc

SEQ ID NO: 159851 - DNA, 21 bp, Homo sapiens
cccacctttattaaaatctta

SEQ ID NO: 159852 - DNA, 17 bp, Homo sapiens
cccactcaagccaagca

SEQ ID NO: 159853 - DNA, 23 bp, Homo sapiens
cccactcaagccaagcagccaag

SEQ ID NO: 159854 - DNA, 18 bp, Homo sapiens
cccactcagctccgtgaa

SEQ ID NO: 159855 - DNA, 19 bp, Homo sapiens
cccactctcattccccagg

SEQ ID NO: 159856 - DNA, 16 bp, Homo sapiens
cccactgacagcctcc

SEQ ID NO: 159857 - DNA, 13 bp, Homo sapiens
cccactgctcccc

SEQ ID NO: 159858 - DNA, 21 bp, Homo sapiens
cccactggggaaataacagct

SEQ ID NO: 159859 - DNA, 19 bp, Homo sapiens
cccagaacctgtccttgca

SEQ ID NO: 159860 - DNA, 12 bp, Homo sapiens
cccagacagctc

SEQ ID NO: 159861 - DNA, 14 bp, Homo sapiens
cccagacagctccc

SEQ ID NO: 159862 - DNA, 16 bp, Homo sapiens
cccagacagctccctc

SEQ ID NO: 159863 - DNA, 20 bp, Homo sapiens
cccagacagctccctctgcc

SEQ ID NO: 159864 - DNA, 13 bp, Homo sapiens
cccagagacagga

SEQ ID NO: 159865 - DNA, 14 bp, Homo sapiens
cccagagacaggaa

SEQ ID NO: 159866 - DNA, 14 bp, Homo sapiens
cccagagatgcctc

SEQ ID NO: 159867 - DNA, 16 bp, Homo sapiens
cccagagatgcctcca

SEQ ID NO: 159868 - DNA, 18 bp, Homo sapiens
cccagagatgcctccacc

SEQ ID NO: 159869 - DNA, 20 bp, Homo sapiens
cccagagatgcctccaccgc

SEQ ID NO: 159870 - DNA, 23 bp, Homo sapiens
cccagagatgcctccaccgctgc

SEQ ID NO: 159871 - DNA, 20 bp, Homo sapiens
cccagagatgggactgggag

SEQ ID NO: 159872 - DNA, 14 bp, Homo sapiens
cccagagcaggaag

SEQ ID NO: 159873 - DNA, 24 bp, Homo sapiens
cccagaggaaggggccagaggctc

SEQ ID NO: 159874 - DNA, 23 bp, Homo sapiens
cccagagtgtgggaagggagagc

SEQ ID NO: 159875 - DNA, 16 bp, Homo sapiens
cccagcaactccaact

SEQ ID NO: 159876 - DNA, 15 bp, Homo sapiens
cccagcactttggga

SEQ ID NO: 159877 - DNA, 13 bp, Homo sapiens
cccagcccagctg

SEQ ID NO: 159878 - DNA, 18 bp, Homo sapiens
cccagcccctagcccagg

SEQ ID NO: 159879 - DNA, 20 bp, Homo sapiens
cccagcccctagcccaggag

SEQ ID NO: 159880 - DNA, 22 bp, Homo sapiens
cccagcccctagcccaggagag

SEQ ID NO: 159881 - DNA, 12 bp, Homo sapiens
cccagcctcagt

SEQ ID NO: 159882 - DNA, 21 bp, Homo sapiens
cccagcctcttctagagccgt

SEQ ID NO: 159883 - DNA, 15 bp, Homo sapiens
cccagctacttggga

SEQ ID NO: 159884 - DNA, 17 bp, Homo sapiens
cccagctatacctgtgc

SEQ ID NO: 159885 - DNA, 15 bp, Homo sapiens
cccagctcagagggt

SEQ ID NO: 159886 - DNA, 12 bp, Homo sapiens
cccagctctccc

SEQ ID NO: 159887 - DNA, 14 bp, Homo sapiens
cccagctctccctc

SEQ ID NO: 159888 - DNA, 21 bp, Homo sapiens
cccagctctccctctggccct

SEQ ID NO: 159889 - DNA, 15 bp, Homo sapiens
cccagctgctcccct

SEQ ID NO: 159890 - DNA, 16 bp, Homo sapiens
cccagctggtgggaag

SEQ ID NO: 159891 - DNA, 17 bp, Homo sapiens
cccagctgtgagccttg

SEQ ID NO: 159892 - DNA, 20 bp, Homo sapiens
cccaggacaccacacccagc

SEQ ID NO: 159893 - DNA, 13 bp, Homo sapiens
cccaggagagaga

SEQ ID NO: 159894 - DNA, 16 bp, Homo sapiens
cccaggagagagaaag

SEQ ID NO: 159895 - DNA, 20 bp, Homo sapiens
cccaggagagagaaagccag

SEQ ID NO: 159896 - DNA, 14 bp, Homo sapiens
cccaggagagccag

SEQ ID NO: 159897 - DNA, 21 bp, Homo sapiens
cccaggagagccagccctccc

SEQ ID NO: 159898 - DNA, 22 bp, Homo sapiens
cccaggagagccagccctccct

SEQ ID NO: 159899 - DNA, 23 bp, Homo sapiens
cccaggaggtggaggttgcagtg

SEQ ID NO: 159900 - DNA, 21 bp, Homo sapiens
cccaggcattgccaagggctt

SEQ ID NO: 159901 - DNA, 21 bp, Homo sapiens
cccaggccaggctccttcctg

SEQ ID NO: 159902 - DNA, 13 bp, Homo sapiens
cccaggccccagg

SEQ ID NO: 159903 - DNA, 15 bp, Homo sapiens
cccaggccgtggctg

SEQ ID NO: 159904 - DNA, 13 bp, Homo sapiens
cccaggcctctgt

SEQ ID NO: 159905 - DNA, 18 bp, Homo sapiens
cccaggcgccccttcccc

SEQ ID NO: 159906 - DNA, 13 bp, Homo sapiens
cccaggcgggagc

SEQ ID NO: 159907 - DNA, 22 bp, Homo sapiens
cccaggcgggagcggtggccct

SEQ ID NO: 159908 - DNA, 16 bp, Homo sapiens
cccaggctggtctcaa

SEQ ID NO: 159909 - DNA, 22 bp, Homo sapiens
cccagggagcggaaagcagctc

SEQ ID NO: 159910 - DNA, 23 bp, Homo sapiens
cccagggccactctgcctctgcc

SEQ ID NO: 159911 - DNA, 15 bp, Homo sapiens
cccagggcctgagcc

SEQ ID NO: 159912 - DNA, 21 bp, Homo sapiens
cccagggctaccctcccccag

SEQ ID NO: 159913 - DNA, 18 bp, Homo sapiens
cccagggctcagcctggt

SEQ ID NO: 159914 - DNA, 21 bp, Homo sapiens
cccaggggagagggtctggag

SEQ ID NO: 159915 - DNA, 23 bp, Homo sapiens
cccaggggagagggtctggagaa

SEQ ID NO: 159916 - DNA, 16 bp, Homo sapiens
cccaggtggctgaccc

SEQ ID NO: 159917 - DNA, 18 bp, Homo sapiens
cccaggtggctgacccag

SEQ ID NO: 159918 - DNA, 23 bp, Homo sapiens
cccagtccccgtgccccgcctcc

SEQ ID NO: 159919 - DNA, 13 bp, Homo sapiens
cccagtccctggg

SEQ ID NO: 159920 - DNA, 14 bp, Homo sapiens
cccagtgcacccac

SEQ ID NO: 159921 - DNA, 15 bp, Homo sapiens
cccagtgccgagaag

SEQ ID NO: 159922 - DNA, 15 bp, Homo sapiens
cccagtttgcagaaa

SEQ ID NO: 159923 - DNA, 22 bp, Homo sapiens
cccagtttgcagaaaagcacct

SEQ ID NO: 159924 - DNA, 22 bp, Homo sapiens
cccataattttttttttccttt

SEQ ID NO: 159925 - DNA, 23 bp, Homo sapiens
cccataattttttttttcctttt

SEQ ID NO: 159926 - DNA, 20 bp, Homo sapiens
cccatatttgtacaccaata

SEQ ID NO: 159927 - DNA, 20 bp, Homo sapiens
cccatcactggagcaccagg

SEQ ID NO: 159928 - DNA, 23 bp, Homo sapiens
cccatcagtgctccctcacatgt

SEQ ID NO: 159929 - DNA, 12 bp, Homo sapiens
cccatcattcat

SEQ ID NO: 159930 - DNA, 20 bp, Homo sapiens
cccatcattcatgctactgc

SEQ ID NO: 159931 - DNA, 21 bp, Homo sapiens
cccatctatgtcccttgctgt

SEQ ID NO: 159932 - DNA, 23 bp, Homo sapiens
cccatctctccctcccctgccat

SEQ ID NO: 159933 - DNA, 20 bp, Homo sapiens
cccatggacactccagtgcc

SEQ ID NO: 159934 - DNA, 20 bp, Homo sapiens
cccatgtgtgagtgtgtgca

SEQ ID NO: 159935 - DNA, 20 bp, Homo sapiens
cccattctctctcctgtcca

SEQ ID NO: 159936 - DNA, 14 bp, Homo sapiens
cccattgccctggt

SEQ ID NO: 159937 - DNA, 17 bp, Homo sapiens
cccattgcctcctcctt

SEQ ID NO: 159938 - DNA, 22 bp, Homo sapiens
cccattgtggtcacaggaagta

SEQ ID NO: 159939 - DNA, 20 bp, Homo sapiens
cccatttctagaacatccct

SEQ ID NO: 159940 - DNA, 12 bp, Homo sapiens
ccccaaagcccc

SEQ ID NO: 159941 - DNA, 22 bp, Homo sapiens
ccccaacagcgacatagcccat

SEQ ID NO: 159942 - DNA, 17 bp, Homo sapiens
ccccaccacttctttta

SEQ ID NO: 159943 - DNA, 12 bp, Homo sapiens
ccccaccccctt

SEQ ID NO: 159944 - DNA, 15 bp, Homo sapiens
ccccactgacagcct

SEQ ID NO: 159945 - DNA, 18 bp, Homo sapiens
ccccactgcaggccccgc

SEQ ID NO: 159946 - DNA, 19 bp, Homo sapiens
ccccactgcctactgcatc

SEQ ID NO: 159947 - DNA, 22 bp, Homo sapiens
ccccagagtgtgggaagggaga

SEQ ID NO: 159948 - DNA, 15 bp, Homo sapiens
ccccagcccagggtg

SEQ ID NO: 159949 - DNA, 20 bp, Homo sapiens
ccccagcccctagcccagga

SEQ ID NO: 159950 - DNA, 13 bp, Homo sapiens
ccccagccctggc

SEQ ID NO: 159951 - DNA, 16 bp, Homo sapiens
ccccagccctggctct

SEQ ID NO: 159952 - DNA, 12 bp, Homo sapiens
ccccaggcccca

SEQ ID NO: 159953 - DNA, 18 bp, Homo sapiens
ccccaggccccaggaagc

SEQ ID NO: 159954 - DNA, 17 bp, Homo sapiens
ccccaggcctctgtgtc

SEQ ID NO: 159955 - DNA, 16 bp, Homo sapiens
ccccagggcctgagcc

SEQ ID NO: 159956 - DNA, 21 bp, Homo sapiens
ccccagggcctgagcctggcc

SEQ ID NO: 159957 - DNA, 16 bp, Homo sapiens
ccccaggggaaaatga

SEQ ID NO: 159958 - DNA, 13 bp, Homo sapiens
ccccaggtggctg

SEQ ID NO: 159959 - DNA, 14 bp, Homo sapiens
ccccatcagtgctc

SEQ ID NO: 159960 - DNA, 19 bp, Homo sapiens
ccccatctctccctcccct

SEQ ID NO: 159961 - DNA, 19 bp, Homo sapiens
ccccatggtcagccctagg

SEQ ID NO: 159962 - DNA, 17 bp, Homo sapiens
ccccatttctatttatt

SEQ ID NO: 159963 - DNA, 13 bp, Homo sapiens
cccccaatccatg

SEQ ID NO: 159964 - DNA, 21 bp, Homo sapiens
ccccctggggcttctcctgac

SEQ ID NO: 159965 - DNA, 12 bp, Homo sapiens
ccccctgtgcag

SEQ ID NO: 159966 - DNA, 15 bp, Homo sapiens
cccccttcagtgccc

SEQ ID NO: 159967 - DNA, 19 bp, Homo sapiens
ccccgcagacctccccagc

SEQ ID NO: 159968 - DNA, 12 bp, Homo sapiens
ccccggccacct

SEQ ID NO: 159969 - DNA, 14 bp, Homo sapiens
ccccggccacctct

SEQ ID NO: 159970 - DNA, 15 bp, Homo sapiens
ccccgtgcagactgg

SEQ ID NO: 159971 - DNA, 19 bp, Homo sapiens
ccccgtgcagactggaggg

SEQ ID NO: 159972 - DNA, 23 bp, Homo sapiens
cccctaatgacatcaccacagtt

SEQ ID NO: 159973 - DNA, 21 bp, Homo sapiens
cccctatccacccagcccatt

SEQ ID NO: 159974 - DNA, 13 bp, Homo sapiens
cccctcacagcct

SEQ ID NO: 159975 - DNA, 16 bp, Homo sapiens
cccctcaccctgcctt

SEQ ID NO: 159976 - DNA, 12 bp, Homo sapiens
cccctcactctg

SEQ ID NO: 159977 - DNA, 13 bp, Homo sapiens
cccctcccagaac

SEQ ID NO: 159978 - DNA, 13 bp, Homo sapiens
cccctcccctgct

SEQ ID NO: 159979 - DNA, 12 bp, Homo sapiens
cccctcctcact

SEQ ID NO: 159980 - DNA, 13 bp, Homo sapiens
cccctcctcactg

SEQ ID NO: 159981 - DNA, 23 bp, Homo sapiens
cccctcctcactggccatccctc

SEQ ID NO: 159982 - DNA, 11 bp, Homo sapiens
cccctcctctg

SEQ ID NO: 159983 - DNA, 13 bp, Homo sapiens
cccctcctctgcc

SEQ ID NO: 159984 - DNA, 14 bp, Homo sapiens
cccctcctctgcca

SEQ ID NO: 159985 - DNA, 20 bp, Homo sapiens
cccctccttccttgaccagc

SEQ ID NO: 159986 - DNA, 18 bp, Homo sapiens
cccctgcactccagcctg

SEQ ID NO: 159987 - DNA, 14 bp, Homo sapiens
cccctgccctgctg

SEQ ID NO: 159988 - DNA, 15 bp, Homo sapiens
cccctgccctgctgc

SEQ ID NO: 159989 - DNA, 13 bp, Homo sapiens
cccctgccctggg

SEQ ID NO: 159990 - DNA, 23 bp, Homo sapiens
cccctgctgcaggggctctggag

SEQ ID NO: 159991 - DNA, 15 bp, Homo sapiens
cccctggactgggag

SEQ ID NO: 159992 - DNA, 18 bp, Homo sapiens
cccctggggcttctcctg

SEQ ID NO: 159993 - DNA, 15 bp, Homo sapiens
cccctgtcctcactg

SEQ ID NO: 159994 - DNA, 14 bp, Homo sapiens
ccccttccactgag

SEQ ID NO: 159995 - DNA, 12 bp, Homo sapiens
ccccttccccct

SEQ ID NO: 159996 - DNA, 14 bp, Homo sapiens
ccccttctcagaat

SEQ ID NO: 159997 - DNA, 18 bp, Homo sapiens
cccgacagcctggcacag

SEQ ID NO: 159998 - DNA, 20 bp, Homo sapiens
cccgcagacctccccagccc

SEQ ID NO: 159999 - DNA, 12 bp, Homo sapiens
cccgctcagccc

SEQ ID NO: 160000 - DNA, 15 bp, Homo sapiens
cccgctcagccctcc

SEQ ID NO: 160001 - DNA, 19 bp, Homo sapiens
cccgctcagccctccctgc

SEQ ID NO: 160002 - DNA, 18 bp, Homo sapiens
cccgcttgtccagcgcct

SEQ ID NO: 160003 - DNA, 18 bp, Homo sapiens
cccggaggggcctggcag

SEQ ID NO: 160004 - DNA, 13 bp, Homo sapiens
cccggccacctct

SEQ ID NO: 160005 - DNA, 14 bp, Homo sapiens
cccggccacctctg

SEQ ID NO: 160006 - DNA, 21 bp, Homo sapiens
cccggccacctctgcggaccc

SEQ ID NO: 160007 - DNA, 14 bp, Homo sapiens
cccggcgcggtggc

SEQ ID NO: 160008 - DNA, 22 bp, Homo sapiens
cccggctcgagcagtcctgcct

SEQ ID NO: 160009 - DNA, 18 bp, Homo sapiens
cccgggacgcagcaggag

SEQ ID NO: 160010 - DNA, 22 bp, Homo sapiens
cccggtcccttgagacctcagc

SEQ ID NO: 160011 - DNA, 23 bp, Homo sapiens
cccgtctggggttcagcccctcc

SEQ ID NO: 160012 - DNA, 21 bp, Homo sapiens
cccgtgaggatgtcactcaga

SEQ ID NO: 160013 - DNA, 13 bp, Homo sapiens
cccgtgcagactg

SEQ ID NO: 160014 - DNA, 12 bp, Homo sapiens
cccgtggtctct

SEQ ID NO: 160015 - DNA, 20 bp, Homo sapiens
ccctacagttgaaaaacagc

SEQ ID NO: 160016 - DNA, 18 bp, Homo sapiens
ccctaccgagtctcttct

SEQ ID NO: 160017 - DNA, 14 bp, Homo sapiens
ccctatccacccag

SEQ ID NO: 160018 - DNA, 16 bp, Homo sapiens
ccctatccacccagcc

SEQ ID NO: 160019 - DNA, 13 bp, Homo sapiens
ccctatgctgcct

SEQ ID NO: 160020 - DNA, 12 bp, Homo sapiens
ccctcacagcct

SEQ ID NO: 160021 - DNA, 14 bp, Homo sapiens
ccctcacagcctct

SEQ ID NO: 160022 - DNA, 15 bp, Homo sapiens
ccctcacagcctctg

SEQ ID NO: 160023 - DNA, 13 bp, Homo sapiens
ccctcacccctgc

SEQ ID NO: 160024 - DNA, 13 bp, Homo sapiens
ccctcaccctgcc

SEQ ID NO: 160025 - DNA, 18 bp, Homo sapiens
ccctcagaacccttggct

SEQ ID NO: 160026 - DNA, 22 bp, Homo sapiens
ccctcagaacccttggcttgcc

SEQ ID NO: 160027 - DNA, 13 bp, Homo sapiens
ccctcatctgtcc

SEQ ID NO: 160028 - DNA, 16 bp, Homo sapiens
ccctcattcaggaaaa

SEQ ID NO: 160029 - DNA, 14 bp, Homo sapiens
ccctccacatccct

SEQ ID NO: 160030 - DNA, 15 bp, Homo sapiens
ccctccacatccctg

SEQ ID NO: 160031 - DNA, 12 bp, Homo sapiens
ccctccactcct

SEQ ID NO: 160032 - DNA, 14 bp, Homo sapiens
ccctccccagggga

SEQ ID NO: 160033 - DNA, 21 bp, Homo sapiens
ccctcccctaatgcctgcgga

SEQ ID NO: 160034 - DNA, 16 bp, Homo sapiens
ccctcccctcccctgc

SEQ ID NO: 160035 - DNA, 16 bp, Homo sapiens
ccctcccctgccctag

SEQ ID NO: 160036 - DNA, 13 bp, Homo sapiens
ccctcccctgctg

SEQ ID NO: 160037 - DNA, 14 bp, Homo sapiens
ccctcccctgctgc

SEQ ID NO: 160038 - DNA, 13 bp, Homo sapiens
ccctccctgtcct

SEQ ID NO: 160039 - DNA, 14 bp, Homo sapiens
ccctcccttcaacc

SEQ ID NO: 160040 - DNA, 23 bp, Homo sapiens
ccctccgtggcatcaccttaggc

SEQ ID NO: 160041 - DNA, 12 bp, Homo sapiens
ccctcctcactg

SEQ ID NO: 160042 - DNA, 21 bp, Homo sapiens
ccctcctcactggccatccct

SEQ ID NO: 160043 - DNA, 12 bp, Homo sapiens
ccctcctctgcc

SEQ ID NO: 160044 - DNA, 22 bp, Homo sapiens
ccctcgaagcgcgccactcgct

SEQ ID NO: 160045 - DNA, 13 bp, Homo sapiens
ccctcggagaaga

SEQ ID NO: 160046 - DNA, 23 bp, Homo sapiens
ccctcgtggtccccaacagcgac

SEQ ID NO: 160047 - DNA, 15 bp, Homo sapiens
ccctctacagagctt

SEQ ID NO: 160048 - DNA, 21 bp, Homo sapiens
ccctctacagagcttccctga

SEQ ID NO: 160049 - DNA, 11 bp, Homo sapiens
ccctctccctg

SEQ ID NO: 160050 - DNA, 11 bp, Homo sapiens
ccctctcctgc

SEQ ID NO: 160051 - DNA, 17 bp, Homo sapiens
ccctctcctgcctactc

SEQ ID NO: 160052 - DNA, 13 bp, Homo sapiens
ccctctctctgac

SEQ ID NO: 160053 - DNA, 9 bp, Homo sapiens
ccctctgcc

SEQ ID NO: 160054 - DNA, 13 bp, Homo sapiens
ccctctggccctg

SEQ ID NO: 160055 - DNA, 14 bp, Homo sapiens
ccctgaaaacccag

SEQ ID NO: 160056 - DNA, 15 bp, Homo sapiens
ccctgaaaacccaga

SEQ ID NO: 160057 - DNA, 15 bp, Homo sapiens
ccctgaagccagcct

SEQ ID NO: 160058 - DNA, 15 bp, Homo sapiens
ccctgactcattctg

SEQ ID NO: 160059 - DNA, 19 bp, Homo sapiens
ccctgactcattctgaagg

SEQ ID NO: 160060 - DNA, 16 bp, Homo sapiens
ccctgagctgaggcag

SEQ ID NO: 160061 - DNA, 17 bp, Homo sapiens
ccctgagctgaggcagc

SEQ ID NO: 160062 - DNA, 19 bp, Homo sapiens
ccctgagctgaggcagcag

SEQ ID NO: 160063 - DNA, 19 bp, Homo sapiens
ccctgattacaccagcctc

SEQ ID NO: 160064 - DNA, 13 bp, Homo sapiens
ccctgcatcccct

SEQ ID NO: 160065 - DNA, 12 bp, Homo sapiens
ccctgccagctc

SEQ ID NO: 160066 - DNA, 17 bp, Homo sapiens
ccctgcccctcccttca

SEQ ID NO: 160067 - DNA, 11 bp, Homo sapiens
ccctgccctgc

SEQ ID NO: 160068 - DNA, 13 bp, Homo sapiens
ccctgccctggga

SEQ ID NO: 160069 - DNA, 14 bp, Homo sapiens
ccctgccgcctcaa

SEQ ID NO: 160070 - DNA, 22 bp, Homo sapiens
ccctgccttatcttgcacccca

SEQ ID NO: 160071 - DNA, 16 bp, Homo sapiens
ccctgctgcaggggct

SEQ ID NO: 160072 - DNA, 20 bp, Homo sapiens
ccctgctgccgcctcccagc

SEQ ID NO: 160073 - DNA, 17 bp, Homo sapiens
ccctgctttgggctgcc

SEQ ID NO: 160074 - DNA, 21 bp, Homo sapiens
ccctggaccagtggtctcaca

SEQ ID NO: 160075 - DNA, 23 bp, Homo sapiens
ccctggaccagtggtctcacatg

SEQ ID NO: 160076 - DNA, 15 bp, Homo sapiens
ccctggccagaggct

SEQ ID NO: 160077 - DNA, 13 bp, Homo sapiens
ccctggcctgctg

SEQ ID NO: 160078 - DNA, 19 bp, Homo sapiens
ccctggctcccacaggccc

SEQ ID NO: 160079 - DNA, 14 bp, Homo sapiens
ccctgggccccacc

SEQ ID NO: 160080 - DNA, 22 bp, Homo sapiens
ccctgggccccaccacctaggc

SEQ ID NO: 160081 - DNA, 21 bp, Homo sapiens
ccctggggctaggctggagcc

SEQ ID NO: 160082 - DNA, 23 bp, Homo sapiens
ccctggtaataagtactgtgtac

SEQ ID NO: 160083 - DNA, 14 bp, Homo sapiens
ccctgtccctccca

SEQ ID NO: 160084 - DNA, 15 bp, Homo sapiens
ccctgtccctcccac

SEQ ID NO: 160085 - DNA, 21 bp, Homo sapiens
ccctgtccctcccacctctgt

SEQ ID NO: 160086 - DNA, 22 bp, Homo sapiens
ccctgtccctcccacctctgtg

SEQ ID NO: 160087 - DNA, 23 bp, Homo sapiens
ccctgtccctcccacctctgtga

SEQ ID NO: 160088 - DNA, 15 bp, Homo sapiens
ccctgtcctcctcgg

SEQ ID NO: 160089 - DNA, 16 bp, Homo sapiens
ccctgtcctcctcgga

SEQ ID NO: 160090 - DNA, 23 bp, Homo sapiens
ccctgtctcaaaaaaagaaaaag

SEQ ID NO: 160091 - DNA, 16 bp, Homo sapiens
ccctgtggagactggg

SEQ ID NO: 160092 - DNA, 21 bp, Homo sapiens
ccctgtggatgagccctcaga

SEQ ID NO: 160093 - DNA, 23 bp, Homo sapiens
ccctgtgttgtctctagagcagg

SEQ ID NO: 160094 - DNA, 17 bp, Homo sapiens
ccctgttcagctactcc

SEQ ID NO: 160095 - DNA, 17 bp, Homo sapiens
ccctgtttaatatttaa

SEQ ID NO: 160096 - DNA, 18 bp, Homo sapiens
ccctgtttaatatttaaa

SEQ ID NO: 160097 - DNA, 19 bp, Homo sapiens
ccctgtttaatatttaaac

SEQ ID NO: 160098 - DNA, 18 bp, Homo sapiens
cccttacagcctctgact

SEQ ID NO: 160099 - DNA, 16 bp, Homo sapiens
cccttatctgtgctca

SEQ ID NO: 160100 - DNA, 20 bp, Homo sapiens
cccttatctgtgctcaggac

SEQ ID NO: 160101 - DNA, 17 bp, Homo sapiens
cccttcagtgcccacca

SEQ ID NO: 160102 - DNA, 13 bp, Homo sapiens
cccttccactgag

SEQ ID NO: 160103 - DNA, 17 bp, Homo sapiens
cccttcctctccactgc

SEQ ID NO: 160104 - DNA, 15 bp, Homo sapiens
cccttgacaccgggg

SEQ ID NO: 160105 - DNA, 22 bp, Homo sapiens
cccttgagaaaccttattgtac

SEQ ID NO: 160106 - DNA, 17 bp, Homo sapiens
cccttgagacctcagcc

SEQ ID NO: 160107 - DNA, 20 bp, Homo sapiens
cccttgagacctcagccatg

SEQ ID NO: 160108 - DNA, 15 bp, Homo sapiens
cccttgccagacatg

SEQ ID NO: 160109 - DNA, 13 bp, Homo sapiens
cccttggaggcca

SEQ ID NO: 160110 - DNA, 15 bp, Homo sapiens
cccttggaggccagc

SEQ ID NO: 160111 - DNA, 22 bp, Homo sapiens
cccttggctgtgaggcccctgg

SEQ ID NO: 160112 - DNA, 23 bp, Homo sapiens
cccttggctgtgaggcccctgga

SEQ ID NO: 160113 - DNA, 17 bp, Homo sapiens
cccttggtggcaagagc

SEQ ID NO: 160114 - DNA, 21 bp, Homo sapiens
ccctttccttccttccctggc

SEQ ID NO: 160115 - DNA, 23 bp, Homo sapiens
ccctttgctgtgaggctgtcctg

SEQ ID NO: 160116 - DNA, 23 bp, Homo sapiens
ccctttttgaagtgtaggcagac

SEQ ID NO: 160117 - DNA, 23 bp, Homo sapiens
ccgaacatcaccgacgcgtctcc

SEQ ID NO: 160118 - DNA, 19 bp, Homo sapiens
ccgaagaagggtccttccc

SEQ ID NO: 160119 - DNA, 23 bp, Homo sapiens
ccgaatctctttttgctttcgaa

SEQ ID NO: 160120 - DNA, 15 bp, Homo sapiens
ccgaccacctgccca

SEQ ID NO: 160121 - DNA, 15 bp, Homo sapiens
ccgacctcagccttc

SEQ ID NO: 160122 - DNA, 13 bp, Homo sapiens
ccgagagcctgct

SEQ ID NO: 160123 - DNA, 14 bp, Homo sapiens
ccgagagcctgctc

SEQ ID NO: 160124 - DNA, 21 bp, Homo sapiens
ccgagattgcaccactgcact

SEQ ID NO: 160125 - DNA, 19 bp, Homo sapiens
ccgagctttgaaaattcag

SEQ ID NO: 160126 - DNA, 20 bp, Homo sapiens
ccgaggcagggtcaggagag

SEQ ID NO: 160127 - DNA, 21 bp, Homo sapiens
ccgagtctcttctccactgga

SEQ ID NO: 160128 - DNA, 22 bp, Homo sapiens
ccgagtctcttctccactggat

SEQ ID NO: 160129 - DNA, 17 bp, Homo sapiens
ccgcaccccagagtgtg

SEQ ID NO: 160130 - DNA, 12 bp, Homo sapiens
ccgcaggaagct

SEQ ID NO: 160131 - DNA, 14 bp, Homo sapiens
ccgcaggaagctgc

SEQ ID NO: 160132 - DNA, 19 bp, Homo sapiens
ccgcaggaagctgctccgt

SEQ ID NO: 160133 - DNA, 15 bp, Homo sapiens
ccgcatcttctccat

SEQ ID NO: 160134 - DNA, 16 bp, Homo sapiens
ccgcatcttctccatc

SEQ ID NO: 160135 - DNA, 19 bp, Homo sapiens
ccgcatcttctccatctgg

SEQ ID NO: 160136 - DNA, 13 bp, Homo sapiens
ccgcattccctga

SEQ ID NO: 160137 - DNA, 17 bp, Homo sapiens
ccgccaaggctggggga

SEQ ID NO: 160138 - DNA, 16 bp, Homo sapiens
ccgccatgctcctggc

SEQ ID NO: 160139 - DNA, 15 bp, Homo sapiens
ccgccccagcctctg

SEQ ID NO: 160140 - DNA, 14 bp, Homo sapiens
ccgcctcccagcct

SEQ ID NO: 160141 - DNA, 15 bp, Homo sapiens
ccgcctcccagcctg

SEQ ID NO: 160142 - DNA, 14 bp, Homo sapiens
ccgcctctgctggc

SEQ ID NO: 160143 - DNA, 15 bp, Homo sapiens
ccgctcctgtctgcc

SEQ ID NO: 160144 - DNA, 20 bp, Homo sapiens
ccgctgcctaagtggctgct

SEQ ID NO: 160145 - DNA, 15 bp, Homo sapiens
ccgctgtgagcccct

SEQ ID NO: 160146 - DNA, 19 bp, Homo sapiens
ccgctgttcacccacaggg

SEQ ID NO: 160147 - DNA, 14 bp, Homo sapiens
ccggaggggcctgg

SEQ ID NO: 160148 - DNA, 16 bp, Homo sapiens
ccggaggggcctggca

SEQ ID NO: 160149 - DNA, 13 bp, Homo sapiens
ccggcagaaggga

SEQ ID NO: 160150 - DNA, 12 bp, Homo sapiens
ccggccacctct

SEQ ID NO: 160151 - DNA, 15 bp, Homo sapiens
ccggccacctctgcg

SEQ ID NO: 160152 - DNA, 13 bp, Homo sapiens
ccggccctggggc

SEQ ID NO: 160153 - DNA, 15 bp, Homo sapiens
ccggcgagccctgtg

SEQ ID NO: 160154 - DNA, 23 bp, Homo sapiens
ccggctatgggggcactgaggac

SEQ ID NO: 160155 - DNA, 22 bp, Homo sapiens
ccggctgcttttccctaagcca

SEQ ID NO: 160156 - DNA, 19 bp, Homo sapiens
ccggggctggcggctactc

SEQ ID NO: 160157 - DNA, 22 bp, Homo sapiens
ccggtaaacacgcctgcaaacg

SEQ ID NO: 160158 - DNA, 20 bp, Homo sapiens
ccggtcccttgagacctcag

SEQ ID NO: 160159 - DNA, 22 bp, Homo sapiens
ccggtcccttgagacctcagcc

SEQ ID NO: 160160 - DNA, 22 bp, Homo sapiens
cctgggaggtcaaggctgcagt

SEQ ID NO: 160161 - DNA, 22 bp, Homo sapiens
cctgggatgtccacagatgcct

SEQ ID NO: 160162 - DNA, 23 bp, Homo sapiens
cctggggcagtcacctgcccaga

SEQ ID NO: 160163 - DNA, 19 bp, Homo sapiens
cctgggggaagccctggat

SEQ ID NO: 160164 - DNA, 15 bp, Homo sapiens
cctgggggtgccagg

SEQ ID NO: 160165 - DNA, 16 bp, Homo sapiens
cctgggggtgccagga

SEQ ID NO: 160166 - DNA, 15 bp, Homo sapiens
cctgggtggggctgc

SEQ ID NO: 160167 - DNA, 21 bp, Homo sapiens
cctgggtggggctgctcctcc

SEQ ID NO: 160168 - DNA, 19 bp, Homo sapiens
cctgggttttgtattctct

SEQ ID NO: 160169 - DNA, 22 bp, Homo sapiens
cctgggttttgtattctctgag

SEQ ID NO: 160170 - DNA, 21 bp, Homo sapiens
cctggtcacaggactctgcct

SEQ ID NO: 160171 - DNA, 20 bp, Homo sapiens
cctggtcacagggcatgccc

SEQ ID NO: 160172 - DNA, 23 bp, Homo sapiens
cctggtcctgagggtccccacct

SEQ ID NO: 160173 - DNA, 21 bp, Homo sapiens
cctggtgctgccacacttcag

SEQ ID NO: 160174 - DNA, 20 bp, Homo sapiens
cctggtgggcctcctctgtc

SEQ ID NO: 160175 - DNA, 21 bp, Homo sapiens
cctggttccggaatcctgtcc

SEQ ID NO: 160176 - DNA, 13 bp, Homo sapiens
cctgtaatcccag

SEQ ID NO: 160177 - DNA, 15 bp, Homo sapiens
cctgtaatcccagct

SEQ ID NO: 160178 - DNA, 16 bp, Homo sapiens
cctgtaatcccagcta

SEQ ID NO: 160179 - DNA, 18 bp, Homo sapiens
cctgtaatcccagctact

SEQ ID NO: 160180 - DNA, 19 bp, Homo sapiens
cctgtagagtgggagctga

SEQ ID NO: 160181 - DNA, 23 bp, Homo sapiens
cctgtagagtgggagctgagtgg

SEQ ID NO: 160182 - DNA, 21 bp, Homo sapiens
cctgtagcagtgagaaaaagc

SEQ ID NO: 160183 - DNA, 12 bp, Homo sapiens
cctgtagcccac

SEQ ID NO: 160184 - DNA, 24 bp, Homo sapiens
cctgtagcccactctgctcgcctt

SEQ ID NO: 160185 - DNA, 18 bp, Homo sapiens
cctgtagttaggaaataa

SEQ ID NO: 160186 - DNA, 23 bp, Homo sapiens
cctgtagttaggaaataaaacct

SEQ ID NO: 160187 - DNA, 22 bp, Homo sapiens
cctgtatagttaggatagcatt

SEQ ID NO: 160188 - DNA, 12 bp, Homo sapiens
cctgtccaacct

SEQ ID NO: 160189 - DNA, 19 bp, Homo sapiens
cctgtcccatggacactcc

SEQ ID NO: 160190 - DNA, 14 bp, Homo sapiens
cctgtccctcccac

SEQ ID NO: 160191 - DNA, 18 bp, Homo sapiens
cctgtccctcccacctct

SEQ ID NO: 160192 - DNA, 19 bp, Homo sapiens
cctgtccctcccacctctg

SEQ ID NO: 160193 - DNA, 20 bp, Homo sapiens
cctgtccctcccacctctgt

SEQ ID NO: 160194 - DNA, 21 bp, Homo sapiens
cctgtccctcccacctctgtg

SEQ ID NO: 160195 - DNA, 23 bp, Homo sapiens
cctgtcccttctcttaatttaat

SEQ ID NO: 160196 - DNA, 16 bp, Homo sapiens
cctgtcctcactgctc

SEQ ID NO: 160197 - DNA, 22 bp, Homo sapiens
cctgtcctcactgctccctgaa

SEQ ID NO: 160198 - DNA, 22 bp, Homo sapiens
cctgtcctcccatcccctggac

SEQ ID NO: 160199 - DNA, 23 bp, Homo sapiens
cctgtcctcccatcccctggact

SEQ ID NO: 160200 - DNA, 15 bp, Homo sapiens
cctgtcctcctcgga

SEQ ID NO: 160201 - DNA, 13 bp, Homo sapiens
cctgtctcagcct

SEQ ID NO: 160202 - DNA, 14 bp, Homo sapiens
cctgtctcagcctc

SEQ ID NO: 160203 - DNA, 15 bp, Homo sapiens
cctgtctcagcctcc

SEQ ID NO: 160204 - DNA, 16 bp, Homo sapiens
cctgtctcagcctccc

SEQ ID NO: 160205 - DNA, 21 bp, Homo sapiens
cctgtctcctttgcaggctca

SEQ ID NO: 160206 - DNA, 14 bp, Homo sapiens
cctgtctcttccat

SEQ ID NO: 160207 - DNA, 19 bp, Homo sapiens
cctgtctgccagccagcag

SEQ ID NO: 160208 - DNA, 20 bp, Homo sapiens
cctgtctgccagccagcagc

SEQ ID NO: 160209 - DNA, 23 bp, Homo sapiens
cctgtctgccagccagcagccag

SEQ ID NO: 160210 - DNA, 18 bp, Homo sapiens
cctgtgacttcagctctg

SEQ ID NO: 160211 - DNA, 13 bp, Homo sapiens
cctgtgaggcagg

SEQ ID NO: 160212 - DNA, 14 bp, Homo sapiens
cctgtgaggcaggg

SEQ ID NO: 160213 - DNA, 18 bp, Homo sapiens
cctgtgcagccgctgagc

SEQ ID NO: 160214 - DNA, 20 bp, Homo sapiens
cctgtgcctctgggactgga

SEQ ID NO: 160215 - DNA, 20 bp, Homo sapiens
cctgtggatgataaaacaca

SEQ ID NO: 160216 - DNA, 18 bp, Homo sapiens
cctgtggcggtgcctggg

SEQ ID NO: 160217 - DNA, 21 bp, Homo sapiens
cctgtgtgtgaaaggaagctc

SEQ ID NO: 160218 - DNA, 22 bp, Homo sapiens
cctgttacctaattagagcaga

SEQ ID NO: 160219 - DNA, 18 bp, Homo sapiens
cctgtttttaagctgttt

SEQ ID NO: 160220 - DNA, 23 bp, Homo sapiens
ccttaaaactttaatcccacttg

SEQ ID NO: 160221 - DNA, 14 bp, Homo sapiens
ccttacagcctctg

SEQ ID NO: 160222 - DNA, 18 bp, Homo sapiens
ccttacagcctctgactt

SEQ ID NO: 160223 - DNA, 15 bp, Homo sapiens
ccttaccatgtgcct

SEQ ID NO: 160224 - DNA, 16 bp, Homo sapiens
ccttacctcctgccca

SEQ ID NO: 160225 - DNA, 16 bp, Homo sapiens
ccttagaacctttctt

SEQ ID NO: 160226 - DNA, 17 bp, Homo sapiens
ccttagcttagacctca

SEQ ID NO: 160227 - DNA, 20 bp, Homo sapiens
ccttagcttagacctcagcc

SEQ ID NO: 160228 - DNA, 15 bp, Homo sapiens
ccttatctgtgctca

SEQ ID NO: 160229 - DNA, 21 bp, Homo sapiens
ccttattagagtgtctttcca

SEQ ID NO: 160230 - DNA, 13 bp, Homo sapiens
ccttcaactgaaa

SEQ ID NO: 160231 - DNA, 12 bp, Homo sapiens
ccttcacagtgt

SEQ ID NO: 160232 - DNA, 12 bp, Homo sapiens
ccttcagcctga

SEQ ID NO: 160233 - DNA, 20 bp, Homo sapiens
ccttccacggatccatgtag

SEQ ID NO: 160234 - DNA, 16 bp, Homo sapiens
ccttccagcaccctgc

SEQ ID NO: 160235 - DNA, 17 bp, Homo sapiens
ccttccagcaccctgca

SEQ ID NO: 160236 - DNA, 23 bp, Homo sapiens
ccttccatgtcgcctctgcattc

SEQ ID NO: 160237 - DNA, 21 bp, Homo sapiens
ccttcccaaaggactccaccc

SEQ ID NO: 160238 - DNA, 13 bp, Homo sapiens
ccttcccagctct

SEQ ID NO: 160239 - DNA, 19 bp, Homo sapiens
ccttcccagctctccctct

SEQ ID NO: 160240 - DNA, 13 bp, Homo sapiens
ccttccccagcct

SEQ ID NO: 160241 - DNA, 16 bp, Homo sapiens
ccttcccctccttctc

SEQ ID NO: 160242 - DNA, 13 bp, Homo sapiens
ccttcctcctggg

SEQ ID NO: 160243 - DNA, 21 bp, Homo sapiens
ccttcctctccactgccttcg

SEQ ID NO: 160244 - DNA, 17 bp, Homo sapiens
ccttcctgccacctgct

SEQ ID NO: 160245 - DNA, 16 bp, Homo sapiens
ccttccttgaccagca

SEQ ID NO: 160246 - DNA, 17 bp, Homo sapiens
ccttcgtttactatgcc

SEQ ID NO: 160247 - DNA, 22 bp, Homo sapiens
ccttcgtttactatgcctgtgt

SEQ ID NO: 160248 - DNA, 16 bp, Homo sapiens
ccttctccatccacat

SEQ ID NO: 160249 - DNA, 22 bp, Homo sapiens
ccttctccatccacatgggagc

SEQ ID NO: 160250 - DNA, 17 bp, Homo sapiens
ccttctctcacctccta

SEQ ID NO: 160251 - DNA, 17 bp, Homo sapiens
ccttctcttcacagtca

SEQ ID NO: 160252 - DNA, 15 bp, Homo sapiens
ccttctgtgaaagta

SEQ ID NO: 160253 - DNA, 20 bp, Homo sapiens
ccttcttattctcactccac

SEQ ID NO: 160254 - DNA, 22 bp, Homo sapiens
ccttcttccatcccaggacacc

SEQ ID NO: 160255 - DNA, 14 bp, Homo sapiens
ccttctttttcttc

SEQ ID NO: 160256 - DNA, 16 bp, Homo sapiens
ccttctttttcttctt

SEQ ID NO: 160257 - DNA, 13 bp, Homo sapiens
ccttgaacactgg

SEQ ID NO: 160258 - DNA, 20 bp, Homo sapiens
ccttgaacactgggggaggg

SEQ ID NO: 160259 - DNA, 20 bp, Homo sapiens
ccttgaccagcagatcccag

SEQ ID NO: 160260 - DNA, 16 bp, Homo sapiens
ccttgacttagattct

SEQ ID NO: 160261 - DNA, 14 bp, Homo sapiens
ccttgagaaacctt

SEQ ID NO: 160262 - DNA, 14 bp, Homo sapiens
ccttgagacctcag

SEQ ID NO: 160263 - DNA, 17 bp, Homo sapiens
ccttgagacctcagcca

SEQ ID NO: 160264 - DNA, 18 bp, Homo sapiens
ccttgagacctcagccat

SEQ ID NO: 160265 - DNA, 20 bp, Homo sapiens
ccttgagttgattcagctct

SEQ ID NO: 160266 - DNA, 23 bp, Homo sapiens
ccttgagttgattcagctctgca

SEQ ID NO: 160267 - DNA, 22 bp, Homo sapiens
ccttgcacactcccctgcactg

SEQ ID NO: 160268 - DNA, 14 bp, Homo sapiens
ccttgcacctgcat

SEQ ID NO: 160269 - DNA, 16 bp, Homo sapiens
ccttgcacctgcatcc

SEQ ID NO: 160270 - DNA, 13 bp, Homo sapiens
ccttgccagacat

SEQ ID NO: 160271 - DNA, 14 bp, Homo sapiens
ccttgcccagagat

SEQ ID NO: 160272 - DNA, 15 bp, Homo sapiens
ccttgcccagggctc

SEQ ID NO: 160273 - DNA, 16 bp, Homo sapiens
ccttgcccagggctca

SEQ ID NO: 160274 - DNA, 18 bp, Homo sapiens
ccttgcccagggctcagc

SEQ ID NO: 160275 - DNA, 22 bp, Homo sapiens
ccttgcccagggctcagcctgg

SEQ ID NO: 160276 - DNA, 20 bp, Homo sapiens
ccttgctctcccctgccctg

SEQ ID NO: 160277 - DNA, 22 bp, Homo sapiens
ccttgctggacggggactgggg

SEQ ID NO: 160278 - DNA, 15 bp, Homo sapiens
ccttggactcatttt

SEQ ID NO: 160279 - DNA, 12 bp, Homo sapiens
ccttggaggcca

SEQ ID NO: 160280 - DNA, 18 bp, Homo sapiens
ccttggaggctgtcttct

SEQ ID NO: 160281 - DNA, 22 bp, Homo sapiens
ccttggataatgctgttgcctc

SEQ ID NO: 160282 - DNA, 23 bp, Homo sapiens
ccttggataatgctgttgcctca

SEQ ID NO: 160283 - DNA, 15 bp, Homo sapiens
ccttggcatgccttc

SEQ ID NO: 160284 - DNA, 21 bp, Homo sapiens
ccttggctgtgaggcccctgg

SEQ ID NO: 160285 - DNA, 21 bp, Homo sapiens
ccttggctgttggcagtgagt

SEQ ID NO: 160286 - DNA, 15 bp, Homo sapiens
ccttgggaggcccca

SEQ ID NO: 160287 - DNA, 18 bp, Homo sapiens
ccttggtgtccacctggc

SEQ ID NO: 160288 - DNA, 19 bp, Homo sapiens
ccttggtgtccacctggcc

SEQ ID NO: 160289 - DNA, 21 bp, Homo sapiens
ccttggtgtccacctggcccc

SEQ ID NO: 160290 - DNA, 15 bp, Homo sapiens
ccttgttcacactct

SEQ ID NO: 160291 - DNA, 13 bp, Homo sapiens
cctttattgtgat

SEQ ID NO: 160292 - DNA, 21 bp, Homo sapiens
cctttcacaaaattttattcc

SEQ ID NO: 160293 - DNA, 17 bp, Homo sapiens
cctttcaccccagggcc

SEQ ID NO: 160294 - DNA, 21 bp, Homo sapiens
cctttcaccccagggcctgag

SEQ ID NO: 160295 - DNA, 19 bp, Homo sapiens
cctttcccaggtgctacac

SEQ ID NO: 160296 - DNA, 21 bp, Homo sapiens
cctttccttccttccctggct

SEQ ID NO: 160297 - DNA, 23 bp, Homo sapiens
cctttgaagaggaaaatgaataa

SEQ ID NO: 160298 - DNA, 22 bp, Homo sapiens
cctttgagtttcctcaggctgc

SEQ ID NO: 160299 - DNA, 13 bp, Homo sapiens
cctttgctgtgag

SEQ ID NO: 160300 - DNA, 23 bp, Homo sapiens
cctttgctgtgaggctgtcctgt

SEQ ID NO: 160301 - DNA, 12 bp, Homo sapiens
cctttggctctg

SEQ ID NO: 160302 - DNA, 14 bp, Homo sapiens
cctttggctctgga

SEQ ID NO: 160303 - DNA, 23 bp, Homo sapiens
cctttgtcatctttcttctattt

SEQ ID NO: 160304 - DNA, 11 bp, Homo sapiens
ccttttatagc

SEQ ID NO: 160305 - DNA, 16 bp, Homo sapiens
ccttttatagctatta

SEQ ID NO: 160306 - DNA, 15 bp, Homo sapiens
ccgtaacccaactct

SEQ ID NO: 160307 - DNA, 14 bp, Homo sapiens
ccgtccagaccttg

SEQ ID NO: 160308 - DNA, 11 bp, Homo sapiens
ccgtcctcacc

SEQ ID NO: 160309 - DNA, 16 bp, Homo sapiens
ccgtcctcacccctgt

SEQ ID NO: 160310 - DNA, 24 bp, Homo sapiens
ccgtcctcacccctgtcctcactg

SEQ ID NO: 160311 - DNA, 22 bp, Homo sapiens
ccgtcgaggggctctcagctca

SEQ ID NO: 160312 - DNA, 20 bp, Homo sapiens
ccgtctggggttcagcccct

SEQ ID NO: 160313 - DNA, 21 bp, Homo sapiens
ccgtctggggttcagcccctc

SEQ ID NO: 160314 - DNA, 23 bp, Homo sapiens
ccgtgatgtagggtaaggtgcct

SEQ ID NO: 160315 - DNA, 14 bp, Homo sapiens
ccgtgcagactgga

SEQ ID NO: 160316 - DNA, 19 bp, Homo sapiens
ccgtgcagactggagggga

SEQ ID NO: 160317 - DNA, 15 bp, Homo sapiens
ccgtgccccgcctcc

SEQ ID NO: 160318 - DNA, 14 bp, Homo sapiens
ccgtgccttcagct

SEQ ID NO: 160319 - DNA, 17 bp, Homo sapiens
ccgtgccttcagctcta

SEQ ID NO: 160320 - DNA, 19 bp, Homo sapiens
ccgtggattgcacgtggcc

SEQ ID NO: 160321 - DNA, 22 bp, Homo sapiens
ccgtggattgcacgtggcctct

SEQ ID NO: 160322 - DNA, 14 bp, Homo sapiens
ccgtggctgcggca

SEQ ID NO: 160323 - DNA, 15 bp, Homo sapiens
ccgtggcttcccgct

SEQ ID NO: 160324 - DNA, 14 bp, Homo sapiens
ccgtggtcctttgg

SEQ ID NO: 160325 - DNA, 13 bp, Homo sapiens
ccgtgtgccctcg

SEQ ID NO: 160326 - DNA, 13 bp, Homo sapiens
ccgttactctcca

SEQ ID NO: 160327 - DNA, 17 bp, Homo sapiens
ccgttactctccaacct

SEQ ID NO: 160328 - DNA, 22 bp, Homo sapiens
ccgttactctccaacctggaca

SEQ ID NO: 160329 - DNA, 18 bp, Homo sapiens
cctaaaaaagatatatta

SEQ ID NO: 160330 - DNA, 19 bp, Homo sapiens
cctaaagtagacttcattt

SEQ ID NO: 160331 - DNA, 15 bp, Homo sapiens
cctaagtggctgctg

SEQ ID NO: 160332 - DNA, 14 bp, Homo sapiens
cctaattagagcag

SEQ ID NO: 160333 - DNA, 18 bp, Homo sapiens
cctaccaatagattcccc

SEQ ID NO: 160334 - DNA, 13 bp, Homo sapiens
cctaccacctccc

SEQ ID NO: 160335 - DNA, 18 bp, Homo sapiens
cctaccacctccccagcc

SEQ ID NO: 160336 - DNA, 13 bp, Homo sapiens
cctaccccaccac

SEQ ID NO: 160337 - DNA, 17 bp, Homo sapiens
cctaccgagtctcttct

SEQ ID NO: 160338 - DNA, 19 bp, Homo sapiens
cctaccgagtctcttctcc

SEQ ID NO: 160339 - DNA, 20 bp, Homo sapiens
cctaccgagtctcttctcca

SEQ ID NO: 160340 - DNA, 22 bp, Homo sapiens
cctaccgagtctcttctccact

SEQ ID NO: 160341 - DNA, 23 bp, Homo sapiens
cctaccgagtctcttctccactg

SEQ ID NO: 160342 - DNA, 12 bp, Homo sapiens
cctacctggtaa

SEQ ID NO: 160343 - DNA, 20 bp, Homo sapiens
cctacgtcaaacatgaagtg

SEQ ID NO: 160344 - DNA, 21 bp, Homo sapiens
cctacgtcaaacatgaagtgt

SEQ ID NO: 160345 - DNA, 17 bp, Homo sapiens
cctactacatcgccctc

SEQ ID NO: 160346 - DNA, 20 bp, Homo sapiens
cctactacatcgccctccac

SEQ ID NO: 160347 - DNA, 15 bp, Homo sapiens
cctacttcctgtgac

SEQ ID NO: 160348 - DNA, 15 bp, Homo sapiens
cctagagcacactgt

SEQ ID NO: 160349 - DNA, 17 bp, Homo sapiens
cctagcccaggagagag

SEQ ID NO: 160350 - DNA, 14 bp, Homo sapiens
cctagccgacctca

SEQ ID NO: 160351 - DNA, 18 bp, Homo sapiens
cctagccgacctcagcct

SEQ ID NO: 160352 - DNA, 19 bp, Homo sapiens
cctagccgacctcagcctt

SEQ ID NO: 160353 - DNA, 14 bp, Homo sapiens
cctaggccactcct

SEQ ID NO: 160354 - DNA, 20 bp, Homo sapiens
cctaggccactcctccaaag

SEQ ID NO: 160355 - DNA, 22 bp, Homo sapiens
cctagtgaaggcttctctctgt

SEQ ID NO: 160356 - DNA, 23 bp, Homo sapiens
cctagtgaaggcttctctctgtg

SEQ ID NO: 160357 - DNA, 18 bp, Homo sapiens
cctagtggggtctccctc

SEQ ID NO: 160358 - DNA, 20 bp, Homo sapiens
cctataaaacaggtcaatac

SEQ ID NO: 160359 - DNA, 18 bp, Homo sapiens
cctatatgatttatagtt

SEQ ID NO: 160360 - DNA, 14 bp, Homo sapiens
cctatccacccagc

SEQ ID NO: 160361 - DNA, 16 bp, Homo sapiens
cctatccacccagccc

SEQ ID NO: 160362 - DNA, 20 bp, Homo sapiens
cctatgctgcctaggctgac

SEQ ID NO: 160363 - DNA, 17 bp, Homo sapiens
cctatggggatggtcca

SEQ ID NO: 160364 - DNA, 22 bp, Homo sapiens
cctatggtataatggttgactg

SEQ ID NO: 160365 - DNA, 16 bp, Homo sapiens
cctcaacacctctgca

SEQ ID NO: 160366 - DNA, 13 bp, Homo sapiens
cctcaatccagct

SEQ ID NO: 160367 - DNA, 18 bp, Homo sapiens
cctcacagcctctgaccc

SEQ ID NO: 160368 - DNA, 21 bp, Homo sapiens
cctcacagcctctgacccctc

SEQ ID NO: 160369 - DNA, 15 bp, Homo sapiens
cctcacatctttcac

SEQ ID NO: 160370 - DNA, 16 bp, Homo sapiens
cctcacccctgccctg

SEQ ID NO: 160371 - DNA, 15 bp, Homo sapiens
cctcacccctgtcct

SEQ ID NO: 160372 - DNA, 19 bp, Homo sapiens
cctcacccctgtcctcact

SEQ ID NO: 160373 - DNA, 20 bp, Homo sapiens
cctcacccctgtcctcactg

SEQ ID NO: 160374 - DNA, 21 bp, Homo sapiens
cctcacccctgtcctcactgc

SEQ ID NO: 160375 - DNA, 22 bp, Homo sapiens
cctcacccctgtcctcactgct

SEQ ID NO: 160376 - DNA, 21 bp, Homo sapiens
cctcacggtgccttttttcac

SEQ ID NO: 160377 - DNA, 17 bp, Homo sapiens
cctcactctggcctcag

SEQ ID NO: 160378 - DNA, 16 bp, Homo sapiens
cctcactgctccctga

SEQ ID NO: 160379 - DNA, 16 bp, Homo sapiens
cctcagagccacccct

SEQ ID NO: 160380 - DNA, 12 bp, Homo sapiens
cctcagcctccg

SEQ ID NO: 160381 - DNA, 23 bp, Homo sapiens
cctcagccttggataatgctgtt

SEQ ID NO: 160382 - DNA, 22 bp, Homo sapiens
cctcaggcactagcctttggct

SEQ ID NO: 160383 - DNA, 12 bp, Homo sapiens
cctcaggcaggt

SEQ ID NO: 160384 - DNA, 16 bp, Homo sapiens
cctcaggctgctggag

SEQ ID NO: 160385 - DNA, 17 bp, Homo sapiens
cctcaggctgctggagg

SEQ ID NO: 160386 - DNA, 18 bp, Homo sapiens
cctcaggctgctggagga

SEQ ID NO: 160387 - DNA, 11 bp, Homo sapiens
cctcagggaca

SEQ ID NO: 160388 - DNA, 22 bp, Homo sapiens
cctcagggacagagacacctgc

SEQ ID NO: 160389 - DNA, 24 bp, Homo sapiens
cctcagggacagagacacctgcac

SEQ ID NO: 160390 - DNA, 20 bp, Homo sapiens
cctcaggtcagggtgaggat

SEQ ID NO: 160391 - DNA, 20 bp, Homo sapiens
cctcaggtgagaagcagagg

SEQ ID NO: 160392 - DNA, 12 bp, Homo sapiens
cctcagtcctcc

SEQ ID NO: 160393 - DNA, 17 bp, Homo sapiens
cctcagtcctcccctca

SEQ ID NO: 160394 - DNA, 22 bp, Homo sapiens
cctcagtcctcccctcacagcc

SEQ ID NO: 160395 - DNA, 12 bp, Homo sapiens
cctcatatttaa

SEQ ID NO: 160396 - DNA, 13 bp, Homo sapiens
cctcatatttaaa

SEQ ID NO: 160397 - DNA, 15 bp, Homo sapiens
cctcatccgaggcag

SEQ ID NO: 160398 - DNA, 17 bp, Homo sapiens
cctcatccgaggcaggg

SEQ ID NO: 160399 - DNA, 20 bp, Homo sapiens
cctcatccgaggcagggtca

SEQ ID NO: 160400 - DNA, 15 bp, Homo sapiens
cctcatctgtccctc

SEQ ID NO: 160401 - DNA, 18 bp, Homo sapiens
cctcatcttcttcaccat

SEQ ID NO: 160402 - DNA, 13 bp, Homo sapiens
cctcatgcatctc

SEQ ID NO: 160403 - DNA, 15 bp, Homo sapiens
cctcattcaggaaaa

SEQ ID NO: 160404 - DNA, 16 bp, Homo sapiens
cctcattcaggaaaac

SEQ ID NO: 160405 - DNA, 21 bp, Homo sapiens
cctcattccaccttcccatgc

SEQ ID NO: 160406 - DNA, 16 bp, Homo sapiens
cctcatttatccctca

SEQ ID NO: 160407 - DNA, 20 bp, Homo sapiens
cctcatttatccctcaaccc

SEQ ID NO: 160408 - DNA, 23 bp, Homo sapiens
cctcatttttgaatacaggcata

SEQ ID NO: 160409 - DNA, 22 bp, Homo sapiens
cctccaagctccatctccactc

SEQ ID NO: 160410 - DNA, 14 bp, Homo sapiens
cctccacctcttca

SEQ ID NO: 160411 - DNA, 23 bp, Homo sapiens
cctccacctcttcaccccccact

SEQ ID NO: 160412 - DNA, 21 bp, Homo sapiens
cctccacgttctgctcatcat

SEQ ID NO: 160413 - DNA, 14 bp, Homo sapiens
cctccagggccacg

SEQ ID NO: 160414 - DNA, 19 bp, Homo sapiens
cctccatgactgcacagta

SEQ ID NO: 160415 - DNA, 11 bp, Homo sapiens
cctccatggga

SEQ ID NO: 160416 - DNA, 14 bp, Homo sapiens
cctcccaggcgccc

SEQ ID NO: 160417 - DNA, 13 bp, Homo sapiens
cctccccacgccc

SEQ ID NO: 160418 - DNA, 15 bp, Homo sapiens
cctccccagccccta

SEQ ID NO: 160419 - DNA, 15 bp, Homo sapiens
cctcccccactgcca

SEQ ID NO: 160420 - DNA, 14 bp, Homo sapiens
cctccccccactgc

SEQ ID NO: 160421 - DNA, 15 bp, Homo sapiens
cctccccccactgca

SEQ ID NO: 160422 - DNA, 16 bp, Homo sapiens
cctcccccgccactcc

SEQ ID NO: 160423 - DNA, 17 bp, Homo sapiens
cctcccccgccactcct

SEQ ID NO: 160424 - DNA, 13 bp, Homo sapiens
cctccccctgcca

SEQ ID NO: 160425 - DNA, 20 bp, Homo sapiens
cctccccctgccagtgcctt

SEQ ID NO: 160426 - DNA, 15 bp, Homo sapiens
cctcccctatccacc

SEQ ID NO: 160427 - DNA, 22 bp, Homo sapiens
cctcccctatccacccagccca

SEQ ID NO: 160428 - DNA, 16 bp, Homo sapiens
cctcccctcacagcct

SEQ ID NO: 160429 - DNA, 19 bp, Homo sapiens
cctcccctcacagcctctg

SEQ ID NO: 160430 - DNA, 14 bp, Homo sapiens
cctcccctcccctg

SEQ ID NO: 160431 - DNA, 19 bp, Homo sapiens
cctcccctcccctgctgca

SEQ ID NO: 160432 - DNA, 12 bp, Homo sapiens
cctcccctgctg

SEQ ID NO: 160433 - DNA, 13 bp, Homo sapiens
cctcccctgctgc

SEQ ID NO: 160434 - DNA, 14 bp, Homo sapiens
cctcccctgctgca

SEQ ID NO: 160435 - DNA, 13 bp, Homo sapiens
cctcccggtgccc

SEQ ID NO: 160436 - DNA, 21 bp, Homo sapiens
cctccctgcccctcccttcaa

SEQ ID NO: 160437 - DNA, 12 bp, Homo sapiens
cctccctgtcct

SEQ ID NO: 160438 - DNA, 16 bp, Homo sapiens
cctccgccaggcgaga

SEQ ID NO: 160439 - DNA, 18 bp, Homo sapiens
cctccgggacctggtgct

SEQ ID NO: 160440 - DNA, 15 bp, Homo sapiens
cctccgtatttcaga

SEQ ID NO: 160441 - DNA, 14 bp, Homo sapiens
cctcctcactccct

SEQ ID NO: 160442 - DNA, 14 bp, Homo sapiens
cctcctcactggcc

SEQ ID NO: 160443 - DNA, 17 bp, Homo sapiens
cctcctcactggccatc

SEQ ID NO: 160444 - DNA, 20 bp, Homo sapiens
cctcctcactggccatccct

SEQ ID NO: 160445 - DNA, 13 bp, Homo sapiens
cctcctctgccac

SEQ ID NO: 160446 - DNA, 18 bp, Homo sapiens
cctcctctgccacctccc

SEQ ID NO: 160447 - DNA, 21 bp, Homo sapiens
cctcctctgccacctccccta

SEQ ID NO: 160448 - DNA, 12 bp, Homo sapiens
cctcctctgtga

SEQ ID NO: 160449 - DNA, 22 bp, Homo sapiens
cctcctctgtgaccaatgtctt

SEQ ID NO: 160450 - DNA, 19 bp, Homo sapiens
cctcctgcccaggagagcc

SEQ ID NO: 160451 - DNA, 21 bp, Homo sapiens
cctcctgcccaggagagccag

SEQ ID NO: 160452 - DNA, 18 bp, Homo sapiens
cctccttccttgaccagc

SEQ ID NO: 160453 - DNA, 18 bp, Homo sapiens
cctcgaagcgcgccactc

SEQ ID NO: 160454 - DNA, 12 bp, Homo sapiens
cctcggagaaga

SEQ ID NO: 160455 - DNA, 23 bp, Homo sapiens
cctcggagcctcatccgaggcag

SEQ ID NO: 160456 - DNA, 17 bp, Homo sapiens
cctcggatcaccgagag

SEQ ID NO: 160457 - DNA, 19 bp, Homo sapiens
cctcggcttttctcagctg

SEQ ID NO: 160458 - DNA, 19 bp, Homo sapiens
cctcgggcgagtcactgcc

SEQ ID NO: 160459 - DNA, 22 bp, Homo sapiens
cctcgggcgagtcactgcctct

SEQ ID NO: 160460 - DNA, 14 bp, Homo sapiens
cctcggtgtggaga

SEQ ID NO: 160461 - DNA, 16 bp, Homo sapiens
cctcgtcctccccctg

SEQ ID NO: 160462 - DNA, 17 bp, Homo sapiens
cctcgtcctccccctgc

SEQ ID NO: 160463 - DNA, 19 bp, Homo sapiens
cctcgtggccttccccagc

SEQ ID NO: 160464 - DNA, 15 bp, Homo sapiens
cctcgtggtccccaa

SEQ ID NO: 160465 - DNA, 18 bp, Homo sapiens
cctctacagagcttccct

SEQ ID NO: 160466 - DNA, 20 bp, Homo sapiens
cctctacagagcttccctga

SEQ ID NO: 160467 - DNA, 21 bp, Homo sapiens
cctctacagagcttccctgac

SEQ ID NO: 160468 - DNA, 16 bp, Homo sapiens
cctctcactaaacttt

SEQ ID NO: 160469 - DNA, 13 bp, Homo sapiens
cctctccactgcc

SEQ ID NO: 160470 - DNA, 12 bp, Homo sapiens
cctctcccagga

SEQ ID NO: 160471 - DNA, 15 bp, Homo sapiens
cctctccctggccct

SEQ ID NO: 160472 - DNA, 11 bp, Homo sapiens
cctctcctgcc

SEQ ID NO: 160473 - DNA, 19 bp, Homo sapiens
cctctcggtggccagcagg

SEQ ID NO: 160474 - DNA, 12 bp, Homo sapiens
cctctctctgac

SEQ ID NO: 160475 - DNA, 14 bp, Homo sapiens
cctctgacccctcc

SEQ ID NO: 160476 - DNA, 17 bp, Homo sapiens
cctctgacccctcctca

SEQ ID NO: 160477 - DNA, 12 bp, Homo sapiens
cctctgactcag

SEQ ID NO: 160478 - DNA, 21 bp, Homo sapiens
cctctgactcagggctcctgg

SEQ ID NO: 160479 - DNA, 22 bp, Homo sapiens
cctctgacttaagctgcctcaa

SEQ ID NO: 160480 - DNA, 19 bp, Homo sapiens
cctctgagcccctgggact

SEQ ID NO: 160481 - DNA, 14 bp, Homo sapiens
cctctgatacctca

SEQ ID NO: 160482 - DNA, 11 bp, Homo sapiens
cctctgcacaa

SEQ ID NO: 160483 - DNA, 19 bp, Homo sapiens
cctctgcacaagctgcacc

SEQ ID NO: 160484 - DNA, 21 bp, Homo sapiens
cctctgcactactgacatgtg

SEQ ID NO: 160485 - DNA, 22 bp, Homo sapiens
cctctgccaaaggatgtgatat

SEQ ID NO: 160486 - DNA, 11 bp, Homo sapiens
cctctgccacc

SEQ ID NO: 160487 - DNA, 15 bp, Homo sapiens
cctctgccacctccc

SEQ ID NO: 160488 - DNA, 13 bp, Homo sapiens
cctctgcctcaat

SEQ ID NO: 160489 - DNA, 14 bp, Homo sapiens
cctctgcctcaatg

SEQ ID NO: 160490 - DNA, 19 bp, Homo sapiens
cctctgcctgaaccttcca

SEQ ID NO: 160491 - DNA, 17 bp, Homo sapiens
cctctgcctgcattctg

SEQ ID NO: 160492 - DNA, 19 bp, Homo sapiens
cctctgcctgtctccccca

SEQ ID NO: 160493 - DNA, 16 bp, Homo sapiens
cctctgcggaccccag

SEQ ID NO: 160494 - DNA, 20 bp, Homo sapiens
cctctgcggaccccagctgt

SEQ ID NO: 160495 - DNA, 13 bp, Homo sapiens
cctctggccctgc

SEQ ID NO: 160496 - DNA, 15 bp, Homo sapiens
cctctggccctgcct

SEQ ID NO: 160497 - DNA, 22 bp, Homo sapiens
cctctggctggctaactggaag

SEQ ID NO: 160498 - DNA, 23 bp, Homo sapiens
cctctggctggctaactggaagc

SEQ ID NO: 160499 - DNA, 17 bp, Homo sapiens
cctctgggtcagtggtc

SEQ ID NO: 160500 - DNA, 18 bp, Homo sapiens
cctctgtccagggccctg

SEQ ID NO: 160501 - DNA, 16 bp, Homo sapiens
cctctgtgacctcagg

SEQ ID NO: 160502 - DNA, 17 bp, Homo sapiens
cctcttaaaaaataaaa

SEQ ID NO: 160503 - DNA, 19 bp, Homo sapiens
cctcttcctccctcattcc

SEQ ID NO: 160504 - DNA, 16 bp, Homo sapiens
cctcttccttgctgtg

SEQ ID NO: 160505 - DNA, 14 bp, Homo sapiens
cctcttgagcagtg

SEQ ID NO: 160506 - DNA, 17 bp, Homo sapiens
cctcttgagcagtggct

SEQ ID NO: 160507 - DNA, 13 bp, Homo sapiens
cctctttcatcca

SEQ ID NO: 160508 - DNA, 16 bp, Homo sapiens
cctgaaaacccagaga

SEQ ID NO: 160509 - DNA, 15 bp, Homo sapiens
cctgaaagaggctga

SEQ ID NO: 160510 - DNA, 22 bp, Homo sapiens
cctgaaagaggctgaggcctgg

SEQ ID NO: 160511 - DNA, 14 bp, Homo sapiens
cctgaagaacagta

SEQ ID NO: 160512 - DNA, 15 bp, Homo sapiens
cctgaagccagcctt

SEQ ID NO: 160513 - DNA, 16 bp, Homo sapiens
cctgaagccagccttc

SEQ ID NO: 160514 - DNA, 19 bp, Homo sapiens
cctgaagtaagcaaagact

SEQ ID NO: 160515 - DNA, 18 bp, Homo sapiens
cctgacaaccactggtct

SEQ ID NO: 160516 - DNA, 19 bp, Homo sapiens
cctgaccaacatggagaaa

SEQ ID NO: 160517 - DNA, 20 bp, Homo sapiens
cctgaccacgctttctagct

SEQ ID NO: 160518 - DNA, 15 bp, Homo sapiens
cctgacccagtcccc

SEQ ID NO: 160519 - DNA, 16 bp, Homo sapiens
cctgacctccctctaa

SEQ ID NO: 160520 - DNA, 13 bp, Homo sapiens
cctgactcattct

SEQ ID NO: 160521 - DNA, 12 bp, Homo sapiens
cctgagaagaga

SEQ ID NO: 160522 - DNA, 13 bp, Homo sapiens
cctgagccaagct

SEQ ID NO: 160523 - DNA, 23 bp, Homo sapiens
cctgagccaagctagaattccct

SEQ ID NO: 160524 - DNA, 15 bp, Homo sapiens
cctgagctccccacc

SEQ ID NO: 160525 - DNA, 14 bp, Homo sapiens
cctgagtggtgcca

SEQ ID NO: 160526 - DNA, 15 bp, Homo sapiens
cctgatccagcctct

SEQ ID NO: 160527 - DNA, 19 bp, Homo sapiens
cctgcaaaaggactctcag

SEQ ID NO: 160528 - DNA, 15 bp, Homo sapiens
cctgcaaacgctgcc

SEQ ID NO: 160529 - DNA, 16 bp, Homo sapiens
cctgcaaacgctgcct

SEQ ID NO: 160530 - DNA, 21 bp, Homo sapiens
cctgcaaacgctgcctgcccg

SEQ ID NO: 160531 - DNA, 20 bp, Homo sapiens
cctgcaactcaaggactttg

SEQ ID NO: 160532 - DNA, 17 bp, Homo sapiens
cctgcaagggctcccca

SEQ ID NO: 160533 - DNA, 17 bp, Homo sapiens
cctgcaagtcagtccag

SEQ ID NO: 160534 - DNA, 20 bp, Homo sapiens
cctgcacaaagcccttccat

SEQ ID NO: 160535 - DNA, 23 bp, Homo sapiens
cctgcacaaagcccttccatgtc

SEQ ID NO: 160536 - DNA, 18 bp, Homo sapiens
cctgcacctccccccact

SEQ ID NO: 160537 - DNA, 22 bp, Homo sapiens
cctgcacctccccccactgcag

SEQ ID NO: 160538 - DNA, 15 bp, Homo sapiens
cctgcacctgtgcag

SEQ ID NO: 160539 - DNA, 19 bp, Homo sapiens
cctgcagcctcctcctgac

SEQ ID NO: 160540 - DNA, 15 bp, Homo sapiens
cctgcagcctggagg

SEQ ID NO: 160541 - DNA, 16 bp, Homo sapiens
cctgcaggacctgcct

SEQ ID NO: 160542 - DNA, 19 bp, Homo sapiens
cctgcaggacctgcctgta

SEQ ID NO: 160543 - DNA, 15 bp, Homo sapiens
cctgcaggtgctgct

SEQ ID NO: 160544 - DNA, 23 bp, Homo sapiens
cctgcatccccttggctgtgagg

SEQ ID NO: 160545 - DNA, 15 bp, Homo sapiens
cctgcattcacccag

SEQ ID NO: 160546 - DNA, 16 bp, Homo sapiens
cctgcatttctgagtt

SEQ ID NO: 160547 - DNA, 23 bp, Homo sapiens
cctgcatttgtgaaatgatggtg

SEQ ID NO: 160548 - DNA, 19 bp, Homo sapiens
cctgccagacggcacccac

SEQ ID NO: 160549 - DNA, 15 bp, Homo sapiens
cctgccaggcatggt

SEQ ID NO: 160550 - DNA, 13 bp, Homo sapiens
cctgccagggcag

SEQ ID NO: 160551 - DNA, 14 bp, Homo sapiens
cctgcccacctgtc

SEQ ID NO: 160552 - DNA, 22 bp, Homo sapiens
cctgcccaggagagccagccct

SEQ ID NO: 160553 - DNA, 23 bp, Homo sapiens
cctgcccaggagagccagccctc

SEQ ID NO: 160554 - DNA, 18 bp, Homo sapiens
cctgccccaggcctgaaa

SEQ ID NO: 160555 - DNA, 14 bp, Homo sapiens
cctgcccctccctt

SEQ ID NO: 160556 - DNA, 23 bp, Homo sapiens
cctgcccgtaaacacgcctgcaa

SEQ ID NO: 160557 - DNA, 18 bp, Homo sapiens
cctgccctagagcacact

SEQ ID NO: 160558 - DNA, 19 bp, Homo sapiens
cctgccctagagcacactg

SEQ ID NO: 160559 - DNA, 15 bp, Homo sapiens
cctgccctgccccca

SEQ ID NO: 160560 - DNA, 16 bp, Homo sapiens
cctgcccttgtcccac

SEQ ID NO: 160561 - DNA, 14 bp, Homo sapiens
cctgccgcctcaat

SEQ ID NO: 160562 - DNA, 20 bp, Homo sapiens
cctgccggtaaacacgcctg

SEQ ID NO: 160563 - DNA, 14 bp, Homo sapiens
cctgcctcagcctc

SEQ ID NO: 160564 - DNA, 16 bp, Homo sapiens
cctgcctgtagcccac

SEQ ID NO: 160565 - DNA, 13 bp, Homo sapiens
cctgcctgtctcc

SEQ ID NO: 160566 - DNA, 14 bp, Homo sapiens
cctgcctgtctcct

SEQ ID NO: 160567 - DNA, 15 bp, Homo sapiens
cctgcctgtctcctt

SEQ ID NO: 160568 - DNA, 20 bp, Homo sapiens
cctgctacaacttcagcagt

SEQ ID NO: 160569 - DNA, 16 bp, Homo sapiens
cctgctcccaggccag

SEQ ID NO: 160570 - DNA, 14 bp, Homo sapiens
cctgctcccccacc

SEQ ID NO: 160571 - DNA, 19 bp, Homo sapiens
cctgctctcctcttgccac

SEQ ID NO: 160572 - DNA, 22 bp, Homo sapiens
cctgctctcctcttgccactgc

SEQ ID NO: 160573 - DNA, 21 bp, Homo sapiens
cctgctgaaggtggggattgc

SEQ ID NO: 160574 - DNA, 20 bp, Homo sapiens
cctgctgagagacccaagga

SEQ ID NO: 160575 - DNA, 21 bp, Homo sapiens
cctgctgccgcctcccagcct

SEQ ID NO: 160576 - DNA, 12 bp, Homo sapiens
cctgctgggctc

SEQ ID NO: 160577 - DNA, 18 bp, Homo sapiens
cctgctgggctctccacc

SEQ ID NO: 160578 - DNA, 21 bp, Homo sapiens
cctgctgggctctccacctca

SEQ ID NO: 160579 - DNA, 24 bp, Homo sapiens
cctgctgggctctccacctcagcc

SEQ ID NO: 160580 - DNA, 18 bp, Homo sapiens
cctgctttgggctgccct

SEQ ID NO: 160581 - DNA, 23 bp, Homo sapiens
cctgctttgggctgccctggtgc

SEQ ID NO: 160582 - DNA, 22 bp, Homo sapiens
cctggaaatatcagttactcag

SEQ ID NO: 160583 - DNA, 18 bp, Homo sapiens
cctggaagctgtgtcctt

SEQ ID NO: 160584 - DNA, 23 bp, Homo sapiens
cctggaagctgtgtccttgcacc

SEQ ID NO: 160585 - DNA, 13 bp, Homo sapiens
cctggaccctgtg

SEQ ID NO: 160586 - DNA, 14 bp, Homo sapiens
cctggactgggagg

SEQ ID NO: 160587 - DNA, 16 bp, Homo sapiens
cctggagaactagaga

SEQ ID NO: 160588 - DNA, 21 bp, Homo sapiens
cctggatccatcaggccactt

SEQ ID NO: 160589 - DNA, 15 bp, Homo sapiens
cctggcactgctgtg

SEQ ID NO: 160590 - DNA, 13 bp, Homo sapiens
cctggcccactgc

SEQ ID NO: 160591 - DNA, 18 bp, Homo sapiens
cctggccccatgtctctc

SEQ ID NO: 160592 - DNA, 12 bp, Homo sapiens
cctggcctgctg

SEQ ID NO: 160593 - DNA, 17 bp, Homo sapiens
cctggctcccacaggcc

SEQ ID NO: 160594 - DNA, 18 bp, Homo sapiens
cctggcttgtaactccac

SEQ ID NO: 160595 - DNA, 20 bp, Homo sapiens
cctggcttgtaactccacca

SEQ ID NO: 160596 - DNA, 16 bp, Homo sapiens
cctggcttttcactgc

SEQ ID NO: 160597 - DNA, 17 bp, Homo sapiens
cctggcttttcactgct

SEQ ID NO: 160598 - DNA, 20 bp, Homo sapiens
cctggcttttcactgctggc

SEQ ID NO: 160599 - DNA, 21 bp, Homo sapiens
cctggcttttcactgctggct

SEQ ID NO: 160600 - DNA, 18 bp, Homo sapiens
cctgggaaatattcccta

SEQ ID NO: 160601 - DNA, 17 bp, Homo sapiens
cctgggactgctgcttc

SEQ ID NO: 160602 - DNA, 14 bp, Homo sapiens
ctccatactcagga

SEQ ID NO: 160603 - DNA, 16 bp, Homo sapiens
ctccatctggcagggt

SEQ ID NO: 160604 - DNA, 15 bp, Homo sapiens
ctcccacaggccctt

SEQ ID NO: 160605 - DNA, 23 bp, Homo sapiens
ctcccaccccacccccttcagtg

SEQ ID NO: 160606 - DNA, 19 bp, Homo sapiens
ctcccacccccatctctcc

SEQ ID NO: 160607 - DNA, 15 bp, Homo sapiens
ctcccacgtgggaga

SEQ ID NO: 160608 - DNA, 21 bp, Homo sapiens
ctcccacgtgggagacaagaa

SEQ ID NO: 160609 - DNA, 11 bp, Homo sapiens
ctcccagcctg

SEQ ID NO: 160610 - DNA, 21 bp, Homo sapiens
ctcccaggccaggctccttcc

SEQ ID NO: 160611 - DNA, 22 bp, Homo sapiens
ctcccaggccaggctccttcct

SEQ ID NO: 160612 - DNA, 17 bp, Homo sapiens
ctcccaggcgccccttc

SEQ ID NO: 160613 - DNA, 22 bp, Homo sapiens
ctcccagtcaccttgtggcaag

SEQ ID NO: 160614 - DNA, 17 bp, Homo sapiens
ctcccagtcatttaata

SEQ ID NO: 160615 - DNA, 20 bp, Homo sapiens
ctccccaccaccccagctgc

SEQ ID NO: 160616 - DNA, 12 bp, Homo sapiens
ctccccacgccc

SEQ ID NO: 160617 - DNA, 15 bp, Homo sapiens
ctccccacgccctcc

SEQ ID NO: 160618 - DNA, 13 bp, Homo sapiens
ctccccagcccct

SEQ ID NO: 160619 - DNA, 19 bp, Homo sapiens
ctccccagcccctagccca

SEQ ID NO: 160620 - DNA, 16 bp, Homo sapiens
ctccccagccctggct

SEQ ID NO: 160621 - DNA, 14 bp, Homo sapiens
ctccccccactgca

SEQ ID NO: 160622 - DNA, 16 bp, Homo sapiens
ctccccccactgcagg

SEQ ID NO: 160623 - DNA, 12 bp, Homo sapiens
ctcccccgccac

SEQ ID NO: 160624 - DNA, 17 bp, Homo sapiens
ctccccctgccagtgcc

SEQ ID NO: 160625 - DNA, 18 bp, Homo sapiens
ctcccctatccacccagc

SEQ ID NO: 160626 - DNA, 19 bp, Homo sapiens
ctcccctatccacccagcc

SEQ ID NO: 160627 - DNA, 21 bp, Homo sapiens
ctcccctatccacccagccca

SEQ ID NO: 160628 - DNA, 15 bp, Homo sapiens
ctcccctcacagcct

SEQ ID NO: 160629 - DNA, 13 bp, Homo sapiens
ctcccctgctgca

SEQ ID NO: 160630 - DNA, 20 bp, Homo sapiens
ctcccggctatgggggcact

SEQ ID NO: 160631 - DNA, 14 bp, Homo sapiens
ctccctaccacctc

SEQ ID NO: 160632 - DNA, 14 bp, Homo sapiens
ctccctcaacccca

SEQ ID NO: 160633 - DNA, 14 bp, Homo sapiens
ctccctcccctgcc

SEQ ID NO: 160634 - DNA, 12 bp, Homo sapiens
ctccctctcctg

SEQ ID NO: 160635 - DNA, 13 bp, Homo sapiens
ctccctctcctgc

SEQ ID NO: 160636 - DNA, 14 bp, Homo sapiens
ctccctctcctgcc

SEQ ID NO: 160637 - DNA, 17 bp, Homo sapiens
ctccctgaagccagcct

SEQ ID NO: 160638 - DNA, 20 bp, Homo sapiens
ctccctgaagtaagcaaaga

SEQ ID NO: 160639 - DNA, 20 bp, Homo sapiens
ctccctgcccctcccttcaa

SEQ ID NO: 160640 - DNA, 14 bp, Homo sapiens
ctccctgtcctcct

SEQ ID NO: 160641 - DNA, 22 bp, Homo sapiens
ctcccttcaaccattccccatg

SEQ ID NO: 160642 - DNA, 17 bp, Homo sapiens
ctcccttcccataagct

SEQ ID NO: 160643 - DNA, 13 bp, Homo sapiens
ctcccttgggctc

SEQ ID NO: 160644 - DNA, 18 bp, Homo sapiens
ctcccttgggctccctgt

SEQ ID NO: 160645 - DNA, 20 bp, Homo sapiens
ctcccttggtggcaagagcc

SEQ ID NO: 160646 - DNA, 21 bp, Homo sapiens
ctcccttggtggcaagagccc

SEQ ID NO: 160647 - DNA, 14 bp, Homo sapiens
ctccctttgaaatg

SEQ ID NO: 160648 - DNA, 16 bp, Homo sapiens
ctccgcctctgctggc

SEQ ID NO: 160649 - DNA, 13 bp, Homo sapiens
ctccggagacagg

SEQ ID NO: 160650 - DNA, 14 bp, Homo sapiens
ctccgggagagggg

SEQ ID NO: 160651 - DNA, 13 bp, Homo sapiens
ctccgtatttcag

SEQ ID NO: 160652 - DNA, 22 bp, Homo sapiens
ctccgtcttagaagtggaccag

SEQ ID NO: 160653 - DNA, 15 bp, Homo sapiens
ctcctaggaaaatac

SEQ ID NO: 160654 - DNA, 22 bp, Homo sapiens
ctcctatcagaagtttctcagc

SEQ ID NO: 160655 - DNA, 14 bp, Homo sapiens
ctcctcactggcca

SEQ ID NO: 160656 - DNA, 18 bp, Homo sapiens
ctcctcactggccatccc

SEQ ID NO: 160657 - DNA, 23 bp, Homo sapiens
ctcctccaaaggaagtctaggag

SEQ ID NO: 160658 - DNA, 22 bp, Homo sapiens
ctcctccagccgccatgctcct

SEQ ID NO: 160659 - DNA, 11 bp, Homo sapiens
ctcctccaggg

SEQ ID NO: 160660 - DNA, 19 bp, Homo sapiens
ctcctccagggccacgtgc

SEQ ID NO: 160661 - DNA, 18 bp, Homo sapiens
ctcctccatgggagaaaa

SEQ ID NO: 160662 - DNA, 16 bp, Homo sapiens
ctcctccttcccaaag

SEQ ID NO: 160663 - DNA, 20 bp, Homo sapiens
ctcctcggccccctccatcg

SEQ ID NO: 160664 - DNA, 14 bp, Homo sapiens
ctcctctcccctct

SEQ ID NO: 160665 - DNA, 12 bp, Homo sapiens
ctcctctgccac

SEQ ID NO: 160666 - DNA, 14 bp, Homo sapiens
ctcctctgtccagg

SEQ ID NO: 160667 - DNA, 19 bp, Homo sapiens
ctcctcttaaaaaataaaa

SEQ ID NO: 160668 - DNA, 23 bp, Homo sapiens
ctcctcttaaaaaataaaaactg

SEQ ID NO: 160669 - DNA, 18 bp, Homo sapiens
ctcctcttcaactgacca

SEQ ID NO: 160670 - DNA, 12 bp, Homo sapiens
ctcctcttgcca

SEQ ID NO: 160671 - DNA, 15 bp, Homo sapiens
ctcctcttgccactg

SEQ ID NO: 160672 - DNA, 16 bp, Homo sapiens
ctcctcttgccactgc

SEQ ID NO: 160673 - DNA, 16 bp, Homo sapiens
ctcctgacccagtccc

SEQ ID NO: 160674 - DNA, 20 bp, Homo sapiens
ctcctgcccaggagagccag

SEQ ID NO: 160675 - DNA, 14 bp, Homo sapiens
ctcctgcctgtagc

SEQ ID NO: 160676 - DNA, 16 bp, Homo sapiens
ctcctgccttcctcct

SEQ ID NO: 160677 - DNA, 11 bp, Homo sapiens
ctcctggaaat

SEQ ID NO: 160678 - DNA, 17 bp, Homo sapiens
ctcctggaagctgtgtc

SEQ ID NO: 160679 - DNA, 15 bp, Homo sapiens
ctcctgggccctctc

SEQ ID NO: 160680 - DNA, 18 bp, Homo sapiens
ctcctgggggttctttct

SEQ ID NO: 160681 - DNA, 23 bp, Homo sapiens
ctcctgggggttctttcttcctc

SEQ ID NO: 160682 - DNA, 21 bp, Homo sapiens
ctcctgggttttgtattctct

SEQ ID NO: 160683 - DNA, 22 bp, Homo sapiens
ctcctgggttttgtattctctg

SEQ ID NO: 160684 - DNA, 23 bp, Homo sapiens
ctcctgggttttgtattctctga

SEQ ID NO: 160685 - DNA, 14 bp, Homo sapiens
ctcctgtccaacct

SEQ ID NO: 160686 - DNA, 20 bp, Homo sapiens
ctcctgtcctcccatcccct

SEQ ID NO: 160687 - DNA, 21 bp, Homo sapiens
ctcctgtcctcccatcccctg

SEQ ID NO: 160688 - DNA, 13 bp, Homo sapiens
ctcctgtctgcca

SEQ ID NO: 160689 - DNA, 14 bp, Homo sapiens
ctcctgtctgccag

SEQ ID NO: 160690 - DNA, 16 bp, Homo sapiens
ctcctgtctgccagcc

SEQ ID NO: 160691 - DNA, 22 bp, Homo sapiens
ctcctgtctgccagccagcagc

SEQ ID NO: 160692 - DNA, 14 bp, Homo sapiens
ctccttcctgtctt

SEQ ID NO: 160693 - DNA, 21 bp, Homo sapiens
ctccttgggaggccccactgg

SEQ ID NO: 160694 - DNA, 13 bp, Homo sapiens
ctcctttcacaac

SEQ ID NO: 160695 - DNA, 17 bp, Homo sapiens
ctcctttcacaaccttc

SEQ ID NO: 160696 - DNA, 19 bp, Homo sapiens
ctcctttcaccccagggcc

SEQ ID NO: 160697 - DNA, 23 bp, Homo sapiens
ctcgagcagtcctgcctcagcct

SEQ ID NO: 160698 - DNA, 13 bp, Homo sapiens
ctcgattttgtat

SEQ ID NO: 160699 - DNA, 14 bp, Homo sapiens
ctcgattttgtatc

SEQ ID NO: 160700 - DNA, 15 bp, Homo sapiens
ctcgattttgtatct

SEQ ID NO: 160701 - DNA, 15 bp, Homo sapiens
ctcgccgtctgtgaa

SEQ ID NO: 160702 - DNA, 18 bp, Homo sapiens
ctcgctgcacaaatactc

SEQ ID NO: 160703 - DNA, 16 bp, Homo sapiens
ctcgctgccagctctg

SEQ ID NO: 160704 - DNA, 16 bp, Homo sapiens
ctcgctggactctcag

SEQ ID NO: 160705 - DNA, 16 bp, Homo sapiens
ctcgcttcccccatag

SEQ ID NO: 160706 - DNA, 19 bp, Homo sapiens
ctcgctttctatgtagttt

SEQ ID NO: 160707 - DNA, 17 bp, Homo sapiens
ctcgctttgttgcccag

SEQ ID NO: 160708 - DNA, 16 bp, Homo sapiens
ctcggagcctcatccg

SEQ ID NO: 160709 - DNA, 17 bp, Homo sapiens
ctcggccccctccatcg

SEQ ID NO: 160710 - DNA, 19 bp, Homo sapiens
ctcggcttttctcagctgg

SEQ ID NO: 160711 - DNA, 20 bp, Homo sapiens
ctcgggacacctgccctgcc

SEQ ID NO: 160712 - DNA, 14 bp, Homo sapiens
ctcggtggacccag

SEQ ID NO: 160713 - DNA, 17 bp, Homo sapiens
ctcggtgtggagaagcg

SEQ ID NO: 160714 - DNA, 20 bp, Homo sapiens
ctcgttgactggctgtgtgt

SEQ ID NO: 160715 - DNA, 23 bp, Homo sapiens
ctctaaggccgaagaagggtcct

SEQ ID NO: 160716 - DNA, 13 bp, Homo sapiens
ctctacaaaaagc

SEQ ID NO: 160717 - DNA, 20 bp, Homo sapiens
ctctacagagcttccctgac

SEQ ID NO: 160718 - DNA, 20 bp, Homo sapiens
ctctaccatcccctgtagag

SEQ ID NO: 160719 - DNA, 14 bp, Homo sapiens
ctctacccagggcc

SEQ ID NO: 160720 - DNA, 17 bp, Homo sapiens
ctctacccagggcctgc

SEQ ID NO: 160721 - DNA, 21 bp, Homo sapiens
ctctactaacaatcagctcct

SEQ ID NO: 160722 - DNA, 22 bp, Homo sapiens
ctctaggtgcccttggaggcca

SEQ ID NO: 160723 - DNA, 22 bp, Homo sapiens
ctctatatttagattgttaaaa

SEQ ID NO: 160724 - DNA, 20 bp, Homo sapiens
ctctatgaactctgttttct

SEQ ID NO: 160725 - DNA, 20 bp, Homo sapiens
ctctattaagatttccaagt

SEQ ID NO: 160726 - DNA, 12 bp, Homo sapiens
ctctatttaata

SEQ ID NO: 160727 - DNA, 15 bp, Homo sapiens
ctctatttaatattt

SEQ ID NO: 160728 - DNA, 15 bp, Homo sapiens
ctctcactaaacttt

SEQ ID NO: 160729 - DNA, 16 bp, Homo sapiens
ctctcagctcagcgcc

SEQ ID NO: 160730 - DNA, 17 bp, Homo sapiens
ctctcaggaccaaagct

SEQ ID NO: 160731 - DNA, 13 bp, Homo sapiens
ctctcagtctctg

SEQ ID NO: 160732 - DNA, 18 bp, Homo sapiens
ctctcagtctctgagcag

SEQ ID NO: 160733 - DNA, 13 bp, Homo sapiens
ctctccaacctgg

SEQ ID NO: 160734 - DNA, 14 bp, Homo sapiens
ctctccaacctgga

SEQ ID NO: 160735 - DNA, 15 bp, Homo sapiens
ctctccacctcagcc

SEQ ID NO: 160736 - DNA, 12 bp, Homo sapiens
ctctccactgcc

SEQ ID NO: 160737 - DNA, 17 bp, Homo sapiens
ctctccctcccctgcca

SEQ ID NO: 160738 - DNA, 19 bp, Homo sapiens
ctctccctctggccctgcc

SEQ ID NO: 160739 - DNA, 13 bp, Homo sapiens
ctctccctggccc

SEQ ID NO: 160740 - DNA, 15 bp, Homo sapiens
ctctcctcttgccac

SEQ ID NO: 160741 - DNA, 19 bp, Homo sapiens
ctctcgggttcaagcaatt

SEQ ID NO: 160742 - DNA, 17 bp, Homo sapiens
ctctctcctcctgccca

SEQ ID NO: 160743 - DNA, 14 bp, Homo sapiens
ctctctcctgtcca

SEQ ID NO: 160744 - DNA, 19 bp, Homo sapiens
ctctctcctgtccaaccta

SEQ ID NO: 160745 - DNA, 17 bp, Homo sapiens
ctctctgcagccagccc

SEQ ID NO: 160746 - DNA, 20 bp, Homo sapiens
ctctctgcagccagcccagc

SEQ ID NO: 160747 - DNA, 12 bp, Homo sapiens
ctctgacccctc

SEQ ID NO: 160748 - DNA, 17 bp, Homo sapiens
ctctgaccgaaacagcg

SEQ ID NO: 160749 - DNA, 22 bp, Homo sapiens
ctctgaccgaaacagcgctggg

SEQ ID NO: 160750 - DNA, 23 bp, Homo sapiens
ctctgaccgaaacagcgctgggt

SEQ ID NO: 160751 - DNA, 16 bp, Homo sapiens
ctctgactctcaaatc

SEQ ID NO: 160752 - DNA, 18 bp, Homo sapiens
ctctgactctcaaatctt

SEQ ID NO: 160753 - DNA, 16 bp, Homo sapiens
ctctgagcaaatgtgg

SEQ ID NO: 160754 - DNA, 12 bp, Homo sapiens
ctctgatccctc

SEQ ID NO: 160755 - DNA, 22 bp, Homo sapiens
ctctgcaagaattgaagcagga

SEQ ID NO: 160756 - DNA, 23 bp, Homo sapiens
ctctgcaatgggcactgggatga

SEQ ID NO: 160757 - DNA, 10 bp, Homo sapiens
ctctgcacaa

SEQ ID NO: 160758 - DNA, 13 bp, Homo sapiens
ctctgcacaagct

SEQ ID NO: 160759 - DNA, 14 bp, Homo sapiens
ctctgcacaagctg

SEQ ID NO: 160760 - DNA, 17 bp, Homo sapiens
ctctgcacaagctgcac

SEQ ID NO: 160761 - DNA, 16 bp, Homo sapiens
ctctgcactactgaca

SEQ ID NO: 160762 - DNA, 19 bp, Homo sapiens
ctctgccaaaggatgtgat

SEQ ID NO: 160763 - DNA, 14 bp, Homo sapiens
ctctgccaccagag

SEQ ID NO: 160764 - DNA, 17 bp, Homo sapiens
ctctgccaccagagacc

SEQ ID NO: 160765 - DNA, 18 bp, Homo sapiens
ctctgccacctcccctat

SEQ ID NO: 160766 - DNA, 14 bp, Homo sapiens
ctctgccagtgaca

SEQ ID NO: 160767 - DNA, 17 bp, Homo sapiens
ctctgccctgccctagc

SEQ ID NO: 160768 - DNA, 19 bp, Homo sapiens
ctctgccctgccctagctc

SEQ ID NO: 160769 - DNA, 16 bp, Homo sapiens
ctctgcctcctcttca

SEQ ID NO: 160770 - DNA, 22 bp, Homo sapiens
ctctgcctgcattctgccgtgt

SEQ ID NO: 160771 - DNA, 15 bp, Homo sapiens
ctctgctcgccttag

SEQ ID NO: 160772 - DNA, 24 bp, Homo sapiens
ctctgctttgactgagcagactgg

SEQ ID NO: 160773 - DNA, 15 bp, Homo sapiens
ctctgctttggaaat

SEQ ID NO: 160774 - DNA, 16 bp, Homo sapiens
ctctggacaaagcgtt

SEQ ID NO: 160775 - DNA, 13 bp, Homo sapiens
ctctggccccaag

SEQ ID NO: 160776 - DNA, 15 bp, Homo sapiens
ctctggccccaaggg

SEQ ID NO: 160777 - DNA, 15 bp, Homo sapiens
ctctggccctgcctt

SEQ ID NO: 160778 - DNA, 13 bp, Homo sapiens
ctctggctctcat

SEQ ID NO: 160779 - DNA, 20 bp, Homo sapiens
ctctgggtcagtggtccaca

SEQ ID NO: 160780 - DNA, 20 bp, Homo sapiens
ctctggtgacaccagccttt

SEQ ID NO: 160781 - DNA, 21 bp, Homo sapiens
ctctgtccagggccctgagct

SEQ ID NO: 160782 - DNA, 22 bp, Homo sapiens
ctctgtccagggccctgagctc

SEQ ID NO: 160783 - DNA, 22 bp, Homo sapiens
ctctgtctgagtaagaaacaga

SEQ ID NO: 160784 - DNA, 18 bp, Homo sapiens
ctctgtgaacgatttaga

SEQ ID NO: 160785 - DNA, 18 bp, Homo sapiens
ctctgtgaccaatgtctt

SEQ ID NO: 160786 - DNA, 19 bp, Homo sapiens
ctctgtgaccaatgtcttg

SEQ ID NO: 160787 - DNA, 17 bp, Homo sapiens
ctctgtgtccttccctg

SEQ ID NO: 160788 - DNA, 17 bp, Homo sapiens
ctcttaaaaaataaaaa

SEQ ID NO: 160789 - DNA, 13 bp, Homo sapiens
ctcttaaaaccca

SEQ ID NO: 160790 - DNA, 16 bp, Homo sapiens
ctcttatagaatattt

SEQ ID NO: 160791 - DNA, 20 bp, Homo sapiens
ctcttatagaatatttatta

SEQ ID NO: 160792 - DNA, 17 bp, Homo sapiens
ctcttcaactgaccagc

SEQ ID NO: 160793 - DNA, 19 bp, Homo sapiens
ctcttcatactttttttca

SEQ ID NO: 160794 - DNA, 15 bp, Homo sapiens
ctcttctagagccgt

SEQ ID NO: 160795 - DNA, 17 bp, Homo sapiens
ctcttctccactggatg

SEQ ID NO: 160796 - DNA, 19 bp, Homo sapiens
ctcttcttaacttaaattt

SEQ ID NO: 160797 - DNA, 20 bp, Homo sapiens
ctcttgaagatgctgaaaca

SEQ ID NO: 160798 - DNA, 15 bp, Homo sapiens
ctcttgagcagtggc

SEQ ID NO: 160799 - DNA, 14 bp, Homo sapiens
ctcttgcaggtctc

SEQ ID NO: 160800 - DNA, 18 bp, Homo sapiens
ctcttgcaggtctcaacc

SEQ ID NO: 160801 - DNA, 17 bp, Homo sapiens
ctcttgccactgcctct

SEQ ID NO: 160802 - DNA, 19 bp, Homo sapiens
ctcttgccactgcctcttc

SEQ ID NO: 160803 - DNA, 22 bp, Homo sapiens
ctcttgccactgcctcttcctc

SEQ ID NO: 160804 - DNA, 12 bp, Homo sapiens
ctctttcatcca

SEQ ID NO: 160805 - DNA, 13 bp, Homo sapiens
ctctttctctgcc

SEQ ID NO: 160806 - DNA, 16 bp, Homo sapiens
ctctttctctgccagt

SEQ ID NO: 160807 - DNA, 17 bp, Homo sapiens
ctctttgaatgacaaag

SEQ ID NO: 160808 - DNA, 15 bp, Homo sapiens
ctctttggcagtcta

SEQ ID NO: 160809 - DNA, 18 bp, Homo sapiens
ctgaaaaaaagtttacaa

SEQ ID NO: 160810 - DNA, 20 bp, Homo sapiens
ctgaaaaaaagtttacaagt

SEQ ID NO: 160811 - DNA, 22 bp, Homo sapiens
ctgaaaaatctaagtgatataa

SEQ ID NO: 160812 - DNA, 15 bp, Homo sapiens
ctgaaaacccagaga

SEQ ID NO: 160813 - DNA, 17 bp, Homo sapiens
ctgaaaacccagagagg

SEQ ID NO: 160814 - DNA, 18 bp, Homo sapiens
ctgaaaagactcagtgtt

SEQ ID NO: 160815 - DNA, 15 bp, Homo sapiens
ctgaaaatctaatat

SEQ ID NO: 160816 - DNA, 15 bp, Homo sapiens
ctgaaacaacaaata

SEQ ID NO: 160817 - DNA, 13 bp, Homo sapiens
ctgaaacaggaga

SEQ ID NO: 160818 - DNA, 21 bp, Homo sapiens
ctgaaagccacgttccttact

SEQ ID NO: 160819 - DNA, 15 bp, Homo sapiens
ctgaaagccctgagc

SEQ ID NO: 160820 - DNA, 13 bp, Homo sapiens
ctgaacagctgta

SEQ ID NO: 160821 - DNA, 21 bp, Homo sapiens
ctgaaccccgtcgaggggctc

SEQ ID NO: 160822 - DNA, 21 bp, Homo sapiens
ctgaacctgggtaactaggga

SEQ ID NO: 160823 - DNA, 14 bp, Homo sapiens
ctgaaccttccatc

SEQ ID NO: 160824 - DNA, 17 bp, Homo sapiens
ctgcccagcctccaagc

SEQ ID NO: 160825 - DNA, 18 bp, Homo sapiens
ctgcccaggcctgcctgt

SEQ ID NO: 160826 - DNA, 14 bp, Homo sapiens
ctgccccaactcct

SEQ ID NO: 160827 - DNA, 18 bp, Homo sapiens
ctgccccaactcctggaa

SEQ ID NO: 160828 - DNA, 20 bp, Homo sapiens
ctgccccaactcctggaagc

SEQ ID NO: 160829 - DNA, 19 bp, Homo sapiens
ctgccccagggctcccggc

SEQ ID NO: 160830 - DNA, 15 bp, Homo sapiens
ctgccccgtgcagac

SEQ ID NO: 160831 - DNA, 19 bp, Homo sapiens
ctgccccgtgcagactgga

SEQ ID NO: 160832 - DNA, 13 bp, Homo sapiens
ctgcccctccctt

SEQ ID NO: 160833 - DNA, 11 bp, Homo sapiens
ctgcccctggc

SEQ ID NO: 160834 - DNA, 13 bp, Homo sapiens
ctgcccggcaggg

SEQ ID NO: 160835 - DNA, 19 bp, Homo sapiens
ctgcccgtaaacacgcctg

SEQ ID NO: 160836 - DNA, 17 bp, Homo sapiens
ctgcccgtcttcagcct

SEQ ID NO: 160837 - DNA, 15 bp, Homo sapiens
ctgccctagagcaca

SEQ ID NO: 160838 - DNA, 16 bp, Homo sapiens
ctgccctagctccaca

SEQ ID NO: 160839 - DNA, 21 bp, Homo sapiens
ctgccctgctgccgcctccca

SEQ ID NO: 160840 - DNA, 21 bp, Homo sapiens
ctgccctgggatgtccacaga

SEQ ID NO: 160841 - DNA, 12 bp, Homo sapiens
ctgccctggtgc

SEQ ID NO: 160842 - DNA, 17 bp, Homo sapiens
ctgccctggtgctgcca

SEQ ID NO: 160843 - DNA, 19 bp, Homo sapiens
ctgccctggtgctgccaca

SEQ ID NO: 160844 - DNA, 21 bp, Homo sapiens
ctgccctggtgctgccacact

SEQ ID NO: 160845 - DNA, 23 bp, Homo sapiens
ctgccctggtgctgccacacttc

SEQ ID NO: 160846 - DNA, 15 bp, Homo sapiens
ctgcccttgtcccac

SEQ ID NO: 160847 - DNA, 23 bp, Homo sapiens
ctgcccttgtcccactcaagcca

SEQ ID NO: 160848 - DNA, 15 bp, Homo sapiens
ctgccgcaccccaga

SEQ ID NO: 160849 - DNA, 17 bp, Homo sapiens
ctgccgcaccccagagt

SEQ ID NO: 160850 - DNA, 16 bp, Homo sapiens
ctgccgcctcccagcc

SEQ ID NO: 160851 - DNA, 19 bp, Homo sapiens
ctgccgcctcccagcctgg

SEQ ID NO: 160852 - DNA, 15 bp, Homo sapiens
ctgccggccctgggg

SEQ ID NO: 160853 - DNA, 14 bp, Homo sapiens
ctgcctaagtggct

SEQ ID NO: 160854 - DNA, 16 bp, Homo sapiens
ctgcctaagtggctgc

SEQ ID NO: 160855 - DNA, 14 bp, Homo sapiens
ctgcctcctcttca

SEQ ID NO: 160856 - DNA, 16 bp, Homo sapiens
ctgcctctccctggcc

SEQ ID NO: 160857 - DNA, 18 bp, Homo sapiens
ctgcctctgcctgcattc

SEQ ID NO: 160858 - DNA, 22 bp, Homo sapiens
ctgcctcttagacttctgcttt

SEQ ID NO: 160859 - DNA, 23 bp, Homo sapiens
ctgcctcttagacttctgctttc

SEQ ID NO: 160860 - DNA, 14 bp, Homo sapiens
ctgcctcttctcta

SEQ ID NO: 160861 - DNA, 17 bp, Homo sapiens
ctgcctcttctgggagg

SEQ ID NO: 160862 - DNA, 22 bp, Homo sapiens
ctgcctcttctgggagggcagc

SEQ ID NO: 160863 - DNA, 21 bp, Homo sapiens
ctgcctgcagtactttacctc

SEQ ID NO: 160864 - DNA, 13 bp, Homo sapiens
ctgcctgcccaca

SEQ ID NO: 160865 - DNA, 16 bp, Homo sapiens
ctgcctggcccccagc

SEQ ID NO: 160866 - DNA, 15 bp, Homo sapiens
ctgcctgtagcccac

SEQ ID NO: 160867 - DNA, 22 bp, Homo sapiens
ctgcctgtagcccactctgctc

SEQ ID NO: 160868 - DNA, 16 bp, Homo sapiens
ctgcctgtagttagga

SEQ ID NO: 160869 - DNA, 22 bp, Homo sapiens
ctgcctgtagttaggaaataaa

SEQ ID NO: 160870 - DNA, 12 bp, Homo sapiens
ctgcctgtctcc

SEQ ID NO: 160871 - DNA, 13 bp, Homo sapiens
ctgcctgtctcct

SEQ ID NO: 160872 - DNA, 14 bp, Homo sapiens
ctgccttcctcctg

SEQ ID NO: 160873 - DNA, 16 bp, Homo sapiens
ctgccttcctcctggg

SEQ ID NO: 160874 - DNA, 13 bp, Homo sapiens
ctgcgcccttccc

SEQ ID NO: 160875 - DNA, 14 bp, Homo sapiens
ctgcgcccttcccc

SEQ ID NO: 160876 - DNA, 14 bp, Homo sapiens
ctgcggcatcagat

SEQ ID NO: 160877 - DNA, 21 bp, Homo sapiens
ctgctaacttggagccccagt

SEQ ID NO: 160878 - DNA, 23 bp, Homo sapiens
ctgctaacttggagccccagtgc

SEQ ID NO: 160879 - DNA, 23 bp, Homo sapiens
ctgctacaaatactcttaggaag

SEQ ID NO: 160880 - DNA, 12 bp, Homo sapiens
ctgctacctcac

SEQ ID NO: 160881 - DNA, 14 bp, Homo sapiens
ctgctacctcactg

SEQ ID NO: 160882 - DNA, 18 bp, Homo sapiens
ctgctacctcactggggt

SEQ ID NO: 160883 - DNA, 14 bp, Homo sapiens
ctgctagcacttgg

SEQ ID NO: 160884 - DNA, 17 bp, Homo sapiens
ctgctatcaaagaggtt

SEQ ID NO: 160885 - DNA, 16 bp, Homo sapiens
ctgctatcctgccaaa

SEQ ID NO: 160886 - DNA, 17 bp, Homo sapiens
ctgctcatcattctctg

SEQ ID NO: 160887 - DNA, 22 bp, Homo sapiens
ctgctcatcattctctgtctca

SEQ ID NO: 160888 - DNA, 15 bp, Homo sapiens
ctgctccagctgttc

SEQ ID NO: 160889 - DNA, 17 bp, Homo sapiens
ctgctccccagccctgg

SEQ ID NO: 160890 - DNA, 18 bp, Homo sapiens
ctgctccccagccctggc

SEQ ID NO: 160891 - DNA, 22 bp, Homo sapiens
ctgctcccccaccccctcccca

SEQ ID NO: 160892 - DNA, 23 bp, Homo sapiens
ctgctcccccaccccctccccag

SEQ ID NO: 160893 - DNA, 18 bp, Homo sapiens
ctgctccctgaagccagc

SEQ ID NO: 160894 - DNA, 21 bp, Homo sapiens
ctgctccctgaagccagcctt

SEQ ID NO: 160895 - DNA, 21 bp, Homo sapiens
ctgctctcctcttgccactgc

SEQ ID NO: 160896 - DNA, 18 bp, Homo sapiens
ctgctctttctctgccag

SEQ ID NO: 160897 - DNA, 21 bp, Homo sapiens
ctgctctttctctgccagtga

SEQ ID NO: 160898 - DNA, 13 bp, Homo sapiens
ctgctgaaacaac

SEQ ID NO: 160899 - DNA, 18 bp, Homo sapiens
ctgctgaaacaacaaata

SEQ ID NO: 160900 - DNA, 18 bp, Homo sapiens
ctgctgaaggaataaatt

SEQ ID NO: 160901 - DNA, 22 bp, Homo sapiens
ctgctgaatgatttccaaagag

SEQ ID NO: 160902 - DNA, 20 bp, Homo sapiens
agctttaaactcagggacag

SEQ ID NO: 160903 - DNA, 19 bp, Homo sapiens
agctttattttttaagtat

SEQ ID NO: 160904 - DNA, 12 bp, Homo sapiens
agctttcctgcc

SEQ ID NO: 160905 - DNA, 14 bp, Homo sapiens
agctttcctgcccc

SEQ ID NO: 160906 - DNA, 21 bp, Homo sapiens
agctttcctgccccaggcctg

SEQ ID NO: 160907 - DNA, 22 bp, Homo sapiens
agctttcctgccccaggcctga

SEQ ID NO: 160908 - DNA, 19 bp, Homo sapiens
agctttgaaaattcagtgg

SEQ ID NO: 160909 - DNA, 19 bp, Homo sapiens
agctttgtttcaaccaagt

SEQ ID NO: 160910 - DNA, 21 bp, Homo sapiens
agctttgtttgttgtcagctg

SEQ ID NO: 160911 - DNA, 17 bp, Homo sapiens
agcttttattgtataaa

SEQ ID NO: 160912 - DNA, 16 bp, Homo sapiens
agcttttcccttcttt

SEQ ID NO: 160913 - DNA, 13 bp, Homo sapiens
agctttttgtctt

SEQ ID NO: 160914 - DNA, 15 bp, Homo sapiens
aggaaaaaaatgact

SEQ ID NO: 160915 - DNA, 13 bp, Homo sapiens
aggaaaaatgtgt

SEQ ID NO: 160916 - DNA, 14 bp, Homo sapiens
aggaaaaatgtgta

SEQ ID NO: 160917 - DNA, 20 bp, Homo sapiens
aggaaaaccaagccgtggct

SEQ ID NO: 160918 - DNA, 21 bp, Homo sapiens
aggaaaaccaagccgtggctt

SEQ ID NO: 160919 - DNA, 22 bp, Homo sapiens
aggaaaaccaagccgtggcttc

SEQ ID NO: 160920 - DNA, 23 bp, Homo sapiens
aggaaaaccaagccgtggcttcc

SEQ ID NO: 160921 - DNA, 22 bp, Homo sapiens
aggaaaagtacatttaatacag

SEQ ID NO: 160922 - DNA, 13 bp, Homo sapiens
aggaaaatttcac

SEQ ID NO: 160923 - DNA, 22 bp, Homo sapiens
aggaaagatttttgttgttatt

SEQ ID NO: 160924 - DNA, 17 bp, Homo sapiens
aggaaaggccagctggc

SEQ ID NO: 160925 - DNA, 21 bp, Homo sapiens
aggaaaggccagctggcagca

SEQ ID NO: 160926 - DNA, 24 bp, Homo sapiens
aggaaaggccagctggcagcagag

SEQ ID NO: 160927 - DNA, 17 bp, Homo sapiens
aggaaataaaacctttc

SEQ ID NO: 160928 - DNA, 21 bp, Homo sapiens
aggaaataaaacctttcaaat

SEQ ID NO: 160929 - DNA, 20 bp, Homo sapiens
aggaaatcaaatatgcaaag

SEQ ID NO: 160930 - DNA, 21 bp, Homo sapiens
aggaaatcaaatatgcaaagc

SEQ ID NO: 160931 - DNA, 19 bp, Homo sapiens
aggaacccttacagtagga

SEQ ID NO: 160932 - DNA, 15 bp, Homo sapiens
aggaactgtccagag

SEQ ID NO: 160933 - DNA, 16 bp, Homo sapiens
aggaactgtccagaga

SEQ ID NO: 160934 - DNA, 18 bp, Homo sapiens
aggaactgtccagagagc

SEQ ID NO: 160935 - DNA, 19 bp, Homo sapiens
aggaactgtccagagagca

SEQ ID NO: 160936 - DNA, 14 bp, Homo sapiens
aggaagagaaaaaa

SEQ ID NO: 160937 - DNA, 19 bp, Homo sapiens
aggaagcaacgaagggaaa

SEQ ID NO: 160938 - DNA, 18 bp, Homo sapiens
aggaagcattcagagagc

SEQ ID NO: 160939 - DNA, 20 bp, Homo sapiens
aggaagctcagactggttga

SEQ ID NO: 160940 - DNA, 19 bp, Homo sapiens
aggaaggagactcacctct

SEQ ID NO: 160941 - DNA, 15 bp, Homo sapiens
aggaaggagaggaga

SEQ ID NO: 160942 - DNA, 14 bp, Homo sapiens
aggaaggatgagca

SEQ ID NO: 160943 - DNA, 13 bp, Homo sapiens
aggaagtagagga

SEQ ID NO: 160944 - DNA, 15 bp, Homo sapiens
aggaagtaggaagta

SEQ ID NO: 160945 - DNA, 18 bp, Homo sapiens
aggaagtctaggagctgg

SEQ ID NO: 160946 - DNA, 20 bp, Homo sapiens
aggaataaattgctccttga

SEQ ID NO: 160947 - DNA, 23 bp, Homo sapiens
aggaatatatggcagagttgtaa

SEQ ID NO: 160948 - DNA, 23 bp, Homo sapiens
aggaattgacccacaagaaatga

SEQ ID NO: 160949 - DNA, 17 bp, Homo sapiens
aggacaccacacccagc

SEQ ID NO: 160950 - DNA, 22 bp, Homo sapiens
aggacagcctgtggcggtgcct

SEQ ID NO: 160951 - DNA, 23 bp, Homo sapiens
aggacagcctgtggcggtgcctg

SEQ ID NO: 160952 - DNA, 12 bp, Homo sapiens
aggacaggcccg

SEQ ID NO: 160953 - DNA, 15 bp, Homo sapiens
aggacatgtttttgt

SEQ ID NO: 160954 - DNA, 16 bp, Homo sapiens
aggacatgtttttgtt

SEQ ID NO: 160955 - DNA, 14 bp, Homo sapiens
aggacatttctcta

SEQ ID NO: 160956 - DNA, 19 bp, Homo sapiens
aggaccagtcaacctgggc

SEQ ID NO: 160957 - DNA, 15 bp, Homo sapiens
aggacccagaggaag

SEQ ID NO: 160958 - DNA, 20 bp, Homo sapiens
aggacccatcacgcctgtgc

SEQ ID NO: 160959 - DNA, 21 bp, Homo sapiens
aggacccggaggggcctggca

SEQ ID NO: 160960 - DNA, 14 bp, Homo sapiens
aggacctcaggtga

SEQ ID NO: 160961 - DNA, 18 bp, Homo sapiens
aggacctctgaaaccctg

SEQ ID NO: 160962 - DNA, 14 bp, Homo sapiens
aggacctgcctgta

SEQ ID NO: 160963 - DNA, 13 bp, Homo sapiens
aggactctgcctc

SEQ ID NO: 160964 - DNA, 19 bp, Homo sapiens
aggactctgcctcctcttc

SEQ ID NO: 160965 - DNA, 13 bp, Homo sapiens
aggactgagcccc

SEQ ID NO: 160966 - DNA, 16 bp, Homo sapiens
aggactgagccccgca

SEQ ID NO: 160967 - DNA, 11 bp, Homo sapiens
aggagaaactg

SEQ ID NO: 160968 - DNA, 12 bp, Homo sapiens
aggagaaatgca

SEQ ID NO: 160969 - DNA, 16 bp, Homo sapiens
aggagaaggaaggaga

SEQ ID NO: 160970 - DNA, 13 bp, Homo sapiens
aggagactcacct

SEQ ID NO: 160971 - DNA, 21 bp, Homo sapiens
aggagagaaggggaggagggc

SEQ ID NO: 160972 - DNA, 18 bp, Homo sapiens
aggagagagaaagccagg

SEQ ID NO: 160973 - DNA, 18 bp, Homo sapiens
aggagagaggcagagagc

SEQ ID NO: 160974 - DNA, 14 bp, Homo sapiens
aggagagccagccc

SEQ ID NO: 160975 - DNA, 15 bp, Homo sapiens
aggagagccagccct

SEQ ID NO: 160976 - DNA, 12 bp, Homo sapiens
aggagaggaaag

SEQ ID NO: 160977 - DNA, 16 bp, Homo sapiens
aggagaggggcacagg

SEQ ID NO: 160978 - DNA, 18 bp, Homo sapiens
aggagaggggcacagggt

SEQ ID NO: 160979 - DNA, 19 bp, Homo sapiens
aggagattgagaaggagag

SEQ ID NO: 160980 - DNA, 15 bp, Homo sapiens
aggagccccattcct

SEQ ID NO: 160981 - DNA, 19 bp, Homo sapiens
aggagccccattcctggga

SEQ ID NO: 160982 - DNA, 23 bp, Homo sapiens
aggagcccttatctgtgctcagg

SEQ ID NO: 160983 - DNA, 22 bp, Homo sapiens
aggaggccaggccggcgagccc

SEQ ID NO: 160984 - DNA, 16 bp, Homo sapiens
aggaggctgaggcaga

SEQ ID NO: 160985 - DNA, 17 bp, Homo sapiens
aggagggcgtgactcac

SEQ ID NO: 160986 - DNA, 22 bp, Homo sapiens
aggagggcgtgactcacccaag

SEQ ID NO: 160987 - DNA, 14 bp, Homo sapiens
aggagggtcaggaa

SEQ ID NO: 160988 - DNA, 14 bp, Homo sapiens
aggagtcagagaga

SEQ ID NO: 160989 - DNA, 12 bp, Homo sapiens
aggagtccctgg

SEQ ID NO: 160990 - DNA, 19 bp, Homo sapiens
aggagttcctaaccagcct

SEQ ID NO: 160991 - DNA, 21 bp, Homo sapiens
aggagttgctgtttgtttgac

SEQ ID NO: 160992 - DNA, 12 bp, Homo sapiens
aggataaaataa

SEQ ID NO: 160993 - DNA, 18 bp, Homo sapiens
aggatactatattttagg

SEQ ID NO: 160994 - DNA, 12 bp, Homo sapiens
aggatctcttga

SEQ ID NO: 160995 - DNA, 14 bp, Homo sapiens
aggatgcccagggc

SEQ ID NO: 160996 - DNA, 16 bp, Homo sapiens
aggatgctaacatcta

SEQ ID NO: 160997 - DNA, 19 bp, Homo sapiens
aggatgtaaacagtgcctg

SEQ ID NO: 160998 - DNA, 20 bp, Homo sapiens
aggatgtaaacagtgcctgc

SEQ ID NO: 160999 - DNA, 22 bp, Homo sapiens
aggatgtaaacagtgcctgctg

SEQ ID NO: 161000 - DNA, 14 bp, Homo sapiens
aggatgtgatatat

SEQ ID NO: 161001 - DNA, 14 bp, Homo sapiens
aggatgttgaaaaa

SEQ ID NO: 161002 - DNA, 14 bp, Homo sapiens
aggattattggaaa

SEQ ID NO: 161003 - DNA, 13 bp, Homo sapiens
aggattctatgag

SEQ ID NO: 161004 - DNA, 15 bp, Homo sapiens
aggattctatgaggc

SEQ ID NO: 161005 - DNA, 18 bp, Homo sapiens
aggatttaacagtcattt

SEQ ID NO: 161006 - DNA, 21 bp, Homo sapiens
aggatttaacagtcatttaaa

SEQ ID NO: 161007 - DNA, 15 bp, Homo sapiens
aggcaactgaggcag

SEQ ID NO: 161008 - DNA, 16 bp, Homo sapiens
aggcaactgaggcaga

SEQ ID NO: 161009 - DNA, 19 bp, Homo sapiens
aggcaactgcattggcttt

SEQ ID NO: 161010 - DNA, 16 bp, Homo sapiens
aggcaacttgggaact

SEQ ID NO: 161011 - DNA, 12 bp, Homo sapiens
aggcaagagaat

SEQ ID NO: 161012 - DNA, 21 bp, Homo sapiens
aggcacctataaaacaggtca

SEQ ID NO: 161013 - DNA, 17 bp, Homo sapiens
aggcacgaacccacctg

SEQ ID NO: 161014 - DNA, 19 bp, Homo sapiens
aggcacgaacccacctgct

SEQ ID NO: 161015 - DNA, 16 bp, Homo sapiens
aggcactgctgcccag

SEQ ID NO: 161016 - DNA, 15 bp, Homo sapiens
aggcagaagaattga

SEQ ID NO: 161017 - DNA, 23 bp, Homo sapiens
aggcagaagaattgaacccagga

SEQ ID NO: 161018 - DNA, 11 bp, Homo sapiens
aggcagacacg

SEQ ID NO: 161019 - DNA, 18 bp, Homo sapiens
aggcagacacggatctga

SEQ ID NO: 161020 - DNA, 20 bp, Homo sapiens
aggcagacacggatctgaga

SEQ ID NO: 161021 - DNA, 19 bp, Homo sapiens
aggcagacagcagctcagg

SEQ ID NO: 161022 - DNA, 22 bp, Homo sapiens
aggcagcagtgtgaggccaggg

SEQ ID NO: 161023 - DNA, 12 bp, Homo sapiens
aggcagcattta

SEQ ID NO: 161024 - DNA, 13 bp, Homo sapiens
aggcagggaagtc

SEQ ID NO: 161025 - DNA, 19 bp, Homo sapiens
aggcagggaagtccccagg

SEQ ID NO: 161026 - DNA, 22 bp, Homo sapiens
aggcagggccttgcccagagat

SEQ ID NO: 161027 - DNA, 19 bp, Homo sapiens
aggcagggtcaggagaggg

SEQ ID NO: 161028 - DNA, 13 bp, Homo sapiens
aggcatggccctg

SEQ ID NO: 161029 - DNA, 19 bp, Homo sapiens
agattcatatttacttctt

SEQ ID NO: 161030 - DNA, 22 bp, Homo sapiens
agattcatatttacttcttata

SEQ ID NO: 161031 - DNA, 19 bp, Homo sapiens
agattccagagagtggctc

SEQ ID NO: 161032 - DNA, 22 bp, Homo sapiens
agattccagagagtggctcctc

SEQ ID NO: 161033 - DNA, 19 bp, Homo sapiens
agattccccattgcctcct

SEQ ID NO: 161034 - DNA, 18 bp, Homo sapiens
agattgagaaggagagaa

SEQ ID NO: 161035 - DNA, 19 bp, Homo sapiens
agattgagaaggagagaaa

SEQ ID NO: 161036 - DNA, 16 bp, Homo sapiens
agattgcaccactgca

SEQ ID NO: 161037 - DNA, 13 bp, Homo sapiens
agattgtgtaaca

SEQ ID NO: 161038 - DNA, 18 bp, Homo sapiens
agcaaaagatgcttctca

SEQ ID NO: 161039 - DNA, 15 bp, Homo sapiens
agcaaaatgtgaatg

SEQ ID NO: 161040 - DNA, 21 bp, Homo sapiens
agcaaagctgatgacaacttc

SEQ ID NO: 161041 - DNA, 23 bp, Homo sapiens
agcaaagctgatgacaacttccc

SEQ ID NO: 161042 - DNA, 19 bp, Homo sapiens
agcaaattctgtttttcta

SEQ ID NO: 161043 - DNA, 12 bp, Homo sapiens
agcaagaaagaa

SEQ ID NO: 161044 - DNA, 15 bp, Homo sapiens
agcaagaaagaaacc

SEQ ID NO: 161045 - DNA, 20 bp, Homo sapiens
agcaagggtgatgggaaagc

SEQ ID NO: 161046 - DNA, 20 bp, Homo sapiens
agcaagtgagaccctgtctc

SEQ ID NO: 161047 - DNA, 14 bp, Homo sapiens
agcacactgtagca

SEQ ID NO: 161048 - DNA, 19 bp, Homo sapiens
agcacactgtagcattaca

SEQ ID NO: 161049 - DNA, 13 bp, Homo sapiens
agcacagaaggag

SEQ ID NO: 161050 - DNA, 16 bp, Homo sapiens
agcacagaaggaggag

SEQ ID NO: 161051 - DNA, 12 bp, Homo sapiens
agcacagagagg

SEQ ID NO: 161052 - DNA, 23 bp, Homo sapiens
agcacagagagggggccacctcc

SEQ ID NO: 161053 - DNA, 16 bp, Homo sapiens
agcacctgccgacctc

SEQ ID NO: 161054 - DNA, 13 bp, Homo sapiens
agaaaccctgtct

SEQ ID NO: 161055 - DNA, 17 bp, Homo sapiens
agaaaccttaatatgtg

SEQ ID NO: 161056 - DNA, 20 bp, Homo sapiens
agaaaccttattgtacctct

SEQ ID NO: 161057 - DNA, 15 bp, Homo sapiens
agaaactgcagggaa

SEQ ID NO: 161058 - DNA, 15 bp, Homo sapiens
agaaactggaactct

SEQ ID NO: 161059 - DNA, 23 bp, Homo sapiens
agaaacttaaggttacctttgtt

SEQ ID NO: 161060 - DNA, 14 bp, Homo sapiens
agaaacttccaaat

SEQ ID NO: 161061 - DNA, 16 bp, Homo sapiens
agaaagaaaatgaaga

SEQ ID NO: 161062 - DNA, 23 bp, Homo sapiens
agaaagactattcaaacagtctc

SEQ ID NO: 161063 - DNA, 18 bp, Homo sapiens
agaaagcagaacagtgat

SEQ ID NO: 161064 - DNA, 14 bp, Homo sapiens
agaaagcaggggct

SEQ ID NO: 161065 - DNA, 20 bp, Homo sapiens
agaaagcaggggctacaaga

SEQ ID NO: 161066 - DNA, 16 bp, Homo sapiens
agaaagcattacattt

SEQ ID NO: 161067 - DNA, 15 bp, Homo sapiens
agaaagccaggcagg

SEQ ID NO: 161068 - DNA, 15 bp, Homo sapiens
agaaagcctcagaga

SEQ ID NO: 161069 - DNA, 21 bp, Homo sapiens
agaaagtcgaattaatagctt

SEQ ID NO: 161070 - DNA, 19 bp, Homo sapiens
agaaagtcttatttattca

SEQ ID NO: 161071 - DNA, 22 bp, Homo sapiens
agaaagtcttatttattcatat

SEQ ID NO: 161072 - DNA, 19 bp, Homo sapiens
agaaagtggaaaacaagga

SEQ ID NO: 161073 - DNA, 23 bp, Homo sapiens
agaaagtggaaaacaaggaagtc

SEQ ID NO: 161074 - DNA, 21 bp, Homo sapiens
agaaagtgggtgagatgctgg

SEQ ID NO: 161075 - DNA, 20 bp, Homo sapiens
agaaatagcctgcgctgttt

SEQ ID NO: 161076 - DNA, 14 bp, Homo sapiens
agaaatataattga

SEQ ID NO: 161077 - DNA, 16 bp, Homo sapiens
agaaatatgattttat

SEQ ID NO: 161078 - DNA, 14 bp, Homo sapiens
agaaatatgtggtt

SEQ ID NO: 161079 - DNA, 18 bp, Homo sapiens
agaaatcagtaatattta

SEQ ID NO: 161080 - DNA, 16 bp, Homo sapiens
agaaattatttaataa

SEQ ID NO: 161081 - DNA, 17 bp, Homo sapiens
agaaattatttaataaa

SEQ ID NO: 161082 - DNA, 10 bp, Homo sapiens
agaacaaaaa

SEQ ID NO: 161083 - DNA, 19 bp, Homo sapiens
agaacaaaaaaatctgcag

SEQ ID NO: 161084 - DNA, 20 bp, Homo sapiens
agaacaaaaaaatctgcaga

SEQ ID NO: 161085 - DNA, 21 bp, Homo sapiens
agaacaaaaaaatctgcagaa

SEQ ID NO: 161086 - DNA, 18 bp, Homo sapiens
agaacagcagaggttctt

SEQ ID NO: 161087 - DNA, 16 bp, Homo sapiens
agaacaggcaagtgaa

SEQ ID NO: 161088 - DNA, 22 bp, Homo sapiens
agaaccatccctattttgtatt

SEQ ID NO: 161089 - DNA, 18 bp, Homo sapiens
acccatcagaaggagaag

SEQ ID NO: 161090 - DNA, 19 bp, Homo sapiens
acccatcagaaggagaagg

SEQ ID NO: 161091 - DNA, 15 bp, Homo sapiens
accccaaagctttcc

SEQ ID NO: 161092 - DNA, 18 bp, Homo sapiens
accccaaagctttcctgc

SEQ ID NO: 161093 - DNA, 17 bp, Homo sapiens
accccaaggagggagat

SEQ ID NO: 161094 - DNA, 22 bp, Homo sapiens
accccaccacgatgtggccctg

SEQ ID NO: 161095 - DNA, 17 bp, Homo sapiens
accccagctgtgagcct

SEQ ID NO: 161096 - DNA, 22 bp, Homo sapiens
accccagctgtgagccttggct

SEQ ID NO: 161097 - DNA, 13 bp, Homo sapiens
accccagggcctg

SEQ ID NO: 161098 - DNA, 14 bp, Homo sapiens
accccagggcctga

SEQ ID NO: 161099 - DNA, 19 bp, Homo sapiens
accccatagtgaccggctg

SEQ ID NO: 161100 - DNA, 18 bp, Homo sapiens
accccatctctacaaaaa

SEQ ID NO: 161101 - DNA, 16 bp, Homo sapiens
aaaccaagccgtggct

SEQ ID NO: 161102 - DNA, 15 bp, Homo sapiens
aaaccacagcagttg

SEQ ID NO: 161103 - DNA, 23 bp, Homo sapiens
aaaccatgaagagatttttcatg

SEQ ID NO: 161104 - DNA, 13 bp, Homo sapiens
aaaccccatctct

SEQ ID NO: 161105 - DNA, 19 bp, Homo sapiens
aaacccgacagagggaaga

SEQ ID NO: 161106 - DNA, 15 bp, Homo sapiens
aaaccgccaaggctg

SEQ ID NO: 161107 - DNA, 17 bp, Homo sapiens
aaacctcaaaatgtcta

SEQ ID NO: 161108 - DNA, 17 bp, Homo sapiens
aaaccttattgtacctc

SEQ ID NO: 161109 - DNA, 18 bp, Homo sapiens
aaaccttattgtacctct

SEQ ID NO: 161110 - DNA, 20 bp, Homo sapiens
aaaccttttggaaaatctgc

SEQ ID NO: 161111 - DNA, 14 bp, Homo sapiens
aaacgctgcctgcc

SEQ ID NO: 161112 - DNA, 13 bp, Homo sapiens
aaactaaatctct

SEQ ID NO: 161113 - DNA, 11 bp, Homo sapiens
aaactatcagt

SEQ ID NO: 161114 - DNA, 20 bp, Homo sapiens
aaactatttgtctttcagga

SEQ ID NO: 161115 - DNA, 19 bp, Homo sapiens
aaactcaaaacttaacata

SEQ ID NO: 161116 - DNA, 19 bp, Homo sapiens
aaactcagggacagagcca

SEQ ID NO: 161117 - DNA, 21 bp, Homo sapiens
aaactctaaacattaatcaat

SEQ ID NO: 161118 - DNA, 14 bp, Homo sapiens
aaactctgggaaat

SEQ ID NO: 161119 - DNA, 22 bp, Homo sapiens
aaactctgggaaataagagaga

SEQ ID NO: 161120 - DNA, 12 bp, Homo sapiens
aaactcttaaaa

SEQ ID NO: 161121 - DNA, 23 bp, Homo sapiens
aaactgagactcagacaggaaag

SEQ ID NO: 161122 - DNA, 21 bp, Homo sapiens
aaactgagatgtgaacacatc

SEQ ID NO: 161123 - DNA, 15 bp, Homo sapiens
aaactgcactgtcaa

SEQ ID NO: 161124 - DNA, 16 bp, Homo sapiens
aaactggggcctccct

SEQ ID NO: 161125 - DNA, 15 bp, Homo sapiens
aaactgtagtctcag

SEQ ID NO: 161126 - DNA, 12 bp, Homo sapiens
aaactgtccctt

SEQ ID NO: 161127 - DNA, 21 bp, Homo sapiens
aaacttccctttctgcttgtg

SEQ ID NO: 161128 - DNA, 22 bp, Homo sapiens
aaacttgatgtgttatctctta

SEQ ID NO: 161129 - DNA, 11 bp, Homo sapiens
aaacttgtaaa

SEQ ID NO: 161130 - DNA, 19 bp, Homo sapiens
aaactttatgctaagtgaa

SEQ ID NO: 161131 - DNA, 17 bp, Homo sapiens
aaagaaaatatgcatct

SEQ ID NO: 161132 - DNA, 18 bp, Homo sapiens
aaagaaaattcttggaat

SEQ ID NO: 161133 - DNA, 23 bp, Homo sapiens
aaagaaacccgacagagggaaga

SEQ ID NO: 161134 - DNA, 18 bp, Homo sapiens
aaagaaagcctcagagaa

SEQ ID NO: 161135 - DNA, 16 bp, Homo sapiens
aaagaacaaaaaaatc

SEQ ID NO: 161136 - DNA, 17 bp, Homo sapiens
aaagaatacagaaagat

SEQ ID NO: 161137 - DNA, 13 bp, Homo sapiens
aaagacagaagcc

SEQ ID NO: 161138 - DNA, 14 bp, Homo sapiens
aaagacatcaagca

SEQ ID NO: 161139 - DNA, 15 bp, Homo sapiens
aaagacatgaatatg

SEQ ID NO: 161140 - DNA, 22 bp, Homo sapiens
aaagacctttggagcaaagctg

SEQ ID NO: 161141 - DNA, 12 bp, Homo sapiens
tgtccacctggc

SEQ ID NO: 161142 - DNA, 18 bp, Homo sapiens
tgtccacgactgtctcca

SEQ ID NO: 161143 - DNA, 13 bp, Homo sapiens
tgtccagggccct

SEQ ID NO: 161144 - DNA, 12 bp, Homo sapiens
tgtccatgtgtg

SEQ ID NO: 161145 - DNA, 20 bp, Homo sapiens
tgtcccactcaagccaagca

SEQ ID NO: 161146 - DNA, 17 bp, Homo sapiens
tgtcccatggacactcc

SEQ ID NO: 161147 - DNA, 18 bp, Homo sapiens
tgtcccctccactgtcac

SEQ ID NO: 161148 - DNA, 12 bp, Homo sapiens
tgtccctacacc

SEQ ID NO: 161149 - DNA, 19 bp, Homo sapiens
tgtccctacacccctcccc

SEQ ID NO: 161150 - DNA, 14 bp, Homo sapiens
tgtccctaggtcag

SEQ ID NO: 161151 - DNA, 18 bp, Homo sapiens
tgtccctcccacctctgt

SEQ ID NO: 161152 - DNA, 12 bp, Homo sapiens
tgtccctccggg

SEQ ID NO: 161153 - DNA, 13 bp, Homo sapiens
tgtccctgtcacc

SEQ ID NO: 161154 - DNA, 20 bp, Homo sapiens
tgtcccttctgtccctcaca

SEQ ID NO: 161155 - DNA, 20 bp, Homo sapiens
tgtcctcacggtgccttttt

SEQ ID NO: 161156 - DNA, 22 bp, Homo sapiens
tgtcctcacggtgccttttttc

SEQ ID NO: 161157 - DNA, 13 bp, Homo sapiens
tgtcctcccatcc

SEQ ID NO: 161158 - DNA, 21 bp, Homo sapiens
tgtcctcctcggatcaccgag

SEQ ID NO: 161159 - DNA, 14 bp, Homo sapiens
tgtccttccctgca

SEQ ID NO: 161160 - DNA, 21 bp, Homo sapiens
tgtccttctctcacctcctaa

SEQ ID NO: 161161 - DNA, 13 bp, Homo sapiens
tgtccttgcacct

SEQ ID NO: 161162 - DNA, 23 bp, Homo sapiens
ctgctgaatgatttccaaagaga

SEQ ID NO: 161163 - DNA, 21 bp, Homo sapiens
ctgctgcaggggctctggaga

SEQ ID NO: 161164 - DNA, 15 bp, Homo sapiens
ctgctgcccagcctc

SEQ ID NO: 161165 - DNA, 22 bp, Homo sapiens
ctgctgcccagcctccaagctc

SEQ ID NO: 161166 - DNA, 14 bp, Homo sapiens
ctgctgccgcctcc

SEQ ID NO: 161167 - DNA, 17 bp, Homo sapiens
ctgctgccgcctcccag

SEQ ID NO: 161168 - DNA, 20 bp, Homo sapiens
ctgctgccgcctcccagcct

SEQ ID NO: 161169 - DNA, 15 bp, Homo sapiens
ctgctgctgctgctg

SEQ ID NO: 161170 - DNA, 21 bp, Homo sapiens
ctgctggcacatttccccaga

SEQ ID NO: 161171 - DNA, 14 bp, Homo sapiens
ctgctgggctctcc

SEQ ID NO: 161172 - DNA, 16 bp, Homo sapiens
ctgctgggctctccac

SEQ ID NO: 161173 - DNA, 18 bp, Homo sapiens
ctgctgggctctccacct

SEQ ID NO: 161174 - DNA, 19 bp, Homo sapiens
ctgctgggctctccacctc

SEQ ID NO: 161175 - DNA, 22 bp, Homo sapiens
ctgctgggctctccacctcagc

SEQ ID NO: 161176 - DNA, 23 bp, Homo sapiens
ctgctgggctctccacctcagcc

SEQ ID NO: 161177 - DNA, 13 bp, Homo sapiens
ctgcttgaggcaa

SEQ ID NO: 161178 - DNA, 21 bp, Homo sapiens
ctgcttgaggcaactcatctt

SEQ ID NO: 161179 - DNA, 22 bp, Homo sapiens
ctgcttgaggcaactcatctta

SEQ ID NO: 161180 - DNA, 20 bp, Homo sapiens
ctgctttgactgagcagact

SEQ ID NO: 161181 - DNA, 13 bp, Homo sapiens
ctgctttggaaat

SEQ ID NO: 161182 - DNA, 15 bp, Homo sapiens
ctgcttttccctaag

SEQ ID NO: 161183 - DNA, 18 bp, Homo sapiens
ctgcttttccctaagcca

SEQ ID NO: 161184 - DNA, 23 bp, Homo sapiens
ctggaaatatcagttactcagcc

SEQ ID NO: 161185 - DNA, 16 bp, Homo sapiens
ctggaagctgtgtcct

SEQ ID NO: 161186 - DNA, 17 bp, Homo sapiens
ctggaaggggcccgtgg

SEQ ID NO: 161187 - DNA, 20 bp, Homo sapiens
ctggaatgtaatcaatgttt

SEQ ID NO: 161188 - DNA, 18 bp, Homo sapiens
ctggacggggactgggga

SEQ ID NO: 161189 - DNA, 17 bp, Homo sapiens
ctggactcctctgtcca

SEQ ID NO: 161190 - DNA, 20 bp, Homo sapiens
ctggactcctctgtccaggc

SEQ ID NO: 161191 - DNA, 18 bp, Homo sapiens
ctggactctcagtctctg

SEQ ID NO: 161192 - DNA, 20 bp, Homo sapiens
ctggactctcagtctctgag

SEQ ID NO: 161193 - DNA, 20 bp, Homo sapiens
ctggactgccttgaatatcc

SEQ ID NO: 161194 - DNA, 16 bp, Homo sapiens
ctggactgggaggtag

SEQ ID NO: 161195 - DNA, 16 bp, Homo sapiens
ctggagaagagaggag

SEQ ID NO: 161196 - DNA, 19 bp, Homo sapiens
ctggagaagagaggagagg

SEQ ID NO: 161197 - DNA, 14 bp, Homo sapiens
ctggagaagcagtg

SEQ ID NO: 161198 - DNA, 13 bp, Homo sapiens
ctggagacagccc

SEQ ID NO: 161199 - DNA, 14 bp, Homo sapiens
ctggagacagcccc

SEQ ID NO: 161200 - DNA, 17 bp, Homo sapiens
ctggagacagccccaga

SEQ ID NO: 161201 - DNA, 15 bp, Homo sapiens
ctggagcaccaggca

SEQ ID NO: 161202 - DNA, 13 bp, Homo sapiens
ctggagcccaggg

SEQ ID NO: 161203 - DNA, 16 bp, Homo sapiens
ctggagctctgcccat

SEQ ID NO: 161204 - DNA, 19 bp, Homo sapiens
ctggaggaaaactgagact

SEQ ID NO: 161205 - DNA, 14 bp, Homo sapiens
ctggaggcagggcc

SEQ ID NO: 161206 - DNA, 15 bp, Homo sapiens
ctggaggcagggcct

SEQ ID NO: 161207 - DNA, 20 bp, Homo sapiens
ctggaggcagggccttgccc

SEQ ID NO: 161208 - DNA, 22 bp, Homo sapiens
ctggaggcagggccttgcccag

SEQ ID NO: 161209 - DNA, 22 bp, Homo sapiens
ctggaggggcatggccagcagc

SEQ ID NO: 161210 - DNA, 23 bp, Homo sapiens
ctggaggggcatggccagcagct

SEQ ID NO: 161211 - DNA, 19 bp, Homo sapiens
ctggaggtgggagcaggag

SEQ ID NO: 161212 - DNA, 21 bp, Homo sapiens
ctggaggtgggagcaggagat

SEQ ID NO: 161213 - DNA, 15 bp, Homo sapiens
ctggataacttaggt

SEQ ID NO: 161214 - DNA, 19 bp, Homo sapiens
ctggatccatcaggccact

SEQ ID NO: 161215 - DNA, 13 bp, Homo sapiens
ctggatgaagatt

SEQ ID NO: 161216 - DNA, 16 bp, Homo sapiens
ctggatgctccttcca

SEQ ID NO: 161217 - DNA, 21 bp, Homo sapiens
ctggatggaggaaaaccaagc

SEQ ID NO: 161218 - DNA, 22 bp, Homo sapiens
ctggattgatcggagcctcctc

SEQ ID NO: 161219 - DNA, 17 bp, Homo sapiens
ctggcacagggcagtgg

SEQ ID NO: 161220 - DNA, 21 bp, Homo sapiens
ctggcacagttttctgagaaa

SEQ ID NO: 161221 - DNA, 22 bp, Homo sapiens
ctggcacagttttctgagaaag

SEQ ID NO: 161222 - DNA, 23 bp, Homo sapiens
ctggcagaaagcaaatgtgacct

SEQ ID NO: 161223 - DNA, 18 bp, Homo sapiens
ctggcagggtgggatgga

SEQ ID NO: 161224 - DNA, 16 bp, Homo sapiens
ctggccaacggggtga

SEQ ID NO: 161225 - DNA, 12 bp, Homo sapiens
ctggcccactgc

SEQ ID NO: 161226 - DNA, 23 bp, Homo sapiens
ctggcccagccaaaccctgtctg

SEQ ID NO: 161227 - DNA, 17 bp, Homo sapiens
tgtttctgttcaccttc

SEQ ID NO: 161228 - DNA, 21 bp, Homo sapiens
tgtttcttttgtatgtaaatg

SEQ ID NO: 161229 - DNA, 21 bp, Homo sapiens
tgtttgacaaagaaacccaag

SEQ ID NO: 161230 - DNA, 23 bp, Homo sapiens
tgtttgagctcagacccccactc

SEQ ID NO: 161231 - DNA, 16 bp, Homo sapiens
tgtttgtctcatccca

SEQ ID NO: 161232 - DNA, 17 bp, Homo sapiens
tgtttgttgtcagctga

SEQ ID NO: 161233 - DNA, 22 bp, Homo sapiens
tgttttaaatttatttcaaaaa

SEQ ID NO: 161234 - DNA, 23 bp, Homo sapiens
tgttttatcatgacatgttatat

SEQ ID NO: 161235 - DNA, 15 bp, Homo sapiens
tgttttcataataaa

SEQ ID NO: 161236 - DNA, 15 bp, Homo sapiens
tgttttctcttgaga

SEQ ID NO: 161237 - DNA, 17 bp, Homo sapiens
tgtttttaagctgtttc

SEQ ID NO: 161238 - DNA, 12 bp, Homo sapiens
tgtttttctggg

SEQ ID NO: 161239 - DNA, 16 bp, Homo sapiens
tgttttttgaaaacat

SEQ ID NO: 161240 - DNA, 18 bp, Homo sapiens
tgttttttttttccactt

SEQ ID NO: 161241 - DNA, 18 bp, Homo sapiens
ttaaaaaaaacaaaaaga

SEQ ID NO: 161242 - DNA, 13 bp, Homo sapiens
ttaaaaaaaatcc

SEQ ID NO: 161243 - DNA, 12 bp, Homo sapiens
ttaaaagacaag

SEQ ID NO: 161244 - DNA, 17 bp, Homo sapiens
ttaaaagacaagacttc

SEQ ID NO: 161245 - DNA, 19 bp, Homo sapiens
ttaaaatattcctgcattt

SEQ ID NO: 161246 - DNA, 14 bp, Homo sapiens
ttaaaatcatttct

SEQ ID NO: 161247 - DNA, 22 bp, Homo sapiens
ttaaaatcatttctgcatcagc

SEQ ID NO: 161248 - DNA, 12 bp, Homo sapiens
ttaaaatcctca

SEQ ID NO: 161249 - DNA, 11 bp, Homo sapiens
ttaaaatctta

SEQ ID NO: 161250 - DNA, 14 bp, Homo sapiens
ttaaaatcttaaac

SEQ ID NO: 161251 - DNA, 16 bp, Homo sapiens
ttaaaatgattgtaaa

SEQ ID NO: 161252 - DNA, 13 bp, Homo sapiens
ttaaactcaggga

SEQ ID NO: 161253 - DNA, 22 bp, Homo sapiens
ttaaactcagggacagagccat

SEQ ID NO: 161254 - DNA, 17 bp, Homo sapiens
ttaaagctgcctgtagt

SEQ ID NO: 161255 - DNA, 20 bp, Homo sapiens
ttaaagcttattaaaactca

SEQ ID NO: 161256 - DNA, 13 bp, Homo sapiens
ttaaagtatatat

SEQ ID NO: 161257 - DNA, 18 bp, Homo sapiens
ttaaagtatgttattgca

SEQ ID NO: 161258 - DNA, 13 bp, Homo sapiens
ttaaataaatcat

SEQ ID NO: 161259 - DNA, 19 bp, Homo sapiens
ttaaatagagtatatgcac

SEQ ID NO: 161260 - DNA, 23 bp, Homo sapiens
ttaaatgagaaggaatttgagtt

SEQ ID NO: 161261 - DNA, 15 bp, Homo sapiens
ttaaattttaattta

SEQ ID NO: 161262 - DNA, 14 bp, Homo sapiens
ttaacagagacaga

SEQ ID NO: 161263 - DNA, 12 bp, Homo sapiens
ttaaccaaaggt

SEQ ID NO: 161264 - DNA, 17 bp, Homo sapiens
ttaaccacttcagctga

SEQ ID NO: 161265 - DNA, 13 bp, Homo sapiens
ttaaccagaataa

SEQ ID NO: 161266 - DNA, 12 bp, Homo sapiens
ttaactagaatt

SEQ ID NO: 161267 - DNA, 14 bp, Homo sapiens
ttaactagaattta

SEQ ID NO: 161268 - DNA, 21 bp, Homo sapiens
ttaactagaatttattcaatt

SEQ ID NO: 161269 - DNA, 22 bp, Homo sapiens
ttaacttaaattttaatttatt

SEQ ID NO: 161270 - DNA, 21 bp, Homo sapiens
ttaagaaaaaataacacacat

SEQ ID NO: 161271 - DNA, 22 bp, Homo sapiens
ttaagcactacataaactgact

SEQ ID NO: 161272 - DNA, 21 bp, Homo sapiens
ttaagcctcatatttaaagac

SEQ ID NO: 161273 - DNA, 17 bp, Homo sapiens
ttaagctgttactgtct

SEQ ID NO: 161274 - DNA, 20 bp, Homo sapiens
ttaaggattgtgatattttt

SEQ ID NO: 161275 - DNA, 21 bp, Homo sapiens
ttaagtgttgtaaatatttat

SEQ ID NO: 161276 - DNA, 11 bp, Homo sapiens
ttaataaaaag

SEQ ID NO: 161277 - DNA, 14 bp, Homo sapiens
ttaataaaaaggca

SEQ ID NO: 161278 - DNA, 22 bp, Homo sapiens
ttaatagcttttattgtataaa

SEQ ID NO: 161279 - DNA, 20 bp, Homo sapiens
ttaatatatcccagaaatta

SEQ ID NO: 161280 - DNA, 16 bp, Homo sapiens
ttaatatttaaacagc

SEQ ID NO: 161281 - DNA, 17 bp, Homo sapiens
ttaatatttaaacagca

SEQ ID NO: 161282 - DNA, 22 bp, Homo sapiens
ttaatatttaaacagcagtgtt

SEQ ID NO: 161283 - DNA, 20 bp, Homo sapiens
ttaatatttgctgacagctg

SEQ ID NO: 161284 - DNA, 16 bp, Homo sapiens
ttaatcagacaaagta

SEQ ID NO: 161285 - DNA, 14 bp, Homo sapiens
ttaatgaagaaagt

SEQ ID NO: 161286 - DNA, 16 bp, Homo sapiens
ttaatgataagtaaat

SEQ ID NO: 161287 - DNA, 17 bp, Homo sapiens
ttaatgataagtaaatg

SEQ ID NO: 161288 - DNA, 13 bp, Homo sapiens
ttaatgtgtatta

SEQ ID NO: 161289 - DNA, 15 bp, Homo sapiens
ttaatgtttattcct

SEQ ID NO: 161290 - DNA, 14 bp, Homo sapiens
ttaattattattct

SEQ ID NO: 161291 - DNA, 13 bp, Homo sapiens
ttaatttttccta

SEQ ID NO: 161292 - DNA, 23 bp, Homo sapiens
ttacaataaaatcttgaaaatgc

SEQ ID NO: 161293 - DNA, 18 bp, Homo sapiens
ttacaattccctgctgtc

SEQ ID NO: 161294 - DNA, 13 bp, Homo sapiens
ttacaatttacaa

SEQ ID NO: 161295 - DNA, 18 bp, Homo sapiens
ttacaatttacaaagtgt

SEQ ID NO: 161296 - DNA, 21 bp, Homo sapiens
ttacacaaaacaaatgccaca

SEQ ID NO: 161297 - DNA, 21 bp, Homo sapiens
ttacaccagcctcgtcttcat

SEQ ID NO: 161298 - DNA, 16 bp, Homo sapiens
ttacagaggaagttat

SEQ ID NO: 161299 - DNA, 17 bp, Homo sapiens
ttacagtaggagcccag

SEQ ID NO: 161300 - DNA, 13 bp, Homo sapiens
ttacatccttaaa

SEQ ID NO: 161301 - DNA, 21 bp, Homo sapiens
ttacatctgttttaaatttat

SEQ ID NO: 161302 - DNA, 23 bp, Homo sapiens
ttacatgcaatttattaaaatga

SEQ ID NO: 161303 - DNA, 13 bp, Homo sapiens
ttacattctgaat

SEQ ID NO: 161304 - DNA, 12 bp, Homo sapiens
ttacattgtaaa

SEQ ID NO: 161305 - DNA, 16 bp, Homo sapiens
ttacatttttacaata

SEQ ID NO: 161306 - DNA, 14 bp, Homo sapiens
ttaccaactttctg

SEQ ID NO: 161307 - DNA, 18 bp, Homo sapiens
ttaccaactttctgtaaa

SEQ ID NO: 161308 - DNA, 20 bp, Homo sapiens
ttaccagcctccgtatttca

SEQ ID NO: 161309 - DNA, 23 bp, Homo sapiens
ttaccagcctccgtatttcagac

SEQ ID NO: 161310 - DNA, 20 bp, Homo sapiens
ttacctagtagtcatttcat

SEQ ID NO: 161311 - DNA, 11 bp, Homo sapiens
ttacctcctga

SEQ ID NO: 161312 - DNA, 14 bp, Homo sapiens
ttacctcctgccca

SEQ ID NO: 161313 - DNA, 15 bp, Homo sapiens
ttacctcctgcccag

SEQ ID NO: 161314 - DNA, 19 bp, Homo sapiens
ttacctcctgcccaggaga

SEQ ID NO: 161315 - DNA, 22 bp, Homo sapiens
ttacctgaaaacactgtgcaca

SEQ ID NO: 161316 - DNA, 15 bp, Homo sapiens
ttactaactaaactc

SEQ ID NO: 161317 - DNA, 18 bp, Homo sapiens
ttactacatgtgggagct

SEQ ID NO: 161318 - DNA, 13 bp, Homo sapiens
ttactatgcctgt

SEQ ID NO: 161319 - DNA, 14 bp, Homo sapiens
ttactatgcctgtg

SEQ ID NO: 161320 - DNA, 12 bp, Homo sapiens
ttactcagccct

SEQ ID NO: 161321 - DNA, 16 bp, Homo sapiens
ttactgagcttctctg

SEQ ID NO: 161322 - DNA, 13 bp, Homo sapiens
ttactgcaaatgt

SEQ ID NO: 161323 - DNA, 18 bp, Homo sapiens
ttactgcaaatgtcatca

SEQ ID NO: 161324 - DNA, 22 bp, Homo sapiens
ttactgtctggttttaacaatt

SEQ ID NO: 161325 - DNA, 23 bp, Homo sapiens
ttactgtctggttttaacaattt

SEQ ID NO: 161326 - DNA, 18 bp, Homo sapiens
ttactgttagtcatttgc

SEQ ID NO: 161327 - DNA, 23 bp, Homo sapiens
ttacttcttatacatttgataaa

SEQ ID NO: 161328 - DNA, 16 bp, Homo sapiens
ttagaaacataaataa

SEQ ID NO: 161329 - DNA, 22 bp, Homo sapiens
ttagaaagaagcccaatattat

SEQ ID NO: 161330 - DNA, 11 bp, Homo sapiens
ttagaaatata

SEQ ID NO: 161331 - DNA, 12 bp, Homo sapiens
ttagaaatataa

SEQ ID NO: 161332 - DNA, 14 bp, Homo sapiens
ttagaaatataatt

SEQ ID NO: 161333 - DNA, 18 bp, Homo sapiens
ttagaacaggcaagtgaa

SEQ ID NO: 161334 - DNA, 21 bp, Homo sapiens
ttagaatcagccttgaaacat

SEQ ID NO: 161335 - DNA, 21 bp, Homo sapiens
ttagagaagtatacataagtt

SEQ ID NO: 161336 - DNA, 18 bp, Homo sapiens
ttagaggaaaaaaatgac

SEQ ID NO: 161337 - DNA, 22 bp, Homo sapiens
ttagatgttctaagtctttcca

SEQ ID NO: 161338 - DNA, 15 bp, Homo sapiens
ttagcaaatacatat

SEQ ID NO: 161339 - DNA, 18 bp, Homo sapiens
ttagcaaattctgttttt

SEQ ID NO: 161340 - DNA, 14 bp, Homo sapiens
ttagccccataatt

SEQ ID NO: 161341 - DNA, 16 bp, Homo sapiens
ttagcttagacctcag

SEQ ID NO: 161342 - DNA, 21 bp, Homo sapiens
ttagcttagacctcagcctgt

SEQ ID NO: 161343 - DNA, 17 bp, Homo sapiens
ttaggaaataaaacctt

SEQ ID NO: 161344 - DNA, 15 bp, Homo sapiens
ttaggaagagaaacc

SEQ ID NO: 161345 - DNA, 18 bp, Homo sapiens
ttaggatgttgaaaaagt

SEQ ID NO: 161346 - DNA, 21 bp, Homo sapiens
ttaggatttaacagtcattta

SEQ ID NO: 161347 - DNA, 22 bp, Homo sapiens
ttaggatttaacagtcatttaa

SEQ ID NO: 161348 - DNA, 14 bp, Homo sapiens
ttagggaagggcct

SEQ ID NO: 161349 - DNA, 15 bp, Homo sapiens
ttaggggaactgggt

SEQ ID NO: 161350 - DNA, 13 bp, Homo sapiens
ttagtatttgcat

SEQ ID NO: 161351 - DNA, 15 bp, Homo sapiens
ttagtctgcaaaatg

SEQ ID NO: 161352 - DNA, 21 bp, Homo sapiens
ttagtgtttgggtatattcat

SEQ ID NO: 161353 - DNA, 18 bp, Homo sapiens
ttcccctccttctccctt

SEQ ID NO: 161354 - DNA, 17 bp, Homo sapiens
ttcccctgttcactcta

SEQ ID NO: 161355 - DNA, 14 bp, Homo sapiens
ttccccttccactg

SEQ ID NO: 161356 - DNA, 15 bp, Homo sapiens
ttccccttccactga

SEQ ID NO: 161357 - DNA, 14 bp, Homo sapiens
ttcccgctcagccc

SEQ ID NO: 161358 - DNA, 22 bp, Homo sapiens
ttcccgctcagccctccctgcc

SEQ ID NO: 161359 - DNA, 15 bp, Homo sapiens
ttccctaagccaagg

SEQ ID NO: 161360 - DNA, 13 bp, Homo sapiens
ttccctacttcct

SEQ ID NO: 161361 - DNA, 15 bp, Homo sapiens
ttccctattagagaa

SEQ ID NO: 161362 - DNA, 14 bp, Homo sapiens
ttccctctccctgt

SEQ ID NO: 161363 - DNA, 17 bp, Homo sapiens
ttccctgaaaacccaga

SEQ ID NO: 161364 - DNA, 15 bp, Homo sapiens
ttccctgaatgtatt

SEQ ID NO: 161365 - DNA, 16 bp, Homo sapiens
ttccctgagtcaccag

SEQ ID NO: 161366 - DNA, 19 bp, Homo sapiens
ttccctgagtcaccaggaa

SEQ ID NO: 161367 - DNA, 21 bp, Homo sapiens
ttccggaatcctgtcctcagc

SEQ ID NO: 161368 - DNA, 13 bp, Homo sapiens
ttcctaagtgatt

SEQ ID NO: 161369 - DNA, 17 bp, Homo sapiens
ttcctacagatagtcaa

SEQ ID NO: 161370 - DNA, 12 bp, Homo sapiens
ttcctagtgaaa

SEQ ID NO: 161371 - DNA, 19 bp, Homo sapiens
ttcctatatagtttattga

SEQ ID NO: 161372 - DNA, 13 bp, Homo sapiens
ttcctcattagca

SEQ ID NO: 161373 - DNA, 15 bp, Homo sapiens
ttcctgaaatgcagt

SEQ ID NO: 161374 - DNA, 19 bp, Homo sapiens
ttcctgataataattgatc

SEQ ID NO: 161375 - DNA, 14 bp, Homo sapiens
ttcctgcagcctgg

SEQ ID NO: 161376 - DNA, 17 bp, Homo sapiens
ttcctgccaggcatggt

SEQ ID NO: 161377 - DNA, 16 bp, Homo sapiens
ttcctgcctgtctcct

SEQ ID NO: 161378 - DNA, 21 bp, Homo sapiens
ttcctgggaaatattccctag

SEQ ID NO: 161379 - DNA, 14 bp, Homo sapiens
ttcctggtctgtag

SEQ ID NO: 161380 - DNA, 19 bp, Homo sapiens
ttgccatattttcaccatt

SEQ ID NO: 161381 - DNA, 19 bp, Homo sapiens
ttgcccagagatgcctcca

SEQ ID NO: 161382 - DNA, 18 bp, Homo sapiens
ttgcccaggctggtctca

SEQ ID NO: 161383 - DNA, 14 bp, Homo sapiens
ttgcccatccatct

SEQ ID NO: 161384 - DNA, 13 bp, Homo sapiens
ttgccctgttaaa

SEQ ID NO: 161385 - DNA, 14 bp, Homo sapiens
ttgcccttcacagt

SEQ ID NO: 161386 - DNA, 17 bp, Homo sapiens
ttgcctactatgccaga

SEQ ID NO: 161387 - DNA, 15 bp, Homo sapiens
ttgctcacctggggt

SEQ ID NO: 161388 - DNA, 19 bp, Homo sapiens
ttgctcttaagttgtggag

SEQ ID NO: 161389 - DNA, 21 bp, Homo sapiens
ttgctgcctgaagaacagtaa

SEQ ID NO: 161390 - DNA, 14 bp, Homo sapiens
ttgctgcttgaggc

SEQ ID NO: 161391 - DNA, 18 bp, Homo sapiens
ttgctgcttttccttggg

SEQ ID NO: 161392 - DNA, 21 bp, Homo sapiens
ttgctggacggggactgggga

SEQ ID NO: 161393 - DNA, 16 bp, Homo sapiens
ttgctggcaaagacag

SEQ ID NO: 161394 - DNA, 21 bp, Homo sapiens
ttgctgtcataagaatgaata

SEQ ID NO: 161395 - DNA, 19 bp, Homo sapiens
ttgctgtgaggctgtcctg

SEQ ID NO: 161396 - DNA, 13 bp, Homo sapiens
ttgcttacatttt

SEQ ID NO: 161397 - DNA, 18 bp, Homo sapiens
ttgcttacatttttacaa

SEQ ID NO: 161398 - DNA, 15 bp, Homo sapiens
ttgcttgaaagaaaa

SEQ ID NO: 161399 - DNA, 22 bp, Homo sapiens
ttgcttgaaagaaaatatgcat

SEQ ID NO: 161400 - DNA, 19 bp, Homo sapiens
ttggaaaagaatacagaaa

SEQ ID NO: 161401 - DNA, 22 bp, Homo sapiens
ttggaaaagaatacagaaagat

SEQ ID NO: 161402 - DNA, 12 bp, Homo sapiens
ttggaaaataaa

SEQ ID NO: 161403 - DNA, 23 bp, Homo sapiens
ttggaatattgtccattgtccaa

SEQ ID NO: 161404 - DNA, 23 bp, Homo sapiens
ttggacaatcatgaaatatgcat

SEQ ID NO: 161405 - DNA, 16 bp, Homo sapiens
ttggacccttccatgg

SEQ ID NO: 161406 - DNA, 13 bp, Homo sapiens
ttggactattata

SEQ ID NO: 161407 - DNA, 18 bp, Homo sapiens
ttggagagtaaaaactga

SEQ ID NO: 161408 - DNA, 15 bp, Homo sapiens
ttggaggccagccag

SEQ ID NO: 161409 - DNA, 18 bp, Homo sapiens
ttggattattcatttaaa

SEQ ID NO: 161410 - DNA, 20 bp, Homo sapiens
ttggattattcatttaaaat

SEQ ID NO: 161411 - DNA, 17 bp, Homo sapiens
ttggcaatgccatcatc

SEQ ID NO: 161412 - DNA, 15 bp, Homo sapiens
ttggcacagaaacac

SEQ ID NO: 161413 - DNA, 16 bp, Homo sapiens
ttggcacagaaacaca

SEQ ID NO: 161414 - DNA, 23 bp, Homo sapiens
ttggcacagaaacacaatatttt

SEQ ID NO: 161415 - DNA, 20 bp, Homo sapiens
ttggcagtgagtgagcctgg

SEQ ID NO: 161416 - DNA, 13 bp, Homo sapiens
ttggctctggaga

SEQ ID NO: 161417 - DNA, 17 bp, Homo sapiens
ttggctctggagacagc

SEQ ID NO: 161418 - DNA, 19 bp, Homo sapiens
ttggctctggagacagccc

SEQ ID NO: 161419 - DNA, 23 bp, Homo sapiens
ttggctctggagacagccccaga

SEQ ID NO: 161420 - DNA, 23 bp, Homo sapiens
ttggctggatgaaattttctaga

SEQ ID NO: 161421 - DNA, 21 bp, Homo sapiens
ttggctgtagaaggagacaga

SEQ ID NO: 161422 - DNA, 21 bp, Homo sapiens
ttggctgtgtctaaactgcat

SEQ ID NO: 161423 - DNA, 23 bp, Homo sapiens
ttggcttcacggaagagccttgc

SEQ ID NO: 161424 - DNA, 14 bp, Homo sapiens
ttgggaatgtttgt

SEQ ID NO: 161425 - DNA, 19 bp, Homo sapiens
ttgggtgtaacaggtctcc

SEQ ID NO: 161426 - DNA, 19 bp, Homo sapiens
ttggtaacatcctttctat

SEQ ID NO: 161427 - DNA, 21 bp, Homo sapiens
ttggtaacatcctttctattg

SEQ ID NO: 161428 - DNA, 19 bp, Homo sapiens
ttggttctaatagaactca

SEQ ID NO: 161429 - DNA, 18 bp, Homo sapiens
ttggtttgcagatgacaa

SEQ ID NO: 161430 - DNA, 22 bp, Homo sapiens
ttgtaaaaattaaaagttatgg

SEQ ID NO: 161431 - DNA, 18 bp, Homo sapiens
ttgtaaaatatagctgta

SEQ ID NO: 161432 - DNA, 20 bp, Homo sapiens
ttgtaaaatatagctgtaca

SEQ ID NO: 161433 - DNA, 13 bp, Homo sapiens
ttgtaaatattta

SEQ ID NO: 161434 - DNA, 18 bp, Homo sapiens
ttgtaaatgtgcttttaa

SEQ ID NO: 161435 - DNA, 14 bp, Homo sapiens
ttgtaactccacca

SEQ ID NO: 161436 - DNA, 14 bp, Homo sapiens
ttgtaattctaaat

SEQ ID NO: 161437 - DNA, 18 bp, Homo sapiens
ttgtaattgcttacattt

SEQ ID NO: 161438 - DNA, 19 bp, Homo sapiens
ttgtaattgcttacatttt

SEQ ID NO: 161439 - DNA, 16 bp, Homo sapiens
ttgtacagctgtttaa

SEQ ID NO: 161440 - DNA, 18 bp, Homo sapiens
ttgtacatatgtaaaata

SEQ ID NO: 161441 - DNA, 16 bp, Homo sapiens
ttgtaccgcaatgtga

SEQ ID NO: 161442 - DNA, 11 bp, Homo sapiens
ttgtacctctc

SEQ ID NO: 161443 - DNA, 17 bp, Homo sapiens
ttgtaggggtcaaagaa

SEQ ID NO: 161444 - DNA, 19 bp, Homo sapiens
ttgtatatatctgcttcag

SEQ ID NO: 161445 - DNA, 18 bp, Homo sapiens
ttgtatattatggaagat

SEQ ID NO: 161446 - DNA, 21 bp, Homo sapiens
ttgtatattatggaagatttt

SEQ ID NO: 161447 - DNA, 16 bp, Homo sapiens
ttgtatattgtcagat

SEQ ID NO: 161448 - DNA, 14 bp, Homo sapiens
ttgtatctcttttg

SEQ ID NO: 161449 - DNA, 16 bp, Homo sapiens
ttgtatgtaaatgtgc

SEQ ID NO: 161450 - DNA, 18 bp, Homo sapiens
ttgtatgtaaatgtgcat

SEQ ID NO: 161451 - DNA, 20 bp, Homo sapiens
ttgtattctctgagctgtgc

SEQ ID NO: 161452 - DNA, 15 bp, Homo sapiens
ttgtattgtttcaat

SEQ ID NO: 161453 - DNA, 20 bp, Homo sapiens
ttgtatttttttgcaagtga

SEQ ID NO: 161454 - DNA, 13 bp, Homo sapiens
ttgtcaaagagag

SEQ ID NO: 161455 - DNA, 19 bp, Homo sapiens
ttgtcatctttcttctatt

SEQ ID NO: 161456 - DNA, 13 bp, Homo sapiens
ttgtccattgtcc

SEQ ID NO: 161457 - DNA, 11 bp, Homo sapiens
ttgtctaaaat

SEQ ID NO: 161458 - DNA, 17 bp, Homo sapiens
ttgtctgaagtcactgc

SEQ ID NO: 161459 - DNA, 15 bp, Homo sapiens
ttgtcttaaaaagtg

SEQ ID NO: 161460 - DNA, 13 bp, Homo sapiens
ttgtctttcagga

SEQ ID NO: 161461 - DNA, 14 bp, Homo sapiens
ttgtgaaatgatgg

SEQ ID NO: 161462 - DNA, 15 bp, Homo sapiens
ttgtggctgtcagca

SEQ ID NO: 161463 - DNA, 21 bp, Homo sapiens
ttgtgtaatagaaaactgaaa

SEQ ID NO: 161464 - DNA, 16 bp, Homo sapiens
ttgtgtgttatttaaa

SEQ ID NO: 161465 - DNA, 13 bp, Homo sapiens
ttgtgttgtgaat

SEQ ID NO: 161466 - DNA, 14 bp, Homo sapiens
ttgttatttataac

SEQ ID NO: 161467 - DNA, 22 bp, Homo sapiens
ttgttattttgcaacctcgctg

SEQ ID NO: 161468 - DNA, 19 bp, Homo sapiens
ttgttgcaagtactgctgt

SEQ ID NO: 161469 - DNA, 16 bp, Homo sapiens
ttgtttcaattgcatc

SEQ ID NO: 161470 - DNA, 14 bp, Homo sapiens
ttgttttgttttaa

SEQ ID NO: 161471 - DNA, 18 bp, Homo sapiens
ttgttttttttttccact

SEQ ID NO: 161472 - DNA, 19 bp, Homo sapiens
tttaaaatacacactcaaa

SEQ ID NO: 161473 - DNA, 12 bp, Homo sapiens
tttaaaatgatt

SEQ ID NO: 161474 - DNA, 14 bp, Homo sapiens
tttaaaatgattag

SEQ ID NO: 161475 - DNA, 13 bp, Homo sapiens
tttaaacagcagt

SEQ ID NO: 161476 - DNA, 20 bp, Homo sapiens
tttaaatacgcactacatgt

SEQ ID NO: 161477 - DNA, 16 bp, Homo sapiens
tttaaatgtaaaacat

SEQ ID NO: 161478 - DNA, 21 bp, Homo sapiens
tttaaattcacaatagaaact

SEQ ID NO: 161479 - DNA, 23 bp, Homo sapiens
tttaacaactatgatttggaaaa

SEQ ID NO: 161480 - DNA, 16 bp, Homo sapiens
tttaacagtcatttaa

SEQ ID NO: 161481 - DNA, 17 bp, Homo sapiens
tttaacagtcatttaaa

SEQ ID NO: 161482 - DNA, 15 bp, Homo sapiens
tttaactagaattta

SEQ ID NO: 161483 - DNA, 18 bp, Homo sapiens
tttaagaaaaaataacac

SEQ ID NO: 161484 - DNA, 18 bp, Homo sapiens
tttaagctgtttccatag

SEQ ID NO: 161485 - DNA, 17 bp, Homo sapiens
tttaagggtttgtggaa

SEQ ID NO: 161486 - DNA, 21 bp, Homo sapiens
tttaagtattgcatctgtata

SEQ ID NO: 161487 - DNA, 20 bp, Homo sapiens
tttaataaaaaggcacctat

SEQ ID NO: 161488 - DNA, 13 bp, Homo sapiens
tttaataaaccat

SEQ ID NO: 161489 - DNA, 14 bp, Homo sapiens
tttaatacagcagt

SEQ ID NO: 161490 - DNA, 15 bp, Homo sapiens
tttaatataaagcct

SEQ ID NO: 161491 - DNA, 18 bp, Homo sapiens
tttaatatttaaacagca

SEQ ID NO: 161492 - DNA, 14 bp, Homo sapiens
tttaattattattc

SEQ ID NO: 161493 - DNA, 23 bp, Homo sapiens
tttaattattattcttcataaca

SEQ ID NO: 161494 - DNA, 14 bp, Homo sapiens
tttaattgattatt

SEQ ID NO: 161495 - DNA, 16 bp, Homo sapiens
tttaatttatgagttt

SEQ ID NO: 161496 - DNA, 15 bp, Homo sapiens
tttacaagtgtatat

SEQ ID NO: 161497 - DNA, 16 bp, Homo sapiens
tttacaataaataatc

SEQ ID NO: 161498 - DNA, 13 bp, Homo sapiens
tttattgtataaa

SEQ ID NO: 161499 - DNA, 19 bp, Homo sapiens
tttatttagttccttgagt

SEQ ID NO: 161500 - DNA, 15 bp, Homo sapiens
tttatttatactatt

SEQ ID NO: 161501 - DNA, 18 bp, Homo sapiens
tttcaaaaccttttgaaa

SEQ ID NO: 161502 - DNA, 14 bp, Homo sapiens
tttcaaatttcaca

SEQ ID NO: 161503 - DNA, 16 bp, Homo sapiens
tttcaacgcagccctg

SEQ ID NO: 161504 - DNA, 18 bp, Homo sapiens
tttcaattgcatctccca
